United States Patent 9,283,287 (MODIFIED POLYNUCLEOTIDES FOR THE PRODUCTION OF NUCLEAR PROTEINS) - sequence listing, part 13

SEQ ID NO: 23272 - DNA, 7076 bp, Artificial Sequence
  Description of Artificial Sequence: Synthetic coding sequence
atgcagggtccctattctctaaacggctaccgggtccgggtctaccgccaggacagcgccacacagtggttcactggcatcatcacccaccatgacctgtttactaggaccatgattgtgatgaatgaccaggtgctggagcctcaaaacgtggatccgagcatggttcagatgacgtttctggacgatgtagtgcatagcctgctgaagggggaaaatatcggaattaccagccgcagaaggtccagggcgaatcagaatgtgaatgcggtgcatagccattacacaagagcccaagctaactccccaagaccagccatgaattcccaggcagcggtacctaagcagaacacacaccagcagcagcagcagcggtccatacgcccaaacaagcgcaaggggtccgactcctcaattccagacgaagaaaagatgaaggaggaaaaatacgactacattagtcgcggagagaacccaaaaggaaagaacaagcatctgatgaacaaaagacgcaagcctgaagaagatgagaaaaagctgaacatgaaaaggctacgcacagataacgtgtcagatttcagtgaatcctcggactccgagaactctaacaagagaatcattgacaactcgagtgagcagaagcccgagaacgaactgaaaaataagaatacaagtaagatcaatggcgaggaagggaagcctcacaacaacgaaaaagcaggcgaggagacactgaagaatagccagccaccttgggaccagattcaggaggataaaaaacatgaggaagctgaaaagaggaagtcggtggatacacagcttcaagaggatatgattatacactcctctgaacagagcacagtgtccgatcataattctaatgatcttttgccacaagagtgtaacatggacaaaacccatacaatggagttgttgccgaaagagaagtttgtcagccgaccgccaactccaaaatgtgtaatcgacatcacaaatgatacaaatctcgaaaaagtggctcaagagaactcatctaccttcggcttgcagaccctgcaaaagatggatcctaatgtatccgattcaaagcactcgatagccaatgcaaagtttctcgagaccgctaaaaaagatagcgatcagagctgggtgtcggacgttgttaaagtggatttaactcaaagctcggtgaccaatgcttcctcaggaaatgaccaccttaatatggaaaaggagaagtatgtgagctacatttcaccactaagcgccgtctcagtgatggaggacaagctccacaaacggtctcctcctccagagacaattaaatcaaagctgaataccagcgtagatactcacaaaattaagtcctccccctccccagaggttgtcaagccaaaaatcactcattctcccgattctgttaaaagcaaggccacgtacgtaaacagccaagccacaggcgagagaaggttagctaacaaaattgaacacgaactgagccggtgctcattccacccaattcctactagatcttcaacattggaaacaacaaagtctcccctcattatagataagaacgagcattttaccgtgtatagggatcccgcattaattgggtcagaaacgggtgctaatcacatcagcccttttctgtcgcagcatccttttcccctacactcgtcctcgcatcgcacctgtctaaacccaggaactcatcacccggcacttacgccggctcctcacctattggccggtagctcaagccagactcccctgcccaccattaacacacatccactcacttctggcccacatcacgcagtccatcacccccatctactacctactgtcttacccggtgtgccaaccgcctccctgttgggcggtcatccacgccttgaaagtgctcacgctagcagtctatctcatctagccctcgctcatcaacagcaacagcagctgctgcaacatcaatccccccatctgctcggtcaggctcatccaagtgccagttataaccagctgggtctgtacccaatcatctggcagtaccctaacggaacccacgcttacagcggccttgggctgccctcttcaaagtgggtacatccagagaacgcagttaatgcggaagctagtctgcgcagaaacagtccctccccatggctgcaccagccaactcctgtgacaagcgccgatgggatcggcctcctttcacacatccctgtgaggccctcctcagcagaaccccacaggcctctaaagataacagcacactcttcacccccactgaccaagaccctagtggaccaccataaagaggagctggagcggaaggcttttatggagcccctgaggagcgtggcttccaccagcgccaagaacgatcttgatcttaacagatctcagacaggtaaagactgccaccttcacagacactttgtcgatccagtcctgaaccagctgcagcggccacctcaggaaacaggtgaaaggttgaataaatacaaggaagaacacaggaggattctgcaggagtcaatcgatgttgctccatttacaaccaagataaaaggacttgagggggaacgggaaaactattctagagtggcctcatccagctcatcacctaaaagtcacattataaagcaggacatggacgtggagcgatccgtctcagatctctataagatgaaacactcagtgcctcagagcttacctcagagcaattacttcacaaccttatccaatagcgtggtgaacgaacctcctaggtcctatccttccaaggaagtaagtaatatttacggagacaaacagagcaacgcattagctgccgctgccgctaacccacaaactctgacctcttttatcacaagtctatcaaagccccctccattgattaaacaccaacctgagagtgaggggctggttggcaagataccggagcacctcccacaccaaatagctagccacagcgtgacaacctttaggaacgattgccgctctccaacccatcttaccgtgtcctctacaaatacgctcagatctatgcccgctctccacagggccccagtgttccaccctcctatccaccattcacttgaacgtaaggagggatcctactcgagtctgagccccccaacgctgacaccagtgatgcccgtgaatgcaggaggcaaggtccaggagtcacagaagccgccaactcttattcccgagcctaaagactcccaggccaatttcaagagcagctcagagcagtccctgacggagatgtggcggcctaataacaatctctctaaggagaaaacagaatggcacgtggagaagtcgtccggaaagttgcaagcagctatggcctctgtcatcgttcgaccatcaagcagtaccaagactgatagtatgccagcgatgcagttggcgtcaaaagatcgcgtgagcgagcgctctagtgctggagcgcacaaaactgactgtttgaagctcgcggaagcaggagagaccggaaggatcattttaccgaacgtcaactcagattcagtacatacaaagtctgaaaagaatttccaagccgtcagccagggttcagtgccatcaagtgtcatgagcgccgtcaacaccatgtgcaacactaagaccgacgtcatcacatcggcggctgacacaaccagtgttagtagctggggaggttcggaagttatcagcagcttatccaacacaatcctagcctcgacctcttctgaatgcgtgagttcaaagtcagtcagtcaacctgtggcccagaaacaggaatgcaaagtcagcacaaccgcaccagtcacactggcctcctcaaagacagggtcagtggtccagccctcaagtggcttctcgggcacgacagactttattcatctgaaaaaacacaaagcagctctggctgcggctcagtacaagagttcaaacgccagcgagaccgaaccaaatgccataaaaaatcagaccttatctgcctctctacccctggactccactgtgatctgcagtaccattaataaagccaattccgttggcaacggccaggccagtcagacctctcagcctaattatcacacgaaactaaaaaaagcttggctaacacgccactccgaggaagataagaacacaaataagatggagaattcgggcaattccgtgtctgagatcatcaagccatgttccgtcaaccttatcgctagcaccagctccgatattcaaaatagtgtcgatagcaagattatagtagacaaatacgtgaaggacgacaaggtcaaccggagaaaagcaaagcgtacatatgaatctggtagtgaaagcggagactcggatgagagcgagtccaagtctgaacagcgtactaagcgacagcccaaaccaacctacaaaaagaaacagaatgacctgcaaaagaggaaaggcgagatcgaggaagatttaaaacccaacggcgtacttagtagatccgctaaggagagatccaagctgaaactacagtccaactctaatactggaatccccaggagtgttctgaaggactggagaaaagtgaagaagctgaaacaaactggggaatcattccttcaggacgattcatgctgtgaaatcggtcctaacctccagaagtgccgggaatgcaggctaattcgctctaaaaagggagaagaacccgcacattcccccgtcttctgtaggttttattacttccgacggctcagtttttctaaaaatggcgtcgtacggatcgacggcttttcctcacctgaccagtatgatgatgaggccatgtcgctgtggacacacgagaacttcgaggacgatgagctggatatcgagaccagcaaatacatcctcgatattatcggcgataagttctgccagctggtaacctccgagaagaccgctctaagctgggtgaaaaaagatgcaaagatcgcttggaagagagccgtccgcggagtacgcgaaatgtgcgacgcttgcgaggccacactcttcaacattcactgggtgtgtcagaaatgtggattcgtggtgtgcttggactgttacaaggcaaaggaacgtaagtctagtcgggacaaagaactgtacgcttggatgaagtgtgttaagggacagccacacgaccacaagcatttgatgcccacccaaatcatcccaggaagtgtcttaaccgacttgctggatgctatgcatacgcttcgcgaaaaatatggtataaagtcacattgccactgtactaataagcagaaccttcaagttggcaatttccctacaatgaatggcgtgtcacaggtgttacagaacgtcctcaaccacagtaacaagataagtttgtgtatgccagaatcacagcaacaaaacacaccccctaaaagtgaaaaaaacggtgggtcttctccagaatcggacgtgggaactgataacaaactgacaccaccagaaagccagtccccgctgcactggctggccgacctggctgagcagaaggctcgcgaagagaaaaaggagaacaaagagctcacgttggaaaatcagattaaggaggaacgcgaacaggacaattccgagtccccaaacgggagaaccagtcccctcgtcagccaaaacaacgagcagggttctacacttcgagatttgctcaccacgacagctgggaagctgcgtgtgggctcaacagatgccggaatcgcattcgcacctgtgtattctatgggagctccgtccagtaaaagtggaaggaccatgcccaacattctcgatgacatcatcgcaagtgtcgtcgaaaataagataccaccctccaagacgtcgaaaattaacgtcaaaccagaattgaaggaggagcccgaagagagtatcatcagcgcagtcgacgagaacaacaagttatattcagatatacctcattcctggatctgtgagaaacacatattatggctgaaagactataagaattcaagtaactggaagttgtttaaggagtgttggaagcaggggcagccagcagtggtgagtggggtccataaaaagatgaatatctctctgtggaaagcagaatctatcagccttgacttcggcgaccatcaggcagatctgctgaactgcaaggattccatcatttctaacgccaacgtgaaggagttttgggatgggtttgaggaggtcagcaaacgccagaagaataagtctggagaaacggtggtattgaagctgaaagattggccatcaggagaagattttaagaccatgatgccagcacggtacgaagacctcctgaagagtctgccactgccggagtactgcaatcccgaaggtaagttcaatctggctagccatcttcctggcttcttcgtgagaccagacttaggaccgagattgtgcagcgcttacggcgtagtcgcagctaaggaccatgacataggaaccactaacctgcacatcgaggtgtccgacgtggtaaatatcctcgtgtatgtggggatcgccaagggaaatggcattctatctaaagcaggtatcctgaaaaaattcgaagaagaagatctggatgacatactgaggaaacgccttaaagatagtagtgaaattcctggcgctctgtggcacatatacgctggcaaggatgtggacaagattcgcgagttcttgcagaagatcagtaaagagcagggcttggaagtcctgcccgaacacgacccaataagagaccagtcttggtacgtaaataagaagttgagacagcggcttttagaagagtacggcgtgagaacgtgcactctcatccaattcctaggcgatgcgattgtcctgccagccggtgctctgcaccaggtgcagaattttcacagttgcattcaagtgactgaggacttcgtgtcccccgagcacctagtcgagagtttccatctgacccaggagctgagactattaaaagaggaaattaactacgacgacaaactgcaggtcaaaaatattctctaccatgctgtaaaggagatggtgagggcactcaaaattcacgaggatgaggtggaggatatggaggagaacta

SEQ ID NO: 23273 - DNA, 3741 bp, Artificial Sequence
  Description of Artificial Sequence: Synthetic coding sequence
atgtcgaaagagcgccctaagagaaacatcatccaaaaaaaatacgatgattctgacgggatcccttggagcgaggagcgggtggttaggaaagtgctttacctgtccctgaaagaattcaagaattcacagaaaaggcaacacgcagaggggatcgccggatcgctcaagacagtgaacggcctgctgggtaatgaccagtctaagggcctgggcccagcatcagagcagtctgaaaacgaaaaggatgacgccagccaggtttcatccacatccaacgatgtgagtagcagcgattttgaagaggggcctagccgaaaaaggccaagactgcaagcccagcggaaatttgcccagagccagcccaattccccttccacaacacccgtaaaaattgtcgagcctctgctgcctccgcctgcaacccagatcagcgacctctctaagaggaagcccaaaaccgaggacttcctgacattcctgtgcctccgaggcagtcccgctctgcctaactcgatggtttattttgggagctcacaggacgaggaggaggtggaggaggaagatgatgagacagaagacgtaaaaacagccacaaacaatgcctccagttcctgccagagcacaccacgaaagggaaaaactcataagcacgtgcacaatggccacgtgttcaacggttcttctcggtcaacaagagagaaagagcccgtccagaagcataagtctaaggaggccaccccagctaaagaaaagcattccgatcatagggcagactctcggcgtgagcaggcctccgccaaccatccggctgccgctccgtccactggtagctctgcgaagggattggccgcaacacatcaccacccccctctgcacaggagcgctcaagatcttcgaaagcaggtttccaaggtaaacggcgtgacacgcatgtcttccctgggggcaggcgttacgtcggcaaagaaaatgagagaagtccggccatcaccgagcaaaactgtgaagtacacagcaaccgtgaccaagggagctgttacatacaccaaggccaagcgcgaattggtcaaggacacaaaaccgaatcaccacaagccaagcagcgccgtgaaccacaccatcagcgggaaaacagaaagtagtaatgcgaaaacccggaagcaagtactaagccttgggggagcaagtaagtcaacagggccagctgtgaacggtcttaaagtgtccggccgattaaatcccaagtcatgcaccaaggaggtgggtgggagacagctccgggagggcctacagctcagggagggcctcaggaattctaagcggcgtcttgaagaggcacatcaggctgaaaaacctcagtctcccccaaagaagatgaaaggcgctgcgggacccgctgagggaccaggcaaaaaggctccggcagagcggggactactgaacggacacgtgaagaaagaggtgcccgagcgaagtctggagcgcaatagaccaaagcgagccactgcgggaaaatctacccccggacggcaggcccatggtaaggcagactctgccagctgtgagaacaggtctacgagccagcctgagagtgtgcataagccacaggattcaggcaaagccgagaagggcggtgggaaagcaggttgggccgcaatggacgagattcctgtgttgcgcccttcggcaaaagagtttcatgaccccctgatatacatagaatcagtccgggctcaggttgaaaagtttggcatgtgtcgtgtgattcctcctccggactggcgccctgagtgtaagctcaatgacgagatgcggtttgtgacccagatccagcacatacacaagttgggcagaagatgggggcctaatgtgcagcgattagcttgtattaaaaagcatctgaagtcccagggaatcacaatggatgaactgcccctcattggcggttgcgagctggacctcgcctgctttttccggctgataaacgaaatgggcggaatgcagcaggtgaccgatctgaagaagtggaataagctggccgacatgctcagaatccctcggaccgctcaagatcgcctcgctaagttacaagaggcctactgccaatatctcctgagctacgacagtctgagtcccgaggaacatagaagactcgaaaaggaggttctcatggaaaaagaaatcctggaaaaaaggaaaggtccattagagggccacaccgagaacgaccatcataagttccacccactccctaggttcgagccgaagaacggtttgattcacggcgtcgcccctcgaaacggcttccgaagcaagttaaaagaagttggccaggctcaattgaagactgggaggcgcagactatttgcccaggaaaaggaggttgtgaaggaagaagaagaggacaagggcgtattgaatgatttccacaagtgtatctacaagggtcggtctgtcagcctcaccacattttataggactgcaagaaatattatgtcaatgtgttttagtaaggagccagccccagctgaaatagagcaagagtactggagattagtcgaagaaaaggattgccatgttgctgttcactgtgggaaggtggatacaaacactcatggctccggatttccggttgggaagagcgagccctttagccggcacggctggaatctcaccgtgcttcccaataatacaggttctatactgcgccacctgggggctgtacccggagtcaccataccatggctgaacataggtatggtcttctcaaccagctgctggagccgggatcagaaccacctgccttatatcgattatctccatacaggagcagactgtatttggtattgcatccctgccgaagaagagaacaagctcgaagatgtggtgcacaccctactgcaagccaacggaactccgggactgcaaatgctcgagtccaatgtcatgatcagtcccgaggtattgtgtaaggaggggattaaagttcataggacggtgcagcagtctggtcagtttgtggtgtgttttccagggtcttttgtgtccaaagtgtgttgcggatattccgtctctgaaaccgtgcattttgcaaccactcagtggacttccatgggctttgaaacggccaaagaaatgaaacggcgacacattgcaaagcctttttcaatggaaaagctgctgtaccaaatagcgcaggctgaggccaagaaagaaaacggaccaaccttaagcacaatatcagctctgttagacgaactgcgggacaccgagcttaggcagcgtaggcaattgtttgaagctggcctgcattcctccgccaggtatggaagtcacgatggctcatctacagtggcagacggcaaaaaaaagcctcgcaagtggcttcaacttgaaacctccgagcgtcggtgccagatctgccagcacctttgctatttgtcaatggttgtgcaggaaaatgaaaacgtcgtcttctgccttgagtgcgcactgaggcatgtagaaaagcagaaatcatgtcgaggcctcaaactgatgtaccggtacgacgaggagcagattatcagtttggtgaaccagatctgcggcaaggtgagtggaaagaatgggtccattgagaactgcttaagtaagcctacccccaagcgcggacccaggaagcgggcaactgtggatgttcctcctagcaggctgagcgcaagtagctcttccaagtcggcaagcagttcctcttag

SEQ ID NO: 23274 - DNA, 3225 bp, Artificial Sequence
  Description of Artificial Sequence: Synthetic coding sequence
atggtttattttgggtcgtcccaggacgaagaagaagtggaagaggaggatgacgaaacagaagacgtcaaaaccgccaccaacaacgccagttcttcgtgccagagcactcctcgaaaaggcaagacacataaacacgttcacaacgggcacgtctttaatggctccagcaggagtacaagagaaaaggaacctgtacaaaaacataaatcaaaagaagctacacctgcaaaggaaaaacactctgaccaccgggctgactcacgccgagaacaggcctctgctaatcaccctgcggcagccccatctaccgggtcctctgctaagggcctcgctgctactcaccatcacccacccctgcatcgtagcgcacaggatttacgcaagcaggtgtctaaggtaaacggtgtgacgcgaatgtcctcgttaggggctggcgtgaccagcgccaaaaaaatgagggaagtccggccatccccaagcaagacggtgaagtacaccgccactgtcacaaagggcgctgtaacatacaccaaagcaaagagggagctggtgaaggatacgaaacctaatcaccataagccatcctccgccgttaaccatacaatctctggtaaaaccgaaagtagtaacgccaagacacgcaagcaagtattgtcactggggggtgcgtccaagtcaactggccctgcagttaatggactgaaggtgtccggacgcctgaatccaaagtcctgcaccaaggaggtgggtggtagacaattacgcgagggcctccagttgcgagagggcctgcgcaacagtaagcgcaggttggaggaggcccaccaggccgaaaaacctcagagcccgcctaaaaaaatgaaaggagcagctggacccgctgaggggccaggaaagaaagctccagctgaacgaggtctgctgaacggccatgtgaagaaagaagtacctgagagatcattggaaaggaacagacccaaacgggcaactgccggaaaatccacacctggcaggcaagcgcacggaaaagccgactccgcctcatgtgaaaaccgctctacaagccagcctgaatctgtgcacaaacctcaggactctgggaaggcagaaaagggtggtggcaaagccggatgggcagctatggatgagatcccagtgttgcggccttcggccaaagagttccacgaccctttaatatacattgagagcgtacgggcacaagttgaaaagttcgggatgtgtagagtaattcctccccctgattggaggcccgagtgcaagctcaatgatgaaatgaggtttgttacacagattcagcatattcacaagctcggccgaagatggggcccaaacgtacagcgtctcgcctgcatcaagaaacacttaaagtctcaaggtattaccatggatgagctgcccctgatcggcggttgcgagctggacctagcctgcttttttcgcctgatcaatgagatgggaggcatgcagcaagttacagatctgaagaaatggaataagttagccgacatgttacggattcctagaacggcccaggacagactggcaaaattgcaggaagcctattgtcagtatctgctgagctacgattctctgtcgccagaggaacacaggaggctagaaaaggaagttctgatggaaaaagagattcttgagaagcgaaagggaccactagaaggccacaccgagaacgaccatcacaaatttcatcctctgcccagattcgaacccaaaaatggcttaattcacggagttgcgcctaggaacggctttaggagtaagctgaaagaggtcgggcaagcccagcttaagacaggtcgacgccgtcttttcgcccaagagaaggaggttgtcaaagaggaggaagaagataagggcgttctgaatgacttccataagtgcatctataagggcagatcagtgtccttgacaaccttctaccggaccgcccgtaacatcatgagtatgtgctttagcaaggaacctgctcctgccgagatcgaacaagagtattggcggctcgtggaggagaaggactgccatgttgcggtgcattgtggtaaggtggacacaaacacacatggttcgggcttccccgtaggtaagagtgagccgttctcaagacatgggtggaacctcacagtgctgcctaataatacaggttctattctgagacacctgggagccgtgcccggagtcacaatcccatggcttaacattggcatggtcttctcaacatcttgttggtctagggatcaaaatcacctgccgtacatcgactatctccataccggagccgattgcatctggtattgtattcccgcagaggaggagaataaactggaggatgtggtgcacaccctgcttcaggccaatggcacgcccggtctgcagatgttagaatcgaacgtgatgattagccctgaggttctctgtaaagaaggcattaaagttcataggactgtgcagcagagcggacaatttgttgtttgtttcccaggctcctttgtttccaaagtctgctgtggctacagcgtgagcgagacggtccactttgccaccacacagtggacttcaatgggatttgagaccgcgaaggagatgaagaggcgccatattgccaagcccttcagtatggagaaattactgtatcagattgcccaggcagaggccaaaaaggaaaatggcccaacgctgtccacaatctctgctttactggacgagttacgagatacagagttacggcagcgcaggcagttgttcgaggcagggctgcacagcagcgctaggtacggctctcatgacgggagttccacagtcgcggatggcaaaaagaagccccgaaaatggttacagctggagacctcggagaggcgctgtcagatatgtcagcatctatgttatttgagtatggtggttcaggaaaacgaaaacgtggtgttttgcttggagtgcgcgctaaggcatgtggaaaaacaaaaatcgtgcaggggcctgaaactgatgtatagatatgacgaagaacaaattatctcactggtcaaccagatatgtggaaaagtgagtggcaagaacggtagcatcgagaactgtctcagcaaacccacacctaaaagaggcccacgcaagcgagccaccgtcgatgtccctccctctagactatctgcttctagctcatcgaaatccgcttcatcctccagttag

SEQ ID NO: 23275 - DNA, 1524 bp, Artificial Sequence
  Description of Artificial Sequence: Synthetic coding sequence
atgaaacgcactatgcacccaaaatgcccccctttggcaactatgctggtgctccagatccttaaaaaagggaggcgcggtaaaggcagccctgccctgccgaattctatggtatactttggcagcagtcaggatgaggaggaagtggaggaggaggacgatgaaactgaagacgtaaaaacggctactaataacgcctctagctcttgccagtctacccctaggaagggaaagacccacaaacacgtgcacaatgggcatgtctttaacggctcatcccgctcaacgagagagaaggagcctgtgcagaaacataaaagcaaagaagctacacctgcaaaggagaaacattccgatcaccgcgcagactccaggcgcgaacaggcgtctgccaaccatcccgcagctgcaccgtctaccggctccagcgccaaaggactggcagccacccatcatcatccaccattacatcgatcagcccaggacctgcgaaaacaggtgtctaaggtgaacggggtgacccggatgagttctctcggagccggagtgacttcagcgaagaagatgcgagaggtgcggccatctcctagcaaaaccgtgaaatataccgctacggtgactaagggggcagtcacttatacaaaggctaagcgtgaactcgtgaaagacaccaagcctaaccatcacaagcccagctcagcagtgaatcacaccatctccgggaagaccgaatcgagcaatgcaaaaacccgcaagcaggtgctttccctggggggtgcctctaaatccacaggccctgcagttaacggattgaaggtatcaggcaggcttaatccaaaaagctgtaccaaagaggtgggcggacgacagttgcgcgaaggcctgcaattacgtgaaggcctacgcaattccaaacgccgtctcgaagaggctcatcaagccgagaagccccagtctccgcctaaaaaaatgaaaggtgccgctggccctgcagaagggcctggcaagaaggcgcctgcggaaagaggtttacttaacggtcacgtcaagaaagaggtgcccgagagaagtttagagcgcaatcggcctaaaagagccaccgcaggcaagagtacacctggcaggcaggctcacgggaaggccgattctgcgtcttgcgaaaataggagcacaagtcagcccgagtcagtgcacaaaccccaagattcaggaaaggcggaaaaggggggtggtaaagccggatgggcagctatggacgaaatccctgtgcttcggcctagtgctaaagagtttcatgatccccttatttacatcgagtccgtgcgcgctcaggtagaaaaattcgggatgtgtagggttattcctccccctgattggcggcctgagtgcaagctaaacgatgagatgcgcttcgtgacccagatccagcatatccacaaacttggtaggcgttggggcccaaacgtgcagcggctagcgtgtattaaaaagcatctgaagtctttggggggatgcggaagctag

SEQ ID NO: 23276 - DNA, 2883 bp, Artificial Sequence
  Description of Artificial Sequence: Synthetic coding sequence
atggctgcgcctcgtgtgtgccaggttcagttcctggtggcctatctcgaggaaccaggcattgagggcctccttggcaatgatcagtcaaaagggcttggtccagcgagcgagcagagtgaaaatgaaaaggacgacgcttcccaagtatccagcacctctaacgatgtatcaagctctgattttgaagagggtcctagtcggaaaagacctaggctccaggcccagcgaaaattcgcccaaagtcagcccaatagcccctcaaccacacccgtgaagatagtggaacctctcctcccacctcccgcaactcaaatctcagacctgtcaaagcggaagcccaaaaccgaagatttcctcacatttctgtgtctccgaggctcccctgccctgcccaactctatggtgtactttggaagctcccaggacgaagaagaagtcgaagaggaggacgacgagactgaggatgtgaagactgccaccaacaacgcctcttctagctgtcaatctacccctaggaagggcaagactcataaacatgtccacaatggtcacgtgtttaatggctcatcaagatccactagggaaaaggagccagtgcagaaacacaaatctaaagaagcaactcccgcaaaagagaagcattccgatcacagagccgatagccgcagggagcaggcgagcgccaatcatccagccgcagcaccaagtacaggatcaagcgccaagggcctcgccgcaactcatcaccatcctccactgcacaggtccgcccaagacctcaggaagcaggtgagcaaggtgaacggagttactcgaatgtcctccctgggtgccggtgtgacctctgctaaaaaaatgcgggaggtacgcccttctccctcaaaaaccgtcaagtacactgcaacggtgactaagggggctgtcacatacaccaaggcaaagagggagctggtgaaagacactaagcctaaccatcacaagccgagcagcgccgtaaaccatacgatttccggcaagacagagtcatctaatgcaaagaccagaaagcaggttctttcactgggaggagcgtccaagtccacaggccctgccgtgaatggcctgaaggtcagcggccgattgaaccccaaatcctgtaccaaggaagtaggcggacggcagttacgggaaggcctacagctgagagaaggccttcgtaacagtaaaagacggctggaggaggcacaccaagctgagaagccacagagtcctcccaagaaaatgaagggagcagctggcccagctgaaggcccaggaaagaaggctcccgcagaaagaggtctcctgaatgggcatgtcaaaaaggaagtgccagaacggagtctggagcgcaatcgacccaagagggctaccgcaggaaaatctactcccggtcgacaagctcacgggaaagccgacagcgcctcctgcgaaaaccgaagcacttctcaacccgagtctgtacacaaacctcaagactcaggcaaggcggagaaggggggtggaaaagccggatgggccgctatggatgaaatccccgtgctgcgtccttctgctaaggagtttcatgacccattgatctacatagagagcgtaagggcacaagtcgagaagtttggaatgtgtagagtgataccaccacccgattggaggcctgagtgtaagctgaatgatgaaatgaggtttgtgacacaaattcagcatatacacaagcttggacggaggtggggcccaaacgtgcagcgcctggcctgtattaagaagcatctcaaatcccaggggattacgatggacgaactgcctcttatcggtgggtgcgagctggacttggcctgcttttttaggctcattaacgagatgggaggaatgcagcaagtcactgatttgaagaagtggaataagttggcagacatgctgagaatccccaggactgcccaggatcggcttgcaaaactgcaggaggcatactgccagtacctattgtcctacgattctctgtcccctgaggagcacaggaggctggagaaagaggtactgatggaaaaagagattttagagaagcgcaagggcccactggaaggacatacagagaacgatcaccacaagtttcatcctctgcctagattcgagccgaaaaacgggctcatccatggggtcgctcccagaaatgggtttaggagtaagttgaaagaggtgggccaagcccaattaaaaacaggcaggcgacgtctgtttgcccaggagaaagaggtagtaaaagaggaagaggaggataagggcgtcctcaacgactttcacaaatgtatttataagggtcgcagcgtttccctgacaacattctaccggacagccaggaacattatgagcatgtgctttagtaaagagccagccccagcggagatcgaacaggaatattggagactggtggaagagaaagactgccatgtggccgtgcactgcggtaaggtggataccaatactcatggcagtggattcccggtgggcaaaagcgaaccattctccaggcacggttggaacctgacggttctgcctaataacacaggatctatactacggcatcttggcgctgttccaggagtcacaataccttggctgaatatcgggatggttttctcgacatcgtgctggtccagagaccaaaaccacctgccttacatagactacctgcataccggcgctgattgtatatgcctgtctgtggaacccgtgtttccccatctatcagtggcggtgggttctagagtagacctggggattagctttcttccatgcggggatacgcgggtgatgtatcccgtagaaagtgtagcatggcggggagtgcttggtcctcgtctttag

SEQ ID NO: 23277 - DNA, 525 bp, Artificial Sequence
  Description of Artificial Sequence: Synthetic coding sequence
atggtggccggatggcccgctactcctccggctatgatgccaggccagataccagacccctccgtcacaactggctcgttgcctgggttgggccctctcaccggcttgccttcctctgcattgaccgtcgaggagctaaaatatgcggatattaggaatctcggcgctatgatagcaccactacacttcttggaagtcaagttgggcaaacgaccacagccggtgaagtcagaactcgatgaagaggaggagcgcagaaagcgcaggcgcgagaagaacaaagtggcagccgctagatgcagaaacaaaaaaaaggaacgaaccgagtttcttcagagggagagcgagcgtctggaactgatgaacgcagaactcaagacacaaatcgaagagcttaagcaagagcggcaacaattaattctgatgctcaatcggcaccgccctacttgcatcgtgagaacggattctgtcaaaactcctgaatcggaagggaaccccctcttggagcaactcgaaaaaaaatag

SEQ ID NO: 23278 - DNA, 492 bp, Artificial Sequence
  Description of Artificial Sequence: Synthetic coding sequence
atgatgcccggtcagattcccgatccctccgtcactactggttcactgcccggactagggccactgaccgggctgccctcttctgcactcacagtcgaagagctcaagtacgctgatatcaggaatttaggggcaatgatagcgcctctccattttctggaggttaagctgggcaagcgtcctcagccagttaaatccgagcttgacgaagaagaagagcgtcgcaagaggcgacgcgaaaagaataaggtagccgctgctcgatgtaggaataaaaagaaggagcggaccgagtttttgcagcgcgaaagcgagcggctggaactcatgaatgcagagttgaaaacacaaattgaggagctcaaacaggagaggcaacagcttattctgatgctgaaccggcaccggcctacctgcattgtgcgtaccgactctgtaaaaactcccgaaagtgagggcaacccgttactggagcagctggagaaaaaatag

SEQ ID NO: 23279 - DNA, 492 bp, Artificial Sequence
  Description of Artificial Sequence: Synthetic coding sequence
atgatgcccggacaaattcccgatccaagtgtcacaaccgggtccctaccaggtctcggacccttgacaggcctcccttcttctgcactgaccgtcgaggaactgaagtacgctgacatccgtaacctgggggcaatgatcgctccactgcactttctcgaggtaaagctgggaaagaggccccaaccggtcaaaagcgagctggacgaggaagaggaacgaaggaagcgacgacgagagaaaaataaggtggccgcagcgaggtgcagaaacaagaagaaagagaggaccgaatttctgcagagggaatcagaacggctggagctgatgaatgccgagctgaagacgcagattgaagaactgaaacaggaaagacagcagctgatacttatgttgaaccgccatcggccaacatgcattgtgagaactgattcagtgaagacaccagagagtgagggtaacccgctactggagcagctggagaagaaatag

SEQ ID NO: 23280 - DNA, 492 bp, Artificial Sequence
  Description of Artificial Sequence: Synthetic coding sequence
atgatgcccggacagatccctgacccttccgtcaccaccgggagtcttcctggtctgggaccgctcaccggcctcccatccagcgctttgaccgttgaagaattaaaatatgccgatatcagaaacctcggcgcaatgatcgcaccgctgcattttttggaagtcaaactggggaagcgtccacagcccgtaaagtcagaactcgacgaagaggaggagcgcagaaaaagaagacgcgagaagaacaaggtggctgcagcaaggtgtcgcaataaaaagaaggaaagaaccgaattcctgcaacgagaatcagaacgcctggaacttatgaacgcggaactgaagactcagatcgaagagctcaagcaagaacgccagcagctgatcttgatgcttaaccggcaccggccaacctgtatcgtgcgtaccgactctgtcaaaactccagagtctgagggaaatcctctgcttgagcagcttgaaaaaaagtag

SEQ ID NO: 23281 - DNA, 405 bp, Artificial Sequence
  Description of Artificial Sequence: Synthetic coding sequence
atgatgccgggacaaatacccgatccatccgtcacgactggttctttgcccggactgggccctctaactggcctaccctcatcagctttgactgtagaagagctaaaatatgccgatattcgtaacctgggggcaatgatcgccccactccacttcctggaggtcaaactaggcaaaaggcctcagccagtgaagtccgaattagatgaagaggaggagaggagaaagaggcgacgggaaaagaacaaggtggcggctgccagatgcaggaacaaaaaaaaggagagaaccgagttcctgcagagagagtctgagaggttagaactcatgaacgcggagctgaagactcaaattgaagagttaaaacaggaacgacaacagctgattctaatgctaaaccgttag

SEQ ID NO: 23282 - DNA, 6015 bp, Artificial Sequence
  Description of Artificial Sequence: Synthetic coding sequence
atggtgaagttggccaatcccctgtacacagagtggatcttggaagccatcaaaaaagtgaaaaaacagaaacaacgcccatcagaagaacggatttgcaatgctgtctccagttcccatgggctcgacagaaagaccgtactcgagcagctggaactgtctgtgaaggatggaacgattctgaaagtaagcaataagggtctgaacagctacaaggacccagacaaccccggtcgtattgcgctccctaaaccaagaaatcatggaaaacttgataacaaacagaacgtggactggaataagctgataaagcgagcggtcgaaggcttggctgaaagtgggggtagcactctcaaatccattgagaggtttttaaaagggcagaaggacgtgagcgccttatttggaggctctgctgcgagtggcttccaccagcagttacgattggccattaaaagagcgattggtcacggtcggctgctcaaagacggaccgttgtacagattgaacacaaaggctacgaacgtggacgggaaggaatcttgtgaaagtctttcttgcctcccccctgtgagccttctgccccacgagaaggataagcccgtggccgaacctatcccaatctgttccttctgtcttgggactaaagaacagaaccgggaaaaaaagccagaggaattgatcagttgtgcggattgtggcaactccggacacccctcctgcctgaagttttcgccggagctcacggtacgggtgaaggctttgcggtggcagtgtatcgaatgcaaaacctgctcgagttgtcgcgatcagggcaagaacgcagataacatgctgttctgcgattcctgcgatagggggtttcatatggaatgttgtgatccccctcttaccaggatgcccaaaggcatgtggatctgccagatctgcagaccaagaaaaaaaggtcgcaagctgttgcagaagaaggcagctcaaatcaagcggaggtacaccaatcctatcgggagaccaaagaatcgtttgaagaagcagaatactgtgtcgaaaggtccgttctcaaaagttcggactgggcctgggagaggacgaaaacgcaagattactctctcgtcacagagtgcgtcaagtagctccgaagagggttatctggagcgcatcgacgggctcgacttctgccgagacagcaacgtatcactaaaattcaataagaaaaccaagggcctcatagacggactcaccaaattcttcaccccatcaccagatggcagaaaggccaggggcgaggtcgttgactactcagaacaataccgcataagaaaaaggggaaaccgaaaatcctcaacatcagattggccaaccgacaaccaggacggctgggatggaaagcaggaaaacgaagagagactgttcggctcccaggagataatgactgaaaaggacatggagctgtttagagacattcaggagcaagctctacagaaggttggcgtgacagggcctcctgacccgcaggttcgctgcccatctgtgatcgagttcggcaagtatgaaatacatacttggtactccagtccatatccacaggagtatagtcggctcccaaaactttacctctgtgagttctgtctcaagtacatgaagtctcggaccatcctgcagcaacatatgaagaaatgcgggtggttccatccccctgccaatgagatctatcgcaaaaataacatctccgtgttcgaagtagacgggaacgtgtccacgatatactgtcagaatctttgtcttcttgccaaactgttcttggaccacaagactttgtactatgatgtcgaaccgtttcttttctacgtgcttacacagaacgatgtgaagggttgtcatctggtcgggtacttttcaaaggagaagcactgccagcagaaatataatgtcagttgtatcatgattcttccacagtatcagagaaagggatatggacggttcctgatcgattttagctatctgctctccaagcgggagggccaagctggatcacctgaaaagccattgtccgacctggggagactgtcctacatggcctactggaaatcagtgattttggaatgcttgtatcaccagaacgacaagcagatctctatcaagaagctgtccaagttaaccgggatatgcccacaggacattacgtctacactgcatcatttgcggatgcttgatttcaggagcgatcagtttgtcattatccggcgagaaaaactgatccaggaccatatggccaaacttcagctcaacttacggcctgttgacgtagacccagagtgtctcagatggactcccgtgatcgtgagtaatagcgtggtatcagaggaggaggaggaagaagctgaagagggggagaacgaggaaccccagtgccaggaaagggaactcgagatttccgtggggaagagcgtctcccacgagaataaggagcaagatagctacagtgtggaaagcgaaaagaagcccgaagtcatggccccagtgagcagcactcggcttagcaagcaagtgctgccacatgacagcctgccggctaatagccagccctcccgacgcggaagatggggacggaagaatagaaagacccaagaacgctttggcgacaaagatagcaagttactcctggaggagacaagttccgcccctcaagagcagtatggtgagtgtggcgagaaatccgaggccacccaggagcagtacaccgaatccgaagagcagctggtggcatcagaggaacagccctcccaagatggaaaacccgatttacccaaacgtagactttccgaaggagtggagccctggaggggccagcttaagaaaagcccggaggctctaaagtgtcgacttacggaagggtccgagcggcttccaagaaggtacagtgagggcgaccgtgctgttctacggggatttagtgaaagctcagaggaggaagaagaacctgagtctcctaggtcgtctagccccccaatcctgactaaacccacactgaagaggaagaaaccatttctgcataggcgacgaagggtccggaagagaaaacaccataacagcagcgtggtgactgagaccatcagcgaaactacggaagtcttagatgagccgttcgaagacagtgattcagaaaggcccatgcccaggttggagcctacatttgagatcgacgaggaggaggaggaagaggatgagaacgaactcttccctagggaatattttcggaggctgagctcacaggatgttctgcgctgccagtcctcctctaaaaggaaatctaaagacgaggaagaggatgaggaatcagacgacgctgatgacacccccattctcaagcctgtgagcctactgcggaaacgcgatgtcaagaattcccccctggaaccagacaccagcacacctctgaagaaaaagaagggctggcccaaagggaagagtcgtaaacccattcactggaagaagcgccctggtcggaagccaggatttaagttatcccgcgagatcatgcccgtatctacacaagcttgcgtgatagaacccatagtttccatccctaaggccggtaggaagcctaagatacaggagagcgaggaaactgttgagcctaaagaggacatgcccctccccgaggagcgcaaagaggaagaggagatgcaggccgaagctgaggaagctgaggaaggcgaggaagaggatgcagcttcaagcgaagtacccgctgcatcgccagccgacagtagcaactcacctgagaccgaaacaaaggaacctgaagttgaagaagaagaagaaaaacctcgagtctctgaggagcagcggcaatccgaggaggagcagcaggagctcgaagagcctgaacccgaagaggaggaagatgctgccgctgagaccgcccagaacgatgaccacgacgcggacgacgaggatgacggtcacctggagtctacgaagaagaaggagctggaagagcagcctacaagggaggatgtcaaggaggaacccggagtgcaggagtcatttctagacgctaatatgcaaaaatcgcgcgagaagatcaaggataaggaggagaccgaactggattccgaagaggagcagccgagccacgacactagtgtcgtctctgagcagatggctggatccgaggatgaccatgaagaagacagtcataccaaggaagaactcatcgaactgaaagaagaagaagagattcctcattccgagctggatcttgagaccgtgcaggcagtgcagtccctgactcaggaggagtcctcagaacatgagggagcctaccaggattgtgaagagactctggcagcctgtcagactctgcagtcctatacccaggctgatgaggatccccagatgtctatggttgaagactgccatgctagtgagcataacagccctatttcttctgtccagtcacacccctctcagagtgtccgatcagtgtcctctccaaacgtgcctgccctggaaagtggttacacccagatctcaccagaacagggctctctttctgctccctctatgcagaacatggagacatcaccgatgatggatgtcccctccgtgtcagaccactcccagcaggtagttgactcaggcttttcagacctcggctccatcgaatccactactgagaactatgaaaacccctccagctatgacagtactatgggaggctctatctgtggtaacagcagctcgcaaagcagttgttcctatggtggtctatccagctcttcaagtctgacacaaagcagctgcgtggtaactcagcagatggccagcatgggaagttcctgcagtatgatgcagcagtcctcagtgcagccggctgcaaattgttcgatcaaaagcccgcagtcctgcgtcgtagaaaggccaccatcaaatcagcagcagcaaccgcctccacccccaccccagcagccccagcctcccccaccgcagcctcagcctgcaccgcaacctcccccaccacagcagcaacctcaacagcagccacagcctcagccacaacagccgccaccacccccacctccccaacagcagccaccactatcccagtgctccatgaacaatagctttactcctgctcctatgattatggaaatccctgagagcggatcaacaggtaacatcagcatctatgagcgtattcccggtgacttcggcgcaggctcgtactcacagccctcagccaccttctccctggctaaacttcagcagttgactaataccataatggatccacacgccatgccttacagccattcccctgccgtaacgagttatgcaacctcagtgtccctgtccaacacaggccttgctcaacttgcgccaagtcatcctctggcaggcactccccaggctcaggctactatgacacctcctccaaacctggcttcaacaacaatgaatctgacctcgcccctgctgcagtgcaatatgtccgctaccaatatcgggattccacacacacagcgcctgcagggacagatgcctgtgaagggccacataagcatccgtagcaagtccgcccctctgcccagtgccgctgcccaccagcagcaattgtacggcaggagccccagtgccgtggccatgcaagctgggcctcgcgctctggcagtgcaacgtggcatgaacatgggagttaatctgatgcccacgccagcttacaatgtgaattccatgaacatgaatacattgaatgctatgaactcctatagaatgactcaacctatgatgaactcgtcgtaccacagcaacccagcttatatgaatcagactgcacagtatcctatgcaaatgcagatgggcatgatgggtagccaggcctacacacagcagcccatgcagcccaatccccatggaaacatgatgtacactggtccttcacaccactcttacatgaacgcagccggagtcccaaagcaatcactgaacggaccatatatgagacggtat

SEQ ID NO: 23283 - DNA, 6014 bp, Artificial Sequence
  Description of Artificial Sequence: Synthetic coding sequence
atggtgaaacttgctaaccctctgtacacggagtggattctggaagctattaaaaaggttaaaaagcagaagcagcgcccatctgaggagaggatttgtaatgccgtgtcaagcagccacgggttagatcgtaaaactgtgctcgagcagctggaattgtctgtcaaggacgggaccattctaaaggtgagtaacaaaggtctcaactcttacaaggacccagacaacccaggccgaatcgctctaccaaaaccaaggaaccatggtaaactcgacaataagcaaaacgtggactggaataagctcatcaaacgcgctgtcgagggtctggctgagtccgggggaagcactctcaagagtatcgagcggtttctgaaaggtcagaaggatgtcagcgctctgtttggcggtagtgccgcttcaggcttccaccagcagctacggctagctatcaaaagggctatcgggcatggtcgtctgcttaaagatgggcctttgtacaggcttaacaccaaggccaccaatgtcgatggcaaggaaagctgtgagagcctgtcttgcctcccgccagttagtctcctgccgcacgagaaagataaaccagtggccgagccaattcccatttgctcattctgccttggaaccaaggaacagaaccgcgaaaagaaacccgaggaactcattagctgtgcagattgtggaaattctggtcatccaagctgtcttaagttctctcccgaactgactgttcgggtcaaggccctgcgatggcagtgcattgaatgcaagacctgcagctcttgccgcgaccaagggaagaacgcagataacatgctgttttgtgattcctgcgaccgtggctttcatatggaatgctgtgatccaccgctgacgcgtatgcccaaggggatgtggatctgccaaatctgccgtccaaggaagaaaggacgtaagctgttacagaaaaaggctgcacagatcaagaggagatacactaatcctatcgggagaccaaaaaaccgtctgaagaagcagaacacggtttccaaggggcctttcagcaaggtcagaaccgggccaggtcggggacggaaaaggaaaattactctttcatctcagtctgcttcgagcagctctgaggaggggtacctcgaacggattgatgggctggacttttgtcgtgacagcaacgtctccctgaagttcaacaaaaagaccaagggactcatcgatgggctgacaaaattttttacccccagcccagatggcaggaaggccagaggggaggtggttgattatagtgaacagtacagaataaggaagagaggcaataggaagagctccacaagtgattggccaaccgataaccaggacggatgggacggaaagcaggaaaacgaagagcggttgttcggtagtcaggagatcatgactgagaaggacatggagctgttccgagacattcaggagcaagctctgcaaaaggtgggagttactgggccaccggacccccaagtgcgctgccccagcgtgattgagtttggcaaatatgagatacacacgtggtacagctctccttatccccaggagtacagccgcctgcctaagctttacttgtgtgagttttgtctcaaatatatgaagagccgtaccatactgcagcagcacatgaaaaaatgcgggtggtttcaccccccagccaacgagatctaccgaaaaaacaatattagtgtgttcgaggtagacggcaacgtgagcactatctactgccaaaatctctgccttctggcgaaactctttcttgaccacaaaaccttgtattacgacgtggagcccttcttattctacgtgttaacccaaaacgacgttaaagggtgccacctggtgggttatttcagtaaagaaaagcattgccagcaaaaatacaatgtcagttgtataatgatcttgccccagtaccagaggaaaggatacgggcgatttctcattgatttcagctacctgctgtcaaagcgcgagggtcaggctggcagcccggagaaacccctttccgatctgggcaggttatcttatatggcttattggaaatccgtgattttagaatgcctataccaccagaatgataagcagatcagcataaagaaactcagcaaactcacagggatttgtcctcaagatattactagtacgttacaccatctccggatgctggatttccgaagtgatcagtttgtgataatccgccgtgagaaactcatacaggatcacatggccaagctacaactgaatttacgcccagttgacgtggaccctgaatgtctcaggtggactcccgttatcgtatcaaactccgttgtatctgaagaggaagaagaggaggctgaggaaggggaaaatgaggagccacagtgccaggaaagggagctggagatctccgtcggaaaatccgtgagtcacgaaaacaaggaacaggattcttattcggtggagagtgaaaagaagcccgaagtgatggcgccagtttcgtccaccaggctctcaaagcaagttctgccgcatgattctctgcccgcaaatagccaacccagcaggagggggcgatggggcaggaagaaccggaagacacaagaaaggttcggagacaaagactcaaagcttctgctggaggaaactagctccgcccctcaagaacagtatggtgagtgcggggaaaaatccgaagctacacaggaacagtacactgaatctgaggaacaactggtggccagcgaggagcagccatctcaggacggaaagccagacctccccaagagaaggctgtcagagggcgtcgagccctggcgtgggcaactgaaaaaaagcccagaggccctgaaatgcagactgaccgagggctctgaacgcctgccaaggagatactcggagggagaccgggcagtgctccgcggtttttctgagagctctgaagaggaagaggagcctgagagccctcgttcatcctcccctcccattctgacaaagccgacactcaagcggaagaagcctttcctccaccgtcgaagaagagtcaggaagagaaaacatcacaactcgagcgtggttacagagacgatctcagagacaaccgaagtcttagatgagccgttcgaggattcagattcagagcgacccatgccgcgactggaaccgacctttgaaatcgacgaggaggaggaggaggaggacgaaaacgaattattccccagggaatactttaggcggctgagtagtcaggatgttcttcgctgtcagtcatcgagcaagagaaagagcaaagacgaagaggaggacgaagaatccgacgacgctgacgatacaccaatcctgaagccggtgtcactccttcggaaacgggacgttaaaaacagccccctggaaccggacacgtccacacccctgaagaaaaagaagggctggcccaagggtaaatctagaaaacccatccattggaagaagcgtccgggacgaaagcctggcttcaaactgtcaagggagatcatgcctgtcagcacccaggcatgcgtcatagagccaatcgtatctattccaaaggctggacgcaaaccaaaaattcaggagagcgaagagactgtggagcctaaagaagatatgccgctgcccgaagaaagaaaggaggaagaagaaatgcaggctgaggcagaggaggccgaggagggcgaagaggaggacgccgcttcctccgaggtccctgccgcttctcccgcagattcctccaactcaccagaaaccgaaacaaaagagcctgaagtggaagaggaggaggagaaacctagagtgtccgaagagcagaggcagagcgaagaggaacagcaagagttggaagaaccggaacctgaggaggaggaagacgcggctgccgagacggcacagaacgacgatcacgatgcagacgacgaggatgacggccatttagaatccacaaaaaaaaaagagctagaggagcagcccacgcgagaggacgttaaggaagaaccaggcgtgcaagagtcatttctggatgccaacatgcaaaaatcccgggagaagattaaagataaagaagagaccgagctggatagtgaagaggagcagccgtctcacgatacatcagtggtatctgagcagatggccggttcagaggacgatcacgaggaagacagccacactaaggaggagcttatcgaacttaaggaagaagaggagattcctcattcagaattggacttggaaaccgttcaggctgtccagtctctcacgcaggaagaatcttcggaacacgaaggcgcttaccaagattgcgaagagactcttgcggcatgccagacccttcaaagctatacccaggccgatgaggaccctcagatgtctatggttgaagactgccatgcatcagaacacaacagtcccatctcatctgtccagagtcatccctcacaatccgtccgctccgtgtcatccccaaacgtgccagccctggagtccggctatacccagatatccccagagcaggggtctcttagtgcaccctccatgcagaatatggagacttctccgatgatggacgtgccgtcggtttccgaccactcccagcaagttgtcgacagtggcttctctgatctgggatcaatcgagtcaacaactgagaattacgaaaacccatccagctacgactctaccatgggaggctctatttgcggcaactcttctagccaatcctcttgttcttacggcggtctatcctctagctcctcactaacccagtcatcttgcgtcgtgacacagcaaatggcttccatggggtctagctgttctatgatgcagcagagcagcgtccagccggcagccaactgtagcattaagagccctcagtcgtgcgtggtcgagcgaccacctagcaatcaacaacaacaacctcctccccctccccctcagcaaccccagcccccacctcctcagccccagccggcaccgcagcctcctccgcctcagcagcagccccaacagcagcctcagcctcagccacagcagccacccccaccgccacctcctcagcagcagccacccctgagccagtgttctatgaacaatagcttcacgcccgctcccatgattatggaaatccccgagtcaggatcaacaggtaacatatccatctatgagagaattcctggggactttggtgccggaagttacagccaaccttcagccacgttttcccttgccaaactgcagcagctaacgaataccatcatggacccgcatgcaatgccgtactcccatagcccagccgtgacctcctacgccacatctgtctcactaagtaacactgggctcgcacagctcgccccttcccatcccctcgcaggaacacctcaggctcaggccactatgacaccgcctcctaatctcgcatccaccacaatgaatctgacgagccccttgctccaatgcaatatgagtgctacaaacattgggatacctcacacacagagactgcaggggcagatgcctgtcaaaggccacatctccatccgctcaaaaagcgcacctctgccgtctgccgcagcccaccagcagcagttgtatgggaggtcaccaagcgctgttgctatgcaggccggacccagggcgctcgcagtacagaggggtatgaatatgggcgtgaacctcatgcccacacccgcttacaacgtgaactcaatgaacatgaacactctcaacgctatgaactcatatcgcatgacgcaacccatgatgaacagttcttaccactccaaccctgcatatatgaaccagacagcacagtatccaatgcaaatgcagatgggtatgatggggtctcaagcctatacccagcaacctatgcaacccaaccctcacgggaatatgatgtacaccggaccaagtcaccacagctacatgaatgccgctggagttccaaagcagagcttgaatggcccatatatgcgaagata

SEQ ID NO: 23284 - DNA, 6014 bp, Artificial Sequence
  Description of Artificial Sequence: Synthetic coding sequence
atggtcaaactcgccaacccgctctacaccgagtggatattggaagccattaaaaaggtgaagaaacaaaagcaacggcctagcgaagagcggatttgcaatgcggtctcaagtagtcacgggttagatcggaagacagtgctagagcagttggagttgtctgtcaaagacggaaccatccttaaggtttctaacaagggtctgaacagttacaaggacccagacaaccctgggaggattgctctccctaagccccgtaaccacgggaagctggataataaacagaatgtggactggaacaaactgatcaagcgcgcagttgaaggcctcgccgaatcaggaggaagcaccttaaagagtattgaacggttcctcaaagggcagaaagacgtaagcgctttattcggagggagtgccgcttctgggttccaccagcagctgcgtctggccattaagagagctatcggccacggacggttattgaaggatggcccactgtatagactgaataccaaagcaaccaatgtggacggcaaagagtcttgcgagagcttaagctgtctcccgccagtctctctgctcccgcatgagaaggacaagccggtggctgagccgattcctatttgtagtttttgtctaggaaccaaggaacagaaccgggaaaagaaacccgaggaactaatctcttgtgctgattgcggaaacagcggacatccatcctgcctgaaattctcccccgagctgacggtgagggtgaaggcactacgttggcagtgtatcgagtgcaagacatgttctagctgccgagatcagggcaaaaacgccgacaacatgctcttttgcgatagctgtgatcgagggttccatatggagtgctgtgatcctcccttgacaaggatgccaaaaggcatgtggatctgtcagatctgccgccctaggaagaaaggccgtaagcttctacagaaaaaggctgcccagattaagcgcagatacaccaaccctatcgggaggcccaagaataggttaaaaaagcagaacacagtctccaaaggcccattctcaaaggtaaggactggcccaggacggggaagaaagcgcaagatcactctttcaagtcaatccgcaagctcctcctcagaggaggggtacctggaacgtatcgacgggctcgacttttgcagagacagtaatgtcagtctcaaatttaacaagaagacgaagggcttgatagatggattgacaaaatttttcacgcccagccccgacggccgtaaagcaagaggcgaggttgtggattattccgagcagtaccgaattcggaaaaggggcaaccgtaaatccagcacctccgactggccaactgacaatcaagacggatgggatggcaagcaggaaaacgaagaaagactgtttggctcacaggagattatgaccgagaaagacatggaactctttagggacatccaggaacaggccttacagaaagtcggtgtaacaggaccaccggatccccaggtcagatgtcctagtgtcatcgagtttggaaaatacgagatccatacctggtattcctcaccttacccacaggaatactccagactacccaaattgtatctctgcgaattctgtctcaaatatatgaagtccaggaccatccttcagcagcacatgaaaaaatgcggatggtttcatcctccggcaaatgagatctatagaaagaataacatatctgtatttgaggtcgatggaaacgtgagtactatctattgtcagaatctttgtctccttgcgaaactcttcctcgatcacaagaccctttattacgatgtggaacctttcttgttttacgtgcttactcagaatgatgttaagggttgccacttagtgggctacttctccaaggaaaagcactgtcagcagaagtataacgtttcttgcatcatgatcctccctcagtatcaacgtaagggctatgggagatttttgatcgatttttcctatttgttatcgaaacgcgagggacaagccggtagtcctgagaagcctctctccgacctgggtcgtttgtcgtatatggcttactggaagtcagtcattttggagtgcctctatcaccagaatgataaacagatcagcatcaaaaagttatccaagcttaccgggatctgtcctcaagacatcacgtcgacacttcaccatctgagaatgctcgactttcggtctgaccagttcgtgattatccgtcgggagaaactgatccaagaccatatggctaaactgcagctgaacttgaggcccgtggatgtcgacccagaatgtctgaggtggacgccagtgatcgttagtaacagcgtggtaagcgaggaggaggaggaagaggccgaggagggggagaatgaggaaccacagtgtcaggagagggagcttgaaataagcgtcggcaagagcgttagtcacgagaataaagaacaggacagttatagcgtggagtctgaaaaaaaacctgaggtgatggcacccgtgtcctcgacgagactatctaagcaagtgctgccgcatgacagcctgccagctaattcgcagccgagcagaagaggacgctggggacgcaaaaaccgcaagacccaggagaggttcggggacaaggattccaaacttctgctggaggagacctcttccgctccacaggaacagtacggcgagtgtggcgaaaaatccgaggccacacaggagcagtacaccgagtccgaagaacagctcgtagcctctgaagagcagccttcccaagatggaaaacccgacctgcccaagcgaagactttccgagggagttgagccatggcggggacagctgaaaaagagccctgaggctttaaaatgcaggcttacagaaggctctgaacgcctgccacgcaggtacagcgaaggtgatcgagcagtcctgaggggtttctctgaaagttctgaggaggaagaggagccagagtcaccacgatcttccagcccccctatattgaccaaaccaacgctgaagaggaaaaaacccttcttacacagaaggaggcgggtccggaaacgcaagcatcataactcgtcagtggttacagaaaccataagcgagaccaccgaggtactggatgaaccgttcgaagattccgacagcgagagacccatgccacggctggaaccgacattcgaaatcgacgaggaggaggaggaggaggacgagaacgagctgtttccccgagagtactttaggcgcctgagctcccaggacgttctgaggtgccagtcatcctccaaacgcaagagtaaggacgaggaagaggacgaagaatccgatgacgccgacgatacaccaattctcaaaccggtgagtttgctccgaaagcgggatgtaaaaaattcccccctcgagcccgatactagcacaccactgaagaagaagaagggttggcctaaaggtaaatcccgcaaaccaatacactggaagaaaaggcccggaagaaagcccggatttaaactgtcgagagagatcatgcccgttagcacccaggcctgtgtgatcgagcccatagtttccatacccaaagctggccgaaaacccaaaattcaggaatctgaagagaccgtggaacctaaagaagacatgccgttgcctgaggaaaggaaggaagaggaggaaatgcaggcagaggctgaggaagctgaggagggcgaagaggaggatgccgcttcttccgaagtgccagccgcttctccggcagattcttctaattcccctgagacggagactaaggagccggaagtggaagaagaggaggaaaagccccgagttagcgaggagcaacgccagtccgaggaagaacagcaggaactggaggagccggagccagaggaggaggaagacgcagccgctgaaaccgcccagaacgacgatcacgacgccgacgatgaagacgacggccatctagaaagtacaaagaagaaggaacttgaggaacagcctacaagggaggacgtaaaagaagaacccggagtccaggaaagttttcttgacgctaacatgcagaagagccgcgagaaaatcaaggataaggaggaaacagagctggattcagaggaagagcaaccttcccatgacacatccgtggtgagtgaacagatggccggaagcgaagatgaccacgaagaagactctcacactaaggaggagctcattgaactcaaggaggaagaagagattcctcactcagaactagacctcgagacagtgcaggccgttcagagtctaacccaggaggaaagttctgagcatgagggcgcataccaggactgtgaagaaacactcgctgcttgccagacactgcagtcctacacccaggccgacgaggaccctcagatgagtatggtggaagattgccatgccagcgaacataattctccaatcagcagtgttcagagtcacccttcgcaatctgtgcggtccgtttctagccctaatgtacccgcactggaatctggctacacacagattagcccagagcagggctcactgtctgcacccagcatgcagaacatggagacttcaccaatgatggatgtgccaagcgtgagtgatcattcacagcaggtggtggactctggcttttccgacctaggctcaatcgaaagtacaactgagaattacgaaaacccctctagctacgattcgacaatgggtggatccatctgtggcaactccagctcccaatcttcatgctcctatggcggactttctagctccagctcattaacacagagtagctgcgtcgttacccagcagatggcttctatgggcagctcctgctccatgatgcagcagagctccgtgcagcccgctgccaactgttcaattaaatcccctcagtcttgcgtggtggaaagaccaccatctaatcagcaacagcagcccccacccccaccaccgcagcagccccagcctccccctccacagccccagccagcaccccagccaccccctccccagcagcaaccccaacagcagccccagccccagccacagcagccccctccaccacctccgccacagcagcagccaccactctcccagtgctccatgaacaactcttttaccccggcacctatgatcatggaaattccagagtccggcagtacgggcaacatatcgatttatgaacgtatacctggagattttggagcaggaagctactctcagccatccgccacattctccctggcaaagttgcaacagctgacgaacacgatcatggacccccatgcaatgccttattcccacagcccagccgtgacatcttatgccacgtctgtgtcactgtcaaatactggactcgctcaattggcgccatcacatcctctagccggaaccccgcaggcacaggccaccatgacaccacccccaaaccttgcctctacaacaatgaatcttacctctccactactgcaatgcaatatgtctgctacaaatattggaataccgcatacacagagacttcagggccaaatgccggtgaagggccacatcagtatccgcagcaagagcgctccgctgccctctgccgcagcccatcagcagcaactgtatgggagatccccgtccgccgtggcaatgcaggccggacctcgcgctctcgccgtgcaacgaggcatgaacatgggggtgaacctgatgccgacacccgcttacaatgtgaactccatgaacatgaacaccctcaacgcaatgaatagctaccgcatgactcagcccatgatgaactcaagctaccacagtaatcctgcatatatgaatcaaaccgcacagtaccccatgcagatgcagatgggaatgatgggatcacaagcctatacacaacaacctatgcagcctaatccacacgggaatatgatgtacaccgggccatctcatcatagctacatgaacgccgctggtgtgcccaagcagtctttaaacggcccttacatgaggcgtta

SEQ ID NO: 23285 - DNA, 42 bp, Artificial Sequence
  Description of Artificial Sequence: Synthetic coding sequence
atggtgaagctggccaacccactctacacggaatggatttag

SEQ ID NO: 23286 - DNA, 2448 bp, Artificial Sequence
  Description of Artificial Sequence: Synthetic coding sequence
atggttaaactggctaaccccctttatacagaatggatattggaagctattaagaaggtgaagaaacaaaaacagcgtccatcggaagagcgtatctgcaatgctgtgtcctcttcccacgggctggacagaaaaacagttctggaacagttagaactcagtgtcaaggacggtactattcttaaagtgtcaaacaagggcctgaattcatataaagatcctgacaaccccggacggatagctctgcctaagcccagaaatcacggaaagctagataataagcagaacgtagattggaataagctgatcaaacgagccgttgagggactggctgaatccggtgggtccacattaaaatccattgagcgcttcctcaagggacagaaagacgtgagtgccctgttcggcggttccgctgcttctggattccatcaacaattgcgcctcgctattaagagggcaatcggacacggaaggttgttaaaagacggtcccttgtaccgtctgaatactaaggctaccaatgtcgacggcaaggagtcctgtgaatcgcttagttgtctgccacctgtaagcttgctgccacatgaaaaggataagcccgtcgcggagccaattccaatctgtagcttctgtctaggcacaaaggaacagaacagggagaaaaagcctgaggaactgatctcttgtgcggattgcggaaactccggacacccctcatgcctcaaatttagtccagagctgaccgtcagggtgaaggcgctccgctggcagtgcattgagtgtaagacgtgctcctcctgccgagaccaaggcaaaaatgccgataatatgctcttttgcgactcatgcgataggggctttcacatggaatgctgtgatcctcccctgaccagaatgccaaagggtatgtggatatgccagatctgtagaccacggaagaagggcagaaaattgcttcagaaaaaagccgcacagatcaaaagacgttatactaatccaatcggacgccctaaaaaccgacttaaaaaacagaacacggtgagcaagggaccctttagcaaagtgcgcaccggccctggtcgtggcagaaaacgcaagattacgctgagttcccaatccgcctcttcgtcgtctgaagaaggctacctggagagaatcgacggcctagacttttgtagggattcaaacgtgagtctgaagttcaacaagaagaccaaaggcctgattgatgggctgacaaagtttttcactccatctcctgacgggagaaaggccaggggtgaggtggtagattatagcgagcagtaccggatcaggaagcgcggaaataggaaaagttccacaagtgactggcccacagacaatcaggatgggtgggacggcaaacaggaaaatgaggaacgcctgtttggatcccaggagatcatgaccgagaaagatatggagctgttcagagatatccaggaacaggccttacagaaagtgggggtaacaggccctcccgatccacaagtccgatgcccaagtgttatcgaatttggcaagtacgaaattcatacttggtactcatccccttatccacaggagtatagccgcctacctaaactgtatctgtgtgaattctgtctgaagtacatgaagagccggactatccttcaacagcatatgaaaaaatgcgggtggttccatcctccagccaacgaaatctaccggaaaaacaacatatccgtgttcgaagtagacggcaatgtgagcaccatctactgtcagaacctgtgcctcctggctaagctgttcctcgaccacaagacactgtattatgatgtcgagccctttctgttttacgtcttgacacagaatgatgttaaaggctgccacttagtcggctacttttccaaggaaaagcattgccaacaaaaatacaatgtttcctgtatcatgatcttgccccagtatcagcggaaaggctacggacgttttctaatcgattttagctacctactgtcaaaacgcgaggggcaggcaggcagcccggaaaaaccactgagtgaccttgggagactcagctacatggcctattggaagtcagtgatactcgagtgcctttaccaccagaacgataagcagatctcaatcaagaaactcagtaaactgacaggaatttgtcctcaggatatcacaagcacacttcatcacctcaggatgttagattttcggtctgaccagttcgtaatcattcggcgtgagaagcttatacaggatcatatggcgaagctgcagctgaatctcaggcccgtggacgtggaccccgaatgccttcggtggactccggtgattgtgagcaactccgttgtgtcagaagaggaggaggaggaggctgaagagggcgaaaacgaggagccccagtgccaggagcgggaactagagatctccgtcagagcatag

SEQ ID NO: 23287 - DNA, 1836 bp, Artificial Sequence
  Description of Artificial Sequence: Synthetic coding sequence
atgccccgtaggaaacggaacgccggatccagcagcgacggcactgaagattccgatttctcaacagacctggaacacaccgattcaagtgagtctgacgggacctctcggagaagcgcaagagtgacacggtcttccgcaagattgagccagtcgtctcaggacagcagtcccgtgaggaacctgcaaagttttgggactgaagagcccgcttactctacacgcagggttacccgctcccagcagcagcctacacctgttacccccaagaaatatccccttcgccagacacgctctagcggcagtgaaactgagcaggtggtggatttctcagatcgagagaccaagaacaccgcggaccacgacgagtctccccctcggactcctaccggcaatgctccttcttccgaatccgacatcgacatctcttcacctaacgtatcccacgatgagtcaatagcaaaggacatgagcttgaaggactccggatccgatctgtctcaccgtcccaaacggagaaggttccacgaatcttacaatttcaacatgaaatgtccaaccccgggatgtaattcgttgggccatctgaccggaaaacatgagaggcatttctcgatctctggctgtcccctgtatcacaacctatcagccgatgagtgtaaggttagggcacagagtcgggataaacagatcgaagaaaggatgcttagtcacaggcaggatgataataataggcatgccacccggcatcaggccccaacagagcggcaactacggtacaaggaaaaagtggctgagctacgtaagaaacggaattccggcttgtctaaggaacagaaggagaagtatatggagcaccgtcaaacttacggaaacacccgggagcccctgttagaaaatctcacttccgaatacgacctcgatctgttccgcagagcccaagccagggcctcagaagatctggagaagttaagattgcagggccagatcactgagggcagcaacatgatcaagacaatcgcattcggacgatacgaactagacacatggtaccacagtccctatcccgaagaatatgctaggttggggagactgtacatgtgtgagttttgtttaaaatacatgaagagtcagactattctgcgtcgtcacatggccaaatgtgtttggaagcacccgcctggggatgaaatctaccgtaaaggctctatttctgtcttcgaggtggatggaaaaaagaacaagatttactgccaaaatctttgtctgctagcaaagctcttcctggatcacaagacactgtactacgatgtcgaaccttttttattctacgtcatgacagaagccgacaataccggctgtcacttgatcggttatttttctaaagaaaagaattcatttctgaactataacgtctcatgtatcttgacaatgccacagtacatgcggcagggttacgggaagatgcttatagacttttcctatctgctttcgaaggtggaggagaaggtcggaagtccagaacgtcctctctctgacctaggtcttatttcatacaggtcatactggaaggaggtgctgttacgttacctgcataacttccaaggaaaagagataagtatcaaggagatatctcaagaaaccgctgtcaatcccgtggatatagtctcaacactgcaggcactccaaatgctgaaatactggaaaggtaaacacctggtgctcaaacggcaggatctgatcgatgagtggatagccaaagaggcaaagagaagcaatagtaataaaactatggatccctcttgcctgaaatggacccctccaaaggggacttag

SEQ ID NO: 23288 - DNA, 1746 bp, Artificial Sequence
  Description of Artificial Sequence: Synthetic coding sequence
atgcctcgtagaaaacgcaacgctggcagctcatctgacgggactgaggacagtgatttttcgactgaccttgagcatactgatagcagtgagtccgatgggacttcacgcaggagcgctcgggtgactaggagctccgccaggctctcccaatcgagtcaggacagcagtccagtcagaaaccttcagtcctttggcacagaagaaccagcctactcaacgaggagggtcactcggtcccaacagcaaccgactccagtcacccctaaaaaataccccctcagacaaactagaagctcaggttcggaaactgagcaggtggtagatttctctgacagggaaacgaagaataccgccgaccacgacgagtcaccgcctagaacacccactggcaacgcaccttcttccgagagcgacattgatatatcctcccccaacgtgtcacacgatgaaagcatagctaaggatatgtccctgaaggatagtggaagtgacctgagccataggcctaagaggcggaggttccacgagagctacaattttaatatgaagtgccctacaccgggatgtaattccctagggcacctcacagggaagcacgagagacacttctcaattagcggttgccccttgtaccacaacttaagtgcagacgaatgcaaggccccaacggaacggcagctcagatataaagagaaggtcgccgagcttcgtaagaagagaaacagtggcctgtcaaaagagcagaaggaaaagtacatggagcatcgacaaacgtatggcaataccagagaacccctgctagagaatctaaccagtgagtatgacctggatctgtttcgcagggctcaggccagagcaagtgaagatctcgagaaacttaggttacaaggccagatcacagagggcagcaacatgattaaaaccatcgccttcgggaggtacgagttagatacctggtatcactcaccctaccctgaagagtatgccaggttaggaaggctgtacatgtgtgagttttgtctgaagtatatgaaatcccagactatcctgcgacgtcacatggcgaagtgtgtgtggaagcatccgcctggggacgagatttaccgcaagggtagcataagtgtcttcgaggtggatggaaaaaaaaacaaaatttattgtcaaaacctgtgtttgctcgctaaactctttctggatcataaaaccctatactatgacgtggaaccattccttttctacgtgatgaccgaagctgataataccggatgccacctgataggctatttctctaaggagaaaaactcctttctaaattacaatgtctcatgtattttgaccatgccacagtacatgcgacagggatatggtaaaatgctcattgattttagctacctgctgagtaaagtcgaggagaaagtcggctctcctgaaaggcctctgtctgatcttggcttaatttcatataggagctactggaaagaggtcctgttaagatacctgcataactttcaggggaaggagatttccataaaagagattagtcaggagaccgctgttaacccagtggatatagtgtccaccctgcaggccttgcagatgctgaagtactggaaaggcaaacatctggtgctgaaacggcaggatcttatcgacgaatggatcgctaaggaagctaaacgtagcaacagcaacaaaaccatggatcctagctgtctgaagtggactcctcccaagggaacttag

SEQ ID NO: 23289 - DNA, 1278 bp, Artificial Sequence
  Description of Artificial Sequence: Synthetic coding sequence
atgtccctgaaagactccggatccgatctctcccaccgtcctaagagacgtcgatttcacgaatcgtacaattttaacatgaagtgccccacccctgggtgcaattcactgggacatttaaccggaaagcatgagaggcacttcagtatatccggctgccctctgtaccacaatttgagtgctgatgagtgtaaggcccctactgagcgtcaactgcgctataaggagaaggtggcagagctgagaaagaaaagaaattccggcctctcaaaggaacaaaaagagaagtatatggaacaccgccagacctatggaaatacacgcgaacctctgctggagaacctcacaagtgaatatgacctggatctcttcagacgcgctcaggcaagggccagcgaagacttagaaaagctgagactccaaggccagatcactgaggggtcaaacatgattaaaacaatcgcattcggcaggtacgagctagacacctggtaccactcaccttacccggaagaatacgccagactcgggagactctatatgtgcgaattttgtctgaagtacatgaaaagccaaactatactgcgacggcatatggcgaaatgtgtatggaaacatcccccaggggatgagatttatcggaagggctctatctccgttttcgaggttgatgggaaaaagaacaaaatatattgtcagaacttgtgtctgctcgcaaaattatttctggaccacaaaaccctgtattatgacgtggaaccttttctattctatgtgatgactgaggccgacaacacaggctgccacttaattggctacttcagcaaggaaaagaactcgttcttaaattataatgtgtcatgtattttgaccatgcctcagtatatgagacaggggtacgggaagatgctcattgatttttcctacctgctctccaaagtggaagagaaggtgggctcaccggaacgtcctttaagtgacctgggcttgattagctacagaagctattggaaggaagtgctgctacgctacctgcacaactttcagggtaaggaaatctccattaaagagatctcccaagagacagccgtaaatccagtcgacattgtctcaaccctccaggccctgcaaatgttgaaatattggaaggggaagcacctggtactgaaacgccaggatctcattgatgaatggatcgccaaggaggccaagaggtcgaactcaaataaaactatggaccccagttgtctgaagtggaccccacctaagggcacctag

SEQ ID NO: 23290 - DNA, 1419 bp, Artificial Sequence
  Description of Artificial Sequence: Synthetic coding sequence
atgccgcgacgcaaacgaaacgcagggagttcttcagatggaaccgaagactccgactttagtacagatctggagcacaccgatagctccgaatccgacggaaccagtcgcagatcagccagagtcacgcgctctagcgcaagactgtcccagagctctcagggtcatttaactgggaaacacgaacggcatttctccatttcagggtgtccactctaccataacctgagcgccgatgagtgcaaggttagagcccagtcccgggacaaacagatcgaggagcgcatgctgtctcatcggcaggatgacaataaccgccacgcaaccagacaccaggcgcctaccgagagacagcttcgctataaggaaaaggtggctgagctgaggaaaaagagaaactctggtcttagtaaagagcagaaggagaaatacatggagcataggcagacttatggaaatacccgcgaacctctgttagaaaacctgacgagtgagtatgatcttgacctttttaggagggcacaagcccgagcgagcgaggatctggaaaagcttcgtttgcaagggcaaataaccgaaggctcaaatatgattaagaccatcgcattcggcaggtatgagctggatacatggtaccactccccttacccagaggagtacgcacgcctggggcgactgtacatgtgcgaattctgtttgaagtacatgaagtctcaaacaatactgcgcaggcatatggctaagtgtgtctggaagcacccccctggcgacgaaatctaccgtaagggatctatcagcgtgttcgaggtggacggtaagaagaataaaatatattgtcaaaacctttgcctgctggctaaactgtttctcgatcataaaaccctgtattatgatgtggagccgtttctgttctatgtgatgaccgaggcggataatacagggtgccacctgatcggctatttttcaaaagagaagaacagcttccttaactacaacgtgagctgcattctgacaatgcctcaatatatgcggcaggggtatggtaaaatgctcattgactttagttacctgcttagcaaggtagaagagaaagttggaagccccgaacgacccctgagtgacctaggtctcattagctacagaagctattggaaagaagttcttctgcgctacttacacaactttcagggtaaagaaattagcataaaggagatctctcaggagacagccgtcaatccagtcgacatcgttagcacattacaggccctacagatgctgaagtactggaaggggaaacatctggtgctcaagcgccaggacttgatagatgaatggatagctaaggaggccaaacgatccaactcaaataagaccatggatcctagctgtctgaaatggaccccaccaaaaggaacctag

SEQ ID NO: 23291 - DNA, 1368 bp, Artificial Sequence
  Description of Artificial Sequence: Synthetic coding sequence
atgtccctgaaagactcagggtctgatttgagccatcggcctaagcgacgacgctttcacgagagttataactttaatatgaaatgtcccacacccggatgcaatagcctcggtcacctcactggtaaacacgagagacatttctccatcagtggctgccccctgtatcacaacctctccgccgacgaatgtaaggtcagggcacagtctcgcgataagcagattgaagagagaatgctgagtcatagacaggatgacaataacaggcacgcgacgaggcaccaagccccaactgagaggcagctccgatacaaggagaaagtcgcagagctccgtaaaaagaggaattccggactgtccaaagagcagaaggaaaaatacatggaacaccgtcagacctacgggaatacgcgtgagccactgctagagaacctgactagtgagtacgatctggacctgtttcgacgcgctcaggctcgagcatccgaggatctggagaaactgcgactgcaaggtcagattaccgaggggtccaatatgatcaaaactatagctttcggacggtacgagctggacacttggtaccactccccatatcctgaagagtatgctcgtctgggaaggctgtacatgtgcgagttttgccttaaatatatgaagagtcaaaccatcctccggcgacacatggcaaagtgcgtatggaagcaccctcctggagatgagatctatcggaagggtagtatatcggtgtttgaggtggatgggaagaagaataaaatttactgtcagaatctttgtctgctggccaaattgttcctggaccacaagactctgtactatgatgtggaaccttttctgttctacgtcatgacggaggcagacaacaccggatgccacttgattgggtacttctccaaagaaaagaattccttcctcaactataacgtctcatgcattctcactatgccccaatatatgaggcaggggtatgggaagatgttaatcgacttttcgtatttgcttagcaaggtggaggagaaagttggcagtcccgagcgccctctgtccgatctcggtctgatcagttaccgttcttactggaaagaagtgctgctgcgctatcttcacaactttcaggggaaggagatctccatcaaggaaatatcccaggaaacagctgtgaatcctgtcgacattgtgtccacactgcaggccttacagatgctgaagtactggaaaggcaaacacttggtgttgaaacgccaggatctgatagacgagtggattgctaaagaggccaagcggtctaattctaataaaacaatggatcctagctgtctcaaatggaccccccctaaaggcacctag

SEQ ID NO: 23292 - DNA, 1506 bp, Artificial Sequence
  Description of Artificial Sequence: Synthetic coding sequence
atgcctagaagaaagagaaacgctggctcatccagtgacggaaccgaggacagtgacttctccaccgatttggagcacaccgactcgagcgaaagcgacgggacctctcgtcggtctgcccgagttaccaggtccagtgctcgtctgtctcagtccagtcaggatagctctcccgtgcgaaacctacagtcttttgggaccgaagagcccgcatactcaacgaggcgcgtcacacgcagccagcagcagccgactcctgtgacgcctaagaagtacccgcttcgacagactaggtccagtgggagcgagacggagcaagtcgtggacttcagcgaccgagggcacctcaccggtaaacatgagagacacttttcaattagtggatgccctctgtatcacaacctttcagcggacgaatgcaaggccccaaccgagagacagttgcgctacaaagaaaaagtcgccgaactgcggaaaaaacgaaattctggactttcgaaggaacagaaagaaaagtacatggaacataggcagacgtacgggaacactcgcgagcccctactggagaacctgactagcgagtacgaccttgatttgttccgccgagcacaggcacgtgccagtgaagatctcgagaagttgaggcttcaggggcaaatcactgaaggttccaatatgatcaaaaccatagccttcggacgctatgaactcgatacctggtatcacagcccatatccagaagaatatgcccgacttggccgtctgtacatgtgcgaattttgtctgaagtatatgaaatcccagactattttgcgacggcatatggcaaaatgtgtatggaagcatccacctggcgacgagatctaccgtaaaggttcaatatctgtgtttgaggtcgatgggaagaagaacaagatctactgtcagaatctatgcctcttggccaagctgtttctggaccataagaccttatactatgacgtagaaccattcctgttttacgtgatgacagaggcagataataccggatgtcacctgattgggtacttcagtaaagaaaaaaattccttcctgaactataacgttagctgcatccttaccatgccccagtacatgaggcagggatacggcaagatgttgattgattttagctaccttctgtccaaggtcgaagagaaagtaggctcccctgagcggccactgtctgatctgggcctgattagctatagaagctattggaaggaagtgctcttaagatatctgcataactttcagggtaaagaaatctcgataaaggagatctcacaggagaccgccgttaacccagtggacattgtatcgacactgcaagcattacaaatgttaaaatactggaaaggaaaacaccttgtgctaaaacgacaagacttgatagacgagtggatcgcaaaggaggccaagcgttcgaactcaaacaaaactatggatccttcatgtctgaaatggacaccgcctaaaggtacctag

SEQ ID NO: 23293 - DNA, 1329 bp, Artificial Sequence
  Description of Artificial Sequence: Synthetic coding sequence
atgcctcggagaaagaggaacgccggatccagcagtgacgggacagaagatagcgatttttccacagatctcgagcataccgactcaagtgagtctgatggcacttcccgccgatctgcgcgtgtcactcgctcctccgccagattatcccagagctcgcaggggcatctgacagggaagcacgagaggcattttagcatatccggatgccctctctaccataacctgtccgccgatgagtgcaaggccccaacagaacggcagctgcgctataaggaaaaggtggccgagctgcgcaagaaaagaaattccggattatcaaaggagcagaaagagaagtacatggaacaccggcagacgtacggaaatacccgggagcctctgttagagaacctgacttcagagtacgaccttgacttgttcaggcgtgcccaggcaagagcctcagaagacctcgaaaagctgcgcttgcagggccagatcaccgaaggtagcaacatgattaaaacaattgctttcggtagatacgaactcgacacctggtatcatagcccttatcccgaggaatacgcacggctggggaggctgtacatgtgtgagttctgtttgaaatacatgaagagccagactatcttgcgaagacacatggccaagtgcgtttggaaacacccccctggagatgaaatttatcgaaagggcagcattagtgttttcgaggttgatggaaagaaaaataagatttactgccagaacctctgtctcttggccaaactgttcttagatcataagacgctgtactacgacgtggaaccctttttgttctatgtgatgactgaggccgacaacaccggatgccatctgatcgggtatttttccaaagaaaaaaacagctttttgaattacaatgtttcctgcatcctaacaatgcctcaatacatgagacagggatacgggaagatgctgatcgatttttcataccttctgtctaaggtagaagaaaaagtagggtcccctgaaaggcccctttctgatctagggctgatttcatatcgatcatattggaaggaggtgctcctgcggtacctgcacaactttcaaggcaaagaaatttccattaaggagattagccaagaaactgcggtaaacccagttgacattgtatctaccctgcaagcactccagatgcttaaatattggaagggtaaacacctcgttctgaaaaggcaggatttaatcgacgagtggattgccaaagaggccaagagatccaattccaataagaccatggatccatcctgcctaaaatggacccctcctaaggggacttag

SEQ ID NO: 23294 - DNA, 1239 bp, Artificial Sequence
  Description of Artificial Sequence: Synthetic coding sequence
atgatcctggcctccgtcctgcgtagcgggcctggtggcggactgccactgcgcccacttctgggcccagctttggcactgagggctcgctccacatcggcaaccgacactcatcacgtggaaatggcccgagagcgctctaagacggtcacaagtttttataaccagtcggccattgatgccgcagccgagaagccttccgtgcgccttaccccgaccatgatgctgtatgcgggaaggtcacaggatggctcccacctgctgaaatctgctaggtacctgcagcaggagttaccagtccggattgctcataggatcaaggggttcaggtgcctgcccttcattataggctgtaatccaaccatactgcacgtccacgagctttacatcagagcctttcagaaattgactgacttccccccaattaaggaccaggccgacgaagctcagtattgccagttagtgagacagctcctggatgaccacaaagatgtcgtcaccctactcgccgagggactcagggagagccgcaagcacatcgaggacgaaaagctcgtgcgctactttctcgataagactctgacgagtagactggggatcagaatgttggcaacccaccacctcgctttgcacgaagataaacccgacttcgtgggaataatatgcacccgcttgtctccaaaaaagatcattgagaaatgggttgatttcgcacgcagattatgtgagcacaagtatgggaacgctcctcgcgtccggatcaatggacacgtggccgcacgtttcccatttatccctatgccattggactatattcttcctgagctgctgaagaatgccatgagggccactatggagtctcacctagacactccttataatgtgcccgatgtggtaatcactatagccaataatgacgtcgatttgatcatccggatctcagaccgcggtgggggaattgctcacaaggatctggatcgggttatggactatcacttcactacagctgaagcaagcacccaggatcccagaatcagccccctctttggccacttagatatgcacagcggcgctcagagcggcccaatgcacggatttggcttcggcctgccgacctcaagagcatacgccgaatacctgggcggtagcctacagctgcagtccttgcagggtattggaaccgacgtgtatcttcggctgaggcacatcgacggtagagaggaatcttttaggatctag

SEQ ID NO: 23295 - DNA, 1404 bp, Artificial Sequence
  Description of Artificial Sequence: Synthetic coding sequence
atggccgctcagggagctgcagctgctgttgcagctgggacctcaggtgttgccggagaaggagagcccggtccaggcgagaacgccgctgctgaggggactgcccctagtccaggcagggtctcccctcccactccagccaggggtgaacccgaggtaacagttgaaatcggggaaacctacttgtgccggaggcccgactccacctggcactctgcagaagtaatccagagccgcgtgaatgatcaagagggaagggaggaattctatgtgcattacgtgggctttaataggcgcctggatgagtgggtggacaagaatcgtctggccctcaccaagacagtgaaagacgccgtccaaaagaactcagagaagtatcttagcgaacttgcagagcagcccgagcgaaagatcacgagaaatcagaaacggaagcatgatgagattaaccacgttcagaagacttacgccgagatggaccctactacagctgcccttgaaaaggaacacgaagcgataactaaagttaaatacgtcgataagatccatattggaaattatgagatcgatgcatggtactttagcccgtttcccgaagactatggcaagcagccaaagttgtggctctgtgagtattgcctcaaatacatgaagtacgaaaagtcataccgctttcatctgggtcagtgccaatggaggcagcctccaggaaaagagatttaccgaaagagcaacatttctgtgtacgaggttgacggtaaggatcacaaaatctactgccagaacctgtgtcttctcgcgaaattgtttctcgaccacaaaaccttgtattttgatgtagaacccttcgtgttttacatcctcacagaggtggatagacaaggagcgcacatcgtgggttattttagcaaggagaaagaaagcccagacggcaataacgtcgcgtgcattctgacactacctccgtatcagaggagagggtatgggaagtttttgatcgcattcagttatgaactcagcaagctcgaatcgacggttgggtcaccagagaaacccctatcagatctgggcaaactgtcatataggagctattggagctgggtcctgctggagatcttgagggactttcggggaactctgagcatcaaggatctaagccaaatgacctccattacacagaatgatatcattagcacccttcagtccctgaacatggtgaaatactggaaaggtcagcatgtgatatgcgtcaccccaaaactagtcgaggagcacctcaagagcgcacagtacaagaaacctcctattacgggaggctggggcgctgctgtgtgtcgcggacgctgggggagcgtgagcatttggacaggccgaagtcagggcttactgattgccgtcacttag

SEQ ID NO: 23296 - DNA, 1221 bp, Artificial Sequence
  Description of Artificial Sequence: Synthetic coding sequence
atggctgatggaaacgaggacttgagagccgacgatctgccaggcccagcttttgaaagttacgaatccatggagcttgcttgccccgctgagcgctccggtcacgttgccgtgagcgatggacggcatatgtttgtgtggggcggatacaagagtaatcaagtacgcggactgtacgatttttatttgccccgagaggaactttggatttacaatatggaaacaggaagatggaagaagatcaataccgaaggagacgtgcccccatccatgagtggcagttgcgctgtctgtgtcgatcgggtgctttacctatttggaggtcaccatagcagagggaataccaataaattctatatgcttgatagcagatccacagatcgggtattgcagtgggaaagaattgactgtcagggcatcccacccagttccaaggataaactgggtgtttgggtgtataaaaacaagctgatattcttcggcggatacgggtatctccctgaagataaggtgctgggaacattcgaattcgacgagacctcattttggaactcgagtcatccgaggggctggaatgatcacgtccatatcctggataccgaaacgttcacatggtctcaaccaataactactgggaaggcaccgtccccaagagccgcacatgcctgtgccaccgtcggtaaccgcggatttgtcttcgggggtcgttatagggatgccaggatgaatgatctgcattacctgaatcttgacacctgggagtggaatgagttaattccacaaggcatttgccctgttggcagatcgtggcatagccttacgccagtgagtagtgaccatctgttcctcttcgggggtttcaccactgataagcagcccctcagcgacgcatggacatactgtatatccaagaatgaatggattcagttcaatcacccttacacggaaaagccacgattatggcatactgcatgcgcatccgacgagggagaggtaatcgtattcggcggttgtgcaaataacctcctcgtgcaccatcgagcagctcattctaacgagatactgatcttctcagtgcagcctaaatccctcgtaaggctttctctcgaggctgtaatttgcttcaaagagatgctcgcgaattcctggaactgtctcccaaagcatctgctgcacagtgtgaaccagaggttcggctcaaacaataccagcgggtcctag

SEQ ID NO: 23297 - DNA, 411 bp, Artificial Sequence
  Description of Artificial Sequence: Synthetic coding sequence
atggtcaactcttgttgtgggagtgtttgttccgaccaagggtgtggactagagaactgttgtcgcccaagttgctgccagacaacatgttgtcgcactacatgttgtcgaccttcctgttgcgtttcttcctgctgcagaccccaatgttgtcagagcgtgtgctgtcagcctacatgttgttccccttcttgctgtcaaactacgtgttgccggaccacctgctgcaggccatcttgctgcgtgtcctcctgcttcaggcctcagtgctgccagtctgtctactgccaacccacctgttgtcgcccatcttgcggccagactacctgctgcagaacaacctgttatagaccaagctgctgtgtatctacgtgctgccggccaacctgctcctccggctcttgttgttag

SEQ ID NO: 23298 - DNA, 762 bp, Artificial Sequence
  Description of Artificial Sequence: Synthetic coding sequence
tgctgccaccccagctgttgtcagactacttgctgtaagacggcctgctgctgtcgtagttttctcaccaccgcccctcagaccacatgctgttgcccatcctgtgtagtttcttcatgctgtcgaccttcatgcagccagactacctgttgccagacgacgtgctgtcgtcccagctgttgccatccagtgtgttgtcagacaacctgcaggccatcctgcggcgtaagtagctgctgcagaccgttgtgttgccagaccacctgtcacccttcgtgtggcatgtcttcctgttgcagacccctttgctgccagactacgtgccgtccatcttgcggcgtgagtagttgctgccgtcctctttgttgtcagacgacctgctgccgggctacctgctgcaggcctaactgctgtcgcccaagctgttgtcaaacaacgtgctgtcggacgacatgttgtcgaccatcatgctgcgtctcatcatgttgtcgcccacagtgctgccaatcggtttgctgccagcctacatgttgctcgccatcttgctgtcagaccacatgttgcagaacaacctgttgccggccttcttgctgcgttagctcctgttttagacctcagtgctgtcagtcggtttattgtcaaccaacatgctgcaggccaagttgtggacaaacaacatgctgcaggaccacttgctatcgaccatcctgttgcgtcagtacctgctgtcggccaacctgctccagtggtagttgctgctag

SEQ ID NO: 23299 - DNA, 1332 bp, Artificial Sequence
  Description of Artificial Sequence: Synthetic coding sequence
atgcagaggcgggacgatccagccgcacggatgtccaggtcctcagggcgatcgggcagcatggacccgtctggggctcatccttcagtgcgacagacaccctcccggcaacctccactgccacatcggagcaggggcggaggcggaggatctcggggtggtgccagggccagccctgccacccaacctccccctctgctcccaccaagtgccaccggaccagacgcaacggtaggaggcccagcaccaacaccactcctgcctccctccgccaccgcctcagtcaagatggagccagagaacaagtacctacctgagctcatggcggaaaaagacagcctggacccgagtttcactcatgccatgcagctactgactgccgagattgagaagatccagaagggtgacagcaaaaaggatgacgaggaaaactatctggacctcttctctcataagaacatgaagctgaaggaacgggtcttaataccagtgaaacagtaccctaagtttaattttgtgggcaagatccttggaccccagggaaataccatcaagaggctacaggaagaaacaggggctaagatctctgtccttggcaagggcagcatgcgcgacaaagctaaagaagaggaattgcgaaagggcggagatccaaagtatgcccacctcaacatggacctgcacgtgttcatcgaggtgttcggtccaccctgcgaggcatacgccctcatggcccatgcaatggaagaagtgaaaaagtttttagtgccagatatgatggacgatatctgtcaggaacaattcctcgaactgtcttatctgaacggagtgcccgagccaagccgcggacgaggggtacccgtcagaggccgaggagcagccccacctcctccacccgtgcccaggggaaggggagttggtccaccacgcggagccttggtacggggaactcccgtcaggggtgccatcactcgcggagccacagtgacaaggggcgttcctccaccaccaaccgtgcggggagcgccagcgccaagagcgcgtaccgctggaattcagaggatcccactgccacccccacctgcccctgaaacctatgaagaatacgggtacgatgacacttacgccgagcagagctacgaggggtatgaaggctattattcacagtcgcaaggcgattcagagtactacgactatgggcacggcgaagttcaggacagctatgaggcatacggacaggacgattggaatgggaccaggccctcgctcaaggcccctcctgcccgtccagttaagggagcttatagagagcatccttatggccgttactag

SEQ ID NO: 23300 - DNA, 1260 bp, Artificial Sequence
  Description of Artificial Sequence: Synthetic coding sequence
atgcagagaagggatgacccagccgctcgcatgagcaggtctagcgggcgaagcggttccatggaccccagtggagcacacccaagcgttcgacagacaccatcgcgccaacccccaccaccactactgcctccgtcggccacaggacctgatgccactgtgggaggaccggcaccaacccccctcttacccccaagtgcgacggctagtgtcaaaatggaacctgagaacaagtacctgcctgaactgatggcggaaaaagactcactcgacccttcattcacacatgctatgcaacttctcaccgcggagatcgaaaagattcagaagggagactcaaaaaaagatgatgaggaaaactacctcgacctcttttcacacaagaacatgaagttgaaggagcgcgtgcttatccctgtaaaacagtaccccaagtttaactttgttggaaaaatcctgggacctcaggggaatactatcaagcggctgcaggaagaaactggggcaaagatttcggtgctggggaaaggatccatgcgggacaaagcgaaagaagaagaacttcggaaaggcggagatcctaaatatgcgcaccttaacatggatctccatgtcttcattgaagttttcggtcctccctgtgaagcctacgcactcatggcccatgccatggaagaggttaaaaagtttttggttcccgatatgatggatgacatatgtcaggaacagttccttgagctttcttaccttaatggagttcctgagccatctcggggtcggggagtaccggtgcggggtcgcggtgccgcaccacctcctcccccagtgccgagaggcagaggcgtgggccctcccagaggcgctctggtgcgtggaaccccagtgaggggcgcaatcaccaggggagctacagtgaccaggggggtccccccaccacctactgtgcgaggagccccagcacctcgcgctcggacagctggaatccaacggatccccctgcctcctccacctgctccagagacgtatgaggagtacggatacgatgacacctatgcagagcagtcttacgagggatacgagggctactacagccagtcacagggagattctgagtattacgactacggacacggcgaggtgcaggacagctatgaggcatatgggcaagatgattggaacgggaccagaccctccctcaaggcacctcctgcacgtcccgtgaagggcgcttaccgcgagcacccttacggcaggtactag

SEQ ID NO: 23301 - DNA, 1215 bp, Artificial Sequence
  Description of Artificial Sequence: Synthetic coding sequence
atgcagagacgggacgatccagctgccagaatgagcaggtcttcaggcaggtcgggatccatggacccctcgggcgctcaccctagtgtgcgtcagacaccatcccggcagccacccctgccacacagatcgcgtggcggagggggagggtcacggggaggagccagggcttcacccgctacacagccccctcccttgcttccgccttcggccacaggcccagatgccactgtgggaggccctgcccctacacccctgctgccaccttctgccacagcctcagtaaaaatggagcccgagaacaaatatcttcccgaactcatggccgaaaaggactcgctggaccccagtttcacacacgcaatgcagctgcttacggctgaaatcgagaaaattcagaaaggtgactccaagaaggacgacgaggaaaactacctggatctgtttagtcataaaaatatgaagttgaaagagcgtgtactgatacccgtcaaacagtacccgaaagaagaggagttgaggaaaggaggagacccaaagtacgcgcatctcaatatggaccttcacgtgttcattgaggtcttcggaccaccatgtgaggcatacgccttaatggcccatgccatggaagaagtgaagaaatttctcgtgcccgacatgatggacgacatctgccaggagcaatttctcgaactatcatacctgaatggggtgccagagccatccaggggcaggggagttccagttcgtgggagaggagccgcacctcctcctccaccggtaccccgagggagaggtgtgggcccacctcgaggcgcactggtccggggaacccctgtcaggggtgccatcacacgtggggcaaccgtgacaagaggagtgcctcctcccccaacagtcagaggagccccagcacccagggcccgtacagccggaatccagcggattcccctccctccacctcctgctccggagacctatgaggaatatggctacgatgatacctatgcggagcagtcttacgagggatacgaaggctattacagccagtctcagggcgactccgaatactacgactatggccatggagaggtccaggactcatatgaggcttacggccaagacgactggaacgggacccgtccaagtctcaaggctccccctgcacgccctgttaaaggagcttacagggagcatccatacggaagatactag

SEQ ID NO: 23302 - DNA, 1050 bp, Artificial Sequence
  Description of Artificial Sequence: Synthetic coding sequence
atggaagaagagaagtatctccctgagctgatggccgagaaggattcactggatcccagctttgttcatgcgtccagactgcttgctgaggaaatcgaaaaattccaaggaagcgacggcaaaaaagaggacgaagaaaaaaaatacttagacgtgataagcaataagaacatcaagctgagtgaaagagtattgatacctgtcaaacaataccctaagtttaatttcgtcgggaaactgttgggacctagggggaattctttgaaacggttacaagaagagacaggcgctaagatgtcaatcttgggtaaaggttccatgcgcgacaaggccaaggaggaagagctccgcaaaagcggagaagccaagtatgctcacctgtcagatgagctccacgtgttgatagaagtgtttgcccctccaggcgaagcttattcgcggatgagccatgctctggaggagattaagaagttcttggtacccgactataacgatgagatcaggcaggaacagctccgggagctgagctacctgaacggtagcgaagactcaggccgaggtcgaggaatcagggggagaggaattcgaattgccccaaccgccccaagtcgcggtcgtggaggcgcaatccccccacccccacctccaggcaggggcgtgcttactcctcgcggtagtacagttacaagaggcgcactgccagtgcccccagtagctagaggagttccgacgcccagagccaggggcgctcctacagttccgggatatagagcacctcctcctccagcccacgaagcatatgaagagtacggctacgacgatggatacggaggtgagtatgacgatcaaacatacgagacatacgacaactcctatgccacccagacccagtccgtacccgaatactatgattatgggcacggggtctccgaggacgcttacgatagctacgcacctgaggagtgggccactacacgctcctcactgaaagcaccaccccagcgcagtgctcggggtggctacagggaacatccctatggcaggtattag

SEQ ID NO: 23303 - DNA, 951 bp, Artificial Sequence
  Description of Artificial Sequence: Synthetic coding sequence
atggaagaggagaaatatctgccagaactgatggccgaaaaggactctcttgatccatccttcgtgcacgcctcgcgcttgctggctgaggagattgagaagttccaaggctccgacggaaagaaggaagacgaagagaagaaatacctggatgtaatctccaacaaaaacattaaactctccgaacgggtattgattccagttaagcaataccctaaattcaacttcgtcggcaagctactggggccaagggggaactccttgaaacggcttcaggaggagactggggcaaagatgtccatcctggggaaaggctctatgagagataaagcaaaagaggaggagttaaggaaaagtggggaagctaagtacgcgcatctgagtgacgagctgcatgttctgatcgaagtgttcgcccctccaggcgaggcatacagcagaatgagtcatgccctagaggagatcaagaagttcttagtacctgactataacgacgagatccggcaggagcaactgcgcgaactgtcttatctgaacggaagcgaggactccggaagaggcagaggaatcagaggccgaggtattcgcatcgctccaacagctccatctcgcggtcgcggaggcgctattcctccacctcccccacccggacgcggagtacttactcccaggggcagtaccgtcacaaggggagcccttcccgtccccccagtagccagaggtgtcccaaccccaagagctagaggcgctcctactgtgcccggatacagagctccaccccctcccgctcacgaggcctacgaagagtacccttccctgccactgagcctcttctttgacaccgtggctaaaagtcatcagcactgcgataatgaagtgccacaaacgggctctacgagacttaatcccggacgtagtttcttcctggcgtggagatgggaatgggactag

SEQ ID NO: 23304 - DNA, 1905 bp, Artificial Sequence
  Description of Artificial Sequence: Synthetic coding sequence
atggcctcagctcgcataggcgatgagtatgcggaggattcatcagatgaagaagatatccgaaatactgtcggcaacgtgcctctggaatggtacgacgacttcccgcatgttggctatgatctcgatggcaggagaatctataagcctcttagaacaagagacgagctcgatcagttcctcgataaaatggacgacccagactactggagaaccgtccaggaccctatgactggccgagacttgcggctgactgatgaacaggttgccttggtcagaagacttcagtccggacagttcggggatgtgggctttaacccctacgaacccgctgtggatttttttagcggggacgtgatgatccatccagttactaacagaccagcagacaagcgtagcttcatcccttcattagttgagaaagaaaaagtcagtcgcatggtgcatgccatcaaaatgggctggatccagccaagaagacctcgcgaccccacgcccagtttctatgatctctgggctcaggaagatcccaacgctgtgttgggaaggcataagatgcacgtccccgctccgaagctggccctgcctggtcacgcggaatcttataaccctccacccgaatatctcctgtccgaagaagaaaggttggcctgggagcagcaagaaccaggagagaggaagctgtctttcctgcccaggaagttcccttctctaagagctgtccctgcctatggcaggtttattcaggaacgcttcgagaggtgtctcgacttgtacctgtgcccgaggcagcgcaagatgcgggttaacgtggatccagaggacttgatcccgaaattgcccaggcccagggaccttcagccctttccaacctgtcaggccctcgtatatcgtggtcacagcgacctggtgcgttgtctgtccgtaagtccagggggacagtggctcgtctccggatctgacgacgggagcctcaggctttgggaggttgcgactgcccgatgcgtacgtaccgtaccggtgggcggtgtggtaaagtcagttgcatggaatccttctccagctgtgtgtcttgtggcagctgccgtggaagactccgtgctactacttaatcccgctctaggggaccgactggttgccggtagcaccgaccaactactgtctgcatttgtaccccctgaagaaccccctttgcagcccgctcggtggctggaggcctccgaggaggaacgtcaggtcgggttgcggctgcgcatctgccatggaaaaccagtgactcaagtgacatggcacggcaggggagattacctcgctgtggtgttggctacgcagggacacacgcaggtcctcatccaccagctgtctagacgccgtagtcagtcgcctttccggagatcgcatgggcaagtgcagcgcgtggccttccaccccgctaggccgttcctgcttgtggcctcacagcggtctgtgaggttataccacctgctacgccaggagctgaccaaaaagctgatgccaaactgcaaatgggtcagcagcctcgctgttcatcctgctggagacaatgttatttgtggctcctacgactcaaaactggtgtggttcgacctcgatctgagcactaagccgtacagaatgctgaggcatcataagaaggctcttagggcggtggccttccaccccagatatcccctgtttgccagcggttcagatgatggtagcgtcatagtctgtcacggcatggtttacaatgacctactccaaaatcccctactcgtaccagtgaaggtgctaaaaggacacgtgttaactagggatctcggggtcctggacgtaatctttcatccaacgcagccttgggtgtttagctcaggggctgacggaacagttaggctcttcacctag

SEQ ID NO: 23305 - DNA, 1443 bp, Artificial Sequence
  Description of Artificial Sequence: Synthetic coding sequence
atgctgaacttcggagcgagtctgcagcagaccgccgaagagcgcatggagatgatcagcgagagacccaaggaaagcatgtacagctggaataaaacagcagagaagagcgacttcgaagctgtggaagccctgatgagtatgagctgctcctggaagtctgactttaagaagtatgtggagaaccgacccgttactccagtgagtgacctgtcagaggaagaaaatctgttaccgggaactccagatttccacacgatccccgctttttgccttactcccccttattccccctctgacttcgagccgtcgcaggtgtccaatttgatggcccctgccccttcaacagtgcatttcaaatcgctttcagacaccgccaagccgcatatcgctgcaccttttaaagaagaggaaaaatctcccgtaagtgcccctaaactaccaaaagctcaggctacaagcgtgatccgccatactgcagatgctcagctgtgtaaccatcagacatgtccaatgaaagcagcatcgattctgaattaccagaataactctttcaggaggaggactcatctcaacgtggaggcagcccgaaaaaatataccttgcgcagctgtgtcccccaataggtctaagtgcgagaggaacacggtcgctgacgtggatgagaaggcctctgcagcgttgtacgactttagcgtgccatcctccgagactgtcatctgtaggtcgcagccggctccagtgagcccccagcagaaaagtgtgcttgtgtctcctccggctgtgtcagctgggggtgtgcccccaatgccagttatttgccagatggttcctctgcctgctaataaccctgtcgtgaccaccgttgtaccttcgactcctccatctcagccccctgctgtttgccctcctgtcgtgttcatgggcacccaagtgcctaagggagcagtgatgttcgtcgtgccccaacccgtcgtgcagagttcaaagccccctgtggtctctccaaacgggactcggctaagtccaatcgctccagcccctggtttctctccatccgctgcaaaggtgacaccccaaatcgactcctctcggatcagatcacacatatgctcacaccccggatgcgggaagacctatttcaaatcctcccatctcaaggcacacactcgaactcataccggggagaagcccttctcctgtagctggaagggatgtgaacgtcgctttgccagatccgatgagctgtccaggcaccgtagaactcacacgggagaaaagaaatttgcctgcccgatgtgcgatcggcgatttatgagaagcgatcacctcacaaagcacgccaggaggcacttgtcggctaaaaaactccccaactggcagatggaggtgagtaagctgaacgatatcgcactgccccctactcccgcacccacccagtag

SEQ ID NO: 23306 - DNA, 1410 bp, Artificial Sequence
  Description of Artificial Sequence: Synthetic coding sequence
atggaggagcggatggagatgatttccgagcgcccaaaggagagcatgtactcctggaacaaaacggctgagaagtccgactttgaagcggttgaagctctgatgtcgatgtcatgctcatggaaaagtgattttaagaagtacgtggagaatcggcctgtaacacctgtgagtgatttgagtgaagaggaaaacctgcttccagggactccagatttccacactatccccgcattctgcctgacaccaccctacagtccctccgacttcgagcccagccaggtatccaatttgatggctcctgctcctagcacagtccactttaagagtctcagcgatacagcgaagcctcatattgctgccccttttaaagaggaagagaagtcacccgtgagtgcaccaaaactacccaaagcccaggctaccagcgtcattcgtcatacagcagacgcccaactgtgcaatcaccagacctgtccgatgaaggccgcttccatcctgaactaccagaacaacagtttccgccgacgaacccacctgaacgtggaagcagccaggaaaaacatcccgtgcgcagccgtttcacctaatcgtagcaaatgcgaacgcaacaccgtggccgatgtcgacgaaaaagccagcgccgcattgtatgacttttcagtacccagttccgagaccgtgatctgtcgcagccagcccgctccggtgagtcctcagcaaaagagcgtacttgtgagtcccccagctgtcagtgcgggaggtgtaccgcctatgcctgtgatctgccaaatggtgccgcttcctgccaacaatccagtggtcacaacggttgtacccagtacccctccttcccagcctccagcggtatgtccccctgttgtgtttatgggcactcaggtgcccaagggtgcagtgatgttcgttgtgccacagcctgtggtccaaagcagtaaacctcctgtggttagccctaatggcacaaggctttcgccgattgctcccgctcccggtttcagtccaagcgccgctaaagttactccccagattgactctagccgaatccgatcacacatctgcagccatcccggttgcgggaaaacctacttcaagagtagccatctcaaggcgcacaccagaacgcatactggtgaaaaaccattttcttgctcttggaaggggtgtgagagacggttcgccagatccgacgaactgtcccgccaccgtcgaacacataccggcgagaagaaatttgcatgcccgatgtgcgaccgccgatttatgagaagcgaccatctgaccaagcacgctcggagacacctctctgccaaaaagcttcctaattggcaaatggaagtcagtaagttgaatgacattgcactccctcctactcctgcgcctacacaatag

SEQ ID NO: 23307 - DNA, 972 bp, Artificial Sequence
  Description of Artificial Sequence: Synthetic coding sequence
atgagtgctgccgtggcttgtcttgactactttgccgcagaatgcctggtgtcaatgagtgcaggggctgtggtgcaccggcgtcccccagacccggaaggtgctggcggagcggctggatccgaggtcggagctgctcatcccgaaagcgctctcccaggtccgggaccctccggccctgcctctgtccctcagcttccccaggtgcctgccccatctcccggagcaggaggtgccgcacctcatctgcttgcagcttctgtctgggcagacctgcgagggtctagtggcgaaggctcgtgggagaacagtggagaggcaccgcgagcctcctccggtttttccgatcccattccatgctccgtccaaacaccttgcagtgaactggctccagcctccggcgcagcagccgtgtgcgcaccggaaagctctagcgatgctcctgcggttccatcagccccagccgctcctggggcacccgcagcatcgggcggattctccggtggcgcattgggagctggccctgctcccgcagccgaccaagccccacgcaggcgatctgtgacaccagccgctaaaagacatcagtgtccctttccgggatgtacaaaggcgtattataagagcagtcacctcaagtcccatcaaaggacccacaccggcgagcgccctttctcctgcgattggttggactgcgacaagaaattcaccagaagcgacgagctcgcccgacactataggactcacaccggggagaagcgtttcagttgccctttatgccctaagcagttcagtaggagcgaccatctgactaagcacgcgaggcgacaccccacatatcatccagacatgattgagtatagagggagacggcgaacacctaggatcgatcctcctcttactagcgaagtggaaagctctgcgtccgggtccgggcctggccctgcgccaagcttcacaacatgcctctag

SEQ ID NO: 23308 - DNA, 759 bp, Artificial Sequence
  Description of Artificial Sequence: Synthetic coding sequence
atgagcgctgccgttgcctgcgtggattactttgctgcagacgtgcttatggcaatctccagcggtgcagttgtgcatagaggcagacctgggccagaaggcgcaggtcccgctgctggcctggacgtgcgggcagctagacgggaggccgctagcccaggcactccgggacctcccccacctcccccagctgctagcggacctggaccaggtgcggctgccgcaccacatctgctggccgcatccattctggcggacctgagggggggacccggagcagcccctggaggtgcatcgcctgctagcagttctagtgctgcctcctccccatcatccggacgagcgcctggcgctgctccttcagcagctgctaaatcacatagatgcccgttcccagattgtgccaaggcctactataaaagctcccatctgaagtcccatctcagaacacataccggggaacgccctttcgcctgcgactggcagggctgtgacaagaagttcgctcgctctgatgaactggcgaggcatcaccggactcatacaggtgagaaaagattctcgtgccctttatgttcaaaacgtttcacacgcagcgaccacctggccaagcacgcacgtcgtcatccaggcttccatcccgatttgctgcggcgtcctggggctcgctcgacaagcccttccgattcgttaccttgtagcctggcaggctcccctgccccatcccccgcaccaagtcccgctccagccggactctag

SEQ ID NO: 23309 - DNA, 759 bp, Artificial Sequence
  Description of Artificial Sequence: Synthetic coding sequence
atgtccgccgctgtggcctgtgtggattacttcgctgcagacgtcctgatggccatcagttctggagccgttgtgcaccggggaaggcccggaccagagggagccggaccagctgccggtctcgatgtgagagctgctcggagagaagcagcatctcccggaacacccggaccgccacctccaccccctgccgcatcgggccctggacccggagccgctgcggctccccacctgttggccgcatcaattttagcagatctcagaggcggaccaggggctgccccaggcggagcaagtcctgcatcatcaagctctgcagctagtagcccttcttccggtcgcgcaccaggtgccgctccctctgctgccgcaaagtcacacaggtgccctttcccggattgtgccaaggcctattacaaatccagccacctgaaatcacacctgcggacccataccggcgagcgtccttttgcttgtgattggcagggatgcgataagaagttcgctagatcagacgaacttgctaggcatcacaggacgcacacaggcgagaaaaggttttcgtgtcccctgtgctccaagaggttcaccagatccgatcatctggcaaagcacgcaaggaggcacccaggttttcacccagacttgttgagacggccaggagctcggtccactagtcccagcgattctctgccctgctccctcgctggctcccccgctccctctcctgcgccatcaccggctcctgccggactgtag

SEQ ID NO: 23310 - DNA, 1170 bp, Artificial Sequence
  Description of Artificial Sequence: Synthetic coding sequence
atgtacggacgcccacaggctgagatggaacaggaagctggtgagctatctagatggcaggcggctcaccaggcagcccaggacaacgagaatagcgcaccaatacttaatatgtcttcaagctctggtagtagtggcgtgcacacgtcatggaatcaaggattgccaagtatacagcacttcccgcattctgcagagatgctcggcagccctctggtctccgtggaagcgccaggacaaaatgtcaacgaggggggaccacagttttccatgcctcttccagagcgcggaatgtcctattgtccgcaggcaacactgactccctctcgtatgatatactgccagaggatgagtcctcctcagcaagaaatgaccatattcagtggcccacaacttatgcctgtgggtgaacccaatattccacgcgtcgcccgaccttttgggggtaacctgcgcatgccgccaaatggactccctgtgtctgctagtacagggattccgatcatgtcacatactggcaatcccccagtgccttatccaggcttgtctaccgtaccttcggacgagactttgctgggaccgaccgtgccttccacagaagcccaggccgttctgcccagcatggcacagatgctgccaccgcaggatgctcacgatctcggaatgccccctgccgaaagccaatccctgctggtcttgggcagtcaggattccttggtaagtcagccagattcccaagaggggccatttctgccagaacaaccaggtcctgcaccccaaacggttgaaaagaatagccgccctcaggaaggcactggcaggagagggagcagcgaagcgaggccctattgttgcaattacgaaaactgcgggaaagcctacactaagaggtcccaccttgtgtctcaccagagaaagcataccggagagcggccttactcatgcaactgggaaagctgctcctggagctttttccgctccgatgagttacgtcggcacatgcgtgtgcacactcggtacaggccctataagtgcgaccagtgttcgcgagagttcatgcggtctgaccacctgaaacagcatcagaagacccaccggcctggcccatcggatcctcaggctaacaataacaacggagaacaggactcgccacccgcagccggtccctag

SEQ ID NO: 23311 - DNA, 1038 bp, Artificial Sequence
  Description of Artificial Sequence: Synthetic coding sequence
atgttaatgttcgatcctgtccccgtgaagcaggaggcgatggatcccgtctcagtcagttatccctccaattatatggaatcaatgaagcctaacaagtacggcgtgatctatagtactccacttcccgagaaatttttccagacccccgaaggcctctcccacggaatccagatggagcccgtcgacctgacagtgaacaagaggtcctcccctccgtccgcagggaatagtccttccagtctgaaatttcccagctcgcaccgcagggcctcccctgggctctctatgccgagcagttcccctcctatcaagaagtattcaccaccttccccaggcgtccagccattcggagttccactgagcatgccccctgttatggcagcggctctgtccaggcacggcatccgttcaccaggtatcttgcccgtaattcagcccgtggttgttcagcccgtcccgtttatgtatacgtcccatcttcagcagcctttgatggtaagtctgagcgaggaaatggaaaactcttcctcatctatgcaggtgcctgtaatcgaaagttatgagaaaccgatctctcagaagaagataaaaattgagccaggtattgagccccagcgcacagattattatccagaggagatgagtcctccactcatgaacagcgtatctccacctcaggccttgctccaggagaaccacccttcagtgatagtgcagccagggaaaagaccacttccggttgaatcgcctgatacgcagaggaagagaagaattcaccggtgtgactatgatgggtgtaacaaagtgtataccaaatcctcacatttgaaagcgcaccgtcgcacacacacaggagaaaagccttataaatgcacctgggagggatgcacatggaagtttgcccgtagcgacgagctcacccgccatttccggaaacacaccggaataaaaccttttcagtgccccgattgcgatcggagcttcagtaggagtgaccatctagctctgcatcgcaaaagacacatgcttgtgtag

SEQ ID NO: 23312 - DNA, 1374 bp, Artificial Sequence
  Description of Artificial Sequence: Synthetic coding sequence
atggccacaagggtactaagtatgagcgcgagactgggcccagtgcctcaacctcccgctccgcaggacgagccagtttttgcacaattgaagccagtactaggcgctgctaacccggcacgagatgcagctttatttcccggtgaggagttgaagcacgcccatcatagaccacaggcccagccggctcctgcccaagctcctcagccggcacagcctcctgccaccggacccagattgccaccggaggatttggtacagacccgttgcgaaatggagaagtatttgactcctcagctcccaccagtacctatcattccagagcacaagaagtaccggagggattccgcaagcgtggtcgaccagttttttaccgacacagaggggctaccttacagtatcaatatgaacgtgttcttgccagatattactcacctaagaaccggcttgtacaagtctcagaggccctgtgtgacacacattaagacagagccagtggccatcttttcacaccagtctgaaactacagcacctcccccagctcccactcaggctttgcctgagttcacaagtatcttctcatctcatcagaccgccgctcccgaggtcaataacattttcatcaaacaggagttacctacgccggatcttcacctgtccgtcccaactcagcaaggacacctgtatcagcttctgaacacgcctgacctggacatgccatctagcactaatcagactgccgctatggatacgctcaatgtgtccatgagtgccgcaatggccggactgaatacccatacttctgctgtacctcagaccgctgtgaaacaattccaaggcatgcctccctgcacatatactatgcccagccaatttctcccccagcaagctacctactttccaccatcgcccccttcatcggagccgggatctccagatcggcaagccgagatgctgcagaacttaactcccccaccctcatatgccgcaaccatcgccagcaaactcgcaatacacaatccaaatcttcctacgacgttgccagtgaattcccagaacattcagcccgttaggtacaataggaggagtaatccagacctggaaaaacggaggattcactattgtgactaccccggatgtaccaaggtttataccaagtcctcccacttaaaggcccaccttaggacacacactggtgaaaagccgtacaagtgcacttgggagggttgcgattggaggtttgccagatccgacgaactgaccagacactatcgcaaacacaccggagccaaaccttttcaatgtggcgtttgtaataggtctttttccagaagcgatcatctggcgctgcatatgaagcgacaccaaaattag

SEQ ID NO: 23313 - DNA, 1101 bp, Artificial Sequence
  Description of Artificial Sequence: Synthetic coding sequence
atggagaaatacctgacccctcagcttccaccagtgcctatcattccggagcataaaaagtatcgaagggattcggcctctgtagtcgaccagttttttactgacacggagggattgccgtactcgatcaatatgaacgtctttcttccagatatcactcatctgcggaccggactgtacaaaagtcagcgtccttgcgtgacacatatcaagactgaacctgtcgctatcttctctcaccagtcagagaccacagcgccacctccagctcccactcaggcactccctgaattcacttctatattctcatcgcaccagacagcagcacctgaggtcaacaatatcttcattaaacaggaactgccaaccccagatctacatttgtcagtgcccacccagcaagggcacctctatcagcttcttaatacccctgatctggacatgccctcttctactaatcagaccgcagcaatggatactctaaacgtgtcaatgtctgccgctatggccggactcaacactcacacgagcgccgttccccagaccgccgtgaaacagtttcaggggatgcccccttgtacttacaccatgccgtcccagttcctcccccagcaagccacctacttcccacccagccccccttcaagcgaacccggttcccccgataggcaggcggagatgttgcaaaatttgacccctcctccatcatatgctgctactatcgccagcaagcttgcgatacacaaccccaacttacctaccaccctgccggttaactcccaaaacatccagcccgtccgctataatcggcgtagcaaccctgacctcgaaaagagaagaatccattactgtgactaccccggatgtactaaagtctacaccaaatcatctcacctcaaggctcacttaaggacgcacactggtgagaaaccctacaaatgtacatgggaggggtgcgactggagatttgctcggagcgacgagttgacccggcactacaggaagcacactggagcaaaacctttccagtgtggcgtgtgcaaccgttctttctctcggtcagatcatctggccctgcatatgaaacggcatcagaattag

SEQ ID NO: 23314 - DNA, 1314 bp, Artificial Sequence
  Description of Artificial Sequence: Synthetic coding sequence
atggccacaagagttctttcaatgagcgctagactgggacccgtaccacagccacccgcaccccaggatgagccggttttcgctcagctcaaaccagttctgggcgctgctaatcccgctagggacgccgcactattccccggtgaggaactgaaacatgctcatcacaggcccaggcttccgcctgaagacttggtgcagactcgctgcgaaatggaaaaatatttgactccccaactccctcctgttcccattattcccgaacataagaaataccgtcgcgactcagccagcgtggtggatcaattcttcacagacactgaaggactcccttattccataaatatgaatgtatttctgcccgacatcacccaccttcggacaggcctctataaaagccaacggccatgtgtgacccacataaaaaccgaaccagttgctattttctctcatcagtccgagacaaccgccccaccacctgcccctactcaagctttgcctgagtttactagcatatttagttctcaccagaccgccgcacccgaggtgaacaatatattcataaaacaggagctaccaacaccagatcttcacctcagcgtgccgacccagcaagggcatctctaccagctccttaacacccctgacctggacatgccttcgtcaaccaatcagacagcagcaatggatactctcaatgtgtccatgtccgccgctatggccggtctcaatacacatacctccgctgttcctcagaccgctgtgaagcaatttcagggtatgcctccttgtacatacaccatgcccagccagttcctcccccagcaggcaacatattttccaccaagtccaccatccagtgaacccggaagccctgataggcaagcggaaatgctccaaaatctcacacccccacccagctatgcagcaaccattgccagcaaactagcgattcataacccaaacctcccgaccacattaccagtcaattctcagaatatacagcctgttcggtacaataggcgaagtaacccagacctggagaaacgtagaatccactactgtgactaccctgggtgcaccaaggtttatactaagagttcacatttgaaagcacatctcagaacacacactggagaaaagccttataagtgcacttgggaggggtgcgactggaggttcgctcgaagcgacgagctgacaaggcactacaggaaacacacaggagctaaaccattccagtgcggggtgtgtaatcgaagcttcagcagatccgatcacctcgccctccatatgaagaggcaccaaaattag

SEQ ID NO: 23315 - DNA, 735 bp, Artificial Sequence
  Description of Artificial Sequence: Synthetic coding sequence
atgagtgcggctgcatacatggattttgttgctgctcagtgtctggtgtcaatttctaaccgagctgcagtgccggaacatggcgtggctcctgacgccgaaagactacgtctcccagagcgcgaagtaaccaaagagcacggggacccgggtgatacgtggaaggactactgcacactcgtgactatagccaaatctttactcgatctcaataagtaccggccaatccagaccccatctgtatgctccgattcgttggaaagtccagatgaggatatgggctccgacagtgacgtgacaaccgagtccggaagttcacccagccactctcccgaggaaagacaagacccgggtagcgccccatctccgctgagcttgttacacccaggagttgcagctaagggaaaacacgcctcagaaaagagacataagtgcccctattcaggctgtggtaaagtgtacggcaaatccagccatctgaaagcacattatcgagtacacacaggcgagagacctttcccttgcacctggcccgattgtcttaagaagttcagtcgatccgatgaattgactaggcactatagaactcataccggggagaaacaattcagatgccccctgtgcgagaaacgcttcatgagatcggatcacctgacaaagcacgctagacgccacacggaatttcatccctcgatgatcaaacgctctaaaaaggccctagcgaatgcgctctag

SEQ ID NO: 23316 - DNA, 2343 bp, Artificial Sequence
  Description of Artificial Sequence: Synthetic coding sequence
atgacagagagtgccagttccacatccggacaggaattcgatgtgttctcggtcatggactggaaagacggcgtggggaccctccctggttcagatctcaagtttagagtgaacgagttcggggctctcgaagtcattacagacgagaatgagatggaaaatgtcaaaaaagccacggccacgacaacctggatggtgcctacggctcaagaagctcccacttcaccaccgagcagccggccagttttcccccctgcctactggacatcccccccaggctgccccaccgtgtttagtgaaaagaccggcatgccctttagacttaaagacccagtaaaagtggagggtttacagttttgtgaaaactgttgtcaatatggtaacgtggatgaatgtctttcaggaggaaattactgcagtcagaattgtgctaggcatattaaggacaaagatcagaaggaagagagagatgtggaggaggacaacgaggaagaggacccaaaatgtagcaggaaaaagaaaccgaaactctctttgaaggcagacaccaaggaagatggggaagagagagacgacgaaatggagaataagcaggacgtgcggatcttgagaggctcccagcgcgcaaggcgtaaaagaaggggagacagcgccgtactaaaacagggattgcccccaaaggggaagaaggcatggtgttgggcctcctacctcgaagaggagaaagccgtcgctgtccccgcaaagctatttaaggaacaccagtcgttcccatataacaagaacggatttaaagtagggatgaagttggaaggtgtggatcccgagcatcagtccgtgtactgtgtactcacagtcgcagaagtttgcggctatcggatcaaactgcatttcgatggttacagtgattgttacgatttctgggttaatgccgacgctcttgatattcacccggtcggttggtgcgagaagacaggacacaagcttcatccaccaaaagggtacaaggaggaagagttcaattggcagacatatctcaagacctgcaaagctcaggccgcaccaaaatcattgttcgagaaccagaacataaccgtgatcccttcaggattcagggtgggaatgaagcttgaagccgtcgacaagaagaacccatcatttatttgtgtggctactgtcaccgacatggtcgataaccgcttcctagtgcatttcgataattgggatgagtcctacgattactggtgcgaggccagctccccacacatccatcccgtgggatggtgtaaggaacacaggcggacattgatcactccacctggatacccaaacgtcaaacacttctcttgggacaagtacttagaagaaaccaattccttacccgcacctgcaagggcttttaaggttaagccgccacatggttttcagaaaaagatgaaactcgaagtcgtggataaacgcaatcccatgtttatccgcgtggcgacagtcgcggacaccgacgaccatcgggtcaaggtccactttgacggttggaacaattgttacgactactggattgatgctgattctcctgatatccatccggtgggatggtgctccaagacagggcatcctctccagccacccctgagccccctcgagctgatggaggcctctgaacacggcggatgctcgactcccggatgcaaaggaattgggcacttcaagagggctcggcatcttgggccacactctgccgcaaactgcccgtacagcgagatcaatctgaacaaggaccgaatattccccgatcgtctgtctggggagatgccccctgctagtccttctttcccaagaaacaagcgaaccgatgccaatgagagctcctcctcccctgagattcgcgatcagcacgcagacgacgtgaaagaggactttgaggaaaggaccgaatccgaaatgcgcacttcccacgaagccaggggggctcgcgaggaaccgaccgtacagcaggcccagagacgcagcgcagtgttcctgtctttcaaatcccccatcccatgcctgccactgcggtgggagcagcagtccaaattactcccgacggtagcaggcattccggctagcaaggtgtctaagtggagcaccgatgaggtgagtgagttcatccagtccctccccggttgtgaggaacacggcaaggtctttaaagatgaacagattgacggagaagcatttctcttgatgacccagacggatattgtcaagattatgtccattaagctgggcccagctttgaagatcttcaacagcattttaatgtttaaggctgccgagaagaattcgcataacgagctgtag

SEQ ID NO: 23317 - DNA, 2343 bp, Artificial Sequence
  Description of Artificial Sequence: Synthetic coding sequence
atgacggaaagtgcgtccagtacttctggccaggagtttgacgtgtttagtgtaatggattggaaggatggagttggcaccttgcccggatcagatttgaaatttagagtgaatgaatttggggctttggaagttattaccgacgagaatgagatggaaaatgtgaagaaagccacggcgacgactacttggatggtcccaaccgctcaggaggcccctacgtctccacccagctctcgacctgtatttcctccagcttattggacatctcccccaggatgccctacagtcttctcagagaaaaccggaatgccttttagactgaaggatcccgtgaaagtcgaaggactgcagttctgtgaaaactgttgccaatacggcaacgtggatgaatgtctgtcaggagggaactattgtagtcagaattgtgctaggcatatcaaggacaaggatcaaaaagaagagcgcgatgtcgaagaggataatgaagaggaagatccaaagtgttctaggaagaagaaacccaagctgagcttgaaagctgacaccaaggaggacggcgaggagcgagacgacgagatggaaaacaaacaggacgtgcgtatcctgagaggatcccaacgtgcgagacgcaaacgtcgcggtgattctgcagtgctgaagcaaggactcccacccaaaggcaaaaaggcctggtgttgggctagttacctggaagaagaaaaggccgtcgcggtgcctgctaagctattcaaggagcaccagagctttccctacaacaaaaacggtttcaaggttggaatgaaactggaaggtgtggatccagagcaccagagcgtgtactgcgtgctcaccgtcgcagaggtgtgcggttatagaatcaagttacacttcgacgggtattccgattgctatgatttttgggtgaatgcagacgccctggatattcatcctgtcgggtggtgcgaaaagactggccacaaactccaccctcccaaaggttacaaggaagaagaattcaactggcagacttacctgaaaacttgcaaggcccaagccgcacccaaaagcctgtttgaaaatcagaatattacggtgataccatctggttttcgtgtcgggatgaaactggaggctgtggataaaaagaacccttcttttatctgtgtcgcaaccgtcactgatatggttgacaaccgctttctggtgcacttcgacaactgggacgagagctatgattattggtgcgaggcttcctcccctcatatccaccctgtggggtggtgcaaagaacatcgacgcactctcattacaccgccagggtaccccaatgtgaaacacttcagctgggataaatacctggaggagaccaatagtctgccagccccagcacgcgcattcaaagtaaaaccacctcacggatttcaaaaaaaaatgaagcttgaagtcgtggataaaagaaaccctatgttcatacgcgttgccaccgtggcggatacggacgatcatagggtgaaagttcacttcgatgggtggaacaactgctacgactactggatcgatgccgacagtcctgatatccatccagtgggctggtgctctaagacaggtcaccccctgcagccccctctgagccctttggagctaatggaggcgtctgagcacgggggttgctcaacacccggttgtaagggcatcggtcacttcaaaagagcacgacacctgggacctcatagtgccgctaactgcccttactcagagattaacctgaacaaggatagaatctttcctgatcggctgtccggcgagatgccgcctgcatcccctagctttcctcgaaacaagaggacagatgcaaacgaaagctcctcttctcctgagattcgcgatcagcatgcagatgacgtgaaggaggacttcgaagaaaggacagaaagtgagatgaggacgtcacacgaagcgagaggagctagggaggagcctactgtccagcaggctcagcgcaggtcggctgtattcctttcttttaaaagtcccattccgtgcctacccttgcgctgggagcagcagtcgaaactgctgcccacagtggcagggatacctgcatccaaggtaagcaaatggagcacggatgaagtctctgaattcattcaatctctgcctggttgtgaggagcacgggaaagtttttaaggacgagcagatagatggcgaggcctttttgctgatgacgcagacggacattgtcaaaatcatgtccatcaaactgggacctgccctcaagatctttaattctatacttatgtttaaggctgcagaaaagaacagccacaatgagctctag

SEQ ID NO: 23318 - DNA, 2268 bp, Artificial Sequence
  Description of Artificial Sequence: Synthetic coding sequence
atgaccgagtctgcaagctccacctccggccaggaatttgatgtgttctctgtgatggactggaaggacggggtgggcaccttgcccggatccgatcttaagtttagagtgaatgagttcggggctctggaagtcatcacagatgaaaacgaaatggagaacgtcaaaaaagcaacggccacgaccacctggatggtgcccaccgcccaagaggtcttcagtgagaagacaggtatgcccttcagattgaaggatcccgtgaaagtcgaggggctgcagttctgtgaaaattgttgccagtacggaaatgttgacgagtgcctctcaggtgggaactattgtagccagaactgtgctcgccacatcaaggacaaggaccagaaagaagaacgggatgtggaggaagacaatgaagaagaagatcccaagtgttctcgtaaaaagaagcctaaactatctttaaaagccgatacaaaggaagatggggaagagcgagatgacgaaatggaaaacaaacaagatgttagaatcttgcgaggtagccagcgggctcgcaggaagagaaggggggactctgccgtcctcaaacaaggacttcctcccaaagggaagaaagcttggtgctgggcgtcctacttggaggaggagaaagccgtggccgtgccggctaagttatttaaggaacaccagagcttcccctacaataagaatggctttaaagtgggaatgaaactggagggggtggatcctgaacatcagagcgtgtactgcgttctgacggtggctgaggtgtgtggttacaggattaagctgcactttgatggatattcagactgttacgatttttgggtcaacgcagacgcgttagatatccaccccgttgggtggtgtgaaaaaacaggacacaaactccaccctcccaaggggtataaagaggaggagtttaactggcagacctatctaaagacttgtaaagcacaggcagcaccaaaaagcctgttcgagaatcagaatatcaccgttatccccagcggttttagagtaggtatgaagcttgaggctgtggacaagaaaaatccttcttttatatgcgtggccacagttacagacatggtggataatagatttctcgttcattttgacaactgggatgagagctatgactattggtgtgaagccagttcacctcacatccaccctgttggttggtgtaaagaacatcggcgaacacttatcacgcctccagggtatccgaatgtgaaacacttttcttgggataagtatcttgaggagactaattctctgccggctcccgctcgagcctttaaggttaagcccccacacggcttccaaaaaaaaatgaagttagaggtcgtcgacaagagaaatcccatgttcatccgcgttgccaccgtggccgacacagatgatcaccgcgtcaaagttcatttcgacggctggaacaactgttatgactattggattgatgccgacagtccggatatccacccggttggttggtgttctaagaccggtcaccctctgcagcccccactctcccctttagagttaatggaagcgtcagaacatgggggatgcagcactcctgggtgtaagggaataggtcatttcaaacgcgcaaggcacctcggcccacattcagctgcgaattgtccgtacagtgaaattaaccttaacaaagatagaatattcccggataggctgagcggtgagatgccccctgcttccccgagcttcccacgcaataagcgcaccgatgccaatgaatcctcttcctcaccggaaattagggatcagcacgccgacgatgtaaaagaggactttgaagagaggaccgaaagcgaaatgaggactagccatgaagcacggggtgcccgagaagagccaactgtgcagcaggcccagagacgctccgcagtattcctgagcttcaaatcccccattccgtgcctccccctccggtgggaacagcaatctaagttgctccccacagtggccggaattcccgcttctaaggtctccaaatggtcaacagacgaggtgtctgagttcatacagtccttgccgggttgtgaggaacacggaaaagtgtttaaggatgaacagatcgacggagaggcattcctgttgatgactcagacagacatcgtgaaaattatgtcaatcaagctcggccctgcccttaaaatttttaattccatcctgatgttcaaggcagcagagaagaatagccacaatgagctctag

SEQ ID NO: 23319 - DNA, 2268 bp, Artificial Sequence
  Description of Artificial Sequence: Synthetic coding sequence
atgaccgaatctgcctcaagtacaagcggacaggagtttgacgtgtttagcgtcatggactggaaggatggagtggggacacttccgggaagcgacctaaaatttcgcgtgaatgaattcggggctctggaggttataactgatgaaaatgaaatggaaaatgtgaagaaggcaaccgccactaccacctggatggtgccgacagctcaagaggtgttctcggagaaaaccggtatgccctttcgcctgaaggacccggtgaaagtggaggggctgcaattctgcgagaactgctgtcaatacggaaatgtggacgagtgtctctccgggggaaactattgttctcaaaactgtgccaggcacattaaagacaaagatcaaaaggaggagcgggatgtagaagaagataatgaagaggaagaccctaagtgttcccggaagaaaaagccaaagctgtcattgaaggcagacactaaggaagacggagaagaacgcgatgatgagatggaaaacaagcaggacgtgagaatccttaggggctctcaaagggccaggcgcaagcgtcgtggcgattcagccgtgctcaagcagggtctgccacctaaggggaaaaaagcgtggtgctgggctagctacttggaggaggagaaagctgtagctgttcctgccaaactgtttaaagagcaccagtctttcccctataacaagaatggcttcaaagtcgggatgaagctggagggcgtggaccctgagcatcagtcagtgtattgcgttctcactgtcgctgaggtgtgtgggtatcgaatcaagctacacttcgacggctacagtgactgctacgatttttgggtgaacgcagacgccttggatatacaccctgttggctggtgtgagaaaaccggacataaactccatccaccaaaggggtataaagaagaagaattcaactggcagacctacttaaagacctgcaaagcccaggcagcacccaagagtctgtttgagaatcagaacattaccgttataccctcaggctttcgcgtgggtatgaaactggaggcagtggacaaaaaaaatccctcctttatttgtgttgcaaccgtcaccgacatggtagataatagattcctggtgcattttgacaactgggatgaaagctacgactactggtgcgaggctagttctcctcacatccaccctgtgggatggtgcaaagaacaccgtcggactttaatcacacccccagggtaccctaacgtcaagcacttctcgtgggacaagtatctcgaggagactaattcactgcctgcgccagccagggccttcaaggtgaaaccccctcacgggttccagaagaagatgaagctcgaggtcgtcgataagaggaaccctatgttcataagggtagcaaccgtggccgacacagatgatcatcgcgtcaaagtgcatttcgacggctggaacaattgttatgattattggatcgatgccgactcccctgatatccacccagttggatggtgcagtaagactggccatcccctgcagccaccactttccccattggagcttatggaggcatctgaacatgggggttgttcgacgccaggttgcaaaggtattgggcacttcaaaagggctcggcacctaggaccgcacagtgcagccaactgcccttattcagaaattaatctgaataaagatagaatcttccctgacagactgtctggtgaaatgcctcctgctagcccaagttttccaaggaataaaaggaccgacgcaaatgaaagcagcagctctcctgagatcagggatcagcacgcagacgacgttaaagaggacttcgaggagagaaccgaaagcgagatgcgcacatcccacgaagccaggggcgcacgggaggaaccgaccgtgcagcaggcacaacggagatctgcggtttttctatcatttaaaagcccaatcccttgtttacctcttagatgggagcagcagagtaaactcctgcccacagtagcagggataccagcaagcaaggtgagcaagtggagcaccgacgaggttagcgaatttattcaaagtctgcctggttgtgaagaacatgggaaagttttcaaggatgaacagatcgatggcgaggcttttctattgatgacccagactgatatcgttaaaatcatgtctatcaagttgggcccagctctgaaaattttcaacagtattctgatgttcaaagctgctgaaaagaattcacataacgaactgtag

SEQ ID NO: 23320 - DNA, 573 bp, Artificial Sequence
  Description of Artificial Sequence: Synthetic coding sequence
atgacagagtcggcctcaagcacatcgggacaagagttcgatgtgttctccgtaatggattggaaggacggtgtgggaaccctaccaggaagcgatctcaaattcagggtcaatgagtttggggcactggaagtgatcacggatgaaaatgagatggaaaatgtgaaaaaagcaaccgccactactacatggatggtgccaaccgctcaggaggctccgacctctcctcccagttctagacctgtcttcccgccagcttattggacctccccccctgggtgcccaactgtgttttccgaaaaaacaggcatgcctttcagattgaaggacccggtgaaggtggagggcctccagttctgtgagaattgctgccagtacggcaatgtggatgagtgcctttctgggggaaattattgcagccagaattgcgcaaggcacatcaaagataaagaccagaaggaagaacgagacgtagaggaggacaatgaggaagaagacccaaagtgcagtcgaaagaagaaacccaagctcagcctgaaagcagacacaaaagaagacggggaagagagatag

SEQ ID NO: 23321 - DNA, 2343 bp, Artificial Sequence
  Description of Artificial Sequence: Synthetic coding sequence
atgaccgagagtgcgtcatccacctcaggacaggaattcgacgtgttctccgtaatggactggaaggacggagtaggcactctgcctggctccgatctgaaatttagagtcaatgagtttggggctttggaagttataacagatgaaaacgagatggagaacgtcaaaaaagccactgctactaccacatggatggtgcctaccgctcaggaagctcccacttcccctccctcatccagaccagtttttcctcctgcgtattggacgtcccctccaggatgcccgactgtgttcagtgaaaagacaggtatgccttttcgtttaaaggacccggttaaagtggagggcctgcaattctgcgaaaactgttgtcaatacggaaatgtggatgagtgccttagcggcggaaattattgctctcagaattgtgcaagacatataaaagataaagatcagaaggaggaacgggacgtggaggaagataatgaggaagaggacccgaaatgtagccgcaaaaagaaacctaaactgagcctgaaagcagatacgaaagaagatggcgaagagcgcgatgacgagatggaaaataagcaagacgtgagaatcctgagaggatcccagagagcccgacgtaagcgtagaggagactctgcagttctcaagcagggtctgccccctaagggcaagaaagcctggtgctgggcatcttatttagaggaggaaaaggcggttgcagtccccgcaaaattgttcaaggagcaccagtcttttccatataataaaaacgggtttaaagtgggaatgaaactcgagggggtggaccccgaacaccaaagcgtctactgcgtcctgacggttgcggaggtttgtgggtatcgaatcaaattgcactttgacggctattcagactgctatgacttctgggttaatgctgacgcattagatattcatcctgtgggttggtgtgagaagacaggccacaaattacacccgcctaaggggtacaaagaggaagaattcaattggcagacttacctaaagacctgcaaggcccaggccgctccaaagtccctgtttgaaaaccagaacattactgtcattccctcaggattccgggttggtatgaaattggaggccgtggacaagaagaaccccagttttatctgtgtcgcaacggtgactgatatggtagacaacagattcctggtacattttgacaattgggacgaatcctatgattactggtgcgaggcatcatcccctcacatccacccagttggatggtgcaaagagcaccggcgaacattaatcaccccacccggttatccgaatgtaaagcattttagctgggataaatacttggaggagacgaattctctgcctgcccctgcgagagcttttaaggtcaaacctccccacgggttccaaaagaaaatgaaattggaagtggtggacaagcggaacccgatgtttatccgggtggctaccgtggcagacacggacgatcatcgggtgaaggtccacttcgacgggtggaacaactgctacgattactggatcgacgccgatagtcctgatatacatccagttggctggtgttcgaaaacaggtcacccactccagcctccccttagtcccctggagctaatggaagccagcgagcatggcggatgctcaacaccgggatgtaagggcatcggacatttcaagagggctagacacttgggccctcattccgccgcaaattgtccttactcagagattaacctgaacaaagacagaatttttccagaccggctgtccggcgaaatgccccctgcttcaccttctttcccacgcaataaacggactgatgcgaacgagtctagttctagccctgaaatcagagatcagcacgcagatgatgtgaaggaggacttcgaagaacgaaccgagtccgagatgcggacaagccatgaagctcggggagccagagaagagcctacagtgcagcaggctcagagacggagtgccgtcttcctgtccttcaagagcccaatcccctgtctcccgctgcgttgggaacagcagagcaaattgctgccaaccgttgctgggatccctgcatcaaaagtttctaagtggtctacggatgaagtgagcgagtttattcagtccctaccagggtgcgaagaacacgggaaggttttcaaggatgagcagattgacggagaggcattcctgctgatgacacaaaccgacattgtaaagatcatgagcattaaattaggccctgccctgaaaatttttaattcaattttaatgttcaaggccgctgaaaagaattcccataacgagctctag

SEQ ID NO: 23322 - DNA, 2268 bp, Artificial Sequence
  Description of Artificial Sequence: Synthetic coding sequence
atgactgagagcgcctcctccactagtgggcaggaattcgatgtgttttccgtgatggattggaaggatggagtgggcactctgcctggctcagacctcaaattcagggtgaatgaattcggggcactggaggtcatcaccgacgaaaatgaaatggaaaatgtgaagaaggcgaccgcaacaacaacatggatggtccctactgcccaagaggtgttcagcgagaagaccggaatgcccttccgcctaaaagatcctgtcaaagtcgaaggattacagttttgcgagaactgttgccagtacggcaatgttgacgaatgcctgtccggaggaaactactgtagccagaattgcgcaagacacattaaagacaaagaccagaaggaagaacgcgatgtggaagaagacaatgaggaagaggaccctaagtgttcaaggaaaaagaagccaaagctatctctaaaggcagatacaaaggaggatggagaagaacgggacgatgagatggaaaataagcaagatgttcgcatactccggggaagtcaaagagcacggaggaagaggcgcggagattcagccgttcttaagcaaggactccccccaaagggtaagaaagcctggtgttgggcaagctatctcgaagaagaaaaagcagtagccgtgcctgcaaaactgttcaaagaacaccagtcctttccttacaataagaacggtttcaaagtgggcatgaaactggagggggtggaccccgaacatcaatctgtgtattgcgtacttactgtcgcggaggtgtgtggctatagaattaaactccattttgatgggtactctgactgttatgacttctgggtcaatgcagatgccctagatatccatcccgtgggctggtgcgaaaaaacaggacataagctgcacccccctaaggggtacaaagaagaagaattcaactggcagacctatctgaagacttgtaaggcccaggctgcaccgaagtcattattcgaaaaccagaatattaccgtcattccttctggttttagagtcggcatgaaactagaagcagtggataaaaagaatccatcgttcatttgtgtggctaccgtgaccgatatggtcgacaaccggttcttggtgcatttcgacaactgggacgaatcctacgactactggtgtgaagcaagttcccctcacatacatccagtaggatggtgtaaagaacatagacgaactctgatcacaccaccgggttatcccaacgtgaaacatttttcctgggataagtacttggaagaaacaaatagcctgcccgcacctgcaagggcctttaaggtgaagccacctcacggttttcagaagaaaatgaagctggaggtggtcgacaagcgaaacccaatgtttatcagagtggccacagtggctgacacagatgaccaccgtgtgaaagtgcacttcgatggctggaataactgctacgattactggatagacgcagacagcccggatattcatcccgtcgggtggtgtagtaagaccggtcaccctctgcagccccctctgagtcccctggagctgatggaagcctcggaacacggcggatgctccacccctggatgcaagggaatcggtcactttaaacgcgcacgccacttaggtccgcattctgcagcaaactgtccatacagcgaaattaacctgaataaggacagaatctttccggatcgactatctggggaaatgccccctgcgagtcccagttttcctcggaacaaaaggaccgacgctaatgaaagctcctcttcaccagaaatcagagaccagcatgccgacgacgtgaaggaggactttgaggagcggactgagagcgagatgcgcacctcccatgaagctaggggggctagagaggagccgaccgtccagcaagcacagcgacggtcagccgtttttttgtcatttaagagccccatcccttgtctcccgctgaggtgggagcagcaatctaaacttcttcccacagtcgcgggaatcccagcctcaaaggtgtcgaagtggtccactgatgaagtgtctgagtttattcagtccctgcctgggtgcgaagaacatggcaaggttttcaaggacgaacagattgacggcgaggcctttctgctgatgacgcaaaccgacatcgttaaaatcatgagcatcaaacttggccctgccttgaaaatctttaacagcattctcatgtttaaggccgctgagaagaatagccataatgaactgtag

SEQ ID NO: 23323 - DNA, 1872 bp, Artificial Sequence
  Description of Artificial Sequence: Synthetic coding sequence
atgaagcagcctaatcggaagcgaaaacttaacatggattctaaggagaggcttgaccaagacggaaggttagagcaggccgaggaggaaaaaaagcctaaagattcaaccacccctctgtcccacgtcccatcggctgctgctcagggggcatggagctgggaatggtatctgaaggagcagaaggctgtagctgccccagtggaactgttttcaaaggatcaatcttttcccgagcacgaaaatggcttccagatcggaatgagactggaggggatagacccaagacatccttcagtgttttgtgtcttaagcgtagctgaagtatgcggctaccgtctgaggctccattttgatggatatctttcctgctatgatttctggacaaatgcgggtagcccagacattcacccagtgggctggtgtgagaagactaaacatgaactgcatatccctaaaggctaccgcaaagataagttcgtttggatggattatctgaaggcatgtaaattgcagaacgccccaaagaagctgttcaggaatagaagccctaacggccctatgagtaaagagtttcaagttggtatgaaattagaggctgtggatagaaaaaacccgagtcttgtctgcgtggccactattgcagacattgtggaggacaggttgcttgtacatttcgataactgggatgattcttacgactactggtgcgatgtgaattcaccttatgtgcaacctgtcggttggtgtcaggagaacggaagaaccttgatagcccctcaaggctaccctaacccagagaatttctcgtggaccgagtacctggaagctacgcagaccaacgcagttcctgcaaaagtgtttaagatgagattgccccacggcttcctacctaatatgaaactggaagtcgtcgacaaaagaaatccacggttgatcagagtcgcaactatcgtcgacgtggatgaccaacgcgttaaagtgcacttcgatggctgggatcacaagtatgattattgggtggaagcagacagtcccgacattcatcccatcggatggtgtgacgtgaccgggcatccattagaggtgcctcagagaacaaacgacctaaaaatcctgcctggccaagccgtgtgtccaactcccggatgccgcggaatagggcacattagaggtccgcgatatagcggacatcacagcgcgtttggctgtccttacagcgatatgaatttaaagaaagaggcgacgctgcatgaccggttgagagagcagactcaggcgaatctcgagtctgactcctcccactctaagagcaaaagtctatgcagcctaaacttcaacgggaaacatgagaaggttaactctcaacccaggcttgtccagcaggcaaagtgcctgaagattaaggggaaagaagatatcgaccttgataatttgttcagggtcctcgtgctgcatcccagagggcttgaatactcggtggaacaggcccagcaggtgctgcaccagtccgtttccatgtcaactgtatccgcccacccatttcgggacctgcccctcggacgcgaacagcactgcaagctcctccctggagttgccgatattcgagcaagtcaggtggccaggtggactgtagacgaagttgcagagtttgtacagtccctgctcgggtgcgaggagcacgctaagtgcttcaaaaaagagcagatagatgggaaagctttcttgctcctgacacagaccgatatcgtcaaggttatgaaaatcaagctcggcccagctctcaagatttacaactccatcctaatgttcaggcactcgcaggaacttccagaggaagacatagcctctggacaggaggtcagggggtag

SEQ ID NO: 23324 - DNA, 1872 bp, Artificial Sequence
  Description of Artificial Sequence: Synthetic coding sequence
atgaagcagccgaaccgcaaacggaaactaaacatggattccaaggagcgccttgatcaggacgggagactggagcaagcagaggaggagaagaaaccaaaggattccactacacccctgagtcacgttccaagcgcagccgctcagggagcttggagctgggaatggtatctgaaagagcagaaagctgtagcggctcctgtggaactcttttcgaaagaccagagcttccccgaacacgagaatgggttccagattggcatgcgattggaaggaatcgaccccaggcacccgtccgtgttctgtgtcctgtccgtggctgaagtgtgcggataccggctgaggctgcatttcgacggctacctcagctgctatgatttctggactaatgctggatcccctgacatccatcctgtcgggtggtgtgaaaaaacaaagcatgagctccacattcccaagggatacaggaaggacaagttcgtctggatggattatcttaaggcgtgtaagctacaaaatgcccctaagaaactcttccggaatcgtagtcccaacggtcctatgtcgaaggaattccaggtgggaatgaaactggaagcggttgacaggaagaacccatctctggtatgcgtggccacgatcgccgatattgtggaggaccgtttacttgtgcacttcgacaattgggacgatagctacgattactggtgtgacgtgaattcgccctatgtccagccagtggggtggtgtcaggaaaacggaagaacactaatcgctccacagggctatcctaatcctgaaaacttcagttggaccgagtacctcgaggctacccagactaacgcagttccagcaaaagtattcaaaatgcggctacctcatggctttctgccaaatatgaagttggaggtggttgacaaacgcaatcccagattaatcagggttgcaacgatcgtggacgtggacgatcagagagttaaagttcatttcgatggctgggaccataaatatgactactgggtcgaggctgattcccctgatatccatccgataggatggtgcgacgtgaccgggcaccccctagaagtacctcaaagaaccaacgacctgaagattctcccagggcaagccgtctgccccacgcctggttgtcggggtataggccacatccgaggaccgcgatattctgggcaccatagtgccttcggttgcccatattctgatatgaatcttaaaaaggaagccaccttgcacgataggcttagggagcaaacccaggccaacctggagtctgattcatcgcactccaagagcaaatccctgtgctcactgaattttaatggaaagcacgagaaggttaatagtcaaccgagactggttcagcaagctaagtgcttaaagatcaagggaaaggaggatatagatttagataaccttttcagagtgctcgtactacatcccagaggcctggagtacagcgtggaacaagcccagcaggtgcttcaccaatccgtatctatgtctactgtcagtgcccatccctttcgcgaccttccgcttgggcgagagcagcattgcaagctgctgcctggcgtggcagacattagggcatcgcaggtcgcacgctggactgttgacgaggtcgctgagtttgtgcagagcctcctagggtgcgaagagcacgctaaatgttttaagaaagagcaaatagatggcaaagccttccttctattaactcagaccgacatagtgaaggtcatgaaaatcaagctgggaccagcattgaagatctataattcaattctaatgtttcgacactctcaggagcttcccgaggaggatatagccagtggacaggaagtaagaggatag

SEQ ID NO: 23325 - DNA, 1284 bp, Artificial Sequence
  Description of Artificial Sequence: Synthetic coding sequence
atgtccaaggagtttcaggtgggcatgaagctcgaggcggtggacagaaagaaccctagcttagtttgcgtggcgaccatcgcggacatcgtcgaggaccgcttactcgtccacttcgataattgggatgactcctacgattactggtgtgacgtgaattctccatacgtgcagcccgtgggctggtgccaagagaacggacgaacactcatagccccacagggctatcccaacccggagaatttttcctggaccgagtatttggaggccacgcagacaaacgcagttccagcaaaagtgttcaagatgcgtttgccacatggatttctgccaaacatgaagctcgaagtcgtagacaagcggaatccccgtttgatcagggtggctaccattgtggatgtggatgatcagcgggtcaaagttcatttcgacggctgggaccataaatacgactactgggtcgaggcagattcaccggacatacacccgattggctggtgcgatgtcaccggtcatccccttgaggtgccccaaagaactaacgacctaaagatcctgccgggacaggcagtctgcccaaccccaggatgtagaggaattggacacatccggggacctaggtatagcgggcatcactcagccttcggctgcccctatagcgatatgaacctgaaaaaagaggccacgcttcacgatcggctgcgggaacagacccaggctaacctcgagtccgactcatctcactccaaatccaagtctctctgctccttgaatttcaatggcaaacatgaaaaggtcaattcccagccaagactcgttcagcaggccaagtgtttgaaaatcaagggtaaggaggacatcgacctggacaatctgttcagggagtattctgtcgaacaggcacagcaggttctgcatcaaagtgtttctatgtccaccgtgtccgcacatcctttccgggacctgcctctggggagggagcaacactgcaaactgttaccaggagtcgcagacataagagcttcgcaggtcgccaggtggactgtagatgaagttgccgaattcgtgcagtcgcttctgggctgcgaggagcatgcaaagtgctttaagaaggaacagattgatgggaaagcgtttctgttgctgacccaaaccgatatcgtaaaggtgatgaaaatcaagctcggtcctgctttgaagatttacaattccatcctgatgtttcgacactcgcaggaacttccagaggaggacatagcgagcggacaggaagtcagagggtag

SEQ ID NO: 23326 - DNA, 876 bp, Artificial Sequence
  Description of Artificial Sequence: Synthetic coding sequence
atgagctgggagagtggagctgggccaggcctcggtagtcagggaatggacctggtgtggagcgcctggtatggaaaatgtgtgaaagggaaagggtccctgccgctgagtgcacacgggatcgtggtagcctggctctctcgggctgagtgggatcaggtgaccgtgtacctgttttgcgatgaccacaagttgcagcgttacgctctcaacagaattacggtgtggcggagcaggtccgggaacgaactaccactagccgtcgcttccaccgctgacttgatcagatgcaagcttttggacgtcacaggaggacttgggacagacgagcttcggctgctttacggcatggctctggtgcggttcgtaaacctgattagtgagaggaaaaccaagttcgctaaggtgcctttaaagtgcctggcccaggaggtgaacatacctgattggatcgtggacctccggcacgagctcacccacaagaagatgccgcacattaatgactgtcgccgtggttgctactttgtcctcgactggttgcaaaagacatattggtgcaggcagttagagaactcacttagggagacatgggagcttgaagagttccgagaaggcattgaggaggaggatcaggaagaggacaaaaacatcgtggtggatgatattacggagcaaaaacctgagcctcaagatgacgggaaatccaccgagtctgatgtgaaggctgatggcgattccaaaggttctgaagaagtcgactcgcactgtaaaaaggcattgtcccataaggagctgtatgagcgggctcgcgagttactggtgtcttatgaagaagaacagttcacaggcggatgcgctggatgcttttctggttag

SEQ ID NO: 23327 - DNA, 2028 bp, Artificial Sequence
  Description of Artificial Sequence: Synthetic coding sequence
atgtcttgggaatccggcgcaggacctgggctggggtctcaaggcatggatctggtctggtctgcctggtacggaaagtgcgtaaagggaaaggggtccctgccactgtccgcccacgggatcgttgtggcctggctgtccagagctgagtgggaccaagtgaccgtttacctgttttgtgacgatcacaagctgcaacgatacgcgctcaatcgcatcaccgtatggcggtccaggttcgtgaatctgatctcagaacggaagaccaagttcgcgaaagtgcccctgaaatgcctggcacaggaagtgaatattcctgattggatcgtggatctgcgccacgaactgacacataaaaagatgcctcacatcaatgactgcagacgaggctgctatttcgtgcttgactggcttcagaagacatattggtgccgacagctggagaactcactgagggagacttgggaactcgaagaattcagagaaggaattgaagaggaggatcaagaagaggataagaatatagtcgtggacgacattacagagcagaaacctgagcctcaggatgacggaaaaagcactgagtccgacgtgaaagcagacggagactctaaaggttcggaagaagttgattctcactgcaaaaaagcactctcgcacaaggagctatatgaacgagccagggaactactggtaagctacgaagaggagcagttcacggtgttggagaagtttaggtacctacccaaagctatcaaagcttggaataacccctctccaagggtggaatgcgtacttgccgagctgaagggtgtgacatgcgagaaccgcgaggctgttttagatgcctttcttgatgacggattcctagtacctacattcgagcagcttgcggcacttcagatcgagtacgaggaaaatgtggatctgaacgacgtcctcgtgcccaagccgttcagtcagttctggcagcctcttttgcggggattgcacagtcaaaacttcactcaggcactcctcgaaaggatgctgtctgagctgcctgcactgggcatttcggggatccggccaacatatatactgaggtggaccgtcgaactcatcgtcgctaacacaaaaaccggtcgcaacgctagacgattcagtgcgggtcagtgggaggcgcgtcgcggatggaggctatttaattgctcagccagtctggattggccgaggatggtcgagtcctgcctcggctctccttgctgggcctccccacagctgctacgcattatattcaaagctatgggacaaggcctgccagacgaggagcaagagaaattgttaagaatttgcagtatttatacacagtctggggaaaattcattggttcaggagggtagtgaggcttcacccatcggaaagtccccgtatactctggatagcctctactggtctgtgaagccagcttcctccagcttcggcagcgaagcaaaagcacagcagcaggaagaacaggggagtgttaacgatgtaaaggaggaagaaaaagaagaaaaggaggtgcttcctgaccaggttgaagaggaggaagagaatgacgatcaggaggaagaagaagaagacgaagacgatgaagatgatgaggaggaagacagaatggaggtgggcccattcagcaccggacaggagtctcccactgctgagaacgcaaggctacttgctcagaagaggggggctctgcaggggtctgcatggcaagtttcgtccgaagatgtgcgctgggataccttccccctcgggagaatgcccggtcaaacagaggaccccgctgaactgatgttggagaactatgacaccatgtacctgttggaccagcccgtgctggagcaacgcctagaaccctctacatgcaaaactgacaccctcggtctttcttgtggggtagggagcgggaattgttcaaactcaagttcgagcaattttgagggactgctttggagccagggccagctgcacgggctgaagaccggactgcaactattctag

SEQ ID NO: 23328 - DNA, 2154 bp, Artificial Sequence
  Description of Artificial Sequence: Synthetic coding sequence
atgtcttgggaaagcggagcaggcccaggcctcgggtcccaaggcatggacctggtgtggagtgcctggtacggcaaatgtgtcaagggcaaaggatccttacccctctcagcccacggcattgtcgtggcgtggctcagtcgagccgaatgggaccaggtaactgtatatttgttctgcgacgaccataaactccagagatacgcacttaatcggattactgtatggcgcagccgcagcggaaacgagctgcctctggccgtcgcgtccactgcagaccttataaggtgcaaactcctggacgtcacaggcggactcggcacagacgaacttaggttgctatatggaatggccttggtacgttttgtcaatctcattagcgagcggaagactaagttcgccaaagttcccttaaagtgcctcgcgcaggaggtgaatatccccgactggatagtggatctccgtcacgagctgacacataagaaaatgcctcacattaatgattgtcgacggggttgctacttcgtgctcgactggttgcagaagacatattggtgtcggcaactggaaaatagcttacgcgaaacatgggaactcgaggagtttcgcgagggcatagaggaggaggaccaggaggaagataaaaatattgtagtggacgacatcactgaacagaaacctgaaccacaagatgatgggaagtctactgaatccgacgtgaaggccgatggtgactccaaaggctctgaagaggtcgattcccactgtaagaaggccttgtcacacaaggaactctatgagcgggcacgggaactgctagttagctacgaggaggaacagtttactgttctcgagaagttcagataccttcctaaagcaattaaggcatggaataatccgagcccacgggtagaatgtgttctggcggaactcaagggcgttacatgcgaaaatcgagaggcagtgctggacgctttcctggacgacggtttccttgtacccacattcgagcagctggcagcccttcagatcgagtatgaggagaacgtcgacctcaacgatgtgttagtcccaaagccgttcagccagttttggcagcccctcttaagaggcctccattctcagaactttacccaagcactgctcgagcggatgctgtctgaacttcccgctctgggcatttccggtatccggcctacgtacattctccgctggaccgtcgaactgatcgtcgcaaatacaaagaccggccgaaatgcccgtagattctctgctggccaatgggaggccagacggggatggcgcttgtttaactgcagtgccagcctggactggccgaggatggtagagagttgtctgggctctccgtgctgggcatcacctcaactcctgcgcattattttcaaggccatggggcaggggctcccggacgaagaacaggagaagctgctgcgcatatgttccatatacacccagtcaggcgagaactcacttgtacaggagggctccgaagctagcccgatcggaaaatccccatacacccttgattccctgtattggagtgtaaagcccgcatcctcttcttttggatccgaggctaaggcccagcagcaggaagagcaaggttctgtgaacgatgttaaagaggaggaaaaggaagagaaagaggtactaccagaccaggtggaggaggaggaggagaacgatgatcaggaggaagaagaagaggacgaggatgacgaggatgatgaggaggaggacagaatggaagttggacccttttcaactggccaggagagtcctactgccgagaacgcacgcctgttggcgcagaagaggggagcactacagggaagtgcgtggcaagtatcctccgaagatgtgagatgggacacctttccactgggcaggatgcctgggcagaccgaagatccagcagaattgatgctcgaaaactatgataccatgtatctgctggaccagccagtgttagaacaacgcctggaaccaagcacctgtaaaactgacacactgggcctaagctgtggcgtcggtagcggcaattgcagtaatagttctagctctaattttgagggactcctttggtctcagggacagctgcacggcttgaaaaccggcctgcagctgttttag

SEQ ID NO: 23329 - DNA, 2205 bp, Artificial Sequence
  Description of Artificial Sequence: Synthetic coding sequence
atgtcatgggaaagtggtgcaggtccaggcctggggagccaaggcatggacttggtctggtcagcctggtatggaaaatgcgttaagggtaagggcagcctgccactgtcagcccacgggattgtggttgcctggctgtcccgcgcagagtgggaccaggtcaccgtgtacttattttgcgatgatcacaaattgcagagatatgcccttaaccgcatcacagtgtggcggagccggtctggcaatgaactgcccctggcagtggcgagtacagcggacctgattagatgtaaactgttggatgtgaccggtgggctggggacagacgagttgaggcttctttatggcatggcgctcgtgcgtttcgtgaacctcatctctgagcgaaagaccaagtttgccaaagtcccactaaagtgtctggctcaagaggtgaacatacccgactggatagtggacttaagacatgagcttacccacaagaagatgcctcatattaatgactgtaggaggggatgctatttcgtgctggattggctgcaaaaaacatactggtgccgccagttggagaatagcctgcgggagacgtgggagctggaagagtttagagaaggtatcgaagaagaggaccaggaagaagataagaacattgtggtagacgacatcacagagcagaaacccgagccacaggacgacggaaaatccaccgaaagcgatgtcaaggctgacggagactcaaaaggttccgaagaggtcgactcccactgtaaaaaagccctgtcacacaaggagttatatgaaagggccagagagttgctcgtttcttacgaggaggaacagttcactgtgctcgaaaaattccgctatcttcccaaggcgattaaagcctggaataatccttctcctagggtggagtgtgtcttggccgagcttaaaggggtcacttgtgagaatcgcgaggctgtgctggatgcctttttggacgacggttttctggtcccaacattcgaacaactggcagccctccagattgaatatgaggatgggcaaaccgaagtacagagaggtgaagggaccgatcccaaatcccacaagaacgtggacctcaacgacgtgctcgttcccaagccattttcacagttttggcagcctctgttgcgaggccttcatagccagaatttcacacaggccctgttggaacgcatgttgagcgagttgcccgcactgggcatttccggcataagaccaacatatattctgcgttggaccgtcgagcttattgtggctaatacaaagaccggacgcaacgccagaaggttttctgctggacagtgggaggcacggagaggctggcgtctgttcaactgttctgcatccctggattggccaagaatggtggaatcatgcctcggctccccatgctgggcttctccgcaactcctgcgaatcatttttaaagccatgggccaggggctccctgacgaggagcaggaaaaactccttagaatctgttcaatttatacccagtcaggcgaaaacagcctggtgcaggagggcagtgaagccagcccaattgggaagtccccgtatactctcgattccctgtattggtccgttaagcccgcatcttcctctttcggtagtgaggccaaagcgcagcagcaggaagaacaggggagtgtgaatgacgtcaaagaggaagaaaaggaagagaaggaagttctgcccgatcaggtggaggaggaagaagagaatgatgatcaggaagaagaggaggaggacgaagatgatgaagatgacgaagaagaggacaggatggaggtggggccttttagtaccggacaggaatctcccactgccgagaacgccagactcctcgctcagaaaagaggagccctgcagggatctgcatggcaagtgtcaagtgaggatgtcaggtgggacacttttcccctggggaggatgccaggccaaacggaggaccccgctgagctgatgctcgagaactacgacacaatgtacctgctggaccagcccgtgttagaacaaagattagaaccttccacttgcaaaacagacactcttggcctaagttgtggagtgggatcaggcaactgcagtaacagctcctcatccaattttgaaggactgctatggtctcagggtcagctgcacggccttaaaaccgggctacaactgttttag

SEQ ID NO: 23330 - DNA, 507 bp, Artificial Sequence
  Description of Artificial Sequence: Synthetic coding sequence
atgagccttactcaccgccttcacctgtgtaaatactggggatgcgcagtaagcaatgtgtgccgattctgggaaggccgtcccctacctcttatgatcgtcgttccatacacattgcctgtgagcctcccagttggaagctgtgttatcattacagggactccgatcctgaccttcgtaaaggatccgcagttggaagtgaacttttataccggcatggacgaagatagtgatattgccttccagttccgactacactttggccatcccgctataatgaattcttgcgtttttggcatttggaggtatgaagagaaatgttactacttgcctttcgaagacggaaagcccttcgagttgtgtatttatgttaggcacaaagagtacaaagtcatggttaacggccaacgtatttacaactttgctcatcgattccctccagcttcagttaagatgctgcaggtgttcagggacattagtctgacccgagtgcttatctcagattag

SEQ ID NO: 23331 - DNA, 420 bp, Artificial Sequence
  Description of Artificial Sequence: Synthetic coding sequence
atgtcttctcttcctgtgccctacaccctccccgtctccctcccggttggaagctgtgtgatcatcactgggactcccatcctcactttcgtgaaagaccctcagctcgaggtaaatttttacaccggtatggatgaggattctgacatcgctttccagtttaggctccattttggacaccccgctatcatgaatagttgtgtctttggtatctggagatatgaagaaaagtgctactatcttccattcgaggatggcaagccgtttgagctctgcatttacgtgcgccacaaggagtataaggtgatggttaacggtcagcggatatacaatttcgcacatcgttttccccctgccagtgttaagatgcttcaggtgttcagggatatttccctaacaagggtcctcatctctgattag

SEQ ID NO: 23332 - DNA, 1314 bp, Artificial Sequence
  Description of Artificial Sequence: Synthetic coding sequence
atggcacgagtggcttgggggctgctctggttgttgctcgggtcagctggagctcagtatgagaaatactcgttcagaggattcccccctgaggacctaatgcctctcgccgcagcctacgggcacgccttagaacaatacgaaggggagagttggcgggagagtgcaagatatctagaggctgcactccgcctacatcgcctgttgcgcgattcggaggccttctgccacgcaaactgcagcggaccagcccctgctgccaagccagatcctgacgggggtagggcagacgaatgggcgtgcgagctgcggctattcggaagggtcctcgaacgcgctgcctgcctccgccgatgcaagcgcacccttcctgcatttcaggtcccatatccgccacgccaattactgcgggacttccaatcacgtctgccataccagtatctacactacgcccttttcaaagccaatcgtctggaaaaggccgttgcagcggcttatacgttcctgcagagaaacccgaaacacgaactgacagctaaatacctgaattattatcaaggcatgctcgacgtggccgacgagagcttaaccgacctggaagcacagccttacgaggcagtgttcttgagagcggtgaagctgtataacagcggagattttagaagtagcaccgaagacatggagagggccctttcagaatacctcgcagtgttcgcaagatgtctggctggctgcgaaggagctcacgagcaggtcgatttcaaggacttttacccagcaatcgccgacctgttcgctgaatcactacagtgtaaggtggattgtgaagcgaacctcactccaaacgtaggagggtacttcgtagacaaatttgtagccactatgtatcattatctgcagtttgcatattataaacttaatgacgtcagacaagccgcacggtcggcagcatcttatatgctgtttgaccccaaagattccgttatgcagcagaacctagtttactaccggtttcatagggcaaggtggggcttggaagaagaggattttcagcccagggaagaggcaatgctgtaccacaaccagactgcagaactcagagagttactggaatttacgcatatgtacttgcagtcagacgacgagatggagctcgaagaaaccgagccacccctcgaacccgaggatgccctgagcgatgccgagtttgagggcgagggcgattatgaggaggggatgtacgctgactggtggcaggagcccgacgcaaaaggagatgaggcggaagccgaaccagagccagagctggcctag

SEQ ID NO: 23333 - DNA, 1314 bp, Artificial Sequence
  Description of Artificial Sequence: Synthetic coding sequence
atggccagggtggcatggggtctgctttggctcttactgggcagcgccggagctcaatacgagaagtactctttccggggattcccgcctgaggatctgatgcctctggccgcagcgtatggccacgccctggaacaatatgaaggagagtcctggcgtgaatccgcaagatatctcgaggccgctctccggctgcaccgtctgttaagggactcggaggcattttgccacgctaactgttccggccctgcaccggcagcaaagccagatcccgatggcggtcgtgcagatgagtgggcttgtgagctccgccttttcggaagggtcctggagagggctgcctgtcttaggcgatgcaaaagaaccctgcccgcttttcaggtcccctacccccctcgtcagctgctgagggatttccagtctcgccttccttaccagtatcttcactatgcactcttcaaggctaacagattagaaaaagcggtggcagcagcatatacctttctgcagaggaacccaaagcatgagctgaccgccaaatatttgaattactatcaggggatgctggacgtggcggatgagagcctgaccgatttagaagcccagccctacgaggccgtttttctcagggcagtgaagctgtacaactcgggcgacttccgaagtagtactgaggacatggaaagggctctctcggagtacctggccgtgtttgctaggtgtctggcgggatgcgaaggggctcacgagcaggtggatttcaaggacttttacccggctattgccgacctgttcgctgagtcactgcagtgcaaagtggattgcgaagccaatctgactccaaatgttggaggttatttcgtggacaagttcgtggctaccatgtaccactacctacagttcgcatactataaactgaatgatgtgagacaagccgcacgcagtgccgcttcttatatgctttttgatccgaaagactctgtgatgcagcagaacctagtttactatagatttcatagagctagatggggcctggaggaagaggatttccagcctcgagaagaagcaatgttgtatcacaatcagacagccgagctgcgcgaactgttggagttcacccatatgtatctgcagagcgatgacgaaatggagctcgaagagacggaaccccctctagagcctgaagacgctctcagcgatgcagagttcgaaggggaaggcgactatgaggaaggcatgtatgcggactggtggcaagagccagatgcgaaaggcgacgaggccgaggccgagcctgagccagagctagcatag

SEQ ID NO: 23334 - DNA, 1281 bp, Artificial Sequence
  Description of Artificial Sequence: Synthetic coding sequence
atggcgagagtggcctggggactgctatggttacttctgggctctgcgggagcgcaatacgagaaatattccttccgaggcttccctcctgaagacctaatgccattagcagcagcttacggacatgctctcgagcagtacgaaggcgaaagctggagagaaagcgccagatatcttgaagcagctctgaggctccatagacttctgcgggacagcgaagccttttgccacgcaaattgcagcggtcccgctcccgctgctaagcccgatcccgatggcggaagggctgatgagtgggcttgcgaactaaggctgttcggaagagtgcttgagagagccgcttttcaggtgccatacccccctcgccagctgttgagagactttcagtcccgcttaccttaccagtacctgcactatgctctattcaaagctaacagattggaaaaggcggtcgccgctgcctataccttcctccagcgcaaccccaaacacgagctcacggcaaagtacctcaactactaccagggcatgctggacgtggctgatgagtcgcttaccgatctggaagcccagccttacgaggctgtcttcctgagggccgtgaaactttacaacagcggtgacttcaggagctctacagaggatatggaacgcgctttatccgagtacttggcggtcttcgccaggtgtttagctggctgtgaaggtgcacacgaacaggtcgatttcaaggatttctacccagcaattgcagacctcttcgctgagtcgcttcaatgcaaagtagactgtgaggctaacctgacacctaatgtcggtggttatttcgtggataagtttgtggctactatgtaccattatctgcagttcgcatactataagctgaacgacgtccgtcaggctgctcgttctgctgcctcctatatgctcttcgaccccaaggactccgtgatgcagcagaatctcgtttactataggtttcaccgggcacgctggggattagaagaagaagatttccagccaagggaggaggcgatgctgtaccacaaccagaccgctgagcttcgggaattacttgaattcacccacatgtacctccaaagtgatgacgagatggagctagaggagactgagccgccactagagcctgaagacgctttaagcgatgctgagtttgaaggggaaggggactacgaggaaggaatgtatgccgattggtggcaagaaccagatgcgaaaggggacgaagcagaagcagagccagaacctgagctggcgtag

SEQ ID NO: 23335 - DNA, 942 bp, Artificial Sequence
  Description of Artificial Sequence: Synthetic coding sequence
atggcctcgtttcgcaaattaaccttatcagagaaagtgcccccaaatcatccatctcggaaaaaagtgaacttcctggatatgtctctggatgacattataatttacaaggaactcgaaggtacgaatgctgaggaagagaagaataagaggcagaatcatagcaaaaaagagtcccccagtagacaacagagtaaggcacatcggcaccgccataggcgtggttactccagatgccgtagtaatagcgaggagggcaaccacgataagaagccctctcagaagccctcgggcttcaagagcggccagcacccacttaatggacagccactaattgaacaagaaaaatgtagcgacaattatgaggctcaagcagaaaaaaaccagggacagtctgaaggtaaccaacaccagagcgaagggaacccagataagtcagaagaatcccagggacaaccagaagagaaccaccattcagagcgtagtagaaaccacctggaacgcagtctatcacaaagcgaccgatcccaggggcaacttaagagacaccaccctcagtacgagcgctcccacggccagtataaacggtcccacggccagtcagagagatcccatggacattccgagcgcagccacggacactccgagcggtctcacggccattccgagcggtcacatggacactcgaagcgctctcgtagtcaaggggacctggtagacacacagtccgacctgattgcaacacagagagatctgatcgcgacccaaaaggacctgattgccacgcagcgcgacctgatcgccacacagcgtgacttgattgtaacccagagggatctggtggccaccgagagggaccttatcaatcaaagtgggagatctcatggacagtctgagagacatcagagatatagcacaggcaagaataccatcaccacttag

SEQ ID NO: 23336 - DNA, 237 bp, Artificial Sequence
  Description of Artificial Sequence: Synthetic coding sequence
atggcatcttttcgcaaactgactctgtccgagaaagtgccgccaaatcatccatcccgaaaaaaggttaacttcttggacatgtcactcgacgatatcatcatttataaagagctcgaggggacaaatgcggaggaggagaaaaacaaaagacaaaatcacagcaagaaggagagtccgtctaggcagcagtctaaggctcatcgacacaggcacagaagaggcgaagtgcagtag

SEQ ID NO: 23337 - DNA, 696 bp, Artificial Sequence
  Description of Artificial Sequence: Synthetic coding sequence
atgctaaaaaaaaagcgcattaaggatcgtaccatcgtgaagaggaaccggctgcaggatagtaatcaaaaactgatagacatcgccataggcgaagaaaagtgcagtgataattatgaggctcaagctgagaagaatcagggtcagagcgaaggaaatcagcaccagagtgagggcaaccccgacaagagtgaggagtcgcaaggacagccggaggagaaccatcacagtgaacgatcccggaaccatttagagcgatctctgtcacagtcagaccggagccaaggccagctcaagaggcaccacccacagtacgagcgctcccatgggcagtacaaacgctcacatggacagagcgagcggtcacacggccacagcgagagaagccacgggcattccgaacgctctcatgggcattccgaaagatcacacggccactccaaacggagtaggtcacagggagatctggtggatacccaatctgaccttattgctacgcagagagatcttatagctacacagaaagacctgattgctacacagcgggatttaattgctacgcaacgagacctgatagtaacacaacgtgatcttgtggcaaccgaacgagatctcataaaccagagtggtcggtcccacgggcagtccgagcgccaccagcgctattcaactggaaaaaacactatcacaacctag

SEQ ID NO: 23338 - DNA, 1944 bp, Artificial Sequence
  Description of Artificial Sequence: Synthetic coding sequence
atgggccctctgtccgctcgcctcctgatgcagcgcggtcgcccaaagagtgacaggttaggaaagattaggtctttggacctcagcggattagaattgctttctgagcatctggacccgaaactattgtgtaggctcacgcagctccaggaactggacctgtctaataatcatctcgagaccctgccagacaatttgggcctttcacacttgagggtacttaggtgtgccaacaatcagctaggcgatgttaccgccctttgtcagttcccaaagcttgaagaattatccctagagggcaacccattcctgactgtgaatgataatctgaaggtgagctttctcctgcctacattgcggaaggttaacggcaaggatgcttccagcacttacagtcaagtggagaacttgaaccgggagctgacctctcgagtgactgcccattgggagaaattcatggccacgctggggcctgaagaggaggcagagaaagctcaagctgacttcgtgaaatctgctgtccgggatgtgaggtacggtcccgaatccctttccgaatttacacagtggagagttaggatgatcagcgaggagcttgtggcagcgagtagaacacaagtgcagaaagctaattccccggagaagccccctgaggcgggagctgcacataagcctcgcgctcgccttgctgcattgaaaagacctgatgatgtgcctctgagtctttccccaagcaagagggcatgcgcaagtccgtccgcccaggtggagggctctcccgtggcagggagtgatggctctcagcctgctgtgaagttggagccgctgcatttccttcagtgccattctaaaaacaattccccgcaggaccttgagacacagctgtgggcctgcgccttcgagccggcatgggaagagggagctaccagtcaaactgtggcaacctgtggaggcgaagccgtttgtgtgattgactgccagactggtatcgttctacacaagtacaaagcgcctggagaggaattctttagtgttgcctggaccgccctgatggtggtgacacaggcgggtcataaaaaaagatggagtgtgctggccgcagccggactgcgcggacttgtgagattgcttcacgtgcgggctgggttctgttgcggggtgatcagagctcataaaaaggccatcgcaacactatgtttctcaccagcccacgaaacccacctgtttaccgcgagctacgataagcgtatcatactgtgggatattggcgttcctaatcaagattatgagttccaagcttcacaactgttgaccctggacacgacttccatccccttgcgcctctgcccagtcgccagctgtccagacgctcgtttactggctgggtgcgagggaggctgctgctgctgggacgtgcgcctggatcagccccaaaagcggagggtatgcgaggtagagtttgtattctcagagggcagtgaggcaagcgggaggcgcgttgatgggttagccttcgtgaacgaggacatagtggcttcaaagggctccggattaggtactatatgcctttggtcctggcgccagacttggggaggcagaggatctcagtctacagttgcagtagttgtcctcgcacggcttcagtggtcctctacagaacttgcgtacttctccctgtccgcttgtcccgataaagggattgtcctgtgcggagacgaggagggcaatgtgtggttgtatgatgtttcaaacattctgaagcagccccctcttctgcccgctgctctccaggcccctacccagatactgaaatggccacaaccgtgggcactgggtcaggtggtcacaaaaactatggttaacacagtcgtcgctaatgcttcatttacctacctcaccgctctaacagattctaacattgtggctatctggggaaggatgtag

SEQ ID NO: 23339 - DNA, 2310 bp, Artificial Sequence
  Description of Artificial Sequence: Synthetic coding sequence
atgtctaacaatctccgacgcgttttcctcaagcctgcagaagagaacagcggcaacgcctccagatgtgttagcggctgcatgtaccaagtcgttcagactatagggtcggacggtaaaaatctgctccagctgctccccatccccaaaagctccggcaacctgatcccactagtacagagctcagtcatgagcgacgcactgaaggggaacaccggaaaacccgtacaggttacattccagactcagattagcagctctagtacctcagcatccgtccagctccccatcttccagcctgcaagtagctctaattactttctcaccagaaccgttgacaccagcgagaagggccgagtaacatcggttggcacagggaatttctcttcaagtgtatccaaggtccaatctcatggagtcaagatcgatggtctaaccatgcagacgttcgctgtgcccccatccacccagaaagacagttctttcatagtggttaatacgcagtctctaccagtgacggtcaaatctcccgtgctgccgagcggacatcaccttcagattccagcccatgctgaggtgaagagtgtgccggcttccagtctgccaccatccgtccagcagaagatcctcgctacagccacaacttccacaagcggaatggtcgaagcatcacagatgcccaccgtgatatatgtgtcgccagtaaacacggtgaaaaacgtggtaaccaaaaattttcagaacatctatccaaagccagtgaccgagatcgctaaacctgtaatcctcaataccactcaaatccccaagaacgtggccactgaaacacaacttaagggcggtcagcacagccaggcagccccagtaaagtggatcttccaggataacctccagccgtttactccaagcttagtgcctgttaagtcctccaataacgtggcctccaagatcctcaagactttcgtggaccgaaaaaatctgggggataacactattaacatgcctccgctctctacaattgaccctagtggaactagatccaaaaatatgccaataaaggacaacgctctggttatgtttaacggcaaagtctacttgcttgcaaaaaagggaaccgacgtattaccttcccagatcgatcagcagaattctgtgtcaccagatacccctgttagaaaggacacgctgcagacagtatcctccagtcccgtgactgaaatatctcgtgaggtggttaatatagtcctggcaaagtcaaagtccagtcaaatggaaactaaatcactttccaatacccagctagccagtatggctaatcttcgggcagagaaaaataaggtggagaagcctagccctagcactacaaacccacatatgaaccagtcttctaattacttaaaacaatccaagacactgtttacaaatccaatttttcccgtggggttctcaacaggccacaatgcccctagaaaggtgacggccgtcatctacgcgcgaaaaggcagcgtgcttcagtcgatcgaaaagatttccagctctgtcgacgctactaccgtcacctcgcagcagtgtgtcttccgcgatcaggaacccaagattcataacgagatggctagcacctcggataaaggtgctcaaggcaggaatgacaaaaaggatagccaaggacgctctaataaagcacttcacctaaaaagcgacgccgaattcaagaagatcttcggacttactaaagacttgagggtttgtcttacccgaatcccagaccatctgacaagtggggaaggcttcgactcgttcagcagcctggttaagtcgggaacatataaggagacagagttcatggtgaaggaaggggagcgaaaacagcaaaacttcgacaaaaaacggaaagcaaaaaccaacaaaaagatggaccatataaagaaacgtaagactgagaacgcctataacgctatcattaacggggaagccaatgtaactggatctcaactactcagctctatactgccaacatctgatgttagccagcacaacattctgaccagccactccaagactaggcaggaaaaacgcacagagatggagtattatacacacgaaaagcaagagaagggcacccttaattccaacgcggcatatgagcagtctcacttcttcaataagaactacacagaggacatctttcccgtcactccccctgaacttgaggagaccatcagagatgagaagatcagaaggttgaagcaggttttgcgagagaaggaggctgcactcgaagaaatgagaaagaaaatgcaccaaaaatag

SEQ ID NO: 23340 - DNA, 702 bp, Artificial Sequence
  Description of Artificial Sequence: Synthetic coding sequence
atggcatcgacgtcagataagggagcgcaaggcaggaatgacaagaaggacagccagggtaggagtaataaggccctgcacctcaaatctgatgcagagtttaagaagattttcggactgactaaggaccttagggtgtgtctcaccagaataccagatcatcttacttctggagagggtttcgatagctttagctcattggtgaagtcaggtacctataaggagaccgaattcatggtgaaagagggagaaaggaagcagcagaatttcgacaagaagaggaaagcaaaaacaaacaaaaaaatggaccatataaagaaaaggaaaacggaaaatgcttacaatgctattattaatggggaggcaaatgtcacaggcagccagctcttgtctagcatcctcccaacctccgatgtgagccagcacaacattctgacctctcattctaaaactcgacaggagaaaagaaccgagatggagtactacacgcacgagaaacaggaaaaagggaccctgaactccaatgccgcttacgaacagagccacttttttaataaaaattacactgaggacattttccccgtaaccccaccagagttggaggagacaatccgcgacgagaagattcggcgtctgaaacaggtccttcgagaaaaggaggccgcactggaagaaatgcgcaagaagatgcaccaaaagtag

SEQ ID NO: 23341 - DNA, 702 bp, Artificial Sequence
  Description of Artificial Sequence: Synthetic coding sequence
atggccagtacaagcgacaaaggagctcagggtcggaacgacaagaaagattcccagggtagatctaacaaagcactgcacctgaagtctgacgcagagtttaagaagattttcggcctcacaaaggacttgagagtgtgtctcacacggattcctgatcacttgacgtcaggagagggctttgactcattttctagcctggtgaagagcggcacatacaaggagacagaattcatggtgaaagagggggaaagaaaacagcagaacttcgataaaaaacgtaaagctaaaactaacaagaagatggaccacatcaagaagcgaaaaacggagaacgcatataatgctataattaacggggaggccaatgtgacgggatcacagttgctttcttctatactgccgacttccgatgtgagtcagcacaatatcctgaccagtcactcaaaaacccggcaggaaaagcgtactgagatggagtattacacccatgagaaacaggagaaaggcacgctcaactctaacgccgcatatgagcagagccatttctttaataagaattacaccgaagacatttttccagtcacgcctcctgaactggaagaaacaatccgtgacgagaagattcgcagactgaaacaagtcctgagggaaaaagaagctgctttagaggaaatgcgtaagaagatgcatcaaaagtag

SEQ ID NO: 23342 - DNA, 1134 bp, Artificial Sequence
  Description of Artificial Sequence: Synthetic coding sequence
atgtactggaagcatgaaaacgcagctccagcccttccagagggatgtcgtctccctgccgagggagggcctgcaactgatcaggtgatggcccaacctggctctgggtgcaaggcaaccacgcgatgtctggagggcacggcccctccagctatggcccagtcggacgctgaagcactggcgggagctctcgataaggacgaagggcaggcatctccttgcacaccatccactccatccgtctgtagcccaccttcagctgcatcttccgtgccctctgctggcaagaatatttgtagctcatgcggcctggagatcctggacaggtatctgcttaaggttaataatctgatatggcacgttcgctgcctcgaatgttctgtctgccggacatcattgcggcagcagaattcatgctacatcaagaacaaagagattttttgcaagatggactacttctctaggttcggtaccaaatgtgctcgctgtggtcgccagatctacgcaagtgattgggtgaggagggccaggggcaacgcgtatcacctggcatgcttcgcttgcttctcgtgcaagcggcagttgagcacaggagaggagttcgggctggtggaggagaaggtgctgtgtagaatacattatgatactatgatcgagaacctgaagcgggctgcagagaatgggaatggccttacactggaaggcgctgttcccagcgagcaggacagccagccaaaaccagccaaacgggctcgcacaagtttcactgcagaacagctgcaggtcatgcaggcacagttcgctcaggataacaacccagatgcacagactttgcagaaactggctgatatgacagggctgagtagaagggttatccaggtctggttccagaactgtagggctcgccataagaagcatactccgcagcatcctgtgcccccttctggcgcacccccaagtaggctcccaagcgctctgtctgatgacattcattacactccattttcatcacctgagcgcgcacgcatggtcaccttgcacggctacatcgaaagtcatcctttcagtgtactcacactacccgcattaccccaccttcccgtcggagcaccccagctgccccttagccgctag

SEQ ID NO: 23343 - DNA, 1092 bp, Artificial Sequence
  Description of Artificial Sequence: Synthetic coding sequence
atggctcagcccggttctgggtgcaaggccaccacccggtgtctcgaggggactgcacctcccgcaatggctcaatccgatgccgaagcactcgccggagctctagataaagacgaaggtcaagcctcaccttgcaccccttccacccccagtgtgtgctcaccccctagtgccgcaagttctgtgccatctgcgggaaagaatatctgcagttcttgcgggcttgagatcctagatcgttatttgctgaaggtcaacaacctgatctggcatgtgaggtgcttggaatgcagcgtctgcaggacgagtttaaggcagcaaaacagttgctacataaagaacaaggagatcttctgcaagatggattacttcagcagatttggcaccaaatgtgctaggtgcggtcggcagatctacgcttccgattgggttcggagagccaggggaaacgcctatcaccttgcttgctttgcctgtttcagctgcaagcggcagcttagcacaggtgaagaatttggcctggtggaggagaaagtcctgtgtagaatccattatgatacaatgatagaaaatcttaaacgcgctgctgaaaatgggaatgggctcacgctggagggtgctgtgccgtccgagcaggacagccagcccaagccagctaaaagagccaggacttcattcaccgccgaacagctacaggtcatgcaggcgcagttcgcccaggacaacaatcctgatgcacaaacactgcagaaactggccgatatgactgggttgagccgcagggtaatccaagtgtggtttcagaactgcagggcgcgacacaaaaagcatacccctcaacaccccgtgccaccctccggtgctcctccaagccgactgcccagtgcgctgtcggatgacattcactacacgccattcagctcaccagaacgggctcgcatggtcacactacacggatatatcgagtcccaagtccagtgcgggcaggtccactgtcggttgccttacaccgcacctcctgtccacctgaaagcagatatggatgggccactgtcgaatcggggagaaaaggttattttattccagtattag

SEQ ID NO: 23344 - DNA, 1179 bp, Artificial Sequence
  Description of Artificial Sequence: Synthetic coding sequence
atgtactggaaacacgagaacgccgcacccgcactgccagaagggtgcaggctgcctgctgaaggtggccctgctaccgatcaggtgatggcccaacccggttctggatgcaaagctaccactaggtgtctggaaggtactgccccacctgccatggcccaatccgatgcggaggcactagcaggtgcattagacaaggacgaggggcaggctagtccatgtacccccagcacaccctcagtgtgttcccctcctagtgccgcttcgagcgtcccgtctgcaggtaagaacatctgttcttcttgcgggctggaaatactcgaccgatatctgctgaaagtgaacaacctcatttggcacgtccggtgcttggaatgctccgtgtgccgtacttctcttcgacaacagaatagctgctacataaagaataaggagatattctgcaaaatggactattttagtcggtttggaaccaaatgcgctcgttgcggcagacagatatatgcatctgactgggtgagaagagcgagaggtaatgcttatcacctggcctgtttcgcatgtttttcctgtaaacgacaactttcaaccggcgaggaatttggcttggtcgaagaaaaagttctgtgccgcatacattacgatacgatgattgaaaatctgaaacgggcagccgagaatggaaatgggctgaccctcgaaggcgctgtgccttcagaacaggacagtcaaccaaagcctgccaagagagcccgaacttcatttaccgctgaacagctccaggtaatgcaggcacagttcgcccaagataataacccagacgctcaaaccctgcaaaaactggccgacatgactggactgagtagaagggtgatccaggtatggtttcagaattgcagagcgaggcataagaagcacacaccacagcatcccgtccctcctagcggtgcgcctcctagcaggctgccgagtgcgttgtccgacgatattcattacacccccttcagtagcccagagcgcgctaggatggtgacactccatggatacatcgagtcccaagtacaatgcggccaggtccattgtcgcctcccctacaccgccccacctgtgcacctaaaagctgatatggacggacctctgagtaaccgaggtgaaaaagtgatacttttccaatattag

SEQ ID NO: 23345 - DNA, 1101 bp, Artificial Sequence
  Description of Artificial Sequence: Synthetic coding sequence
atgagacggggattatgcaggcgctccgccgaaaacccagacgccggacccgtcatggctcagccaggcagcggttgcaaggccactacacgttgcttagagggaacagctccaccagcgatggcacaatcagacgccgaagccttggcgggagcactcgacaaagatgaaggacaggcttccccctgtaccccaagcacaccgagcgtctgctcgcctccatccgccgcttccagtgtgccctccgctggcaaaaatatatgctcctcctgcggtctggagattttagatcgatatttgctgaaggttaataacctcatttggcacgtgcgttgtttagaatgctctgtttgcaggacctctctccgtcagcaaaactcttgttacattaagaacaaggaaatattttgcaagatggactacttctctcgttttgggacgaagtgcgcacgctgtgggaggcaaatctatgcaagcgattgggtaagaagagccagagggaatgcttatcatctcgcctgctttgcctgcttttcttgtaagagacaactaagtaccggagaagagtttggattagttgaggaaaaggtcctgtgtaggattcattacgacaccatgatcgaaaacctcaagcgcgctgccgagaatgggaatgggcttacattagagggcgctgtgccctcggaacaggacagccagcccaaacctgcaaagagagctcgaacatcttttacagcagaacaactgcaggtgatgcaggctcagttcgcacaggacaataatcccgatgcccaaaccctccagaaattagccgatatgacagggctgagcaggagggtcatccaggtttggttccagaactgccgtgcccgtcataaaaagcatacccctcagcacccagtgcctccttctggcgcaccccctagtcgtctcccttccgcattaagtgacgacattcactatactccattttcttctcccgagagggctcggatggtcactttgcatggttacattgaaagccatccatttagcgtacttactttgcccgcactccctcaccttccagtgggtgctccgcagctccctctgagtcgctag

SEQ ID NO: 23346 - DNA, 66 bp, Artificial Sequence
  Description of Artificial Sequence: Synthetic coding sequence
atggctcagccagggtcaggctgcaaagccacaacaagatgcctggaagggactgctccaccttag

SEQ ID NO: 23347 - DNA, 105 bp, Artificial Sequence
  Description of Artificial Sequence: Synthetic coding sequence
atggcacagcctggctccggctgcaaagcaactaccaggtgcctggagggaacagccccaccagccatggcccagagcgacgctgaggccctggctggagcatag

SEQ ID NO: 23348 - DNA, 531 bp, Artificial Sequence
  Description of Artificial Sequence: Synthetic coding sequence
atgatcgagaatcttaaacgggcagctgagaatgggaacggtttaaccctggagggtgccgtcccctctgaacaggacagccagccaaagccggctaagagagctcgaactagtttcacagccgagcaattacaggtgatgcaggctcaattcgcacaggataacaatcccgatgctcagactttacagaagctagccgacatgaccgggctgagccgacgagtgatacaagtgtggttccagaattgtcgggcaagacacaagaaacatactccacagcatcccgtcccacctagtggggctccaccaagccgcctcccttcagctctgagtgatgatatacattataccccattttcctcccctgaacgtgccagaatggtaactctgcatggctacatcgaatcccaagtgcagtgtggtcaggttcattgtagattaccctatactgcccctcccgtacacctcaaggcagacatggatgggccactttccaatcggggagagaaggtaatcctttttcagtactag

SEQ ID NO: 23349 - DNA, 372 bp, Artificial Sequence
  Description of Artificial Sequence: Synthetic coding sequence
atggctgtctcacactctgtcaaggaaagaaccatctcggaaaacagtttgattatcttattacagggcctgcagggcagggtgaccactgtcgacctcagagatgagagtgtcgctcacggaagaatagacaatgttgacgcattcatgaacatcagactcgcaaaggtcacttacacggaccgctgggggcaccaggtcaagttagacgatctgttcgtcaccggcagaaatgtgcggtatgtccatattccggatgacgtgaatattacaagcaccatcgagcagcagctccagatcattcaccgggtgcgaaatttcggcggaaagggccagggtcggtgggagttccctccaaagaactgcaagtag

SEQ ID NO: 23350 - DNA, 1083 bp, Artificial Sequence
  Description of Artificial Sequence: Synthetic coding sequence
atggaagagagggagcgaggagctagatcggctggtgcgggttcacctgctcgccctccctcaccccgactggacgtgagctccgattcatttgacccgctgttggctttgtacgccccaaggctccccccaataccctaccccaatgccccatgctttaataatgtggcagagtatgagtcctttctgagaacgggagtgagaggtggaggtagaggcaggggacgcgcacggggtgcggctgccggtagtggcgttccagctgcccctggtccctccgggcgtacgagacgtagacctgacgcccctgcaccagacccagagaggattcaacgactaaggagactgatggtcgcaaaggaggaaggcgacggcgcagcaggcgctggccgacgaggcccaggcaggtcccgcaaagcgccacgcaatgtactgacacggatgccattacacgaaggaagtccactcggtgaattacaccggtgcatccgtgagggcgttaaggttaacgtgcatattcggacctttaagggactaagaggagtgtgcacgggtttcttggtggcgttcgataagttttggaacatggcactgacagacgtggatgaaacctaccgaaagcccgttttgggaaaggcctacgaacgagatagctcgctgactctgaccagactattcgaccgattgaagcttcaggactcctccaagaaggaagccgacagcaaaagtgcagtagaggacagcactctgagcaggtattcacagacatcaacctggaagctggcttccgtatggggtcgcgcagacaccggacgcggttcacataaaaggtcacgaagcgtcccaagcagcttgcaggcctccgctagagaggagtcacgctcagaactgtcaggccgaaccactaggacggatggcagcagcgtagggggtacgttcagtcgcgctaccactttgtctcgcggtcagtccagaaaaaaaaagcgcaagccaaaggttgactatcagcaggttttcacaagacacattaatcagatattcatccggggtgaaaatgtgctcttagtgcacctggcccagtag

SEQ ID NO: 23351 - DNA, 1140 bp, Artificial Sequence
  Description of Artificial Sequence: Synthetic coding sequence
atggtgtttttcacttgtaatgcctgtggcgagtccgtgaagaagattcaggtggaaaaacacgtttctgtgtgtagaaactgcgagtgtctatcatgtatagactgtgggaaggacttctggggtgatgattacaaaaatcatgtcaaatgcatatcagaggaccagaagtacggcggaaaaggctatgaggggaaaactcacaagggcgacatcaagcaacaggcatggattcaaaagatttcagagctaattaagaggccaaacgtgtcacctaaggtcagggagctccttgagcagatcagcgcctttgataacgtccctaggaaaaaggccaagttccagaactggatgaagaacagccttaaagttcacaacgagagcattttagaccaggtttggaacatattttccgaggcttctaattctgagccagtaaataaggaacaggatcagagaccgctgcatcctgtggctaatccccacgcagaaatctctacgaaggtgcctgcctccaaagtgaaagacgctgtggagcagcaaggtgaggtgaagaaaaacaaacgcgagcgtaaagaggaacgccagaaaaaacgtaagagagaaaagaaggaactgaagctggagaatcatcaggaaaatagccggaatcagaagcctaaaaagcgcaagaagggacaggaagccgacttagaggcagggggagaagaggtgcccgaagcaaacggatctgctgggaagaggagcaaaaagaagaaacagaggaaagattctgccagtgaagaggaagcccacgtgggggcaggtaaaagaaagaggcgtcattccgaggtggagacagacagtaaaaaaaagaaaatgaaactgcctgaacatccggaagggggagaacctgaggatgacgaagctcccgctaagggcaaattcaactggaaggggactatcaaggctatcctgaagcaggcacctgataatgagatcacgataaagaagctcaggaaaaaagttctggcacagtattacacagtgacagacgagcaccaccggtccgaggaggagcttctggtcatctttaataagaagatctcaaagaatccgaccttcaagctgctgaaagacaaagtaaagctggtaaagtag

SEQ ID NO: 23352 - DNA, 1140 bp, Artificial Sequence
  Description of Artificial Sequence: Synthetic coding sequence
atggtgttcttcacatgcaacgcctgcggcgagagcgtgaaaaagattcaggttgaaaaacacgtctctgtttgtagaaattgtgaatgcctaagttgcattgattgcggtaaggatttttggggtgatgattacaaaaatcatgtgaagtgcatcagcgaggaccaaaaatatgggggaaaggggtacgaaggaaaaacgcacaagggcgatataaaacagcaagcttggatccagaagatctctgagctgattaagaggcctaatgtctcccccaaggtaagagagctcctagagcagatctctgcgtttgataatgtgccaaggaagaaagccaagtttcaaaactggatgaagaactctctgaaagtccacaatgaaagtattctcgatcaagtgtggaatattttctccgaggcttctaattcagagccagtgaacaaggaacaggaccagagacccctccaccctgtggccaacccacacgcagaaataagcaccaaagttcctgcctctaaggtcaaggacgccgtcgaacaacaaggagaggttaagaagaataaaagggagagaaaagaagaacgccagaaaaaaaggaagcgggagaagaaggagcttaagctagagaaccaccaagagaatagtcgcaaccagaagccgaaaaagcggaagaaaggccaagaggctgacttagaagctggcggagaagaagttcctgaggctaacgggagcgctggcaagcggagcaaaaaaaaaaagcagaggaaggattcagccagtgaggaagaagctcatgttggcgcaggcaagcggaagcgtagacattcggaagtcgagacagattccaagaaaaaaaaaatgaagttgcctgaacatcctgaggggggtgaacccgaggacgacgaggcgcctgcaaaagggaagttcaactggaaagggacaatcaaggccattttaaagcaggctccggacaacgagatcaccattaagaagctgaggaaaaaggtcctggcacagtattatactgtgactgatgaacaccatagatctgaggaagaactgttagtaatcttcaacaaaaagatctccaagaatcctacatttaaattgctgaaggacaaagtgaaactagtcaagtag

SEQ ID NO: 23353 - DNA, 240 bp, Artificial Sequence
  Description of Artificial Sequence: Synthetic coding sequence
atggtgttctttacttgtaacgcatgcggcgaatctgtaaagaaaattcaggtcgagaagcatgtctctgtttgtcgcaactgtgagtgcctgtcctgtattgattgcggcaaagatttctggggggacgattataagaaccacgtcaaatgtatctccgaggaccagaagtatggcggaaaaggatacgagggaaagacccataagggggacatcaagcagcaagcatggatacagtag

SEQ ID NO: 23354 - DNA, 1863 bp, Artificial Sequence
  Description of Artificial Sequence: Synthetic coding sequence
atgaaaccggcacccaggctaacacccgtcaggcccgctgccgcaagccccatcgtgtcaggagcacggcgtcggagggtgcgttgccggaagtgcaaggcatgtgttcaaggtgaatgtggcgtgtgccactactgcagagacatgaaaaagttcgggggaccaggcaggatgaaacagtcttgtgtcttgcgccagtgcctggccccacgcttacctcattcagtaacatgctcactttgcggggaggtggaccagaacgaagagactcaggattttgaaaaaaagctcatggaatgctgcatttgtaatgagattgttcaccctgggtgtctccagatggatggggagggacttctgaatgaagagcttccaaactgttgggaatgccctaagtgttatcaagaggacagttcggaaaaggcccagaagagaaaaatggaggaatcagatgaggaagccgtgcaagccaaagtgctccgtcccttgaggagttgcgacgaacctctgacacctccaccgcatagtcccacgagtatgctgcagctcatccacgatccagtcagcccaaggggcatggtaactaggagttccccaggggctggaccatcagaccaccactctgcgtcacgagacgaacggttcaaacggaggcagctccttcgcctgcaagccaccgaacggactatggtgcgcgagaaggagaacaatccttccggaaagaaggaattgagtgaggtcgagaaggctaagattcggggaagctatctgaccgtaaccctgcagagacccacaaaggagctccacgggacctccattgtgccaaagctccaagcaataaccgcttctagcgccaacctgcggcacagccctcgcgttttagtacaacactgtccggcaaggactccgcagcgaggggatgaggagggactgggcggagaggaagaggaggaagaagaggaggaagaagaggacgactctgccgaagaaggcggagctgcccgactgaacggcagaggctcttgggcccaggatggtgatgaaagttggatgcaaagggaggtctggatgtcagtgttccgctacctatcccgcagagagctgtgcgaatgtatgagagtgtgcaagacatggtataaatggtgttgcgataagcgcctgtggaccaagattgatctttctaggtgtaaggctatcgtccctcaggcacttagcggcattatcaagaggcagcctgtttcattggatctgtcttggaccaatatctcgaagaaacagttaacctggcttgtcaacagacttcctggactcaaggaccttctactagccggttgttcctggtccgcagtgtcagcccttagcacgagctcttgcccactcctccgcacactggatcttagatgggctgtgggtataaaggacccccagatcagagacctgttgacccctccagccgataagcccggtcaggacaatcggagtaaactcagaaacatgactgacttcagactagccggattggatatcacagacgcaacactgaggctgattatccggcatatgcccttgctttctaggttagatctctcgcactgctcccacctaacggaccaatccagcaacttgctgactgctgtgggctccagcacccggtattccttaacggagctgaatatggcagggtgcaataaactgactgaccagaccctgatatacctgaggagaattgccaacgttacactgatcgatctgcgcggatgtaagcagattaccaggaaagcatgcgagcattttataagcgacttatccattaactccctgtactgcctgagcgatgaaaagctaatccagaagatatcatag

SEQ ID NO: 23355 - DNA, 2349 bp, Artificial Sequence
  Description of Artificial Sequence: Synthetic coding sequence
atggagcctgaggaggaacgaatcaggtacagccaacgactgaggggaaccatgaggcggaggtacgaggacgatgggattagcgacgatgaaatagaggggaagaggacctttgacctggaagagaaattgcacaccaacaagtataacgcgaacttcgtgaccttcatggagggtaaagattttaatgtggaatatatccagagggggggtctacgtgacccacttatatttaaaaactccgacggcttggggatcaagatgcccgatccggacttcaccgtcaacgatgtgaagatgtgcgtgggctcacgcagaatggttgacgtgatggacgtgaatacccagaagggcatagagatgaccatggcacaatggacccggtactacgaaacgccagaggaggagagagagaagctgtataatgtgataagtctcgagttctctcacaccagattggaaaatatggtccagaggccatcaactgtggactttatagactgggtggacaatatgtggcctcgccatttgaaagagagtcaaaccgaatctacaaatgctatcttggagatgcaatatccgaaggtgcaaaaatattgtctgatgagcgtgagaggctgttatacagatttccatgtcgattttggtggcacatcagtgtggtatcatattcaccaaggcggtaaagtgttctggctaatccccccaacggcgcataacctggagctgtatgaaaattggctgctttccggaaaacaaggagacatattcctgggagacagagtaagcgattgtcagcgcatcgagcttaagcaggggtacaccttcgtgattccgtcaggttggatccacgccgtttacacccctaccgacactctcgtatttggcggaaatttcctgcatagctttaacatccctatgcaattaaagatctacaacatcgaagaccgcacacgggtcccaaacaagttccggtatcctttctattatgaaatgtgctggtacgtcctggagagatacgtatactgtatcaccaataggagtcatctcactaaagaatttcaaaaggaatcattgtccatggatttggagcttaacggcctggagagcggtaacggcgacgaagaggcagtagacagagagccacgtcgcttaagtagccggaggagcgtgttgactagccccgtggccaacggagttaacctcgattatgacggactgggtaagacgtgcagatccctgccttctctgaaaaagactctagcgggagattcctcttcagattgcagtcgaggctcccacaatggccaggtctgggatccccagtgcgctcccaggaaagaccggcaggtgcatctgacacattttgagctggaaggccttaggtgtctggtagacaagctcgaaagtcttcctttgcacaagaagtgcgtgcctacgggtattgaggatgaggatgccctaatcgccgacgtcaaaattctgctggaggagctcgctaacagcgaccccaaactggctctgaccggtgttccgatcgtccaatggcccaagcgcgacaaactcaaattcccaacaaggcctaaagtaagggtacccacaatcccaattaccaagccgcacacaatgaagccagccccaagactgactccagtgagacccgctgcagcaagtcccatcgtgagtggcgcacgccgtaggcgtgtgcggtgtagaaagtgtaaagcctgcgtccaaggcgagtgtggtgtctgccactattgtagggacatgaagaaatttggcggtccgggaaggatgaaacaaagttgtgtgctgcgtcagtgtctggcccctcggctaccccattctgtgacttgcagtttatgcggcgaagtggatcagaacgaggaaacccaggactttgagaagaaactgatggagtgctgcatctgtaacgaaatcgtccatccgggttgcctgcagatggatggtgaggggctgctgaacgaagagttgcccaattgctgggagtgtcctaagtgctatcaggaagacagttctgagaaagctcagaagcggaagatggaagagagcgatgaagaggccgtgcaggctaaagttttgcgaccccttaggagttgcgacgagccgctgactcctccccctcatagccctactagcatgctgcaactgatccatgatcctgtgtctcctcgcggaatggtgacccgtagctcccctggggcagggccaagcgatcatcacagcgcctcacgtgacgagcgctttaagcgcaggcagctcctcaggttgcaggcgaccgagcggaccatggtcctgcggcaggaaaccctcgataagaattag

SEQ ID NO: 23356 - DNA, 1263 bp, Artificial Sequence
  Description of Artificial Sequence: Synthetic coding sequence
atgtgtagcggaagattccagaacatccaagttaaccccgactttcctcgcggaaggatcagcaacagcttcaggcgaacctctagtacagagaacaaaacaaagaccttaggtaaattgcaccaggagcctagacaattgcagagcgatggaaagcgtaagattttgctggaagaactggctaatagtgacccaaagcttgccctgacgggagtcccgatcgtgcagtggccaaagcgcgataaactcaagtttcccacccgtcctaaagtgagagttcccactatcccaattactaaaccacataccatgaagccggcaccccgactgacgcccgttaggccagctgccgcaagccccatagtgtcaggggcaaggcgccgtagggtgcgttgccggaagtgcaaggcttgcgtccaaggggaatgcggggtttgtcactattgtcgcgacatgaaaaagtttgggggtcctggccgtatgaagcagtcctgcgtactgaggcagtgtctggccccacgactaccccacagcgtcacatgttctttatgtggggaggtggaccagaatgaggaaacgcaggacttcgaaaaaaagctgatggagtgttgtatttgcaacgaaatagtgcacccaggatgcctccagatggatggtgagggtctcctgaacgaggaactgcctaactgctgggagtgtccaaagtgctaccaggaagactcatcagaaaaagcgcagaagcgcaagatggaggagtccgacgaggaagccgtccaggccaaggttctccgtccgctgagatcatgcgacgaacctcttacccctccccctcattcccccactagcatgctgcagctgattcacgaccctgtgtcccccagaggcatggttactagaagcagcccaggagccggtccaagtgatcaccactctgcttcgagagacgagaggtttaagaggagacagttgctgcgccttcaagccactgagcggactatggtgcgagaaaaggagaataatccgtcgggtaagaaggaactgagtgaggtcgaaaaagcaaaaattaggggaagttatctgaccgttaccctgcagcggcctacaaaggaactgcatggaacatccatcgtgcctaaactgcacggccaggtacttgtggtgagttcagcccgtctgtctagtattacactttctcgtctagcccaagagggccctgcggctccgggagtgccagatccctgcaggagtcactggtgttgctag

SEQ ID NO: 23357 - DNA, 3489 bp, Artificial Sequence
  Description of Artificial Sequence: Synthetic coding sequence
atggagccagaggaggaacggatccgctacagtcagcgtctcaggggaacgatgcggcgtcgctacgaagatgatggtatatccgacgacgagattgagggcaaaagaacttttgacctcgaggagaagctgcatacaaacaaatacaatgctaacttcgtgacttttatggagggcaaggattttaacgtggagtacatccagaggggcggacttcgtgaccctctaatttttaaaaattctgatggactgggaattaagatgccagacccagacttcaccgtaaacgacgtgaagatgtgcgtcggaagccggaggatggtcgatgtcatggacgtcaacacgcagaaagggattgaaatgacgatggctcaatggacccgatactacgaaactccagaggaggaacgagagaagttgtacaacgtgattagtctggaattctcacacactagattggaaaacatggtgcagaggccctccacagtggatttcattgactgggtagacaacatgtggccgagacacctgaaggaaagccaaacggagtctacaaatgcaattctagagatgcagtatccaaaagtgcaaaagtattgtctgatgagcgtacgcggatgttataccgacttccatgtggatttcggagggacctccgtgtggtatcacattcatcagggaggcaaggttttctggttgatacctcctacagcccataatctcgagctgtacgaaaattggcttctgagtggtaaacagggcgatatattcctgggcgatagagttagcgactgtcagcgtatagagctgaaacagggatataccttcgtcatccctagtggatggattcatgcagtgtacactccaaccgatacattggttttcggcggaaattttctgcacagctttaatattccaatgcagctaaaaatatataacatcgaagaccggacccgggtccccaacaaatttagatatcccttctactacgaaatgtgctggtacgtcctggagcgctacgtgtactgtatcacaaataggtcgcaccttaccaaggagtttcagaaggagtctctcagtatggatcttgaattgaacggccttgaaagcggcaatggcgacgaagaagccgtagatcgggaacctaggcggcttagctctcggagaagcgttttgacgtccccggtggccaatggcgtgaatcttgactacgacggtctcggaaagacctgccggtctctgccctccctcaagaaaacattagcgggtgattcttcgagcgactgcagcagaggctcacataatgggcaggtctgggaccctcagtgtgcccctcggaaggacaggcaggtacaccttacgcattttgaactggaaggcctcagatgtctggtggataagctggagtctttaccactacacaagaaatgcgttccaactggaattgaagacgaggacgcattaatcgctgatgtgaaaatactgctggaggagctggccaactccgacccaaaacttgctctgacaggcgttccaatcgtgcagtggccaaagcgcgataaactgaaattccctactaggcctaaggtgcgtgtaccgacgattcccattacgaagcctcacaccatgaagcccgctcccagattgacacccgtccgccctgctgcagcatctcctatcgtgagcggcgctcggcgtcggagggtgagatgcaggaaatgtaaagcctgtgtgcagggggagtgtggcgtgtgccactattgccgggatatgaagaagttcggtggcccaggcaggatgaagcagtcatgcgtgctgcgccagtgccttgcacctcgcctgccccattcggtgacctgttctctgtgcggggaggtggaccagaacgaggagacacaggactttgagaaaaagctgatggagtgttgcatttgcaacgaaattgttcatcctggctgccttcagatggatggcgagggtttacttaacgaggagcttcctaactgttgggagtgtcctaagtgctatcaggaagatagctcagagaaagctcagaagcgcaagatggaggaaagcgacgaagaggccgtccaggccaaggtgcttcgccctttaagaagttgcgatgagcctttaaccccgccaccgcactcacctacttctatgttgcagctgatccacgacccggtgtctccaagaggaatggtgacccgtagctcccccggtgcaggaccatcagaccaccactcagcgtcgagggacgagcgcttcaaacgtcgacagctgctccgccttcaggccacggagcgcaccatggtccgagaaaaagagaacaatccgtctggaaagaaggaactgagcgaggtcgaaaaggcaaaaatcagaggcagttacttgacagtgaccttgcaacgaccgacaaaagaactgcacgggactagcatcgttcccaagctccaggccatcactgcaagttcagcgaacctcaggcactctccgagagtactggttcaacactgtccagctcgtacccctcagaggggagacgaggagggactggggggagaggaagaagaggaggaagaagaggaagaagaggatgactccgccgaagaggggggtgcagcccgtctgaacgggagaggctcctgggcccaggacggagacgagagttggatgcagcgagaagtttggatgagtgtgttccgctacctgagccggagagagttgtgtgaatgtatgagagtctgtaagacatggtacaaatggtgctgcgataagagactgtggacaaaaatagacctctccagatgcaaggctattgtcccacaggctttgagtggtattattaaaaggcaacccgtttcactcgacctttcttggacaaatattagcaagaagcagctgacatggctggtgaatcgcttgccaggcttgaaagacctgttactggctggctgcagttggagcgccgtctctgcgctgagcacttcatcatgtcccctgctgcggacactggatctgcggtgggccgttggaatcaaggatcctcagatccgcgatttactgacaccacctgccgataaacctgggcaggataatagatccaaattacgaaacatgactgatttcagactggctggcctcgacatcactgacgccacactgaggctaatcatcaggcacatgcccctgttatcgcgcctcgacttatcccactgtagtcacttgaccgatcagtcatccaatctactgaccgcagtaggaagtagtacaagatattctctcactgagctcaacatggccggttgtaacaagcttaccgatcaaaccctaatctacctgcgaagaattgcaaacgtcactctgatcgatctgcgaggatgcaagcagatcacccggaaggcatgtgaacatttcatcagtgacctgtccatcaacagcttgtactgtctgagcgatgaaaagctgatccagaagatctcttag

SEQ ID NO: 23358 - DNA, 2172 bp, Artificial Sequence
  Description of Artificial Sequence: Synthetic coding sequence
atgtgttccggcagattccagaacattcaggtgaatcccgacttccccaggggcaggatctcaaatagtttccgccgtacatcttctaccgagaacaaaaccaaaacattggggaagcttcaccaggagccacggcaattacagtccgacgggaaaagaaagatactgctggaggagctggccaattctgatcccaaacttgctttaactggtgtgccaatagttcagtggccgaagcgggacaaactaaagttcccgaccagacccaaagttagggtgcctaccataccaatcaccaaaccacacaccatgaagccggctccgagactgacaccagtgagaccagcagccgcatccccaattgttagtggggcacgcaggcggagggtgagatgcaggaaatgtaaggcctgtgtgcagggcgagtgcggagtctgtcactactgcagggatatgaagaaatttggcggaccaggtagaatgaagcagtcatgtgtgctgcgacaatgcctagctcccagattgcctcactccgttacctgttcgctttgcggggaagtcgatcagaacgaagagacccaggactttgaaaaaaagctgatggagtgctgtatctgtaacgagatcgtgcaccccggttgtttacagatggacggagagggtctacttaacgaggagctgcccaactgctgggagtgtcccaaatgctatcaggaggatagctcagagaaagcccagaagagaaagatggaggagtccgacgaggaagctgtgcaagctaaagttctgcggcctctacgtagctgcgacgagcccttaacacccccaccacacagccctacgagtatgctgcaacttatccacgaccctgtcagccctcggggaatggtgacaaggtccagtcccggtgcaggtcccagcgaccatcactcagcctcaagggacgagagatttaagaggcggcagttactccggctccaggctaccgaaaggactatggtgagagagaaggagaataaccctagtggcaaaaaggagctatccgaagttgaaaaggctaagatcagagggagctaccttaccgttacgctgcaacggcctaccaaggaacttcacgggacaagcatcgtgccaaagttgcaggccatcacggcatccagtgctaacttaaggcattccccccgagttctggtccaacactgtcctgcaagaacgccgcagagaggggatgaggagggcctgggcggtgaagaggaggaagaggaggaggaggaagaggaagatgattccgctgaagagggcggtgccgctcgcctgaacggccgaggctcctgggcccaggacggtgacgaatcctggatgcagagagaagtgtggatgagtgtattccgctacttgagcaggcgcgaactctgcgagtgcatgcgcgtgtgcaaaacatggtacaaatggtgttgtgacaagcgactctggacaaagatagatctgtcgagatgcaaggcaatcgtcccccaagccctgagtggcattatcaagagacagcctgtatcgctcgacctgtcctggactaatatcagcaagaaacagctgacctggctcgtaaatagactccctggcctgaaggacctcctacttgccggttgtagctggagcgcggtgtctgctctctccacgtcgtcttgcccccttttgaggactttggacctacggtgggccgtggggatcaaggatccccagattagggacttgcttaccccaccagccgataagccaggccaggacaatcggtcgaaactgaggaatatgacggatttccgactggccggactggacatcaccgacgctaccctgcgcctcattattcgccacatgcccctccttagtaggctcgatctgagccactgttcccacctgactgaccagtcctcaaatctcctgaccgccgtcggcagctctacacgctattcgcttacggagttgaacatggccggatgtaataaacttacggaccagaccctaatttacctgaggcggatagcaaatgtcaccctgatagacctgcggggttgcaagcagattacccggaaggcctgtgagcacttcataagtgacttgagcatcaattctctgtactgcttgtctgacgaaaaactgatccagaagatctcctag

SEQ ID NO: 23359 - DNA, 3921 bp, Artificial Sequence
  Description of Artificial Sequence: Synthetic coding sequence
atggcgggtccgcagatgggaggctcagctgaagatcaccctccacgaaagaggcacgcggcagagaagcagaagaagaaaactgtcatctatacaaaatgctttgaattcgagtcagctacacagcgtcctattgatcgccaacgctacgacgaaaacgaagacctgagtgacgtggaggagattgtctcagttaggggtttttctctagaggaaaagctgaggagccaactctaccagggggacttcgtacacgcaatggaaggaaaggattttaactatgagtatgttcagagggaggccttgcgagtgcccttgattttccgggaaaaagatgggctgggtattaaaatgcctgatcctgactttactgtccgggatgttaaattgctcgtcggatctcgacggctggttgatgtaatggacgtgaacacgcagaagggtaccgagatgagcatgtctcagttcgtcaggtactatgaaacaccagaagcacagcgcgataaactgtataatgtgatcagcctggagttttcgcataccaaactggagcacctcgtaaagcggcctaccgttgtggatctggtagattgggtggataacatgtggcctcagcacctcaaagagaaacaaactgaagcgacaaatgcaatcgcagagatgaaataccccaaggtaaagaagtattgtctaatgagcgtgaagggatgttttaccgattttcatatcgacttcggcggaacctcagtgtggtatcacgtgtttcgcggagggaaaatcttttggttaatccccccaaccttacacaatctggcgctctatgaggaatgggtactgagcggaaagcagtctgatatattcttgggagacagagtcgagcggtgtcagaggatcgaattgaagcagggttatactttctttatccctagcggttggattcacgcagtgtatacacccgtggatagtctggtatttgggggtaatatacttcactcatttaatgtacccatgcagctacgaatctacgagatcgaggacagaacacgagtgcagcctaagttccgttatccgttttattatgaaatgtgttggtacgtgctggaaaggtacgtgtactgtgtgactcagcgctcccatttaactcaagagtatcagcgcgagtcgatgctgatagacgcccctcggaagccaagtatcgacggtttctcaagcgattcttggttagaaatggaagaggaagcctgcgatcagcagccacaggaggaggaagaaaaagacgaagaaggagaaggacgggatcgcgcaccgaagcctcccacagacggcagcactagtcccaccagtaccccctctgaggaccaagaggcacttggcaaaaaaccaaaggctccagccctgcggttcctgaagagaaccctgtccaatgagagcgaagagtctgtgaaaagtactacactggcggtcgactaccctaagacccccactgggtccccggcaaccgaggtctccgcaaagtggacccacctgactgaattcgaattgaaaggcctgaaggcactggtagaaaaacttgagtctctgccagagaacaagaaatgcgtgccagagggtatcgaggatcctcaagctttactcgaaggcgtgaagaacgtgctaaaagaacacgcagatgacgacccttcgcttgctatcacgggagtgccggtcgtgacatggccgaagaaaacgcccaaaaacagagctgtgggccgtcccaaggggaaacttggaccagccagcgctgtcaagcttgccgctaatcgtacaactgccggtgcccgtcgtcgacgcacaagatgtcggaagtgtgaggcatgcctgcgcacagagtgtggggagtgtcatttttgcaaagacatgaagaagttcggtggccctggacgtatgaaacagtcttgtatcatgcggcagtgcattgccccagtgcttccacacactgctgtttgtctcgtgtgcggagaggctggcaaggaagacaccgtggaagaagaggagggtaagtttaaccttatgctcatggaatgttctatttgcaatgaaatcattcacccaggatgcctcaaaatcaaggaaagtgagggcgtggtgaacgatgagttgcctaattgttgggaatgtccgaagtgcaaccacgctgggaagaccggaaaagcgtacaagcagaagcgcggacccggattcaagtacgccagcaatctccccggtagcctgctcaaggagcagaagatgaaccgcgacaataaagaggggcaagagcccgctaagcgacgctctgagtgtgaagaagcgcctaggcggagatccgacgagcactccaaaaaggtacccccagacggactcttgcgaagaaagtcagacgatgtccatctccgtaagaagcgcaagtatgagaaacctcaggaactgagtgggagaaaacgtgctagctctctgcaaaccagtcccggatcctcaagccacctctctcctaggcctccgctcgggagcagccttagtccctggtggcggtcatctctgacatatttccagcagcagctgaagccagggaaagaggataagctgtttcgaaagaagaggcggtcctggaaaaatgccgaagatagaatggccctggctaacaagcctttaagacgctttaagcaggaaccggaagatgagctgcctgaggcccctcctaagacaagagaatccgatcatagccgcagttcttcgcccaccgcgggtcctagcactgaaggtgcagaaggacctgaggaaaagaagaaagttaaaatgcggaggaagagacgtttacctaacaaggaactgtcgcgtgagctatctaaggagcttaaccacgaaattcaacgcactgagaattctttggccaacgagaaccaacagcctataaagagcgaacccgagagcgagggggaggaaccaaagaggcccccagggatatgtgaacggccacatcgattctctaaaggcctcaatggcacccctcgggaattgagacaccaactgggacctagcctgcggagtccaccacgggtaatctcgagaccgccacccagcgtatctccccctaaatgcattcagatggagagacatgtcatccgtcccccaccaatctccccgcctcccgattcattacctcttgatgacggcgcagcacacgtgatgcatagagaagtctggatggccgtgttctcctatctttcacatcaggacctgtgcgtctgcatgcgggtatgtagaacttggaaccgctggtgttgtgataagagactctggacacgcatagatcttaaccattgcaaaagcattactcccctgatgctcagtggaataatacgccgtcagcctgtcagccttgatttatcctggacgaacatttctaagaaacagttgagttggctcataaatcgtctgccaggcctgagggatctcgtgctctccggctgttcctggatagcagtgtcggcactatgctcctcctcatgtcctctgctgcggaccctagatgtccagtgggtggaaggcctcaaggatgcacagatgcgggacctgttaagtccccctaccgataaccgccctggccaaatggacaatcgatctaagctgcgcaatatcgtagagctccgtctggccggattggatataacggatgcatccctgcggcttatcatccgccacatgcctttgctgtctaagctgcacctctcctattgcaaccacgtgacagatcagtctatcaatttactgactgccgtcggtaccactactagagactctctgaccgaaataaacctatctggcttctttgtaggtcgcgtgttcggcctccaattttggggcatctgcgagccacaggcccgaaagaacgcgggttgggcctag

SEQ ID NO: 23360 - DNA, 3798 bp, Artificial Sequence
  Description of Artificial Sequence: Synthetic coding sequence
atggaggctgaaaaagactccgggagacgtttacgcccaattgaccgccagcgatatgacgagaacgaagatctgtccgatgttgaagagattgtctccgttcgcggatttagcttagaagaaaagctgcgttcgcagctgtatcagggcgattttgtccacgctatggaaggtaaagatttcaattacgaatacgtccagagagaagccctgagggtgccattaatatttcgggaaaaggatggcctcggcatcaagatgcctgatccagacttcactgtccgcgacgtaaaactactcgtgggcagtcggagactggttgatgtaatggacgtcaacacacaaaaagggactgaaatgtcgatgtctcagtttgtgaggtattatgagacgccagaggcacaacgagacaaattgtataatgtaataagtctggagttttctcacaccaagctggaacatttggttaaacgccctaccgtcgtggacttggtcgattgggtcgataacatgtggccccagcacttaaaagagaaacagacggaggccaccaacgcaatagcggagatgaagtaccccaaggtgaagaaatactgcctcatgtccgttaaaggatgcttcacagatttccatattgacttcggtgggacttctgtgtggtaccacgtcttcaggggaggtaagatcttttggctgatcccccctaccctgcacaatctcgcactttacgaagagtgggtcctgtctggaaaacagagcgacattttcctgggcgatagggtagaacggtgccagcggattgagctcaaacagggttataccttttttattcccagcggctggattcacgcagtgtatactcctgtagactccctggtgtttggcggaaacattctccacagctttaatgtcccaatgcagctgagaatatatgagattgaggatagaacaagagttcaaccaaaattccgctatccattttattacgagatgtgctggtatgtcctcgaacggtacgtgtactgcgtcacacaaagatctcatctaacgcaagagtaccagcgagaaagcatgttaatcgacgctcccagaaagccaagcatcgatggcttttcatccgacagttggttggaaatggaagaggaagcctgtgaccagcaacctcaggaagaagaggagaaggatgaagaaggggagggcagagacagagccccaaagcctccaacagatggcagtactagtcctacgtccactccctcagaagatcaggaggcactgggtaagaagcctaaagcacccgctttaaggtttttgaagcgcacactgtctaatgaatctgaagaatctgtgaaatctacgacactggctgttgattaccccaagacgccgactggtagtcccgctacagaggtatctgccaaatggacccacctgaccgagtttgagctgaaaggattgaaggccctggtggagaagctcgagtccctgcctgagaacaaaaagtgtgtccctgagggcatcgaggaccctcaggcactcttagagggtgtgaagaacgtcttaaaggaacacgccgacgatgaccctagtctggccatcaccggggtccctgtggtgacctggcccaaaaagactcctaagaatcgcgctgttggacggccaaagggtaagctgggacctgcatccgccgtcaagttagccgctaatcggactacagccggagccaggagacggaggacccgctgccgcaagtgtgaggcctgtctccggaccgagtgcggcgagtgtcacttttgcaaggacatgaaaaagttcggaggtcccggacgcatgaaacaaagttgcattatgaggcagtgcattgccccagtattgccacacaccgccgtgtgcctggtctgcggcgaagcgggtaaggaggacaccgtggaggaggaggaaggcaaattcaatttgatgctgatggagtgtagtatctgcaacgagattatccaccccggatgcctgaagataaaggaatcggagggagtggtgaatgacgaattgccgaattgctgggaatgtcccaaatgtaatcacgcgggaaagacaggcaaacagaagaggggaccaggtttcaaatacgcaagcaatctgccgggatctttgctcaaggagcagaaaatgaacagagataataaagaagggcaagagccagcgaaacgccgatcagagtgcgaggaagcacccaggagaaggtcagacgaacactcaaagaaggttccaccggatgggctgctcagacggaagtcagacgacgtgcatctacggaaaaagcggaaatacgaaaagccacaagagctttccggcagaaagcgcctcaagcctgggaaagaggataagcttttccgaaagaaacggaggtcatggaaaaatgccgaagaccgaatggctttggccaataagcctttacggaggtttaaacaggagcccgaagacgagcttcctgaagcacctccgaagacccgagagtcagatcactcccgcagtagctcaccaacagcaggaccctccactgaaggcgctgaagggccagaggagaagaagaaggtgaaaatgagacgaaagaggagactccccaacaaggagctgagtcgtgaactcagcaaggaactcaatcatgagattcagagaacggagaatagcctcgccaatgaaaaccaacagccaatcaaatccgagccagaatccgagggagaagaacctaagagacctccgggaatttgcgagaggcctcaccgcttcagtaaaggtctcaacgggacccctagggagctccgccaccagttaggtccaagtcttagatctcctccgagggtaatttcccgtccacctccctcggtttcccccccaaaatgcatacagatggaaagacacgttatacggccacccccaatctcgccaccacccgactccttgccccttgatgacggcgctgcacacgtcatgcacagagaggtgtggatggcagtcttttcatatctgtcacatcaggatctgtgcgtgtgtatgagagtctgcagaacatggaaccgctggtgttgtgacaagaggctgtggacgagaattgatctaaatcattgcaagagtatcactccgctcatgctgagtgggattattaggaggcagcccgttagtcttgatctctcttggactaatatttcaaaaaagcagctgagctggctgataaatcgactcccaggccttagggacctggtgcttagtggttgttcctggattgcggtttcagcactgtgctcatccagctgccctctgctgaggacactcgacgttcaatgggtggaggggctgaaagacgcccaaatgagggacctcctctcaccccctaccgacaataggcccggacagatggataatcggagtaagttgaggaacatcgtcgaactcagactcgcaggtctcgatatcactgacgctagtttaagattgatcattcggcacatgccgcttctctccaaactgcacttaagttactgcaatcacgtgaccgaccagagtattaatctactgaccgcggttggaacgaccacacgagattctttaactgagattaacctcagcgattgtaacaaagtcaccgatcagtgcctgtccttcttcaagaggtgtgggaacatctgtcatatcgatctgcggtactgtaaacaggtgacgaaggaaggatgtgagcagttcattgccgagatgagctccttccaaggcagatcctgctccactactcgccttggggatgaatag

SEQ ID NO: 23361 - DNA, 4011 bp, Artificial Sequence
  Description of Artificial Sequence: Synthetic coding sequence
atggctggacctcagatgggcggatccgctgaagaccatccgccacgcaagcggcatgccgctgaaaaacagaagaagaagacagtgatttatactaagtgttttgaattcgagtcagctactcaacggcctattgacaggcagaggtatgatgagaacgaggatttatcagatgtggaggaaattgtctctgtgagaggtttcagcctcgaggagaaactgagaagccagctgtaccaaggagacttcgtgcatgctatggaagggaaggacttcaactacgaatatgttcaaagggaagcactgcgagtgccactgattttccgcgaaaaggacggtcttggaatcaaaatgcctgatccggactttactgtcagggacgtgaagctcttggtgggctctcggaggctggtggacgtaatggatgtgaatacccagaaaggaaccgagatgtctatgtcccagttcgttagatactacgaaacccccgaggcccaaagagataagctgtataacgtgatcagccttgagttctcccacaccaagttagaacatctcgtcaagaggcccacagtagtcgacctcgtggattgggtggacaacatgtggcctcaacacctgaaagagaagcagacggaggctactaatgccatcgcagagatgaagtatccaaaggttaagaagtactgcttgatgagtgtgaaggggtgttttacagacttccatattgattttgggggtacgagtgtgtggtaccacgtcttcagagggggtaagatcttctggctgatcccgccaacccttcataacttggccctgtacgaagaatgggtactgtccgggaagcagagcgacattttcctaggagatcgcgtggagcgatgccagcgcatagagctgaaacagggatacactttcttcatcccctcaggatggatacacgctgtatacacgccagtggactctctggtgttcggcggtaatattttgcattctttcaacgtgcccatgcagctgaggatttacgaaatcgaagatcgtactagagttcagcctaagttcaggtacccattctattacgagatgtgctggtacgtgttagagcgttatgtctactgtgttacccaacgctcccacctgacacaggagtaccaacgtgagtctatgctcatcgatgccccacgcaaaccgagcatcgatggcttctcctcagatagctggcttgagatggaggaggaggcttgtgatcagcagccccaggaagaggaggaaaaagacgaagagggtgaaggcagagatagagcccctaagcctcccaccgacgggtcgacctcccccacttccactcccagcgaggatcaggaggctctcgggaagaaacctaaagctcccgctttgagattcttgaagagaacactttctaatgagtctgaagagtctgttaaatccaccactctagcagtggattatccaaagactcccacaggatcgccagccaccgaagtcagtgccaaatggactcatttaactgaattcgagttaaagggcctgaaggctctggtcgagaagctcgagtccctgccagaaaataaaaaatgcgtccccgaagggatcgaggaccctcaggcactgcttgagggagttaagaacgttcttaaagaacacgctgacgatgacccttcactggccattacaggggtccccgtggtcacttggcctaaaaagactccaaaaaatagggccgtgggtcgcccaaagggcaagttgggacccgcatccgctgtcaagctcgcagctaacaggacaacggccggagctagacggcgacgaacacgatgcaggaagtgcgaggcctgcctcaggactgaatgcggcgaatgtcatttctgtaaagacatgaaaaaatttggaggccctggacgaatgaagcagtcatgtattatgaggcagtgtattgccccagtgctcccacataccgccgtatgcctcgtctgcggagaggccggaaaagaagacacagtggaagaggaagaaggcaagttcaatctcatgctgatggagtgctcaatttgtaatgagatcatacacccaggctgcttgaagattaaagagtctgaaggagtcgtgaacgatgagctgcccaactgctgggaatgccccaaatgtaatcacgccggtaagactggaaaacagaaacggggtccgggatttaaatacgcctccaatctgccgggttcactactcaaggaacaaaagatgaatagagataacaaagaaggccaggagccagctaagagacgtagcgagtgcgaggaagcaccacgtaggcgctccgatgaacacagcaaaaaggtgcccccagacggcctgctgcgtcgaaagagcgacgatgtgcatttaaggaaaaagagaaaatatgaaaagccgcaggaactctccggacgaaagcgggcatcctctctgcagacatcccccggatctagtagtcatttaagccctaggcccccactcggaagttccctgagcccttggtggaggagttccctgacgtacttccagcagcagcttaaaccaggtaaagaggacaagctgttcaggaagaaacgtcggtcttggaaaaatgccgaggaccgaatggcacttgccaacaaaccactgcggagattcaaacaggagcctgaggatgagctgcctgaggcccctcctaagacacgggagtcagaccattcaagaagcagctcccctacagcagggccaagtactgagggtgcagaaggcccagaggagaagaaaaaggtgaaaatgaggcgaaagaggagactcccgaacaaggaactctcaagggagctttcaaaagaactcaatcacgaaattcagcggacagaaaactcgctagcaaacgagaatcaacagccgattaagagtgagcccgaatcggaaggtgaggaacctaagcggcctcccggaatctgtgagcggccacacagattctcaaagggactcaatgggacgcctagagaactgaggcaccagctggggccttccctgcgctcacctcccagagttatctctagacccccacccagcgtgtcacccccaaaatgcatccagatggaacgccatgtgatcagaccccctcctatttcaccacccccagacagcctccctctggacgatggggctgctcatgtaatgcatcgtgaagtgtggatggccgttttcagttacctgtcccaccaggacttgtgcgtgtgtatgagggtatgcaggacatggaatcgttggtgctgcgataaaagactttggacaaggatcgaccttaatcactgcaaatctatcacccccctaatgttgagcggcatcatccggaggcagccagtgtccctggacctgagctggactaacatcagcaaaaaacaactcagctggttgataaataggctgcccggtctgagagatctggtgctgagtggctgctcttggatcgccgtgagcgcgctgtgctcatcgagttgccccctccttaggaccttagatgtacagtgggttgagggtctgaaagatgcccaaatgagggatcttctgagcccccctactgacaacagaccaggccaaatggacaacaggagtaaacttcgaaatatcgtggagctccgactggccggattggatatcacagatgccagcctcagattgataattagacacatgcctttacttagcaagttgcatttgtcttactgtaaccatgtgaccgatcagagcattaacctcctcactgccgtgggaactacaactagggattcccttacggagatcaacctttccgattgtaacaaagtaacagaccaatgcttgagtttctttaagagatgcggtaatatctgccatattgatctacgctactgtaaacaagtgactaaagaaggttgcgagcaattcatagccgaaatgtcggtttcagtacagttcggtcaagtggaagagaagctgcttcagaaacttagttag

SEQ ID NO: 23362 - DNA, 2121 bp, Artificial Sequence
  Description of Artificial Sequence: Synthetic coding sequence
atggcaggtccccagatgggcggttcagcagaggaccacccacctcgtaagcggcacgctgctgagaaacagaaaaagaaaaccgttatctacaccaagtgcttcgagtttgagtctgccacacaaagacccatagataggcagaggtacgatgagaatgaagatctgtctgacgtcgaggaaatcgtgtccgtgaggggattctcactggaggaaaaactgcggtcccagttgtatcaaggagatttcgtgcacgctatggaagggaaggactttaactatgaatatgtgcagagagaggcactacgcgtccccctgatcttccgtgaaaaggacggcctaggcatcaaaatgccagaccctgatttcacggtcagagatgtcaaactgctcgtcggtagtcggagactcgtcgatgtaatggatgtaaatactcagaagggaaccgagatgtctatgagccagtttgttagatactacgagacgcccgaggctcagcgcgacaagctctataatgtgatctcactggagttcagtcatactaagctggaacacctcgtcaaacgccctaccgttgtagacctagtcgattgggtggacaacatgtggccccagcacctgaaagagaagcagacagaagctacaaatgcgatcgcagaaatgaagtaccctaaggtgaaaaagtattgtcttatgtcagtgaaaggctgttttaccgacttccatatcgattttgggggaacatccgtctggtaccatgtttttcgtggaggcaagatcttttggttgatccctccaaccctccacaatttggccctctatgaagaatgggtcctgagcggaaagcagagcgatattttccttggtgacagagtcgaaaggtgccaacgaatcgagctgaaacagggatatactttttttatcccctctggttggatccacgctgtgtacacccctgtggactccttggtcttcggtggcaacatcctgcatagctttaacgtccctatgcagctccgaatctatgagatcgaagatcgcacaagagtgcagcctaagtttagataccccttttactacgagatgtgttggtatgtgttagagagatacgtgtactgcgttacgcagcgcagtcacttaacacaggagtaccagcgggaatcaatgctcatagacgcccctcggaagccctcaatcgatggcttctccagtgactcttggctagaaatggaggaggaggcttgcgatcaacaaccacaggaggaagaggaaaaggacgaggagggcgagggtcgcgacagggcaccaaaacccccaacggatggctctactagccctactagcacccctagcgaggatcaagaggctttgggaaagaagcccaaagcaccagccctgagatttctaaagcgtaccttatcaaatgagagcgaggagtcggtaaagagcaccaccctggctgtcgactatcccaaaactccgacaggtagccctgctacagaagtaagtgcaaagtggacccatctaaccgagttcgagctgaaaggacttaaggccctggtcgagaagctggagtcactgcctgaaaacaaaaaatgtgtgcctgaaggcattgaagacccacaagccctcctcgaaggagtgaaaaatgtgctgaaagagcatgcagatgacgatccaagcttggccataaccggcgtccctgtggtgacctggccaaagaagaccccaaagaaccgggcagtggggaggcccaaagggaagttgggtccagcttctgcagtgaaactggctgctaacaggaccacagcaggtgcacgaaggcgaaggacccgttgtagaaagtgcgaggcttgtctccggaccgaatgtggagagtgccatttctgtaaggacatgaaaaagttcgggggtcccggacgcatgaaacagtcttgtattatgcgccaatgcatcgccccagtcctcccacataccgcggtgtgccttgtgtgcggtgaagcgggtaaggaagatacagtcgaggaggaagaggggaagtttaacctgatgctgatggagtgctcgatttgcaatgaaatcattcatcccggatgcctgaagcgggatcagcccgtatag

SEQ ID NO: 23363 - DNA, 3981 bp, Artificial Sequence
  Description of Artificial Sequence: Synthetic coding sequence
atggcgggacctcagatgggtggaagtgctgaagaccacccgcctaggaaacggcatgccgctgaaaagcagaagaaaaagacagtgatttacaccaagtgtttcgagttcgagagtgccacacagcggcctattgacaggcagcgttatgacgaaaatgaagatctgagcgacgtggaggaaatcgtgtccgtgaggggcttttccttagaggaaaaactccgctcccaactgtaccagggcgacttcgttcatgccatggagggaaaggactttaattatgagtatgttcagagagaggcactgcgagtgcccttgatttttcgggaaaaagacggactggggatcaaaatgcccgaccccgattttactgtacgcgatgtgaagcttctggtcggctcccgcaggctcgtggacgtgatggatgtcaatactcagaaagggacagagatgagcatgtcccagtttgtgcgctactacgagacacctgaggctcaaagagataagctatataacgtaatctccctggagttctcacacaccaaattggaacatctggtcaagcgccctaccgttgtggatctggtggactgggtggataacatgtggcctcagcacctaaaagaaaaacagaccgaagcaaccaacgcaatagccgagatgaagtatcccaaagtcaaaaaatactgcttgatgtcggtgaaaggttgctttaccgattttcatatcgatttcggcggaacttcagtgtggtaccacgtcttccgcggtggtaaaatattttggctcatcccacccacccttcacaacctggcactgtacgaggagtgggtgctgagcggcaaacagagtgacatcttcctcggggatcgggtcgaaaggtgccagagaatcgagttgaaacaggggtatactttctttataccgagcggttggatacatgcagtgtacacccctgtggacagcttggtgtttggaggaaacattctccacagctttaacgttcccatgcagttgagaatctacgaaatcgaagatcgaacacgtgtgcagcccaaatttcggtatccattttattatgaaatgtgctggtacgttttggagaggtacgtgtattgtgtgacccagcggagtcaccttacccaggaataccagcgcgagtcaatgctgatcgacgctccgaggaaaccgtctattgacggtttttcctcggatagttggttagagatggaggaagaggcttgtgatcaacagcctcaggaagaggaggagaaggatgaggagggggagggccgagatagagcgcctaaacctccaacagatggatctacatctcccacatccactccgagtgaggaccaggaggcccttgggaagaagccaaaggcgcctgcactacgcttcctaaaaaggacgctgagcaacgaatcagaagagtccgttaaatccactaccctggcagttgactatccaaagaccccaaccggcagcccggctactgaagtttctgcaaagtggacacatttaactgagtttgagcttaaaggcctaaaagcattggttgagaagctggaatccctgcccgaaaataagaaatgtgtgcctgagggcatcgaggacccacaagccctgctggagggggtgaaaaatgtactgaaggaacacgcagacgacgatccttcactggccattaccggcgtgcctgtggtgacttggcctaaaaaaacacctaaaaacagagcagtcggccgacccaagggaaaactggggccagcttcagccgtcaaactggcggcaaatcgtactaccgccggagcccgtagacggaggacccgctgccgaaaatgcgaggcatgtttaagaaccgaatgcggcgagtgccatttctgcaaagacatgaaaaaatttgggggaccaggaaggatgaagcagtcctgtatcatgagacaatgtatagctcctgttctcccccacaccgccgtgtgcttggtatgtggtgaggccggtaaagaggatactgtggaagaggaagaagggaagtttaatttaatgctgatggaatgcagcatctgcaacgaaataatacaccccggttgtcttaaaattaaagagagtgagggagtggtaaacgacgaattacccaactgctgggaatgtccgaaatgcaaccacgctggcaagacagggaagcaaaaaagaggaccaggctttaagtacgcttccaatctgcctgggagtctgttgaaagagcagaaaatgaatagggacaacaaggaaggacaggaacctgccaaacgtcggtctgaatgtgaggaagcgccaagacggaggagtgatgaacactcgaaaaaagtgcctcctgatggtttactcagaaggaagtctgacgacgttcacttgcggaagaaacgcaaatacgagaaaccacaggaactgtctgggcgaaaaagggcaagctccctccagactagtcctggcagttcaagccacctgtcccccaggcccccactggggagctcactaagcccgtggtggagatcctcactcacctactttcagcaacagcagagacgctcctggaaaaatgccgaggaccggatggcgctcgccaacaaaccactgagaaggtttaaacaggagcctgaggacgaacttcccgaggccccaccaaagacccgtgagagcgatcattcccgctcctcctcacccactgctggtccatcaacggagggcgcagaagggcctgaagagaaaaagaaagtgaagatgaggcgcaaacgtagactgcccaataaggaactgtcccgggaactatctaaggagctaaaccacgagattcaaaggaccgagaactccttggctaacgagaaccagcagccaatcaaatccgagccggaaagcgagggggaggagcccaagagaccccctggaatctgcgaaaggccacatcgcttttccaaaggactcaatggcacacccagagagcttcggcatcaactgggcccttccctaaggtcccccccacgggttatctccagaccgccacccagcgtgagtcccccaaagtgcatccaaatggaaagacacgtaattagacctcctcctatctcacctccaccagacagcctccccctggatgatggagcggctcatgtaatgcatcgagaggtgtggatggcggtgttttcttacctgagtcaccaggatctatgtgtttgcatgagggtctgtcgcacttggaacagatggtgctgcgataagcgtctatggactcgtatcgacctgaaccactgcaaatccattacccccttgatgctgtcaggcatcattcggaggcagccggtgtccttggacctcagttggactaatattagtaaaaagcaactatcatggcttataaataggctgccaggcctgcgcgatctggtccttagcggttgttcttggatcgcagtgtcagccctgtgtagctcatcgtgcccacttctcagaacactggacgtgcagtgggtcgagggcctgaaggatgcccaaatgcgcgatctactgagcccaccaaccgataaccgccctgcccctggacaaatggacaaccgcagcaagctgcggaatatagtggagctccgactggccggattagacataacagacgcctcattgcggctgataattaggcatatgcccttgctctccaaacttcacctgtcatattgtaatcatgtgactgatcagtctataaacctccttacagcagtgggcactacaacgcgcgactccctcacagagattaatctgtccgattgtaacaaggtgacagatcaatgcctgagctttttcaaacggtgcggaaatatctgtcatatcgaccttcggtactgtaaacaagtcacgaaggagggatgtgagcagtttattgccgaaatgtccgtgagtgttcagtttggacaggtcgaagaaaaactacttcaaaagctttcctag

SEQ ID NO: 23364 - DNA, 1680 bp, Artificial Sequence
  Description of Artificial Sequence: Synthetic coding sequence
atgcctgatcccgacttcactgttagagacgttaagctgctcgtaggatcccgtaggcttgttgacgtcatggatgtcaacactcagaagggcaccgagatgtccatgtctcagttcgtcagatattatgaaacccccgaagcccagagggataaactttataacgtcattagcttagaattttcccacaccaaacttgagcacctggtaaaacgcccaaccgtagttgatctggtcgactgggtcgataacatgtggccacagcacctgaaagagaagcagaccgaggctaccaacgctatcgccgaaatgaagtatcctaaagtgaaaaaatactgcttgatgtccgtaaaaggctgcttcaccgacttccacatcgacttcggaggcacttctgtctggtaccatgtgttcagaggcggtaagatcttttggctcattcctccgacactgcacaacctagccctctacgaagaatgggttctctccggtaagcaatccgatatcttccttggagatagggttgagcgctgccagaggatcgagctgaaacaggggtacacttttttcattccttccgggtggattcacgccgtgtatactcctgttgattccctcgtattcgggggtaacattctgcatagtttcaacgttcccatgcaactgagaatctatgagatcgaagataggaccagagtgcagcccaagtttaggtaccccttctactacgaaatgtgctggtatgtgctggagaggtacgtgtactgtgtgacccagcggtcccatctaacccaggagtatcaacgggaatccatgctgatcgacgctccacggaagccgtcaatcgatggcttctcctcagacagctggctagagatggaagaggaagcctgtgatcagcagcctcaggaggaggaagaaaaagatgaggaaggtgaaggacgcgatcgcgcacctaagccacctactgatggtagtacttcaccaacttccaccccttcggaagaccaggaagctctcgggaagaaacctaaagcccctgccttgagatttctgaagcggacactgtcaaatgaatccgaagaatctgtaaaatcaacaaccctggccgtggactacccaaaaacgcccactgggtcccccgctactgaagtgtccgcaaagtggactcatcttaccgaattcgagcttaaaggtttgaaggcgctagttgagaagttggaatcattgcctgaaaacaaaaaatgcgttcccgaggggatagaagacccacaggctctgctggagggggttaagaacgtattgaaggagcatgccgatgacgacccaagtctggccatcaccggagtgcctgtcgttacatggcccaaaaagacgccgaaaaacagggcggtgggacgccctaagggcaagctcggacccgcatccgccgtcaagctggcagcgaatcgaaccaccgcaggagcacggaggagacgcacccgttgtaggaagtgtgaagcatgtctgaggaccgaatgcggcgagtgccacttctgtaaggacatgaaaaaattcggcggacctggaaggatgaagcaaagctgtatcatgagacagtgtatagcgacggcgattagatcccttatctccgcgtgtccgtcttcaaacgcagttgagaccagtgtcatactcacctag

SEQ ID NO: 23365 - DNA, 2340 bp, Artificial Sequence
  Description of Artificial Sequence: Synthetic coding sequence
atggcaatgagtgtgtcagcagaagatgacgattatgagtcagaaccggaccagaatcgagcagtcggcagacctaagggtaagctcggacctgctagcgctgtgaaattagctgccaataggacaacggccggagccagacggaggcgcacacgctgcagaaagtgtgaagcctgccttcgcaccgagtgtggggaatgtcatttctgcaaggacatgaagaagttcggtggtccagggaggatgaaacagtcctgtattatgaggcagtgcatagcccctgtgcttcctcatacagccgtgtgtctagtctgtggcgaggccggaaaagaggacacagtggaagaggaagagggaaaatttaacctcatgttaatggagtgttcgatatgcaatgagattatccaccccggttgcctgaaaatcaaagaatccgagggcgtggtaaatgatgagctcccaaattgttgggagtgccctaagtgcaaccacgccggtaaaacagggaaagcttataaacagaaacgagggcctgggttcaaatacgcgtctaatctgcccggttctttgttgaaagaacagaagatgaacagggataataaggagggccaggaaccggctaaaagaagatctgagtgcgaggaggctccgagaaggcggagcgatgagcactcaaagaaagtgcctcctgacggcctgttacggaggaagagcgacgatgtgcacttgcggaaaaaacgcaagtacgaaaaacctcaagagctgtctggacgcaagcgagcttccagtctgcaaacttcaccagggagctcaagccacctgtcccctaggcctcccctaggcagtagtctcagcccatggtggcgatcgtcattgacttattttcagcaacagctgaaacctgggaaggaagataaacttttccgcaagaagcgcagaagctggaagaacgcagaggacaggatggcccttgccaacaaacctttaagacggtttaagcaagaacctgaggacgagttgcctgaggcaccaccgaagactagagagtcagaccactctcggagctcgagtcccactgctggacccagcacagagggagccgaagggccagaggagaaaaagaaggttaagatgaggcggaaaaggcgattgcccaacaaggagctttcccgagaactgagtaaggagcttaaccacgaaattcaacgaaccgagaatagcctggctaatgaaaaccagcaacccatcaaaagcgaacctgaatccgagggggaggagcccaagcgtccacccggaatatgcgaacgtccgcatagattttcaaaaggccttaacggaacccctagagaactgagacatcagctggggccttcattacgaagccctcctcgggttatctcccggccacccccatcggttagcccccctaaatgtatacagatggaaaggcatgtgattagaccacctcccatatcccccccacctgattccctccccctggacgatggggctgcacatgtgatgcaccgcgaggtctggatggctgtattctcgtacctgagccatcaggacctgtgtgtatgtatgcgggtctgccggacgtggaaccgatggtgttgtgataagcggctatggactcgcattgatctgaaccattgcaaatccataaccccattaatgctgtccgggataattaggagacaaccagtcagcctagatctgtcttggacaaacatctcaaaaaagcagctttcctggctgattaatcggttacccggactccgggacctcgtgctatcgggctgtagctggattgccgtctcagctctgtgcagttcaagctgccctctgttaagaactctcgatgtccaatgggtggagggactgaaggatgcccagatgagggacttgctgtcaccgccaaccgataatcggccaggacagatggataatagaagcaagctaaggaatatcgtcgagctgcggctcgccggactcgatatcacggatgcatctttaagattgattatccgccacatgccactgctttccaagttgcatctttcgtattgcaaccacgtcactgaccagtcgattaatctgctcactgctgtgggtacaaccacacgagactctttgacagagattaacctgtcggattgtaataaagtcaccgatcagtgcctgtccttcttcaaaagatgcgggaacatttgtcatattgaccttcggtactgtaaacaggtgactaaagaaggctgtgaacaatttattgcggagatgtctgtgagcgtccaatttggccaggttgaagaaaagttgttacagaaactgtcttag

SEQ ID NO: 23366 - DNA, 3291 bp, Artificial Sequence
  Description of Artificial Sequence: Synthetic coding sequence
atgggtagtgaggaccacggagcacagaatcccagctgcaagataatgacctttcggccaactatggaggaatttaaggactttaacaaatacgttgcttatatagaatcccaaggagcccatagggccggactggccaaaatcataccacccaaagaatggaaacccagacagacatacgacgatatagatgacgttgttatccctgctccaattcagcaggtggtgacagggcagtctggtttgtttacacagtacaatatccagaagaaggccatgacggttggggagtatagaagacttgctaattctgaaaagtactgtactcctagacaccaggacttcgatgaccttgaaagaaagtactggaagaacttaactttcgttagtccaatctacggcgcagacattagcggctctctctatgacgatgatgtcgcccagtggaacattggcagtctgcggacgatcctcgatatggtggagcgggagtgtgggaccatcattgagggcgttaacaccccttatctgtacttcggtatgtggaagacaacgtttgcctggcacacagaggacatggacctatattccatcaattacctacactttggcgagccaaaatcttggtacgccattccccctgagcatggcaaaaggctggaaagactggctattggtttttttccagggagcagccaggggtgtgacgcctttttgcgacataaaatgacgctgattagtcccatcatattgaaaaaatacggaatcccttttagccgcattactcaagaggcaggggaatttatgattacttttccatatgggtaccacgccggatttaatcacggtttcaactgtgccgaaagtaccaactttgccacccttaggtggatagattacgggaaagtagcaacacagtgcacttgtaggaaagatatggtaaaaatttcaatggacgtctttgtgcgaattttacagccggagcgctacgagttgtggaaacagggaaaggatctgaccgtgctggaccatacccgaccgacagccctgaccagcccggagctatcttcctggtctgccagtagggcaagcctgaaggccaaacttctgaggaggtcccaccgcaagaggtcccagccgaagaagcccaagcccgaggacccgaaatttcctggcgagggcacagccggagctgctttactcgaggaggcagggggttctgtaaaagaggaagcaggacccgaagtggatcccgaagaagaagaagaagagccccaaccacttccccatgggagggaggccgaaggtgcggaggaggacggacggggaaagctaagacctactaaagctaaatccgaacggaagaaaaaaagcttcggcctgctgcctcctcaactgcctcctccaccagcccattttccatccgaagaagcactctggctcccttcaccactggagccacctgtactggggcctggcccagccgctatggaggaatctcccctcccagcaccactgaacgttgtaccacctgaagttccttcggaggagctggaggccaaacctcggcctataatcccaatgctgtacgtggtgcctcgtcctgggaaagcagcgttcaaccaggagcacgtctcttgccaacaagcatttgaacacttcgctcagaaaggacccacatggaaggagcctgttagccctatggaactaacaggcccagaggacggcgctgccagctctggcgctggcaggatggaaactaaggcccgtgccggtgagggccaggccccttcaacctttagtaaactgaagatggaaatcaaaaaaagccgcaggcatcccttggggagaccccctacacggtctcccctaagcgtggtaaaacaggaggcgagcagcgacgaggaggcttcaccattctcaggtgaagaagacgtgagcgatcctgacgccctgaggcctttgctgtcgcttcagtggaagaaccgcgctgccagttttcaggccgagcgaaagttcaacgctgccgctgcccgaaccgagccctattgcgcaatctgcacactcttttacccctactgccaggctctgcagaccgagaaagaggcaccgatcgcttctctgggcaaaggatgccctgcaactctcccttctaagagcaggcagaagactcgcccactcatccctgagatgtgcttcacgtcaggaggtgagaacacagagccgttacccgctaatagttacatcggagacgacggcacatcgcccctgattgcctgtgggaagtgttgcttgcaggtgcatgcgagctgctatggtatccgccctgagctcgttaatgagggctggacttgcagtagatgcgctgcccacgcctggactgctgaatgctgcctgtgcaaccttcggggaggcgctctgcagatgaccacagatcggagatggattcatgtcatttgtgccatcgccgtccctgaagcacgtttcctgaatgtaatcgaaaggcatccagtcgatattagcgcgattccagaacaacgctggaaacttaaatgcgtttattgcagaaagaggatgaagaaggtttctggcgcatgtatccagtgtagctacgagcactgcagtacgagctttcatgtgacctgtgcccacgccgctggagtgctgatggaaccggacgactggccttacgtggttagtataacttgcctgaagcataagagcggaggccacgctgtgcaactgttgagagccgtgagccttgggcaggtggtaataacaaagaataggaacggcctgtattaccgttgcagagtaataggagctgcaagtcaaacctgttatgaagtaaatttcgacgatgggtcttacagtgacaatctatatccagagagcatcacctcaagggattgtgtgcagttgggcccaccatccgaaggggaactggtggagttacggtggaccgatggcaacctgtataaagccaaattcatttcttccgttacttcccacatctatcaggtagagtttgaagacggatcccagctgactgtaaagcggggagatatctttacactggaggaggaattacccaagagagtccgatcaagactttctcttagcaccggagcccctcaggagccagcgttctccggcgaagaggccaaggctgctaagcggccacgggtgggtacccctcttgccactgaagattctgggagatctcaggactacgtggccttcgtggagagccttctgcaggtgcaaggcaggcccggagccccattctag

SEQ ID NO: 23367 - DNA, 1347 bp, Artificial Sequence
  Description of Artificial Sequence: Synthetic coding sequence
atgggctctgaggaccacggcgcacagaacccgtcctgcaaaatcatgaccttcaggcccactatggaagaattcaaagactttaacaaatacgtggcatacattgagagtcagggggcacacagggccggattggctaaaattatccccccaaaggaatggaaaccacggcaaacgtatgatgatattgacgacgtggttatacccgctcccatccagcaggtggtaaccgggcagtccggtctctttacacagtacaacattcagaaaaaagcaatgaccgtgggcgaataccggcgactggctaattccgagaaatattgcacccccaggcatcaggactttgacgatctggagaggaaatattggaaaaatctgacgttcgtaagtcccatctatggtgcagacatctcggggtctctctacgatgatgatgtggcacagtggaatatcggctctttgagaacaatcctcgatatggtggaacgggaatgcggcaccataatcgagggggtaaatacaccatacctgtacttcggcatgtggaagaccacttttgcctggcatacagaggacatggacctgtatagcatcaattacctccatttcggggagccaaaatcatggtatgcaatccctcccgagcacggaaagcgcctcgaacggctcgccataggattcttcccaggctcctcccaggggtgcgacgcattcttgaggcataagatgaccctcatttctcctatcatcctaaaaaagtatggcatccccttttcgcgcattacccaggaggccggtgaatttatgatcaccttcccatacggttaccatgccggtttcaatcacggattcaactgtgcagaaagcactaattttgccacactgcgttggatcgattatggcaaagttgcaacacagtgtacctgtcgcaaggatatggtgaaaatttcaatggacgtcttcgtgcgcattctgcaacccgagcgctacgaactgtggaaacaaggtaaagatctgaccgtcctagatcacacgagacccacagcactgacaagccctgagttgtcttcatggtctgcctcacgggcttctctgaaggcaaagctgttgaggcgcacacccccttgcgtaagccctcaccgacctagtcagcccggtatctggtgccccccagggggagaggctaaagcttcagctgcaagctggttgctgactactaggggacacggtgacacggaggctggccctgggctcggaggggatccactccacgctcagtctgagggccaggccagttgtgtttctacatcaagattgaggatggccactcaagatccatgtcggtag

SEQ ID NO: 23368 - DNA, 3393 bp, Artificial Sequence
  Description of Artificial Sequence: Synthetic coding sequence
atgggttcagaagaccatggagctcagaacccttcctgtaaaatcatgacgtttaggcctacaatggaggaattcaaggacttcaacaagtatgtagcctacattgagtcacagggagctcatcgagccggattggccaagataattccaccaaaagaatggaaacctaggcaaacatatgacgacatagatgatgtggtcattccggcacctatacagcaagtagtgaccgggcaaagcggactctttacacagtacaatatccagaagaaagcaatgaccgtgggggagtaccggagactagccaatagtgagaaatattgtaccccacgccaccaggactttgacgaccttgaaaggaagtactggaagaatctcacatttgtgtctcctatctacggtgccgacatcagtgggtccctgtatgacgacgacgttgcccaatggaatatcggcagcctgaggaccattctcgacatggtggagagagagtgtgggacaatcatcgagggtgtgaatacaccttatctttacttcggaatgtggaagacgacattcgcatggcatacggaggacatggatctatacagcatcaattacctccacttcggcgagcctaaaagctggtatgctatacctcccgaacatggaaaacgcctggagcggctcgccatagggttctttcctggttcttcccaggggtgcgacgcattcctgcggcacaaaatgacacttatcagcccaatcatcctaaaaaaatacggcattcctttctcaagaataacccaggaggctggggaatttatgatcacatttccttacggctaccatgcgggatttaatcacggattcaactgtgccgaatcaacaaattttgccacactccggtggatcgattacggtaaggttgccacacagtgtacgtgccggaaggatatggttaaaatctcaatggatgtctttgttagaatcctgcagccagaacgatatgagttatggaaacaggggaaggatctgaccgtgttggaccatacccgccctaccgccttgacgagccctgaactgtctagctggagcgcctctagggcctcactgaaagctaagctgttaagacggcagatttccctgaaggagaaccgccactggcggaaaaccgaggaggagcgtaagccttcattagaacgaaaaaaggagcaaaccaaacggcctggtctttcttcacataggaagcgttcccaaccaaagaaaccaaagccagaggaccccaagtttcctggcgagggcaccgcgggagccgctctgttggaagaagctggcggtagcgtgaaggaagaagctggccctgaagtcgatcctgaggaagaggaggaggagcctcagccactgcctcatggtagggaagccgagggcgctgaagaagatggcagagggaaactccgcccaaccaaggctaagagcgagaggaagaagaagtcatttggcttgttgcctccgcagctgccccctcctccggcacacttcccaagcgaggaagcactgtggttaccttctcctctcgaacccccagtcctggggccaggccctgccgctatggaggagagccctctccccgctcccctgaacgtggtgccacccgaagtgccaagcgaagagctcgaagctaaaccccgaccgattattccgatgctgtacgtagttccaaggccagggaaggctgcttttaatcaggaacatgtgagctgccagcaggccttcgagcacttcgctcagaagggacctacctggaaagagcctgtgagcccaatggagctgaccggaccagaggacggcgcagcgagttcaggcgctggcagaatggaaacaaaagcaagggctggtgagggacaagcaccatcaaccttttcgaaactgaaaatggagatcaagaagtctagaaggcatcctctaggtagaccgccaacccggtctcctctctccgtagttaaacaggaggccagttccgacgaagaggcatcacccttttctggtgaggaggacgttagcgatcctgacgcgcttcggccattactctcgctccagtggaaaaaccgggctgcctccttccaagccgaaagaaaatttaacgccgctgccgcacgaacagagccatattgtgccatttgcaccctcttctacccatattgccaagcgttgcagaccgagaaggaggcgccaatcgctagccttggcaaaggctgcccggctacattgccttctaaatcaaggcagaaaaccagaccgctaattcccgagatgtgtttcacatcagggggagagaatacggaacccctgcccgctaattcctacataggtgatgacgggacatcaccgttaatagcatgcgggaagtgttgtctgcaagtgcacgcaagctgctacggtattcggcctgagctagtcaatgagggctggacgtgtagccggtgtgctgcgcacgcatggaccgcagaatgctgtctgtgcaacctgaggggtggcgctctgcagatgactacagaccgcaggtggatccatgtgatctgcgctatagccgtaccagaagcgaggttcctgaacgtcatcgagcggcaccccgttgacatcagcgccattccagagcagaggtggaagcttaagtgcgtgtactgcaggaagcgaatgaagaaggtgtccggagcctgcatccaatgttcgtatgagcattgtagtacctccttccacgtcacgtgtgctcacgccgctggagtgttaatggagcctgacgattggccatatgtggtctcaatcacatgtctgaaacataagagcgggggacacgcagtgcaactcctccgcgctgtttcgctgggacaagttgttataactaagaataggaacggcctttattataggtgcagggtcattggcgctgccagccagacatgttatgaggtcaactttgatgatggtagctactcagacaatctgtatccggagtccattacaagtcgtgattgtgtgcagctcggcccacccagcgaaggcgaactcgtagagctgcggtggactgacggtaatctatacaaagctaagtttatatcttccgtaacgtctcatatttaccaagtggaattcgaggacggatcccagttaaccgtgaagcgtggcgacatctttacccttgaagaggagttacccaaacgcgtccgctccaggctgtccctcagtaccggagctcctcaggaaccagccttctcaggggaagaagctaaggccgcaaaacgcccacgcgtcgggaccccattggccaccgaagacagtggtagatcccaagattatgtggcctttgttgaatccctgctgcaagtccagggaaggcctggggctcctttctag

SEQ ID NO: 23369 - DNA, 3144 bp, Artificial Sequence
  Description of Artificial Sequence: Synthetic coding sequence
atggaagtagcagaggtggagagcccgctgaacccttcttgtaagatcatgaccttccgccctagcatggaagagttcagggaattcaataagtatctcgcatatatggaatcgaagggcgcacaccgcgctggtctggctaaagtaatccctcctaaagaatggaaacccagacagtgctacgacgacatagacaacctcttaattccggctccaatccagcagatggtaactggccagtctgggctctttacccagtacaacattcagaaaaaggctatgacagttaaagagttccgacagctggcaaattccggcaagtattgtacgcctcgatacctggactatgaggacctggaacggaagtactggaagaatttgaccttcgtagcccctatttatggtgcggatatcaacgggtctatttacgacgagggagtggatgaatggaacatcgctcggcttaataccgtgcttgacgtcgttgaagaagagtgcgggatctccatcgagggtgtgaacactccttacctgtattttggaatgtggaaaactacctttgcttggcataccgaggacatggacctgtatagcatcaattatctgcacttcggcgagccaaagagctggtatgccataccccctgagcacggcaagagactggaacggcttgctcagggttttttccccagctcctcccaggggtgtgacgcatttttaagacacaagatgactttaatcagcccctctgtgttgaaaaagtatgggatccccttcgacaagatcacgcaggaggcaggagagtttatgatcactttcccttacggctatcacgcgggtttcaaccatggcttcaactgcgctgaatctacaaacttcgccacagtcagatggatcgactacggcaaggtggctaagctgtgtacgtgccgtaaggacatggtgaagatctctatggacatcttcgtaaggaaattccagccggatcgctaccagctctggaaacagggcaaagacatctacacaatcgatcatactaaacccacccctgcctctactcctgaagtaaaagcatggctgcagcgccgtcgcaaggtgagaaaggcctctagaagttttcagtgcgcgagaagcacctctaaacggcctaaagcagacgaagaagaggaggtcagcgatgaggtggatggggcagaggtacctaatcctgactccgtaaccgatgatctgaaggtgtcggaaaagtcagaggccgctgtgaaactgcggaatacagaagcaagcagcgaggaggaatccagcgcctctcgcatgcaggtcgaacaaaacctgtcagaccacatcaaattatccggcaactcctgtttatccacaagcgttactgaagacataaagacagaggacgacaaagcttacgcgtataggtccgtgccctcaatttcttccgaggccgacgactcaatccccctcagttcaggatacgaaaaaccagagaagtccgatccgtctgagttaagttggcccaaaagcccggaatcttgctccagcgtcgccgagtctaatggggttttaacagaaggagaggaaagcgacgtcgagtcccatggaaacggtttggaacctggagaaatcccggcagtcccttcgggggagaggaattccttcaaagtgccttcaatagccgagggcgagaataaaacgagtaaaagttggcgtcacccgctgtcccgaccaccggctcgcagtccaatgacgttagtcaaacagcaagcaccaagcgacgaagaactacctgaggtgctgagtatcgaagaggaagtggaggaaacagagtcttgggcaaagcccttgatacacctgtggcaaacaaaatctccgaactttgccgctgaacaggagtacaatgcgactgtggctcggatgaaaccacactgcgcgatttgcactctgctgatgccataccacaagcccgactctagcaacgaggagaacgatgcccgttgggagacaaaactggacgaggtcgtgactagtgagggcaagaccaagccacttatacctgagatgtgttttatatactctgaggagaatatcgaatacagcccaccaaacgcttttcttgaagaggacgggacttccctgctgatctcatgcgcgaaatgctgtgtcagagtccatgcatcttgctacggaatcccttcacacgagatctgcgacggatggctctgcgcacgatgtaaaaggaacgcatggacagccgagtgttgcctgtgcaacctccgcggaggtgcattgaagcagaccaaaaacaataaatgggcccacgtgatgtgtgctgtggctgttccagaggtcaggtttacaaatgtccctgagagaacccagatcgacgtaggccgtattccactgcagcgcctaaaactcaagtgtatattctgtagacaccgtgtcaaacgcgttagcggtgcttgtattcaatgctcctacggtcggtgtcccgcatcatttcacgtcacttgtgcacacgccgctggggttttgatggaacccgacgactggccttatgtggtgaatatcacttgtttccggcataaggtaaatcccaacgtgaaaagtaaggcttgcgagaaagttatcagcgtggggcagactgtgattaccaaacatcgtaacacacgatattactcctgccgggtcatggctgtcacctcccagaccttttatgaggttatgttcgacgacgggtcattttctcgcgataccttcccggaggatattgtaagcagagattgcctcaaactcgggccacccgcagaaggggaagtcgtgcaggttaagtggccagacggtaagctgtatggtgcaaaatactttggtagtaatatcgcgcacatgtatcaggtggaattcgaagacggttctcagatcgccatgaaacgagaggacatctatacactggatgaggagctacctaagcgcgtgaaagccagatttgttagcgccggacggtgtcatctgggtacttgccaagtaaacagcttatcaagccctcatgtatcccaggcgcagcaagagacatatctcggattctggatcaattccaagaaaagccagtgtaatatctttctgtctggcacttactag

SEQ ID NO: 23370 - DNA, 3171 bp, Artificial Sequence
  Description of Artificial Sequence: Synthetic coding sequence
atggaagtcgcagaggtcgagtcccccctcaaccctagctgtaagatcatgacttttcgtccaagtatggaggaattccgggaatttaacaaatacctggcttatatggagtctaaaggtgcccatagggctggactagctaaagtgatccctccgaaagagtggaagccccgacagtgttacgacgacatcgacaatctcctgatccccgcaccaatccagcaaatggtcactggccagtccggtctcttcacccagtacaacatccagaagaaggccatgacagttaaggaatttcgacagttagccaactccggaaagtattgcaccccccgatacttggactatgaagatttagagagaaaatattggaaaaatctgacatttgtggctcccatctacggagcagatataaacggctcaatctatgacgagggagtggacgagtggaacatagctcgccttaatacagttctagatgtggtggaggaagaatgcggtatctccatcgagggagttaataccccttatttgtatttcgggatgtggaagactacttttgcatggcacacagaggacatggatctgtattctattaactatctccactttggcgaaccaaaatcttggtatgcgattccacccgaacatgggaagcgcctggagagactggcacaaggcttcttcccttccagtagccagggttgtgatgcattcctgcgacataagatgaccctcataagtccctccgttttaaagaagtatggaattcccttcgataaaatcacccaagaggctggcgagtttatgattactttcccatacgggtatcacgcaggctttaatcacggattcaactgcgccgagagcactaattttgctactgtgcgctggatcgattatgggaaggtggcaaagctctgcacctgtcgaaaggatatggtgaagatctctatggacatttttgtcagaaaattccagcccgacagataccaactgtggaaacaaggcaaggatatctatacgatcgaccatacaaagccaacacctgcttccacacctgaagttaaggcttggctccaaaggcgccgtaaggtccgcaaagcctccaggtctttccagtgtgctcggagcacttccaaacgcccaaaggctgatgaagaagaagaagtgagcgatgaggtggacggggcagaggtaccaaacccggattccgtgacagacgaccttaaggtctcggaaaaatcagaggccgctgtgaagctgagaaacaccgaagcctccagcgaagaggagtcctctgcgtccaggatgcaggtggaacaaaatctgtctgaccacattaaactgagcggcaacagctgtctgtctacttctgttacagaggacattaagaccgaggatgataaagcttacgcctatcggtcagttccgtctatttcgagtgaagctgatgactccattccattgtccagcggatatgagaagccagagaaaagcgacccaagcgagctcagttggccaaagagcccagagtcatgttcatctgttgccgagagtaatggcgttctgacggagggagaagagtcggacgtcgagagccacgggaacggcctcgagccaggagaaatccctgccgtcccctctggggaaaggaattctttcaaggtcccaagtatagcagagggcgagaacaagacatccaaaagctggagacaccccctgtctaggccaccagctaggtctcccatgaccttggtgaaacagcaggctcctagtgatgaagagttgccagaagtgcttagcatcgaggaagaggtggaggagactgaatcatgggctaaacctcttatccatctttggcagacgaagagtcccaattttgcagcggagcaggaatacaatgcaactgtggccaggatgaagcctcattgcgctatctgtacactgctaatgccatatcacaagccagattcttcgaacgaagagaatgatgctagatgggaaacaaaactggacgaagtggtcacatcggagggcaagactaagccactcatccccgaaatgtgcttcatctactctgaagaaaacatcgaatattccccgccaaacgcttttttagaggaggacggtacatccctcctgatttcttgtgctaagtgttgtgtgagggtacatgcatcgtgctacggaatcccaagccacgaaatttgcgatgggtggctgtgcgcgagatgcaaacggaatgcgtggactgcggaatgttgtttatgcaatctgagaggaggtgctctgaagcagacaaaaaataacaagtgggcacacgtgatgtgtgccgtggccgttcctgaggtcaggttcacaaatgttcccgagcggactcagattgacgtggggaggattcccttgcagcggctgaagctgaaatgtatcttctgtaggcaccgggtgaaacgggtctccggtgcttgtatacaatgctcatacggtaggtgccccgcatcctttcacgtgacctgcgctcatgcggcaggcgtcctgatggagccagatgactggccgtatgtcgtgaatattacatgcttcaggcacaaggtgaatccaaatgttaaatccaaagcttgcgaaaaagtgattagcgtcgggcagacggtaatcacaaagcaccgaaatacccgttactacagctgtagggtgatggcggtgacatctcagacattttatgaggtgatgtttgacgatggtagtttctcacgggatacattccctgaggacatagtgtcaagagattgcctcaaattggggccaccagccgaaggagaggtggtacaggttaagtggcccgacggcaaattatatggtgcaaagtatttcggatcaaatatcgctcatatgtaccaggtcgagtttgaggacggttctcaaatcgccatgaaacgcgaggacatttatacactggatgaggaattaccaaaacgggtgaaagcacggttttcaaccgctagcgatatgagatttgaggacactttctacggagccgacatcattcagggagagcgtaaacgtcagcgggtgctgagttctagattcaagaatgagtatgtcgccgatcctgtgtaccgcactttcctgaagtcctccttccagaagaaatgccagaagcgccagtag

SEQ ID NO: 23371 - DNA, 1065 bp, Artificial Sequence
  Description of Artificial Sequence: Synthetic coding sequence
cccgattcttctaatgaggaaaatgacgccagatgggaaacaaagctcgatgaggtggtcacttctgaaggtaaaactaagccacttatccctgaaatgtgctttatatacagcgaggagaatatcgagtacagccctccgaatgccttccttgaggaagatggaacctctctgcttattagttgcgctaaatgttgcgtgcgggttcacgcctcatgctacggcataccttcgcacgagatctgcgacggctggctctgcgcacgatgtaagaggaacgcttggacagccgaatgttgtctgtgtaaccttcgcggtggagccctgaaacaaactaagaacaacaagtgggcacacgtgatgtgtgctgtcgctgtgcccgaggtgcggttcacaaacgtccccgagagaacacagatagatgtgggcaggatcccccttcagcgtttgaagttgaaatgtattttctgtcggcatcgtgtgaaacgcgtgagtggagcctgcatccagtgctcttacggccgatgtccagccagcttccatgttacctgcgcccacgctgcaggtgtgctcatggagcccgacgactggccatacgttgtaaacatcacctgctttcgccacaaagtcaatccaaacgtgttcacagcccagtctaaacactctaaaaatgagtcttgtatcgctacaacaacctccgcagcagccgctggagctactatcctatgcgagctgggccacaagtctaaggcttgcgaaaaggtcatctccgtgggacaaacagtgatcaccaaacatagaaacactaggtactactcctgcagggtcatggccgtgacgtcccagacattctatgaggttatgttcgatgatgggtccttctcacgggacacttttccagaggacatcgtgagtcgagattgtctcaaacttggcccacccgctgaaggagaagtggtccaggtcaaatggcctgacggcaagctgtacggagctaaatatttcggatccaatattgctcacatgtaccaggtggagttcgaggacggcagccagattgcttag

SEQ ID NO: 23372 - DNA, 2232 bp, Artificial Sequence
  Description of Artificial Sequence: Synthetic coding sequence
atggttaagatctctatggacatttttgtcaggaagttccagcctgaccgataccagctgtggaagcaggggaaggacatctataccatcgaccacaccaaaccgacccccgcttcaacaccagaggttaaagcctggctgcaaagaaggcggaaggtgagaaaggcctctagatccttccagtgtgctagatctacctccaaaagacctaaggctgacgaggaagaagaggtcagtgacgaggttgatggcgctgaagtcccaaatcctgatagtgtaacagacgatctgaaggtctctgagaagagtgaagccgctgtgaagctgaggaatacagaggcctccagcgaggaagaatcctcggcctcccgcatgcaagttgagcagaatctctcggatcacatcaaactgtctggcaactcatgcctgagcacatctgtaactgaggatatcaagaccgaagacgataaagcctatgcgtacaggtctgttccatcaataagctccgaggccgatgatagtattcctcttagctctggatatgagaaaccagagaagtccgatcctagcgagttaagctggcctaagagccccgagagttgtagcagtgtggccgagtcaaatggagtactgactgagggagaagagtctgatgttgaatcccacggaaatggcctcgaacccggtgagatcccggctgttccatctggtgaacggaacagtttcaaggtgccctccatcgctgaaggggagaataagacctcaaagtcctggcggcatccgctgtctcggccacctgcaaggtcccccatgacccttgtcaagcagcaggctccatctgatgaggagttgcctgaagttttatccatagaagaggaagttgaggagactgaatcatgggccaaacctctcatccatctgtggcagaccaaatcacccaactttgccgctgagcaggagtacaacgctaccgtagctcggatgaaacctcactgtgcaatctgcactcttctcatgccctaccacaagcctgactcctcgaacgaggaaaatgatgccagatgggagaccaaactggatgaagttgttacctctgagggcaaaactaagcctttaattcccgaaatgtgctttatatacagcgaagagaatatcgagtacagtccaccaaatgccttcctggaagaagatggcacctcattgctgatcagctgcgcaaaatgttgcgttcgggttcatgcttcatgctacggaataccatctcatgagatttgcgatgggtggctatgtgctcgatgcaagcgtaacgcgtggaccgcggagtgctgcttgtgtaatttacggggaggggcactcaagcaaactaaaaataataagtgggcacacgtgatgtgcgccgttgcagtccccgaggtcaggttcaccaatgttcccgagaggacccagatcgatgttggaaggattccattacagaggttgaagctgaagtgtattttttgtcggcatagagttaaaagagttagcggggcatgtatacagtgtagctacggtcggtgtcctgcgtccttccacgtgacgtgtgcccacgcagctggagtgctgatggagccagatgattggccgtacgtggtgaatattacttgctttcgtcacaaggtgaaccctaatgtgaagtcgaaggcttgcgaaaaagtaataagcgtgggacagacagtaatcacgaaacacaggaacactaggtactatagttgcagagtaatggccgttacatctcagacgttttacgaagtcatgttcgacgatggttctttctctcgagacaccttccccgaggatatcgtatccagagactgtctgaaactggggccaccggcagagggggaggtggtccaggtaaaatggccagatggcaaattgtatggcgcaaagtactttgggtctaacattgcccatatgtatcaggtggaattcgaggacggctcccagatagccatgaagcgggaagacatctatactctagacgaggaactccccaagagagtgaaagccaggtttagcacggcttcggatatgagatttgaagacaccttttacggagctgacatcattcagggcgagcgtaaacgacagagggtgctgtccagtcggttcaagaacgagtacgtggccgatccggtctacagaacattcctgaagagctcatttcagaaaaagtgccagaaaaggcagtag

SEQ ID NO: 23373 - DNA, 2406 bp, Artificial Sequence
  Description of Artificial Sequence: Synthetic coding sequence
atgtggaaaactacatttgcatggcataccgaggacatggatctgtactctattaactatctccactttggagagccaaagagctggtacgccatccctcctgagcatgggaagcgcctcgaacgactggcccaaggcttcttccccagtagcagtcagggttgtgacgcattcttacgccataagatgaccttaatatccccgagcgtgctgaagaaatacgggatcccttttgacaagatcacccaggaagccggagagtttatgatcacattcccttatggatatcacgcaggctttaatcatggctttaactgcgctgaatcaacgaactttgccaccgttaggtggatagactatggtaaggtggctaaactgtgtacttgtcgcaaggatatggtcaaaatatctatggacatattcgtgaggaaatttcagcctgatcgttatcagctatggaaacaagggaaggatatctacacaatagaccatactaagccaactcctgcttccacccccgaggtcaaggcttggctgcagagacgaaggaaggtgaggaaggcgagcaggtccttccaatgtgccagatccacctctaaaagacctaaagctgacgaggaagaagaggtttctgacgaggtcgacggtgccgaggtgccaaaccccgactccgtaactgacgacctgaaagtttcggagaagtcagaggccgcagtaaagctgcgaaacaccgaggcttcttctgaagaagagagcagcgcttccaggatgcaggtcgagcaaaatctgtccgatcatatcaagctgagcgggaactcctgcctcagcacttccgtgactgaggacataaagacagaggatgataaggcgtacgcctacagatccgtgccctctatctccagcgaggctgacgactctatccctctgtcaagtgggtacgagaagcccgaaaaatctgacccgtcagagttgtcttggccaaagtcacctgagtcatgctccagcgttgcagagtctaatgagctcccggaggtgctttccattgaggaagaagtggaggagaccgaaagttgggctaagccacttattcatctgtggcagactaaaagccccaattttgctgccgaacaggaatacaacgctactgtcgctagaatgaaacctcactgcgccatctgcactcttctcatgccctaccacaaaccagattctagcaacgaagagaatgacgcgagatgggagaccaagctcgatgaagtggtaacatccgaaggaaagacaaaaccgttaatcccggaaatgtgttttatatattctgaggagaacatagaatactccccccctaacgctttcttagaagaagatggtacatctcttctcatctcctgtgcgaaatgttgcgtgcgtgtgcacgcatcctgctatggcattccaagtcacgaaatatgcgatggatggctgtgtgccaggtgtaaacggaacgcctggacggcggaatgctgcctttgcaacctgcgcggaggcgctctcaaacagacaaagaacaataagtgggcccatgtgatgtgcgccgttgccgtgcccgaagtcagattcacgaatgtgccagagcggactcaaatcgacgtgggaaggattccccttcagcgactgaaattgaaatgtatcttttgtaggcatcgcgtgaagcgagtatccggcgcttgcatacagtgcagttatggcaggtgtcccgctagttttcatgtgacttgcgctcacgcggctggcgtgctcatggaaccggatgactggccatacgtcgttaatattacctgctttcggcacaaagtgaaccctaatgtgaagagcaaagcttgtgagaaggttatctccgttgggcagaccgtgattacaaaacacagaaacacaagatactatagttgccgagttatggcagtgacctctcagactttttacgaagtgatgtttgatgacgggagcttctccagggatacattccccgaagatatcgtttctcgggactgcttgaagttgggcccaccagcagaaggggaggtggtgcaggtgaagtggcccgacgggaagctctatggcgctaaatatttcgggtccaacatcgctcacatgtatcaggtcgagttcgaggatggctcccagattgcaatgaagagggaagacatctatactctcgacgaggagctacccaagagggtcaaggcgaggttctctaccgcttccgacatgcggttcgaggataccttctacggggcagacatcatccagggagagagaaagcggcagagggtgctgtccagcagattcaagaacgaatatgtggccgaccctgtataccggacgttcctgaaatcaagcttccaaaaaaaatgtcagaagcggcagtag

SEQ ID NO: 23374 - DNA, 2508 bp, Artificial Sequence
  Description of Artificial Sequence: Synthetic coding sequence
atgaagcactatgggctgccttggaagaggaccgaagaagccgctgctgatacagctctgaccatcatggaggttgcagaggtggaaagccccctcaacccgtcctgcaagatcatgacttttcggccttcgatggaggagtttcgcgagtttaacaagtacctggcgtatatggagagcaaaggcgcacatcgcgctggtttagccaaagttatcccacccaaagagtggaagccaaggcagtgttatgatgatatcgacaacctcttgatccctgcgccaatccaacagatggtgacaggccagagcggcttatttacccagtataacatccagaagaaagccatgactgtgaaggagttccgtcagctcgccaacagcgggaaatattgcaccccacgctatctggactacgaagacctagagcgtaaatattggaagaatctgacattcgtggcccctatctatggcgcagacataaatggctccatatatgatgagggagtggatgagtggaatattgcacgcctgaatactgtgttggacgtagttgaagaagagtgcgggatctctatcgaaggcgtcaatacgccttacctctactttggcatgtggaagaccacatttgcctggcatacagaggatatggacctatatagtatcaattatctgcatttcggagagccaaagtcctggtatgcaattccaccggagcacggtaagagactggagcggcttgcacaaggattcttccccagctcgtcccagggctgtgatgcattcctccggcataagatgacacttatcagcccttccgtcctgaagaagtacggtatcccttttgacaagattactcaggaagcaggtgaattcatgattacctttccttacggataccacgccggttttaaccatggatttaactgtgccgagagcacgaatttcgctactgtgcgatggattgactacgggaaggtggcaaagctctgcacctgtagaaaggatatggttaaaatctcaatggatatcttcgtgcggaagttccaaccagaccggtatcaactgtggaagcaaggaaaggacatttacactattgaccacacaaaaccgacacccgcatcgacccccgaggttaaggcttggctccagcgcaggaggaaggtccggaaggccagtcgctcctttcaatgcgccagaagtacttccaagaggccgaaagcagacgaagaagaggaggtctccgatgaagtggacggagccgaggtccccaatcccgacagcgtcactgacgatctaaaggtcagtgaaaagtcagaggctgctgttaaactcagaaatacggaggcctcctctgaagaagaatcctccgcctctcgcatgcaggtggaacagaatctgtccgaccacataaaactctcagggaatagttgtctttctacgtctgtgacagaagacattaaaacagaagacgataaagcctacgcttataggtctgtaccaagtatttcatcagaggctgatgattctatcccactgagtagtggatacgagaaaccggagaaatcggatcctagtgagcttagctggcctaaatctcccgagtcttgtagctcagtggcagaaagtaatggggtgctgaccgaaggtgaagaatccgacgtggagagtcatggcaacgggctggagccgggagagattcctgctgtgcctagcggagagcggaattccttcaaggtaccctctatcgcagagggtgagaacaagacatccaagtcctggaggcatcccctgagcagacccccagctaggagtcccatgacactagtgaagcaacaggctccgagtgacgaggaactccctgaggtgctcagtatagaggaggaagtagaggagaccgagtcatgggccaaacccttaattcacctttggcaaacgaaatcccctaatttcgcggcagagcaggaatataacgctaccgtggcaagaatgaaaccccactgcgcgatctgcactctgctcatgccctaccacaagcctgatagttccaacgaggagaacgacgccaggtgggagactaagcttgatgaagtggtgacctctgaggggaaaaccaagccactgatcccagaaatgtgctttatctatagtgaagagaacatagaatacagtccccctaatgccttcttggaggaggatggaacctcgctcctgatatcttgcgcgaaatgctgcgtgagagttcacgcctcatgctacggcataccctcccatgaaatttgtgacggttggttgtgcgctaggtgcaaaaggaatgcttggaccgctgagtgctgcttgtgcaatctcagaggaggagcgcttaaacagaccaaaaacaataaatgggcgcacgtgatgtgtgccgtggcagtgcctgaagtgcgcttcaccaacgtccccgagcggactcagattgatgtaggcagaatccctctccagagacttaaattaggaaggctaggaatctag

SEQ ID NO: 23375 - DNA, 1890 bp, Artificial Sequence
  Description of Artificial Sequence: Synthetic coding sequence
atgtggaaaactacttttgcctggcacacggaagatatggacttatatagtatcaactacctgcattttggtgagccgaagagctggtacgcgataccacccgaacacggtaagcggctcgagagactggcccaaggcttctttccgtcgtccagtcaggggtgcgatgccttcctgagacacaaaatgacactgatcagtcccagcgtgctgaagaaatatggaattccttttgacaagatcacccaggaagccggtgaattcatgatcaccttcccctatggttaccatgcgggttttaatcacggatttaattgcgctgagtctacaaatttcgccacagtgcggtggattgattacggaaaggtcgccaagttgtgcacttgtaggaaggacatggtgaaaatcagtatggatatttttgtgcgcaaatttcagcccgacagataccagctatggaagcagggtaaagacatatacactattgatcatactaaaccaactcctgcatctacgcccgaagtcaaggcctggttgcagcggcgtcgaaaggttcggaaggcttctcgctcgtttcagtgcgcccgtagcacatcaaaaaggccaaaggctgatgaggaggaggaagtgagcgacgaggtcgatggcgctgaagttccaaaccccgattctgtgactgacgaccttaaagtcagtgagaaatctgaagccgcagtgaagctgcggaacactgaggcatcttcggaagaggaaagctcagcaagccgcatgcaggtggaacaaaacctgtctgaccacattaagctgtcaggcaattcctgtctcagcacttccgtcacggaggacatcaagaccgaagatgacaaggcttacgcctaccgttccgtaccaagcatcagtagtgaagctgatgactccattccgctgtcttccggatacgagaaacctgagaagagtgacccaagtgagctgtcatggcccaaaagcccggaatcttgttcctccgtcgccgaaagtaatggcgtgctgaccgagggtgaagaaagtgacgtggaaagtcatggaaacggacttgagcctggagagatcccagccgttcctagcggtgaacgcaactctttcaaagtgccctctatcgccgagggggaaaacaaaaccagcaagtcatggcgtcatcccttatctaggcctcccgctcgctccccaatgacactggtgaagcagcaagctccatcagacgaggagctgccagaggtcctgagtatcgaggaggaggtcgaagagactgaaagttgggccaaaccccttattcatctgtggcagacaaagagcccaaatttcgcagccgagcaggagtacaatgctaccgtggcacgtatgaagccgcactgcgctatttgcaccctcttaatgccctaccacaaaccagactctagcaatgaagaaaacgacgcccgttgggagacgaaactggacgaagtcgtaacctcagagggcaagactaaaccgcttatcccagagatgtgtttcatctattccgaagagaatatcgaatacagtcccccaaacgcttttctagaggaagacggtacttccctactgatctcatgtgctaagtgttgtgtcagagtgcatgcaagttgttacggcatacctagtcatgaaatctgtgatggatggctttgcgcgagatgcaaacggaatgcgtggacagcagagtgctgcctctgtaaccttcgcggaggagctctcaagcagaccaaaaataataagaacgcctcctccgccgacacgggactccgtggaagcttggagccggcttccagtgttccaactgtggccgcacgtcccccaagcatgtcactcgttccaatgctcctggggtactag

SEQ ID NO: 23376 - DNA, 2442 bp, Artificial Sequence
  Description of Artificial Sequence: Synthetic coding sequence
atggaagttgcggaggtggaatcccccctcaacccgtcctgcaagataatgacctttcgcccttccatggaggagttcagggagtttaacaagtaccttgcgtacatggaaagcaaaggtgcccacagagctgggttagccaaagtaatcccacccaaggagtggaaaccacgccagtgttatgacgacatagacaacctcctgattcccgctcctattcaacagatggtgaccggacagagcggattgtttacccagtataatatccaaaagaaggcaatgacggtgaaagagtttcgacagctggccaatagcggaaaatactgcacaccgaggtacctggactacgaagaccttgaacggaagtactggaaaaacctgacattcgttgcacccatttatggcgcagacatcaacggatcaatatacgatgaaggtgttgacgaatggaacatagctcgactcaataccgttctcgatgtggtggaggaagagtgtgggatctctatcgagggggtgaacaccccatacctgtactttggaatgtggaaaacgacatttgcatggcacactgaagacatggacctttactctatcaattatttacacttcggagaacctaaatcctggtatgccattccacccgaacacgggaagagactcgaacggctcgctcagggctttttcccaagttcaagccaagggtgtgacgcctttctcaggcataagatgactcttataagtcccagcgttctgaaaaagtacggaattcccttcgataaaataacacaagaggccggagaatttatgattaccttcccatatgggtaccacgcagggtttaatcacggattcaattgcgcagaatccacaaactttgccacagtgaggtggattgattatggcaaggttgccaaactgtgtacttgcaggaaggacatggtgaagattagcatggatatcttcgtgcggaagtttcagccagaccgatatcagctctggaagcagggcaaagatatttatactatagaccacaccaaaccgacgccagcttccacccccgaggtgaaggcatggttacagcggcgacggaaggtgagaaaggctagtagatcctttcaatgtgctaggtccacttccaagaggccaaaggccgatgaggaagaagaggtttccgatgaagtagatggagctgaagtaccgaaccccgattcagttaccgatgatttgaaagtctcagaaaagagcgaggccgcagtcaagctccgtaacacagaagccagctctgaggaggaaagcagcgcctctagaatgcaggtggagcagaacctgtccgatcacattaaactgtctggaaactcctgcctgagtactagtgtgaccgaagacatcaaaaccgaagatgacaaggcttatgcctacaggagcgtgccttcgatctcgagcgaagccgacgatagcatccctctttcctccgggtatgagaagccggaaaaatctgacccttccgagctttcttggcctaagtctcctgagtcttgctcctcagttgccgaatccaacggagttcttaccgagggagaagaatcagacgtggagagtcacggtaacgggttggagcccggagagataccagctgtgccaagcggggagcgaaacagtttcaaggtgccttctatcgcggaaggagaaaacaagacaagcaagtcatggcgccatcctttgtcacggcctcccgctaggtcccccatgacactcgtcaagcagcaggctccatctgacgaagaacttccagaggtactgtcgattgaagaggaggtcgaggagacagagtcctgggctaagcccctgattcatctctggcaaaccaaatcccctaactttgccgcagagcaggaatacaacgccactgtggctagaatgaagccacattgcgccatctgcactttactgatgccttatcacaaaccagacagctccaatgaagaaaatgacgcgcgttgggagactaaactagatgaagtggtcacctccgaaggtaagacaaagccactgatcccggagatgtgcttcatctactcagaagaaaatatcgagtattcccctcccaacgcatttctggaagaggacggaacttctctgctgatctcttgtgctaagtgctgcgtgcgggtgcatgcaagttgttacggaatccccagccatgaaatttgtgacggatggctttgtgcacgttgtaaacgtaacgcctggaccgcagagtgctgcctgtgcaacctcaggggaggggctctgaagcagactaaaaataataagtgggctcatgtcatgtgtgcagttgcggtgccggaagtgaggttcacaaatgtgcctgagcgcacacaaatagacgtgggtagaattcctctgcagcgtcttaagctcggtaggttgggaatctag

SEQ ID NO: 23377 - DNA, 1572 bp, Artificial Sequence
  Description of Artificial Sequence: Synthetic coding sequence
atggaaactatgaaaagtaaagctaactgcgctcaaaacccaaattgcaatataatgatattccaccccactaaggaggagttcaacgacttcgacaaatatattgcctatatggaatcacagggcgctcaccgcgcaggtctcgcaaaaatcattcctcctaaggagtggaaggcgcgagagacatatgataacatctcagaaattctgattgccacgcccctccagcaggtagcctccggccgtgcgggtgtgtttacgcaatatcataaaaaaaagaaagcaatgactgtaggcgagtatcgacacctggctaattctaagaaataccaaaccccaccgcaccagaatttcgaggacttggaaaggaagtattggaagaaccggatatacaactctcccatttacggagccgacattagcggcagcctgttcgatgaaaacacgaagcagtggaatctcggccacttgggaactattcaggatttacttgagaaggaatgcggggtggtgatagagggggtgaatactccttacctgtatttcggtatgtggaaaacaactttcgcctggcacacagaagatatggatctctactccattaattatctccacctcggggagccaaagacatggtacgtggtgccccctgaacacggccagcggctcgagagacttgccagggaattgttcccgggatccagtcgcggatgcggcgctttcctgagacataaagtggctctgatcagtcctaccgttctaaaagagaacgggattccctttaatagaattacccaggaggccggagagttcatggttacattcccctatgggtatcacgccggtttcaaccatggctttaactgcgcagaagctattaatttcgccacccctcgctggattgactatggaaaaatggccagtcagtgcagctgcggcgaagccagagtgaccttttctatggatgccttcgtgagaatcctacagcccgaacgctacgacctttggaaaagaggccaagacagggccgttgtggaccatatggagccacgcgtgcctgcctctcaggagctttccacacagaaggaagtacagctccctaggagagctgccttgggcctgcgtcagttgccttcgcattgggcccgacacagcccatggccaatggcagccagaagcggtactcgctgccataccctggtgtgtagcagcctgccacgcagatcagcagtgagtggtactgccacgcagccaagagccgctgcagttcactcttcaaagaagccatcatccacaccctcatccacccccggacccagtgcgcagattatccacccgagcaacggacggaggggcagggggaggcccccacagaagttacgggctcaggaactcacactgcagactccagcgaagcggcctctgctggccggaacaacgtgcacagccagtggcccagaaccagagccactgcctgaggacggcgctctgatggataaaccggtgcccctctctccaggtctgcagcacccagtcaaggcctctgggtgtagttgggcccctgtcccatag

SEQ ID NO: 23378 - DNA, 1521 bp, Artificial Sequence
  Description of Artificial Sequence: Synthetic coding sequence
atgaagagtgtacattcttcgcctcagaacacctctcacactattatgacattctaccccaccatggaggaatttgcagactttaatacttacgtcgcttacatggagtcacagggggctcaccaagccggactggctaaggtcatccctccgaaggaatggaaagccaggcagatgtacgacgacatcgaagatatccttatcgccaccccacttcagcaagtgacctccgggcagggtggggttttcactcagtatcataagaaaaagaaagccatgcgtgtcggccagtatcgacgcttggcaaattcaaaaaagtatcagacgccacctcatcaaaacttcgcggatcttgagcaacggtattggaagagccaccccggaaatccacctatatacggggctgacatttccggttccttgttcgaggagtccaccaagcaatggaaccttggccacttgggcaccattctggacctccttgaacaggagtgcggcgtggtcatcgagggtgtcaacacgccctacctctattttgggatgtggaaaaccacatttgcctggcacacagaagatatggacctttactccattaattaccttcacttcggagagcccaagacttggtatgtcgtccctccagaacacgggcagcacttagagcgcctggctcgagagctattccccgatatatcccgcggatgcgaggcgttccttaggcataaagtggccctcatcagccctaccgtacttaaggagaacggcatacccttcaattgcatgacccaagaagctggtgaattcatggtaaccttcccttacggataccatgccggattcaatcacggttttaactgcgcagaagcgatcaatttcgctactcctcgctggattgattatggaaaaatggcctcccagtgttcctgtggggaatcaaccgtcacattttcgatggacccttttgtacgcatagtacaacccgagtcatatgaactctggaaacatcgtcaggacctagcaatcgtcgagcatactgaaccacgcgtggccgaatcccaggaactgtccaactggagagatgacattgtgctgagaagggccgctctggggctgagactgttaccaaacctgacagcccagtgcccaacccagcccgtgtcctctgggcactgttataaccccaaggggtgtgggacagacgcagtaccgggttctgccttccaatccagtgcataccacacccagacccagagcctcacactggggatgtcagctcgcgtgttactgcctagtacgggctcctgggggtctggcagaggacgcggtagaggtcaaggccagggtcggggttgctcacgaggtaggggacacgggtgttgcacccgagagctgggaactgaggaacctactgtccaaccagcaagcaaacggcgactgctcatgggcactcgctcgagggctcaaggacacaggccccagcttccattggcgaatgatctcatgacaaacctgtccctgtag

SEQ ID NO: 23379 - DNA, 1080 bp, Artificial Sequence
  Description of Artificial Sequence: Synthetic coding sequence
atgattgccgctcaagcaaagctagtgtaccaactcaacaagtattatactgaacgctgccaggctagaaaggccgctatcgcgaaaacgattcgcgaggtctgtaaggtggttagcgatgttttgaaagaggtggaggtccaggaaccaagattcatctcatcattgtcagagattgatgctcgctatgagggcctcgaagtaatcagcccaacagaattcgaggtggtcctttacctgaaccagatgggtgtcttcaatttcgtagacgacggcagcttgcccggatgcgccgtgctcaaactctctgacggcagaaaacggtccatgtccctgtgggtggagttcataaccgcctccggctatctttccgccagaaaaattaggtcacggtttcaaaccctggttgcccaagccgtggacaagtgctcctacagagacgtggttaagatgatagcagataccagcgaggtgaagctgcgtatccgcgaacgatacgtagttcagatcacaccagcctttaagtgcacaggtatctggccccgaagtgcagcccaatggcccatgccacacattccatggccgggacccaaccgtgttgccgaggtaaaggctgaaggattcaatctgctcagcaaggagtgctatagcctaacaggcaagcagtcttccgcggaatccgatgcttgggtgctgcagtttggcgaggccgagaatcggctgctcatgggcggatgccgcaataagtgtttgtctgtgcttaaaactttaagagaccgtcacttagagctgcctggtcagccactaaacaactatcacatgaagactctgctcttatacgaatgtgagaaacacccaagggagactgactgggacgagtcctgcttaggtgaccgtctaaatggaatcttgctgcagctcatctcctgtctccaatgcagacgctgtccacattatttcctgcccaaccttgacctctttcaggggaaaccacattcagcgctcgaaagcgcagccaagcaaacttggcgactggccagggaaatcttgacgaatccaaaatcacttgacaagctctag

SEQ ID NO: 23380 - DNA, 447 bp, Artificial Sequence
  Description of Artificial Sequence: Synthetic coding sequence
atggccgtcgcaagcgatttttatctgcgatactacgtggggcataaggggaagttcgggcatgaattcctggagttcgagttccgaccggatggtaaactgagatatgctaacaatagcaattacaaaaacgatgtgatgattcgaaaggaagcttatgttcataagtcagttatggaggaactaaagcgcattatcgatgacagtgaaatcacaaaagaggatgatgcgctatggccacctcccgacagagttgggaggcaggaactagagatcgttattggggatgagcacatctcctttaccacctctaaaatcggcagcttaatagacgtgaatcagtccaaggaccctgaaggcctgagggtgttttactacttggtccaggaccttaagtgccttgtcttctctttaatcggtctccactttaaaattaagcctatctag

SEQ ID NO: 23381 - DNA, 336 bp, Artificial Sequence
  Description of Artificial Sequence: Synthetic coding sequence
atggccgttgcctccgacttctatctgcgttactacgtcgggcataagggaaagttcggacatgagttccttgagttcgaatttcgaccagacggcaagttgcgttatgccaacaactccaactataagaacgatgtaatgatccgcaaagaggagctcgagatcgtaatcggcgacgaacacatctcattcacaacctctaaaatcgggtccctgatcgacgtgaaccaatccaaggaccctgaagggctgagagtgttctattatcttgtgcaggatctaaagtgcctggtgttcagtctcatcgggctgcactttaagatcaagcccatttag

SEQ ID NO: 23382 - DNA, 1041 bp, Artificial Sequence
  Description of Artificial Sequence: Synthetic coding sequence
atggctccacgatctctgctgttgctgctaagtggcgctctggctctcacggatacatgggcaggttcccatagtttgcgctacttttctaccgccgtgtccaggccgggtaggggcgaaccacgctacatagccgtggagtatgtcgacgacacccaatttctgcgattcgactccgatgcagcgatccctcgcatggaaccaagagaaccctgggtcgagcaagagggccctcagtattgggaatggaccaccggatatgcaaaggccaacgcacagacagatcgtgtagctttgcgaaacctccttcgtagatacaatcagagtgaggccggatcccacactcttcaaggaatgaatggctgcgacatgggcccagacggacgcttactgagggggtatcaccagcacgcttatgatggcaaagattacatatctctgaatgaggacctgcgaagctggacagccgctgatactgtcgctcaaataactcagagattttacgaggctgaagagtacgctgaagaatttaggacttatctcgaaggggaatgcttggagctgctgcggcgatatttggagaacgggaaagagactctgcagagagccgacccaccaaaagcccacgtagctcatcaccctatttccgaccatgaggccacactgaggtgctgggctcttggtttctatcccgctgaaatcacattgacgtggcagcgggatggcgaggagcagacccaggatactgagctcgtcgagacccggccagctggcgacggtacttttcaaaaatgggccgctgtcgtggtgcccagtggtgaggaacagcgatacacttgtcatgtccaacatgaagggcttccacagcccttaatcctgcgatgggaacaaagcccccagcccaccattccgatcgtagggatcgtcgccggtctggtagtgcttggcgctgtggtgaccggcgctgtggtggctgctgtcatgtggcgaaaaaaatcaagcgacagaaacagaggcagttactcccaagctgcagtctag

SEQ ID NO: 23383 - DNA, 903 bp, Artificial Sequence
  Description of Artificial Sequence: Synthetic coding sequence
atgcagagcgacgacgtgatctgggatacactgggtaataaacaattctgctcatttaagataaggacaaaaacacagagcttctgtcgaaacgagtactctctcacaggcctctgcaaccgtagttcttgccccctcgccaacagccagtatgccactattaaagaggaaaagggtcagtgttatctctacatgaaggtaatcgaacgggcagccttccctcggagactttgggagcgtgtccggctgtcaaagaactacgaaaaagctttggagcaaatagatgagaatttgatatattggccgagattcatcaggcataagtgcaaacagcggtttaccaaaataacccagtatctgatccggatccggaaactcacactgaaacggcagcgaaagctcgtgcctctcagtaaaaaggttgaacgacgggagaaacgccgtgaagagaaggctctgattgccgcacagctggacaacgctattgagaaggagctgctggagcgtctcaagcaagacacttatggagacatatacaacttcccaatccacgcgttcgacaaagctttggagcagcaggaggcagagagcgacagctctgacacagaggagaaggatgatgacgacgacgatgaggaggatgtgggaaagcgcgagttcgtagaagacggcgaggttgacgaatctgatattagcgattttgaggatatggacaagcttgacgcatcctctgatgaagaccaagatgggaaatccagcagcgaggaagaggaagagaaagctttgagcgccaaacataaagggaagatgccattacgtgggccactgcagagaaagcgggcatacgttgaaattgaatacgaacaagaaactgaacccgtggctaaggccaagactacatag

SEQ ID NO: 23384 - DNA, 1056 bp, Artificial Sequence
  Description of Artificial Sequence: Synthetic coding sequence
atggagcgcagaatgcaactggtcaaaaaagataacgaaaaggagcggcataagctgttccaggggtacgagaccgaagagagggaggagacagaactgagtgagaagattaaattggagtgtcaaccagagcttagcgagacaagccagacacttccccctaaacccttctcctgcgggagatccgggaaagggcacaagagaaagagccctttcgggagtaccgagcggaaaacaccagtaaaaaagcttgccccagagttcagcaaggtcaaaactaaaacgcctaaacattcccccattaaagaagagccatgcggctctttatcagagacagtgtgcaaacgagagctccgctctcaagagactccagaaaaaccaagatcttccgtggacacccccccacggctttcaacacctcaaaaggggccttctactcaccccaaggagaaggccttttcatccgaaatcgaggacctcccatacctgtcaactaccgagatgtatttgtgtagatggcaccagccccctcctagcccactgccactcagagagtcatctcccaaaaaagaagagactgttgccaggtgtcttatgcctagcagcgtggcaggcgaaacctcagtcctcgctgtgccttcttggcgggaccactccgtcgagccattacgggaccctaaccccagcgacctgctagagaatctggacgacagcgtgttttctaaaaggcacgctaaactggaactggacgaaaagcggaggaaaagatgggacatccaacggatcagagagcaacgtatccttcaacgcctgcagcttcgcatgtacaaaaagaagggaattcaggaatcagagccggaggtgactagcttttttcccgaacccgacgacgtcgaatccctgatgattacaccttttttacccgtggtagccttcgggcgtccccttccaaagctaactcctcagaatttcgaactgccttggctggatgagcggtcaaggtgcagactcgagattcagaaaaaacagactccacataggacgtgccgaaaatag

SEQ ID NO: 23385 - DNA, 1845 bp, Artificial Sequence
  Description of Artificial Sequence: Synthetic coding sequence
atgacaatgaggtctgctgtcttcaaggctgcagctgcgcctgctggagggaatcctgaacagagattagactacgaaagggctgcagcgctagggggaccggaggatgaaccgggagccgcagaagctcactttttgcctcgccaccgcaaattaaaagagccgggacccccactcgcctcctcacagggcggtagccctgcaccctccccagccggatgtggcggaaagggcaggggcttactgctccctgctggggcagccccaggacagcaagaggagtcttgggggggatcggtgcctctgccatgtcctcctcccgctacaaagcaggctggaatcggtggcgagccggctgcggcaggggctggatgttcacctcgccctaagtaccaggctgtactgcccattcagaccggatcacttgtggcagcagcaaaggagccgactccctgggcgggtgataaagggggagcagccagcccagccgctactgcatctgaccctgcaggacctccccctctgccgttgcctgggccacctccactcgctccaaccgcaactgccggaacgctggctgcctcagaagggcgttggaaaagtatgcgcaagagcccgctgggaggaggtggaggttcaggcgcatcttcacaagcagcatgccttaagcagattcttctgctgcagctggacctgatcgagcagcaacagcagcagctccaagcaaaggagaaggagattgaggagctgaagtccgaacgagatactctcctggctaggatcgagcgaatggaacgtcgcatgcaactggtcaagaaagataacgagaaggaacggcacaagctttttcagggatatgaaacagaggaaagagaagaaaccgaactgagtgagaagattaagctggagtgccagcctgagctgtcagagacgtcacagacattaccgcctaaaccattctcgtgcggccgaagcggcaagggccacaaacgcaaatctcccttcggctcgaccgagagaaagactcctgtcaaaaaactcgcgcctgaattttcgaaggtgaaaaccaagactcctaagcattcccccattaaggaggagccatgcggatccctgagcgaaacagtctgcaaacgagagttgcggtctcaagaaaccccggagaagcccagatcctccgttgatactccccctaggttgtctactcctcagaagggacccagtacgcaccccaaagaaaaggcgttctcaagtgagatcgaggatctcccctacctgagcaccactgagatgtatttgtgtaggtggcaccagccgccaccctcccctctcccgctgagggaatcaagccccaaaaaagaagaaacagtggctcgctgtctgatgcccagttctgtggcaggcgagacaagcgttttagcagtcccgagctggcgcgaccatagcgtcgagccactccgtgatccaaacccttcagacctcctcgagaatttggacgactctgtattctctaagcggcatgctaaacttgagcttgacgaaaagcgtcgcaagagatgggacatccagagaataagggagcaaagaatattacagaggttgcaactacgcatgtacaaaaaaaaaggaattcaggaatctgaacctgaggtgaccagcttctttccggagcctgatgatgtagagtccctgatgattaccccattcttgcctgtggtcgcttttggtcgaccccttcctaaactgacgccacagaactttgaactcccctggctggatgaaagaagccggtgccgactagagattcaaaagaagcaaacgccacacagaacttgtcgcaagtag

SEQ ID NO: 23386 - DNA, 1056 bp, Artificial Sequence
  Description of Artificial Sequence: Synthetic coding sequence
atggagagacgtatgcagctggttaagaaagataacgagaaagagagacacaaactgtttcagggttacgaaacagaagaacgagaagagacagagctgagcgagaaaattaaactcgaatgccagccagaattgagtgaaacatcccaaacactgcctccaaaaccttttagttgtggcagatccggaaagggacataaacgaaagagtccctttggctcgactgagcgaaagaccccagtaaaaaagttagcacccgaattttccaaggtgaagactaagacgccaaaacattctcctattaaagaagagccttgcggctctctgagcgagactgtctgcaaacgggaactgcggtcccaggaaacgccagaaaagccgcgttcttccgtggatactcctcccaggttgtcaacgccacaaaaaggaccaagcacccaccctaaagagaaagccttttccagtgagattgaggatctcccttacttatctacaactgagatgtatttatgtcgctggcaccagcctcctccatctcccttgcctttacgtgaatcaagtccgaagaaagaggagactgtggccaggtgcctgatgcctagctcagtagccggagaaacctcagtgctagcggtgccctcatggagagatcacagtgttgaacccctgagggacccaaatccatccgacctgctggagaatctggatgacagtgtgttctcaaagagacatgcaaaacttgagctcgacgaaaagaggcgtaaaaggtgggacatccagcggatccgcgaacagagaatcctgcaaagactccagctaagaatgtacaagaagaaggggatccaggagtccgagccggaggtgacctctttttttcctgagcctgacgatgtcgaaagcctgatgatcaccccatttctgcctgtggtggccttcggcagacccctgcccaagctgactccccagaactttgaactgccatggctagacgaaaggtccagatgccgcctggagatccaaaagaaacaaacaccacaccggacctgtcgcaagtag

SEQ ID NO: 23387 - DNA, 1734 bp, Artificial Sequence
  Description of Artificial Sequence: Synthetic coding sequence
atgaatccagtgaatgccactgccctgtacatttctgccagtagattggtgctcaattacgatcccggtgaccctaaagcctttacagaaattaacaggctcctgccatactttaggcagagcctgagttgctgcgtttgtggtcacctcttgcaggatcctattgcccctactaattccacatgtcagcactatgtgtgtaagacgtgtaagggtaagaaaatgatgatgaaaccctcctgcagctggtgcaaagactacgaacagttcgaggagaacaagcagctgagtatccttgtgaattgctataagaaattatgcgaatacataacccagactactctcgccagagacattattgaggccgtggactgttcctccgatatactggctctgcttaacgacggctcccttttttgtgaagagaccgagaaaccgtcagacagcagtttcaccttgtgccttacccactcaccattgccctccactagtgagccaaccaccgacccacaggcaagcctttccccaatgtcagagagcacactgtctattgcaattggatcttccgttatcaacgggttgcccacctacaatgggctgtccattgacaggttcggtatcaatattcctagccctgagcactccaacactatcgatgtttgtaacacggttgatattaaaacagaagatttgagtgattcactgccacccgtatgtgatactgtggccaccgacctttgttcaacaggaattgacatatgttcctttagtgaagatatcaaacccggagatagcctcctgctgagtgtcgaagaagtgcttcggagtctggagaccgtttccaatacggaagtgtgctgcccaaatctgcagccgaacctggaggctactgtctcaaacggcccattcctccagctatcaagccagtcgctgagtcacaacgtctttatgtccactagtcccgcactccacgggctttcttgtaccgccgctacacctaagattgccaagctgaatcggaagcgaagccgatcagaatctgacagcgaaaaagtgcagccactccctatctcaacgataatcaggggcccaacgctgggtgcctctgcacccgtgactgtgaagcgcgagagtaagattagtctacagcccatcgccaccgtgccaaatgggggaacgacaccgaagatcagcaagacagttttgctgagtacaaaatcaatgaaaaagtcgcacgaacacgggtcaaagaagtctcactccaagaccaaacctggcatccttaagaaggacaaagccgttaaagagaagattcccagccaccactttatgccaggctctcctaccaaaaccgtgtacaagaaaccacaggaaaaaaaggggtgcaagtgtggcagggccacccaaaatccctcagtgcttacttgccgaggccagagatgcccctgttactcgaatcggaaagcttgcctggactgtatctgtagaggatgtcagaattcctatatggccaatggcgagaaaaaactggaggcttttgctgtgcctgaaaaggccttggaacagactcgccttaccttaggcatcaatgtgacctctatcgccgtcaggaatgccagcacgtccacaagcgttattaatgtaacaggctcgccggtgacaaccttcctggccgcttccacacacgacgacaagtctctcgatgaggctatcgacatgagattcgactgttag

SEQ ID NO: 23388 - DNA, 1512 bp, Artificial Sequence
  Description of Artificial Sequence: Synthetic coding sequence
atgatgatgaaaccttcatgcagttggtgtaaggactacgagcagtttgaggaaaataagcaacttagcattctggtgaactgctataaaaagctttgcgaatacattacccaaactaccctggctagagacatcatcgaggctgttgactgctcttccgatatccttgctctgctcaacgatgggagtctgttctgtgaggagacggaaaagcctagcgattccagtttcaccctctgcttgactcacagccctctccccagtacttccgaaccaacaacagacccgcaggcctccctttccccaatgagcgagagtacgctctccatcgctattggatccagcgtaatcaacggactgcccacttacaatggcctttcgatagaccgcttcggtattaacattcctagcccagagcactcaaataccatcgatgtatgtaatactgttgacattaaaaccgaggatttgtccgatagcctcccaccggtctgtgacaccgtcgcgaccgacctgtgcagcacgggcatagacatttgctcgttcagcgaggacattaagccaggcgatagtttgctgttgagcgtggaggaggttttacgctccttggagactgtctccaataccgaggtgtgctgccctaacttgcagccaaatctagaagcgacagtgtcaaatggaccgtttttgcaactctcttctcagagcctgtctcataacgtgttcatgagcacctccccagccctccacggactctcatgcacagcggctacacctaaaatcgcaaaactgaacagaaagcggtcacgctctgagtcagacagtgagaaagtccagccattgcctatatctaccattattcgcggacccacgctgggagcaagcgctcccgtaaccgtcaagagggaaagcaaaattagcctgcaacccattgcaaccgtgcccaacggcggtacaacaccaaagatctctaagactgttctactcagcactaagtcaatgaaaaagtcacatgagcatgggagcaagaagtcgcacagcaaaacaaaacctggcatcctgaagaaagataaggccgtcaaagaaaagattccctctcaccatttcatgccaggctcgcccacaaagactgtgtacaaaaagccgcaagagaagaagggatgcaaatgcggacgggcaactcaaaacccctcagtgctgacgtgcaggggacagaggtgcccttgttatagcaatcgaaaggcatgcctagactgcatatgtcgcggatgccagaactcttatatggcaaacggcgagaagaagctggaagcctttgccgtgcccgagaaggcattggagcagacgagattaacactcggcattaatgtaacgtcaatcgctgtacgcaatgcctccacctccacctctgtgatcaatgtgacaggctcacctgtcacgacttttctcgcagcatcaacccacgacgacaagtccctagacgaagctatcgatatgcgcttcgactgctag

SEQ ID NO: 23389 - DNA, 1566 bp, Artificial Sequence
  Description of Artificial Sequence: Synthetic coding sequence
atgagtgctagtgaaggaatgaaattcaaattccatagcggagagaaggtgctatgtttcgagcctgatcctacaaaggcacgcgtcctgtacgacgccaagatcgtcgatgtgatcgtcggtaaagatgagaaaggcaggaagattcccgagtacctgattcactttaacgggtggaatcggtcttgggaccgttgggccgcagaagatcacgttctccgagacacggatgaaaatcgaagactccagcgcaagctagcaaggaaggccgtggctcggctgaggtcaacaggtagaaaaaagaaacgatgccgactcccaggtgttgattccgtattgaaaggtctccctaccgaagaaaaggatgaaaacgacgaaaacagtctgtcctcatcctccgattgctccgaaaataaggatgaagagatttctgaggagtcagatatcgaggagaagacagaagttaaagaggagcccgagcttcagacaagaagggagatggaggagaggactatcactatcgagatccctgaggtgctcaagaagcagctggaggacgattgttactacattaaccgtcgcaaacggttagtgaaactcccatgtcagactaatattatcacaatcctcgagagttatgtgaaacactttgctatcaacgccgctttcagtgccaacgaacggcctcggcaccatcacgtcatgccgcacgccaacatgaacgttcactatatccccgctgaaaaaaacgtggacctgtgtaaagaaatggtcgacgggctgaggattacgtttgactatacacttcctcttgtgttgctgtatccttacgaacaggcacagtacaagaaggtgacctcaagcaagttcttccttccaattaaagagagtgccacctctacaaatcgctcccaagaggaactgtccccttctccgcctctgctcaatccctcaacacctcagagcaccgagtctcagcctacaacgggggagccggctactccaaagcgtagaaaagctgagccagaggctctccagagcttgcgacgaagcacaagacatagtgccaattgcgaccgattgagtgagtcttccgcctctcctcagcctaaacggaggcagcaggacaccagtgccagcatgcccaagctttttctccacctggagaagaagacccctgtgcactcacgctcatcctcccccatacctttgactccctccaaggaaggcagcgctgtctttgctggcttcgaggggaggagaaccaatgagatcaatgaggtgctcagttggaaactagtgcccgacaattatccaccaggcgatcagcctccccctccatcttatatttatggtgcgcagcatctcctgaggctgttcgtaaagctaccagagatcctgggaaagatgagtttctccgaaaaaaatctcaaggccttgctgaaacatttcgatttattcctaagattcttggccgaataccacgacgacttttttcccgagagtgcatacgtggctgcatgcgaggcacactattcaacaaagaacccacgtgcgatctactag

SEQ ID NO: 23390 - DNA, 1251 bp, Artificial Sequence
  Description of Artificial Sequence: Synthetic coding sequence
atgagtgcttcggagggcatgaaattcaagtttcattccggggagaaagtgctgtgtttcgagcctgatccaacaaaagctagggtgctgtatgatgcaaaaatcgtcgacgtgatcgttggtaaggatgaaaaaggtcgtaagattcccgagtacttgatacatttcaacggatggaatagaagctgggaccggtgggctgcagaggaccacgttctacgagataccgatgagaacaggcggctgcaaagaaagcttgcccgtaaggcggtggctcgcctgaggagtacagggagaaaaaagaaacgctgtcggttacctggagtcgattcagttttaaagggactgccaactgaggagaaagacgaaaatgacgagaacagcctgagctcatcctctgattgctctgagaacaaagatgaagagatctcagaagagtcagacattgaagagaaaaccgaagtgaaggaagaaccggagctgcagacaaggcgggaaatggaagagcgcaccattacgattgagatccctgaagtactcaagaaacagcttgaagacgactgctactatattaaccggaggaagaggctagtgaaactcccttgtcagactaatattattaccatcctggagtcttacgtaaaacactttgctatcaacgccgctttctcagcgaatgaacgccctcgacaccaccatgtcatgccccacgcaaatatgaatgtgcattacatcccagctgaaaagaatgtcgatctgtgcaaagagatggttgacggactcaggataacctttgactataccctacctctggtgcttctttatccatacgagcaggctcaatataagaaggttacatcctctaaatttttccttcccatcaaggagtctgccaccagcaccaaccgctcacaggaagaactgtctccttcacctccgctgctgaacccaagcactccccagagcaccgagtctcagcccacaacaggagaacccgcaactccaaagcgacgaaaggctgaaccagaagctctccagtctctgcgtcgctctacgagacatagtgccaattgtgaccgattgtctgagtcttctgcaagcccacagccaaaacgccgacaacaggatactagcgccagcatgcccaaactgtttctccatctcgagaagagtcgatttattctgggctgcccacgtcctggtcgcgcttccgtgtacttcgtgttttcacagtgccaggcttggtgctag

SEQ ID NO: 23391 - DNA, 1119 bp, Artificial Sequence
  Description of Artificial Sequence: Synthetic coding sequence
atgaagatgatgaagaccaaggaggagccggaactgcagacccgccgagagatggaggagcgcacaattaccattgaaattcccgaggtcctgaagaaacagctggaagacgattgctattacataaaccggaggaaacgtctagtgaagctgccatgtcagacaaatatcattacgatcctggagagttatgtgaagcacttcgcaatcaacgccgctttctctgctaatgagcgacctaggcaccaccacgtcatgcctcatgccaatatgaacgtgcattacataccagcagaaaaaaatgtggacctgtgtaaagagatggtggacggcttgcggatcaccttcgactacaccttgcccctagtgctgctgtacccatacgagcaggcccagtataaaaaagtgacgagcagtaaattctttctacccattaaagaatcagccactagcactaataggagccaggaagagctatctccatcaccgcctctgctgaacccttccacccctcagtccaccgaaagtcagccaactaccggtgaacctgcaacccccaagcgaaggaaagcagagccggaagcactgcagtcactgcgcaggagcacacgccattccgcaaactgcgaccgcctgtctgagtccagcgccagcccacagcctaagcgcagacagcaggatacttccgcaagtatgcccaagctctttcttcatctggagaaaaagacacccgtccacagtagaagcagttccccaattcccttaactccatcaaaggaaggatcggcagtgttcgcaggctttgagggtcgtagaaccaatgagattaatgaggtcctgagctggaagctcgtgccagacaattatccgcctggtgaccagccaccccctccctcatacatctacggagcacagcatctcctgcggctcttcgtaaaattaccggagattctgggcaagatgtctttctctgagaagaatctgaaggccctactgaagcacttcgacctatttctgcgatttcttgccgagtaccatgacgatttctttcccgagtcagcttatgtagccgcttgtgaggctcattattcgaccaagaatccaagggctatctattag

SEQ ID NO: 23392 - DNA, 591 bp, Artificial Sequence
  Description of Artificial Sequence: Synthetic coding sequence
atggaagagaggacaataacgatcgagatcccagaggtgctgaagaaacagttggaagacgattgttactacattaacaggaggaaacggttggtcaaactgccatgccaaaccaacatcatcacaatcctcgagtcttacgtgaagcatttcgcaattaatgctgctttctctgctaatgagaggccacggcatcatcatgtaatgcctcacgccaatatgaatgtgcactacatcccagcagagaaaaatgttgatctatgcaaagaaatggtagacggcctcaggatcaccttcgattacaccctcccactggtgcttctatacccttatgaacaggcccagtataaaaaggttacttccagtaagttctttctccccatcaaagaatcagcaacatctaccaataggagccaggaagagctgtcaccttctcctccactgcttaacccaagtaccccccagtctacggaatcccagcctacaactggcgaacctgctacccctaagcggagaaaagcagaacccgaggcgcttcagagcctgcggaggtcgacgagacattccgctaactgcgataggttgtcttag

SEQ ID NO: 23393 - DNA, 1068 bp, Artificial Sequence
  Description of Artificial Sequence: Synthetic coding sequence
atggaggaacgcactattactattgagatccctgaggtgctgaagaagcaactcgaggatgattgctactatataaataggcgcaagcgcttggtgaaactgccatgccagaccaacattataacaattcttgaaagttatgtgaagcatttcgccatcaatgctgccttttctgctaatgagaggccgaggcaccatcatgttatgcctcacgccaatatgaacgtccattacatacccgctgagaaaaatgtggatctgtgtaaagagatggtggacggcctgcgcatcacctttgactatacccttccactggtgttgctctacccttacgagcaggcccagtacaagaaggtcacctcaagcaaattcttcctgccaattaaggagtctgcgactagcacaaacaggtcacaggaagagctgtccccaagtccccctctactgaatccttctacaccacagagtactgaatcccaacctaccaccggagagcctgcaacaccaaagcgcagaaaggcagagcctgaagcattacaatctctgcggaggtccactcggcatagtgctaactgcgatagattgtcggaaagctccgcaagtccccagcccaagcgccgtcaacaggataccagcgcgagtatgcccaaacttttccttcacctggagaagaagacaccagttcatagtcgcagcagctcgccaatacctctgacaccatctaaagaggggtccgcagtgttcgccggatttgagggcagaagaaccaatgagataaacgaagttctgtcttggaaattagtgccagataattaccctcctggcgaccagccccctccaccgtcctatatctacggcgctcagcacttactcaggctgttcgtgaaactccccgagattctcggcaagatgagcttttccgagaagaaccttaaagcgctcctgaaacactttgacctattcctgcgattcttggctgagtaccatgacgatttttttccagagtcagcctacgttgctgcctgcgaggctcattatagcaccaagaatccgagggccatctattag

SEQ ID NO: 23394 - DNA, 1530 bp, Artificial Sequence
  Description of Artificial Sequence: Synthetic coding sequence
atgagtccttccgtgcggccaggggctggatgggctcctgtggggagaccgggacggccaatacaaattgttgatgtgatcgtcggaaaagacgagaagggccgaaaaatcccagagtatctaattcactttaatggctggaaccgctcttgggaccgatgggctgccgaagatcatgtcctacgtgatacagatgaaaatcgccgtctccagcgtaagcttgcgaggaaagccgttgctaggttgaggagtacgggaaggaagaaaaaaaggtgtagattacctggggtggactccgtcctcaaaggtttgccaacagaggagaaagatgagaatgatgaaaacagcctcagctcctcttctgattgcagtgagaataaagacgaggagatctccgaggaaagcgatatagaggagaagacggaggtgaaggaagaaccagaactccagacccgccgagagatggaggaacgcacaattaccattgaaattccggaggtgctgaagaaacaacttgaggacgactgctattatattaatcgtagaaaaagactggtcaaacttccctgtcagaccaacatcatcaccattctggagtcctacgtgaaacatttcgcaattaacgcagcgttctcagcgaatgagaggccccgtcaccaccacgtaatgccacacgccaacatgaacgtgcactacattccagccgaaaaaaatgttgatctgtgtaaggagatggtggatggacttcgtatcacctttgattatactcttccactggtgctgctgtatccatatgagcaggcccaatacaagaaagtcaccagcagtaagttttttctgcccatcaaagagtcggccacgagcactaaccgctcccaagaggagttgagccctagtcccccactcctgaatccatccacaccgcagtcgacggagtctcagccgacaacaggggagcccgctacccccaagaggcggaaggccgagcccgaggccttgcaatctctgcgcagatccactcgacactctgccaactgtgatcgtctgagcgagtcttccgctagtccccagcctaagagaagacagcaggacaccagtgcctccatgcctaaattattcctccatttagaaaaaaaaacccctgtgcatagtcgttcttccagccccatccccctgacaccctccaaggaagggtccgccgtgtttgccggattcgagggcagaagaaccaacgaaatcaatgaagtcctgagctggaaactggttccagacaactatcctcccggagaccagccacctcctcctagttatatctacggggctcagcatcttttaaggctgttcgtgaagctgcctgaaattttgggaaaaatgtcctttagcgagaagaatctaaaggcgctacttaagcacttcgacttgttcctgagattccttgcagaataccatgacgatttttttcccgaatctgcttacgtagctgcttgcgaggctcattatagtacaaagaatccacgggcaatttactag

SEQ ID NO: 23395 - DNA, 60 bp, Artificial Sequence
  Description of Artificial Sequence: Synthetic coding sequence
atggaagaaagaacaattaccattgagatcccggaggtcctcaaaaaacagttggagtag

SEQ ID NO: 23396 - DNA, 1842 bp, Artificial Sequence
  Description of Artificial Sequence: Synthetic coding sequence
atggctgcccaggccgctgccgcagcacaggctgctgcagctcaggcagcccaggccgaggctgctgattcgtggtacctggctctgctgggattcgcggaacactttagaacatcgtccccgccaaaaattaggctgtgtgtacactgtctgcaagcagtttttcctttcaagcctccccagcggatagaagctcggacccatctgcaactgggttccgtgctgtaccatcacacgaaaaacagtgagcaggccagatcgcatttggaaaaggcaggctctctgagccagcagattccgcagttcgaggatgttaaatttgaagcagccagcctcctgtccgagctctactgccaggagaactcagtggatgctgcaaaaccgctgttgcggaaggccatccagatatcccagcagacgccttattggcactgccgactgctctttcaacttgcccagctgcacactttagaaaaggatctcgtgtcagcgtgcgatctcctgggcgtcggggctgagtacgcgcgtgtggtgggcagcgaatatacaagggctctgtttctactcagcaaaggaatgctgctgctcatggagcgaaaactgcaagaggtgcaccccctgctgaccctgtgcggacagattgtcgagaattggcaggggaaccccatccaaaaggagtccctcagagtctttttcctcgtgttgcaggtgacacactacctcgacgcgggacaggttaaatctgtaaagccttgcctgaaacagctgcaacaatgcatccagacgatttctaccttgcatgatgatgagatactgccctcgaaccctgccgatcttttccactggctacccaaagagcatatgtgcgtcttggtatatttggtgacagtgatgcactccatgcaagccggttacctcgaaaaggctcagaaatatacagataaagctctgatgcagctagaaaagctaaaaatgttagattgctccccaatactgtccagctttcaagttatcctcttggagcacattatcatgtgccggcttgtgacaggtcataaagccactgccctgcaggagatctcccaggtttgccagctgtgccagcaaagtcccaggctgtttagcaaccatgcagcacaactgcacaccctcctgggactgtactgcgtatcagtcaactgtatggataacgccgaagcccagttcactacagcactgaggcttaccaaccaccaggagctctgggcttttattgttaccaaccttgcaagcgtgtatattcgggagggtaatcgtcaccaggaagtgctgtacagtcttctggagagaatcaatccagaccacagctttcccgtttcaagtcactgcctgcgagccgcagctttctacgtgcggggtctgtttagtttttttcaggggagatataatgaagctaagcgctttcttagagaaacccttaaaatgagcaatgccgaggaccttaaccggttgacagcttgcagcttagtcctgctgggtcatatattttacgtccttggcaatcaccgggagtctaacaacatggtggtgccagcaatgcaattagcctctaagatcccagacatgagtgtgcagttgtggagtagtgctctccttcgggatctgaacaaggcctgtggcaatgccatggatgcccatgaagccgctcagatgcatcagaattttagtcagcagttgctccaggaccacatagaggcctgctcgttgccagaacataacctcattacctggacagacggcccacctcctgttcagttccaggcccaaaatggtcctaatacatcgttggcctctctgttgtag

SEQ ID NO: 23397 - DNA, 504 bp, Artificial Sequence
  Description of Artificial Sequence: Synthetic coding sequence
atgcctatgaaaccgccacgttgtacccgtaccagcaggtcatcctgtagtcggaccactctccggccagccgcttctcctaacaccacttcgagcagaggtcagactgtgcatcctccgtgttcttccaagcttcgaatggacccgacccccgcttggccagccagctgcgaggcgcttatgggaccatcgtccagtgctggacccgcacgtcttagactgccccctaggcgtcactcatcacttccacccaggcgggctagcttcctgatcgtgtcccgcgcaagcaagtcgtgggaatgcgccggaccagtgcctgccctgccaggcggagtggtggccgttccgacgtctcagcaggaccctcagtgcaggggcagtcaggttgcgcaccgacggtgtttatcccgcgcaatcctccaatcaggccctcaatgccagtcctgtcttagcatctgggttacttcagctcggtcccgagttcaggcctcttcaagaagctag

SEQ ID NO: 23398 - DNA, 1842 bp, Artificial Sequence
  Description of Artificial Sequence: Synthetic coding sequence
atggctgcccaggccgctgcagccgcacaggccgcagccgcacaggctgcccaggcagaggcagcagattcttggtatctggcattattggggtttgccgagcatttccggaccagcagccctcccaaaatccggctctgcgttcactgtttacaagcagtattcccctttaagcctccccagcgcattgaggccagaacacatttgcagcttggcagtgtgttgtaccaccatactaaaaacagcgaacaggctagatcccacctggagaaagcctggctaatcagccagcagatcccgcagttcgaagatgtcaagtttgaggccgcatcattgctctctgagctgtattgtcaggagaactctgtggatgccgctaaacccctcctccggaaagccatccagattagccaacaaacaccctactggcactgcaggctcttattccagttggcccaactgcacaccctggagaaagacctcgtgtcagcatgtgatctgttgggcgttggagccgagtacgctagagtagtgggaagcgagtataccagagcactgttcttgttgagcaagggcatgctgctgctgatggaacgtaaactgcaggaggttcatccccttctgacactctgcggccaaatcgttgagaactggcagggcaatcctatacagaaggaatcattgagagtgttcttcttagtcctacaagtgactcattacttggacgccggacaggtcaagtccgttaagccctgcctcaaacaactgcagcagtgtatccagactatttctacgctgcacgacgacgagatcctgccaagtaacccggcagatctgtttcactggttaccaaaagaacacatgtgtgtgctggtctacctggttaccgtgatgcactcaatgcaggcaggctacctggagaaagcccagaaatacacagacaaagccctaatgcagttagagaagttaaagatgctagactgcagtcccatactgtctagctttcaggtcatattgttggagcacattatcatgtgtaggttagtgaccggccacaaggcgaccgccttgcaggagatttcccaggtgtgtcagttatgtcaacagtctcccagattattcagcaatcatgcggcacaacttcacaccctgctcgggttgtattgtgtcagtgtaaactgcatggacaacgcagaggctcagttcactacagctttgcgtcttactaatcaccaagaattgtgggctttcattgtcacgaatttggccagcgtgtatatcagggaaggcaaccgtcatcaggaagtcctgtatagccttctggaacgcatcaatccggaccactcattcccagtgagcagccattgcctgcgggcagccgcattctacgtgcgcggactttttagcttttttcagggtcggtacaatgaggccaagcggtttctgcgagagactctgaaaatgtcaaacgctgaggacctgaaccggttgacggcgtgctcactcgtgctgctcgggcacattttctatgttctagggaatcatcgtgagtcgaataacatggtggtaccagctatgcagctcgcctctaaaattcccgacatgtcagtgcagctgtggtcgagtgcgcttctcagagatttgaataaggcttgtggcaacgctatggatgcacacgaggcagcacagatgcatcagaacttctcgcagcagctactgcaggatcacatagaagcttgctctcttccggagcataaccttatcacctggacagatggcccacctccagtgcagttccaggcccaaaatggacctaatacttctctggcttccctgctctag

SEQ ID NO: 23399 - DNA, 504 bp, Artificial Sequence
  Description of Artificial Sequence: Synthetic coding sequence
atgcccatgaagccgcctaggtgcactcggacatcccgatcgagttgtagtcgcaccactctgagacctgccgcatcaccaaacacgacctccagcagaggacagactgttcatccgccatgttccagcaaactccgtatggacccgaccccagcttggccagctagttgtgaagcacttatgggaccgagtagtagcgccggtccagcccgactccgcctaccccctaggcggcacagtagcctgccgcctcggcgagcctcctttctgatagtttcccgagcgagcaaatcttgggagtgtgctggaccggtgccggctctccctggcggagtcgtggcagtacctacatcccaacaggacccgcagtgtcggggatcacaagtggcacaccggaggtgcctgtctagggcaatcctacagagtgggcctcagtgtcaatcatgcctaagcatctgggtcactagcgcgcgaagccgcgtgcaggcatcctccagatcatag

SEQ ID NO: 23400 - DNA, 426 bp, Artificial Sequence
  Description of Artificial Sequence: Synthetic coding sequence
atgtcatccccaccacacagcggtcagacagtgcatcccccatgttcatccaagctcaggatggatcccacacccgcatggccagcatcatgcgaggccttgatggggccatctagctccgctggtcctgcaagactcaggcttccgccacggcgacacagttccttaccacctcgtcgcgcatcatttttgattgtgtcaagggcctccaagagttgggaatgcgcaggcccagtgccggctttgccaggaggtgtagtagcggtcccaaccagtcagcaggatccccagtgccgcggttcccaggtcgcgcatcgcagatgcctgagcagggccatcttacagtctggccctcagtgtcagagctgtctatccatctgggtaacatccgcccgaagtcgcgtgcaagcctcctcgcggagctag

SEQ ID NO: 23401 - DNA, 666 bp, Artificial Sequence
  Description of Artificial Sequence: Synthetic coding sequence
atggcggcagcagtacgcatgaacatccagatgctactggaggctgccgactatctggaaagacgggagagggaagctgagcatgggtatgcctccatgctcccctataataacaaagatcgggatgctttgaagagaaggaacaagtccaagaaaaacaactctagcagccgatccactcacaatgaaatggagaagaatagaagggctcaccttagactctgcctggagaaactaaagggcctcgtgccgttaggccctgagtcgtctagacatactaccttaagccttttaacgaaggccaaactgcacatcaagaaattggaggattgcgatcgcaaggccgtccatcaaatcgaccagctccagagggaacaacgccatctgaaacgccagttggaaaagttaggtatcgagagaatacggatggactccattgggtccaccgtgagcagtgaaaggtctgactctgaccgagaagaaattgatgttgatgtcgagtccactgattacctgacaggagacctcgactggtcttcatctagcgtcagcgactctgacgagcgtggcagtatgcagtcacttgggagcgacgaaggatacagctctacttcaattaaaaggattaaacttcaagacagccacaaagcatgcttgggactgtag

SEQ ID NO: 23402 - DNA, 636 bp, Artificial Sequence
  Description of Artificial Sequence: Synthetic coding sequence
atggcagccgcagtaaggatgaacattcagatgcttcttgaagctgctgattacctggagaggcgggagcgggaagccgaacacggatacgcctcaatgttaccttataataataaagatcgggatgcactcaaacggcgaaataaaagtaaaaagaacaactcgagttctcgccgtgcacatctgaggttgtgtttggaaaagctgaaaggcctggtcccactgggcccagagagttccaggcacaccaccctgagcctgttgaccaaggccaaacttcatatcaaaaagctggaggactgcgataggaaagccgtccatcaaattgatcagttgcagagggaacagcggcacctgaaacggcaactcgaaaagctagggatagagagaattcgcatggactccataggctcaaccgtgtcctccgagcgaagtgattcagaccgcgaagagatcgacgtggatgtcgaaagtacagactatcttacaggggacttagactggtccagttccagcgttagcgattcggatgaaagaggatcaatgcagtcattgggctcagatgaaggttacagcagtacttcaatcaagcggattaaactccaggatagccacaaggcctgtctcggtctctag

SEQ ID NO: 23403 - DNA, 630 bp, Artificial Sequence
  Description of Artificial Sequence: Synthetic coding sequence
atggagctgaatagccttctgatcctgctggaggctgcagagtacctggagagaagagatcgggaagcagagcatggttatgcgtccgtcctgccctttgatggtgacttcgcccgagagaagaccaaagcagcgggtctggttcgcaaggccccaaataatcgatcctcacacaatgaactggagaaacaccgcagagccaagttgaggctgtacttagaacagctgaagcagctggtacctctcggccctgattctacgcgacacacaaccctgagccttctgaaaagggccaaagtgcacatcaaaaagttagaggagcaggacaggagggccctgtcaatcaaagaacagttacagcaggagcatcgctttctgaaacggaggctcgagcagttgagtgtgcagagcgtggagagagtccggaccgacagcaccggcagtgcagtgagtacggatgactcagagcaggaagttgatatcgaagggatggagtttggcccaggagaactggacagtgtaggctccagtagcgacgcagatgaccactactctctgcagagtgggaccgggggagatagcgggttcggaccacactgtcgcagactcggccgtccagccctgtcgtag

SEQ ID NO: 23404 - DNA, 177 bp, Artificial Sequence
  Description of Artificial Sequence: Synthetic coding sequence
atggaactgaactccctgttgattctgcttgaggcagcagagtacttggagagaagagatagggaggctgagcacggatacgcctcagtcctgccatttgacggcgattttgccagggagaagaccaaagcagccggtcttgtgcgcaaggccccaaataaccgcccaccccagtag

SEQ ID NO: 23405 - DNA, 1293 bp, Artificial Sequence
  Description of Artificial Sequence: Synthetic coding sequence
atgttcgatggttatgatagctgtagcgaagatacctccagctcctccagtagtgaggaaagtgaggaggaagtggcgcctcttccctcaaatctgcctataataaaaaacaacggacaggtgtatacttatccggacgggaagtctggaatggcgacatgcgagatgtgtggtatggttggcgtgagagatgctttctactctaaaactaaaaggttctgtagcgtttcatgttcccgcagttacagcagcaatagcaaaaaagcatctattctcgcccgtctccagggaaagcctcccacaaagaaggcaaaagtcttacagaagcagcccctggtggcaaaacttgctgcctacgctcagtaccaggcgaccctccagaatcaggccaagaccaaggccgcagttagtatggaaggatttagttggggaaattacatcaattccaacagctttattgcagcacctgtcacctgcttcaaacatgcacccatgggcacgtgttggggggatatttctgaaaacgtgcgggtggaagtgcccaataccgactgctccttgcccaccaaagtcttttggatcgccggaatcgtgaaactagcgggttataatgccctgctgcggtatgagggctttgaaaatgattccggattggacttttggtgtaacatttgcggcagcgatatacacccagtgggctggtgtgccgcttccggcaaaccccttgtccccccaaggacaattcagcacaagtatactaactggaaggcctttctcgtcaaacgactgaccggggcaaaaacgctaccaccagacttcagccagaaggtgtcagaatccatgcagtaccccttcaaaccctgtatgagggtcgaagtggtggataaacgtcatctgtgtcgaactcgagttgctgtggttgaatcagttatcggcggtaggctgcggctcgtttatgaagagtccgaggaccggactgatgatttctggtgccacatgcacagccccttaatacatcacatcggatggtctagatcaattggtcacagattcaagagaagtgatattacaaaaaaacaggacggacatttcgacactccgcctcacctctttgcaaaggtgaaagaagtggaccagtcaggagaatggttcaaggaaggaatgaaattagaggccatcgacccgctgaacctgagtacgatttgtgtcgccacaatcagaaaagtgacccagaactttctgctgaacggtctgaccactagcggcaagctcgcacccttgcagcatcagtag

SEQ ID NO: 23406 - DNA, 1887 bp, Artificial Sequence
  Description of Artificial Sequence: Synthetic coding sequence
atgttcgacggatacgactcttgttccgaggatacctcaagcagctcatcatccgaggaaagtgaggaagaagtggctcctttgccaagcaacttaccaattattaagaataatggccaggtgtatacatacccagatggcaagagtgggatggccacttgcgagatgtgtggaatggtaggagtgcgcgatgccttttattccaagaccaaacgattttgcagcgtctcgtgcagccgcagttactctagcaactccaaaaaagccagcattctggcaaggctgcaggggaaaccccctacaaagaaggctaaagtattgcagaagcagcccctcgtagctaaactggctgcgtacgctcagtaccaagctaccttacagaatcaggccaagacaaaggcggcagtttccatggagggatttagttgggggaattatataaacagcaacagttttatcgctgcccctgtgacctgctttaaacacgcgcctatgggaacctgttggggcgatatttctgaaaatgtccgcgtggaagtacctaataccgactgttccttgccaacaaaagtgttctggattgctgggatcgttaagctcgccggatacaatgcccttcttagatacgaagggtttgaaaacgattcaggattagacttttggtgtaacatctgtggcagtgacatccatccagtgggatggtgcgcagcatccggcaaaccactggtgcctccgaggacaatacaacacaagtatacaaactggaaagcattcctggtcaagcggctcaccggtgcgaagactctccctcccgactttagtcagaaggttagtgaaagcatgcagtatcccttcaagccctgtatgcgcgtggaagtagttgataagaggcacctgtgtagaactcgtgtagccgtcgtggaaagcgttatcggaggaaggttacggctcgtgtacgaggagagcgaggataggacagacgacttctggtgtcacatgcattctccgcttatacatcacattggctggtctcgtagcattggtcacaggttcaaaaggagcgacattaccaaaaagcaagacgggcacttcgatactcctccccatttgttcgctaaggtcaaggaggtagatcaaagtggagaatggtttaaggagggaatgaaactagaggccatcgatcctctgaatctctcaaccatctgcgtggctacgatccgaaaggtactggcggatggtttcctgatgattggaatcgatggatccgaggcggcagatggtagtgactggttctgctaccacgcaacttctccctcaatcttccctgtgggcttctgcgaaataaatatgatcgaactgaccccaccaagagggtatacaaaactgccatttaagtggtttgactacctccgcgaaacgggtagcattgccgcacccgtgaaactctttaacaaggacgttccaaatcatgggtttcgggttggtatgaagctggaagctgtagacttaatggaacccagactgatctgtgtggccaccgtgacacggattatacaccgcctgctgaggatccatttcgacggttgggaggaagaatatgatcagtgggttgattgcgaaagcccagatctgtatcctgtggggtggtgtcagttgacggggtaccagctgcaacctccagcttcacagtcatctagagaaaaccagtccgcttcgagtaagcagaaaaagaaggccaagtcccagcaatacaaagggcacaaaaaaatgacaacgctccaactcaaggaggagcttctggacggagaggattacaactttctgcagggggcatcagaccaggagtcgaatgggtcagctaacttctatattaagcaggaaccttag

SEQ ID NO: 23407 - DNA, 1887 bp, Artificial Sequence
  Description of Artificial Sequence: Synthetic coding sequence
atgtttgacgggtatgacagctgttctgaggatacgagcagttcgagtagctcggaggagtccgaggaagaggtggctcctctgccctctaatctgccgatcatcaagaataatggtcaagtctacacctacccggacgggaagtccggcatggccacatgcgagatgtgtggaatggtgggggtccgcgacgccttctacagtaagactaaaagattttgctccgttagttgttctaggtcatactccagcaattcgaagaaggcatcaattttggctcggctgcaaggaaaaccccctacaaagaaagccaaagtcctccagaagcaaccattagtagctaagctggcagcctacgcccagtatcaggctaccctccaaaaccaggcgaaaaccaaagctgcagtgagtatggaaggcttctcttggggcaactacataaattccaactcttttatcgccgcaccagtcacgtgtttcaaacacgcgccaatgggaacatgctggggtgacatcagcgagaacgttcgcgtcgaggtgcccaatacggactgtagcctgcctactaaggtcttctggatcgccggaattgtcaagcttgctggatacaatgcgctgctgcgttacgaaggctttgagaatgactcaggattggatttctggtgtaatatatgtggaagcgatatccacccagtgggatggtgcgctgccagtgggaaaccactggtgccaccacggaccatccagcacaagtacaccaattggaaagcctttttggtcaagcgcttgacaggtgctaagaccctgcctcctgatttttcccagaaagtgagtgagagcatgcagtaccccttcaaaccgtgcatgcgcgttgaggtggttgacaagaggcacctctgtcggacccgcgtagctgtggtggaaagcgtgataggcggacgacttcggcttgtgtacgaggaatcagaggataggactgacgacttttggtgccacatgcactcacccctgattcaccatatcgggtggtccaggagtatcgggcaccgcttcaaacggagcgatatcacaaagaagcaggacggccacttcgataccccaccacacttgtttgcaaaggtgaaggaagttgatcagtcgggagagtggtttaaagaggggatgaaattggaggctatagatcctctgaatttgagcacaatttgtgttgccaccattagaaaggtgcttgctgacggctttctgatgatcgggatagatgggagcgaggctgctgacggcagcgattggttttgctaccacgccactagtccatccatcttcccagttggattctgtgaaataaacatgatagagctgactcctcctagaggatataccaagttacccttcaagtggttcgactatctgagggagaccggtagtattgccgcacctgtgaagctcttcaacaaagatgtccccaaccatggatttcgagtggggatgaagttggaggccgtcgatctgatggagccaaggctgatttgtgtggcaactgttacccgaattatacatcggttgctacgcattcatttcgacggttgggaagaagagtacgatcagtgggtagattgtgagagccctgatttataccccgtaggatggtgtcaattgacagggtaccagttgcagcccccagcgtcccagagttcacgtgaaaaccaatcagctagttctaaacagaagaagaaagccaaatcccagcagtacaaaggtcataagaaaatgacaacgctccagctgaaagaggaactcctcgacggcgaggactacaacttcttacagggtgccagtgaccaagaatctaacggcagtgccaacttctacattaaacaggagccctag

SEQ ID NO: 23408 - DNA, 1887 bp, Artificial Sequence
  Description of Artificial Sequence: Synthetic coding sequence
atgttcgatggatacgacagttgcagtgaagacacctcaagctcctcttcctctgaagaaagtgaggaagaggtggcacctcttccgtcaaacctgccaattatcaagaataacggacaggtttatacttatccagatgggaagtccggtatggccacctgtgaaatgtgtggcatggtgggtgtccgtgacgcattctactcgaagactaagcggttctgctctgtctcttgctccaggtcctactcatctaattctaagaaagccagcattctcgcacggctccaggggaagcctccaactaaaaaggccaaagttctccaaaaacaacccttggttgctaagctcgccgcttacgcacagtaccaggcgactcttcaaaaccaggccaaaaccaaggcagccgtatctatggagggcttctcctgggggaactacattaatagtaactcctttattgccgctccagttacctgtttcaagcacgcacccatgggcacgtgctggggtgatatatctgagaacgtgcgagtagaggtaccaaacacggactgcagcctgcctacaaaggtattctggatcgccggtatcgtgaaacttgcagggtataacgcgctgctgaggtacgagggttttgagaacgactccggactggacttttggtgcaatatttgtggatcagacatccatcctgtgggctggtgcgccgcttctggcaagcccctcgttccacccaggacaattcaacacaagtatactaactggaaagctttcctcgttaagcgtctgacgggagccaagactctgcccccagacttctctcaaaaagtgagcgaaagcatgcagtatccctttaaaccatgcatgcgcgttgaggttgtagacaaaagacatctgtgtcgcactagggtagccgtggtcgaaagcgtgatcgggggaagactgagactggtatatgaggagagcgaagatagaaccgacgacttctggtgtcatatgcatagccctctcatccatcacatcggctggtccaggagtatcggtcatagattcaagcggtctgacataaccaaaaagcaagatggtcacttcgatactccccctcacttgtttgccaaggtaaaggaggtggatcagtccggggaatggtttaaggagggaatgaagctcgaggcaatcgatcctctgaatttgagcactatatgcgtcgctaccatccggaaagtgctggctgacgggtttctaatgattggcatcgatgggagtgaggcagccgatgggagcgactggttttgttatcacgcaacctctccctccatttttcccgtaggcttctgtgaaattaacatgatagaattgacaccccctcgcggttatactaaactcccattcaagtggtttgactatctacgcgaaaccggctcaattgcagcgcctgtgaagttatttaacaaggacgttcccaaccacggttttagagtggggatgaagctggaagccgttgacttgatggagccaaggttgatctgcgtggccaccgtaactcgtatcatccaccggttgctgcgcatacattttgatggatgggaggaagagtacgatcagtgggttgactgcgaatccccggatctgtaccctgtgggttggtgccaattgactggctatcaactgcagccacccgcatctcagagctcccgcgaaaaccagtcggcatcctccaaacagaagaagaaggctaagagtcagcagtacaagggacataagaagatgaccacacttcagctgaaagaagaacttctcgatggtgaggactataactttctacagggcgcatcggaccaagagtctaacggttctgcaaacttttatataaagcaagaaccttag

SEQ ID NO: 23409 - DNA, 16791 bp, Artificial Sequence
  Description of Artificial Sequence: Synthetic coding sequence
atggagcatttcctgctggaagtcgccgctgcaccactgcggctgattgccgctaaaaatgaaaaatctcgctcggagctgggacgcttcctcgccaagcaagtctggacaccacaggaccgtcagtgcgtgttatccacgctggcccagttgctactcgacaaagattgcacggtgcttgtgggaaggcagctgcgaccactgttgctagacctcctggagaggaacgctgaagctattaaggctggaggccagatcaaccatgatctgcacgaacgtctctgcgtgagtatgagcaagttgatcggcaaccaccctgatgtactgccattcgccctgaggtactttaaagacacctccccagtttttcagcgattattcctggaatccagtgacgcaaatcccgtgcggtatggaaggcgtcgcatgaagcttcgggatctcatggaggccgcatttaaattcctgcagcaggaacagtctgtttttcgcgagctgtgggattggagcgtgtgtgtcccgttacttcgatcccacgacacattggtgagatggtatacagccaattgcctagccctcgtcacctgtatgaacgaggaacacaaactgagtttcctgaaaaaaatcttcaactccgatgaactgatacattttcgactgaggttgctcgaggaagcacaactacaggatctggagaaagctctggttctcgctaacccagaggtgtccctttggaggaagcaaaaggaattgcagtatctgcagggccatctcgtatccagcgacttaagtcctagagtcacagcggtctgtggagtggtgcttccaggacagctgccggctcctggcgaactaggcggtaataggtcctcatctcgcgagcaggagttagcgttacggagctacgtgcttgttgaatccgtgtgtaaaagccttcagactctggcaatggcagtggcttctcagaacgcagtgctattggaagggcctatagggtgcggcaagacctcattagtggagtatctggcagctgtgacaggcagaactaaacctccccaattgcttaaagtccagttaggcgatcaaactgactcaaagatgttgctgggcatgtatcgttgcaccgacgtgccaggggagttcgtctggcagcccggtacactcactcaggccgcaaccatgggacattggattttactcgaggacatcgactatgctcctctggacgttgtgagcgtgctgatccccctgctggagaacggcgagctgcttatcccaggcagaggcgattgtttaaaagtcgctcctgggttccagttttttgccacacggagactgttgtcctgtggcggaaactggtaccggcctctgaactcccatgcaacactgcttgacaaatactggacgaagatccatctggacaacctggacaagagagagctgaacgaagtattgcagagcagatacccatctctgctggccgtggtagatcatcttctggatatatatattcaactaacgggagaaaagcaccactcatggtccgattcctcagtcgggtgcgaacaagcaccagaggaggtcagcgaggcccgaagggaaaataaaaggccgacactggaaggccgagaactatccttaagggatttgctgaactggtgtaacagaattgctcacagtttcgacagctcaagcctgtctgcgagtctcaacatcttccaggaagccctcgactgtttcactgcaatgctgtccgaacacacctccaagctaaagatggctgaggtaattggtagcaagctaaacatcagcagaaaaaaggccgagtttttctgccagctttataaaccagaaatcgtgattaatgagctcgatctccaagttggacgtgtgaggctgctgcggaaacaaagcgaagcagtgcacctgcagcgcgagaaatttacttttgcagcaacaaggccatcctcagttctgatcgagcagcttgccgtatgcgtatctaagggagagcccgtgcttttggtgggcgagactggaacagggaagacttcgacaatccagtatctagcccatattacaggccaccgcctacgcgtggtgaatatgaatcaacagagcgacacagccgacctcctaggaggctataagcccgtagatcacaagctgatttggctcccgctaagagaggccttcgaggaactgttcgctcaaacattcagtaagaagcagaacttcactttcttagggcacatacagacctgttatcgccagaagcggtggcacgacctgctgcgacttatgcagcacgtccacaagagtgccgtgaataaggacggaaaagacagcgagacaggcctgcttattaaagagaagtgggaggcctttgggctgcgtctaaaccatgctcaacagcagatgaagatgaccgagaacacattactgttcgcttttgttgagggaacacttgctcaggcagtcaagaaaggggagtggattctcctggatgagattaacctggccgcacccgaaattctagagtgcctgtcaggcctccttgaggggagttctggatctctggtcttactggatcggggtgacaccgaacctttagtgcgccaccctgacttccgcctttttgcatgcatgaatcccgcaactgacgtggggaagcggaatcttcctcctggcatccgtaacagatttacagaactctacgtagaggagctggagagtaaggaagatctgcaggtccttatcgttgactacttaaagggcctgtccgtaaataagaacacagtgcaaggaattatcaacttttatactgccctgagaaaggagagtgggacaaaattggtcgatggcacaggccatcgacctcactactctttacgcaccctctgtcgcgcactacggtttgctgccagcaacccatgtgggaatattcaacgaagcctgtacgaagggttttgcctcggatttctgacccaattggacagggcgagtcacccaatcgtccagaaactcatctgtcagcatattgtacctggaaatgtgaagtctctgctgaagcagccgataccagaacccaaaggcggtcggttaattcaggtggaggggtactggattgctgtaggagataaggaacctacaattgacgagacgtacattttgactagctctgtaaaacttaacctgcgagacattgtgcgggtcgtgtccgccggaacatacccagtcctgatccaaggcgaaaccagtgtgggcaaaacttcattgatccaatggctggccgctgccacaggaaatcactgtgtacgaataaataatcacgagcacactgacatccaggagtatatcggatgttatacgagcgatagttctgggaaattggtgttcaaagagggcgttttgatagatgcaatgcggaagggttactggatcatcctcgatgaactcaatcttgcgcctacagatgtcctggaggccttgaatagactgcttgatgataaccgagagctgctcgtgactgagactcaagaggttgtgaaggcccatccaaggtttatgctgtttgcaacacagaatcctcctggtctgtacggtgggaggaaagtgctctctagagcttttagaaacagattcgtcgagctgcatttcgacgaattgcctagcagcgagctggagacaattttgcataagcggtgtagccttcccccaagttactgctcaaagttggtgaaagtcatgctggatctgcaatcttatcgcagatctagtagtgtgttcgccggaaagcaaggcttcatcaccctgagagatttgttccggtgggccgaaagataccgactggccgaacccactgaaaaggaatatgattggctgcaacatctcgcaaacgatggttatatgctcctagccggacgcgttaggaagcaagaggagatcgatgtcatacaagaagtgctggagaaacacttcaaaaaaaaactgtgcccgcagtcgctgttcagcaaggagaacgtgctcaagctgctgggaaagcttagcactcaaatctctacacttgagtgcaattttggacacatcgtttggacggaagggatgagaagactggcaatgctcgttggaagggccctcgagttcggagagccggtactcctcgtgggggacactgggtgtggcaagactaccatctgtcaggttttcgcggcactggcgaatcagaagctttattctgtaagttgtcacctccacatggagacgtctgatttcctaggcggattgcgacccgtgcgccagaaacccaatgacaaagaagaaatcgatacatcgcgcctgtttgagtggcatgacggaccactggtacaggctatgaaagaagacggattcttcctcttagatgaaatcagtctggctgacgatagcgtgctggagcgcctgaattctgtgttagaagtggagaagtccctggtgctagcagagaaaggttccccggaggataaagatagcgagatagaactcttgacagctggaaagaagttcaggattctggccaccatgaaccctgggggagacttcgggaagaaagagctgtccccagcactgagaaatagattcacagagatatggtgtccacaaagcacctctagagaagacttgatccaaatcatttcgcataacttgagaccaggcctttgtctggggaggattgatccgaaaggctccgatatccccgaagtgatgctcgactttatcgattggctcacccatcaggagttcggcagaaaatgcgttgtgtccattagggacatcctatcctgggtgaactttatgaacaagatgggcgaggaagccgcattgaaacggcctgaaatcatctccactgtcacaagtttcgtgcacgctgcatgccttgtgtatattgacggcatcggcagtggcgtcactagttccggcttcgggaccgccctgttggcacggaaggaatgtctgaagtttctaataaaacgcctcgccaagattgtgcgcttgacggagtatcagaagaatgaactcaagatctacgatcggatgaaggccaaagagttcaccggcatcgacaacctttggggaattcatcctttcttcataccacggggacctgtgctccaccgcaacaacatcgctgattatgccctgagcgctgggacaaccgctatgaatgcccagagactgctacgagccacaaagcttaaaaaaccgatacttttggaagggagtccaggtgtcggaaaaaccagcctcgtgggtgccctggcaaaggcctctggcaacacactcgtgcggatcaacctaagtgagcagaccgatatcaccgacctgtttggcgctgatcttcccgtggaggggggaaaaggcggtgaatttgcttggcgcgacggccctctgctggccgctctgaaagccggtcattgggtggttcttgatgaactgaacctggcctctcagagcgtgctggagggcttgaatgcttgcttcgatcatcggggtgaaatttatgtgcctgaattgggcatgagtttccaggtccagcatgagaaaacgaagatattcggctgtcagaaccccttcaggcaggggggtggaaggaaagggcttcctcggagcttcttgaatcgatttacacaagtcttcgtagacccccttacggtcatcgacatggagtttattgcctccaccctgttccccgcaatcgagaaaaatattgttaagaagatggttgcttttaacaatcaaatcgaccatgaagtgacggtagagaaaaagtgggggcaaaagggagggccatgggaatttaatctgcgagacctcttccggtggtgccaactgatgctcgtagatcagagtcctgggtgctacgacccgggacaacatgtgttcctggtttatggtgagcggatgagaacagaagaggataaaaaaaaggttattgccgtgttcaaggatgttttcgggagcaactccaatccctatatgggcacaagactgtttagaattaccccttacgacgttcaactgggctatagcgtcctatctcgcggaagttgcgttccgcatccctcacgccaccctttgttgctcctgcaccagtctttccagcccttggagagtattatgaagtgtgtgcaaatgtcttggatggtcattctggtgggccctgcatctgtcgggaagacctccctcgtccagttactcgcccatctgacaggacacactctgaagataatggcaatgaactctgccatggatacaacagagcttctggggggatttgaacaggttgacctgatccgaccctggagacggctacttgaaaaagttgaagggacggtgcgggcacttctgcgagattccctgctaataagtgcagacgacgctgaagttgtgctacgcgcttggtcccacttcttgctcacgtacaaacccaagtgcctgggggagggcggaaaggccataactatggaaatcgttaacaaattggaagctgttctcctcctgatgcagaggctgaataataagataaactcttactgcaaagccgaattcgcaaagttggtagaagagttccggtcttttggtgtgaaactgacacagctggccagcggtcactctcacggaactttcgaatgggtggactctatgctggtccaggccctcaaaagtggggattggctgttgatggacaacgttaacttctgtaatcccagcgtactggaccgcttgaatgccttactggagccgggaggcgtgttaaccatttctgagcgcggtatgattgatggctccactcctacgattactcctaaccccaacttccggttgttcctaagcatggatcctgtccacggtgacatttcccgagcgatgaggaaccgcggactggaaatctatatatctggtgaaggcgacgcctcgacacctgacaacctggacctaaaagttctattgcattccctggggctggtgggaaatagtgtgtgcgatatattgcttgccttacacacagagactcgaagcaccgttgtgggttccccaacgagttcggtctcaactctcattcagaccgccatactcatcgtgcagtaccttcagcggggtttgagcctagatcgcgcattttccgaggcatgttgggaggtatatgtgtgttctcaacattcgcccgctaaccgtaaactcgtgcaagccctattggaaaagcacgtaagttcccttcgcgctcacgagacatggggggatagcatccttggcatggggttatggccagactccgtgcctagcgctctcttcgccacagaggatagccacctgtctactgtccgaagagacggccagatcctggtgtactgcctgaatcgcatgtccatgaagacttcgagctggactagaagccagcctttcactttgcaggatctcgaaaagattatgcagtctccatcacccgaaaacctgaagtttaacgctgtcgaagtcaatacatactggattgacgaacctgacgtattagtaatggctgttaagctgctgatcgagagagccactaaccaagattggatgcttagggtgaagtggctttaccacctggctaagaacattcctcagggcctggaatcaattcaaattcacctggaggctagcgctgcctccctgcgcaatttttactcccattccttgagcggagctgtatcaaatgtatttaaaatcttacagccaaataccactgacgagtttgtaataccactggatcctcgttggaatatgcaggccttggacatgattcgtaatctgatggacttcgatccccaaaccgaccagcccgatcagttattcgcgctgctagaatcagccgctaacaagactattatctatctggatagagaaaagcgcgtgtttaccgaggctaatctcgtttccgtcggtagtaaaaaattacgagaatccgttctcaggatgagctttgaatttcatcaggaccccgaaagctatcataccctcccgcacgaaattgttgtaaacctggccgcattcttcgaactctgtgacgccctggttctcttgtgggtgcagagcagccagggcatggttagtgacgcatccgccaatgagatccttggaagtcttcgctggagagaccgattttggactgtggcagatactgtcaaagtggacgcccctggactggccctgcttgctctccattggcattgggttcttaagcatctggtgcaccagataccacgcctcctgatgaactatgaagataagtattacaaagaggtacaaactgtttcagaacacatccagaattgcttgggttcccagactgggggtttcgccggaattaaaaaattgcagaagttcctcgggagaccctttccgtttaaagataagctggtcgtggaatgtttttcacaactgaaggtcctgaataaggtgctggccataagagaacagatgtcggctctgggggaaagcggatggcaggaagatataaacagactgcaagttgtagcatcccagtggacacttaagaagagtctgcttcaggcatggggcttgattttgagagctaatatcctggaagatgtgagcctggacgaactgaagaattttgtgcacgcacagtgtctcgagcttaaagccaaaggactctcactcggatttctcgagaaaaaacacgacgaggccagcagcctgtcgcaccccgatctcacctccgtgattcatctgactaggagtgttcagttatggcccgcaatggagtatttggcaatgctctggagatacaaagtgacggctgacttcatggcacaagcctgcctgcggagatgctctaagaatcagcagccacagatcaacgaagagatctctcatctgatttctttttgtctttatcacacacccgtgacccctcaagagctccgagacctttggagtcttctgcatcaccagaaagtttcacctgaggagataacctccctgtggagcgagctgttcaacagtatgtttatgtcattctggagttcaacagtgactacaaaccctgaatattggctgatgtggaacccactacccggaatgcagcagcgagaagctccgaagtcagtccttgactctaccttaaaggggccaggcaacctgaaccggcctatcttttccaagtgctgttttgaggtgctgacctcctcatggagggcctctccctgggatgtttccgggcttcccatcctcagctcgtctcacgtcacgctgggtgaatgggtcgaacggacccagcaactgcaggacattagttcgatgttatggacgaatatggccataagctcagtggccgagtttaggagaaccgatagccagctccagggacaggtactctttagacacctcgctgggctcgcagagctgctgcccgagtccagacgacaagaatatatgcagaactgtgagcaactcctgttgggaagttcacaggcgttccagcacgttggccagacattaggcgacatggcaggccaggaagtgttgcccaaggagctgttgtgtcagctgttgacttctctacaccatttcgtcggcgagggcgaaagtaaaagatccctgcccgaacccgctcagcgcggatcgctgtgggtttccctcggactgctgcagattcagacatggttaccccaagcgagattcgatcctgcggtcaaaagagagtataagctcaactacgtgaaggaggaactccaccaactgcagtgtgaatggaagacacgaaatctgagctcccaactgcagacagggagggacctggaggatgaggtggtagtcagctattctcacccacacgtgagattacttcgccagaggatggatagattagacaatctcacatgccacctgcttaagaagcaggcttttcggcctcagctccctgcttatgagtctttagtacaagagattcaccactacgtcactagtatcgcgaaagcacccgctgtgcaagacctgctaacccgcctcctgcaggcacttcatattgacggccctcgcagtgcgcaagtagcccagagtctgttgaaggaagaggccagttggcagcaaagccatcatcagtttcggaagcgactttctgaggaatataccttctatcctgacgcggtatccccccttcaggccagtattttacagctgcagcacggcatgcggctggtagcaagcgagttacatacttccctgcactcatccatggtcggcgcagaccggctagggacactggccacagctctgctggcgttcccctccgtgggcccaacatttccaacttactatgcccacgcagataccctctgttccgttaagtccgaagaagtgctgagaggcctcggcaagctgattttgaaacgatctgggggtaaggagcttgagggcaaaggacaaaaggcctgccctacacgagagcagttactgatgaatgccctgctctacctcaggagccacgtgctgtgcaagggcgagctcgaccaacgggctctgcagctcttccgccatgtctgtcaggagataatatcagaatgggacgagcaggaaagaatagctcaagaaaaagccgaacaggagagcggactgtatagatacaggtctagaaacagccgtaccgctttgtctgaagaagaggaagaggagagggaattcagaaagcaatttcccctccacgagaaagatttcgccgatatcctcgtgcagccaactcttgaggaaaacaaaggcaccagcgacggacaagaggaagaggcgggaaccaacccagccttgcttagtcaaaactcaatgcaggctgtcatgctgattcatcagcagctgtgcctgaatttcgcaaggagcctttggtaccagcagacgctaccgcctcacgaggccaaacattatttgagcctctttctatcttgctaccaaactggagcttctctggtgacgcatttctatcccctgatgggggtcgagctgaatgacagactgctgggatcccagctgttggcctgtactctctctcacaatacccttttcggcgaagccccaagcgatctgatggtgaaacctgatgggccatacgatttttaccagcatcctaatgtgcctgaggccaggcagtgtcagcctgtgctccagggcttcagcgaagccgtgagccacctgcttcaggactggcctgagcatcccgctctggaacagttgttagttgtgatggatagaattcgttcgttccccctctcctctcctataagcaagttcctgaatggattggaaattctcttggctaaagcccaagattgggaagaaaatgcttccagggcattgtcacttaggaaacacttggacctgatcagccagatgataatccgatggcgtaagctggagctgaactgctggtcaatgagcttggataataccatgaaaaggcataccgaaaaatccacgaaacattggtttagtatctaccagatgttggaaaagcacatgcaggagcagaccgaagaacaggaagatgacaagcagatgactctgatgctcttggtgtctactctccaggcctttatcgaaggcagttccctaggtgaatttcacgttcgactacaaatgcttttagtgttccactgtcatgtgctccttatgccgcaggtggaaggaaaagactccctgtgcagcgtgctgtggaatctgtatcattactacaaacagtttttcgacagggtccaggctaaaatagtggagctgcggtcacccctggagaaagaactgaaggaatttgtcaagatctccaaatggaacgacgtttctttttggagcatcaagcagagcgtcgaaaaaacccaccgtactttgttcaaatttatgaagaagttcgaggctgtcctaagtgagccctgcaggagttccctcgtggagtcagataaggaagaacagcctgatttccttcctcggcctaccgatggagctgctagcgaactgagttctatccaaaacctgaatagggcgcttcgcgagaccctcttggctcagcctgctgcgggacaggctacaatcccagagtggtgccagggggctgcacccagcggccttgagggcgagcttttgagacggttaccgaagctgagaaaacgcatgcgtaaaatgtgtctaacattcatgaaggaaagtccgctgcctcgcctggtggaaggactggaccagtttactggggaagtgatctcgtccgtttctgaactgcagagtctgaaggtcgagccgagcgctgagaaggaaaaacagcgatccgaggcaaaacacatcttaatgcagaaacagcgggcactcagtgacctcttcaagcacctggcaaagattgggctatcctataggaagggcctggcatgggctcgctctaagaatccacaggagatgctgcatctgcatccactggacctgcagtctgcattgagcattgtttcaagtacccaggaagcggattcacgcctactcacggagatttccagtagctgggatggctgccagaaatatttttaccgctctctagccaggcatgctaggctaaatgcggcactggctacacccgcaaaggagatggggatgggcaatgtggagaggtgtagaggctttagtgcacatctcatgaagatgttggtgcgccagcgacgctctctcacaaccctttccgagcagtggattatcttacgcaacttgctcagctgcgtgcaggagatccattctaggcttatgggtccccaagcctatccagttgccttccccccacaggacggcgtgcagcagtggacggagcgtctccaacacctcgcgatgcagtgccagattctgcttgagcagctgtcttggctgctgcagtgttgtcccagcgtgggacccgcacctggccacgggaacgtgcaagttctggggcagcctccagggccatgtctggagggcccagaactgagcaagggccagctgtgcggtgtcgtgctagacctaattccgagcaatctctcctacccgagcccgatccctgggtctcagttgccttccggttgccgtatgaggaagcaggaccatctgtggcagcaatcaactacgcggttgaccgaaatgctgaaaacaatcaagacagtcaaggccgatgttgacaaaatccggcagcagagctgcgaaaccttgtttcatagttggaaggacttcgaagtatgcagcagtgcgctgagttgccttagtcaggtgtccgtgcatctgcaagggttagagagcctctttatcctcccgggaatggaagtggaacagagagattcccaaatggcactcgtggaaagcctggaatacgtaaggggtgaaatcagcaaggctatggccgacttcaccacatggaagacccatttactgacatcagattcccagggtggcaaccagatgttagatgaaggtttcgtcgaagattttagcgagcagatggaaatcgccatcagagccatcctgtgtgcgatccaaaacctagaggagcgaaaaaatgaaaaagcagaggagaacacagatcaggcatcccctcaggaagattacgccggattcgaaaggttgcagtcaggccatctgacaaaactgctcgaagacgacttctgggctgacgtttccacactccacgtacagaagataatatctgcaataagcgagcttctggagcggctgaaatcatatggcgaggacgggacagccgcaaaacacctcttcttctcgcaatcttgttcgctgttagttcgccttgtgcctgttctgagctcttactccgaccttgttctgttctttctgacgatgagtcttgcaacacatcgcagtaccgcgaaactgctgtctgttttagcccaagtgtttactgaattggctcaaaaaggcttctgcctgccgaaggaatttatggaagattctgccggagaaggagcaacggaattccacgattacgaaggcggtgggattggagagggggagggcatgaaagacgttagcgaccagatcggtaacgaggaacaggtggaggacacttttcagaagggccaggagaaagacaaggaagacccagacagcaagagcgacatcaagggggaagataatgccatcgaaatgtcagaggacttcgatggcaagatgcacgatggcgagttggaagaacaagaagaggacgatgagaaatccgacagcgaggggggagacttggataagcatatgggtgacttaaacggagaggaggccgacaagctcgatgagaggctgtggggggacgatgacgaagaggaggatgaggaagaggaggataataagaccgaagagacaggccctggtatggatgaggaagacagcgaattagtcgcaaaagatgacaacctggacagcggcaactccaacaaagacaaatcccagcaggataagaaagaagaaaaggaggaagccgaggccgacgatggcggacagggcgaggataagataaacgagcagattgatgaaagggactacgacgagaacgaggtggacccttatcatgggaatcaggaaaaagtgccagagcctgaagccttggatctgcccgatgatttaaatctggactcagaggataaaaacgggggagaggacacagacaacgaggaaggcgaggaggaaaatccgcttgagatcaaagagaagcctgaggaggcaggacacgaggctgaggagcgcggagagaccgaaacagatcagaacgagagccagtcaccccaggagccggaggaaggccctagtgaagatgacaaagctgaaggcgaggaggagatggacacaggagccgatgaccaagatggggacgctgcacagcacccagaggagcacagcgaagagcagcaacagtccgtcgaggaaaaggataaagaggctgacgaggaaggcggtgagaacggcccagccgaccagggttttcaaccacaggaggaggaagagagagaggactctgatactgaagaacaggtacctgaggccctggaacgaaaagagcacgccagttgcggccagaccggcgtggagaatatgcaaaatactcaggcaatggagttggccggagctgcacctgagaaggagcagggcaaggaagagcatgggagtggcgctgccgatgctaaccaggcggagggccatgaatcgaatttcattgcccagctcgcgagccagaagcataccaggaaaaacacacagtccttcaagcgtaagcctggccaggctgacaacgagcgcagtatgggagatcacaacgagagggtccataaacgactccgaacagtggatacagactcacacgctgaacagggacccgcacaacagccccaggcccaggtcgaggacgccgacgccttcgaacacatcaaacaggggtccgacgcatacgacgctcaaacctacgacgtcgcctccaaagaacagcagcaatctgcaaaggacagcgggaaagaccaggaagaagaggagatcgaagacacgctgatggataccgaggagcaggaagagtttaaggctgctgacgtggagcaactgaagcccgaggaaataaagagtggcactaccgccccactggggttcgatgagatggaggtggagatccagaccgtgaagacggaagaggaccaggaccccagaacggataaagcccacaaagaaaccgaaaacgagaagcccgagagaagtcgagagtctacaatacacacggctcaccaattcttgatggacaccattttccaaccttttcttaaggatgtcaatgagcttaggcaggagctggagcggcaactcgaaatgtggcaaccacgagaaagcggaaacccagaagaagagaaggtggcagccgagatgtggcagtcatacctcatattgacagcaccactttcccaaaggctgtgcgaggaactgcggctgattctagagcccactcaggcggcaaagctcaaaggggattaccgcactggaaaaagattaaacatcaggaaagttatcccatacattgcgtctcagttcagaaaagataagatctggctcaggcgaacaaaaccctcaaaacgccagtatcagatctgtctagccattgatgatagttcaagtatggtcgacaaccacaccaaacagctggcgtttgaaagcctcgcggttattggaaatgcacttaccttgctggaagtgggacagatcgctgtttgctcgttcggggaatcagtgaaactgcttcaccccttccatgagcaattctctgactacagcggttcccagatcctgcgcttgtgcaagtttcagcaaaagaaaactaagattgcccagttcctagagtctgttgccaacatgttcgcggcagcccagcagctgtcccagaatatttctagtgagacagcgcagttgttactggtggttagcgacggaagagggctgttccttgaaggcaaagagcgggttctggccgctgttcaggccgctcgcaacgcaaatatttttgtgatcttcgtggttcttgacaacccctcgtctagagacagtattctggatatcaaagttccaatttttaaaggtcctggagaaatgcctgaaattagatcatatatggaggagtttccctttccgtattatataatcctgagggacgtcaatgcgctgccggagacgctctctgatgctctgcgccagtggttcgagctggtgaccgcatcagaccatccatag

SEQ ID NO: 23410 - DNA, 16791 bp, Artificial Sequence
  Description of Artificial Sequence: Synthetic coding sequence
atggagcacttcctgctggaagtggccgctgccccactgcggctaatcgccgctaaaaatgagaagagtcgaagtgagctcggaaggtttctcgcaaaacaggtctggactcctcaggatcggcagtgtgtgttgtctacgcttgcccaacttctgctcgacaaggactgcacagtgctggtgggaaggcagcttaggccactcctgcttgacctgctggagaggaacgcagaagcaatcaaagccggaggccaaattaaccatgacttgcacgagaggctgtgtgtaagcatgtccaagcttatcgggaaccatcccgatgtgctgccgtttgcactcaggtactttaaggacacaagcccagtattccagcgccttttcctagaatccagtgacgctaatccggtccgctatggcagacggaggatgaagcttagagaccttatggaagccgctttcaaatttttacaacaggagcaatctgtgttccgtgagttgtgggactggagtgtgtgcgttcctctgctgaggagccacgatacgctcgtgcgttggtatacagccaactgtctggcgctcgtcacttgtatgaacgaggagcataaactctcgttcctcaagaagatcttcaacagtgacgagttgatccactttcgactgaggctcctggaagaagcccagctgcaggacttagagaaagccctggttctagctaatcccgaggtatctttatggcggaaacaaaaagagttacagtacctgcaggggcacctggtgtcatctgacttaagtcccagagttaccgccgtatgcggcgttgtcctcccagggcagctgcctgcgccaggcgaactcggtggtaatagatcatcatcaagagagcaggagctggccctgcgttcctatgtactagttgaatccgtgtgcaaaagtctgcagacactcgcaatggccgtcgctagccaaaacgctgtactgcttgaaggtcccataggttgtgggaaaacaagcctggtagagtatcttgcggcagttactggacgtacgaagccaccacagctccttaaggttcagttgggcgatcaaacggatagcaagatgctgctgggcatgtaccgatgcacagatgtccctggtgagttcgtttggcagccgggtaccttgacacaggccgctacaatggggcactggatactcctcgaggatatcgactatgcacctctggacgtcgtgtccgtgctaattcctctgcttgaaaatggcgaactgttgatccctgggagaggagattgcctcaaggtcgcaccaggtttccaattttttgctacacggcgtctcctctcttgcggaggcaattggtaccgtccactcaatagccacgctacacttctcgacaagtactggaccaagattcacctggataaccttgataaaagggagctaaacgaagtcctccagtccaggtacccgtctctcctggctgtagttgaccacctgctggatatttatattcagttgacaggtgagaaacatcacagctggtccgattcgtccgtgggatgtgagcaagcacctgaggaggtgagtgaggcccgaagggaaaacaaacgaccaacgcttgaaggccgtgaactgtctctgagggatttactgaattggtgtaatcgcatagcccatagcttcgacagtagcagcctttcagcttcactaaacatcttccaggaggcgcttgattgctttaccgccatgctaagtgagcacaccagtaaactgaaaatggcggaggtgattggcagcaaattaaatatcagccgaaaaaaggccgagtttttctgccagctctataagccagaaattgtcatcaacgagctagatttgcaggtaggacgcgtcaggctgcttcgaaagcagagcgaagccgtccatttgcaacgcgagaagttcaccttcgcagccacaaggccgtcgagcgtcctgatagaacagctggctgtttgtgtgtctaagggtgagcccgtgctgctggtgggagagaccgggacaggcaaaacaagtacgatacagtacttggcacacattactggtcatcgactgcgtgtcgtgaatatgaaccagcagagcgataccgccgacctgctcggcggatacaaacctgtggatcataaactcatttggctccctctgcgggaagcattcgaagaactttttgctcagacattttccaagaagcaaaattttacatttctgggccatatccagacgtgttataggcagaagcggtggcatgacctcctgcggttaatgcagcacgtccacaagtcagccgttaacaaagacgggaaagactcagaaaccggattgctgatcaaagagaagtgggaagcttttggtcttcggcttaatcatgcccagcagcagatgaagatgactgagaacacactgcttttcgcctttgtcgagggcacgctcgctcaagctgtgaagaagggggaatggattctgctggacgagatcaacttagctgcacccgaaattctggaatgtcttagtggattgcttgaaggctcatctggcagcttagtcttgctggatcgaggcgatacggagcctctggtccgtcacccggattttcggcttttcgcttgcatgaaccccgcaacagatgtgggcaagcggaaccttccacctggtatcagaaaccgatttaccgaactttatgtagaagagcttgagtcgaaggaggatctgcaagtgctcatcgtcgactacctgaagggactttcagtaaacaagaacactgtccagggaatcattaacttctacacggctttgcggaaagaatcgggcacaaaactggtcgatggtactgggcatcggccacattattcacttcgaaccctttgcagagctctgcgcttcgctgcctccaatccctgtggcaatatacaaaggtccttgtacgaggggttctgtcttgggttcctgacacaattggacagagccagtcatcctatcgtccaaaaacttatttgccaacacatcgtacctggaaacgtgaaatccctgctaaaacagccaatccctgagcccaagggtggaagactgattcaggtggaagggtactggatcgccgtaggcgacaaggagccaactatcgacgagacatacattttgaccagtagcgtgaaattgaaccttcgtgatatcgtgcgtgttgtgtccgccggtacttatcctgtgcttatccagggggaaacttccgtgggaaagactagtctgatccaatggctagcagccgcaacaggcaatcattgcgtaagaatcaacaatcacgagcatactgacatccaggagtatattggctgttacaccagcgattcatcaggaaaactggtctttaaggaaggggtactcattgacgctatgagaaagggctattggatcatcctcgatgaactgaatctggcacccaccgacgtccttgaggcccttaatagacttctggacgacaaccgcgagctattggttacagaaacacaggaggtggtcaaggcacaccccagattcatgttatttgctacccaaaacccccctgggttgtatggtggacgaaaggtcctgagccgggcattcagaaacaggtttgtggagctccacttcgatgaactaccatcatccgagttggaaactattctgcacaagcgctgttctctgcctccatcgtattgctccaaactggtgaaggtgatgctggatctacaaagctatcggaggagctcctccgtgtttgctggtaaacagggattcataaccctccgggatcttttccgttgggctgaacgctaccggcttgcagagccaacagaaaaagagtacgactggttgcagcacctagcgaatgacgggtatatgcttctggctggcagggtgcggaagcaagaagaaatagatgtgattcaggaggtgttggagaagcacttcaaaaagaagctgtgtccccaatctcttttctccaaggagaatgttttaaagctgctgggaaaactgagtacccagatttctaccctggagtgcaatttcggacatattgtctggacagaagggatgaggagacttgcaatgctggttgggcgagctttggagttcggtgagccagtgctccttgtgggtgatacaggttgtggcaaaactactatctgccaggtgttcgctgccctggctaaccagaagctatacagcgtgtcgtgccaccttcacatggaaacctccgacttccttggcggacttcgtccagtccgtcagaagccaaatgacaaggaggaaatcgatacatcccggctgttcgaatggcatgatggccctttagtgcaggctatgaaagaagacggattctttctcttagacgagatttctctcgcggacgactcagtgcttgagcgcctaaattcagtcctggaggtggagaagagtctagtactggctgagaagggcagtccagaggataaggattcggaaatagagctgctgacggccggaaaaaagttccggatattagcgactatgaaccctggtggcgactttggaaaaaaagaactgtcccccgctctaagaaatcgatttacagaaatctggtgcccgcaatcgacaagccgcgaagatctgattcagattatttctcataatttacgccctggtctctgcctgggaaggattgaccccaagggttccgacatcccagaggtgatgctggactttattgactggctgactcaccaggagtttggacggaagtgcgttgtgagcataagagatatactgagctgggtcaacttcatgaataagatgggtgaggaagctgcactgaaacgaccagagattatttccacagtgaccagcttcgtacacgctgcctgtttagtgtacatagacgggatcggctccggagttacatctagcggatttgggacagccctccttgccagaaaagagtgtttaaaattcttgattaagcgacttgctaaaatcgtgagactaaccgaataccagaaaaacgagctcaaaatctatgatcgaatgaaggccaaggagtttaccggcatcgataacctgtggggaatccatccatttttcattccaaggggcccagtgttgcacagaaataatatcgcggattacgcactcagcgctggaaccaccgccatgaacgcccaacgtctactgagggccactaaactgaagaagccaatcctgttagaggggagcccgggagttgggaagacctccttagtcggggcactcgccaaagcctctggaaacaccctggtccgcattaaccttagcgagcaaaccgacatcacagatctgtttggggctgatctgccagtggaggggggtaagggaggtgaatttgcctggcgagatggacctttgctcgccgcactgaaggccggtcactgggtggtgctcgacgagctgaatctcgcttctcagagtgtgctcgagggtctgaatgcttgctttgatcatagaggggagatatacgttccagaactaggcatgtcctttcaggtgcaacacgaaaaaaccaaaatctttggctgtcagaatcccttcagacaggggggtggacgaaagggattgcccaggtcatttctgaatcgtttcacccaagtgttcgtggatccccttaccgttatcgatatggaatttatcgcatctactctgtttcctgccattgaaaaaaacattgtgaaaaaaatggtcgccttcaacaatcaaatcgatcacgaagttacagtcgagaagaagtgggggcagaagggagggccatgggagtttaacctgagggatctctttcgttggtgccagctcatgcttgttgaccaatcacccggatgttacgatcctgggcaacacgtatttctcgtctatggagaaaggatgcgcactgaggaagataagaagaaggttattgctgtcttcaaggacgtcttcgggtctaattctaacccgtacatgggcacaaggctgttccgcattacgccatatgatgttcagttagggtacagtgttttatctcggggaagctgtgtgccacacccgagccgacaccctttattgctgctgcaccagtctttccagcctcttgaatcaatcatgaaatgcgtgcaaatgtcttggatggtgattcttgtgggtcctgctagcgttggaaaaacctcactcgtgcaattattagctcatctgaccggtcacaccttgaagatcatggcgatgaatagtgcgatggacactacagaacttttaggcggattcgagcaggtggacctgatccgaccttggcggaggctgctggaaaaggttgaggggaccgtccgcgcactcctgcgcgatagcctgctgatcagcgccgatgacgctgaggtcgtccttagagcttggtcacactttctattaacttataagcccaagtgcctgggtgaaggtggaaaggcaatcaccatggaaatcgtcaataagctggaggcagttttattactgatgcagcgcctgaataacaaaatcaattcatactgcaaggcagaattcgctaagctcgtggaagaattcagatccttcggagtgaagctcacccaactggcaagcggccattcgcacgggactttcgagtgggttgatagtatgctcgtgcaggctctgaagtcaggtgactggctcctgatggacaacgttaacttttgcaacccaagcgttctggacagactgaacgccctgcttgaacctgggggagtcctgaccatttcagagcgcggtatgatcgatggctcaaccccaaccatcacccccaacccgaattttcggcttttcctttctatggatcccgtccatggggatataagccgggcaatgcgcaacaggggattggagatatacatttcaggtgagggcgacgctagcaccccagacaatctcgatctgaaggtcctgcttcacagcctcgggctcgttggtaactctgtctgcgacatcttgctcgccctgcacaccgaaacaaggagcaccgtggtgggcagcccaacatcctctgtctcaaccctgattcaaactgcaatcttgatagtacagtacctccagcgaggcctgagcttggaccgcgctttctctgaggcctgctgggaggtttacgtgtgctcccagcactcccccgcaaatcggaagcttgtgcaggcgctcttggaaaaacacgttagctcactccgggcacacgaaacctggggagacagtattctgggaatgggactttggcccgactccgtgcccagcgcactctttgccaccgaggactcccacctctcgacagtacgaagagatgggcagatactagtctattgtctgaataggatgagtatgaagaccagtagttggactcgatcccagcccttcactctgcaggacctcgaaaaaatcatgcaaagtccgagccccgaaaacttgaagttcaacgcggtggaagtaaacacctactggattgacgagcctgacgttctagtgatggcagttaaattacttatagagcgggctacgaaccaggactggatgctgcgggtcaaatggctctaccatctggctaagaatattcctcagggactcgagtcaatccaaatccatctagaggcctcagctgcctccctgcggaacttctactctcattctctgtcaggcgctgtgagtaacgtctttaaaatcctccagcctaataccactgacgagtttgttatccctttggatcctcggtggaatatgcaggcactcgacatgatacgtaatctgatggactttgacccccagacagaccaacccgatcagttgttcgcccttttggaatccgccgctaataagacaatcatctacctggaccgggaaaagcgtgtgtttaccgaagctaatcttgtctccgtcggttccaaaaaactccgcgagagcgtcctacggatgtctttcgaatttcaccaagatccagaatcataccacacgctgcctcacgagatcgtcgttaaccttgctgcatttttcgagctgtgcgatgcattagttctgctctgggtacagagcagtcaggggatggtaagcgatgcatccgcaaacgaaattctgggaagcctgcggtggagagatcggttctggaccgtcgctgataccgtcaaggtggacgctccagggctggctctcttggctctacactggcattgggtactcaagcatttggtccatcagataccacgcctcctgatgaactatgaggacaaatattataaagaggtgcagaccgtttctgagcacattcagaattgcttgggttcccagacgggtgggttcgctggcatcaaaaaactgcagaaattcctcgggaggccatttccgttcaaggataaattagtggtggagtgtttctctcagttgaaggttctaaacaaggtcctggcgattcgcgaacagatgtcagcattgggggaatcaggatggcaggaagacattaatcgccttcaggtggtggcctctcagtggacactgaaaaagagtcttctgcaggcctggggcctcatcctccgagcaaacattctggaggacgtcagcctggacgagctgaaaaactttgtgcacgcacagtgcctggaactgaaagccaaaggactgtcccttgggttcctcgagaagaagcacgatgaggctagctccctcagtcatcctgacctgacgagtgtgattcacctcacacgatccgttcagctgtggcctgccatggagtacttagccatgttgtggcggtacaaggtgactgcagattttatggcgcaggcctgcctaaggaggtgtagcaagaatcagcagccccagataaatgaagagataagccacctcatttctttctgtctgtaccatacccccgtcacgccccaggagctccgcgacctgtggtcacttctccaccatcagaaagtgagccctgaggagattacatcactgtggagcgaactgttcaactctatgttcatgtcgttttggtcttcgacagtgaccacaaatccagagtactggctgatgtggaaccctctacccggaatgcagcaaagggaagctcctaagtcagtgctagattccacactcaaaggccctgggaaccttaatcggcctatcttctcaaaatgctgttttgaagtgctcacaagttcttggagagcaagtccgtgggacgttagcggtctcccaatcttgtcttccagccatgtcaccctgggtgagtgggtggagaggacacaacagcttcaagacatatcctcaatgctgtggacaaatatggcaattagtagcgttgcagagtttaggagaacagatagccagctccagggacaagtactattcagacacttggctggccttgcagaactgctgccagagtcaaggcgccaggagtatatgcagaactgtgagcagcttttattggggtcctcacaggcgttccagcatgtagggcagacactgggtgacatggccggtcaagaggtactaccgaaggagctcctgtgccagttattaacatccctgcaccattttgtaggagagggggaaagcaagcggtcactcccagagccggcacagcgtggatcgctctgggtctccctgggcctgctgcagattcagacctggttaccgcaggctcgcttcgaccctgcagtgaagagagagtataagctgaattacgtaaaggaggaactccaccagttgcagtgcgagtggaagacaaggaacctgtcttcacaactacagaccggacgggatcttgaggacgaagtcgtggtgagctactcacatcctcacgtaaggttgttgcggcagcgcatggataggctcgacaatctcacctgccacctcctgaaaaaacaggcctttagaccccagctccccgcttacgagagcttggttcaagagattcatcattacgtgacctccattgccaaggccccagcagtgcaggaccttctgaccagactcctgcaggcactgcacattgacggcccacgaagcgctcaggtggcccaatccctgcttaaggaggaagccagctggcagcagtcacaccaccagtttagaaaacggctgagcgaggaatacacattctatcctgatgcggtctcaccacttcaggcatcaatcctgcaactgcagcatggcatgaggttggtagcttccgagttgcataccagcctgcattcatctatggtaggcgctgaccggctaggcacattggcaacggccctgctggctttcccatcggtcgggcctacttttcccacgtattacgcgcatgctgacaccctgtgctccgtaaaatccgaggaagtgttaaggggtttaggtaaattaatactgaagaggtcaggcggaaaggagttggaaggcaaaggccaaaaggcttgtccaaccagagagcagttgttaatgaatgccctactgtatctccgcagccacgtactgtgtaaaggtgagctcgaccagagagctctgcagctgttccgccatgtatgccaggagatcatctctgagtgggatgaacaggaacgaattgcgcaagagaaagccgaacaggaaagtggcctgtatcgttatcgatccaggaacagccgtaccgccttgtctgaagaggaagaggaggaaagggagttccggaagcaatttcccctacatgaaaaagactttgcagacatcctagtccagcctaccctggaggaaaataaggggacctctgacggacaggaagaggaagcaggaactaaccccgcactgctttcccagaactccatgcaggcggtgatgcttattcaccagcagctatgtcttaacttcgctcggtccctgtggtaccagcagaccttgcctccgcatgaagcaaaacactacttaagtctcttcttgagctgctaccagactggggcatccctggtcacccacttttaccccctcatgggggtcgagctgaatgaccgcctgctcgggtcccagctgctcgcctgcacactctcgcataacactctgttcggcgaggccccttcagatcttatggtaaaacctgacggtccttatgatttctatcagcatccaaatgtcccagaggctcgacaatgccagcccgtgctgcaagggttctcagaagcagtgagtcatctccttcaggactggcccgagcaccccgcactagaacagttgttagtggttatggaccggatccgatcatttccactctcaagtcctatctcaaagtttcttaacggtctggaaattttactcgcgaaggcacaggactgggaagaaaacgcgtcccgggctctctcgctgagaaagcatctggatctcataagccagatgatcatcaggtggcgtaagctcgagttaaattgctggtcaatgtctctggataatactatgaaaagacatactgagaaatcaactaagcattggttttccatctatcaaatgttggagaaacatatgcaggagcagaccgaagagcaagaggatgacaaacagatgaccctgatgctcttagtttctacactacaggcctttatcgagggctcaagcctgggagaattccacgtccgactgcagatgctcttggtgtttcactgtcatgttctgctgatgccccaagttgaaggcaaagattctctgtgttcagtgctctggaacttgtaccactattacaagcaattctttgaccgcgtgcaggccaagattgttgagttacgatcacctctggagaaggagcttaaagaattcgtcaagatatccaaatggaacgatgtgtcgttctggagtataaaacagagcgtagagaagacgcaccgaacgctttttaaatttatgaaaaaattcgaggctgtgctgtcagagccatgcaggtccagcctggtagaaagcgacaaagaggagcagccagattttttgcctcgaccaactgacggtgctgcatccgagctgagcagcattcagaacctaaatagggctctgcgggaaactctcctggctcagcccgcagctggtcaggccactattcccgagtggtgccaaggagcagcgccatcaggccttgagggtgagctcctcagaaggctgccaaaactacgcaagcgcatgagaaaaatgtgcctgacattcatgaaggaaagccctttgcccaggctagtggagggcctggaccagtttacaggagaagttatctcctcagtgagtgaattacagtctctcaaggtagaacccagtgctgagaaagagaagcaacgctcagaagcaaagcatattctgatgcagaaacagcgggcactgagtgacctctttaaacatcttgcgaagattggattaagctataggaaaggtctcgcctgggcgcgatcaaaaaatcctcaggaaatgttgcacctgcatcccctcgatcttcagtctgctctaagcatcgtctcatccacgcaggaagcagactctagattactcacagagatctccagttcatgggatggctgccagaaatatttctatcggagtctggctaggcatgctaggctgaacgcagctctggcgacccccgcaaaagaaatgggaatgggcaatgtcgaaagatgtagaggctttagcgcccaccttatgaaaatgcttgtcagacaacgtcggagtttgacgactctcagtgaacaatggatcatactccgaaatttgttgagctgcgtgcaggagattcactctcggcttatggggcctcaagcataccctgtcgccttcccccctcaggatggagtgcaacaatggacagagcggcttcagcatttggccatgcaatgtcagattctcttggagcaactgtcttggctcctccaatgctgtccttctgtcgggccagccccaggccacggaaacgtccaggtgctaggccagccaccaggaccctgccttgaaggaccggaattgagcaaggggcagctgtgtggtgtcgtgctcgatctgatccctagcaacctgtcttacccttcacccattcccggaagtcagttaccaagtggatgtaggatgcgtaagcaggatcatctatggcaacagagcacaacaagacttactgagatgttgaagaccatcaagaccgtcaaggccgacgtggacaaaatcagacagcagtcctgcgaaacgctcttccactcttggaaagactttgaggtgtgctctagcgcactgtcatgcctgagccaggtgtccgtacacctgcagggcctggagtctttattcattcttccgggtatggaggtggagcagagagattcccaaatggctttggtggagtccctcgaatatgtccgcggtgaaatatccaaggcgatggcagacttcacaacctggaagacccatttacttacaagcgactcacagggaggaaatcaaatgctggatgaaggtttcgtggaggacttcagcgagcagatggaaatcgccattcgagccattctttgtgccatccaaaacctagaggaaagaaagaacgaaaaagccgaagaaaataccgatcaagccagtccacaggaggattacgctggatttgagcgcctccagtccggccacctcactaagctcctggaggacgatttctgggccgacgtgagtactctgcacgtgcagaagattatctctgcaattagtgagctgcttgagaggctgaaatcttacggcgaggatgggacggccgcaaaacacctgttcttctcacagtcttgcagcctgctcgtcagacttgttcccgttctgtcctcctacagtgatctggtgttgttttttctgacgatgagcctggccactcacaggagcaccgcaaagcttttgagcgtgctggcccaggtctttactgagcttgcgcagaagggattctgcctccccaaggaattcatggaggacagcgctggtgaaggggctactgagttccacgactacgaaggcggaggcattggcgagggggagggtatgaaagatgtgtctgatcaaatagggaatgaggaacaagtcgaggacaccttccagaaaggacaagagaaggataaggaagacccagattccaaaagtgacattaagggggaagataatgccatcgagatgtctgaagatttcgatgggaagatgcatgacggggaactagaagaacaagaggaagacgacgagaagagtgattcagaagggggagaccttgacaagcatatgggagacttgaacggggaagaagctgataaactggacgaaagactctggggtgacgacgatgaagaagaggacgaggaggaggaggataataagacagaagagaccgggccagggatggatgaagaggacagtgaactcgtcgccaaagatgacaacttggatagtggaaattcaaacaaagataagtcccagcaggataagaaggaggaaaaggaagaggccgaagcggatgacgggggacaaggcgaggataagattaatgagcagattgacgaaagggattacgacgagaacgaagtggatccttaccacggcaatcaggaaaaggtgccagagccagaagcattggatctacccgacgatctaaacctcgatagtgaggacaaaaacggcggtgaggatacagataacgaggagggagaggaggagaatcctctggaaatcaaagaaaagcccgaggaagcaggccacgaagccgaggagaggggagagactgagacagatcagaatgagtcccagtccccgcaggagccggaggaaggccctagcgaggacgataaggcagaaggggaggaagagatggacaccggcgcagacgatcaagacggtgatgctgctcagcaccccgaagagcattccgaagagcagcagcagtctgtcgaggagaaggacaaagaggcggacgaggaggggggtgaaaatgggccagccgaccagggcttccagccgcaggaggaagaagagcgagaggactccgacaccgaagagcaggtgcctgaggcacttgaacgcaaagagcacgcctcttgtggccaaacaggagttgagaacatgcagaatacccaggctatggaactggccggagctgccccagagaaggagcaaggaaaagaagaacacggaagcggggctgcggacgccaaccaggcagaaggacacgaaagcaacttcattgcccaactcgctagccagaagcataccaggaagaatacccaatcttttaaacgaaagccaggccaggccgataacgagagatcgatgggcgatcacaatgagcgtgtccataaacgactgcgaaccgtggacaccgattcacacgcagagcagggcccagctcagcagccacaggcccaggtggaggacgccgatgctttcgaacacattaagcagggatccgatgcctatgacgcgcagacatatgacgtcgccagcaaagagcagcaacagtccgctaaagacagtggcaaggaccaggaggaggaagagatcgaagacacactcatggacacagaagaacaggaagaattcaaagccgcagatgtggagcagttaaaaccagaagagattaagagcggcaccacagctcctctcgggtttgacgaaatggaggttgagatacaaaccgtgaagactgaagaagaccaagatccaaggaccgacaaagcgcataaggagaccgagaacgagaaaccagaacgctcccgtgagtccacaatacacacggctcaccagttcctgatggacacgatctttcagcctttcctcaaggatgtgaatgagctgcgacaggagcttgagagacagctcgaaatgtggcagccacgggagagcgggaatccagaggaagaaaaagtcgcagccgagatgtggcaatcttaccttatcctgacggctccgttatcccagagactgtgtgaggagctgaggttgatactggaacctacccaggctgccaagttgaaaggagactaccgcacagggaagcggctgaatatcagaaaggtcataccatatatagcatctcagtttaggaaggataaaatatggctccggaggacaaagccttcaaagcgacaataccagatctgcctggccatcgatgattcttcttcaatggttgacaatcacaccaaacagctcgctttcgaaagcctggccgtgatcggcaacgcccttaccctgttggaagtcggacagattgccgtgtgtagcttcggggaatccgtcaaactccttcacccatttcatgagcagttttccgactattccggttcacagattctcagactgtgtaaattccaacagaagaagaccaagattgcccagttcctggagtccgtcgcaaacatgtttgcggctgcccaacagctgtcccaaaacatcagctccgagacagcccagctgctgttggtggtctcagatgggcgaggcctgtttttagaaggcaaagagagggtattggctgcggtacaggccgctagaaatgcaaatatctttgtcattttcgtggtacttgataacccttcatctagagattctatactggatatcaaagtacctatctttaaaggccctggcgaaatgccagagatacgctcatacatggaggagttccccttcccctattatataatactgcgggacgtaaacgccttacctgaaacattgagcgatgccctcagacagtggtttgagctcgttaccgcttccgatcacccatag

SEQ ID NO: 23411 - DNA, 3546 bp, Artificial Sequence
  Description of Artificial Sequence: Synthetic coding sequence
atggaacactttctgctagaggtcgccgctgctcccctgcgcctcattgcagcaaaaaacgagaagtcccggagcgagctgggacgtttcctggctaaacaagtttggacgccacaggatagacagtgcgtcctgtctaccctcgcccagctgcttctggataaagactgcacagtgctggtaggaaggcagctgcgtcctctgctgctggacctactggagcgcaatgcggaggctattaaggcaggaggccaaattaaccacgatcttcacgagagactctgcgtgtccatgtcaaaactcattgggaatcatccggatgtgctgccatttgcccttcgctattttaaggacacaagtccagtgtttcagagactgtttctcgagagctctgatgccaatcctgtgcggtatggtagacgcaggatgaaactgagggacctaatggaggctgcttttaaattcctgcagcaggaacagagtgtgtttagggagctgtgggactggtccgtgtgcgtgcctttactgagaagccatgacactctggtcaggtggtataccgccaactgcctggcactcgtcacctgcatgaatgaagagcataagctgtcctttcttaaaaaaatatttaatagcgatgagctcattcattttaggttgcgccttttggaggaagcccagttgcaagaccttgaaaaggcattagtcctggctaatcccgaggtgtctctgtggcggaagcaaaaggaactgcagtacctccagggccatttagtatcctctgacttgtctcccagagtaactgctgtttgcggcgtggtgctgcctgggcagttgcccgcaccaggcgaattaggtggaaaccggtccagttcccgggaacaagagttggccctgagaagttatgtactagtggaatctgtgtgtaagtccttgcaaacattggccatggcagtcgctagtcagaatgcagttctcctggaggggcctattggctgtggcaaaactagtctggtggagtatctagccgcagtgaccggcagaactaaaccccctcaattgctgaaagtccagctcggagatcagacggactccaagatgctcctgggcatgtatcggtgtaccgacgtgccaggagagttcgtttggcagcctggtactctcacccaggctgccacaatgggacattggattctgctggaggacattgactacgccccactcgatgtagttttgcagtcacggtacccctccctgctcgctgtggtggaccacctgttggacatctatatccagttgacgggtgagaaacaccactcttggagcgattcatctgtaggctgcgagcaggcccctgaggaggtgtctgaggctcgcagagagaacaaacgacccactctggagggcagagagctgtccctgcgcgacctgctgaattggtgtaaccgcatagcccattcttttgatagcagctctctgtccgcaagcctaaacatctttcaggaagcattggattgttttaccgcaatgcttagcgagcacactagcaaacttaagatggccgaagtgattggcagcaaactaaacattagccggaaaaaggccgaatttttctgtcaattatataaacctgaaatcgtgattaacgagcttgacttgcaggttgggagggtgagactcctccgcaaacagtcagaagccgtgcacttgcagcgtgagaagtttacatttgcagccacacggccaagctctgtgctgattgagcaactggcggtttgcgtcagcaaaggagaaccagttctcctcgtcggcgagacagggaccggaaagacctccaccatccagtacctggcccacatcacaggacaccggctcagggtggtgaacatgaatcagcagagcgataccgccgatcttctggggggttataagcctgtcgatcacaagctcatctggctcccacttcgggaggctttcgaggagcttttcgcacagacattctctaagaagcagaatttcactttcttggggcatatccaaacttgttaccgacagaaacggtggcacgatttgctccgtctcatgcagcacgtgcacaaaagcgcggtaaacaaggacggcaaagatagtgagaccggcctgctgatcaaagagaagtgggaagcattcggcctccgccttaaccacgcccagcagcagatgaaaatgaccgaaaatacgcttctgtttgccttcgtcgagggcactctggcgcaggccgtgaagaagggcgagtggatcttgctggatgagatcaatctggcagccccagaaattctcgaatgcctgagcggcttgctcgaggggagcagtgggagcctggtgcttctcgaccgaggagacaccgagcctctggttaggcaccctgacttccgcctctttgcttgcatgaaccccgctactgacgtgggcaaacggaatttgccccctgggattaggaacagattcacagaactgtacgtggaagagctggagtccaaggaagacctccaggtcctgatcgtggattacttaaaagggttaagtgtcaataagaataccgtccagggaatcatcaacttctacaccgctctcaggaaggaatccggcactaagctcgtggacggcaccggacatcgcccacattattctttgcgcactctctgtcgcgcattacggtttgccgcttctaatccatgcgggaacattcagagaagtctgtacgagggtttttgtttgggttttctgacgcagctagatcgagcgtcccaccccattgtccagaagttaatctgccagcatatcgtgcctggcaatgttaaatctctgttaaaacaacccattcccgagcctaaaggcggacgattgatccaagtggagggttattggatcgctgtgggagataaggagcccacaatagacgagacatacattctgacctcatccgtcaagcttaacctcagagatatcgtccgcgtggtcagcgcaggcacgtatccagtcttaattcagggggagacatccgtcggtaagactagtctgatccaatggctggcggcagccacagggaaccattgtgttaggattaacaaccatgagcacaccgatatccaggaatacattgggtgctacacgtccgacagctccggcaaacttgtatttaaggagggcgtcctgattgatgcaatgcgaaagggatattggatcattctagatgagctgaatctggccccaaccgacgtcctagaagccctgaatcgtttgctggatgataaccgggagcttttggtaacagagacccaggaggtcgtgaaagctcaccctaggttcatgctgtttgccacacagaatccacccggtctgtatggaggtcgaaaggtgctgtcaagagcttttagaaatagatttgtggagctgcacttcgacgagttgccgagtagcgagcttgaaaccatcctgcacaaaagatgcagcctacccccatcgtactgtagcaagctagtgaaggtcatgttggatttacagtag

SEQ ID NO: 23412 - DNA, 3351 bp, Artificial Sequence
  Description of Artificial Sequence: Synthetic coding sequence
atgatccttgacgagttctacaacgtcaaattttgcattgatgcgtcccagcccgacgttggcagctggctgaagtacattcggtttgccggttgttatgatcaacataacctagtcgcatgccagatcaacgaccaaatattttacagggtcgtggcagacatcgcaccgggtgaagaactcctgctctttatgaaatcagaggattacccgcatgaaaccatggcacccgacatccatgaagaaagacagtacaggtgtgaggactgtgatcagctgttcgagtctaaagccgaactggccgatcaccagaaatttccatgttctaccccgcactctgctttttccatggtcgaggaagatttccaacaaaaattagaatccgagaacgacttgcaggagatccacaccatccaggaatgtaaagaatgcgaccaggtgttcccagatctacagtccctagaaaagcatatgctcagtcataccgaggagagggagtacaagtgtgatcaatgcccaaaagcctttaactggaagtccaacctgatcagacaccagatgagccatgactctggcaagcactacgaatgcgaaaattgtgctaagcaggtctttacagatccctctaacctccagcgtcatattcgatcacagcacgtgggagcaagggcccacgcctgtcctgagtgtggaaaaacgttcgccaccagctcaggactgaagcagcacaagcatatccacagctctgtgaaaccttttatctgcgaggtctgtcataaaagttatacccagttctctaacctctgtagacacaaaagaatgcacgctgactgcagaacacaaataaaatgcaaggactgcgggcagatgttctctactacatcctccttaaacaaacacaggcgtttctgtgagggtaagaatcactttgccgctggcggttttttcggacagggtataagcctgccaggtacgcccgctatggataaaaccagcatggtcaacatgtcacatgccaatccgggactagctgattactttggagctaatagacatcctgcgggtctcacctttcctacagctcctggcttttcattcagctttccagggctgttccccagcgggctgtaccacagacctcctctgatcccagcctcatcaccagttaaaggcctttctagcaccgagcagaccaacaaatcacaatctcctctgatgacgcaccctcagattctgccagccacccaagatatcctcaaagcgttgtctaagcaccctagcgtcggcgataacaagccagtggaactgcaaccggaacgctcatctgaagagcgaccttttgaaaagatcagtgaccagtccgagtctagcgacctggatgatgtgtccacacccagcgggagtgatctcgaaacaacgtctggcagtgaccttgagtctgatatcgagagcgataaagaaaaatttaaggaaaacggtaagatgttcaaggataaggtgtctcctctccagaacctggcctcaataaacaataagaaggaatatagcaaccattctatattcagccctagtctggaagagcagacagcggtgagtggggctgtcaatgacagcataaaagccatcgcatcgatcgccgaaaagtacttcgggtcaaccggtctggtcgggctgcaggataagaaagtgggagcgctgccatacccttcgatgttcccgctccccttcttccctgccttcagccagagtatgtatccattcccggatcgagatttgcggtcccttccactcaaaatggaacctcagtctccaggggaggtgaagaagcttcagaaaggctcatcagaaagccccttcgatcttacaacaaaacggaaggatgagaagcccttgactcctgttccatccaaaccccctgtaacccctgccacaagccaggatcagccgctggacctgagcatggggagccggtcccgcgcatccggtaccaaactgacagaaccacgcaagaatcatgtgtttggcggaaaaaaaggaagtaatgtcgaaagccgcccagccagcgacggttccctgcagcatgccaggcctactcctttcttcatggaccccatttacagagttgaaaagaggaaactgacagatccattggaagctcttaaagagaaatacctgcgaccttcccctggcttcctgttccacccacagtttcagctgcctgatcaacgcacgtggatgtccgcaatagaaaatatggcagaaaaactggaaagcttttctgctctgaaacctgaggcatctgagctgctgcagtctgttcctagtatgttcaactttcgcgcacccccaaatgccctgccagaaaatctgctccggaaaggtaaggagagatatacttgtcggtattgtggcaagatattcccgaggagcgctaaccttacccggcatctaagaacccatacgggggagcagccctatcgctgtaagtactgtgaccgttcatttagcatttcctctaatctgcagcggcatgtgcgaaacattcacaacaaggagaagccttttaagtgccacctctgcgatcgctgtttcggtcaacagacaaatctggaccggcacctaaaaaaacacgagaacggcaacatgtccggcaccgcaactagctctcctcactccgagcttgagagtacaggggctatcttggacgataaggaggacgcatactttaccgagatcagaaactttattggcaactccaaccacggaagtcagagccccaggaacgtggaggagcggatgaacgggtcccactttaaggatgaaaaagctctagtcacaagccagaattccgacctacttgatgatgaggaagtggaggacgaagtgcttttggatgaggaagacgaggacaacgacattacaggcaagactggaaaggaacccgtgacctctaatctacatgagggcaatcccgaagatgattacgaagagactagcgcacttgagatgagctgcaagacatcccctgtgcgatataaagaggaggaatacaagtcaggcctttctgctctggatcacatccgacatttcactgactcactgaaaatgcgaaaaatggaggacaaccaatattcggaagcggagctcagtagcttctcaacatctcatgtacccgaggagctgaaacagcccctacatcgcaagagcaaatcccaggcctatgccatgatgctgtccctgtccgataaagaatctctacatagcacatcacactcttcatccaacgtctggcactccatggcaagggccgctgcggaatccagcgcaattcagagcatttcccatgtatag

SEQ ID NO: 23413 - DNA, 3156 bp, Artificial Sequence
  Description of Artificial Sequence: Synthetic coding sequence
atgaagtcagaggattatccccatgaaaccatggctcctgacattcacgaggagaggcagtacaggtgtgaagattgcgaccagctgtttgagagcaaggctgaattggcagatcatcaaaagttcccctgttctaccccccattcagcattctccatggtagaggaggattttcaacagaagctagagtcagagaacgatctgcaggagattcacaccatccaggaatgtaaagagtgcgatcaggtctttccggacttgcagagtctggaaaagcatatgctgtctcatactgaggaacgtgaatataaatgcgaccagtgtcctaaggcgtttaattggaaatcaaacctcattagacatcaaatgtctcatgattctggcaaacattatgaatgtgagaattgtgccaaggtttttacagacccctcaaatcttcagagacatatccgttctcagcacgtgggggcacgcgctcacgcttgccctgagtgtgggaaaacattcgcgacctcttccggtctcaaacagcacaagcacatccactcgagtgtgaaacccttcatctgcgaggtctgtcacaaatcttatacgcagttctctaatctgtgcaggcataagaggatgcatgctgattgtagaactcagatcaagtgcaaagattgtggccagatgttttcgacaacctcctcactgaataaacaccgcaggttctgtgagggtaagaaccactttgccgctggagggttctttggtcagggaatttctttaccaggcactcccgcaatggacaagacatcgatggtaaacatgtcccacgcgaatcctgggctggccgactattttggagctaatcgacatccagccggactcaccttcccaacagctcccggtttttctttttccttccccggattattccccagcgggctgtaccatcgacctcctctgatccctgcttcatctcctgttaagggtctcagtagcaccgagcagaccaataaatcacaatcccctcttatgacgcaccctcaaattctgccagccacacaggatatactgaaggcacttagcaaacacccgtccgttggcgacaacaaaccagttgagttgcagccagagagatcaagcgaggaacgaccatttgagaaaatctctgaccaatctgaatcttctgatctcgacgacgttagcaccccatcagggagcgaccttgaaacaacgtcaggctccgatctggaatcggacatcgaaagcgacaaggagaaattcaaggagaatggaaaaatgtttaaagataaagtgagcccgctgcagaacctggcctccatcaacaataagaaggagtactcgaatcactcaattttcagcccctctctagaggagcagacagcggtcagcggagccgtgaacgattccataaaagctattgcctctatagctgagaagtactttggttcaacggggcttgtcggacttcaggataaaaaagttggggcactgccctaccccagcatgtttcctctccctttctttcccgcattctctcagtctatgtacccattcccggacagggacctaagaagcctgcctcttaaaatggaaccccagtccccgggagaggtgaaaaaattgcaaaaaggcagcagcgagtctccctttgatctgacaaccaaaagaaaggatgagaaaccgctcaccccagtccccagtaaacctcccgtcacgcctgctacatctcaggaccaaccactcgatctgagtatgggaagcaggtcccgggcatcaggtacaaagttgacagaaccgagaaaaaatcacgtgttcggcggaaagaagggatccaacgtggagtcaagacctgcatctgacgggtccctacagcacgccaggccaactcccttttttatggaccctatctatcgggtcgagaaaagaaagctcacagaccccctggaggccctcaaggagaaatatctccggccaagcccaggattcctgttccacccgcagttccagttgcccgaccaacgaacttggatgtcagcgattgaaaacatggctgagaaactggagtcctttagtgcactgaagccagaagcctctgagctgctccagtccgtaccatctatgttcaactttagggctcctcccaatgccctgcccgaaaatttgctaaggaagggaaaggaaagatacacttgtagatattgtggaaaaatcttccctcgcagcgcgaatcttactaggcatctgcgaacacatactggcgagcagccttaccgatgtaaatactgcgatcggtcatttagcataagcagtaacctccagagacacgtacgaaacatccacaataaagagaagcctttcaaatgccacctgtgcgaccgctgctttggacagcagacaaatctggaccgtcatcttaaaaaacacgaaaatggtaacatgtcaggaaccgcaacatccagcccacatagtgaactggagtcgaccggtgccattttagatgataaagaggatgcctacttcactgaaatacgaaattttattggaaatagcaatcacggtagccagtcaccacggaacgtggaggaacgcatgaacggctcccactttaaggatgagaaagcactcgtgactagccagaattccgacctgttagatgatgaggaagtggaggatgaggtgctactggatgaggaggacgaagacaacgacatcaccgggaaaacaggcaaagaaccagttacttcaaacttacacgagggcaacccagaggacgactacgaggaaacaagtgcgctcgagatgagctgtaaaacttcccccgtgaggtataaagaggaggagtacaagtccggactgtctgcactcgatcatattagacacttcaccgactcgttaaaaatgcggaaaatggaagataatcagtatagcgaggcagaactgagttcttttagtacctcccacgtgcctgaagaactgaagcaaccccttcatcgaaagagcaaatcacaagcttacgcgatgatgcttagcctcagcgacaaagaaagcttacacagcacctcccatagcagtagcaacgtgtggcacagcatggcaagagctgccgctgagtcctctgccattcagagtatttcacatgtgtag

SEQ ID NO: 23414 - DNA, 3159 bp, Artificial Sequence
  Description of Artificial Sequence: Synthetic coding sequence
atgaagtcagaggattacccacacgagacaatggcaccagacatccatgaggagaggcagtaccgatgtgaagattgtgatcagttattcgagagcaaggcagagctggctgatcaccagaagttcccctgctccactccacattccgccttttcaatggtcgaagaagatttccagcagaaactcgagagcgagaacgacttacaggagatccatacaattcaggagtgcaaggaatgcgatcaggtttttccagacctgcagagtcttgagaagcacatgctgtcgcacaccgaggagagggagtataagtgtgaccagtgccccaaggcattcaattggaagagtaacctgatcagacaccaaatgtcacacgactcgggcaagcattacgaatgcgaaaattgtgccaagcaggtcttcactgatccctccaatctgcagaggcacattagatcccagcacgtcggtgctcgcgcacacgcttgtcctgaatgcggtaagacttttgccacatccagcggattgaaacagcataaacacatacactcttcggtgaagcctttcatttgcgaggtatgtcataagtcctatacacagttcagtaatctgtgtagacacaagaggatgcacgccgattgcaggacacagatcaaatgtaaagactgtgggcagatgttttccacaactagttcactcaataagcatcgaaggttctgtgaggggaaaaaccatttcgctgccggagggttttttgggcagggcatttcactgccaggaaccccggcaatggataagacctccatggtcaacatgtcccacgcgaatcccggtttggccgattacttcggcgcaaaccggcatccagctggactgactttccccaccgcaccaggattttcttttagttttccagggctattccctagtggcctgtatcaccgccctccactaattccagctagcagtcctgtgaaaggcctcagcagcacagagcaaaccaataaatcccagagcccccttatgacacatccacagatattgcctgccacccaggatattttaaaggcattatccaaacacccctcggtgggcgacaataaacctgtagaattgcagcccgaaagatcctccgaagaacggcctttcgaaaagatctccgatcaatccgaaagcagtgacctggacgacgtttccacccctagcggctccgacctggagaccacatccggcagcgacctagagtcagacattgaatccgataaggagaagttcaaagaaaacgggaaaatgtttaaagacaaagtctccccactgcagaacctcgcatccattaataataagaaggaatactccaatcattcaatattttctccctctcttgaggaacagacggctgtgtccggcgctgttaacgactctattaaggcgattgccagtatagcagagaagtactttggatccaccggtttagttgggctccaagataagaaggtgggcgctctgccctatccaagcatgtttccattgcccttcttccccgctttttctcagagcatgtacccgtttccagatcgagaccttagaagcttgcccctcaagatggagccccagtccccaggagaggtgaagaagctgcagaagggctcttcagaatctcccttcgacctgaccacaaagcgcaaggacgagaaacccctcactcccgtgccttctaaaccacctgtcacacctgctacatctcaggatcagcccctcgacttaagcatgggatccagatcacgggcatctgggacaaagctcacagagccgagaaagaaccacgtttttggtgggaagaaagggagtaacgtggagtcgcgacccgcatcagacggaagccttcaacacgcgaggcctacacccttctttatggatccaatttacagggtggagaaaaggaaacttaccgacccccttgaggcactgaaagaaaaatatctcaggccctctcctggttttctcttccacccccagttccagctgcccgatcagagaacctggatgtcagcgatcgaaaacatggcggagaagttagagagcttttctgccctaaagcccgaagcgtcggagctcctgcaaagtgtcccttccatgtttaattttcgggcacctccaaatgcgctccccgagaaccttctccggaagggcaaggagagatatacctgtcgatactgcggtaagatcttccccaggtccgcaaacctgactaggcacctgcgtactcataccggggaacagccgtacaggtgtaaatattgcgatcgatcgtttagcatctcctccaatctgcaacgacacgtgagaaatatccacaataaagagaaacctttcaagtgccacctgtgcgaccggtgcttcggacaacagaccaacctcgaccggcacttgaaaaagcacgaaaacggcaacatgtctggtaccgccacaagttccccccactccgagctggagtctaccggcgcaattctcgacgacaaggaagatgcctattttacggaaatccgtaatttcattggcaactctaatcatggctctcaaagccctcggaacgtggaagagcgaatgaacggctcacactttaaagatgagaaagcactggtgaccagccagaactctgacctgcttgatgatgaagaggtcgaagatgaagtgttgttagacgaagaagatgaagacaatgacataactggtaaaacggggaaggagcccgtgacatctaacctgcacgagggcaaccctgaggacgattatgaagagacctcagcactagagatgagctgtaagacaagtcccgtgcggtacaaggaagaggagtacaagtccggacttagtgccctggaccacatacgccatttcaccgatagcctgaagatgaggaaaatggaagataaccaatacagtgaggcggaactgagctccttttctacgagccatgtgcctgaagaactaaagcagcccctgcaccgcaagtctaaatcccaggcctacgccatgatgctcagcctgtctgacaaggagtcactccactccactagccacagttcatccaacgtctggcactctatggccagagccgctgcggagtccagcgcaatccagagtatttcacatgtctag

SEQ ID NO: 23415 - DNA, 3012 bp, Artificial Sequence
  Description of Artificial Sequence: Synthetic coding sequence
atgaagtccgaggattatccccacgagaccatggccccagatatccatgaagagcgacaatataggtgcgaagactgcgatcagctgttcgaatctaaagccgaactcgccgatcatcaaaagtttccgtgcagcacacctcattctgctttcagcatggtggaagaggacttccaacagaaattggagtctgagaacgatctccaagagattcatactatccaggagtgcaaagagtgcgaccaggtcttccctgacttgcagtcattggaaaaacatatgttatctcatacagaggagcgggaatacaagtgcgatcaatgtcccaaagccttcaattggaaatctaacctgattcgccaccagatgagccacgacagcggcaagcactatgagtgcgagaattgtgctaaagtttttaccgacccatccaatctccagagacatatccgctctcagcacgttggggctcgggcacatgcttgtccagagtgtggcaaaacattcgccactagcagtggcctgaaacagcataagcatatacatagttctgtcaagccttttatctgcgaggtttgtcacaagagctacacgcagttttctaatctgtgcagacacaaacggatgcatgccgattgccgaacacagatcaaatgtaaggactgcggtcagatgtttagtactacatcgtctctgaacaagcataggcgtttctgtgagggaaagaaccacttcgccgctggaggcttttttggccagggcataagccttcctggtactcctgccatggacaagacatcaatggttaacatgtcccatgccaaccccggactggcggactatttcggagcgaacagacacccggctggccttaccttccccaccgctccagggttctcattttcttttccaggtctatttccctccggactgtatcaccgacctccactgataccggctagcagccctgtaaagggcctatcttccacagagcagacaaacaagtcccagagccccctgatgactcacccccagatcctcccggcaacacaagatattctgaaagccctgagcaagcatccttccgtcggcgataacaagcctgtggaacttcagccggaacgcagtagtgaagaacgcccatttgaaaagatctctgatcaatctgagagctctgatcttgacgatgtgagcacaccatccggctctgacctggaaactacgagcggcagcgacttggaatcagacattgaatccgacaaagagaagttcaaggagaacggcaaaatgttcaaagacaaggtaagccctctgcagaatctcgccagcatcaacaataagaaagaatattctaatcatagtatcttctctccctccctcgaagagcaaacagccgttagcggggcagtcaatgactctattaaggctattgcctctatcgcagagaagtattttggcagcaccggtctggtgggcctgcaggacaaaaaagtgggcgctctgccatacccctccatgttcccccttcctttcttccccgctttttcccagtcaatgtacccattccccgatagggacttgagaagcctccctctgaagatggagccacagagccccggagaagtgaagaagttgcagaaaggttcctccgaaagccctttcgatttaactaccaaacgcaaagatgagaagccccttacaccggtccccagcaagccccctgtgaccccagcaacgtcccaagatcagcccctagatctcagcatgggctcaaggtcgagggcttctgggacaaagctcacggaaccacggaagaaccacgtttttggagggaagaagggaagtaatgtggaaagcaggccggcttccgacgggtccctgcagcatgccagaccaacgccgttcttcatggacccgatttaccgcgtagaaaaacgcaagctaacggaccctcttgaagccctaaaagaaaagtacctgcgccctagccctggtttcctatttcacccccagatgtcagccattgagaacatggccgagaagttggaatcttttagtgccctgaagcctgaagcatccgagcttctccagagcgttccttccatgttcaacttcagggcgccaccaaatgcactgcctgagaatctgctgagaaagggaaaggagagatatacttgtcgatattgcggcaaaatcttccctaggtctgccaacttgacgcgccatctgcgaactcacaccggggagcaaccctatcgatgtaagtattgtgacaggagcttttctatttcgtccaatctgcagaggcatgtgcgcaacatacacaataaggaaaaacccttcaaatgtcacctttgtgatcgatgtttcggtcagcaaactaacctagacaggcatctcaagaagcacgaaaatggcaacatgagcggaacagccacttcctcacctcactccgagctcgaatcaacaggagccattttagacgataaagaggatgcatactttacagagattcggaattttataggcaatagtaatcacgggagtcagagtcccaggaatgttgaagagcgcatgaacgggtctcacttcaaggatgagaaggcactcgtgacgtctcaaaacagcgacctgctggacgatgaagaggtagaggacgaggttctattggatgaagaggatgaagataatgatatcacagggaaaaccggcaaggagcccgtcacctctaatctacatgaaggcaatccagaggatgactacgaagaaacgagcgcattggaaatgagctgcaaaactagtcccgtgcgctacaaggaggaagagtacaagtcaggcctatctgcccttgaccacataaggcatttcaccgattctttgaaaatgcgaaaaatggaagacaaccagtattctgaagcagagctttcatccttcagcaccagccacgtacccgaggaattaaagcagccattgcaccggaaaagcaaaagccaggaggagtccaaagcatag

SEQ ID NO: 23416 - DNA, 312 bp, Artificial Sequence
  Description of Artificial Sequence: Synthetic coding sequence
atgaaaagtgaggattatccacatgagactatggccccagacatccacgaggagcggcaataccgctgcgaggattgtgatcaacttttcgagtcaaaggccgagctagcagatcaccagaagtttccgtgctccacacctcatagcgctttttcaatggtggaggaagacttccagcagaagcttgaatccgagaacgatctccaggaaatccacacaattcaggagtgtaaagagtgcgatcaggtgttcccagacctgcaaagtctagaaaagcatatgctgtcccatacggaagagagagagtactag

SEQ ID NO: 23417 - DNA, 3129 bp, Artificial Sequence
  Description of Artificial Sequence: Synthetic coding sequence
atgaagtcggaggactatccccacgagaccatggctcctgatatccatgaggagaggcaatataggtgtgaagattgcgaccagttattcgagtcgaaagccgaactagccgaccatcagaaatttccctgctccactccccattctgccttttccatggtcgaagaggacttccagcagaagctggagtccgaaaatgacttgcaggagatccacaccatacaagaatgcaaggagtgcgatcaggtgtttcccgacctgcagtcactcgagaagcatatgctgtctcacactgaagagagagagtacaagtgtgatcaatgtccaaaagcctttaattggaagtccaatcttattcgccaccagatgtcacatgactccggtaaacactacgagtgtgaaaattgtgctaaggtgtttactgatccctcaaaccttcagcgccacatcagatctcaacacgtcggagccagagcgcacgcctgccccgaatgtggcaagacctttgcaacaagttccgggttgaagcagcataagcacatccattctagtgttaaaccgtttatctgcgaggtgtgccacaaatcctatacccagttctctaatttatgtaggcataagaggatgcacgcagattgccgaacccaaataaaatgcaaagattgcgggcagatgttctccaccacctcatcactgaataagcaccggaggttttgtgaaggaaaaaatcactttgcagcgggtgggttcttcggacaagggatatctttgccgggaactcccgctatggacaagacctccatggtgaatatgtcgcacgcaaacccagggttggccgactattttggggctaatcgtcacccagccggactaacgttccccaccgcccctgggttcagtttctcatttcccggtctgtttcccagcggtctttaccatagacctcccctgatccccgctagctcacccgtaaaaggcctttcctccacagagcagacaaataagtctcagagtcccctcatgactcacccgcagattctaccggcaacccaagacattctcaaagctctcagcaagcaccctagcgtgggcgataataagcctgtcgagctgcagcccgagcggtcttctgaagagcgcccattcgaaaagattagcgatcagtccgaatcttccgacttggacgatgtgagtacacctagcggctccgacctagagaccacttccggctctgatttggagtccgatatagaaagtgataaggagaaattcaaggagaatggtaaaatgtttaaggacaaggtttcaccattgcagaacttagccagtattaataacaaaaaggagtattctaaccactccattttctctccttctttagaggagcagaccgctgtctccggggcagtcaacgacagcatcaaggccatagcaagtatcgcagaaaagtattttggcagtacaggccttgtgggcctgcaggacaaaaaagttggggcactcccatacccgtccatgttccccttgccttttttccctgcattcagccagagcatgtaccccttcccggaccgtgatttacgctcgctgccactgaagatggagccgcagtcccctggggaggttaagaaactgcaaaaaggctcctcggagagccccttcgacctgacaacgaagcgcaaggacgaaaagccactcacgccagtgccgtccaaaccacctgtgactcccgctaccagtcaagaccaacctctggacctgtccatgggctccaggagcagggcctccggaaccaagttgaccgagcccaggaagaaccatgtcttcggcggtaagaagggaagcaacgtcgaatcaaggccagctagtgatggtagcttgcaacacgcaaggccaacaccattctttatggaccctatctatcgggtagagaagagaaaactcacagatccattggaagcacttaaggagaagtacctgcgcccatccccaggctttctatttcatcctcagatgtcagcgattgagaacatggcggaaaagctggagtcgttctctgcgctgaagcctgaagcttcggaactgcttcagagtgtcccatccatgttcaatttcagagctcctcccaatgctcttccagaaaatctgctgagaaagggtaaagaacggtacacatgccggtactgtggtaagattttccctcgtagtgctaacctaactagacaccttcgcacccacacaggcgagcaaccatacaggtgtaagtattgtgaccgctctttcagcatctcttcaaacctgcagagacacgtgagaaacatccacaacaaggagaaaccattcaaatgtcatctgtgtgaccgctgttttgggcaacagacaaacttagacaggcaccttaagaagcacgagaatggcaatatgtccgggaccgctacctctagtccccattccgagctcgagtcaacgggtgccatcttggacgataaagaggatgcttacttcaccgagattagaaattttataggcaactccaaccatggctcacagagcccacggaatgttgaggaaaggatgaacggaagccacttcaaggacgagaaggccctggtcacatctcagaactccgacctgctggacgacgaagaggtcgaggacgaggtcctcctggatgaggaagatgaggataacgacattacaggcaagaccggtaaagaaccagtgacaagcaacctccacgaaggtaacccagaagatgattacgaggagacatctgccctggaaatgtcctgtaaaacatcccctgtgagatataaagaagaagagtacaagagcggactctcggccctcgaccacattcgccacttcaccgactctctcaagatgagaaagatggaggacaatcagtatagtgaggccgagctctcctctttcagcacaagccatgtgcctgaggagctgaagcaacccctgcaccgtaaatcaaaaagtcaggcttacgctatgatgctaagcctgtcggacaaggaatctttgcactctactagccacagttcctctaatgtgtggcatagtatggctcgtgccgctgcggagtcttctgccattcagagtatctcacatgtgtag

SEQ ID NO: 23418 - DNA, 69 bp, Artificial Sequence
  Description of Artificial Sequence: Synthetic coding sequence
atgaaaagcgaggattatccacacgagacaatggcccctgatatccatgaagaacgtcagtaccggtag

SEQ ID NO: 23419 - DNA, 3156 bp, Artificial Sequence
  Description of Artificial Sequence: Synthetic coding sequence
atgaaatcagaggactacccacatgaaacgatggccccagatattcacgaggagaggcagtaccgctgtgaggattgtgatcaactgttcgaatccaaagccgaattggcagaccaccagaagtttccgtgcagcacccctcactccgcgttttccatggtggaagaggactttcaacagaaacttgaatccgagaacgaccttcaagaaatccacacaatccaggaatgtaaagagtgcgatcaggttttccccgacctgcaaagcctggagaaacacatgttgtcccacactgaggagcgcgagtataagtgtgaccagtgccccaaggcgttcaactggaagtcaaacctcattcgccaccagatgagccacgatagtggaaaacactatgaatgcgagaactgcgccaaagtattcactgacccttccaatcttcagcggcacattaggtcacagcacgttggtgcccgagctcacgcgtgtcctgagtgcgggaagacgtttgctacctcttctggcctgaaacagcataaacacatacactccagcgttaagccctttatttgtgaggtatgtcacaagagttacacacagttcagtaatttgtgtcgccacaaaaggatgcacgccgactgtcggacccagatcaagtgcaaagattgtggtcagatgtttagtacaacctcatcccttaacaagcatcgacgcttctgcgaaggcaagaaccacttcgctgctggaggcttctttggacagggcatatcccttcctggtacgcccgcaatggacaagaccagcatggtgaatatgtctcacgctaatccaggcctagccgactactttggggcaaaccgacatcctgcgggtctcacgtttcctacagccccaggattcagtttcagcttcccaggtctcttcccttctggactataccaccgtccaccacttatccctgcttcatcccccgtgaaaggactgagctccacggagcagaccaataagtcccagagtccgctgatgacacatccccagattctgccggctacccaggacatactgaaagccttgtctaagcacccaagcgtcggtgacaataaacccgtagagttgcagccagagcggtcaagcgaggaaaggccatttgagaagatctcagaccagtcagagtccagtgatttagatgatgtgagcactccttcaggctctgacctggaaacgacatccggatctgatctggaatctgatatcgaatccgacaaggagaagtttaaagagaacggaaagatgttcaaggacaaggtgtcaccccttcagaatctggcttcaatcaataacaaaaaggagtactccaatcattctatattttccccgtcactcgaggaacagacagccgtgtccggcgctgtgaacgactccatcaaggcgatcgcctctatcgccgagaagtatttcggaagcaccggtctggtcgggcttcaagataagaaagtcggggctctaccctaccccagcatgttcccgcttccgttcttcccggctttctctcaatctatgtacccgttccctgacagagacttgaggtcactgccacttaaaatggaaccacagtcaccaggcgaagttaaaaaattacagaagggctcaagcgagtcacccttcgatctgactaccaaacggaaagacgaaaagccactgacgccagttcctagcaagcctcctgttacaccagcaacctcccaggatcagccccttgacctctcaatggggtcgaggtcgcgcgcaagcggcacaaagcttacagagcctcgcaaaaatcacgttttcggtggaaaaaaaggtagcaatgtcgagagtcgtccggcttctgacggctccttgcagcacgcacgtccgactccgttcttcatggacccaatttatcgggtggaaaaacgcaaactcactgatccactagaggccctcaaagagaagtatctgagaccttcacctggctttctgttccatccccaattccaactaccagatcagcgcacttggatgtccgccatcgagaacatggctgagaagcttgaaagtttttcagccctgaagccagaagcttcggaactgttgcaatctgtcccctccatgtttaatttccgcgctccccctaatgcgctacccgaaaatctccttcgcaagggaaaggagcggtacacatgccgctattgcgggaaaatattcccgaggtctgcgaatctgaccaggcacttacgcacccacacaggagaacaaccctatcggtgcaagtactgcgacaggtctttctccatttcaagcaatctgcagaggcacgtcaggaacattcataataaagaaaaaccctttaagtgtcacctatgtgatcgatgctttgggcagcaaacgaacctcgatcgccacctcaaaaagcatgagaacgggaatatgagcggtacggccacctcttccccccactcggagttagaaagcaccggggcaatcctggatgacaaggaagatgcatattttactgagatccgcaacttcattggaaactcaaaccatgggtcccagagcccaaggaacgtggaggaacgcatgaacgggtcacactttaaagacgaaaaggccctggttacgagtcagaacagtgatctcttagacgatgaggaggttgaggatgaagttctgctggacgaagaggatgaagataacgacattactggaaaaaccggtaaggaaccggttaccagcaaccttcacgagggtaaccccgaggatgattatgaagagacgagcgctctcgaaatgtcttgtaaaacatcacccgttagatataaagaggaagagtataagagtggattgtccgccctcgatcacatccgccacttcaccgatagcctcaagatgagaaaaatggaggataatcagtattcagaagcagagctgtctagctttagcacctcccacgtgcccgaggaactcaagcagcctctccaccgtaagagtaagtctcaagcctacgcgatgatgctgtctctatcagacaaggagtccctgcacagcacaagccattcatcctccaatgtctggcactccatggcccgtgcagcggcagaatcatcagccatacagtccatctcacatgtgtag

SEQ ID NO: 23420 - DNA, 3159 bp, Artificial Sequence
  Description of Artificial Sequence: Synthetic coding sequence
atgaagtccgaggactacccccatgaaaccatggcccctgatattcacgaagaaaggcaataccgctgcgaggactgtgaccagttgttcgagtctaaggccgagttggccgatcaccagaaattcccctgtagtacccctcactctgcttttagcatggtggaggaagacttccagcagaagcttgagtccgagaatgacctccaggagatccacaccattcaggaatgcaaagaatgtgatcaggtgtttccggaccttcaatcgcttgaaaagcacatgttatctcacactgaggagagagaatacaagtgcgatcagtgtcctaaggctttcaactggaagtcgaacctgattcgccaccaaatgtctcacgactctggcaagcactacgaatgcgagaactgcgcaaagcaagtcttcacagacccttccaacctgcaacgacacatccggagccaacacgtgggcgctcgcgcacacgcttgtcctgagtgcgggaagaccttcgcgacatcatccggcctgaaacagcataagcacattcactcctctgtcaaaccattcatctgcgaagtatgccacaagagctacacccagttctcaaacttgtgccggcataaacggatgcatgccgattgccgtacacaaattaaatgcaaggattgtggtcaaatgtttagcaccaccagcagtttgaataagcataggcgattttgtgagggaaagaaccattttgcggcagggggattttttggacagggcatctccttgccaggaacacccgctatggataagacaagcatggttaacatgagccatgctaaccccggactcgcagactatttcggagcgaaccgacaccctgctgggctgaccttccctaccgcaccaggttttagcttctctttcccaggtctcttcccttccgggctgtaccatcgcccacctctgattcctgcatcctcccctgtgaaaggactctcctccactgaacagactaacaagtcacaatcccccctgatgacacaccctcaaattctgcctgccactcaagacattctcaaagcactgagtaaacacccctcagtgggagataacaagccggtggaacttcagcccgaacggtcgtcagaggagcggccatttgagaagattagtgatcagtcagaatcgtccgacctcgatgatgtgtctacaccatccggcagtgacttggaaaccacctcaggctctgacctggaatccgatatcgagtctgataaggagaagtttaaagaaaacggcaagatgttcaaggacaaggtgtccccattacaaaacttggcaagtataaacaacaaaaaagaatactctaatcactctatcttttccccctcacttgaagagcagaccgctgtgagcggcgcagtgaatgattcaatcaaagccatcgcttctattgccgagaagtacttcggaagcacaggcctggtgggattacaggataagaaggtcggcgcactgccctacccttcaatgttccccctgcccttttttccagccttttctcaaagtatgtatccattccctgacagggacctgcgatccctacccctgaaaatggaaccacaaagtcccggtgaagtgaaaaagctgcagaaggggagctctgaatcaccgtttgaccttaccaccaagcggaaggacgaaaagcccttaacccctgtgccttccaaaccgcctgtcacaccagcgacgagccaggatcagccactggatctttccatgggctcccggtcaagagcctccgggaccaaactcaccgagccgcgtaagaaccacgtgtttggtggaaaaaaggggagtaacgttgagtcaaggcccgctagtgatgggtctttgcagcatgcaagacctacccctttcttcatggaccctatctatcgtgtagagaagagaaagctgactgatccactggaggcgctcaaggaaaaatacttaagaccatccccaggcttcctgtttcatccccagttccagctgccagaccagcggacctggatgtcagccatagagaatatggctgaaaagcttgaaagtttctcagcgctgaagcctgaagccagcgagcttctccaaagcgtgccctctatgttcaatttccgcgcaccccctaacgcgctacctgaaaatctcctgcgaaaggggaaggaaaggtacacctgcaggtactgcggcaaaattttcccacgtagcgccaatctcactcgccacctgaggactcacacaggcgaacaaccctatcgctgcaagtactgcgatcgtagcttctcaatctctagtaatcttcagagacatgtgaggaacattcataacaaggaaaaaccattcaagtgccatctctgtgaccggtgctttggccagcagacaaacctcgatagacacctcaagaagcatgagaatggaaatatgtcaggcacggccaccagttctccgcatagcgagctggagtctacgggcgctatcctggacgataaagaggacgcatactttacagagatcagaaacttcattggtaattcaaatcacggatcacaaagtccacgaaacgtcgaggagcgaatgaacggaagccacttcaaggatgagaaggctcttgtgacgtctcaaaacagcgatttattagatgatgaagaggttgaggacgaggtattgttggacgaggaagatgaggataatgacatcacaggaaagacagggaaggaacccgtgactagcaacttgcatgaaggtaaccccgaggatgactatgaagaaacctctgctctggaaatgtcgtgcaagacttcccctgttcgttacaaggaggaggagtacaaatctggtcttagcgccctggatcacatacggcactttacagatagtcttaaaatgaggaaaatggaagacaatcagtactcggaagccgagctcagtagtttttccacctcccacgtccctgaagaacttaaacagccgctccaccggaagagtaagtctcaggcatacgcaatgatgttgtccctgtcagataaagagtcacttcacagtacttctcactcttccagtaatgtgtggcatagcatggccagggccgctgcggagagttcagcgatacagtccatatcccatgtttag

SEQ ID NO: 23421 - DNA, 207 bp, Artificial Sequence
  Description of Artificial Sequence: Synthetic coding sequence
atgaagagtgaagattatccccatgaaaccatggcgcctgatatccacgaagaaaggcagtatagatgtgaagactgcgaccagttgttcgagagtaaggcggaactggccgaccatcagaagtttccgtgttctactccgcatagtgcctttagtatggtagaagaggacttccagcagaaattggaaagcgagaacgacttgtag

SEQ ID NO: 23422 - DNA, 90 bp, Artificial Sequence
  Description of Artificial Sequence: Synthetic coding sequence
atgaaatccgaggattatccccatgagacaatggcccctgacattcacgaggaacggcagtatcggtgcgaggattgcgatcaactatag

SEQ ID NO: 23423 - DNA, 378 bp, Artificial Sequence
  Description of Artificial Sequence: Synthetic coding sequence
atgaagtcagaagactatcctcatgagactatggcccctgatatacatgaagagcgccagtatcgatgtgaggactgcgaccaactcttcgagtccaaagctgaattggctgatcaccagaaatttccctgttctacacctcactcagcttttagcatggtagaggaagactttcaacagaagcttgaaagcgaaaacgaccttcaggagattcacactattcaagagtgtaaagaatgcgatcaggtcttccccgatttgcagtcactggagaaacatatgctctcacatactgaagagagagagtataagtgcgatcagtgtccaaaggccttcaactggaagtctaacctgatcagacaccagatgtcacactag

SEQ ID NO: 23424 - DNA, 312 bp, Artificial Sequence
  Description of Artificial Sequence: Synthetic coding sequence
atgaagtctgaagattaccctcatgagacgatggcaccagatattcatgaggagcgacagtatagatgcgaggactgcgaccagttgttcgagtctaaggcagagctagcagaccaccagaagttcccatgttcaacgccacacagtgctttcagcatggtcgaggaggacttccaacagaagctggaaagcgagaacgacttgcaggagattcatacgattcaggagtgtaaagaatgtgatcaagtattccccgacctgcagtctctggagaaacatatgcttagccacaccgaggagcgcgaatactag

SEQ ID NO: 23425 - DNA, 3693 bp, Artificial Sequence
  Description of Artificial Sequence: Synthetic coding sequence
atgcgctctaaagggagagcgaggaaacttgcgacaaataacgagtgtgtgtatggcaattaccctgagatacctctggaggagatgccagacgccgatggggtggcttcgacaccaagtcttaatattcaggagccctgctctccggctacatccagcgaggctttcacccccaaagaaggctccccctataaggcacccatttatatacctgacgacataccaatccccgctgaatttgagctgagagaatccaatatgcctggcgctggtctcggaatctggacaaaacggaagatcgaagtgggagaaaagttcggcccatatgtgggggaacaacgctccaaccttaaagatccttcctatggttgggagatcctagatgaattctacaatgtcaaattctgtatagatgcctcgcagccggacgtgggctcctggctaaagtacatccgttttgcgggatgttacgaccaacataacctagtggcatgtcagataaacgaccaaattttttacagagtggtcgccgatattgcccctggcgaggagctgctgctgtttatgaagtccgaggactatccacatgagacaatggctcctgatattcatgaagagaggcaataccgatgcgaagactgtgatcagctgtttgaatcaaaagcagagctggccgatcaccagaaatttccctgctctaccccccactccgcattctctatggtcgaagaggacttccagcagaagctggaaagtgagaacgacctccaggaaattcataccatacaggagtgcaaggagtgcgatcaggttttcccagatctccagagtctggagaaacacatgctgagccacactgaagaaagagaatacaagtgtgaccagtgtcctaaggccttcaactggaaatcgaacctgattagacatcaaatgtcacacgactcaggcaagcactacgagtgcgagaattgtgctaaggtgttcaccgatccaagcaatttacaaaggcatatacgcagccagcatgtgggagccagagcccacgcatgccctgaatgtggcaaaacattcgccacctcttcaggacttaagcagcacaagcacatacactcatccgttaaaccctttatttgcgaggtgtgtcacaaatcctatactcaattcagcaacctgtgcagacacaaacgcatgcacgccgattgccgaactcagattaagtgcaaagattgtggacagatgtttagcacgacctcatctcttaacaagcaccggagattttgcgaaggcaaaaatcattttgccgctggcggattttttggccaggggatatccttacccggaacaccagcaatggataagacttcaatggtgaacatgagccacgccaatcccggtttagctgattactttggagctaatcgtcacccggcaggcttaacattccccactgcccctggtttcagcttctcattcccaggcctttttccaagcggcctctaccaccgcccacccctgatacctgcctcatcaccggtcaaaggcctgtctagtacagaacagacgaacaaaagccagagcccacttatgacgcacccccaaattctgcctgccacccaagacattcttaaagctctgtccaagcatccgtctgttggggataacaaacccgtcgagctgcagcctgaacgctctagcgaggaaaggccattcgaaaaaatcagtgatcagagcgagtccagcgatctggatgacgtttccacccccagcgggagtgatctggagactacctctggatccgacttagagtccgacatagaatccgataaggaaaaatttaaggagaacggcaaaatgtttaaagataaggtgtctccactgcagaacttggcctcaattaataacaagaaagaatatagtaaccattcgatcttcagcccgtctttggaggaacaaactgccgtgagtggggctgtcaatgacagcattaaggccattgcctctatcgccgaaaaatactttggttcgactgggttggtgggcttgcaagataaaaaagttggcgctctaccatacccatccatgtttcccctcccctttttccccgctttttcgcaaagtatgtacccatttccagatagagacttacgcagtcttcccctgaaaatggaaccccagtctccgggagaggtgaaaaaactacagaagggcagctcagagtcgccttttgatttgactaccaaaagaaaggacgaaaaaccgttaacacccgttcccagtaagccccctgtgacccctgccacctcccaagatcagccattggacttatccatgggctcaagatctcgcgcttccggcactaaattgactgagcctcggaaaaatcacgtttttgggggaaaaaagggcagtaacgttgaatcaagacccgcttcagacgggtcgctgcagcacgcccgtcccacgcctttttttatggatccaatttatagggtcgagaaacggaagctaacagaccccctggaggccttgaaggaaaagtatctgcgcccttcacctggttttttgttccaccctcagatgagcgctatcgagaacatggcagagaaactcgagtcttttagtgcgctgaaaccagaagcatccgaactgctccagtccgtgccctccatgttcaatttccgggctccccctaatgctttgcctgaaaacctcctcaggaaggggaaggaacggtacacctgtcgctattgcggcaaaattttccctagatccgcaaacttgactcggcaccttcgcacacacactggcgagcagccataccgctgcaagtactgtgacagaagcttttccatatccagcaatctccagcgacatgttcggaatatccataataaagaaaaaccttttaagtgtcacctgtgtgaccggtgcttcgggcagcaaaccaatcttgatagacatttgaagaagcatgaaaacggtaatatgagtggtaccgcaacatcgtctccccactccgagcttgagtccactggggctatcctggatgataaagaggatgcatacttcacagagattcgtaacttcattggcaacagtaatcacgggtcgcaatcgcctcgcaatgtggaggagcgcatgaacggctcccattttaaggatgagaaggcactggtcacctcccaaaactcagacctgctcgacgacgaagaggtggaagacgaagtgcttttggatgaggaggatgaggataacgacatcaccggcaagaccggtaaagagcccgtgacttcgaatctgcatgaggggaatcctgaggatgactacgaggaaacaagcgcactggagatgagctgcaaaactagtcccgttagatacaaggaagaagagtataagagcgggctctcagccttagaccacattcgtcactttacagacagcctaaagatgaggaaaatggaagacaaccagtactctgaagctgaattatccagttttagtaccagtcatgtacccgaggaacttaagcagccactgcacagaaagtccaagtcccaggcctatgcaatgatgctatctctgtctgataaggaatctctccatagcacctcccatagctcatccaacgtttggcattccatggccagagctgccgctgagtcgagtgcaatccagagtatatctcatgtctag

SEQ ID NO: 23426 - DNA, 312 bp, Artificial Sequence
  Description of Artificial Sequence: Synthetic coding sequence
atgaaaagtgaggattaccctcatgagacaatggctcctgacattcatgaggaacgacagtaccggtgcgaagattgcgaccagttatttgaaagcaaagccgagcttgcagaccaccaaaagtttccctgctccactccgcatagcgcattctcaatggtcgaggaggatttccagcagaagcttgagagcgaaaacgatcttcaggaaattcacaccatccaggaatgtaaggaatgcgaccaggtattccccgacctgcagtcccttgagaaacacatgctttctcacacagaggaacgcgaatattag

SEQ ID NO: 23427 - DNA, 2256 bp, Artificial Sequence
  Description of Artificial Sequence: Synthetic coding sequence
atgtgcgatctgcgacgccctgctgctggcggaatgatggacctggcttatgtgtgtgagtgggagaagtggagcaaaagtactcattgcccgagtgtgcccctcgcctgcgcctggtcatgcaggaacttaatagctttcacaatggacctgcgctccgacgaccaggacctgacacgcatgattcacatccttgacactgagcacccctgggacctccattctataccgagcgaacaccacgaagcaatcacatgcctggagtgggatcagtcaggctccaggttgctgtctgctgatgcagacggccagatcaaatgttggagtatggccgaccatctggccaattcatgggaaagtagcgtgggctcactggtagagggtgatcccatcgtagcgctgtcatggttgcacaatggtgtgaagctggccctgcatgtggagaagagtggcgcatctagctttggtgagaagttcagccgcgtgaagttttctccttctctcaccctgttcggcggtaagcccatggagggctggatagcggtgaccgtgtctggtctggttaccgtctctctattaaaaccctcaggccaggtcctgacttctaccgagtctttgtgccgtctgcgtgggcgagtcgcattagcagacattgcctttactgggggagggaatattgtggtggccactgctgacggctcttcagcctcgcccgttcagttctataaggtttgtgtctcagtggtgagcgaaaagtgtaggattgataccgagatcctgcctagcctgttcatgagatgtactacagacctgaataggaaggataaattccccgctattacgcacctgaagttcctggctagagatatgagcgagcaagtgctcctgtgcgcctcaagccaaacttctagcatcgtggagtgttggagcttacgaaaagaaggcctacctgtaaataatattttccaacaaatttcccccgtggtgggcgataaacaacccacaatactgaaatggagaattcttagcgcgacaaacgatttggatagggtgagcgctgtggcacttcccaaactgcccatctcattgactaacaccgaccttaaagtcgcctcagacactcagttttacccaggtctgggccttgccttggcatttcatgacggatcggtgcatatcgtgcatcgcctcagtcttcaaacgatggccgttttctactccagcgcggctcccagacctgtagacgagccagccatgaagaggcctcgtactgcagggccagctgtgcacctgaaggccatgcaactgtcctggacatcattggctctagtgggaattgatagccacggaaaattaagcgttcttaggctgtcccccagcatgggacatcctctcgaggtcggattagcactgaggcatttgcttttcctgcttgaatactgtatggtgacaggttacgattggtgggacattttattgcacgtgcagccatccatggtgcagtcgctggtcgaaaagctgcacgaggaatatactcgccagacagcggctcttcagcaagtgctgtctaccagaattctggccatgaaggcgtctctctgtaaattgtcaccttgcactgtgacccgggtgtgtgattatcatacaaagctcttcctcatagccattagcagtaccctgaagtcgctgctgagacctcatttcctaaacacccccgataaaagccccggtgaccggttgacagagatttgcacaaaaataacggatgtcgacattgacaaagtcatgataaatttgaaaactgaggaatttgtgttagacatgaatactctgcaggccctgcagcagctgctgcaatgggtgggagatttcgtgctttacctattagcgtctctgccaaaccaagtcgcgatgcgggcacagagggcttctcgcactcgccgttggtggatgaatgcagcctgctgtccagcgtcatgtctgagcccagcctggacgggatgccagcctgctaccgcctggctggctgcttgttcaccaagtagcccatttgtgtgcagtctggcaggccgtcctcggtgtctcgctgtgctccctccttgtagcagcactgcctccccaggcccacaagcttctcccaggtctaccacttgcggcggatgcacgcttgccttggctcctcggcgtaacgccaggcccgcaccaggcgctgcggtatccccatgttcctcccgccctaccgagcctcgcagatag

SEQ ID NO: 23428 - DNA, 2583 bp, Artificial Sequence
  Description of Artificial Sequence: Synthetic coding sequence
atgtgcgaccttcggaggcccgctgcagggggaatgatggatctagcgtatgtctgtgaatgggagaaatggtctaagtccacacattgcccgagtgtaccgctggcttgcgcatggtcttgcagaaacctgatcgcttttacgatggatctcagaagcgatgaccaggatcttacacgtatgattcacatattggacacagaacacccatgggacctacacagtattcctagtgaacaccatgaagcgataacttgtctggagtgggaccagtctggctcacggctgctgtccgcagatgcggacggacagattaaatgttggagcatggcagaccaccttgcaaactcctgggaaagtagcgttggctcactcgtggagggggatcccatcgtcgccctttcatggctccataacggcgtgaaactcgcacttcatgtggagaagtccggggcttccagcttcggggaaaagttctcccgagtcaaattcagtcctagcctaactctttttggtgggaaaccaatggaagggtggatagcagtgaccgtcagtggactggtcacagtatctttgctgaaaccatctggacaggtcctaacaagcacagaatcattatgccggctccgcggtagagtggcattagcagatattgcctttaccggaggcggaaatatcgtggtggccaccgctgacggctcatccgcctcccccgtacagttctacaaggtctgtgtttccgtggtctcagaaaaatgccgaatagacacagaaatcctgccttccctattcatgcggtgtactacagatcttaacaggaaggataaatttccagccattactcatctgaagtttttggcccgagatatgtcagaacaggtccttctctgtgcttcttcccagacatcttctatcgtggaatgctggagcttgagaaaggaaggtctgcccgtgaacaatattttccagcagatatcaccagtcgtgggcgacaagcagccgactatcctcaaatggagaattctgtcagccaccaatgatcttgatcgcgtttcggcagtggctctgcctaaattacccatctccctgactaacacggatctgaaagtagcaagcgatacgcagttttatccaggactgggtctcgcactagctttccatgacgggtccgtacatatagtgcataggctctcccttcagactatggcagttttttattcatctgcggcacccaggccagtggacgagccggcaatgaagcggccaaggacagccggacctgccgttcatctaaaagctatgcagctgtcttggacttccctggccctggtggggatcgactcacatggaaagctctccgtcctaaggctgagcccgagcatggggcacccactggaggtcggacttgcgctgagacacctcctgtttttgctcgagtactgtatggtgaccggctacgattggtgggatattctgctgcacgtacagccctctatggtccagtcacttgtagaaaagctccacgaggaatacaccaggcagacagctgctttgcagcaagtcctgagtacccggatactggccatgaaggccagcctttgtaagctttcaccatgtactgtgacccgggtgtgtgattaccataccaaactttttttgattgccataagctcgacacttaagtccctgcttcggccacacttcttgaacacacccgacaagtctcccggagaccgcctgactgagatctgcacaaagattacagatgtggacatcgataaagtgatgataaacctgaagaccgaggagtttgtgcttgacatgaacaccctgcaggccctgcaacaactgctgcaatgggttggcgattttgtcctatatctgttggcttcactgcccaatcagggaagcctgttgcgacccggacattcgttccttcgagacgggacatcgctaggcatgctgagagagctcatggtggtcattagaatttggggactgctaaaaccatcctgtctccccgtgtatactgccacatccgatactcaggactcaatgagtctgctgtttcgactcctgacaaaactgtggatttgtttcccctctacgggcccatgttccgtatgggtgctactcgggtggcaaccacttccagggcgagatgaaggacccgcaagtgagccagatgaggctctagtggacgagtgttgtctgttgccatcacagttactcattccaagcctggattggctcccagccagcgatggattagtgagcaggctccagcctaaacagcccctccgacttcaattcggccgagctcccaccctgcccggaagcgccgcaacacttcaactcgacgggctggcacgggctcctggacagccaaaaatcgatcacctcaggaggcttcatctgggtgcttgtccaaccgaggagtgcaaagcttgcactcggtgtggctgtgtgacaatgctcaagtcccccaatcgaaccaccgcagtgaaacaatgggaacagcgatggattaagaactgtctttgtggcggactgtggtggcgtgttccactgtcctatccatag

SEQ ID NO: 23429 - DNA, 2634 bp, Artificial Sequence
  Description of Artificial Sequence: Synthetic coding sequence
atgtgtgacctgcgccgacccgctgccggtgggatgatggatcttgcatatgtctgcgaatgggagaaatggtctaagtccactcattgtccctcagtgccactagcctgcgcgtggtcctgtcgaaatcttattgcattcaccatggaccttcggagtgacgaccaggatctgactcgcatgatacacatcctggacactgagcatccatgggatctgcatagcattccctcggagcaccacgaagcgattacctgtcttgaatgggaccagtcaggcagccgcctgctctctgcagatgctgatggccagatcaagtgttggtctatggcagatcatctcgctaatagctgggaatcaagcgtaggctccctggtcgagggggaccccatcgtcgcgttgtcatggctccacaacggagttaaactggctttgcatgtggagaagagcggcgcatcttcattcggcgagaagttctcccgagtgaaattctctccttccctgaccctgtttggagggaagccaatggaaggctggattgccgtgacagtatcaggcttggtcaccgtcagtcttctcaagcccagtgggcaggtcttaaccagtacagagtcactgtgtagattgcggggaagggtcgcccttgctgacattgcgtttacaggcggtggcaatattgtagtcgctacggctgatgggagctctgcaagtccagtgcagttttataaagtgtgcgtttcggtggtgtcagaaaaatgccggatcgacacagaaatcctgccttccttgttcatgaggtgcacgactgacctgaatcggaaagacaaattccccgcaatcacccacctaaagttcctggctagggatatgagtgaacaggtcctgctgtgcgctagcagccaaacatcttccattgttgagtgctggtcactcagaaaggaagggctacctgtgaacaacatttttcaacaaatatcaccagtcgtgggcgataaacagccaactattcttaaatggcggatcctgtccgccaccaacgacctcgatagagtgagtgccgtagccctcccaaagctccctatctccttgaccaacactgacctgaaggttgcttccgacacccagttttaccctgggctgggtctggccttagcgttccacgacggctctgtacacatcgtccaccggcttagtctgcagaccatggccgtgttttacagcagtgcggctcctcgccctgtggacgagcccgcaatgaaacggccacgaaccgccggtccggctgtgcacttgaaggccatgcagttaagctggacctctttagctttggtaggtattgattcacacggcaagttgagcgtgctgcggctgtccccttcaatgggccatcccctggaggtgggcctcgctctgaggcaccttctgttcctgctcgaatactgcatggtgacaggttacgattggtgggatatcctgctgcatgttcagccatcaatggtgcagtctttggtggaaaaactacatgaggaatatacccgccaaaccgctgcactccaacaggtcctaagtacaagaatcctggcaatgaaagctagcctttgtaaattgagcccgtgcactgtcaccagagtgtgcgactaccatacaaaactctttctgattgcaattagctcaacactcaagagtctgctgcggcctcatttcctcaataccccagataagagcccgggagacaggctgacagagatttgcacaaaaatcaccgacgtggacatagataaagtgatgattaacctcaagacagaagagttcgtgctggatatgaatactctccaggcacttcaacagttgctacaatgggttggagacttcgtattatacctcctggctagcctcccaaatcaaggatccttgctgaggcccggacactcgttcctgcgggacggtacctccttagggatgttgcgtgagctaatggtcgtgatccggatctggggcctgctcaagccgtcatgtttgccagtctataccgctacatcggacacccaggacagcatgtctttgctcttccgccttctgacaaaattgtggatatgttgtagagacgagggcccagcttccgagccggacgaagcactggtagacgaatgctgcctgttgccatcccagctgctaattccctccctcgactggctcccagcatctgacggccttgtgtcccgtctgcagcccaaacaacctctcaggctgcagttcggccgagccccaacccttccagggtccgccgcaactcttcagttggacgggctggctagggctcccggtcaacctaaaatcgaccatttgcgacgcctgcacctgggcgcttgcccaacagaggaatgcaaagcttgtacaaggtgcgggtgcgtgactatgttgaagtccccaaaccggactaccgcagtgaagcagtgggaacagagatggatcaagaattgtctggcagttgagggcagaggtcctgatgcttgtgtgaccagtcgcgcatcagaagaagcccctgcctttgtgcagctcggcccacagagcacacaccacagtccacgcaccccgagatccctggatcatctccacccagaagatagaccatag

SEQ ID NO: 23430 - DNA, 2526 bp, Artificial Sequence
  Description of Artificial Sequence: Synthetic coding sequence
atgtgcgatctgcgaagaccagcagctgggggaatgatggatttagcttacgtgtgcgaatgggagaagtggagcaagtcaactcactgcccctccgtgccactggcttgtgcatggagctgccggaatctaattgccttcaccatggacctgcggtcggacgatcaagatctcactcggatgatccacattctggacacagagcacccctgggacctccacagcatcccatcagagcaccacgaggccattacctgtctggaatgggaccaatccggctcgcgactgttatctgccgatgccgatggtcagatcaaatgttggagcatggcagatcacttggcgaacagctgggaatcatctgtcggatctcttgttgaaggcgatccaattgtcgccctatcttggctgcataacggtgtaaagctcgcgttacacgttgaaaagtccggggctagcagtttcggcgaaaaattctccagagttaagttctcccctagccttaccttatttggcggtaaacctatggagggttggattgcagtgacggtgtccgggctagtaacggtgtctcttctaaaaccctcgggacaggtcctcactagcaccgaaagtctctgcaggctacgagggagagtcgctttggccgatatagctttcacaggtggagggaatattgtcgtggcaactgcagacggttcttcggcctctcccgtgcagttttacaaggtgtgcgtgagcgtcgtctcagagaaatgcaggatcgacactgagatcttgccttccctgtttatgagatgtacaacagatctgaacagaaaggataagtttcctgccatcacgcatttaaagttcctagctcgcgatatgtctgaacaggtgctgctttgcgcatccagtcaaacatccagcatcgtggagtgttggagccttaggaaagaggggttgcctgtgaacaacattttccaacagatcagtcccgttgtcggagataaacagcccactatcctcaaatggcggatactgtccgcaactaacgacttggaccgagtgagcgctgtcgcactccccaagctgccaattagtttgaccaacacagatttgaaagttgccagtgacactcagttctacccaggtttgggcttggcattggcgttccatgatggcagtgtgcacatcgtgcataggctgtccttgcagacaatggctgtgttctattcctcagctgcacccaggccagtcgatgaacccgctatgaaacgccctcgcacagccggaccagccgtccaccttaaagccatgcaactaagttggactagtctggctctggttgggatcgactcgcatggaaagctgtcagtcctcaggctctcaccatccatgggtcatccccttgaggttggcctagccctgaggcacctcttgtttttacttgaatactgcatggtgaccggttatgattggtgggacattctgctgcatgtacagccttcaatggttcagtctctcgtggagaagctgcacgaggaatatacgcgccagacagcagcactacagcaggtcctgagtactagaattctagcaatgaaggcctctttgtgtaaactgagcccatgcactgttacaagggtgtgcgactatcacacaaaattattcctcatagctatctcttctactcttaagtccctcctgagaccccacttcctgaacacccccgataagtccccaggcgacagacttaccgagatctgcactaaaatcactgatgttgacatcgataaggtgatgataaacttaaaaacagaagaattcgtgctcgacatgaacacactgcaggcccttcagcagctccttcaatgggtgggcgactttgtcctgtacctgctggccagcctgcccaaccagggaagtctgctgcggcctgggcactcttttctgagggacggcacctctttagggatgcttagggaactgatggtcgttattaggatatgggggctgctcaaaccctcctgcctccccgtttacaccgctacttccgacacccaggacagtatgagcctacttttccgcctgctgaccaaactgtggatttgctgtcgggacgaaggcccagctagtgagcccgatgaagcgctggtggatgagtgttgcttactgccctcccagctccttatcccgagcttagattggctgcccgctagcgacggcctggtgtctcggttgcagccaaagcaacctctgcgcttgcagttcggcagagcacctaccctgcccggatcagcggctactctacagctggacggcctggctagagctcccggacagccaaagatcgatcacctccgacggttgcatttaggcgcttgccctacagaagagtgtaaggcctgcacaaggtgcggatgcgtcacaatgctgaagtctccgaaccggactacagcagttaaacagtgggaacagcggtggattaagaactgcttgtgcggcggactctggtggcgcgtgcctctgtcatacccgtag

SEQ ID NO: 23431 - DNA, 1992 bp, Artificial Sequence
  Description of Artificial Sequence: Synthetic coding sequence
atgtgtgacctccggaggcctgctgctggaggcatgatggaccttgcctacgtgtgcgagtgggagaagtggtccaaatccactcattgccccagcgttcccctggcttgtgcctggagttgccggaacctgattgcatttaccatggacctgcgcagcgacgaccaggatctcaccagaatgattcatatacttgacaccgagcatccatgggatctgcactcgatccccagcgaacatcacgaggccattacatgcctggagtgggatcagagcggaagtcgactcttgtccgcagatgcagatgggcagatcaagtgctggtccatggcggatcatctcgccaatagttgggaatctagtgtggggtccctcgtggagggcgatcccatcgtggctctaagctggctccataacggcgtgaaactggctctgcacgttgaaaagagcggagcgagttcctttggcgaaaaattcagtcgagtgaaattctctccaagcttgacattgtttgggggaaaaccgatggaggggtggatcgccgtgaccgtctcggggctggtcacagtaagtttactgaagcccagcggccaggtactcacttcaaccgagagcctgtgtaggctgaggggacgggtcgctctggctgacatagctttcactgggggaggcaacatcgtggttgcaactgcagatggatccagcgccagccccgtgcaattctacaaggtctgcgtgagcgtcgtgtctgagaagtgcagaattgataccgagattttgccatccttgtttatgcggtgcactactgatcttaaccggaaagacaagttcccggcaatcacacacctgaagttccttgctcgggatatgagcgagcaggtcttgctctgcgcctcatcccagacctcctcaattgtagaatgctggtctctgagaaaggagggtctccccgtcaataatatttttcaacagatttcccccgtggttggagacaaacagccaaccatcctgaaatggcgcattctatctgctacaaatgatctcgatagagtgtcagctgtggccctacctaagctccccatttccctgacaaacacagatctgaaggtggccagtgacacccagttctacccgggtttgggccttgcgctggcatttcacgacgggtcagtgcacattgtacaccggttgagccttcagaccatggctgtgttttattcgagtgcagcacccaggcccgtggacgaacccgctatgaagaggccaaggacggccggtcccgcagtgcacttaaaagccatgcagttaagctggacttcgctcgccctcgtggggatagattcgcacggaaaactcagcgttttgaggctaagcccgagcatgggccatccactggaagttggactggcactacgacatttactgttcctgctggagtactgcatggtgactgggtatgactggtgggatatcttgctccatgtacagccctctatggttcagtctctggtggagaagctgcacgaagagtatactagacagaccgccgcattacaacaggttctgtcaacaaggatcctcgccatgaaggctagtctgtgcaaactgtccccctgcacagtgacacgtgtctgtgattaccacactaaactgttcctgatcgccatctccagcacgttgaagtctctgctgcgtcctcacttcctcaatacccccgataagtcgcccggtgaccggttaacagagatttgcaccaaaattaccgatgtggacattgataaggttatgattaatctcaagaccgaggaatttgttttggatatgaatacactacaggcattacagcagcttctgcaatgggtgggagatttcgtgctctatctgttggcctcactgcccaaccagccctgccccacatccgaaccttgtcccacatctgaaccctgtcctaccagcgaacccagcccaacctccgagccttctccaacatag

SEQ ID NO: 23432 - DNA, 1614 bp, Artificial Sequence
  Description of Artificial Sequence: Synthetic coding sequence
atgtgtgatttacggagacccgcagcaggcggaatgatggatctggcctacgtttgtgagtgggagaagtggagtaagtcaacacactgcccatcagttcccctcgcttgcgcctggtcctgtcgaaatctgattgcctttaccatggatcttaggagcgatgatcaggacttaacgagaatgatacacatccttgatacagagcatccttgggatctgcactccattccatcggagcatcacgaggcaataacctgcctcgaatgggaccagagcggctcccggctgctgtctgcggatgcagatggccagatcaaatgttggtctatggctgaccatcttgcgaactcttgggagtccagcgttggatccttggttgaaggggatcctattgtcgccctttcctggctccataacggcgtcaagctggcgctgcatgtggagaaaagcggcgcttcatccttcggtgaaaaattctctagggtcaagttcagtcccagccttaccctgtttggaggaaaacccatggagggctggatagctgtaactgtgtcgggcttagtaacagtgagcctcctcaaaccaagcggacaggtgctgacctccactgagagcctttgccgactgcgagggcgagtggcgctcgccgatatcgccttcaccggaggtggcaacattgtcgttgcgactgctgacggaagctccgcgtctcccgtgcaattttacaaagtgtgcgtgagcgttgtatcggaaaagtgccggattgacaccgagatactcccttctcttttcatgcggtgcacaactgacctgaataggaaagacaagttccccgcaatcactcacttaaaatttctcgccagagacatgtcagaacaggttttgctctgtgcttctagtcagacaagttccatcgtcgagtgctggagcttacgcaaggaaggcctaccggtcaataatatattccaacaaattagtccggttgtgggggacaagcaacccaccatcctaaagtggagaattctgagtgctacgaacgatctcgatagagttagtgctgtggcgctgcccaaactcccaatctcactcaccaacacggatttgaaagtggcgtcagatacccagttttaccccggattaggtttagctctggcattccacgacggctcggtgcacatcgtccacaggttgagtctccagactatggctgtgttctattcaagtgcggctcctcggcctgtagatgaacctgctatgaagcggcctcggaccgccggacccgcagtgcatctcaaggccatgcagctctcctggacctcacttgcgctggtgggaatcgattcacatgggaaagtactgagtactagaatcctcgccatgaaggcatccctctgtaaactgtccccatgcactgtgaccagggtgtgcgactatcacaccaaattgtttctcattgcaattagtagcacactcaaatctctgctgaggcctcacttcctgaacacaccagataaatctcctggggataggctgactgagatctgcaccaagatcaccgacgtggatatcgacaaagtgatgattaatcttaagactgaagagttcgtcttatag

SEQ ID NO: 23433 - DNA, 1389 bp, Artificial Sequence
  Description of Artificial Sequence: Synthetic coding sequence
atgtgcgatctcaggaggccagccgcaggaggcatgatggatcttgcttacgtgtgcgaatgggagaagtggtcaaagtcaacccactgcccctcagtccctttggcttgtgcctggtcatgccggaacctcatcgcttttactatggatctacggagcgacgatcaagacctcacaagaatgatccatattttggatacggaacatccctgggatttgcacagtataccctcagagcaccatgaggcgataacctgcttggagtgggaccagtctggctcccgattgctcagcgccgacgctgatgggcagattaagtgctggtcaatggctgaccacttagctaacagttgggaatccagcgttgggtctctggtcgagggggaccccatagtcgcactgtcttggcttcataacggagtaaagcttgccctgcatgtagaaaaagttctgctctgtgccagtagccagacgtcttccattgtggagtgctggtccctccgaaaagaggggcttcccgtgaataacattttccagcagatcagcccagtggtcggagataaacagcctacgattctaaagtggcgaatcctctctgccactaatgacctggaccgagtgtctgccgtggctcttcctaagcttccaatcagccttaccaacactgatctcaaagtcgcatccgacactcaattttaccccggactggggctggctctcgcgtttcatgatggatcagtccatatagtgcaccggctctcgcttcagactatggcggtgttctattcaagtgccgcacccagacctgtggatgagcccgctatgaagcggcctaggacagccggacctgcagtgcacctcaaggcaatgcaactgtcatggacctctctggccctggtcggcatcgactcccatggaaaattaagcgtattgcggctctcgccctcgatgggccatccactggaagtcggactggccttgagacatctgttgtttcttctggaatattgcatggtgaccggctacgactggtgggatattttgctgcacgtgcaacctagcatggtgcagtcactagtggaaaaactgcacgaagagtacactaggcagaccgcagcgcttcagcaggttttgtccactcggatcctcgctatgaaggctagcctgtgcaaattatccccatgtacagtgactcgggtctgcgattatcacacgaagttgtttctgatcgccatttcttcaactctgaagtcccttctcaggccgcactttcttaatacaccagacaagagtcccggagatcggctgaccgagatctgtaccaagataacggatgtggacatcgataaggttatgatcaacctcaagactgaggaatttgtgctttag

SEQ ID NO: 23434 - DNA, 1098 bp, Artificial Sequence
  Description of Artificial Sequence: Synthetic coding sequence
atgtgtgacctgcgtagaccggctgcgggaggtatgatggatctcgcgtatgtatgtgagtgggagaagtggtcaaagagcacccactgcccaagcgttcccctcgcctgtgcttggagctgcagaaatctcatcgcattcaccatggacctgcggtccgacgatcaggacctgacacgtatgatccatatacttgacacagagcacccatgggacctccacagcatacccagtgaacatcacgaggccatcacttgtctggagtgggatcaaagtgggagcagacttctctccgctgacgcagacggccagatcaagtgctggtctatggcagaccacctggctaatagttgggaaagttctgttggttccttggtagaaggtgacccaatagtggcgctctcctggttgcataacggtctcgccttagcattccatgatggcagcgtccatattgtccacaggctctccctgcagacgatggctgtattctacagctcagccgcacctcgacctgttgatgagccggcaatgaaaaggccgaggacagcagggccagccgtgcacttgaaagcaatgcagctgagttggacttctctcgccctggtcggcatcgattctcatggaaagctctcagtgctacgtctgtccccaagcatgggacatccattagaggtgggcctggctttgcgccatttgctgttcctactggagtattgtatggtgactggctacgactggtgggatattctgttacacgtgcagccgtccatggtccagtccctggtcgaaaaattgcacgaggagtatacacgccagaccgccgctctccaacaggtgctctcgacgaggatcctggcaatgaaggcttccttatgtaaacttagcccgtgcaccgtgacacgcgtgtgtgattaccataccaagttattcctcattgctatctcctcgaccctgaagagcttgttacgtcctcactttctcaacacccctgacaagtcccccggtgaccggctcaccgagatctgtactaagattactgacgtagacatcgataaagtcatgatcaacctgaaaacggaggagttcgtgctttag

SEQ ID NO: 23435 - DNA, 1104 bp, Artificial Sequence
  Description of Artificial Sequence: Synthetic coding sequence
atgtgtgacctgcgacgccctgccgctggcggtatgatggacctggcttatgtgtgtgaatgggaaaaatggagcaagagcacccactgtccttccgtgcctctcgcttgcgcctggtcatgcagaaatctgatcgcctttacaatggatctccgtagcgacgaccaagacctcacacgaatgatccatatcttggacacagagcatccatgggacttgcatagtatcccatctgaacaccacgaggctattacctgcttagagtgggatcagagcggctctcgacttctttcggcagacgctgatggccagatcaagtgttggtcaatggctgatcacctggctaactcatgggagagctctgtgggctccctggttgagggcgacccaattgtggctctatcctggctacacaacggggtgcgcttagccctcgcttttcacgacggaagcgttcacatcgtccaccggttgtctcttcagaccatggcagtgttttactccagtgctgctcctaggccagtggacgagcctgcaatgaaaaggcctaggaccgccggacccgctgttcatctaaaggccatgcagctctcttggacttccctggctctagttggaatagactcccacggaaagctgtctgtgttgcgactgagcccgtccatgggccaccctttagaggtaggtttagccctcagacacctgctgttcctcttggagtattgtatggttaccggttacgactggtgggacattcttctgcacgtgcagccttctatggttcaatccttggttgaaaaacttcatgaagagtacacccgacagaccgctgctctgcagcaagtactttctaccagaattctggctatgaaggcatctctgtgcaagctcagtccttgtacagtgacaagggtttgtgattaccacacaaagctgttcctcatcgcgatttcatcgactcttaagagtctcctgaggccccattttctgaatacccctgacaaatctcccggagataggctgaccgagatctgtaccaagattaccgacgtggatatagacaaagttatgattaacctgaagactgaagaattcgttctctag

SEQ ID NO: 23436 - DNA, 975 bp, Artificial Sequence
  Description of Artificial Sequence: Synthetic coding sequence
atgtgtgacctcaggcgcccagcagccggtggcatgatggatctggcatatgtttgcgagtgggaaaaatggtcaaaaagtactcactgtccaagcgtaccgctagcctgcgcatggtcatgtcgaaacctaattgcctttactatggatctgcgtagcgacgaccaagacctgacgaggatgatccacattttggataccgaacatccctgggacctgcactctattcctagtgaacaccacgaggcaatcacttgcctcgagtgggaccagagcggctctaggttactgtccgctgatgccgacggccagataaagtgctggagcatggcagatcacctggccaactcatgggagagcagcgtggggagcctggtggagggggaccccattgtcgctttgtcgtggcttcacaacggagtcaagcttgcgctgcatgtggaaaagtcaggagcaagtagttttggagaaaaattcagtcgcgtgaagttcagcccttccctcactctgtttggaggcaaaccaatggaggggtggatcgccgtaactgtttccggtcttgtcacagttagtctcctattcctactcgagtactgcatggttactgggtacgattggtgggatatcctactgcacgtccaaccgagcatggttcagtccctcgtggagaaactccatgaagagtacacgcgtcagaccgctgctctgcagcaagtgttgagcactcgcatccttgccatgaaagcttccctgtgtaagctgagtccctgtactgtcacacgcgtgtgtgattatcatactaaactgtttttgatagccatttccagcacactgaaatccctgctgagaccgcactttctgaacacccccgacaagtctcccggagatagacttactgaaatctgcacaaagattacggacgtcgatattgacaaagtcatgatcaacctaaaaaccgaggagtttgttctttag

SEQ ID NO: 23437 - DNA, 603 bp, Artificial Sequence
  Description of Artificial Sequence: Synthetic coding sequence
atggcacagcagagggctctgcctcagtccaaggaaacgcttttacagtcctataacaaaaggctgaaagatgacatcaaaagcatcatggacaatttcaccgaaatcattaagaccgcgaaaatcgaggacgagacgcaggtctcaagagcgacccagggcgagcaagacaattatgagatgcacgttagggccgctaatatcgtgagagccggtgaatctctgatgaaactggttagcgacctcaaacaattcctgatcctaaacgatttcccctcagtgaatgaggctattgatcagcgtaatcagcagctgcgtaccctgcaggaagaatgcgatagaaaactgattaccctccgcgacgagatctctattgacctctatgagttggaagaggaatactattcctcatcatcatctttgtgtgaagcaaacgacttgccactctgtgaggcatatggccgactggatctagacaccgactcggctgacggattgtcggccccacttcttgctagcccggaacccagcgccggacccctgcaggtggccgcacccgcacatagtcatgccggaggccctgggcctactgaacatgcctag

SEQ ID NO: 23438 - DNA, 423 bp, Artificial Sequence
  Description of Artificial Sequence: Synthetic coding sequence
atggcccaacagagggccctgcctcaaagcaaagagaccctgctccagtcttacaataagagactgaaggacgatatcaaatcaatcatggacaactttaccgagattattaaaacggccaaaattgaggatgagacacaggtgtcccgtgccactcaaggggaacaggacaactatgaaatgcacgtccgggctgccaatatcgtccgagccggtgagtctctgatgaaactcgtgtccgacttaaaacagtttctcatcctaaacgatttcccatctgtgaatgaagccatcgaccagagaaaccagcagcttagaactctccaggaagaatgtgataggaagctcatcactctgcgcgatgaaatctccatcgatttatacgaactggaggaggaatattacagctccagatataaatag

SEQ ID NO: 23439 - DNA, 405 bp, Artificial Sequence
  Description of Artificial Sequence: Synthetic coding sequence
atggcccaacaacgggctctcccacaatccaaggagaccttactgcaaagctataataagcgcctgaaggacgatataaagagcataatggacaatttcactgaaataatcaagaccgcaaagattgaggacgagactcaggtaagccgcgcaacacagggagagcaggacaattacgagatgcacgtccgcgctggcgagtccctcatgaagctggtcagtgatttgaagcagttcctgatcctgaatgacttcccaagtgtcaatgaagccatagaccagagaaaccaacagctgcggacacttcaggaggagtgcgaccgtaagcttattacgctgcgcgatgagatatctatcgatctgtacgagctggaagaggagtactattcatcccgttacaagtag

SEQ ID NO: 23440 - DNA, 414 bp, Artificial Sequence
  Description of Artificial Sequence: Synthetic coding sequence
atggcccagcagcgcgcactgccgcagtccaaagaaacgctgctgcagtcatacaacaaaaggctcaaggacgacataaaatccatcatggataatttcactgaaatcattaagaccgccaagattgaagatgagacacaggtaagccgggcaactcaaggcgagcaagacaattatgaaatgcatgtccgtgccgctaatatagtgagggcaggagaatctctaatgaaacttgtgagtgatctgaagcaattcctgatactcaacgactttccatcagtgaacgaggctatcgatcagcgtaaccagcagctacgcaccttacaggaagagtgtgatcggaagctgatcactctcagagatgagatctccattgacctgtacgagttagaagaagagtactactcaagttag

SEQ ID NO: 23441 - DNA, 336 bp, Artificial Sequence
  Description of Artificial Sequence: Synthetic coding sequence
atggcacagcagagggccttaccccagagtaaggagaccctgctccagagttacaacaagcgtctaaaagatgatataaagagcattatggacaatttcactgagattatcaaaacagccaaaatcgaagatgaaacccaagtatcaagggctacgcagggcgaacaagacaattatgaaatgcatgtaagagccgcaaacattgtccgtgctggtgagtccctgatgaagctggtttctgatctgaaacagttcctgatcctgaacgactttccatccgttaatgaggctattgaccagaggaaccagcagttgcggaccttgcaggaggagtag

SEQ ID NO: 23442 - DNA, 423 bp, Artificial Sequence
  Description of Artificial Sequence: Synthetic coding sequence
atggctcagcagcgggcactcccacagagcaaggagactctgttacagagttacaataagagactgaaagatgacataaagtcaattatggataatttcacggaaatcattaaaaccgccaaaatcgaagacgagactcaggtgtcacgagctacacagggggagcaggataattacgagatgcacgtgcgggcagccaacatcgttagagcaggcgagtccctaatgaagttggtctcagatctaaagcagttcctgatcttaaatgatttcccatccgtcaacgaggccattgaccagcgtaaccagcagctgcgtacactccaggaggagtgcgaccgaaagctgataacacttagagacgaaatcagtatcgatctgtacgagctggaggaggagtactattccagccgttacaaatag

SEQ ID NO: 23443 - DNA, 423 bp, Artificial Sequence
  Description of Artificial Sequence: Synthetic coding sequence
atggcccaacagagggcactcccacagtccaaagaaacactgttacaaagttacaataaaaggctgaaagacgatattaagtccattatggacaacttcacagagattatcaagaccgcgaaaattgaagatgaaactcaggttagtcgtgcgactcagggagagcaggacaactatgagatgcacgtgcgtgccgctaacattgtgcgggctggcgaatcgctgatgaagctggtctctgatttaaagcagtttctgattctaaacgactttccttccgtaaatgaggccatagatcagagaaatcagcagctcaggacgctgcaagaggaatgtgaccgtaagctcataacgctgcgggacgagattagcattgacctttacgaactggaagaagaatactactcttctaggtacaaatag

SEQ ID NO: 23444 - DNA, 603 bp, Artificial Sequence
  Description of Artificial Sequence: Synthetic coding sequence
atggcgcagcagcgagccctgccccagtctaaggagaccctgctccagtcgtacaacaagcgcttgaaagacgacattaaaagtatcatggacaacttcaccgagatcattaagaccgcaaagattgaggatgagacccaggtgagtcgggctactcagggtgaacaggacaattatgagatgcacgtccgcgctgccaacattgtcagagcgggagagagcttgatgaaactcgtgagtgacctcaaacagtttctcattttgaatgactttcctagcgtcaacgaagccatagatcagagaaatcagcagctacggacactccaggaggaatgtgatcgcaaactgataaccttgcgcgatgaaatcagcatagacctatatgaacttgaggaggaatactactctagctcctcttcactgtgtgaggcgaacgacctgcccctctgcgaagcatatggcaggctggacctggacacagatagcgccgatggtctctcagcaccacttctggcctccccggagccttccgcgggacccttgcaggtggccgcacctgcacacagccatgcgggtggccctggccctacagagcacgcatag

SEQ ID NO: 23445 - DNA, 408 bp, Artificial Sequence
  Description of Artificial Sequence: Synthetic coding sequence
atggcccaacagcgggcacttcctcagagcaaagagacactactgcagagctacaacaaaaggttgaaggacgacattaagtccataatggataacttcaccgagatcattaagactgcgaagatagaggatgagacccaagtgtcacgggcaactcagggggagcaggataactacgaaatgcacgttcgagcggctaacattgtacgagccggagagtccctgatgaaactggtatctgatcttaagcaattcctcattctgaacgactttccatcggttaatgaagcaatcgaccagcggaatcagcagctgagaactctgcaagaggagtgcgacagaaagctcatcaccctgagggatgagatttctatagacctgtatgaactcgaggaggagtactactag

SEQ ID NO: 23446 - DNA, 1452 bp, Artificial Sequence
  Description of Artificial Sequence: Synthetic coding sequence
atgaaggcttttcacaccttctgtgttgtgctcctggtattcggatccgtcagcgaggccaagttcgacgacttcgaggacgaggaagatattgtcgagtatgatgataatgactttgcagagttcgaagatgtgatggaagatagtgttactgaaagtcctcaacgagtcatcattactgaagacgatgaagacgagaccacagttgagctggaggggcaagacgagaatcaggagggggactttgaggatgccgacacccaggaaggcgacaccgaatctgagccttatgacgatgaggaatttgagggatacgaagataaacccgacaccagctcaagtaaaaataaagatccaatcacaattgtagacgtgcctgcccatttacaaaattcttgggaatcttactatcttgagattctgatggtgacgggcttgttggcatacatcatgaactatattatcggcaagaacaaaaactcacgcctggctcaggcatggttcaatacccatagggaattgctggagagtaatttcacccttgtaggggatgatgggacaaacaaggaagccacaagcacgggaaagttgaaccaggagaatgagcacatatataacctgtggtgctctggcagagtttgttgcgagggaatgcttattcaacttcgattccttaaaagacaggacctgctgaacgtgttagccagaatgatgcgccctgtgagcgaccaggtccagattaaagtgaccatgaacgacgaagacatggacacctacgttttcgctgtgggcacccgtaaggccctggtgaggctccagaaggaaatgcaggacctaagcgagttctgctctgacaaaccgaagagcggggctaaatatggtcttcccgattctctggccattttgtctgagatgggtgaggtgacggatggaatgatggatactaagatggtgcattttctgacccactacgcagacaagattgaaagcgtgcacttcagcgatcagttcagcggcccaaagataatgcaagaagagggccagcccctgaaactgcccgatacgaaaaggacgctgctattcacatttaacgtgccaggtagcggtaatacctatcccaaggacatggaagccctgttgccgctcatgaatatggtgatttactcaatcgataaggctaagaagttccgcctgaacagagaggggaagcagaaggcagacaagaatagagccagggttgaggaaaattttctgaagctcacccatgtccagagacaggaggcagcccagtcgcgacgggaagaaaagaagcgcgcagagaaagaacggattatgaacgaagaagacccagagaagcagagaagactggaggaggccgctctgagaagagagcaaaagaaactggagaaaaagcagatgaagatgaagcagatcaaggtgaaagccatgtag

SEQ ID NO: 23447 - DNA, 741 bp, Artificial Sequence
  Description of Artificial Sequence: Synthetic coding sequence
atggccgcagtcgacatacgggacaacttgttaggcatcagttgggtggactcatcatggatacccattttgaactccggctccgtgttggactatttctctgaacgctccaaccctttctacgaccggacctgcaataatgaagtggtgaagatgcagcgcctcacccttgagcatctcaaccagatggtaggaattgagtacatcctcttgcacgcgcaagagccgatactcttcattattcgcaagcaacagcggcagtcccccgctcaggtcatacctctagcagactattatataatcgccggtgtgatttatcaggcacccgacctgggaagtgtgataaactctagagtcctgaccgcagtgcacggtattcagtccgccttcgatgaagctatgtcatactgccgctatcaccctagcaaaggctactggtggcacttcaaggatcacgaggagcaggacaaagtgcgacccaaagccaaacgcaaggaggagccatcatcaattttccagcggcagagggtggacgccttgctcttagacctgcggcaaaaatttcctcctaagttcgtacaactgaaacccggagaaaagcccgttccagtagatcagactaaaaaggaggcagagccaattcctgaaacagtgaaacccgaggagaaggaaaccaccaagaatgtgcagcagacagtgtccgctaaaggacctccagaaaagcgcatgagactccagtag

SEQ ID NO: 23448 - DNA, 762 bp, Artificial Sequence
  Description of Artificial Sequence: Synthetic coding sequence
atggctgctgtggatattagagacaacctccttggcatctcttgggtcgacagcagttggatacctatcctgaatagtgggtccgttctggattacttcagcgagagatccaatccattctatgaccggacatgtaataacgaggtggtgaagatgcagagattgacactcgagcacctgaaccagatggtcggtatagagtacatcctgctgcacgcgcaggaaccaattctttttatcatcagaaaacagcaaaggcagtcacccgcacaggttatccccctcgcagattactacatcatcgctggtgtgatatatcaggcaccggacctaggaagcgtgatcaactcacgggtgagcttgttttccttttacaagctcaccgctgtacacggcatccagtccgccttcgatgaggcgatgtcatattgtcgctatcaccccagtaagggatactggtggcattttaaagaccatgaggaacaggacaaagtgagacctaaggctaaacggaaagaagagccctctagcatcttccaacggcagcgcgtcgatgcccttctattggatctcaggcagaagtttcctccgaaatttgtgcagcttaaacccggtgagaaaccagtgccagtcgatcagactaagaaggaagctgagccgatcccagaaacggtgaagccagaagagaaagaaacaacgaaaaacgtgcagcagacagtctccgcgaaagggcctcccgagaaacggatgcgtctccagtag

SEQ ID NO: 23449 - DNA, 546 bp, Artificial Sequence
  Description of Artificial Sequence: Synthetic coding sequence
atggcagctgtagacattcgcgacaatctcctgggaattagttgggtcgattcctcatggattcccatattaaacagcggctccgtgctcgactacttcagcgagaggtctaatccattctacgacaggacttgcaataacgaggtcgtgaagatgcagcgcctcactctagaacatcttaatcagatggtagggatcgagtatatactactacacgcccaggagcccatactgtttattatccgcaagcagcagagacaatcccctgcacaggtgattcctctcgcagactattatatcatcgccggagttatctatcaagccccagacctaggctctgtcataaacagccgggtgctgaccgcagtgcacggcatacagtcagcatttgatgaggccatgagctactgtcgctatcacccgtctaagggctactggtggcactttaaggaccacgaggagcaggccaaggcttggcggaaagcgtgttcctctggatctaacaaagaacgcggacgcacatacacccgaaactgcaagacttag

SEQ ID NO: 23450 - DNA, 750 bp, Artificial Sequence
  Description of Artificial Sequence: Synthetic coding sequence
atggcagcagtagacatacgagacaaccttttggggatatcgtgggttgactctagctggatccctattctgaattcaggatcagtgctagactatttcagcgaacggtccaaccccttttatgaccggacatgtaataatgaggtggtgaaaatgcagcgcctgactctggagcacttgaaccaaatggttggaatcgagtatatcttgctccacgcccaagagcctatactgtttataatccggaagcagcaacggcaatccccggcacaggtcattcctttagcagactactacatcatcgctggagtgatctatcaggcaccagatctgggctctgtcatcaactcccgcgttttgacggctgtacacggcatacagagtgcatttgacgaggctatgtcttactgcagataccacccctccaaggggtattggtggcattttaaggatcacgaagaacaggacaaagtccgcccaaaagctaaacgcaaggaggagcccagttccatttttcaacggcagagagtggatgccttactactggacttgcggcagaaatttcctccaaaattcgtccagcttaagcccggagagaaaccagtgccggtagatcagactaaaaaggaggcagagcccatccccgagacggttaagccagaagaaaaggagaccactaagaatgtccagcagacagtatccgccaaaggaccacccgaaaaacgaatgcggctgcagaaagcagtgtag

SEQ ID NO: 23451 - DNA, 906 bp, Artificial Sequence
  Description of Artificial Sequence: Synthetic coding sequence
atgcagagagaggaaaagcagctggaggccagcctggacgccttactgagtcaagtggctgaccttaaaaactcactggggtcctttatttgtaagctggagaacgaatacggcagattaacttggcctagcgtgcttgactcttttgccctcctgagtggtcagctcaacacactgaacaaagtgctgaaacatgagaaaaccccacttttccgtaaccaggtgatcatcccactggttctctcccccgacagggacgaagacctcatgcgtcagactgaaggtcgggtcccggtgttttcacacgaggtagttcctgatcacctgcgaacaaagccagacccagaggtcgaggagcaggagaaacagctgacgactgatgccgcaaggataggggctgatgcagcccagaaacagatccagtctctcaataaaatgtgcagcaacttactggaaaaaatctctaaagaagaacgtgaatccgaatccggaggactacggcctaacaaacagacatttaacccgacggatactaacgcactcgtggccgcagtggccttcggaaagggcctctccaactggagaccaagcggcagctccggaccgggacaggccggtcagcctggggcagggacaattctggctggcacctccgggcttcagcaagttcagatggcaggggcaccctctcaacagcagcccatgctctcaggtgtgcagatggctcaggcaggacagccgggtaaaatgccttctggaattaagacaaatattaagtcagccagcatgcacccttaccagcgcccaagctgtttaggctttatactggccatccccctgcggcgaaaagtgaaaaaactgctcgggcaggagggtaagaagaatgcccaccttcagctctggtag

SEQ ID NO: 23452 - DNA, 807 bp, Artificial Sequence
  Description of Artificial Sequence: Synthetic coding sequence
atgcagagggaggagaagcagctggaagcctccctcgacgccttgctgtcgcaggtcgcagatctgaaaaatagcctgggctcttttatttgcaagctggagaacgagtacggcaggctgacgtggccctccgttcttgactcatttgctttactgtccggccagctcaacacattaaataaagtgctcaagcatgagaagaccccgctgtttcgtaaccaggttataatcccattagtgctgtcaccagaccgggatgaggacctgatgaggcagaccgaaggaagagtgcccgtgttctcccatgaagtagtgcccgaccacctgcgaaccaaaccggatccagaagttgaagagcaagagaaacaactgaccactgacgctgccagaattggagctgacgcggcacagaaacagatccagtccctgaataagatgtgttctaatttattggaaaagatttcaaaggaggagcgtgagtcggaaagtggcggactcagacccaacaagcaaacctttaatccaacagacacaaacgccctcgtggcagccgtggctttcggaaagggtctgagtaattggcgaccttcgggctcctccggccctggacaggccggtcagcccggtgccggaacaattctggcaggcacctcgggacttcagcaggtccagatggcgggtgcgccttcccagcaacaacccatgctgagcggagtgcaaatggcccaggccggacaaccaggaaaaatgccctccggaattaagacaaacatcaagagcgctagtatgcacccttaccaacgatag

SEQ ID NO: 23453 - DNA, 1248 bp, Artificial Sequence
  Description of Artificial Sequence: Synthetic coding sequence
atgacgctggccgctagttcgcaaaggtcacagatcatacgatcaaaattcagaagtgttctgcagctaagaatccacaggcgcaaccaagagcagatctctgatccagacccatggatttccgcctcagaccctccgctggccccagcgttaccttccgggaccgccccatttctcttttctccgggagttttactccccgagcccgaatactgccctccatggcgtagtcccaaaaaagagtctccaaaaatatcccagcgctggagggagagtaaacctcggggaaatcttacgtaccaccagtatatgccacctgagcccagacagggatcccgtgctgaccctcaagcagagggctccgcactaggtcccccaggacctagtctttgggagggcaccgactcccagcagcctcaccccaggatgaaaccgagtccattgacaccttgtcctccgggagtaccctcccccagcccacccccacataagttagaactgcaaaccttgaagctggaagagctgacagtgtcggaactccgccagcagctgcggcttcggggactgcctgtttctgggaccaagagcatgttgctggaaagaatgcgcggaggggcacctccccgagagaggcctaagcctaggagagaagacagcccagctggagccccttggcctcggctgaaacctaaagctctcgccgctgccaggcgacagggcagcgtgaagccgtccgcggcttcacatcggccacctctgccaagggcagctgatacccccggaactgcccctgcccctacaccaacacctgctcctgcggcagcgccagccctgaccccgtcctccggaccaggcagcgcagcactgacccttgaggaagagctccaggaagcaatacggagggcccaactcctacccaatcgcggaatagatgatattcttgaggatcaggtggagccggatgacccccttccccctatccctctcgactttccaggttcctttgacgtgctgtctccatcacctgacagcgaaggcctgtctagcgtcttctctagtagtctcccatcaccaactaatagtagttctcctagccctcgcgaccccaccgacagtttagactggctagaggctctctccggcggaccccctttgggcagcggtcctccaccaccctcgattttttctgcggacctgtcagacagtagcagttctagattatgggacttacttgaggacccctggtag

SEQ ID NO: 23454 - DNA, 939 bp, Artificial Sequence
  Description of Artificial Sequence: Synthetic coding sequence
atgccacccgagccacgccagggatcaagagcagaccctcaagctgaagggagcgccttgggtcccccaggcccttccctgtgggagggcacagattcccaacaaccccatcccaggatgaagccgagccctttaacaccctgtccgcctggcgtgccgtctccctctccccctccgcacaaactggaactccagaccctcaagctcgaagaactgactgtgtcagaactgcggcagcaactgcgattacgtgggctgccagtttccggcacgaagtccatgctgctagaaagaatgcggggtggcgctccgcctagagagagacccaagcccaggagggaagacagcccggcaggcgctccttggccaagactgaagccgaaggcactggctgccgcaagacgacagggtagcgtcaaacccagtgccgcttctcataggcccccactccctagggccgctgacacccccggaactgcacctgctcccaccccaactccggctccggctgctgcacctgcacttactccctctagcggcccaggaagtgccgctctcactcttgaggaggagttgcaagaagccatcaggagggctcaattgctcccaaaccggggaatcgatgacattttggaggatcaggttgaaccagacgatccactgcctcctatccctctggacttccctggcagcttcgacgtcctctctccaagccccgattcagagggtttatcctctgtcttttctagttctctgcctagccctacaaatagcagtagcccaagccccagggatcctacggattctctggactggcttgaagccctgtcagggggaccccctctgggtagcgggcctcccccaccgagtattttttccgcagatctgagcgatagttcatcttcacgcctctgggacctactggaggacccctggtag

SEQ ID NO: 23455 - DNA, 744 bp, Artificial Sequence
  Description of Artificial Sequence: Synthetic coding sequence
atgccacccgaacccaggcaaggaagccgcgctgatccacaggctgagggttcagcactcgggcctccaggcccatcattgtgggaaggcacagacagccagcagccacatcctagaatgaaacccagccccctgaccccgtgccccccaggggtgccctctccttcgccccctccccataaattagagctgcagacgctcaagctggaagagctgacagtgaagccaagtgcagcgtcccatcggccaccgctgcctagagctgctgatactcccggaacagctccggctcctacccccacccccgcacccgcagccgctccagcactaaccccatcttccggccctggcagcgccgctctcaccttggaagaagagctgcaagaggccattagacgggcacagctgctacctaacagaggtattgatgatattctcgaggaccaggtggagccagatgaccctctgccccctattcctctggacttccctggtagcttcgatgtgttgtcacccagcccagacagtgaggggctgagcagcgttttttcatcttcattgccaagccctacaaattcctcgtctccgtcacccagagatcctacggattctctcgactggctggaggctctgagcggcggtcctcccttggggtctggccctcctccaccaagtattttctctgcagatctgagtgattcatcctcatcacggctctgggacttattggaagatccctggtag

SEQ ID NO: 23456 - DNA, 939 bp, Artificial Sequence
  Description of Artificial Sequence: Synthetic coding sequence
atgcctcctgagccaagacagggcagcagagccgaccctcaggcggagggatccgctttggggcctccaggccctagtctttgggaaggcactgactctcagcagccacatccacgcatgaaaccatcccctcttacaccttgtccaccaggggttccctcaccatcccctccaccacacaaacttgagttacagacattgaaattagaagagctgacagtgagtgaactccgacagcagctccggctgcgtgggctgccagtgagtggcacaaaatcgatgctactggagcgcatgcgaggaggagcaccccctcgcgagcggccaaaaccccgaagggaggacagccctgccggagctccgtggcccagactgaaacccaaggccctcgcagctgcacgccgacagggtagcgtgaaaccaagcgccgcttctcaccgccctccactgcccagagcggctgatacacctggcacagcccctgcacccacacccacgcctgctcccgctgccgctcccgctttgacaccatcgtctggcccagggtccgcggcattaacactggaggaagagcttcaggaggcaattcggcgagcccaactcctccctaatcgcggaattgacgatatcctcgaggaccaagttgagcccgatgaccctttgccccctataccactcgacttcccaggcagttttgatgtgcttagccccagcccagactctgagggcctgtcctcagtcttctctagctccctcccttctcctacaaactccagcagcccctctcctcgggatccgacagattccctagattggctcgaggctctgagtggcggtccgcctttggggtcggggccacctcctccctcaattttcagtgcggacctgtctgactctagttcatctaggttgtgggatttgctggaagatccttggtag

SEQ ID NO: 23457 - DNA, 618 bp, Artificial Sequence
  Description of Artificial Sequence: Synthetic coding sequence
atgtccaagaagaaggggctgtctgccgaggagaagcgcacccggatgatggagattttttccgaaactaaggatgtgttccagctgaaggacctggagaagatcgcacctaaggaaaaggggattacggcgatgagtgtgaaagaggtcctccagagcctggttgacgacgggatggtcgattgcgagcgaattggaacttccaactactactgggcgtttccaagcaaagctctccatgctcgtaagcacaagctggaagtcttggaaagccaactatctgagggcagtcaaaaacacgcttctttgcagaagtcaatcgaaaaagccaaaattggcagatgtgagaccgaagagaggacgcgattggcgaaggagctgtcttcattaagagatcagagggaacagctgaaagccgaggtggagaagtataaggactgcgatccccaggtggtggaggaaattcggcaagcgaacaaagtggctaaggaggcagctaatagatggacggataatattttcgcaatcaagtcgtgggcaaaacggaaatttggattcgaagagaataagatcgaccgcacatttggaattccagaggatttcgattacatcgactag

SEQ ID NO: 23458 - DNA, 159 bp, Artificial Sequence
  Description of Artificial Sequence: Synthetic coding sequence
atgatcgaccagtcaaaccgtacgggccagggggctgcctttagccccgagggacagcccataggagggtacactgaaacccagccccacgtagccgtgagaccaccaggcagtgtgggtatgtcgctgaatttggaaggggagtggcattatctgtag

SEQ ID NO: 23459 - DNA, 1077 bp, Artificial Sequence
  Description of Artificial Sequence: Synthetic coding sequence
atggcacggaggtatgatgaactgccacattatcccggtatagtcgacggacccgctgccttggcgtcttttccggaaactgtgcccgcagtacccggaccctatggtcctcatcggcctccacaacctttgccacccggactggactctgacggcttgaagcgagagaaggatgaaatttacgggcaccctttgttccctctgttggcgcttgtttttgaaaaatgcgagctggcgacctgctcaccaagggatggagccggagcgggtcttggcaccccccctgggggtgacgtctgttccagcgactcgttcaatgaggacatcgctgcattcgccaagcaggtcaggtcggaaaggcccttgttcagttctaacccagagctggacaatctgatgatacaggctatccaggtgctgcgctttcatttgctggagctcgaaaagggtaagatgcctatagatctagtgattgaggacagggacggcggatgtagagaagatttcgaggattatcccgcatcttgcccatccctcccagatcagaacaacatgtggattcgggaccacgaggacagcgggtcagtccacctaggaacacccggacccagcagcgggggtctggctagtcagagcggtgataatagcagtgaccagggcgatggtctggatactagcgtggcctccccgagctcagggggtgaggacgaagacctggatcaagaaaggaggcgaaataagaaacgtggcatatttccgaaggtcgctaccaacattatgcgtgcttggcttttccagcacttgagtcatccatacccatccgaggagcagaaaaaacaattggctcaggataccgggttaacgattctgcaggtgaacaactggtttatcaacgccaggaggcgcattgtgcagccaatgattgatcagagtaatcgtaccggccagggagctgccttttctcccgagggacaacccattggcggatacaccgagacccaaccacatgtcgccgtgagacctcccggatctgtgggaatgtcgctaaatctcgagggggaatggcactatctttag

SEQ ID NO: 23460 - DNA, 1128 bp, Artificial Sequence
  Description of Artificial Sequence: Synthetic coding sequence
atggccaggcgatatgatgagctcccacactatcctggcattgtcgacggccctgccgcactggcttcattccctgagacagtgcccgcagtgccaggcccttacggtccacatcggccaccacagccattgccaccaggactggactctgacggactgaaacgcgagaaagacgagatctatgggcaccctctcttccccctgctcgctttggtcttcgaaaagtgcgaattggccacctgctcacctcgcgatggagccggagccggtctggggactcctcccggaggcgatgtgtgctcctccgacagctttaacgaggacatcgccgcattcgctaaacaggtgagatctgaacgaccactgttctcgtccaacccagagctggacaacctgatgatacaggcaatccaagtgctgagatttcatctgctggagcttgaaaaagtccatgatttgtgcgataacttttgtcatcgatatatcacatgtttaaagggcaagatgcccattgatctagttatcgaggaccgggatgggggatgtcgggaggattttgaagattatcccgcatcctgtcctagtctgcctgaccaaaataatatgtggattcgcgaccacgaggatagcggtagtgttcaccttggcacccccggaccttcctctggaggccttgcgagccagagtggggacaatagctccgaccaaggtgacggcctggacacctccgttgcctcacctagttctggcggtgaagacgaagatttggatcaggagcggagacgcaacaaaaagcgcggtatatttccaaaggtcgctactaatattatgagggcatggctcttccaacacctgtcccacccctatccttccgaggagcagaagaagcagctagctcaggataccggcctcactatcctgcaagtgaataactggttcatcaatgctagacgacgcatcgtgcaaccgatgatagatcaatccaaccggacagggcagggagctgccttcagcccggagggacagcccattggcggatataccgaaactcagccgcacgtggctgtgcgcccacccggatccgtaggcatgagtttgaacctggagggcgaatggcactatctatag

SEQ ID NO: 23461 - DNA, 1266 bp, Artificial Sequence
  Description of Artificial Sequence: Synthetic coding sequence
atggcccgtagatatgatgaattgccacattacccgggaatcgtcgacggccctgccgctctcgccagctttccggagacagtccctgctgtcccagggccatatggcccacaccgcccaccgcagccgcttcccccagggctggattctgatgggctgaaaagagagaaggacgagatctatggacatcctttgttccctctcctcgccttggtgttcgaaaagtgtgagctggcaacatgttcacccagagatggggctggtgcgggtcttggcactccacccggtggagacgtctgtagtagtgactcttttaacgaggacattgctgctttcgccaaacaggtgagatccgagcggccactattctctagcaatcccgagctagacaacctcatgatccaggcaatccaggtgctacgtttccacctactggaactagagaaggtgcacgacttgtgtgacaacttttgccatagatatatcacgtgcttaaagggcaaaatgcccatcgacttggtgatcgaggacagggatggcggatgccgggaagattttgaggactacccagcgtcctgcccatcgttgcccgaccagaacaatatgtggattagagatcatgaggatagcgggtcggttcacctcggcactcccggaccctcctctggtggtctggcctcgcagagtggcgataattccagtgaccagggcgacggactggacaccagcgtggcgtccccctccagcggaggagaagacgaggatctggaccaggaaaggcgacgcaataaaaaacggggaatatttccaaaagtggccaccaatatcatgagagcttggttgttccagcacctctctcggaggtccgaagcccctgtactgcctgatgtctgcctgggacttggcagcccctcgcctggtccacggtgggctcgcccatggggaagcgactgcgggaggccagggaggcaaagcgatagctgctggtggctgcagcacccttacccttccgaagagcagaaaaagcagctcgcccaagatacaggactgacaattctacaggtcaataattggttcataaatgccaggaggcggattgtgcaaccaatgatagatcagagcaatcgcaccggacagggagcagcttttagtcccgaaggccaacctatcggtggctacacagagacccagcctcacgtcgcggtacgaccccctggttcggtgggtatgagtctgaatttggaaggagaatggcactatctgtag

SEQ ID NO: 23462 - DNA, 1266 bp, Artificial Sequence
  Description of Artificial Sequence: Synthetic coding sequence
atggcgaggcgctatgatgaattgccccactaccccggaattgttgacggccctgctgcactggcgtccttccccgaaacagtgcctgccgtgcccggtccttacggacctcaccgccctcctcagccgctccctcccggtctggactccgacggtcttaaacgagaaaaggatgagatttacgggcatccactgtttcctttgctagctctggtatttgagaaatgtgaacttgcgacctgctcaccacgggacggcgcaggagctgggcttggaacgccgcctggcggagacgtttgctcatctgacagttttaatgaggatattgcagctttcgcgaagcaggttagaagcgaacgtccattgttctctagcaaccctgagctggacaacctgatgattcaggctattcaagtgcttcgtttccatctgctggagctcgagaaggtgcatgacctttgcgacaacttctgtcatcgttacatcacctgcctgaaggggaagatgccaattgacctggtgattgaggatcgcgatgggggatgtcgggaagatttcgaagactaccctgccagctgtccttcactccccgatcagaacaacatgtggatccgcgaccacgaggattctggatctgtccacctgggcaccccaggacctagcagcgggggtctggcatctcaatcaggcgacaactcaagcgatcagggggatggactggacaccagcgtcgcttctcctagttcggggggagaagacgaggacctcgaccaggagaggcgaaggaacaagaagcggggaatcttccctaaggttgctactaacattatgagagcttggttgtttcaacacttgtcaaggcgctctgaagccccagtcctgccagacgtgtgcctgggactgggctcaccctccccaggcccaaggtgggcccgtccctggggcagtgactgtggaaggcccggaaggcaatctgatagctgctggtggttgcagcacccctacccatcagaagaacaaaagaaacaactggcccaggatactggccttacaatcctgcaggtcaacaactggtttatcaatgcgcgaaggcgcatagtgcagccgatgattgaccaatcaaataggacaggacagggagctgccttttcccccgaagggcagcctattgggggttataccgagactcagcctcacgtagccgtcagacccccaggctcagtcggcatgagccttaatctcgaaggcgaatggcactatttatag

SEQ ID NO: 23463 - DNA, 1266 bp, Artificial Sequence
  Description of Artificial Sequence: Synthetic coding sequence
atggctagacgatatgacgagctgccccactatcctggcatcgtagacggtcccgctgctctggccagtttcccagagacggtgccggcagtgcccggaccctacggcccacatcggccaccacagccccttccacctggtctcgactccgatggcctgaagagagaaaaggacgaaatctatgggcaccccctgtttccattgctcgccctcgtgttcgaaaagtgtgagctggccacttgctccccccgtgatggtgctggtgctggattagggacacccccaggcggtgacgtttgcagtagcgactcctttaacgaggacatagctgctttcgccaaacaggttagatccgagagacccctctttagttccaatcccgagttagataacttgatgattcaggcaatccaggtgttacgtttccaccttttggagctggagaaggtccatgatctctgtgataacttttgtcatagatatattacatgtctgaagggcaaaatgcctatcgatctggtgatcgaggatcgggacggagggtgccgggaggatttcgaagattatcctgccagctgtccatccctgcctgatcagaacaacatgtggattagagaccacgaagacagcggatctgttcatctcggaactcccggacctagcagtgggggattggcctcccagtcaggcgataacagtagcgaccaaggcgacggacttgataccagcgttgccagtccatcttctggcggagaagacgaagacctggatcaggaaagacggaggaacaaaaagcggggaatctttccaaaagtcgccacgaacattatgcgtgcctggcttttccaacatctttcgcgccgatctgaagccccagtgttaccagatgtttgtttaggcttaggaagcccgtcccctgggcctaggtgggctcgaccctgggggtccgattgtggccgacctggcaggcagtctgatagctgttggtggctgcagcacccatatcccagtgaagagcagaagaagcagctcgcccaggacactggactgaccattttgcaagtcaacaattggtttattaatgcaagacgcaggatcgtgcagcctatgatagatcagagcaaccggacgggccagggggcagccttctcacctgagggccagcccatcgggggttacaccgaaacgcagccgcacgtggctgtgcgccctccgggtagcgtagggatgagtttgaacttggagggagagtggcattacctgtag

SEQ ID NO: 23464 - DNA, 1929 bp, Artificial Sequence
  Description of Artificial Sequence: Synthetic coding sequence
atggtttccgccagccagaatgaggtgcccgctgccccactcgaagagctggcataccgacgctccctccgggtggccctcgacgtactgtctgaaggcagcatatggtcgcaggagtcaagcgccggtactgggagagcagatcggtccttgcggggaaaaccgatggaacatgtctcttctccctgtgactcgaatagtagctctctgccaagaggggacgtgttaggatcatcacggcctcacaggaggcgaccctgtgtgcagcagagcctgtcatcttcatttacgtgtgaaaaagacccggagtgcaaagtcgatcacaagaaaggccttaggaagtcggaaaaccctagagggcctcttgtgcttccggcaggaggcggagcccaagacgagtccggtagccgaattcaccacaagaactggactctagcttctaagaggggagggaatagcgcgcagaaagcgagcctctgcctgaacggcagctccctctccgaggacgatacagagcgagacatgggctccaagggcggttcctgggcagcaccatccctccctagcggggtgagggaagatgatccttgtgccaatgccgaggggcacgaccctggacttccactaggctccctaaccgctccccctgcccctgagccatcagcgtgttcagagcccggagaatgtccagccaagaagcggcctcgcctggatggcagtcagcgcccaccagccgtgcagcttgaacccatggccgcaggagccgcaccaagccctggaccaggcccagggcctagagagagcgtaactcctagaagtaccgcaagattaggtccacccccttcgcatgcatccgcggacgccactcgctgtttaccatgccccgacagccagaagctggagaaggagtgccagagttccgaagaaagcatgggtagcaatagcatgaggtccatacttgaggaggacgaggaagacgaagaaccaccgagggttctgctgtatcacgagcctaggtctttcgaggttggaatgctcgtctggcataaacataaaaagtaccctttctggccagcagtggtaaagtcagtgagacagcgggacaagaaagcctctgtgctctatatagagggccatatgaatccgaaaatgaaggggttcacggtcagtcttaagtctctgaagcacttcgattgcaaggagaagcagacccttctgaatcaagcccgagaagactttaatcaagatatcgggtggtgcgtctcgctgatcactgactaccgggtgcgcctcggctgcggatcttttgccggttcatttttggagtactatgccgcagacatcagctatcctgtccggaagagcatccagcaggacgttctgggcacgaagctgccccaactctccaaaggatcacccgaagagccagttgtcggatgcccgctcgggcagcggcagccttgcagaaagatgctgccagaccgcagccgcgcagccagagaccgggctaatcagaagctggtggaatatatcgttaaagccaaaggggcagaatctcatctgcgggcaattctcaaaagccggaagccatcacgatggctgcagacctttctgtcgtcatcccaatacgtcacatgtgtggagacttatcttgaggacgagggtcaattagatttggtggtgaagtacctacagggcgtgtaccaagaggtaggcgctaaagtgcttcaacgcactaacggagacagaatccgtttcattctcgacgtgcttctgcctgaagccatcatatgtgcaatctctgcggtggatgaagttgactacaagaccgctgaagagaagtacataaagggcccatcactcagctatagggagaaagagatattcgataaccaactgctggaggaacgtaataggcgcagacgctag

SEQ ID NO: 23465 - DNA, 2136 bp, Artificial Sequence
  Description of Artificial Sequence: Synthetic coding sequence
atgatggcagacgcgaaatacgtcttatgcaggtgggaaaaaagattatggcccgctaaggttctcgcccgaacagcaacctctacgaaaaataagcgccgaaaagagtatttcctggccgttcagatactgtccctggaggaaaagatcaaagttaagtccaccgaggtggagattctggaaaaatcacagattgaagctatcgcaagcagtctggctagtcagaacgaagtaccggctgcacccctcgaggagttggcctatcgtcggtcactacgggtggctcttgacgttctctctgagggcagcatctggagccaggagagttctgcagggacaggacgagcggatcgatctttgaggggcaaaccgatggaacacgtttccagtccatgtgactcaaacagctcatccctcccccgaggtgacgtgctgggcagctcccgaccacatcgcaggagaccttgcgtgcagcaaagcttgtcctcctcttttacctgcgaaaaggatccggaatgtaaagtcgatcacaaaaaagggctgagaaagtctgagaatcccaggggcccactggtgttgcctgctggcggaggagcccaggatgaatcagggtctcgcattcaccataaaaactggactctggcttcaaaaagaggcggtaattctgcacagaaggccagcctgtgccttaacggttccagcctctctgaagacgataccgagagagacatggggtccaaaggagggtcctgggccgctccgtcccttccaagtggagtgcgggaggacgatccctgcgccaacgcagaagggcacgatcctggactgcccctcggctccctgacggctcctcccgctcctgagccaagcgcatgcagcgaacctggggagtgtccagctaaaaagcggcctagacttgacggatcccagcggccacccgcagtgcagctggagcccatggccgcaggcgctgccccttctccagggccaggacccggtccacgtgagagtgtaaccccaagatctacagcgagactcggcccaccaccctcacacgcctcagccgatgccacccggtgtttgccctgcccggactctcaaaagctcgagaaggaatgccaatccagcgaggaaagcatgggctccaactcgatgcgctccatactggaagaggacgaggaggatgaagaaccccctcgcgtgctattgtaccacgagccacggtccttcgaggtaggtatgttggtatggcacaagcacaagaaatacccattctggcctgccgtggtaaaatctgtcaggcagagggataaaaaagccagcgttctgtatattgagggccatatgaaccctaagatgaaagggtttacagtatctcttaagtcactgaagcacttcgactgcaaggaaaaacagaccctgttgaatcaagccagggaggacttcaatcaggatattggatggtgcgtttcactcatcactgactaccgcgtgcgcctaggttgcggctcttttgcagggtcgtttctggagtactatgctgcggacatctcgtaccccgtccggaaatctatccaacaggacgtcctcggcactaagctgcctcagctgtcaaaggggtcacctgaggagcctgttgtcggctgtcccctcggacaaaggcagccatgtcggaaaatgctaccagatagatcaagggctgcacgggacagggcaaaccagaaactggtcgaatatatagtcaaagccaagggtgctgaatcacacctgagggcaatcctgaagagcagaaaaccctcccgatggcttcagactttcctttcatcttcccaatatgtgacatgtgtggagacctatctggaagacgagggtcagctggacttggtggttaagtatcttcaaggggtataccaggaagttggggcaaaggtcctccagcgtaccaacggggatcggattaggttcatccttgacgtcctgctgcccgaggctataatctgcgcaatttccgccgtggatgaggtggactacaagaccgctgaggagaagtatatcaagggaccatcattgtcatatagggaaaaggagatcttcgataaccaactgctggaggaacgcaaccgacgaagacgatag

SEQ ID NO: 23466 - DNA, 225 bp, Artificial Sequence
  Description of Artificial Sequence: Synthetic coding sequence
gggggagggggaggcggtcatatcggagtacgccctggatccaccctgtgtcaaatcattgccacatgccacatgagcgtgaacgatggcggttgttatgtcctctgtcgatgggagaaaagactctggccggcaaaagtgttagcacgaacagcaaccagtactaagaataagagaagaaaggagtactttttggcagtgcagatactgtctttagaggagtag

SEQ ID NO: 23467 - DNA, 2199 bp, Artificial Sequence
  Description of Artificial Sequence: Synthetic coding sequence
atgatggcagacgccaagtatgtgttgtgtagatgggaaaagagactgtggccagccaaagtgctggctcggaccgccacatcgacaaagaataagaggcgcaaagagtatttccttgccgtccagattctctctctggaagagaaaattaaagtgaaaagcacagaagtcgaaatattagaaaagtcccagatcgaggcaatagcctcctcactcgcctcccaaaacgaggtgcccgcagccccactcgaagagcttgcctacagaaggtctctccgtgtagcattggacgtcctttctgaaggatccatatggtctcaggaaagttcagcaggcacgggcagagccgacaggtcactgcggggtaagcctatggagcacgtttccagcccttgtgattccaattcaagcagcttacctcgaggggacgttcttggaagcagtagaccacaccgtcggagaccctgtgtgcagcaatcactgtcctcctccttcacttgtgaaaaagacccagaatgcaaggtggaccataagaagggcctgagaaaaagcgaaaaccccaggggccctttggtgctgccagccggtggcggagcccaggacgagtccggaagtaggattcatcacaagaattggacactggctagcaagcggggaggtaactcagcacagaaggcatctctgtgcctgaacggatctagtctgtccgaggatgacaccgagagagatatgggctccaaaggtgggtcttgggctgcccctagcttgcctagcggagtgcgtgaggacgacccctgcgctaacgcagaggggcacgatccaggcttgcccctggggtcactgaccgctcctccagccccagagccctctgcttgttctgaacctggggaatgtcctgcgaagaaacggccacggctggacggctcacaacggccacctgctgtgcaactcgaaccaatggcagcaggtgctgccccaagccccggaccgggtccaggaccacgcgagagtgtcacccctagatctactgccaggttgggccctccaccttctcatgctagcgccgatgccacccggtgcctgccttgtccagactctcagaagctggaaaaagagtgtcagtccagtgaggaatcaatggggagtaactccatgaggtctatcctggaggaggacgaagaggatgaggagcccccacgcgttctgctgtatcatgaaccccgttcattcgaagtcggaatgctcgtctggcacaagcacaaaaaatatcccttttggccagccgtcgtgaagagtgtgcggcagagagacaagaaagccagcgtcctatacattgagggacacatgaaccctaagatgaagggattcaccgtatcccttaaaagtctgaagcatttcgactgtaaggagaagcagaccttactgaaccaggctagggaggactttaaccaggacattgggtggtgtgtatctctgattactgattatcgcgtccgactgggctgtgggtcttttgccggttccttcctggagtattacgccgcagacatcagctaccctgtgcgtaagtccatccaacaggacgtccttggcactaagctgccccaattatcaaagggatccccagaggaaccagtggttggctgccctttgggacagagacagccctgccggaagatgctcccggatcgctctcgggctgctcgtgacagagctaaccagaaactcgtggaatatattgtgaaggcaaagggcgcagagagtcatctgcgcgctattctcaaatctcgtaaaccctcacgatggctgcaaaccttcttgagtagttcgcagtatgttacttgtgtggagacttacctggaagacgagggtcagctggacctggtggtgaagtacctgcagggggtctaccaggaagtgggcgcaaaagtcttgcaacggaccaacggcgatcgcataaggtttatactcgacgtgctcctgcccgagtgctgggagatgagagtgcgggctctggatcccgtcaggcgcaggtccaggcttcttgatccatgcgcagagatggagttgctacgaagttgccagcatcagggtgtgcgcactccgtcccttctgcgcgctcatcgatgtttcccggctagcgtgggccatcacctgtgtgatctatgcgggggaaggggcggactgcaggacggttag

SEQ ID NO: 23468 - DNA, 501 bp, Artificial Sequence
  Description of Artificial Sequence: Synthetic coding sequence
gtcctggctgcgtctcagaatgaagtgccggctcacccctggaaaaattggcctaccgacggacgagtggctctcgacgtgctctccgagggatccatctggagccaggagtcctccgccggaactggacgggcagataggtctctgcgtggcaaacctatggagcacgtgagctcgccttgcgatagcaactcatccagccttcctaggggcgatgtcctcggaagctccagacctcatcggcgacgcccatgtgtccagcaatccctcagcagctctttcacctgcgaaaaggaccccgagtgtaaggtagatcataagaagggccttcgaaagagcgagaatcccagagggcctctggtgctgcctgctggcggaggcgctcaagacgagtcaggttcccgaattcaccacaagaattggaccctggcatccaaacgcggaggcaacagtgcccagaaagcttccctttgcctgaatggctcgtctctgtccgaatag

SEQ ID NO: 23469 - DNA, 1539 bp, Artificial Sequence
  Description of Artificial Sequence: Synthetic coding sequence
atggctgagccaagcgtggaatcctcttctccaggcggttccgccactagcgacgatcacgagtttgacccttctgccgacatgctagtgcatgattttgacgacgagagaactctggaggaggaagaaatgatggaaggcgagactaacttttcttcagaaattgaggatctggctcgcgaaggcgatatgccaatccacgaactgctgtctctctatggctatgggagtaccgtgcgacttcccgaggaggatgaggaggaggaggaggaggaagaggaaggagaagatgacgaagatgccgacaacgatgataacagtggctgctccggtgagaataaggaggagaacataaaggactcttccgggcaggaagacgaaacacagtcgtccaatgacgacccatcgcagtccgtggcctcccaggacgcacaggagattatcaggccaaggcgctgcaagtactttgacaccaacagtgaagtggaggaggagagcgaggaggacgaagattacattccttctgaggattggaagaaagagataatggtggggagtatgtttcaagcagaaattcccgtggggatatgtagatataaggagaacgagaaggtgtacgaaaacgacgatcagctgctctgggatcctgaatacctccccgaggacaaagtgattattttcctaaaagatgcttcccgaaggactggcgatgaaaagggtgtggaggccatccccgaaggctctcatattaaggataacgagcaggcactatatgagttggttaagtgcaactttgacacagaagaagccctccggagattgaggtttaatgtcaaggccgctcgcgaggagctgtctgtatggacagaagaggagtgtcgaaatttcgagcaaggcctgaaagcttacggaaaggactttcatctgattcaggccaataaagtgagaactcggagcgtgggggagtgtgtagccttctattatatgtggaagaagtcggaacgttatgacttctttgctcagcagactaggttcgggaagaagaaatacaatctgcatcctggagtgactgactacatggatcggcttcttgatgagagtgagtcggccgcttcctcgagggcgccttcgcctcctcccacagcctccaacagttccaattctcagtccgagaaggaggacggcacagtgtccacagccaaccaaaacggtgtcagttcaaacgggccaggtgagatcctcaacaaagaggaggtgaaggtggagggcctgcatatcaacggccctaccggcggtaacaagaagcccctgcatgctgacatggatactaatggatatgaaacagacaacctcaccacagacccgaagttggcccacatgaccgcgagaaatgaaaacgattttgacgaaaagagcgagaggcccgctaagcgccgtcgtgtcaactcaaacggcaaagagagcccaggctctagtgagttctttcaggaggcggtttcacacgggaagtttgaagagttggagaacactgatgattag

SEQ ID NO: 23470 - DNA, 1113 bp, Artificial Sequence
  Description of Artificial Sequence: Synthetic coding sequence
atgccaattcatgagctgctgagcctctacgggtatggctcaaccgtgaggctacctgaggaagatgaggaggaggaagaggaggaagaagaaggcgaggatgacgaagatgctgacaacgacgacaattcaggttgtagcggagagaataaggaggaaaacattaaagactcctccggccaggaggatgaaacacagagctcaaatgacgatcccagccagtctgtagccagtcaggatgcccaggaaattatccgtcctcggcgttgcaagtacttcgataccaattcagaggtcgaggaagagagtgaagaagatgaggattacatcccttctgaagattggaagaaggagattatggtgggatccatgtttcaggcggagatccctgttggaatctgccgatataaggaaaatgagaaggtctacgaaaatgatgaccagctgctgtgggacccagagtacctccctgaggacaaggtgattatctttctcaaagatgctagcaggaggacaggagacgagaaaggcgtggaggccatcccagaaggctcccatataaaggacaatgagcaggcactttacgagctcgtcaaatgtaactttgacacggaagaggcactacgcaggctgagatttaatgtgaaggcagctcgcgaggagctcagtgtctggaccgaggaggaatgtcgtaacttcgagcagggattgaaggcatatggcaaagatttccacctcatccaggcgaacaaggttcgcacaagatcggtgggagagtgtgtggccttctattatatgtggaaaaaatcagaacgctatgatttctttgcgcagcaaacccgctttgggaaaaaaaagtacaatctccatccgggagtgaccgattatatggacaggcttctggacgagagtgagtccgccgcatcttcacgcgctccgtcccctccacctactgcatctaattcatcaaattcccagagcgagaaggaggatgggaccgtgagcactgcgaaccaaaatggggtctcaagcaacggccctggcattttgcagatgctgctccctgtccacttttcggcaatctcatcccgggctaacgcctttctgaagtag

SEQ ID NO: 23471 - DNA, 1590 bp, Artificial Sequence
  Description of Artificial Sequence: Synthetic coding sequence
atgtttatgttcaactggttcaccgactgtctgtggacacttttcctcagcaactatcagccgagcgtggagagttcctccccgggtggctcagccactagtgacgatcatgaattcgacccctcagccgacatgctggtgcacgatttcgatgatgagcggacacttgaagaggaagagatgatggaaggagaaactaatttctcttccgagatagaggacctcgcacgggaaggtgacatgcccatacacgagctcctctccctatatggctacgggtccacagtgcgtttgcctgaagaagatgaagaggaagaggaagaggaagaagagggggaagatgatgaggacgcagacaacgacgacaattcagggtgctctggagagaataaggaagaaaatatcaaggatagtagcgggcaagaggacgagactcagagcagcaacgacgatccatctcagagtgtagcaagtcaggacgcacaggagatcattagaccgagaaggtgtaagtatttcgatacgaacagcgaggtagaggaggagtccgaagaggatgaggattatatcccatctgaagattggaaaaaagagattatggtgggctcaatgtttcaagccgagatccccgttggaatctgcaggtataaggaaaatgagaaggtgtatgagaacgatgaccagcttctatgggacccggagtacctgcccgaagataaagtcatcatctttctgaaagacgcatcgcgcaggacaggagacgaaaaaggagtggaagccattccggaaggaagtcacatcaaggataacgaacaggccttgtatgagttagttaaatgcaattttgacactgaagaggccctgagacgcctgagattcaacgttaaagccgctagagaagaactgagcgtctggactgaggaagagtgtcgtaattttgagcagggcctaaaggcatatggaaaggactttcacctgatacaggcaaacaaggtgcgaactcgatctgtaggggaatgcgtggcgttttactatatgtggaagaaaagcgaacgctacgatttcttcgcacagcagacccgctttggcaagaaaaagtacaacctacatcccggagttactgattacatggatcgcctactcgacgagtctgaaagcgcggcatccagccgtgcacccagcccccctccaaccgcaagcaactccagcaattcacagtccgaaaaggaggacgggacagtatccaccgccaaccagaacggtgtgtccagcaacggccctggggagattctcaacaaggaagaggttaaagtagagggcctgcacatcaatgggccaaccgggggaaataaaaagcctctgcatgcggacatggatactaacggctacgagacagacaatctcacgaccgatcccaagcttgctcatatgaccgctcgcaatgaaaacgacttcgacgaaaagtccgagaggcccgcaaagcgccgtcgagttaatagcaacggcaaggaatcgccgggaagtagtgagttttttcaggaggccgtaagtcacggtaaattcgaagaactagaaaacaccgacgactag

SEQ ID NO: 23472 - DNA, 1461 bp, Artificial Sequence
  Description of Artificial Sequence: Synthetic coding sequence
atggatggcgcatcctctggcggaggtggttcctccgaaggagggggtgggagctccggctctgggtatggagttgtggcaaggttctcccagtgtttggccgaatttcgcacctggctgcggaccaattggctacgttttaacgcggacaagactgacgtgatgcttccgtccgtggaaagtagctccccaggcggttctgccacctcagatgatcacgagtttgatccttctgcagatatgctcgttcatgatttcgatgacgaacggaccctcgaagaggaggagatgatggagggtgaaacgaatttctcaagcgagatagaggacctcgctcgggaaggtgacatgccaatccatgagttgctgtccctttacggttatggttcgactgtcaggcttcctgaggaggacgaggaggaagaggaagaagaagaggaaggcgaagatgacgaggacgctgacaacgatgacaactccgggtgcagtggcgaaaacaaagaagaaaatatcaaagattcgagtggacaggaagacgaaacacagagcagcaatgacgacccttcgcaatccgtggcgtcccaggacgcacaggagataattcggccaagaaggtgcaagtatttcgacaccaactcagaagtcgaggaggagtcagaagaggacgaagactatatcccttcagaggactggaagaaggagattatggtcgggagtatgtttcaggctgaaatccccgtcggtatctgtcggtacaaagagaacgaaaaggtgtacgagaacgatgatcagctgttatgggatcccgagtacctccccgaagataaagtcatcatcttcttgaaagatgcatccaggaggactggggatgaaaagggggtggaggccatccccgaaggttcccacattaaggacaacgaacaggctctctacgaactggtgaaatgtaattttgataccgaggaggccctgaggcgcttgaggtttaacgtaaaagctgcacgagaggagctgagtgtctggacagaggaggaatgccgaaacttcgaacagggactcaaggcatatggcaaggacttccatctcattcaggctaacaaggtgcgcactcgcagcgtcggggagtgtgtggcattctattatatgtggaaaaagtctgagaggtacgacttcttcgctcaacagacgcggttcggcaagaaaaaatataatctgcacccaggcgtgaccgattacatggatcgactcctggacgagagcgaatcagccgctagttccagggccccatccccccctccgaccgctagcaacagcagcaactcccagtcagagaaggaggacggtaccgtttctaccgccaatcaaaacggagtcagctctaatggtcctggtattttgcagatgctgctacctgtgcatttttccgcaatctcttcacgcgcaaacgccttcctgaagtag

SEQ ID NO: 23473 - DNA, 1353 bp, Artificial Sequence
  Description of Artificial Sequence: Synthetic coding sequence
atgttcatgttcaattggtttacagattgtctttggaccctctttttgagtaactatcaaccctccgtggaatcaagcagccccggtggctctgccacaagtgatgaccacgagttcgacccttcagccgatatgctggtgcatgatttcgatgacgagcgtacacttgaggaggaggagatgatggaaggggagaccaactttagcagtgagatcgaagatctggctagggagggcgatatgccaattcacgagctcctctcactgtacgggtatggctcaacagtgaggctacctgaagaggacgaagaggaggaggaagaggaagaggagggggaggacgatgaggacgccgacaacgacgacaactccgggtgctctggagagaacaaagaggagaatatcaaagactccagcggacaagaggacgagacacagagcagcaacgatgatccctcccagtctgtagcatctcaggacgcccaagagattattcggccacgccgatgtaaatactttgatactaattccgaggtggaggaagaatccgaggaggatgaggactatatcccttcagaagactggaagaaagagatcatggtaggtagtatgtttcaagcagaaatccccgtgggcatttgtcgttacaaggagaacgaaaaagtgtacgagaacgacgatcagctgttgtgggacccagagtatctgcctgaggataaagtcattattttcctcaaagacgcaagccggcgaaccggtgacgagaagggcgtcgaggctatcccagaaggatctcatattaaagacaacgagcaagctctgtacgaattggtcaaatgcaactttgacaccgaggaagctctgcgccgactgcgtttcaacgttaaggctgctagggaagagctgagcgtttggactgaagaagagtgcaggaattttgagcagggtctgaaagcttacggtaaagacttccacctgatccaggccaacaaggtgagaactcgctctgttggtgagtgcgtggccttctattacatgtggaaaaaaagcgaacggtacgacttctttgctcaacagacacgattcggtaaaaagaaatataatctgcaccccggagtcacggattatatggataggctgttggatgaatcagaaagcgctgcgtcgtcacgcgctccttcccctcccccaacagctagcaacagttctaattctcagtcagaaaaagaggatggaaccgtgagcactgccaaccaaaacggggtgtcttccaatggcccaggcattcttcaaatgctgctgccagtgcacttctctgccatctcctccagagctaatgccttcctgaagtag

SEQ ID NO: 23474 - DNA, 1602 bp, Artificial Sequence
  Description of Artificial Sequence: Synthetic coding sequence
atgtgtatccgctgcctctgtcttatcggactgcagactgtttgtggtctgttcagctgccagataactcgtccttctgttgagtcgagttcacctgggggatctgccacaagtgatgaccacgagttcgatccttcggctgacatgttagtgcacgatttcgacgatgaaagaacgctcgaggaagaagagatgatggagggggaaacaaacttttcgtctgagattgaggacctggctcgggagggagatatgcctatccatgagttgttgtccctgtacggatacgggtccaccgttcgcctcccagaggaggatgaggaagaagaagaggaagaggaagaaggcgaagacgacgaagatgcggacaacgatgacaacagcggatgttccggcgaaaacaaagaagagaacatcaaagatagctccggccaagaggacgagactcagtctagtaacgatgaccccagccagtccgtggcctctcaagacgcacaagaaatcattcggcctagacgctgtaagtactttgacaccaactccgaagtggaggaagagtccgaggaggatgaggattacatcccctctgaagattggaagaaggagataatggttggtagtatgtttcaggctgagatcccagtgggcatttgtcgctataaggaaaatgaaaaggtctatgagaacgacgatcagctgttgtgggacccagagtatctacccgaggacaaggtgatcatatttctgaaggacgcctctagacgaaccggggatgaaaaaggtgtggaagcaatccccgagggatcccacattaaggacaatgaacaggcgctgtacgaactcgtcaagtgcaactttgatacagaagaggcactgaggcgcctcagatttaatgtgaaagcggctcgagaggagctgtctgtatggactgaagaagagtgtcgtaactttgaacagggcctgaaagcctacggaaaagatttccacctgattcaagccaataaggtgcgcacccgcagcgtcggcgagtgcgttgccttttattatatgtggaagaagtctgagcggtatgattttttcgcccagcagacacggtttggtaagaagaagtataatttgcatccaggcgtgaccgactatatggataggttgctcgatgagtccgaatctgccgcatctagcagggccccaagccctcccccaaccgcctcaaacagttcaaacagccagagcgaaaaagaggacggcactgtctctacggccaatcagaacggcgtgagctccaatgggccaggtgagatcctcaacaaggaagaggtgaaagtggagggtctgcatatcaatgggcctacaggcggtaacaaaaaacctctgcacgcagatatggacactaatggctatgaaactgacaatctaacgacagaccctaaacttgcacacatgactgctcgaaacgagaatgacttcgatgagaagtcagaacgacccgctaagcgcaggagggtcaactccaatggaaaggagagtccagggtcatccgagtttttccaggaagctgtgtcccatggtaaatttgaagaattggagaatactgatgattag

SEQ ID NO: 23475 - DNA, 1413 bp, Artificial Sequence
  Description of Artificial Sequence: Synthetic coding sequence
atgtttatgtttaactggtttactgactgcctatggacattgtttcttagcaactaccagcctagcgtggaatcaagctctcccggtggttccgccacctccgacgaccacgaatttgaccctagcgccgacatgctggtgcatgactttgatgacgagaggactcttgaggaggaagagatgatggagggagaaaccaacttttctagtgaaattgaggacctggcaagggaaggcgatatgcctatccatgagcttctctcattgtacggctacggttccacagtgcggttacccgaggaggatgaggaagaggaggaggaggaagaggaaggcgaagatgatgaagatgcagataacgatgacaacagcggctgcagtggagaaaacaaggaggaaaatatcaaggatagttctggtcaggaggacgagacacagtccagcaatgatgacccgagccagtctgtcgcgtctcaagacgcccaggaaataattcggcctcgaagatgtaaatatttcgatacaaatagcgaggttgaagaagaaagcgaagaagacgaagactatataccttctgaggactggaaaaaggagattatggtgggctccatgtttcaagccgagatccccgtcggaatttgcagatataaagaaaatgagaaggtctacgagaacgacgaccagctgttatgggacccagaatacctgcccgaagacaaggttatcatcttccttaaagacgcttccagacgaacaggcgacgagaaaggcgtcgaggcaatcccagaaggctcccatatcaaggacaacgagcaggccttgtatgagctggtgaagtgcaatttcgatactgaggaagccctgcggagactgagattcaacgtaaaggcagcgagagaggagctcagcgtgtggaccgaggaagagtgccgaaattttgagcagggcctgaaggcttacggcaaggatttccacctgatccaagctaataaggtgcggacacgctccgtcggtgagtgtgtggccttttattacatgtggaaaaaaagcgagcgctatgacttttttgcccagcagactcgatttggtaagaagaaatataatctgcacccgggtgttaccgattacatggatcggctactcgacgaatctgagtcagctgcctcctctagggcaccatctccacctccaactgcctctaattccagcaattcccagtcagagaaagaagatggcacagttagtacggctaaccagaatggggttagtagcaacggtcccggagaaatcctgaataaggaagaggttaaagttgagggactgcacatcaatgggcctacaggcatcctgcagatgctgctgcccgttcacttcagcgctatctcctcgcgcgctaatgcctttctgaagtag

SEQ ID NO: 23476 - DNA, 1698 bp, Artificial Sequence
  Description of Artificial Sequence: Synthetic coding sequence
atggacggggcttcctccggagggggtggttcctccgaggggggtggtggaagcagcggtagtggatacggtgtggtggcacggttcagtcaatgccttgctgaattccggacctggctgaggacgaactggctgaggtttaatgccgataagacagacgtcatgctgccctctgtggaaagctcaagtcctggcggaagcgcaacatcagatgatcacgaatttgacccgtcagcggacatgctggtgcacgacttcgacgatgagcgtacactggaggaggaggaaatgatggaaggcgagacgaacttctccagcgaaattgaggatctcgctcgggagggagatatgccgattcacgagttgttgagcctctatgggtacgggagcacagtgcggctacctgaagaggacgaggaagaggaggaggaggaggaggagggtgaagatgacgaggatgccgataatgacgacaactctggctgctcaggcgaaaacaaagaggagaatatcaaggattccagcggtcaagaggacgaaacgcaatccagtaatgacgacccatctcagtcagtggcatcacaagacgctcaggaaattatcaggcccagacggtgcaagtattttgacactaattccgaggtggaggaggagagtgaggaggacgaggactatattcctagcgaggattggaaaaaggaaatcatggtgggctccatgtttcaggccgagattcccgtcggaatctgcaggtacaaggaaaacgagaaggtttacgaaaacgacgatcagctgctgtgggaccctgagtatcttcccgaggacaaggtcatcatcttcctgaaggatgcaagtagacgcactggcgacgaaaaaggggtggaagcaataccagagggcagtcacatcaaggacaatgaacaggccctgtacgagctggtcaagtgtaacttcgatactgaggaggcacttagacgcctacgtttcaatgtgaaagctgctcgggaagagctgtccgtctggaccgaagaagagtgtaggaactttgagcagggtctgaaggcctacggaaaggattttcacctgatccaggccaacaaggtgagaacgagatcagtaggcgaatgtgttgccttctattatatgtggaaaaagtctgagcgttatgatttcttcgcccagcagacacgcttcggcaagaaaaagtataacctgcaccctggagtgaccgattacatggatagactactggacgagagcgaaagtgccgctagtagccgcgcaccctcccctccgcctacggcctcaaattcgagtaacagtcaatctgaaaaagaagacggtaccgtgtcgactgccaatcagaatggggttagctctaatggtcctggggagatcttgaacaaggaagaggttaaggtcgaaggtttgcacatcaatggacctacaggtgggaacaagaagccccttcatgctgatatggacactaatggatacgagaccgataatcttactacagatcccaaattagcacacatgacagctcgtaacgagaatgatttcgatgagaaaagtgaacgcccagccaagcgacgacgtgtgaacagtaatggcaaagaatctcccggttccagcgagttttttcaggaagctgtctcacatggcaagttcgaggaactcgagaacaccgatgactag

SEQ ID NO: 23477 - DNA, 1302 bp, Artificial Sequence
  Description of Artificial Sequence: Synthetic coding sequence
atggctgaaccatccgtggaatcttcatcacccggaggctctgccacgtcagatgaccacgagtttgacccgtcagccgatatgttagtgcacgatttcgacgacgaaaggacactggaggaggaagagatgatggaaggcgagacgaacttctcctcagagattgaagatctcgccagagaaggtgacatgccaattcacgaacttttaagtctctatggttatggatccaccgtgcgtctccccgaagaggatgaggaggaagaggaggaggaggaggagggtgaagacgacgaagacgcagacaatgatgacaactccggctgttcgggcgaaaacaaagaggaaaacattaaagacagcagtggtcaggaagatgagacgcagtctagtaatgatgatccatcgcagagcgttgctagtcaggatgcacaggagatcatcaggcctagacggtgtaaatattttgacacgaactctgaggtggaggaagaatccgaagaggacgaggactacatcccatccgaggactggaaaaaagaaatcatggtgggctccatgtttcaggcagaaattccggtcggcatctgtcgatacaaagaaaatgaaaaagtctacgagaacgatgatcagctcctgtgggatcctgaatacctgcctgaggacaaagtgataatctttttgaaagatgcgtcgcgcaggacgggagatgaaaagggcgtggaagccattcccgagggatctcatatcaaggacaatgaacaggctttatacgaactggtaaagtgtaattttgataccgaggaggctttgagaaggttgcgctttaatgtcaaagctgccagggaggagttgtccgtgtggactgaggaggagtgccgtaactttgagcaaggtctcaaagcgtatggaaaggactttcacctcattcaggcaaataaagtcaggacccgttctgtgggggaatgcgtagcgttttactacatgtggaagaaaagtgagaggtacgattttttcgctcagcagacccgctttgggaagaagaagtataatctccaccctggcgtaacagactacatggacaggctccttgatgaaagcgagtctgccgcatcatctcgcgcaccaagcccccctccgacagcctcaaacagttccaactcgcagagtgagaaagaggacggaaccgtatcgaccgctaaccagaacggcgtatcttctaacggcccaggcattctgcagatgctcctgccggtgcatttctctgctatcagcagtagggccaatgctttcttaaagtag

SEQ ID NO: 23478 - DNA, 1638 bp, Artificial Sequence
  Description of Artificial Sequence: Synthetic coding sequence
atggctgaggctagctcactcggcaggcaaagccccagggtggtgtcttgcctggaacattcactgtgcccaggcgagcccggactccagacaactgcggtcgtgtcaatgggaagcggtgatcaccagttcaacctggccgaaattcttagtcagaattatagcgtgcggggtgaatgcgaagaggcaagcagatgtcctgacaaacccaaggaggaactcgagaaagactttatcagtcaatccaatgatatgcccttcgacgagctgcttgccctctatggctacgaagcatcagaccccatttccgacagagaaagcgagggcggagacgtggcccctaatctgcccgatatgaccctcgataaagagcagattgcgaaggacctgctttccggcgaggaagaggaggaaacgcagagcagcgcagacgatctcacgccttctgtcacatctcacgaggccagtgatctcttccctaaccgcagcggctcccggttcctggctgacgaagatcgagagcctggaagtagtgcatcctcagataccgaagaggatagccttcccgcaaataaatgcaagaaggagattatggtgggcccacagtttcaggccgacctatcaaatctccatttgaataggcactgcgagaaaatctacgaaaacgaagaccaacttttgtgggacccaagtgtattgccagagcgtgaggtggaggagttcctgtaccgcgcagtgaaacgtaggtggcatgaaatggctgggccacaattaccagagggtgaggcagttaaggactccgagcaggccctttacgagctcgtgaagtgtaacttcaatgtggaagaggctctgcggagactcaggttcaatgtgaaggtgatccgagacggcctgtgtgcatggagcgaggaagagtgccgaaatttcgagcatggttttcgtgtgcatggtaaaaactttcatctgatacaggctaataaggtgcggacccgatccgttggggagtgcgttgaatactactatctttggaagaaatccgagaggtatgactatttcgctcagcaaacccgtctgggccgacggaaatatgttccctcaggaacaacagacgccgatcaggatctggacggttccgatcccgacgggcctggacggccacgccctgaacaagatactttaacgggtatgaggaccgacccactctctgtggacggtactgctgggggactggacgaaccgggagtagcatcagacggtcttccttcatccgaacccggtccttgctcatttcaacagctggacgagtcccctgccgtcccgctgagtcacaggcctccagccttggcggatccggcaagctatcagccagccgttacagctcccgagcctgacgcctcccctaggcttgccgtcgattttgcgctccccaaggagctcccattgatctccagccacgttgacctgtccggcgaccccgaggaaaccgtcgccccagctcaggtcgccctgagcgtgacggaatttggcctaatcggcatcggagacgtgaaccccttcctggccgcacacccaacttgccctgccccagggctgcactcggagcccctgtctcattgcaatgtaatgacctgttag

SEQ ID NO: 23479 - DNA, 1653 bp, Artificial Sequence
  Description of Artificial Sequence: Synthetic coding sequence
atggccgaagcttccttcggctcaagctccccagttggatccctctcctcagaagatcatgacttcgatcctacggcggaaatgctggtgcacgactatgacgacgagcgcacacttgaagaggaggagatgatggatgagggcaagaattttagttctgaaattgaagacctcgagaaggagggcaccatgccactggaggatctgctagcgttttacggatatgagcccaccatcccagctgtggctaacagttctgctaactcctcaccttcagagttggccgatgagctgcccgacatgaccttggacaaagaggaaattgccaaagatctgctcagtggggatgacgaggaaacccagtcctcagctgacgatctcactccttctgttacaagtcatgaaacctccgattttttcccccgtcccctgcggtctaacaccgcatgcgacggggacaaggagtccgaagtggaagatgtcgagaccgatagtggaaatagccctgaggatctccgaaaggaaattatgatcgggctgcagtatcaggccgagatccccccatatctgggtgagtatgatggcaatgagaaagtttatgagaacgaggaccagcttctgtggtgtcctgacgtggttctcgagtcaaaggttaaggaatacctggtggagacaagcctaagaacaggtagcgagaaaataatggatcggatttctgcaggcacccacacacgagataatgagcaggccctctatgaactactgaagtgcaatcataatatcaaggaggcgattgagcgctactgctgcaatggaaaggcttctcaggaaggaatgacggcttggaccgaagaggaatgtagaagcttcgaacacgcccttatgctctttggaaaagacttccacctcatccaaaaaaacaaagtccgcacgcggaccgtggcagaatgcgtggctttctactacatgtggaagaaatcagagcgttacgactatttcgctcagcagacacgatttgggaagaagcggtataatcaccatcccggtgtcacagactacatggacagactggtggacgaaaccgaagcgctcgggggaactgttaatgcaagcgcattgacgagtaataggccagagcctatccccgatcagcaactcaacatcctgaactcattcactgctagtgaccttaccgctctgaccaattccgtcgctacagtctgcgacccaaccgacgtcaactgcctggatgactcttttcccccactgggtaacacaccacgcggacaggttaaccatgtgccagtggtcactgaagagcttcttaccctaccctcgaacggtgaaagcgattgtttcaacctgtttgaaactggcttctatcattcggagctcaatcccatgaacatgtgtagcgaagaatcagaaaggcccgctaagcggctcaaaatgggcattgcagtgcccgagtcattcatgaatgaagttagcgtgaataacctaggagtcgactttgaaaaccatacccaccatattacatctgcaaagatggctgtttcagtcgctgactttggcagcctgtcagccaacgaaaccaacggctttatttcagcgcatgccctccatcaacacgccgcactgcactctgaatag

SEQ ID NO: 23480 - DNA, 1650 bp, Artificial Sequence
  Description of Artificial Sequence: Synthetic coding sequence
atggctgaggcttcattcgggtctagttctcccgtgggcagtctctccagcgaggatcatgattttgaccccactgccgagatgctcgtgcatgactatgatgacgaacggacgttggaggaagaagagatgatggacgagggcaagaatttcagctcagagatcgaagacctggagaaggagggaaccatgcccctggaggaccttctcgcgttttacggctacgagcccacgataccagccgtcgccaatagctctgctaactcctcccccagcgagttagctgacgaactcccagacatgacacttgataaggaggagatcgctaaggatctgctgtccggcgatgacgaagaaactcagtccagcgccgatgatctcacgccttccgtcacctcccacgaaacaagcgattttttccctcgtccactcagaagtaataccgcctgcgatggcgacaaggagtccgaagtggaagacgtggaaaccgatagtgggaactcccctgaggatttgcggaaggagataatgatcggtctgcaataccaggcagagattcccccttacctcggggagtacgacgggaacgaaaaggtgtatgagaacgaagatcagctgctgtggtgtcctgatgttgtgctggagtccaaggtgaaagagtacctggtagaaacttcccttcggactggctcagagaagataatggaccggataagcgccggtacgcatacacgggacaacgagcaggcactctatgagttgctgaaatgtaaccacaatatcaaggaggccatagagagatactgttgtaacggaaaggccagtcaggggatgaccgcttggaccgaagaagaatgcagatcttttgagcacgcattgatgctgttcgggaaagacttccatctaatccagaaaaacaaggtgcgaacacgcacagtggccgaatgtgttgctttttattacatgtggaagaagagtgagcgctacgactacttcgctcagcagactcgcttcggaaagaaaaggtacaaccatcaccccggtgtcacagattatatggaccggctggtggacgagaccgaggcactgggtgggactgtcaacgcctcagctctgacatcaaataggcctgagcccattccagatcaacagctgaacattctcaacagcttcactgcctccgacctgaccgcgctgacaaactcagtggccacggtctgcgatcccaccgatgtaaactgtctggacgacagctttccacctctgggaaatacccccaggggtcaagtgaaccatgtgcccgtggtgacagaggagctactaacacttccctccaatggagagtccgactgctttaacctgtttgagacaggcttctaccatagtgagcttaatccgatgaacatgtgtagtgaagaatctgaacggccagccaagcgcctaaagatgggcattgcggtgcccgaatcctttatgaatgaggtgagtgtgaataatctgggcgtagactttgagaatcacacccaccacatcaccagcgctaagatggcagtgtctgtcgcagactttggatctctgagtgctaatgaaaccaacggatttatttcagcgcacgccctgcaccagcacgccgctttgcacagcgagtag

SEQ ID NO: 23481 - DNA, 807 bp, Artificial Sequence
  Description of Artificial Sequence: Synthetic coding sequence
atggcccagccactttgcccacccctgtcagagagctggatgttatcagctgcatggggcccaactaggcggcctccacccagtgataaggactgcgggagaagcctggtgtctagcccagattcatgggggtccacccccgctgattccccggtcgcaagtcctgcccgacccggtaccctgcgcgatccacgcgcaccctcagtaggacggagaggcgcacgcagctcccggctggggtctggtcagaggcaatccgcaagcgaacgcgagaagttgcggatgaggacattggccagagccctgcacgagttacgcagattcttgcccccttcggtcgccccagcaggtcaatctctgactaagatcgagaccttgcgtctggccattcgttacatcggccacttgtctgccgtgctggggctgtcagaggaatcactgcaacggagatgccggcagagaggcgacgctggctcaccaagagggtgtccactttgtccagacgactgcccggctcagatgcagactaggacccaggcagagggacaagggcagggacggggtcttggacttgtctccgccgtgcgggctggtgcctcatggggaagcccccctgcttgccctggcgcaagagcggcaccagagccgcgagacccacctgcgctgttcgccgaggcagcttgccccgaggggcaggcaatggaacccagtcctcctagcccattattgccaggggatgtcctcgccttattagaaacttggatgcctctgtcccccctggagtggttacccgaagagccaaaatag

SEQ ID NO: 23482 - DNA, 2007 bp, Artificial Sequence
  Description of Artificial Sequence: Synthetic coding sequence
atggccgcaaatatgtatagagttggagactacgtgtattttgagaattcttcctctaatccctaccttgtgaggagaattgaagagctcaataaaacagccaatggaaatgtggaggctaaagttgtgtgtctcttcagaagaagagatatcagcagctcacttaattctttggccgattcaaacgctcgagaattcgaagaggagtccaagcagccaggcgttagtgaacagcagcgacatcagctgaagcaccgggagctgttcttgtcaaggcagttcgagtcactgcccgcaacccatatccgcggtaagtgcagcgtgaccctgcttaacgaaaccgatattttatctcagtacttggaaaaggaagattgtttcttttatagcctggtctttgaccccgtccagaaaaccttgctcgccgaccagggagaaatcagggtgggctgcaaatatcaggctgagatacctgacaggctagtggaaggtgagtccgataacaggaatcagcagaaaatggagatgaaggtttgggacccggataaccccctgacagatcggcagatcgatcagtttctggtggttgccagggctgttggaacattcgccagggcgcttgattgttcttcttctatccggcaaccgagcctgcatatgtctgcagctgccgcatcgcgagacataacactgtttcacgctatggacactcttcagagaaatgggtacgatctggcaaaagccatgagcaccctagtccctcagggcggtcccgtcctgtgtcgggacgagatggaggaatggtccgcctctgaagccatgctgttcgaagaggccctggaaaagtacggaaaagacttcaacgacattagacaagattttctaccttggaagtcccttgcatctatagtccaattctattacatgtggaagacaactgaccggtatatccaacagaaacggttgaaggccgcagaagccgacagtaagctaaagcaggtgtacattcccacttatactaagcccaatcccaaccaaattatctctgtgggtagcaagccagggatgaatggagcagggtttcagaagggactgacctgtgaatcctgccatactacccagtccgcacaatggtatgcatggggcccacccaacatgcaatgtcgactctgcgccagctgctggatctactggaaaaagtacggcggtctaaaaactcctacccagctcgaaggggcaacacgaggaactaccgaaccccactcaagaggacacctgagccggccagaggcccagtctttgtccccctacacgacttctgcaaaccgggctaagctgctagctaaaaaccgacagacttttttgctgcagaccactaagctcactcgactggccaggcgaatgtgcagagacctgttgcagcccaggcgggctgccaggcgcccatatgccccaattaatgccaacgccataaaggcagagtgcagtataagactgcctaaagcagcgaagactcccttaaaaatccaccccctggtgagattgccgttagcgaccatcgtgaaagacctggtggcccaggctcccctaaaaccaaagacacctcgaggaacaaagactccaataaatcgtaaccaacttagccagaatcgaggtctgggcggaattatggtgaaaagagcgtatgagactatggccggtgccggtgttcctttctctgcaaacgggagacccctggccagtggaatcagatcgtcctctcagcccgcagcaaaacggcaaaagctcaatccagcagacgctcctaatcctgtggtgtttgttgccaccaaagacacgcgggcactcaggaaggccctcactcatcttgaaatgcggcgtgccgctcgcagaccgaacttgcccttgaaagtcaagccgaccctcatcgccgtgcggccacccgtgccactacccgcacccagccaccccgcttcgacaaacgaacctattgtgcttgaagattag

SEQ ID NO: 23483 - DNA, 1488 bp, Artificial Sequence
  Description of Artificial Sequence: Synthetic coding sequence
atggagatgaaggtatgggaccctgacaatcctctgacagaccgtcagattgatcagtttctggtggtagccagagccgtggggactttcgccagggccctggattgttcgtccagtatccggcagcccagccttcatatgtccgctgccgctgcttctcgcgacatcaccctgttccacgcaatggacacccttcagaggaacgggtacgacctggccaaagcgatgagtacattagttcctcaaggaggacctgtgctgtgtagagatgaaatggaggaatggtctgcatctgaggctatgctgttcgaggaggcccttgagaagtatggcaaagattttaacgacatcagacaggattttttaccatggaaaagcctggctagtattgtgcagttttattatatgtggaaaaccacagacagatatattcagcagaagcggctgaaggccgctgaggcggattcaaaacttaaacaggtgtacatacccacttatacgaagcccaaccctaaccagataatcagcgtcggaagcaagccagggatgaacggggcaggcttccagaagggtctcacctgtgaaagttgtcacacaacccagtcagctcagtggtatgcgtgggggccacccaacatgcagtgtaggctttgcgcatcctgttggatctattggaaaaaatatggcggactgaagacacccacacagttggagggtgcaactagaggcacgaccgagcctcacagcaggggacacctgtcacgccctgaagcacaaagtctgagcccgtataccacttccgccaaccgcgcaaagctcctggcgaaaaataggcagacattccttctgcagaccacaaaactgacacggctggctagaaggatgtgtagagatctcctgcaaccacggagagcagcccgtcgaccttacgcccctatcaacgcgaatgcgattaaagccgaatgtagcatccgcctacctaaagctgccaagacccccttgaagattcaccctctggtgagactgccactggccaccattgttaaggatctggtggcccaggcgccacttaagcctaagacaccaagaggcaccaaaacccctataaatcgcaaccagttatcccagaatagaggcctcggcggtattatggtcaaacgagcctatgagaccatggccggagccggtgtacctttcagcgcaaatgggaggccactcgccagcgggatcagatcctcctcacagccagccgctaaacgccaaaagctgaatcctgcagacgctcccaatcctgtagtttttgtggccaccaaagataccagagcgctgaggaaggcccttacgcatctggagatgcgacgggcagcccgtcggccaaatctgccactgaaggtgaagcccacactgattgcggttaggcccccagtgcctttgcccgctccatcacaccctgcttccactaacgagccgatagttctggaagattag

SEQ ID NO: 23484 - DNA, 1488 bp, Artificial Sequence
  Description of Artificial Sequence: Synthetic coding sequence
atggagatgaaagtttgggatcccgataacccactcacggatcgccaaattgatcagtttctggtggtcgctcgcgcagtcggaacattcgccagggcacttgattgtagcagctctatccggcagcctagcttgcatatgtccgcagctgccgcatcccgagatattaccctgtttcacgcaatggacaccctccagcggaatgggtatgacttggccaaggcgatgagcactctcgtcccccagggtggccctgtgctctgtcgggatgagatggaagaatggtcagccagtgaagctatgctctttgaggaagccctggagaaatatggcaaagacttcaacgacattagacaggattttctaccatggaagagcctggcttcaattgtgcagttctactatatgtggaagaccaccgatcgatatattcagcagaaaaggctgaaagccgctgaagccgactccaaactgaagcaggtctatatacccacttatacgaagcccaaccctaaccagattatttccgtgggcagtaagcctggcatgaatggagccggtttccagaagggcttgacctgcgagtcttgccacactacccagtccgcccaatggtacgcctgggggcctccaaatatgcagtgtagactttgcgcgtcctgctggatctattggaagaagtatggaggattgaaaacccccactcaactggagggcgcaacccggggaaccactgaaccccacagcagaggccacctcagtcgcccagaggcccaatctttgtctccatatacaactagcgctaatcgtgctaaactgttggcaaaaaataggcagactttcctgcttcagactacaaaactgactcgcctggcccgaaggatgtgccgagacctcctgcagccccgtcgtgcagctagacgcccatatgctccaataaatgccaacgccataaaagctgagtgttcaatccgattgcctaaggcggctaaaacacccttgaaaatccacccccttgttaggttgcccctcgctactatcgtcaaggatttggttgctcaggctccgcttaagcccaagacaccccgaggaaccaagacaccaatcaaccggaatcagctcagtcaaaacaggggccttggcggaataatggttaaaagggcttatgaaaccatggccggagccggagtcccatttagcgccaacggacgacccctggcctcaggcatccgatcttcgtctcagccagccgctaagagacaaaaattgaaccccgctgatgctcctaaccccgtagtgttcgtcgccacaaaagatactagggccctgcggaaggctctgacacacctagaaatgcgcagggccgctagacgtcctaacctgccacttaaggttaagcctactttgattgccgtgcggccaccagtgcctctcccagcaccctcccatcctgccagcacgaatgagcctatcgttctggaggactag

SEQ ID NO: 23485 - DNA, 1761 bp, Artificial Sequence
  Description of Artificial Sequence: Synthetic coding sequence
atggctgccaacatgtatagggtaggcgactatgtatacttcgagaattcaagttccaatccctatctgatacgaaggatcgaggaacttaacaaaactgcctccggcaacgttgaagctaaggtggtatgcttctataggcggagagacattagcaacacactcatcatgctagccgacaaacatgcgaaggagatagaggaggagagtgagacaaccgtggaagctgacctgaccgataagcagaagcaccaactgaagcaccgtgaactctttctgagccggcagtacgagtcacttccagcaactcacatcagaggtaaatgtagcgtggccttactcaacgagaccgaatccgtgcttagctacctcgacaaagaagatacttttttctattccctggtgtatgatccaagcctcaagactctgttagccgacaaaggggagataagggtgggaccacggtatcaggctgacatccctgaaatgctcctggaaggagaatccgacgaacgagaacagagcaagctggaagtcaaagtgtgggatccaaattctcccctgacagaccgtcagatcgaccaattcctcgtggtagcgagggcagtcggcaccttcgctcgtgcgttggactgttcgagcagcgtgagacaaccttcactccacatgtcagctgctgctgcctctcgagatatcaccttgttccatgctatggataccctttaccgacactcatacgatttgtcttccgcaattagtgtgctggtgcccctgggtggaccagtgttatgtagagatgaaatggaagagtggtctgcgagcgaggcgtcactgttcgaggaggcactcgagaaatatggcaaagatttcaacgatatccgccaagactttcttccatggaaatccctcacttccattatcgagtactactacatgtggaaaactactgatcggtatgttcagcagaagaggctgaaagcagcagaggctgaaagtaagctgaagcaagtttacatccccacctacagtaagcccaacccaaaccagatctcaacatcaaatggtaagcccggagcagtgaatggggcagttggcaccacctttcagccccagaatcccctgctcggacgggcttgtgagtcctgttacgctactcagtcccaccagtggtattcatggggtcccccaaacatgcagtgcagactgtgtgctatttgttggctgtattggaagaagtatgggggtctaaagatgcccacccagtcagaggaggaaaagctctcaccctctccaacaactgaagaccccagagttcggagccacgtttccaggcaggccatgcaggggatgccagtaaggaacacaggcagcccgaagtccgcggtaaaaacacgacaagcattctttctgcacactacttactttactaagtttgccagacaggtttgtaaaaatacactcaggctccggcaagccgcaagacggcctttcgttgctataaattacgcagctattcgggctgagtacgcggaccggcatgctgaactttcaggaagccctctaaagtccaagagcacacgcaaaccactggcatgtattatcggctacttggagatccaccccgcaaagaaaccaaacgtgattcggtccaccccgtcactgcagacacctacaacaaagaggatgctcaccacacccaaccatacgagtctgtctattttgggcaaacggaactacagccaccacaacggactggactag

SEQ ID NO: 23486 - DNA, 1785 bp, Artificial Sequence
  Description of Artificial Sequence: Synthetic coding sequence
atggctgcgaatatgtacagagtgggggactacgtatactttgagaattcgtctagcaacccttatctcattcggcgaattgaggagcttaacaaaactgcaagtggaaacgtagaagccaaggtggtctgtttctaccggcgacgagacatatccaatactctgatcatgctggccgacaaacatgcaaaagaaatcgaagaagagagcgaaaccacagtcgaggctgacctgaccgataagcagaaacatcagcttaagcatagagagctgttcctgtcccggcagtatgagtccctgcctgccacgcatattagagggaaatgcagtgtagccttgctgaacgaaaccgaatctgtcctctcttacttagataaggaagatacgttcttttactctcttgtctatgatcccagcttaaagacactgctggctgataagggcgaaatacgcgtaggacctcgctaccaggccgacattcccgaaatgctgttggaaggcgaaagtgacgaacgcgagcaatctaaactggaagtcaaagtctgggatccaaactcacctctcactgaccgacagatcgaccagtttctggtggtcgcccgagcagttggaactttcgcgcgtgctctggactgttcttcctccgtgcgccagcccagtctccatatgtccgctgcggctgcctcacgggacatcacgctcttccacgccatggataccctctatcggcactcctatgatttgtcaagcgctataagtgtgctggttcccctagggggacctgtgttatgccgggatgagatggaagaatggagcgccagcgaagccagcctctttgaagaggcacttgagaagtatggaaaagatttcaacgatatcaggcaggacttcctaccttggaaatcgcttacgtccatcattgagtattactatatgtggaaaaccaccgaccggtacgttcagcagaagcggttaaaagcagccgaagccgagagtaaactgaagcaggtttacataccaacatactcaaagcctaaccccaatcagatatccacttctaatggcaaacctggcgcagtgaatggcgcagtggggactacatttcaacctcaaaaccccctgctaggccgtgcctgtgaatcttgttatgcgacccaatctcatcagtggtactcttgggggccacctaatatgcagtgtaggctctgtgccatttgctggctctattggaagaagtacgggggacttaagatgcctacacagagcgaagaggaaaaactgtctccgtctccgaccacagaggatccacgagttcgcagtcatgtgagcagacaggctatgcaggggatgcccgtccgcaatacaggctccccgaagagtgccgttaagacgcggcaggcattttttctgcatacgacctatttcacaaaattcgcccgtcaggtgtgtaagaacacactgagactcaggcaagctgccaggcgtccatttgtagccatcaactacgccgcaattagggccgaatatgccgaccgccacgcagaactctcaggtagccctctgaaatcaaagtctacccggaaacccctagcttgcatcatcgggtaccttgagatccatccagcgaagaagcctaacgtcataagatctacaccaagcctccagacacctaccacaaagcgcatgctgaccacaccaaaccatacttctctgtccatcttgggcaagcggaactacagtcatcacaatggcctcgacgagctgacctgttgtgtgtcggactag

SEQ ID NO: 23487 - DNA, 1548 bp, Artificial Sequence
  Description of Artificial Sequence: Synthetic coding sequence
atggccgcaaacatgtacagagtaggcgactacgtttatttcgaaaatagcagttccaatccatacctgatccgcaggattgaagaactgaataagacggcctccgggaatgttgaagccaaggtggtttgtttctatcgaaggagggatatttctaacaccctcatcatgctcgccgataagcacgctaaagagattgaggaggaaagcgagaccaccgtagaagcagacttgactgacaagcaaaaacatcaactgaaacatagagagctattcctctccaggcagtatgaaagccttccagctacacatatccgaggcaaatgttcagttgccttgttaaatgagaccgaaagcgtgttgagctacctggacaaagaggacacctttttctacagccttgtatatgatcccagcctgaagaccctgctggccgacaaaggcgagatccgggttgggccacgttatcaagctgatatacctgaaatgctgttggaaggagagtcagatgagcgggaacagagcaagctcgaggttaaagtttgggatccaaactctcccctgacagaccggcagatcgaccaattcttggtcgtggccagggccgtgggcactttcgcacgggctctcgactgttccagctccgttaggcaaccgtccttgcacatgtccgctgcagctgcgagtcgcgatataaccctgttccacgccatggacactctctatcgacactcgtacgacctttcctctgccattagcgtgttggtgccgttaggcggacccgtgctctgcagagacgagatggaggaatggtcagcctctgaggccagcctcttcgaggaagccctggagaaatacggcaaagacttcaacgatatccgtcaggacttcctgccatggaagagtctgacctcgattatcgagtattactatatgtggaagactaccgaccggtatgtccagcagaaacgcctgaaagcagcagaagccgagagcaaattgaaacaggtgtatatccccacttactcgaagcccaatccgaaccaaatctctacgtcaaatggcaaacctggcgctgttaatggagccgtgggaaccacctttcaacctcagaacccactgttaggccgagcatgcgagtcctgttatgcaactcagagtcaccagtggtactcttggggaccgccaaacatgcagtgtagactgtgtgctatttgttggttgtactggaagaagtatgggggactaaagatgccaacgcagtccgaagaagaaaaactgagtccaagccccacaaccgaagaccctagagtcaggtctcacgtgtcaaggcaggccatgcaggggatgccagtgagaaatacagggagtcctaaaagcgcggtgaaaaccaggcaggcattctttctccacactacctacttcacaaagttcgccagacaggtgtgtaagaacaccctccgcctgagacaagcagcacgcaggccgttcgtggccatcaattacgccgctatacgcgcagaatgcaagatgctgctgaactcctag

SEQ ID NO: 23488 - DNA, 585 bp, Artificial Sequence
  Description of Artificial Sequence: Synthetic coding sequence
atggctaagagcagccagcgaaagcagagggattgcgtgaatcaatgtaaaagcaagccagggctgtctaccagtatcccgctgaggatgagttcatacacattcaagagacccgtgacccgaatcacgcctcatcctggaaatgaggttcgctaccatcagtgggaggagtctcttgagaagccacagcaggtctgttggcagcgtcgattacagggattgcaagcttatagtagtgccggagaacttagctctactctggacctggcaaatacactgcagaagctggtgccaagctataccggcggtagccttctagaagacctggccagcggcctggagcacagttgtccaatgcctcacttggcttgcagttcagacgccgtggagatcatccccgctgagggggtagggatctcgcagctcctatgtaaacagtttctagtgaccgaggaggatatccggaagcaggaggggaaggtcaagacggtgagggaaagactcgcaatcgcattgatcgccgacgggctggccaatgaagccgaaaaagtcagagaccaggaaggcaggcccgaaaagcggtag

SEQ ID NO: 23489 - DNA, 1245 bp, Artificial Sequence
  Description of Artificial Sequence: Synthetic coding sequence
atgctaggcgctctgcccttgcctctgtctttgggtcagccgcctccatctccactactgaatcactctcttttcggggtcctgaccggaggcggtggtcagcccccaccagagccattgttgccaccaccaggtggccctggaccgccactagccccaggagagccagaggggccttctttgcttgtggcctcactcctgcccccacccccttctgatttactgccacccccaagcgcccctccttccaaccttctcgctagtttcctaccgttacttgccctgggccctaccgcaggagatggcgaaggatcagccgagggcgcaggtggccctagcggtgagccgttttccggcctcggcgaccttagccccctgctgtttcccccactgtctgctccccctacccttatcgctctcaattctgctctactcgccgcaactctagaccccccatcaggcactcctccacagccctgtgtcctgtccgcgcctcagccaggcccaccaacaagttctgtgacaactgctacaactgaccccggagcctcctccctgggcaaggccccatctaattcaggacggccaccgcaactcttgagtccgctcctcggtgcctcattgctgggagatctttccagtctcacctcttcccccggagcgctgccctccctcctgcagcctcctggtccactgctgtccggtcaactgggactgcagttacttccagggggaggcgctcctcctcctctgtctgaggcatccagcccactcgcctgcttactacagtcactgcagatcccacctgagcagccggaggcaccttgcttaccccctgagtctccggcttcagccctggagcccgagcctgccaggcctccgctaagtgcactagcccctccacatggatcaccggatccacctgtacctgaactcctcaccgggagaggatccggtaaacgcggacgtcgaggcggaggtggactgcggggaatcaacggtgaggcgcgacctgctcgtggaagaaaacccggatcaaggcgcgaacctggcagactggccctcaaatggggcaccagaggagggtttaatggccagatggagcggcaggaagaacctaccatcggctccatcatggggagctggcttaaaggggtactgtcccctcggattcacccactaccgggacccattttgaggacacttcgttgtcccagcagccagaaagtgtcatcatggccgtag

SEQ ID NO: 23490 - DNA, 3012 bp, Artificial Sequence
  Description of Artificial Sequence: Synthetic coding sequence
atgaacgggggaaacgagtcatctggcgctgaccgggcagggggtcctgtggctaccagtgtaccgattggatggcaacgatgtgtgagggagggggcagtgctttatatcagccccagtggcaccgaactgtcttcactggagcagacacgcagttacctgctgtctgatggcacttgtaagtgtggactggagtgtccacttaatgtgcctaaggtgtttaattttgatcctttagcacccgtcacacctggcggagcgggagttggtcccgcttctgaggaggatatgaccaaactttgcaaccatagacgcaaagccgtggccatggctaccctgtaccggtccatggagacaacatgttcccacagctctcctggagagggcgcaagtcctcagatgtttcacacagtcagtcccggtcctccatccgctcggccaccctgccgcgtgcctccaactacaccactgaatggaggtcctggttccctgcctcctgaacctccaagcgtgtcccaagcctttcctaccctggctggacccggaggactgttcccccctcgcctggcggaccccgtgcctagcggaggttccagctcgccgcgttttttacccaggggcaacgcacctagtccagcgccaccccctccgcctgcaatttcccttaatgccccttcctataactggggggctgcactgagaagcagccttgtgccaagcgacctcggcagccccccagcccctcacgcttcctcctcgccgcctagtgatcctcctttgttccattgttctgacgctttgaccccaccccctctcccaccctctaacaatctcccagctcaccccggacccgcttcacagccaccagtctccagtgctactatgcacctgcctctcgtcctcgggcctctaggcggagccccaactgtagaaggcccaggagcaccgcctttcttggcaagcagtctgctgtctgccgcagcaaaagcacagcatccgccactccctccgccatctaccctccagggccgacgacccagggcacaggcaccaagtgctagtcattcatcctcactcaggcctagccagcgaagacccaggcgtcccccaaccgtctttcgcctcttggagggtagagggccacagacgccacgccgatctcggccaagggctcccgctcccgtacctcagccgttctcccttcccgaacctagccagccgattttgccttctgtgttgagcttactaggactgccaacacctggcccatcccatagcgatggctcttttaacctgttggggagcgacgcgcacctgccacctccacctacactcagtagcggttccccgcctcagcccagacaccctatacagccctcactgcccggaacaacgagcggatccttaagttccgtcccaggggcacctgccccacctgccgcttctaaggcacctgtggtgccctctccagtattgcaatcacctagcgaagggttgggcatgggagccggtcccgcatgtcccttgcctcccctggccggaggagaggcttttcctttcccttcacctgagcaggggttggctctatcaggagcaggcttccccggaatgctcggtgctttaccactgccactgagcctcgggcagccacccccatcccctctcctgaatcatagcctgtttggtgtgctgaccgggggtggtgggcagccccctcctgagcccctgcttcctcctccgggaggacccggaccgccactggctccaggcgagccggaaggacccagcctgttggtggccagcctgctgcccccacctccttccgacctgctaccaccaccaagcgcgccacctagcaatctgctggcttcattcttgcctctgctggctctggggcctaccgctggcgacggcgaagggagcgcagagggcgcaggtggtcccagtggagagcctttttccgggctgggagatctgagccctctcctcttccccccactttccgcgcctccaacactgattgccttaaacagcgctcttctggccgctactttggacccaccctccgggacaccaccacagccatgtgtgcttagtgctccacagcccggtccaccgacctcatcagtaaccacagcgaccaccgacccgggtgctagtagcctcggaaaggctccaagcaatagcgggaggccccctcagctcctgtcacccctcctgggggcaagtttactcggagacttgtccagcctcacctcaagcccgggagcacttccctccctgttgcagccccctgggcctttgctgtctggacagctcgggttgcagctgctccccggtggcggagcgcctcccccactttccgaggcctcttctccccttgcctgtctgctgcagtctctccagatcccgcctgaacagccagaagctccatgtcttcctcccgagagccccgcttccgcattggagcccgaaccagcccgtcccccactgagcgccctcgcgccaccgcacggaagccccgacccgccagtgccggagctgctgacaggcaggggcagtggaaaaagggggaggcggggaggcggtggcctgcgaggcattaatggagaagcccgtcctgccagaggccgtaaacctgggtccaggagagaaccagggagactggctctcaaatggggaacaaggggtggctttaacggccagatggagcgcagccctaggcgcacgcatcactggcaacataacggtgaactcgccgagggcggagcagagcctaaagaccctcctccccctggtccgcactcagaagacctgaaggtccccccaggagtggtgcggaagtcccggagaggaagacgcagaaaatacaatccgactcgcaatagcaactcctcccgacaggatatcaccctcgaaccgtcaccaaccgcaagggcagcagtgcctctccctcctcgcgcacgaccgggaaggcctgcaaagaataagaggagaaagctggccccatag

SEQ ID NO: 23491 - DNA, 3012 bp, Artificial Sequence
  Description of Artificial Sequence: Synthetic coding sequence
atgaacggtgggaatgagagtagcggtgctgatagagccggtggccctgtggccacctcggttcccatcgggtggcagcgttgcgttcgggagggcgcagtcttgtatatctctcctagtggaacagagctcagctcactggagcagacgcgttcttacctgttgtccgacggcacttgtaaatgcgggctggagtgccctcttaacgtcccaaaggtgttcaatttcgaccctctcgcccctgtaacgccaggcggagccggtgtgggtccagctagcgaggaggatatgactaagctttgcaatcatagaaggaaagctgtagcaatggccaccttatatcgcagcatggagaccacctgcagccattcctctcccggagagggggctagcccgcagatgttccacactgtgagccctggacccccatctgccagacctccttgccgcgttccccctaccacgcctctgaacggagggcctggctcactcccccctgagccaccatcagtctcgcaggccttcccaaccctggccggtccaggagggctgttcccccctagactggctgaccccgtgcctagcggcggttctagcagtccaagatttttgcctagaggcaatgcaccgtcacctgcaccccctcctccccctgccatatccctgaacgcgccatcttataactggggcgcagccctgcgaagcagcttggtgccatccgatctgggctccccgccagccccacacgccagcagctcacctccttcggaccctcccctgtttcattgctccgatgcgctgacccctcctcctctgccaccgtccaataacctgccagctcatccagggccagcgagtcagccacctgtcagctcagccacaatgcatctgccgttagtcctgggcccactcggcggagcaccgacggtagaaggtcctggagcccctccctttctcgcctcctcactcctgtccgccgcagccaaagcacagcacccccctttaccaccccctagtaccctgcagggcaggagacccagggcgcaggcacccagcgccagccatagctcgtctctcaggccatcccagagacggccacggagacccccaactgttttcagattactcgagggtcggggaccccagacacctcggagatccaggcccagggctccagctcccgtgccccagccattttcattgcccgaacccagtcagccgatcctaccctcagtgctctctctgctgggccttccaaccccgggaccatcacactccgacgggagctttaatctcttgggaagcgacgcgcacctgccaccaccacccaccctttcctcaggatccccaccacagccgagacacccgatacagccttccttgccaggcactaccagcggctccctctcgtcagtcccaggggctcctgccccaccagcagcttccaaagctcctgtagtcccaagtccagtgctgcagagcccatctgagggactgggaatgggtgcaggcccagcctgccccctgccccctctggcgggaggagaggctttcccgtttcctagtccagagcaggggctcgcactgtctggcgctggctttcctggaatgctcggagcgttgcccttgcctctttccctcggtcagccacctccatccccgctgttgaatcattctttgtttggggtcttgacagggggaggagggcagcccccacctgagcctctgctgcccccacccggaggccctggcccaccgctggctccgggagagccagagggtccatcacttctcgtggcatctctgttacctccgcctccgtcagatcttctgcctccgccatcagcccctccgagcaacttgctcgcctcctttcttccgttactcgcacttggccctactgcgggagatggagaaggctccgccgaaggcgcaggcggtcccagtggcgagccctttagcggcctgggagatctctcgcccttgctgtttcctccattgagcgcgcctccaactctaattgctttgaactcagccctactcgctgcgacactcgatccaccgagcggaacacccccacaaccatgcgtcctctccgctccacagcctggtcctccaacttcttccgtcacaactgccacaactgatcccggagcatcgagtcttggtaaggccccatctaactcaggccgacccccacagctactgtccccgctattgggagcttctttgctgggggatctctcttccctaacctcttcccctggggctctaccctcactgttgcaaccacctggccctctactgtctggacaacttggcctgcaactgttgcctggtggcggtgctcctccacccctatctgaagcctccagcccgcttgcttgcttattgcagtctctgcagatcccaccagagcaacctgaggctccatgtcttccaccggagtcccccgcatcagcactggagcctgaacctgctaggccccctctgagcgcgctggcaccgcctcacggcagcccagatcccccagtgcctgagctcctcacgggcagggggtctggaaaacgaggcaggcgcggaggcggtggcctaagaggtattaacggagaagctaggcctgcacggggtcggaaacctggaagtcgacgggagcccggaaggctcgcacttaaatggggaaccagaggcggatttaacgggcagatggaaagatctccacgccgtacacatcattggcagcacaatggtgaactggccgaaggtggcgctgagccaaaagacccaccacctccgggaccgcattcggaggaccttaaggtaccaccaggcgtggtgcgcaaatctagaaggggacgtagacgcaaatataacccgactagaaatagcaacagttctcgccaggatatcacattagaaccatcaccaacggctcgcgctgctgtgccactgccccctagagcgcgtcccggtcgcccagcaaaaaacaaacgtcgtaagcttgcgccttag

SEQ ID NO: 23492 - DNA, 162 bp, Artificial Sequence
  Description of Artificial Sequence: Synthetic coding sequence
atgaacggcggaaatgagtcttccggtgccgacagggcgggtgggccagtggccacctccgtccccatcggttggcagcgctgtgtacgcgagggtgccgtcttgtacatctccccatctggcacagagctgtcctccctcgagcagacacggagctattag

SEQ ID NO: 23493 - DNA, 222 bp, Artificial Sequence
  Description of Artificial Sequence: Synthetic coding sequence
atgaacggcggaaatgagtcaagcggcgcagatcgggcaggtggccctgtggcaacatctgtgcctataggctggcagcggtgtgtgcgagaaggcgctgtgttatacatctcaccaagcggtacagagctgtccagtctggaacagacgcgctcctatctgttgtctgatggcacttgtaagtgcgggttggagtgccctctcaatgtcccgaaggtgtag

SEQ ID NO: 23494 - DNA, 447 bp, Artificial Sequence
  Description of Artificial Sequence: Synthetic coding sequence
atgaacggaggcaatgagtcctcaggagcggatcgcgctggaggccctgtagccactagtgtaccaatcggctggcagaggtgtgtgagagaaggcgctgtgttgtacatttctccttccgggaccgagctcagcagtcttgagcagacccggagttatctactgtctgacgggacctgtaaatgcggactagagtgtccactgaatgttcccaaggttttcaacttcgatcccttggcccctgtgacacctgggggagccggagtaggtcccgcttcagaagaggacatgacaaaattatgtaaccaccgcagaaaagcggtcgccatggctacactataccgctcgatggagactacatgttctcattcttcacccggtgagggggctagccctcagatgttccataccgtatcccctggaccaccaagtgcgaggcctccatag

SEQ ID NO: 23495 - DNA, 162 bp, Artificial Sequence
  Description of Artificial Sequence: Synthetic coding sequence
atgaatgggggaaacgaatcgtccggggcagatcgagccggaggcccagtcgcaactagcgtgcccatcgggtggcagaggtgtgtgcgcgaaggtgccgtgctgtacatcagccctagcggcaccgaactgagctcactggagcaaactcgctcttattag

SEQ ID NO: 23496 - DNA, 138 bp, Artificial Sequence
  Description of Artificial Sequence: Synthetic coding sequence
atgaacggtggcaatgagagcagcggcgctgatcgcgcagggggtccagtcgctactagcgtgcctatcggttggcagagatgcgtgagagaaggcgctgttctctacatcagcccatccggcacagagctgtcatag

SEQ ID NO: 23497 - DNA, 672 bp, Artificial Sequence
  Description of Artificial Sequence: Synthetic coding sequence
atgacttcagaagtgatcgaggacgagaagcagttctacagcaaagccaagacttactggaaacaaatccctcctacagtggacggcatgcttgggggatacggacatatatcctcaattgatatcaattcctcgcgtaaattcctccaaagattccttagggaggggccaaataaaacaggaactagttgtgcattagactgtggggctgggattggaagaataaccaagcggctgctgttacctttgtttcgagaggttgatatggtcgatattaccgaagatttcttggtgcaggctaagacctacctcggtgaagaggggaagagggtccgcaattacttctgctgcgggctacaagacttcaccccggaaccggattcatatgacgtaatctggatccagtgggtgatcggacacctgacagaccagcatctggctgaatttctacgtagatgtaaaggatcgctaaggcccaacggaataatagtcattaaggacaacatggcacaggagggggttattctcgacgatgtggatagcagtgtttgtcgggatctagatgtcgtacggagaattatctgctccgcaggtctgagcttattggccgaagagaggcaggaaaatctgccggatgagatctaccatgtgtatagcttcgcgttgcggtag

SEQ ID NO: 23498 - DNA, 438 bp, Artificial Sequence
  Description of Artificial Sequence: Synthetic coding sequence
atgacctctgaggttattgaggacgagaagcagttctacagcaaggccaagacctactggaaacagatacctccaacggtggatgggatgttgggaggatatggacacatctctagtatcgacatcaatagttctcgcaagttcttgcaacggtttttacgggagggccctaataagacaggcacatcatgcgctctggattgtggagccggtatcggaagaatcactaagcgactacttttgcctcttttccgtgaggtagacatggtggatatcactgaggacttccttgtgcaggcaaagacatatctgggcgaagaaggtaaacgcgcaacctcaccaataagtacctggccatcgtcatgtggtgccgcacgtgccgcttcagcacccacggccagcagttcctccaagacaacttggcctcggcgagcgtag

SEQ ID NO: 23499 - DNA, 672 bp, Artificial Sequence
  Description of Artificial Sequence: Synthetic coding sequence
atgacgagcgaggtcattgaggatgaaaaacagttctatagcaaggctaaaacgtactggaagcagattccaccgacagtcgacgggatgctcggcggttacggccacatctcatctattgacatcaactcctctagaaagttcctgcagcggtttctcagggaagggcctaacaaaactggcacctcttgtgctctggactgcggagcaggcataggccgaattacgaagaggctcctgcttccattgttcagggaggtagacatggtcgatataaccgaggacttcctggtgcaagccaaaacttatctgggcgaggaaggtaagcgagttaggaactatttctgctgcggtctccaggatttcacgcccgagccagactcatatgacgtgatatggatccagtgggttatcggtcatctgaccgaccagcacctcgcggagtttctgcgcagatgtaaagggtctctcaggcctaacgggatcatcgtgattaaggacaacatggcacaggagggggtcatattggatgatgttgactcctctgtgtgcagggatcttgacgtggtgcggcgaatcatttgctcagccggactgtcacttttggccgaggagaggcaagagaacctgcccgacgagatctaccacgtgtactcttttgcacttagatag

SEQ ID NO: 23500 - DNA, 672 bp, Artificial Sequence
  Description of Artificial Sequence: Synthetic coding sequence
atgaccagcgaagtaatcgaggacgaaaaacaattttactccaaggcaaagacctactggaagcagattccccctacagtggacgggatgctcggcggatacggacacatcagttccatcgacattaatagctcacgcaaatttctccagcgattcctgagagagggacccaataaaactggcacgtcctgcgccctggactgcggcgcagggatcggcagaatcaccaagcgactactcctgcccctgttccgcgaagtcgacatggtggatattacagaggatttcttagtacaggccaagacttatcttggagaagagggcaaacgggtgcgcaactacttctgttgtggcctccaagacttcacacctgagccagattcgtacgatgtcatatggatacaatgggttattgggcacttaactgaccagcacctcgccgagttcctccgcagatgcaagggctccctcaggccgaacggtatcatagtgatcaaagataacatggctcaggagggcgtgatcttagacgacgttgattcatctgtatgccgcgatctggacgtcgtcaggcgtatcatctgcagcgccggtttgtctcttctggccgaagagcggcaggagaacctgcccgatgagatctaccacgtatactcttttgccctgagatag

SEQ ID NO: 23501 - DNA, 1371 bp, Artificial Sequence
  Description of Artificial Sequence: Synthetic coding sequence
atggactctcggctccaggaaataagagagaggcagaagttacgtcggcagttgctggctcagcagctgggggcagaaagcgccgattcgatcggagcggtgctcaattcgaaagatgagcagcgggaaatcgctgagaccagagagacatgcagggcgagttatgacacctctgcacccaatgccaagcggaaataccttgacgaaggggagaccgacgaggacaagatggaggagtataaagacgagctggagatgcagcaggacgaggagaatctgccttacgaagaggagatctacaaagacagttcaaccttcctcaaggggacccagtccctgaatccccataacgattattgccagcacttcgtggataccggccacaggccccagaatttcatcagagatgtcggcctggcggaccgcttcgaagaataccctaaactgagggaactgataagactgaaagacgagctgattgcaaagagcaatacccccccaatgtacctccaggcagacatcgaagcctttgatattcgggagctgacacctaaatttgatgtcatcctgctagaacctcctcttgaggagtattatagggaaactggcattaccgcgaatgagaagtgctggacttgggatgatataatgaaactggagatcgatgagatcgcagcaccgaggagttttatttttctctggtgtggtagtggggagggtctggaccttggacgagtgtgcctcagaaagtggggatatcgtagatgtgaggatatctgctggattaagactaacaagaataaccccggaaagaccaaaactctagatcctaaggcggtgttccaacggactaaagagcactgcctgatgggcatcaagggcactgtaaagcggtcaactgatggtgatttcattcatgccaacgtagacatagacttaattattactgaggagcctgaaatagggaacatcgaaaagccagttgaaatctttcatattatcgaacacttttgcctcggcaggcgacgactccatctgttcggccgtgattctacaattcgtccaggctggctgactgtgggacctacactgacaaacagcaactacaacgccgagacatatgctagctactttagtgccccaaatagctatttgaccgggtgcactgaggagatagagcggctgcgccctaagtctccgcctcctaaatctaagtccgatcgtgggggtggagccccaagggggggaggacgaggtggcacctccgcagggaggggacgggagcgcaacaggtcaaacttccgcggtgaacgaggcggattcagagggggacgcggaggggctcataggggcggatttccccctcggtag

SEQ ID NO: 23502 - DNA, 3399 bp, Artificial Sequence
  Description of Artificial Sequence: Synthetic coding sequence
atgattgctactcccttaaagcacagcaggatctacctgcccccagaggcttcgtcccagcggcgaaaccttccgatggatgcgattttttttgacagtatccctagtggcaccctgacccccgtgaaggatctcgttaagtaccaaaattcaagtctgaaactgaacgaccacaaaaaaaaccagttcttgaaaatgaccactttcaataacaaaaacatcttccagagcactatgctgacagaggctaccacgagcaactcatcactggatataagtgccatcaaacccaataaagatgggctgaaaaacaaagcaaattatgagagtccagggaagatctttctgcgaatgaaggagaaagtgctaagagacaagcaggagcagccatcacgcaatagcagcttactcgaaccccagaagtccggcaataacgaaaccttcaccccgaacagggttgagaagaagaagctccagcatacctacctgtgcgaggagaaagaaaataacaagtccttccagtcggacgattcatctttaagagcctccgtccagggggtccctctggagagttccaataatgatatttttttgcctgtgaagcagaaaattcagtgccagcaggaaaaaaaagctccgttacacaatttgacatacgagttgccaaccctgaaccaggaacaagaaaacttcctggccgtcgaggcccgaaacaagactcttacacgggctcagctggctaaacagatctttcactcaaaagagagcattgtcgccaccacaaaaagcaagaaagatacttttgttcttgaaagcgtcgacagcgccgacgagcaatttcaaaacacaaacgcggagacactctccacaaactgcatccctataaaaaatggtagcctcctcatggtttccgacagcgagagaacaaccgaggggacctctcaacaaaaggtcaaggaaggaaacggtaaaacagtcccaggtgaaactgggctgcccggatctatgaaagatacctgcaaaatcgtactagcgacccctcgcctgcatattactataccacgccgttccaagcgaaatatctctaaactaagtcccccaaggattttccagacagtgacaaacggcctgaagaaaaatcaagtggtgcagctgcaggaatggatgatcaagagcatcaacaacaataccgccatttgtgtagaagggaaactgatcgacgtaacaaacatttactggcatagcaatgtgattattgagcgcattgaacataacaagttacgaaccataagtggaaatgtgtatatcctcaaaggcatgatcgatcaaatctcaatgaaagaggccggttatcccaactacttgattcggaaattcatgtttggattccctgagaattggaaggagcacatagacaacttcctggagcagctccgtgcaggagagaagaacagggagaagactaaacagaagcagaaaaccggcagatcggttcgggatattcgaaagtctatgaagaacgatgccagggagaatcagaccgataccgcccagagggctaccactacctacgattttgattgcgacaatctagaactcaagagcaacaagcactccgagtccccaggggctaccgaactgaatatgtgccactccaattgtcagaacaagcccaccttacggttccctgacgaccaagttaacaatactatacaaaatggtggaggcgacgatttgtcaaaccaggaactcatcgggaaaaaggagtataaaatgtcgagtaagaagctgaagatcggcgagagaacaaatgagagaatcataaaaagtcagaaacaggaaaccactgaggaattagacgtgtccattgacatcctaacctcgcgagagcagttcttcagtgatgaggagagaaagtatatggcaatcaatcaaaagaaggcttatatcctagtgacacccttaaagtcacggaaggtgatagaacaaagatgcatgcgctataatcttagtgctgggactataaaggcagtgacagatttcgtaattcccgagtgccagaagaagtcccccattagcaagtctatgggcacactggaaaataccttcgagggacataagtctaaaaataaagaggactgcgacgagcgagatctactgacagtgaatcggaagatcaaaatttcaaaccttgaaaaagagcaaatgctcactagcgatttcaaaaaaaacactcgactcctccctaagttaaaaaaaattgagaaccaggtggcaatgagcttctacaagcatcagtctagccccgacctgtctagcgaagagagtgagacagagaaagaaatcaaaagaaaggctgaggttaagaaaaccaaagccggaaacacaaaagaagcagttgttcacttgcggaagtccactagaaatacttcaaatattcctgtgattctggagcccgaaaccgaagagtccgagaatgaattctacattaaacagaagaaggccaggccaagcgtaaaagagactctgcaaaagtctggagtgaggaaggagtttccaatcaccgaggccgtggggtcagacaagactaataggcatcccttggaatgcctgcccggtctcatacaggacaaagagtggaacgagaaagaactgcaaaaactacactgtgcatttgccagccttccgaaacataaaccgggtttctggagtgaggtggccgctgctgtaggctctcgttctcccgaagaatgccagcgcaaatatatggaaaatcctaggggaaaagggtcacagaagcatgtcaccaaaaaaaagccggctaattctaaggggcaaaacggaaagaggggtgatgcggaccaaaagcaaacaatcaaaatcaccgcaaaagtgggcacattgaaacgtaaacagcagatgagggagtttcttgaacaattgcccaaagatgaccatgacgactttttttccaccacacccctccaacatcagagaatcctcctgccctcttttcaagactccgaagacgatgatgatattcttcccaacatggataaaaatcccactactcctagttccgtgatctttccccttgtgaaaacccctcagtgtcagcatgtctcccccggtatgctcggcagcatcaatcggaatgactgtgacaaatatgtattcaggatgcaaaaatatcataaatctaatggcggaatcgtctggggaaacatcaaaaagaaactggtcgagacggatttctctacacctaccccaaggcgtaagactccctttaataccgacctgggagaaaacagtggaattggcaaactcttcacaaacgccgtggagagccttgatgaggaagaaaaagattattacttcagcaactcggactccgcatag

SEQ ID NO: 23503 - DNA, 468 bp, Artificial Sequence
  Description of Artificial Sequence: Synthetic coding sequence
atgatagcgacacccctgaagcactccaggatatatctgccacctgaagcctccagccagcgtaggaacttgccgatggatgccatattctttgattccataccgagcggtactctcaccccggttaaggatctcgtgaagtatcagaactcatctctcaaactcaacgatcacaagaagaaccagttcctcaaaatgacaacctttaataataaaaatatcttccagagcacaatgctcactgaggcaacaaccagtaactcttccctggatattagcgctatcaaacccaataaggatggcctgaagaacaaggctaactacgagtctcccggtaaaattttcctgagaatgaaagaaaaggtgctgcgcgataagcaggaacagccgtcacggaatagctcactcctggagccacagaagtcaggaaacaacgagacatttaccccgaaccgtgtcgagaagtag

SEQ ID NO: 23504 - DNA, 702 bp, Artificial Sequence
  Description of Artificial Sequence: Synthetic coding sequence
atggcaggagtgagatcactccggtgttcacggggttgcgcgggtggctgtgagtgcggcgacaaaggcaagtgttccgattcttccttgctagggaaaaggttaagtgaagactcttccagacatcaactgctccagaaatgggcgagcatgtggagcagcatgagtgaagatgcatcagtggcggacatggagagggctcaactagaagaagaggccgcagccgcagaagaaagaccccttgtgtttctttgcagtgggtgtcggagaccactgggcgactctcttagctgggtggcgagtcaggaggatactaactgcatcctcctacggtgcgtatcttgcaacgtctcagttgacaaagaacaaaaactgtcaaagcgggaaaaagagaatggatgcgtacttgaaactctctgttgtgcagggtgctcgttgaacctgggatatgtgtaccgctgcacgcctaaaaatctggactacaaacgcgacctgttttgtctgtccgtggaagctatcgagagttatgtgctaggttcctcagaaaagcaaatcgtttcagaggacaaggaactgttcaacttggaaagcagggtcgagatcgaaaagtctctgacacagatggaagacgtgcttaaggcccttcaaatgaagctttgggaagcggagagcaagttaagtttcgccacttgcaaaagctag

SEQ ID NO: 23505 - DNA, 3150 bp, Artificial Sequence
  Description of Artificial Sequence: Synthetic coding sequence
atggatcatacaggcgcaatagatacagaagacgaggtgggtccgctggcacatctggccccatctcctcagtcagaagctgtggctcacgagtttcaggaactgtcacttcagagcagccagaatcttccccctctgaatgagagaaagaatgtcctgcaactgaggcttcaacagaggaggacccgggagcaactcgtggatcaggggattatgccccctctgaaatctcctgccgcttttcacgagcagattaaaagcttggagcgtgccaggaccgagaacttccttaaacacaagataaggagcagaccggatagatctgagctggtgaggatgcacattctggaggagacatttgctgaaccaagtcttcaggctacacaaatgaagctaaagcgcgcaaggctggccgacgacctcaatgaaaaaattgcgcaacgccctggtccaatggagctggtggagaagaacattctgccagtcgattcctccgtgaaagaagcaatcatcggagtcggcaaagaggactatccccacacacagggcgacttttcattcgacgaggactctagcgacgccctgagccctgaccagcctgcctcccaggagtcccaagggtctgccgcatcaccctcagaacctaaagtgagcgaatccccatcgcccgtcaccacaaatacgcctgcacagtttgcaagcgttagtcccaccgtgccagagttcctcaagacccctcccaccgcagaccagcctcccccacggccagcagcccctgtgctcccaaccaataccgtctcttccgcgaagccgggacccgctctggtgaaacagtcacacccgaaaaatcccaacgacaaacaccgctcaaaaaagtgcaaggaccccaaaccgagagttaagaagttgaaataccaccaatatattccccctgatcaaaagggcgaaaagaacgaacctcaaatggattccaattatgcacggttgctgcaacagcagcagttgtttctgcagctgcagatcctgtctcagcagaaacagcactataattatcaaaccatcctcccagcaccttttaagcccctaaacgacaaaaactctaattcaggtaactccgcccttaataatgccactccgaatacacctcgccaaaataccagtactcccgtccgcaagcccggtccattgccttcgtcactggacgacctcaaggtcagtgaactgaaaacagagctgaaacttcggggtctccccgtctcaggcaccaagcccgatctgattgaaagactcaaaccttaccaagaagtcaatagctcaggcctagctgctggcggtattgtcgccgtgtcatccagcgccatcgtgacatctaaccccgaggttactgtggccctgccagttacaacgttacacaacaccgtgacgtcttccgtctctacgctcaaagctgaactgcctccaactggaacttcaaacgcgacgcgggttgagaatgtgcactctcccttgccgattagccccagtccatcggagcagagctccctttctacagacgataccaacatggccgacacgttcacagaaatcatgacaatgatgtccccgagccagtttttgagttcctcacccctccgcatgacaaacaatgaagactcgctgagcccaacttcttccacactatcaaacctggagctggatgccgctgagaaggatcggaaattacaagagaaggaaaaacagattgaggaactcaaaagaaaactggaacaggagcagaagctggtcgaggttctgaaaatgcagctggaggtggaaaagcgaggccagcagcagcggcctctggaggctcaaccttcagccccaggccactccgtgaaatctgatcagaaacacggctcactgggcagcagcatcaaagatgaggcatcattaccggattgctcatcctctaggcagcccattccagtagcatctcacgcagtcggtcagcccgtgagcacagggggacagacccttgtggctaagaaagccgtcgtgatcaaacaggaagttcccgtcggacaggcagagcaacagtctgtagtctcacaattctatacttcgcctcaagctgggatgcagacccagccgcagattgcaactgctgctcagatccccaccgctgcgttagcgagcggactggccccaaccgtgccacagacccaggacacctttccccagcatgtcctgtcgcagccgcagcaagtgaggaaagtatttaccaacagcgcttcgagcaataccgtgcttccataccaaaggcatcccgcacctgccgttcagcagcctttcattaacaaggcctcaaattcagtattgcagagtaggaatgctccactcccatcccttcagaatgggcctaacaccccgaataagccatcttctccaccccctccgcagcaattcgtggtgcagcattccttgttcggctctcccgtcgccaagaccaaggatccccctcgttacgaagaggccatcaaacagacacgcagtactcaggcaccattgccggaaatatccaatgcccactcccagcagatggacgatctcttcgacatcctgattaagtctggggagattagcttaccaataaaagaggagccctcgcccatttccaagatgcgcccagtgacggccagcatcactactatgcctgtaaacaccgtcgttagtcgacctccccctcaggtgcagatggcccctccggtgagccttgagcccatgggaagtctgtctgcttccctggagaatcagctcgaagcattccttgacgggaccctcccgtccgcaaatgaaatacctcccctccagagtagcagtgaggatcgtgaacctttcagtctgatcgaggacctccagaacgacctgctgtcccattcagggatgctggaccactctcactccccaatggagactagcgaaactcagttcgccgcaggcacaccatgcctgtccctagacctgagtgactctaacctagataatatggaatggctggatattacgatgcccaactccagttctggcctgactccattatccacaacggcccctagcatgttcagcgctgacttcttagacccacaggatcttccactgccatgggattag

SEQ ID NO: 23506 - DNA, 3267 bp, Artificial Sequence
  Description of Artificial Sequence: Synthetic coding sequence
atgattgactctagcaagaagcagcagcaggggtttcccgaaattctgaccgccggagattttgagcctttgaaggaaaaggagtgtcttgagggctccaaccaaaaatcgttgaaggaggtcctccagctacgccttcaacagcggcgtacaagagagcagctcgtagaccagggaattatgccacctcttaagagcccggcagcttttcatgaacaaataaaaagtttggagagagcgcgtactgagaacttcctcaagcataaaattcggagccgcccagaccggtctgaactcgtgcgcatgcatatcttggaggagaccttcgccgaacctagtttacaagccacacagatgaaactcaagagagctagactggccgatgatctgaacgagaaaatcgcgcagcggcctgggccaatggagttagtcgagaaaaacattctccctgtagacagcagcgtcaaggaggctatcatcggagtcggaaaggaagactacccccacacgcagggtgactttagttttgacgaagatagcagcgacgcgcttagccccgatcagccagcttcccaggaaagtcaaggttccgcagccagtccaagcgagcctaaagtgagcgaaagcccatcccccgttactactaacactccagctcaattcgcgtcagtctcacctacggttccagaatttttaaaaactcctcccactgccgaccagcctccaccacgcccagccgctcccgttctcccaaccaatacagtttcaagcgcaaaacccggacctgccctggtgaaacagagccaccccaaaaatcctaacgacaaacaccgatcgaaaaaatgtaaggacccaaaacctcgggtgaaaaagttgaaatatcatcagtatatccctcctgatcagaagggcgagaagaatgagccacagatggacagtaactatgccaggctcttgcagcagcagcagctctttctacagctgcagatcctgagccagcaaaagcaacattacaattatcagactatcctcccggctccttttaaaccgctgaatgataaaaactctaacagtggtaattcagctctaaacaatgccaccccaaatacgcctagacaaaatacctctacgcccgtgcgaaaaccaggcccactgccttccagtcttgacgaccttaaggtctcggagctaaagacagagctcaagcttagaggtctcccggtgtctgggactaaaccggacctgatcgagcggctgaagccctaccaggaggtgaacagctccggtctggccgctggaggaattgtggccgttagctcttccgctatcgtgacgtccaacccagaagtcactgttgcgctgcccgtcaccactctgcacaataccgttacatccagtgtgtccactttgaaggccgaactgccacccactggcaccagtaacgcaaccagagtcgagaatgtccacagcccattacccatctctccgtccccaagcgaacagtccagtctttccaccgacgacaccaacatggccgacacttttacagagattatgacgatgatgtctccttcccaattcctttccagctcccccctcaggatgactaataatgaagatagcctgtctcccacgagttccaccttgagcaatcttgaactagacgccgctgaaaaagacaggaaactacaggagaaggaaaaacagatagaggagcttaagcgtaaactggagcaggagcagaaacttgtggaggtgctcaagatgcagctggaggtggaaaagagaggtcagcagcagcgaccactggaggctcagcccagcgctccaggacacagtgtcaaaagcgatcagaagcacggaagcctgggctcctcaatcaaagatgaggcctctctgcctgactgtagctcaagtcggcagccaattcccgtggcaagccacgctgtcggacagccagtgtccacaggtggccaaactctggtggctaaaaaggccgtggttatcaagcaggaagttccagtaggtcaggccgaacagcaaagtgtggttagtcagttctacgtgtccagtcagggccagccacctccagcagtggtggcccagccacaggcattgttgactacccagacagcccagctcctgctcccggtgagcattcaggggtcctctgtgacgtctgtgcagctgccagtcgggtccctgaagctgcagacctcgccccaggccggaatgcaaacacaaccacagatcgcgaccgccgcacaaattccgacagctgccctagccagcggcctggcgccaactgtgccgcagacccaggataccttcccgcagcacgttctgagccaaccacagcaggttagaaaagtgtttacaaacagtgcctccagtaacaccgtcctgccctatcagaggcatccggctcctgccgttcagcagccctttatcaataaagcgagcaattctgtgttacagtctcggaacgcgcctctgccatctcttcagaacggaccaaacacccctaacaagcctagtagccctcccccaccacagcagttcgtggtgcagcattcactctttgggtcccctgtcgctaagactaaggatcccccaagatacgaagaggcaataaagcaaaccaggtccacacaggcaccacttcccgaaatctctaacgcccattcccagcagatggatgacctgtttgacatcctcattaaaagtggcgagatctccctgcccattaaggaagagccctcacctatctctaagatgcggccagtaacagcctcgataaccactatgccagtgaacactgtggtcagtaggcctcccccacaggttcaaatggccccacccgtgagcttagagccaatgggctctctttctgcttctctcgagaaccagttggaagcattcctggacggaactttacccagcgcgaacgaaataccgcctctgcaatcatcctcagaagaccgcgagcctttctccctgatcgaggacctacaaaacgacctactcagccactctggcatgctcgatcattctcattcacccatggaaacttctgagacacagttcgctgcgggaactccttgtctctcccttgatctttctgattccaacttggacaatatggaatggctggacatcactatgccaaactcaagctcagggctcacacctctgtcgaccacggctccatccatgttctccgccgattttctggatccccaggacctcccgttgccgtgggattag

SEQ ID NO: 23507 - DNA, 1383 bp, Artificial Sequence
  Description of Artificial Sequence: Synthetic coding sequence
atgatagactccagcaagaagcagcagcaagggtttcccgaaattctgaccgccggagatttcgagcctctgaaggagaaagagtgcctcgagggatcaaatcagaagagcctcaaggaggtcctccagttgagactgcaacaacggaggacgcgggagcagctggtcgatcagggtattatgccccctttgaagtcacccgctgcattccatgaacagatcaaatcccttgagcgggcaaggactgagaattttctaaaacacaaaatccgctcgaggccagatcgctctgagctcgttcggatgcacatcttggaagagaccttcgccgagcccagtctccaggccacacagatgaagctgaaacgtgccaggctggccgatgatctgaacgagaagattgcgcagcggcctggtcccatggagcttgtggaaaagaatattctgccggtggattcttcagtcaaggaggctattatcggagtggggaaggaagactatccccacactcagggtgatttctcctttgatgaggattcctctgacgcactttcaccagatcagccagcctctcaggagagtcagggatccgccgcatcaccaagtgaacctaaggtgagtgaatctcccagccctgttaccacaaatacgcccgctcagttcgcctccgtcagcccaacagtgcctgagtttcttaagacacctcccaccgctgaccaacccccacctaggccagcagcgccagtgttgcccactaacacagtaagctccgctaagcctggaccggctctcgtgaaacagagccaccctaaaaaccctaatgacaagcaccggagcaagaaatgcaaggatcctaaaccacgagtcaagaagctcaagtaccaccaatacatcccaccagatcagaagggagaaaagaatgagccgcagatggactctaattatgctagattgcttcagcagcagcagcttttccttcagctccagatccttagtcagcagaaacagcactataactaccagacgatcctaccagctccattcaaatacggaggggcacatgccatattaaacgctggattcagtgtgtttatgcggaattacaagctcccaaaagttgaatgctgtcacttattcgtgctcagtaacgatttccacttctttgtaatcagagcgtaccatacggtgtccgaagtccatatggtacgagtggcatgcattccctttcagtttctaagctctaaaatagggtccgagttcctccaagttagaaacgctttttcgcagctttttatccagatttgtttactgctagaacatcagaacagcacccggtgctcagagaagagcgtgtcttctatcatccccggaatcaattcttag

SEQ ID NO: 23508 - DNA, 3732 bp, Artificial Sequence
  Description of Artificial Sequence: Synthetic coding sequence
atggaaaattgttctgcagcgtctaccttcctgacagactctttggagctcgagctggggactgaatggtgtaagcctccgtacttcagttgcgcagtggataacaggggcggaggaaaacacttttccggtgaaagctatctgtgctctggggctctgaagagactcattctgaacttagatccattacccactaacttcgaggaagacaccttggaaatcttcgggattcagtgggttaccgaaaccgcgctggtgaattctagccgggagctgtttcacttgttccgacagcagctgtacaatctggaaactttgctgcagtcctcctgcgacttcggtaaggtcagcacactgcactgtaaggcggataatatccgacaacaatgcgtcttatttttacactatgtgaaggttttcattttccgatacttaaaggtgcagaacgcagaaagtcatgtacccgtgcatccgtatgaggccctagaagcccagctacctagtgtactgatcgatgaactgcatggacttttattatatatcgggcatctctccgagctcccaagtgtgaatatcggtgcattcgtgaaccagaatcaaatcaagctttttccaccttcctggcatctgctccatctgcatctcgacattcactggcttgttttagaaatcctgtacatgctgggggaaaaactgaagcaggtggtgtatggacaccaattcatgaatttggccagtgacaacctcaccaatatttcccttttcgaggagcactgcgaaactctactttgtgatcttatatccttgagcttgaacaggtacgacaaagtccggagcagtgagagtctgatgagtgaccagtgcccatgcctgtgcataaaggagttgtgggtgcttctgattcatctattggatcaccgttctaaatggttcgtcagcgagtctttttggaactggctgaataagcttcttaagacactgctggaaaagagctccgacaggaggcggtccagcatgccggtcatccagtcccgggatcctttaggttttagctggtggatcattacccacgtggctagtttctacaaatttgatcgtcatggtgtgccggatgagatgagaaaggtggagagcaactggaattttgtagaggaattgctgaaaaagtcaatcagcgtccagggagtgattctggaagaacaactgcgcatgtacctgcattgttgcctcacgctctgtgacttttgggagccaaacatcgccatcgttaccatactttgggaatactacagcaagaatctcaacagttctttctctataagctggctgcctttcaaaggattggcgaacaccatgaagtcccctctgtccatgcttgaaatggtaaaaacctgttgttgtgataaacaggatcaagagctgtataagtcctcttcttcctacacaatcttcctctgcattctcgccaaggtggtgaaaaaggccatgaagagcaatggtccacatccctggaagcaagtgaaaggacgcatttactctaaatttcatcaaaagcggatggaagagctgacggaagtgggcctgcagaatttttttagtctctttctgttgctcgctgccgtcgctgaggtcgaggacgtggcatcccatgttctggatctgctgaattttcttaaaccagcctttgtaacatcgcagagggctctgatttggaagggtcacatggcattcttgttgatgtacgcccagaagaacctcgatatcggagtcctggccgaaaaattcagctgcgccttccgggagaaagctaaagaattcctggtgtctaagaatgaggaaatggttcagcggcaaaccatttggaccttgctgtctatctatatcgacggagtgcaggaagtgttcgagacatcttactgtctgtaccctagccatgagaaactgcttaatgacgggttcagtatgctgcttcgggcatgcagagagtctgaactacggactgtactgtcattcctgcaggccgtcctcgccagaatccgtagtatgcaccagcaactgtgtcaggagctgcagcgggataacgtagatctgttcgttcaatcgtccctttcagccaaggagcgccatttggctgccgtggcatctgccctgtggcggcactttttcagttttctgaagagtcaaagaatgtcacaagtcgttcctttcagtcagctcgcagacgctgcagccgactttacattacttgctatggatatgcccagtactgctcccagcgacttccagccacagccagtcataagcatcatccagctttttggctgggatgatatcatatgccctcaggtggtcgctcgctacttgagtcatgtgctgcagaactctactctgtgtgaagccctctcccattcaggctacgtgtcctttcaggcattaacagttcggagttggatccggtgtgtgctgcagatgtatatcaagaacctgtcagggcctgacgacctcttgattgacaagaacctggaagaggcagttgaaaaagagtatatgaagcagctcgtgaagctgacgcggttgctgttcaacttgagtgaggtgaaatctatatttagtaaggcacaagtggaatatctttccatcagtgaggatccgaagaaggccctggtccgattcttcgaagccgtgggggtcacgtatggaaatgtacaaacgctatcggacaagtcagccatggtaaccaaatcattagagtacctgggtgaagtgctcaagtatattaagccataccttggtaagaaggtgttttccgccggacttcagttgacatacggaatgatgggtatcctcgtgaaatcatgggcccagatttttgccacctcaaaagcacagaagctgctctttagaatcatagactgcttgcttcttccacatgctgtgctccaacaggaaaaggagctccccgctcctatgctgtccgctattcaaaagtccctgccgctctatctgcaggggatgtgcatagtctgttgtcaatctcagaatcccaacgcatatttgaaccaactcttaggaaacgtgatcgaacagtatattggtaggtttctccctgcttccccgtacgtgagcgatctggggcagcacccagtgcttctcgccctcagaaatactgctacaatacccccaatctcgtcgctcaaaaaatgcatcgtgcaggtgattcgcaaatcttacttagagtataaagggtcaagccctcctcccagacttgccagcattctggcctttattctgcaactattcaaggagactaacactgatatttatgaggtagagctcctgttgcccggaattttgaagtgtttggtcctagtgagtgagcctcaagtaaaacgtctcgccactgaaaatctgcagtacatggttaaggcttgccaagtgggcagcgaagaggaaccgtcctcacagctgacgtccgtgttccggcagttcatccaggattacgggatgcgctattactaccaggtgtattctatactcgaaacagtagcgaccctcgaccagcaggtagtcattcaccttatttctacattaactcaatcactcaaggacagtgaacagaaatggggcttaggcagaaatattgcacagagggaagcctacagcaaactattgtcacacctaggacagatggggcaagacgagatgcagcgtctggaaaacgataatacttag

SEQ ID NO: 23509 - DNA, 867 bp, Artificial Sequence
  Description of Artificial Sequence: Synthetic coding sequence
atgtcgtctaggaagcagggatcccagccaagaggtcagcagagcgccgaggaagagaatttcaagaaaccgacccggtcaaatatgcaaagatcaaaaatgaggggagccagttccggcaagaagacagcaggacctcagcagaagaatctggaaccagccctgcccggaaggtggggtggacggagcgctgagaaccctcctagcggctcggtgcgaaaaaccaggaagaacaaacagaaaaccccgggtaatggagacggcggatctacttcggaggccccacagccacctcgaaagaaaagagctcgcgctgatccaactgttgagagcgaggaagccttcaagaatcgcatggaagtgaaggtgaagatccctgaggaactgaagccctggttggttgaagattgggacctagtgacgagacagaaacagctttttcaattgcccgcaaagaagaatgtggacgcaatcttggaagagtatgcgaattgcaagaagagtcagggtaatgtggataataaggaatatgccgtcaatgaagtcgtggcaggcattaaagagtattttaacgtcatgctcggcacccagctcctctataagtttgagcgtccccaatacgctgagattcttctggcccaccccgacgccccaatgtcccaggtgtacggtgcaccacatcttcttcgcttgtttgtgcggatcggggcaatgctcgcttacacaccgctcgacgagaagagtcttgcacttctcctggggtatctccatgactttctgaagtacctggccaaaaacagcgcaagcctgttcactgcaagcgactataaggtggcttccgctgaataccaccgtaaggccttgtag

SEQ ID NO: 23510 - DNA, 813 bp, Artificial Sequence
  Description of Artificial Sequence: Synthetic coding sequence
atgagtagcagaaaacaggggagccagcccagagggcagcaatcagctgaagaggaaaacttcaagaaacccacgcgaagcaatatgcagaagaacttggaaccagcgctacccggacgatggggcggaagatctgcagagaaccctccttcaggaagcgtgcgaaaaactcgtaaaaataaacagaaaacaccaggtaacggtgatggagggagcacgtccgaagccccacagccgcctcgcaaaaaaagggctagggccgaccccactgtagaaagcgaggaagccttcaaaaacagaatggaggttaaggtgaagatcccagaggagctgaaaccctggcttgtcgaggactgggacttggttactcggcaaaaacagctgttccagctgcccgcaaagaagaacgtggatgccattctcgaggaatatgctaactgtaaaaagtcacagggaaatgtggataacaaagagtacgcggtgaatgaggttgttgctgggatcaaagagtactttaacgttatgctgggcacacaactgctgtacaaattcgagagaccacagtacgcggaaatcctgctcgcacaccccgatgcccctatgtctcaggtgtacggcgcaccgcatctcctgagactattcgtgaggatcggggctatgctggcctatacaccactcgacgagaagtcactggctcttctgctggggtacctacatgacttcctgaagtacctggcaaaaaatagcgccagtctgtttacagccagcgactacaaagttgcttctgcagagtatcatagaaaagctctgtag

SEQ ID NO: 23511 - DNA, 513 bp, Artificial Sequence
  Description of Artificial Sequence: Synthetic coding sequence
atggaggtgaaagtcaaaatccctgaggaattgaagccttggctggtggaggattgggatctggtgactcgtcaaaaacagctttttcagttgcctgccaaaaagaatgtcgacgccatactagaggagtacgcaaattgcaagaagagccagggtaatgtcgataataaggaatacgcagtgaacgaagtcgtcgccggaattaaagagtatttcaacgttatgctgggaacccagctgctttacaaattcgaacgcccacagtacgcagaaatcctccttgcccaccccgacgcccctatgagccaggtttatggggctccgcacctgctgagattgtttgtgcggatcggcgcaatgctggcctacacccctcttgatgagaagtcactcgccctcctgctcgggtacttgcacgactttctgaagtatttagcaaagaactctgctagtcttttcactgcgtcagactacaaagtagccagcgccgagtatcaccgcaaagcgctatag

SEQ ID NO: 23512 - DNA, 534 bp, Artificial Sequence
  Description of Artificial Sequence: Synthetic coding sequence
atgtcctccaggaagcagggttcacaacccaggggccagcagtccgcagaagaggagaactttaagaaacctactcgctccaatatgcagaggtccaagatgagaggggcttcctccggtaagaaaactgccggtccccagcagaagaatctcgagcccgctttgccagggaggtggggcggtcggagtgccgagaaccccccttccgggtcagtacgtaaaacaaggaagaataaacaaaaaactccagggaatggcgacggaggctcgaccagcgaggcaccccagcctccccgaaaaaaacgagcaagagccgatcctacggttgagtcagaggaggcctttaaaaatagaatggaggttaaagtgaagatccccgaagagcttaaaccctggctggttgaggactgggacttggttacacggcagaagcagctgtttcagctccccgctaagaagaatgttgacgctatccttgaggagtatgcaaactgtaagaaatcacagggaaacgtggacaataaggagtactag

SEQ ID NO: 23513 - DNA, 867 bp, Artificial Sequence
  Description of Artificial Sequence: Synthetic coding sequence
atgagtagcagaaagcagggaagtcagccacgcggtcagcagtccgctgaagaagagaattttaaaaagccgaccaggagtaatatgcagcggtctaaaatgcggggagcgagttcgggaaagaagaccgcaggccctcagcaaaagaatctggaaccagctctccctggcaggtggggaggacggtccgcggagaacccccctagcgggtccgtgagaaagacccgcaagaataaacagaaaactcccggaaatggcgacggtggatcaacatcagaggctcctcagccaccaagaaaaaagagagcgcgtgctgacccaaccgtggagtcagaggaggcattcaagaaccgtatggaggtgaaggtcaaaattccagaggagttaaagccctggcttgtagaggattgggatctcgtgaccagacaaaaacagttgttccagctcccagcgaagaagaatgttgatgcgatattagaggagtatgccaattgcaaaaaaagccagggtaacgttgataacaaggagtacgcagtcaacgaggtggtggccggaattaaggagtactttaatgtcatgctgggaacccagttgctgtacaaatttgagcgccctcaatatgctgaaattctgctcgctcaccctgacgcacccatgtcccaggtctacggcgctcctcaccttttgcgcttgtttgtgcggatcggggctatgctggcctacaccccactggatgagaagagtctggcccttcttctgggttacttgcacgacttcctgaagtacttagccaagaattctgcgtcattgtttacagcgtccgattacaaagtggcctcagcggaataccaccggaaagcactctag

SEQ ID NO: 23514 - DNA, 204 bp, Artificial Sequence
  Description of Artificial Sequence: Synthetic coding sequence
atgtccagtcggaagcaaggcagtcagccgagagggcagcagagcgctgaggaagagaattttaagaaacccactcggagtaatatgcagcggtctaagatgcgtggggcttcatccggcaaaaagaccgccggaccacagcagaaaaatctggaacctgctctccccggaaggtggggaggcaggtccgccgagaatccttag

SEQ ID NO: 23515 - DNA, 867 bp, Artificial Sequence
  Description of Artificial Sequence: Synthetic coding sequence
atgagcagtcgcaagcaggggtctcaacctcggggacaacagtccgctgaggaggaaaactttaagaaaccaacacgtagcaatatgcaacggagtaaaatgcgcggagcctcctctggaaaaaaaacagcaggcccacagcaaaaaaacctggagcccgcactgcctggcaggtggggcggtagatctgctgagaatccacctagtggctccgtgagaaagacacgtaaaaacaagcagaagacccctggaaatggggatggcggttctacttccgaggcccctcagcccccaagaaagaaacgtgcaagagccgaccctaccgtggagtcagaggaagccttcaagaaccggatggaggtcaaggtgaagatcccagaagaactgaaaccctggcttgtcgaagattgggacctggtaactcgtcagaaacaacttttccagctcccagccaaaaaaaatgtggacgcaattctcgaggagtacgcaaactgtaagaagagccagggtaacgtagacaacaaggaatacgcagtgaacgaggttgtcgcaggaatcaaagagtattttaacgtgatgcttgggacacaacttctctacaaattcgaaagacctcagtacgctgagatcctcctggctcacccagatgcgccaatgagccaggtctacggcgctccgcacttgctacgcctgtttgtgaggattggagcaatgctcgcgtacaccccccttgacgagaaaagcctggctttgcttctgggatatcttcacgactttctgaagtacctcgctaagaactctgcctccctcttcactgcttctgactataaggttgctagtgctgagtaccaccggaaagctctctag

SEQ ID NO: 23516 - DNA, 867 bp, Artificial Sequence
  Description of Artificial Sequence: Synthetic coding sequence
atgagctcaaggaaacagggatcccagccacgcggacagcagtccgccgaagaagaaaattttaaaaaacctacacgcagtaatatgcagagatccaaaatgcgcggagcttcttctgggaaaaagacggccggtccccagcaaaagaacctggagccagcgctccccggtcgttgggggggacgctccgcagaaaacccaccatcaggatcggtgaggaagacacgaaaaaataagcagaagacgccgggaaacggcgacggaggctcaacatctgaagcccctcagccacctcgcaagaagcgggcaagagccgatcctaccgtggaatccgaagaggcgtttaaaaatcgcatggaggttaaagtaaaaataccggaagagctcaagccttggctggtagaggactgggacctggtcacccgccaaaagcagctgtttcagcttcctgctaagaagaacgtagacgctatcctggaggagtatgctaactgtaagaaaagccagggcaacgtggacaataaggagtatgctgtcaacgaggtggttgcgggaatcaaggaatatttcaacgttatgcttgggacccagcttctttataaatttgaaagaccccagtatgcagaaattctgctggctcatcccgacgcccctatgagccaggtctatggggctcctcatttgctcaggctatttgtgcggatcggagccatgctggcatatacacccctggacgagaagagtcttgccctgctgctgggatacttacacgacttcttaaagtatctggccaaaaattctgcctctcttttcaccgcatctgactataaggtcgccagtgcagaataccaccgaaaggctctgtag

SEQ ID NO: 23517 - DNA, 537 bp, Artificial Sequence
  Description of Artificial Sequence: Synthetic coding sequence
atgtcctccaggaaacaggggtcgcaacctcgaggacagcagagtgccgaggaggaaaactttaagaagcctactagatccaacatgcaacgctccaagatgcgaggagcatcaagtgggaagaagaccgctggacctcagcagaagaacctggagcctgctctgcccggacgctggggcggacggagtgccgagaatcccccaagtggaagtgtgcgcaagaccaggaaaaacaagcagaagacccctggcaatggcgatggcggtagtacaagcgaagcgcctcagcctccaagaaaaaagcgcgcaagggcagatcctacagtagagtcagaggaggccttcaaaaataggatggaggtcaaggttaaaattcccgaggagctgaagccctggcttgtggaggactgggatctcgttaccagacagaaacagctttttcaactccccgcaaagaaaaatgtggacgcgatcctggaagaatacgccaactgcaaaaaatcccagggcaacgtggacaacaaagaatacgcctag

SEQ ID NO: 23518 - DNA, 867 bp, Artificial Sequence
  Description of Artificial Sequence: Synthetic coding sequence
atgtctagcagaaaacagggcagccagcctaggggccagcagtctgccgaagaggagaatttcaagaaacccactcgatccaatatgcagcggtccaaaatgcggggtgcctccagcggcaagaagactgcaggtcctcagcagaagaatctggagcccgctttgcccggtcggtggggaggtcgatccgcagagaaccctcctagcggctccgtacgaaagacaagaaaaaataagcagaagactccgggaaatggtgacggcggatctaccagtgaggcccctcagccacctcgtaagaaacgtgcccgtgcagatccaactgtcgagtctgaggaagcctttaagaatcgcatggaggtaaaggtgaaaattccagaggaactcaagccctggctagtcgaggactgggacctagtgaccagacagaagcagctgttccagttgcctgccaaaaaaaatgtggacgccattctggaagaatatgcgaattgcaaaaaatctcagggcaacgtagataataaggagtatgccgtgaacgaagtcgtggccggaatcaaggagtacttcaacgtgatgctgggaactcagctgctgtacaaatttgagcgacctcagtatgccgagatcctactggcccaccctgacgcgcctatgagccaagtgtatggagcgcctcatttgttgaggctgttcgtccgcataggcgctatgctagcctatactccgctagatgaaaagtctcttgctctgctacttggctatctgcacgatttcttaaagtacttggccaaaaatagtgccagcctgttcaccgccagtgactacaaagtggcttctgccgaataccacagaaaagctttgtag

SEQ ID NO: 23519 - DNA, 477 bp, Artificial Sequence
  Description of Artificial Sequence: Synthetic coding sequence
atgagtagcagaaagcagggaagccagcccagaggacaacagagcgctgaggaggagaattttaaaaaacccactaggagtaacatgcaaagatcgaaaatgcgcggagcctcaagtggaaagaaaaccgctggaccgcagcaaaaaaacctggagccggctctcccagggaggtggggcggacgttcggctgaaaacccaccctccggctccgtgcggaaaactagaaagaacaagcagaagactcctggtaacggggacggcggtagcacgtcagaggcccctcagcctcctagaaagaaacgggcacgggctgaccccaccgtggagtctgaagaagctttcaagaatcgcatggaggtgaaggtaaaaattccggaagagttaaaaccttggctggtggaggactgggatctcgtgacaaggcagaagcaactgttccagctgcccgctaaaaagaatgttgacgccatctag

SEQ ID NO: 23520 - DNA, 867 bp, Artificial Sequence
  Description of Artificial Sequence: Synthetic coding sequence
atgtcctctcggaaacagggatcacaacccagaggccaacaaagcgctgaggaggaaaactttaaaaagccaacgcgttctaacatgcagcgcagcaagatgcggggagcttccagtggcaaaaaaacagctgggccacagcagaagaacttagagcccgcactgcccggtcgttgggggggaaggagcgccgagaacccccctagcggaagtgtacgaaaaacgcggaagaacaaacagaaaacgccgggaaatggggacggcggatccacgagcgaggccccacagccgccaaggaagaagcgcgctagggctgatcctaccgttgaatccgaggaggcctttaagaatagaatggaggtgaaagtgaaaattcccgaagaactgaagccatggctggtcgaagattgggaccttgtcactcggcaaaagcaattgttccagctgcctgctaagaaaaatgtcgacgcgattttagaagaatacgcaaattgtaaaaagtcccagggaaacgtggacaacaaagaatacgctgtgaacgaagtcgtcgccggaataaaggagtactttaatgtcatgctgggaacccaactgctttacaagtttgagcggccacagtatgctgaaattctccttgcccatcccgacgccccaatgtcccaggtgtatggtgcgcctcatttactccggttgtttgtacgcattggcgctatgctggcctatacccccctcgacgaaaaatcccttgcattattgctcggatatctccacgactttttgaagtatttagctaaaaacagcgcttctcttttcacagctagtgactataaggtggcctccgccgagtaccatagaaaggcgctttag

SEQ ID NO: 23521 - DNA, 2046 bp, Artificial Sequence
  Description of Artificial Sequence: Synthetic coding sequence
atggcccctcaggtatggcgacggcgaacccttgaacgatgcctaaccgaggtaggcaaagccacaggaaggcccgaatgcttcctgaccatccaagagggactggcttccaagtttacaagcctgacaaaggtgctgtatgacttcaacaagatactagagaatggacgtatccatggaagccccctgcagaagctggtaatcgaaaacttcgatgatgagcagatatggcagcagcttgagctgcaaaatgaacctatattacagtactttcagaacgccgtgagcgaaactatcaacgacgaagacatctccctccttcctgaatctgaggaacaggagcgcgaagaagacggcagcgaaatcgaagctgacgataaagaggacctcgaagatctggaagaggaggaagtgagcgatatgggcaatgacgatcccgaaatgggtgaaagagcagagaattcttctaaatctgacctgagaaagtccccagtcttcagtgacgaagatagcgatctggacttcgacatcagtaagttagagcagcaatccaaagtgcagaataagggacagggcaagcctagagagaagtctatcgtcgatgataagttcttcaagcttagtgagatggaagcatacctggagaatattgagaaggaagaggagcgcaaagacgacaacgacgaagaggaggaagatatcgactttttcgaagacatcgattccgacgaagatgaggggggactgtttggttctaaaaaactcaagtcaggcaaatcctccagaaaccttaaatacaaggacttctttgaccccgtggagtctgatgaagacatcaccaacgtgcacgacgatgaactcgactccaataaagaagatgacgagattgccgaagaggaggcagaggaactctccatctctgagacagacgaagacgatgatctgcaagaaaacgaggacaacaaacagcataaagagtctctgaaacgcgtaaccttcgccctgcctgatgatgctgaaaccgaagatactggagtgctgaatgtgaaaaagaactccgacgaggtgaaaagcagcttcgagaagcgacaggagaagatgaatgaaaagatcgctagcctggagaaggagctcttagagaagaagccctggcagctgcagggcgaagtgacggcacagaaaaggcctgaaaacagcctcctggaagaaactttgcattttgatcatgctgtcaggatggccccagtgattactgaagaaactactctgcagttggaggatatcattaagcaacgtatccgggaccaggcgtgggatgacgtggtccgcaaggaaaagcctaaagaagacgcctacgagtacaaaaaacgcctcacgcttgaccacgagaagtctaaactaagcctagcggaaatctatgagcaggagtacattaagcttaaccaacagaaaacagccgaggaggaaaacccagaacacgtggaaattcaaaaaatgatggatagcctgtttctgaaacttgatgccctttcgaattttcattttattcccaagcctcccgtcccggaaatcaaggtggtttctaatctgcccgctatcactatggaagaggtggctcccgtctctgtcagcgacgccgctctcctggcccctgaggagattaaagagaaaaacaaggctggtgacatcaaaactgccgctgagaagaccgctacagataagaagcgggagagaagaaagaagaaataccagaaacggatgaagatcaaggaaaaggagaaacgtcgcaagctactggagaaatcctccgtagaccaagccggaaagtatagtaaaacagtagccagcgagaaactgaaacagttaaccaagacaggcaaggctagctttataaaggatgaaggcaaagacaaagctctgaagagctcccaagcttttttttctaagctccaagaccaagtgaaaatgcagatcaacgatgccaagaagactgaaaagaagaagaaaaaaaggcaggacatttccgtgcataagttgaaactgtag

SEQ ID NO: 23522 - DNA, 720 bp, Artificial Sequence
  Description of Artificial Sequence: Synthetic coding sequence
atgccgaagagtaagcgagacaagaaagtctcactgacaaagactgcaaagaaagggctcgaattgaaacagaatctgatcgaggaacttaggaaatgtgtggatacgtataagtacttgttcatattttctgtggccaacatgcggaactctaaactcaaggacatccgcaacgcttggaagcattccaggatgttcttcggcaaaaataaagtgatgatggtggctctgggtagatctccatcagatgagtacaaggacaatcttcatcaagtatccaaacggctgagaggcgaagtggggttactgtttaccaacagaaccaaggaagaagttaacgaatggttcaccaagtataccgagatggactacgctcgcgctggaaataaggcagccttcactgtgagcctagatcctggaccccttgaacagtttccacactctatggagccccaactacgtcagctaggcttgcctaccgccctcaagaggggggtcgtcactctgctgtcggactatgaagtctgcaaggagggcgacgtcctgactcctgagcaggctcgggtcctcaagctctttggatacgagatggctgaattcaaggtgacaatcaaatatatgtgggatagtcagtctggccgattccagcagatgggagacgatctccccgaaagcgcttccgagtcgactgaggagtcagactccgaggatgatgactag

SEQ ID NO: 23523 - DNA, 621 bp, Artificial Sequence
  Description of Artificial Sequence: Synthetic coding sequence
atgagtactggctccgtgagcgatcctgaggagatggagttacgcggtctccagagagaatatcctgtgcccgcttctaagaggcctcctctgagaggcgttgagcgctcctacgccagtccatctgataatagcagtgccgaggaggaagaccctgacggggaagaggaaagatgtgctttaggcacagcaggaagcgccgagggctgcaaacggaagagacctcgcgtggctggaggaggcggagcaggcggatccgccggtggtggaggaaagaagcctctgccagccaaggggtccgccgcagaatgcaaacaaagccaacgcaacgctgccaacgcgagagaaagggctaggatgcgcgtgctgagcaaagcattcagtaggttgaagaccagccttccatgggtacctccagatactaaactctcgaagctggacaccctgcgtctcgcgagcagttatatcgcacacctgagacagctgctccaggaagaccgctatgagaatggctatgtgcaccccgtcaacctgacctggccctttgtggtgagtgggcgtccagattcagatacaaaagaggtgtctgctgcgaaccggctctgcggtacaacagcatag

SEQ ID NO: 23524 - DNA, 249 bp, Artificial Sequence
  Description of Artificial Sequence: Synthetic coding sequence
atgagtcaagctggggctcaggaggctcctatcaagaaaaaacgccctcctgtaaaagatgaggacctcaagggagccagaggcaacctgaccaagaatcaggaaatcaaatctaagacatatcaggtcatgcgtgaatgcgagcaagctgggagtgccgcaccctccgtcttcagtagaactaggaccggcaccgaaacggtattcgaaaagcccaaggccggacccaccaagtcagtgttcgggtag

SEQ ID NO: 23525 - DNA, 2508 bp, Artificial Sequence
  Description of Artificial Sequence: Synthetic coding sequence
atggccagtctgggggcaaatccgaggcgtaccccacaggggcctcgccctggtgctgcctccagcggttttcccagcccggctccagttcccggtcccagagaagcggaagaggaagaggtcgaggaagaggaagaactggcagagatacacctgtgcgtgctctggaacagtggttacctcggaatagcttactatgacacgtcggatagcaccattcactttatgcccgacgcacccgatcacgaatccctgaaattgcttcagagggtgctcgatgagatcaatccccagtcagttgtgacgagtgcaaagcaggatgagaatatgaccaggtttctggggaaactggcttctcaggagcacagagagcctaagcgtccagaaataatcttcctgcccagtgtggacttcggccttgaaatcagcaaacagcgactgctgtctgggaactactcttttatccccgacgcgatgacggccacagagaaaatcctctttctgtccagcatcattccatttgactgcctgctaactgtccgagcactcggcggtctgctcaagttcctcgggaggaggcgtattggggtcgaactcgaggactataatgtatcggtgcccatcctggggttcaagaagttcatgcttacacacctggtgaacattgaccaggatacctactccgtgctgcagatctttaagtccgaaagtcacccatcggtctacaaggtggctagcgggttgaaggagggcctgagtctatttgggattcttaaccggtgccattgtaagtggggggagaaacttttgcgcctttggttcacaagaccaacccacgacctgggcgaactgtcctccagattggatgtcattcaattttttcttctccctcagaacctggacatggcccagatgctgcaccgactgctgggccacatcaagaacgtacccttaatcttgaaacgcatgaaactgagccacacaaaggtgagcgactggcaagtgctgtacaaaaccgtatactccgccctggggctcagagatgcttgtaggtccctcccccagtctattcagctcttccgggacatcgcacaggaattttctgacgatctgcatcacatcgcttctctcattggcaaggtggtggacttcgagggctctttagcagagaacagatttacagtcctacccaacatcgaccccgagattgacgaaaagaaacgtcgcttgatggggctcccgtcctttttgaccgaggtggcgcgaaaggaactagagaatctcgactctcgaatcccctcttgtagcgttatctacattcctctgatcggctttctgctctcgattcctagacttcccagcatggttgaagcctccgatttcgaaattaacggtcttgactttatgtttctgtccgaggaaaagcttcactacagaagcgcgaggacaaaggagcttgatgctctgctgggtgacttacactgtgagatcagagatcaggagacactgctgatgtatcaattacagtgtcaggtgctggctagggcagccgttctcactcgggtgctggacctggcaagccggctggatgtgttgttggcgctcgccagcgccgcacgggattatggatatagccgtcccagatacagtccgcaagtgttaggggttagaattcaaaatggacggcatccactcatggaactgtgtgccaggacctttgtccccaatagcacagaatgcggtggtgataaaggtagagttaaggtgattacgggcccaaattcaagcggcaaatctatctacctaaaacaagtagggttgatcacattcatggcgttggtgggctccttcgtccccgctgaagaggctgaaattggagcggtggatgccattttcacccgcatccatagttgtgagagcatctccctgggcctttcaacctttatgatcgacctgaatcaacaggtcgccaaggcagttaacaacgctacagcccagagcctcgttcttatagacgagtttggcaagggaactaacactgtagacgggctggccctgcttgccgcagtactgaggcattggctcgcgagaggacccacatgcccccacatttttgttgctactaattttctctccttggtgcagcttcaattgctccctcagggacctctcgtccagtacctcacaatggaaacatgcgaagatggcaacgacctcgtattcttttaccaggtctgtgaaggcgttgctaaagcctcacatgcaagccataccgccgctcaggccggactgcccgataagctcgtggccagaggaaaagaagttagtgacttaataagatcagggaagccaattaagccagtgaaagacctgcttaaaaagaatcagatggagaattgccagacactagtggacaagtttatgaagctggatctcgaagatccaaatctagaccttaacgtgttcatgagtcaggaggttctcccagctgccactagtatcctttag

SEQ ID NO: 23526 - DNA, 2469 bp, Artificial Sequence
  Description of Artificial Sequence: Synthetic coding sequence
atggccagcctcggtgctaaccctcgacgcaccccccaagggccacgtcctggggctgcgagctctgggttccccagccccgcacccgtgccagggcctcgtgaggctgaagaggaagaggtggaggaagaggaggagttggcagaaatacacctgtgcgtcctttggaactcaggttatcttggcatagcttactacgatacctctgatagtacaattcattttatgcctgacgcccctgaccatgagtcactgaagctgttgcaacgcgtgttagacgaaatcaacccacagagtgtagtgacctccgcaaaacaggatgagaatatgacgcgattcctgggaaagctcgcatcccaggagcaccgtgaaccaaaacggccagagatcatctttctaccttccgtggattttggtcttgagattagcaaacagcgactgctcagcggtaactatagcttcatccccgatgccatgacagctacggaaaagatcctgtttctttcctctattattccctttgattgtctgctgacaccacccggtgacctgcggtttaccccaattccactgctgatcccatcacaggtaagggcccttggtgggctccttaaattcctaggcaggcgtagaataggtgttgaattggaggactacaacgtgagcgtgcctatcctgggattcaagaagttcatgctcacccatctcgtaaacattgaccaggacacatatagcgtgctgcagattttcaagtctgagagccatccttccgtgtataaagtagcttccggattgaaggagggtctgagtttattcggtatcttgaatcgctgtcactgcaagtggggcgagaaactgctccgactttggttcactagacccactcacgatctgggagagctttctagccggctcgatgtgatacagttctttttactgccacagaatttggatatggcacagatgcttcaccggttgcttggccacatcaagaatgtgcccctgattttgaaaagaatgaaattgtcacatactaaagtgtcggactggcaggtcctctataagacagtgtactcggccttaggcctcagggatgcctgcaggtcactgcctcagtccatccagctgttcagagacatagcacaggaattttctgatgacctgcaccatatcgctagcctgatcggcaaggtcgttgatttcgaaggctctctcgctgaaaacaggtttactgtgcttcccaatatcgatcctgagatcgacgaaaagaagcgtaggctcatgggcttgcccagttttctaactgaggtggccaggaaggagcttgagaacttagacagcaggatcccgagttgctctgtcatttatatccccctgatcggcttccttctgagtatccctcggttgcccagcatggtggaagccagcgattttgagatcaacgggctggatttcatgttcttaagcgaagaaaaacttcactacaggagcgccaggactaaggaactggacgctcttctgggagacctccactgcgaaattcgggatcaggaaacacttctgatgtaccagttgcagtgtcaggtgctggcacgtgccgctgtgttaacgcgggttctggatttagcaagcaggcttgatgttctccttgccttagcctctgcagcgcgagactatggttacagtagacccagatattctccacaggtacttggcgttagaattcagaatggaagacatcccctgatggaattgtgcgcaaggacctttgttcccaatagcacagaatgcggtggggataaggggagggtgaaagtaattaccggccctaacagctccgggaagtcaatttatttgaaacaggtcggactgatcacgttcatggccctcgtaggctcctttgtccccgctgaagaagcagagatcggggctgtggacgcgatcttcactagaatccatagctgtgaatctatttccctgggactcagtactttcatgattgacttgaaccagcaggtggcaaaggccgttaataatgccactgcccagtccctggttcttattgacgaatttggcaaagggactaacaccgtcgacgggctcgctctgctggccgctgtacttaggcactggcttgcgcgaggcccaacttgcccccacattttcgttgcgacaaacttcctaagccttgtccaactgcaactcctccctcagggacccctcgtccagtatctcacaatggagacttgcgaagatggcaatgatctggtcttcttctatcaggtttcagacctgattagatctggtaaacccattaagcccgtgaaggatttgctcaaaaagaaccagatggagaattgtcagacactggtggataagtttatgaaattagatttggaggacccaaatttggacttaaatgtcttcatgagtcaagaggtactgcccgctgccacatctattctgtag

SEQ ID NO: 23527 - DNA, 2556 bp, Artificial Sequence
  Description of Artificial Sequence: Synthetic coding sequence
atggcaagtctcggagcaaatcccagaagaaccccgcaggggccacggccaggggcagcttcctccggattccctagtcccgctccggtgcctggcccacgcgaggccgaagaagaggaggttgaagaagaagaagagctagcagaaatccacctgtgtgtgttatggaacagcggttacctgggtattgcttattatgacacctcagactccaccatccacttcatgcccgacgctcctgaccacgaaagtctgaagctgttgcagagagttctcgacgaaataaaccctcagtctgtcgtcacatcagctaaacaggacgagaacatgactcgctttttgggtaaactggcctctcaggagcatcgggagcccaagcggcctgagatcatctttcttccaagcgtggacttcggattagagattagtaaacagagacttctgtctggaaactatagcttcattcccgatgccatgacggccacagaaaagatcctctttttgtctagtatcattccttttgattgcctcctcacacccccaggcgatctgcgattcaccccaatcccactactcatccctagtcaagtcagggctctgggaggactcttgaagttcttgggacgaaggaggattggagttgagcttgaagattacaacgtctcagtccccatactaggattcaagaaattcatgttgacgcatctggtgaacatagaccaggatacatacagcgtcctccagatcttcaaatctgagagccaccctagtgtgtacaaggtcgctagcggcctaaaggaaggcctgtcactgttcggcatcctgaaccgctgccactgcaagtggggagaaaagttgctgagattgtggtttacaaggccgacacacgatctgggcgagttgtctagccgcttagatgttatacagttctttctgctaccccagaacctcgatatggcccaaatgctgcatcgcctgttgggccacataaaaaatgttcctctcatcctgaagagaatgaaattaagccacacgaaagtttccgactggcaagtgctctacaaaacagtctattccgccctcgggcttagagatgcatgccgcagcctcccacaaagtattcagctgttccgagatattgcccaagagttttcagatgacctacaccatattgcgagcctaatcggcaaggtggtggatttcgaaggcagtttggcggagaacaggtttaccgtgcttcctaacattgacccagaaatagatgagaaaaagcggaggctgatgggattaccatcttttctaactgaagtggccagaaaagagcttgagaatctcgattccaggatacccagttgttctgttatctatattccactgattggcttcctgctgtctattcctagactacctagcatggttgaggcctctgacttcgagatcaatggcctggactttatgttccttagcgaggaaaagctccactaccgttctgccagaactaaggaactggacgctctgctgggtgacctgcattgcgagataagagaccaggaaactctcctgatgtatcagcttcagtgtcaggtgctagcgcgagccgctgtgctaacgagggtgctcgacctagccagccgcctggatgtgctccttgctctcgctagcgctgcgagggattacggctattccagaccaaggtattcaccccaggtattgggagtgcggattcagaacggacgacatcctctgatggaactctgtgccaggacttttgtgccaaattccaccgaatgcggaggggataagggacgggtgaaggtgattacaggtccaaactcgagcggcaagtcaatatacctgaagcaggtcggcttgatcaccttcatggcccttgtcggttcattcgtgcctgccgaagaagccgagattggagctgtggacgctatctttactcgcatacactcttgcgagtcaatcagcttaggtctgtctactttcatgatcgatctcaatcaagtggctaaggccgtgaacaatgccacagcacagagccttgtgctgatcgatgagtttggcaagggaacaaacaccgtggatggtctcgcactattagccgcagtactcagacattggctcgcacgcggtcctacctgcccccacatatttgtcgccaccaattttctgtccttggtccagctgcagctcctgccacaaggacctcttgtgcagtacctgaccatggagacctgtgaggacggcaatgacctggtatttttttatcaagtttgtgagggtgtcgccaaagcatcacacgccagtcacaccgctgcacaggctggtctgcctgataagctcgtggccaggggaaaggaggtgtccgacctgattagatctggcaaaccaataaagccagttaaggacctcctaaaaaaaaaccagatggaaaattgtcagacactcgttgacaagttcatgaagctcgacctcgaagaccccaacttagatctcaatgtattcatgtcacaagaagttctgcccgcagctactagcattctttag

SEQ ID NO: 23528 - DNA, 2505 bp, Artificial Sequence
  Description of Artificial Sequence: Synthetic coding sequence
atggccagtcttggtgccaatccacgacggacacctcaggggcctaggccaggagcagcctcaagtggttttccctcccccgctcccgtccccggtccaagggaggctgaggaagaggaagtagaagaagaggaagaactggccgaaatccacttatgtgtcctttggaattccgggtacttagggatagcttattatgatacaagcgatagcaccattcactttatgcccgacgccccagaccacgaaagtttaaaattgttgcagagagtgctggatgaaataaatccgcagtccgtcgtgacttccgctaagcaggatgaaaatatgacaaggttcctgggtaagctggcatcacaagaacaccgtgagcctaagcgcccagagataatcttcctgccatctgtggacttcggtttggagatatcaaaacagaggcttctcagtggaaactattcattcattcctgatgccatgacggccaccgagaagatcctgttcttatccagcatcatcccttttgactgtctcctgactgttagagctctgggtgggttgctgaagtttctgggaagaagaaggatcggcgtggagctagaagactacaacgtgagcgtgccaattctgggtttcaagaaatttatgcttacacacctggtaaatattgatcaggatacctattctgttctacagatctttaaaagtgaatctcatcctagcgtgtataaagttgcatccggcttgaaggagggactgagcctcttcgggatcctgaaccgctgccactgcaagtggggggagaaattgcttaggctgtggtttactcgcccaacccacgacttgggcgagctctccagtaggctcgacgtgatccagttcttcctgcttccacagaatctcgacatggcgcagatgctgcacaggctcttagggcacatcaaaaacgtcccattaattctgaagagaatgaagctgagtcatacgaaagtttccgactggcaggtcctatataaaacggtgtattccgccttgggtttacgagatgcttgccgcagcttgccccagtcaattcagctgttcagagatatagcacaggagttttctgacgatctgcaccacatcgcctccctgattggtaaggttgttgattttgaaggctcactggctgagaaccgatttactgtgttgcccaatatcgaccccgaaattgacgaaaagaagcgccgtttgatgggactgccttcctttctaaccgaggtcgcgagaaaagaactggagaatttggacagtcgaatcccctcttgttctgtgatttatattcctctgatcgggttcctgctgtccatccccaggttaccatctatggtggaagccagcgatttcgaaataaacggcctggatttcatgtttctgtctgaggaaaaactccactacaggagtgctcgtacaaaggagttggacgccctgttgggagatctgcactgtgagatcagagaccaggagacattgctgatgtaccagctgcagtgccaagtattagcccgagcggctgtccttaccagggtgcttgatttggcaagcaggctggatgtccttttagcgctggcctcagctgccagggattatggctattcacggcctagatattcgcctcaggtactgggagtgcggatccaaaatggcaggcatccgctgatggagctctgtgccaggacctttgtgcccaatagcactgaatgcggaggcgataaaggtcgcgtcaaagtgatcaccggccctaactcgtcgggcaagtccatttatcttaagcaggttgggctcatcacttttatggcccttgtggggagcttcgttccagcggaagaagctgagatcggcgcagttgatgcgatttttacccgcatccactcttgcgaatctatttctctcggactcagcacattcatgattgatttaaatcaggtggctaaggccgtaaacaacgccacagctcagtctctggtgctcatagatgagttcggcaaaggaacgaacactgttgacgggcttgcgctcttagccgctgtcttgagacattggttagcccgaggcccaacctgcccacacattttcgtagccacaaatttcttatcactcgtgcagctccagctgcttccacagggtccactggtccagtatcttactatggaaacttgcgaagatggcaatgatctcgtgtttttctaccaggtgtgcgagggtgttgccaaggcaagccacgcctctcacaccgcagctcaggcaggattgccagataaactggtcgcaaggggcaaggaggtcagcgacctcattaggagcggtaaaccaatcaaacctgtcaaggatctactgaagaagaaccaaatggagaattgccaaaccctcgttgataagttcatgaaactcgacctggaggaccccaatctggacctaaacgtcttcatgtcccaggaagtgcttcccgcagccaccagcatactctag

SEQ ID NO: 23529 - DNA, 2505 bp, Artificial Sequence
  Description of Artificial Sequence: Synthetic coding sequence
atggcgtctctgggagccaaccccaggaggacacctcaaggcccacggccaggtgctgctagcagcgggttcccaagccccgcacctgtgccgggaccgagagaggctgaagaagaagaggtggaagaggaggaggagctcgccgaaatccacttatgcgtcctgtggaactccgggtatctcgggatcgcctactacgatactagtgattccaccattcattttatgcccgatgctcctgatcacgaatctctgaaactgctacagagggtacttgatgaaattaacccccagtccgtggtgacaagcgccaagcaggatgagaatatgacgcggtttctgggcaaactagcctctcaggagcaccgcgagcccaagcgccctgagattatcttcctccccagcgtagattttggacttgagatttccaagcagaggctcctctcaggaaactactccttcatacctgacgccatgactgctactgaaaagatccttttcctgtcctccattatcccctttgactgcctgttgacggtgcgcgcactgggagggctactcaagttcctgggcaggcggaggattggcgtcgagttggaagattacaacgtatcagtgcctattcttggcttcaagaaattcatgctgacccaccttgtgaatatcgaccaggatacctactctgtactgcagatcttcaaaagcgagtcccacccttcagtttacaaagttgcttctggtctcaaagaaggcctgagcctgtttggcatccttaatcgctgtcactgcaagtggggagagaagctgctgcggctatggttcacccgccctactcacgacctgggtgagttgtctagccgtttagatgtcatccaattctttttgcttccccagaacttagacatggcccaaatgttacaccgcctcctcggacatataaagaatgtgccactgatactgaagcggatgaagctttcgcacacaaaggtctctgattggcaggtgctgtataagaccgtgtactctgccctaggactccgggacgcttgtcgtagcttgccccagagtatacagttatttagagatattgcgcaagagttcagcgacgatctccaccatatagcctctctgatcggaaaagttgttgatttcgagggatcactcgcagaaaaccggttcaccgtcctgcccaacatcgacccggaaatagacgagaagaaaagaaggcttatgggcctccccagttttctgacggaggtggccaggaaggagcttgagaacctcgatagtcgcatacctagttgtagcgtcatctatatccccctgattggattcctgctgtctatccccaggctcccttcaatggtggaggcgagcgattttgagattaatggtctcgacttcatgtttttgtccgaggaaaaattacactaccgctccgctagaactaaggagttggacgctctgcttggcgacctgcattgcgagatcagagatcaagaaacattgctgatgtaccagctacagtgtcaggtactggctagggccgcagtgttgacaagggtgctggacctcgcatcgcgcttggatgtgctgctcgccctcgcgagcgcggctcgagattatgggtattcacggccacgttactcgccacaggtcctgggcgtgcggatccagaacggccgacaccccctgatggagttgtgcgcgaggacattcgtgccaaactcaacagagtgtggaggagacaaaggcagggtgaaagtcatcacaggacctaatagtagtgggaaaagtatctatctaaaacaagtgggtctcattacattcatggccctggtgggaagtttcgtccctgcggaagaggctgagatcggagcagtggacgctatttttacccggatccattcctgcgaatcaatcagccttggcctctcaacttttatgattgacctgaaccaggtggctaaggcagtgaataacgccactgctcaatctttggtgcttatcgacgagtttggcaagggcactaacacagtggatgggttagccttgctagctgcagtcctgcgtcactggttggccagaggacccacgtgcccccatatctttgtagccacaaattttctgagtctggtgcaactacaacttcttccccagggcccattggtccagtacctaaccatggagacatgtgaggatggaaacgacctggtgtttttctaccaagtctgtgaaggtgtggccaaggcaagtcacgccagtcataccgctgctcaggctggtctgccagacaagctagtggcacgaggaaaagaagtgagcgatctcatacgaagcgggaaaccaataaaacctgtgaaggatttgctgaaaaagaatcagatggaaaactgtcagacgctggtggacaaatttatgaagctcgatctcgaggaccccaacctggaccttaatgtttttatgtcccaggaggttctgcccgctgccacttccatcctgtag

SEQ ID NO: 23530 - DNA, 816 bp, Artificial Sequence
  Description of Artificial Sequence: Synthetic coding sequence
atgtttctctcagaggaaaaactccactatcggagcgccagaactaaagagctagatgcccttctgggcgacctgcactgcgaaatccgcgaccaagaaaccctcctgatgtaccagctccagtgccaggttttggcacgggcagcagtgctgacacgtgtgctggacctggcaagccgactggacgtgctcctagccttggcttccgctgctcgggattacggatactctcgtccgagatattcaccacaggtcctgggcgtacgcattcagaatggtagacatcctctgatggagctctgtgcgaggacattcgtgcccaattcaacagagtgcggcggagacaagggtagggtaaaggtaattacagggccaaactcaagtgggaaatcaatttatctaaaacaggtgggcctgattaccttcatggctcttgtgggaagttttgtcccagcggaggaggcagagattggcgcagtggatgccatcttcacacgaatccacagctgcgagagtatctccctaggactaagtactttcatgattgaccttaaccaggttgctaaagcagtgaacaatgcaaccgctcagagccttgtcctcatagacgagtttgggaaggggaccaacaccgtcgacggtttggccctgctggcagccgtgctccgacattggctcgctcgaggcccaacttgtcctcacattttcgtggctaccaactttctctccctggtgcagctgcaactgctgccacaaggcccactcgtgcagtatctggattggccgagggtcagcggacaagagggcggtgactag

SEQ ID NO: 23531 - DNA, 1002 bp, Artificial Sequence
  Description of Artificial Sequence: Synthetic coding sequence
aagattcttttccttagtagtatcattccttttgattgcctgctcactgtcagggccctgggtgggctgctgaagtttctgggcagacggaggataggcgttgagctcgaggattataacgtcagtgttcccatcctgggctttaaaaagttcatgctcacccatctggtgaacatcgatcaggatacttactctgtactgcagatttttaagagcgaatcccatcctagcgtgtataaggtagccagtgggctgaaagaagggttatcgcttttcggcatccttaataggtgtcactgtaaatggggcgaaaagttactgagattatggtttaccagacccactcatgacttgggagagcttagctctcgtttagacgtgattcaattctttctcttgcctcaaaacttggacatggctcagatgctgcatcggcttctgggccacattaaaaatgtgccgttaatcctgaagaggatgaagctgagccacacaaaggtcagtgactggcaggttttatacaagaccgtatacagtgctctgggactccgcgacgcatgtcgcagtctgccgcagagcattcagctctttcgggacatagcacaagagttttccgacgacctgcaccatattgctagcctaattggcaaggtgtaccttagtcctcaggtcgattttgagggatcactcgcagagaacaggttcactgtgttaccaaacattgaccccgaaatagatgaaaaaaaaagaagactgatgggtctgcctagtttcctaacggaggtagcacggaaggaactggaaaacctcgactcacggatcccctcatgttcggttatctatattccgctcatagggtttctgttgtctattccacgacttccttcaatggttgaggcttccgacttcgaaattaatggtctcgacttcatgttcctgtctgaagaaaagcttcactaccggtcggccaggacaaaagagctggatgcactcctgggctag

SEQ ID NO: 23532 - DNA, 1527 bp, Artificial Sequence
  Description of Artificial Sequence: Synthetic coding sequence
atgtggccagttcttctcttcgtgtttttaagtcagactgtttactcagccctgggccttagagacgcctgcaggtcgctaccccagtccattcagctctttcgcgatatcgcacaagaatttagcgacgacctccaccatatcgcttccctgattggtaaggtggtggatttcgagggttctctcgcagagaaccgattcactgtgttacccaacattgatcctgaaattgatgagaagaaaaggcgactaatgggacttccgagtttcctaactgaagtcgcccgaaaagaacttgagaacctggattcacggattcccagctgttcggttatctatatccctctcataggcttcctcctctccattcctcggttaccttccatggtggaggcctccgacttcgagatcaatggcctcgacttcatgttcctttctgaggagaaacttcattatcggtccgcgcgaacaaaagagctggacgccctgctcggcgatttacactgtgaaatcagagatcaggagacgctgctgatgtaccagcttcaatgccaggtgttggccagggctgcagtcctaacacgggtgctggacctcgcgagtcgcctggacgtgctgctggcactggctagcgcggctcgcgattacggctacagccggccacgatattcaccccaggtgttgggcgtgagaatccagaacggcagacatccgcttatggaactctgtgcacgtacatttgtgccgaacagcacggagtgcggtggcgataagggaagagttaaggtgattactgggcctaattccagtggcaaatctatctacttaaagcaagtgggcctcatcacctttatggcactggtggggtcctttgttcccgcagaagaagctgaaatcggtgccgttgatgcaatttttacaaggatccactcatgcgagagcatatcactcggcctgtcaacattcatgatagatttgaaccaagtcgcgaaagccgtcaacaatgccacagcccagtcactggtgctgattgacgaatttggcaaggggacaaacaccgtggatggactggccctgctggctgcggtgttacgccactggcttgcaaggggccctacctgtccccacatcttcgttgctaccaattttctctctttggttcaactccagctgctcccacaggggccacttgtccagtatcttacaatggagacctgtgaggacggcaatgacctcgtgtttttttaccaggtctgcgaaggggtggccaaggcgtctcatgcctcgcatacggctgcacaagcaggtttacctgataaacttgtggcacgcggtaaagaggtgtccgatttgatacgctccggcaaaccgattaaacccgttaaagatctgctcaaaaaaaaccagatggaaaattgtcagaccttagtcgataagttcatgaaattggacttagaggatccaaacctcgacctgaatgtgttcatgtcccaagaggtgttgccagcggcaactagcattctgtag

SEQ ID NO: 23533 - DNA, 2505 bp, Artificial Sequence
  Description of Artificial Sequence: Synthetic coding sequence
atggcttccctaggtgccaacccccgtcgaacacctcagggccctagacctggtgcagcttcctccggttttccgtcgccagcgccagttcccggtcccagggaggccgaggaagaagaggttgaggaggaagaggaactcgcagaaatccacctctgcgtgctctggaactccggctacctcggcatagcgtactatgatacgagcgactctacaatacactttatgccagatgctcccgaccatgagtccctgaaactgctgcagcgcgtgttggacgagataaaccctcagagtgtggtgacttctgctaaacaagatgaaaatatgacgcggttcctgggcaagctggcctcccaggaacaccgagagcctaagagacctgagatcatctttctgccttccgtcgattttggcctcgagatctctaaacaaaggctgctgtcaggtaattatagtttcataccagatgcaatgacagccactgagaagatcctgtttctcagctccatcattccatttgattgtctgcttaccgtcagggccttagggggactcctgaagtttcttggcaggcggagaatcggtgttgagcttgaggactataacgtctccgtgcccattctcggattcaagaagtttatgttgactcacttagtgaatatcgaccaggacacatacagcgtgttacagattttcaagagcgaatctcatcccagcgtttataaggtggcaagtggcctgaaggagggtctgtcattgtttggcattctgaataggtgccactgtaaatggggtgagaagctcctgcggctctggtttacacggccaacccatgatttaggcgagctgtcatcccgcttggatgtaatccagtttttcctgttaccgcaaaacctggatatggcacagatgctgcaccgtcttcttggacacataaagaacgtccccctgattctgaagcgcatgaagctcagccataccaaagtcagcgattggcaggttttgtacaaaactgtgtattcggccctgggcctgagagacgcctgccgcagtctgccacaaagcattcagctgttccgcgacattgcacaagagttttcggatgacttgcatcacattgcatccctgattggcaaggtagtcgacttcgagggttcactggcagaaaataggtttaccgtactgcccaatatagacccagaaatcgacgagaagaagcggcgtttgatgggactgccttccttcctgaccgaagtcgctaggaaagagctggagaacttggattcacgcatccctagttgtagcgttatctacataccactgatcggcttcctgctttctattcctagactcccctctatggtggaagccagcgacttcgaaattaatggtctggatttcatgtttctcagcgaggagaagctgcattaccgaagcgcgaggaccaaggaactggacgcgctgctaggagatcttcattgcgagatcagagaccaggagacacttttgatgtatcagttacagtgccaggtcctcgccagagctgcagtcctgaccagggtcctagaccttgcaagtcgcctagatgtgctgttagcattggctagcgccgctagagactatggatactctcggccaaggtattctccccaggtactcggcgttcgcatccagaacgggaggcatcccctaatggaactttgcgctcgcacattcgtgcctaactccactgaatgcggcggagataaaggaagagtgaaggtgattaccggacccaactcctcagggaaatctatttacttgaaacaagtcggactgatcacattcatggccctggtcggcagcttcgtcccggctgaggaggcagagatcggtgccgtggacgccatatttacccgcatccatagctgtgaatctatcagcctgggtctcagtaccttcatgattgacctgaaccaggtagcaaaggccgtaaacaatgccaccgctcagtcgctagtgctgattgacgagttcggcaagggtaccaatacagtcgatggattggcactgctggctgctgttttacgccattggctcgccaggggaccaacctgccctcatattttcgttgctactaactttttgagccttgtacagctccaattgctgccacagggcccactcgtgcaatacttaaccatggaaacctgcgaggatgggaacgatctcgttttcttctaccaggtgtgtgagggcgttgcaaaggcgtcgcacgctagtcatacggcggctcaggccggtctgcctgataaattggtcgcaagagggaaggaggttagcgatctgatacggtcaggtaaaccaataaagccggtcaaggatctgctgaagaagaatcagatggagaattgtcaaacgctggttgacaaatttatgaagcttgacctagaggaccctaatctggatctcaacgtcttcatgagccaggaggttttgccggctgcgacttcaatcctgtag

SEQ ID NO: 23534 - DNA, 2508 bp, Artificial Sequence
  Description of Artificial Sequence: Synthetic coding sequence
atggcttctcttggcgcaaatcctcgcagaacacctcaaggaccacgccctggcgcagcctcctcaggctttccgagtccggctccagtcccaggcccaagggaggcagaggaggaagaagtggaggaggaggaggagcttgcggagattcatctgtgtgtgctatggaatagcggctacttaggaattgcttactacgacacgtcggattcgacgatccacttcatgccagatgcaccagatcatgagtcactgaagttattacaaagggtcctggatgaaatcaaccctcagagcgtggtaacctctgctaagcaggacgagaacatgactaggtttctgggcaagttggcttctcaggaacatagagagcccaagcgcccagagattatcttcctgccctctgtggatttcggtcttgaaatttcgaaacaacgtctgctttctggcaattattcgttcatccccgacgccatgacagccacagagaaaattttattcctgtcgagcatcatccccttcgactgcctgctgaccgtgagggccctgggaggtctgttaaaattcctgggacgtcgaaggattggagtcgagctggaagactataacgtgtccgttccaatcttaggtttcaagaaatttatgctgacccatcttgtcaatattgaccaggacacttactccgtgctccaaattttcaaatctgaaagtcatccgagcgtgtacaaggtggcgtcaggcctaaaagaaggcctgagtctattcgggatcttaaatcggtgtcactgtaaatggggagagaaactgttgaggttgtggttcacccgtcccacgcacgacttaggggaactgtcgagtagattagatgtcatccaattcttcctattgccacagaatttggacatggcccaaatgctccacagactgctcggccacattaaaaacgtgcctctgattttgaaacgcatgaaattgtcccatacaaaagtgtcggattggcaagtgttatacaagacggtgtactccgctctcgggctgagagacgcttgccgctccctaccacagtcgatccagctgttccgtgacatcgcgcaggaatttagcgacgatctccatcatatcgccagccttatcgggaaggtggtcgacttcgagggcagcctggcggagaaccggttcactgtgttacccaacatcgacccagagatagacgagaagaagcggagattgatgggactcccgagcttcttaaccgaggttgctcgaaaagagctcgaaaacctcgatagtcgcatccccagctgctctgtcatctacatcccactcatcggatttctcctctccatccctagactgccatccatggtagaggcaagtgatttcgagattaacggcctggatttcatgtttctgagtgaagagaagttgcactataggtctgcgcgaacgaaagaactggacgcactgctgggtgatctgcactgtgagatcagggatcaagagactctgctgatgtatcagcttcaatgtcaagtactggcaagggccgcagtgctcacacgagtacttgatcttgcttcaagactagatgtactgcttgctctggcgtccgccgctcgcgactacgggtactcacgccctcgctacagccctcaggtacttggagtgagaatccagaacggtaggcacccgctgatggaactgtgtgctcgaacattcgtgccaaattccacggagtgcggcggagataagggtagggttaaggtgatcacaggaccaaactctagtggcaaaagtatctatctcaagcaagtgggactcatcactttcatggcactggtcggatcttttgtacctgctgaagaagcagagattggtgccgtggacgccattttcacaagaatacacagctgtgaatctatcagcctgggactgtccacgtttatgatagaccttaaccagcaggtggctaaggcggtcaacaatgcaactgctcagtctcttgtactaatcgatgaattcggaaagggtacaaacaccgttgatggacttgcccttctcgccgctgtgcttcgccattggctcgccagggggcctacatgcccacatatatttgtggcgaccaatttcctctcactcgtgcagctgcagctgctgcctcagggaccgcttgtccagtatttgactatggaaacatgcgaggacggcaacgatcttgtatttttctaccaggtctgcgagggagtagccaaggcatctcacgcaagtcacactgccgctcaagccggactacctgacaaattggtcgcaaggggaaaggaagtgagcgacctgattcgcagtggcaagccaatcaaacctgtgaaggatctgctcaaaaaaaatcagatggagaattgtcagaccctggtcgacaaattcatgaaactggaccttgaagaccccaacctcgacctaaatgtgttcatgagccaggaagtgttacccgctgccacaagcatattatag

SEQ ID NO: 23535 - DNA, 585 bp, Artificial Sequence
  Description of Artificial Sequence: Synthetic coding sequence
atggccagcttaggcgctaatcccagacggacgccgcaggggcctcggccaggcgctgcctcctctggcttcccctccccagcccctgttcccggacccagagaggcggaggaggaggaggtcgaggaagaagaagagctggcagaaattcacctatgtgtcctgtggaattcaggctacctgggtatcgcctactacgatacctccgactcgactattcactttatgccggacgcaccggatcatgagagcctgaagttgctgcagcgggtgcttgacgagattaatccacagtcagtagtgaccagcgccaagcaggacgagaatatgacacgctttctgggaaaactggcctcccaggagcaccgcgagcctaagcgacctgagattattttccttccatctgtggacttcggattggagattagtaagcaacggttgctgtccggaaactactcgttcattcctgatgccatgacggctaccgaaaaaattttattcctgtcaagtatcattccatttgattgcctgctgacagtccgggctttggggggactgctcaaattcctgggcagacggaggtag

SEQ ID NO: 23536 - DNA, 585 bp, Artificial Sequence
  Description of Artificial Sequence: Synthetic coding sequence
atggctagcctgggcgcaaatcccagacgtacaccccagggcccaaggccaggtgctgcgtccagtggatttccaagtcctgccccagtgcccggaccacgcgaagctgaagaggaagaagtagaggaggaggaagaactggccgaaatccacttgtgcgtgctgtggaacagcgggtacctggggatcgcctactacgacacgagcgacagcacaatccacttcatgccagacgcaccagaccacgagagcctgaaactgctgcagcgagtgcttgatgaaatcaacccgcagtccgtggtgacgtcggctaagcaggatgaaaatatgacacgatttctgggtaaattggcatcccaagagcaccgcgaaccaaaacgtccagaaataatctttctcccttcagttgatttcggcctggagattagcaagcaaaggcttctgagcgggaactactccttcatacccgatgcaatgaccgcaaccgagaagattctctttctgagttctattattcccttcgactgcctcctgacagtgagggccctggggggtctcctcaaatttctgggcaggcgccgttag

SEQ ID NO: 23537 - DNA, 2505 bp, Artificial Sequence
  Description of Artificial Sequence: Synthetic coding sequence
atggcatccctgggcgctaatcctcgacgaacaccccaaggccctcggcctggagccgcttcatcagggtttcctagccccgcaccagtgccagggccacgggaggcggaagaagaggaggtggaggaggaagaggaactcgcagagattcatctgtgtgtgctgtggaactctggctatctcggcattgcatactacgatacctctgatagtactatccacttcatgcccgacgcacctgaccacgagtccttgaagctacttcagagggtcctggacgagattaacccccaaagcgtggtcacatccgcaaagcaagatgagaacatgacgcgctttttgggcaaacttgcctcacaggaacacagagagccaaaacgtccggagataatctttttgccttctgttgatttcggcctggaaatctccaagcagcggctgctgtctggtaactactccttcatccccgatgcgatgactgcaacagaaaagatcttgtttctgagctccatcatccccttcgactgtcttttgaccgttagggccctgggtggacttctgaagtttttagggcgacggaggattggggtggagttggaggactataacgtaagcgttccaatcttgggatttaagaagttcatgttgacacatcttgtgaacattgatcaggatacttactctgtgctgcaaatcttcaagtccgaaagccacccatctgtgtacaaggttgcctcagggctgaaggaagggctttccttgtttggtattctaaatcggtgtcattgcaaatggggcgagaaattacttcgtctgtggttcaccaggccaactcatgatttgggggagctatcttcccgcttagatgtgatacagttctttttgctgccccagaacctggacatggctcagatgctacatagacttctggggcacatcaaaaatgtgccattgatcctgaaacgcatgaagttgagtcatacaaaggtgtccgactggcaggtcctgtataagactgtgtattcagctcttgggctcagagacgcatgcagatctctgcctcaatctattcagctcttccgcgatatcgctcaggagtttagtgacgatctgcatcacatcgcctcactaattggcaaggtggtcgattttgagggctctttggccgagaaccggtttactgttttgccaaacatagaccctgagatcgatgagaagaaacgcaggcttatgggccttccatcattccttaccgaggtggctaggaaagaactggaaaatttggactcaagaatcccctcttgctcagtgatctatatccccctgattggtttcctcctcagcattccccgactccctagtatggtggaggcctctgactttgaaatcaatggtcttgacttcatgttcctctctgaagagaaattacactatcgatcagcaaggacgaaggagctggacgcccttctgggagacctgcactgtgaaatccgcgaccaggagaccctgctgatgtaccagctgcaatgtcaggtgctggcacgggcagcagttcttaccagggtcctcgacctggcatcgcgacttgacgtgctgctggcacttgcctccgctgctcgcgattatggttactctcgtcccagatactcacctcaagtgctgggtgtccgaatacaaaatgggaggcatcctctgatggagttgtgtgccaggacctttgtccccaattccacagaatgtggaggagataagggacgcgttaaggtgattactggtccaaattcctctggcaaaagcatatatctgaaacaggtcggcttaatcacattcatggccctggttgggtctttcgtccccgcagaagaggctgagattggagccgtggacgctattttcactcgtattcattcatgtgaatccatcagcttaggactgtccaccttcatgatcgacctgaatcaagtcgctaaggccgttaataatgcaacagctcagtccctggtgctgatcgatgaatttgggaagggcacaaataccgtcgatgggttagccctgctggccgctgtcttgcgacactggcttgctcgaggtccaacctgcccccacatctttgtggccaccaattttctgtcacttgtgcagttacagttactcccacagggcccactggtacagtacctgaccatggagacgtgtgaggatgggaatgacctggtgttcttctaccaagtgtgcgagggcgtggctaaggcctctcatgcgtcacacaccgccgctcaagccggtctccccgataaacttgttgccagaggcaaagaggtatctgatctgatccggagcggtaagccaataaaacccgtgaaggacctgctcaagaaaaatcaaatggaaaactgtcaaaccctggtggataaattcatgaaacttgacctcgaggatccgaacttagacttgaatgtgtttatgtcgcaggaggtgctgcccgctgccacatctatcctgtag

SEQ ID NO: 23538 - DNA, 585 bp, Artificial Sequence
  Description of Artificial Sequence: Synthetic coding sequence
atggcaagcttaggcgcaaatccccgtcgaaccccacagggaccccgtccaggcgctgcctcaagcggatttcccagtccagcacccgtgccaggccctcgagaggcggaggaggaggaagttgaagaagaggaagagttagccgagattcacctctgcgttctgtggaatagcggctacctcggtatagcatactatgacacatccgattccaccattcactttatgcctgatgcaccagaccatgaaagtctcaagttgctgcagcgggtgttagatgagatcaacccacaaagcgttgtgacaagcgctaagcaagatgaaaatatgaccagattcctaggcaaactggcctctcaggaacaccgggaaccaaaaagaccagagattatctttctgccctctgtggatttcggtctggagatatccaagcaacgtctgctttccggcaattattcttttatcccggacgctatgacagccactgaaaagattttattcctgagctccataattccatttgactgtctgttaaccgtccgggctctgggaggtctgttaaaatttctcgggcgaagacgatag

SEQ ID NO: 23539 - DNA, 1602 bp, Artificial Sequence
  Description of Artificial Sequence: Synthetic coding sequence
atggcccagatgctgcatcggctcctgggccacatcaaaaatgtgccccttatcctgaaacgtatgaaattaagccataccaaggtatccgactggcaggtgctttacaaaaccgtatattccgcattagggctcagagatgcatgcaggagcctcccgcagagcattcaactgttccgggacatagcacaggagttttccgacgaccttcaccacattgcttccttaattggcaaggtcgtcgactttgagggaagtctggctgagaatcggtttacagtactgccgaacatcgaccctgagatcgacgagaagaagaggcggctcatgggcctgccctccttcttaacggaagtcgctcgcaaggaactggagaatttggactctcggatacctagctgttcagtaatttatatccctctgattggattcctgctgtccattccccgattgcccagcatggtcgaggctagtgactttgaaataaatgggctggactttatgtttctcagcgaagagaagctgcactataggtctgccagaaccaaggagttagacgcactgctcggcgatcttcactgcgagatacgagatcaggaaacactgctgatgtatcagctgcagtgtcaggtcctcgctcgtgcagcagttctcacccgggtgttggacctggccagcagactagacgttttacttgccctagcctccgccgcaagggactacggttactcaagacctcggtatagcccccaagtcctgggagtgcgtatccagaacgggagacaccccctgatggaattgtgcgcacgcaccttcgtgccaaatagtactgagtgtgggggagacaagggaagagtgaaagttataacaggccctaatagctcggggaaaagtatctatctaaaacaggtgggcttgatcacatttatggctctagtaggttcatttgtccccgctgaagaagctgagattggagcagtggatgctatatttacccgcatacatagttgtgagtctatctctctgggtcttagcacctttatgatcgacctgaatcaggtcgccaaggcagtgaacaatgccacggcgcagtctctggtgttgatagacgagtttggcaaagggaccaacaccgtagatggcctggcccttctggccgcagtcttacggcattggcttgccagagggccaacgtgcccccacatcttcgtggccacgaatttcctatccctggtccagctgcagctactgccccagggtccactggttcaatatctgaccatggaaacctgtgaggacgggaatgacctagtgtttttctatcaggtttgtgagggagtagccaaggcctcccacgcctcgcacacggctgctcaggccggtctgcccgacaaactggtggcgaggggaaaagaggtctccgaccttatcagatcaggaaagccaatcaagcccgttaaagatctgcttaagaagaaccaaatggaaaactgtcagaccctggtcgataagtttatgaagttagatctggaagatcccaatttggatcttaacgtcttcatgtcacaggaagtgctgcccgcagcgacctcaatcttgtag

SEQ ID NO: 23540 - DNA, 2508 bp, Artificial Sequence
  Description of Artificial Sequence: Synthetic coding sequence
atggcctctctaggcgcaaacccacggagaaccccccaaggcccacggcctggggcagctagtagtggatttccatctccagcgcctgtgccagggccacgcgaagccgaggaagaggaggtggaagaggaggaagagcttgccgagatacatctatgcgtgctgtggaactccgggtatcttgggatagcctactatgatacttcagattccactatccacttcatgccggacgcccctgatcacgaatcactgaaactcttgcagagggtgctagacgaaatcaacccccagagtgtggtgacctcggcaaaacaggacgagaatatgacccggtttttgggtaaactcgcatcccaggaacatcgggagccaaagcggccagagataatcttcctgccttccgtggacttcgggctagagatttcaaagcagaggctactgagcgggaactatagcttcatccccgacgctatgaccgcaacagagaaaatattgttcctgtcttctattataccctttgactgcttattgacagttagagctcttggcggattactgaagttcctgggccgtagaagaatcggcgtcgagttagaagattataatgtgtcagttcccattctaggtttcaagaagtttatgctgacacacctggtcaacattgatcaggacacttattcagtgctgcagatattcaagagtgagtcacatccgagcgtctacaaagtcgcctccggccttaaggaaggtctctctctgttcggaatactcaaccggtgccactgtaagtggggggagaagctactgcgcctgtggtttactcgccctacccacgatttgggcgaactgtctagcagactcgacgtcatccagttcttcctactcccacagaacttagatatggcacagatgctccatcgtcttctgggccacatcaaaaacgtcccacttattctgaaaaggatgaagctgagtcacaccaaggtgtcggattggcaggtgttgtataaaacagtgtattcagccttgggccttcgggacgcttgtcgtagcctgcctcagtctattcagttattccgggacattgcacaggagttctccgatgatctccaccatatagcgtcacttatcggcaaagtcgtggacttcgagggctcgctcgccgagaataggtttaccgtcctgcctaacatcgatccggagatcgacgagaaaaagcgtagacttatgggactgcccagtttcctcactgaagtcgccaggaaggaactggaaaacttggactctcgcatcccttcctgttcagtcatatacattcctctgataggattcctgttgtccataccccgtctgccaagcatggtggaagcctccgactttgaaattaatgggctggactttatgttcctcagcgaggagaagttacattataggtccgctcgcaccaaagaacttgatgccctcctgggagatctgcactgcgaaattcgtgatcaggaaaccttgctgatgtatcagctgcagtgccaggtgctcgccagggccgcagtactgacacgagtactggacttagcatcccgcctggatgtgttactcgctcttgcttcggcagcacgcgactacggctattcgagaccgaggtactctcctcaggtcttgggcgtgaggattcagaatggtcggcaccctctgatggaactgtgcgcccgaacgttcgtccccaactcgaccgaatgtggcggtgacaaaggcagggtaaaagtgatcacgggtcctaactctagcgggaaatctatctacctcaaacaagttgggcttataaccttcatggcgctggtcggttcattcgtgcctgctgaagaagctgaaataggggctgtggatgcaatttttaccaggatccacagctgcgagagtatcagcctgggcttgtccactttcatgatagatctaaaccagcaggtcgcaaaggccgtcaacaacgctactgctcagtccctggtcctgattgatgagtttggtaagggaaccaacacagtcgatggtctcgctctgctggctgccgttcttcggcattggctggctcggggaccaacctgcccgcacatcttcgtagccaccaacttcctatcactggtccagctgcagctgctgccccagggaccactcgtgcagtatttgactatggagacgtgcgaggacggtaatgatctcgtattcttctatcaagtgtgtgaaggcgtcgcaaaagcttcacacgctagtcatacggccgcacaggccggactgcctgacaaactggtagccaggggcaaggaggtgtccgacctgatacgatctggaaagcccataaagccggtgaaagatctcttaaagaaaaaccaaatggagaactgccagactctggtagacaagttcatgaaactggacttagaagacccaaatctggatctgaatgtatttatgtcgcaggaggtccttcctgctgccaccagtatcctttag

SEQ ID NO: 23541 - DNA, 1002 bp, Artificial Sequence
  Description of Artificial Sequence: Synthetic coding sequence
aagatactttttctgagttccatcattcctttcgactgtctgctgaccgtgcgagcactcggtggtctgctgaaatttctggggaggcgccgaatcggtgtggagttggaggattacaatgtgagcgttcctattctggggtttaaaaagtttatgctcacacaccttgtgaatatcgaccaggatacatattcagtcttacagatctttaagagtgaaagtcacccctcggtgtataaggtagcttccggcttaaaagagggcctgtccttgttcggaattctgaaccgctgccattgcaaatggggagaaaaattgctacgactgtggttcacacggcctacccacgacctgggcgagctgagtagccgactggacgtaattcagtttttcctgctccctcagaacctggacatggcccagatgcttcacagactgctggggcacatcaaaaatgtacctttgatactcaagaggatgaagctttctcatacaaaagtcagtgattggcaagtcctgtataaaaccgtgtactctgccctcggcctgcgggatgcctgtaggtcattgcctcaaagcatccaactgtttagagatatcgcacaggagttttctgatgatttgcatcatatagccagccttatagggaaggtgtatctttcccctcaggtggattttgaagggtccctcgccgagaatcgcttcactgtgctgccgaacatcgatccagaaattgatgagaagaagagacggctgatgggtttgccctcgtttctgacggaagtggctcggaaggaattagagaatcttgacagtcgtattccatcgtgctccgttatatacatccctctaatcggcttcttactatcgatcccaaggctgccctccatggttgaggcatcagacttcgagatcaacggactggatttcatgttccttagtgaggaaaaactgcattatcgatccgctcgcactaaggagctggacgcgcttcttggttag

SEQ ID NO: 23542 - DNA, 2508 bp, Artificial Sequence
  Description of Artificial Sequence: Synthetic coding sequence
atggcttcccttggggctaatccaaggaggacgccacaagggccacggccaggggctgcgagctccggctttccgtcacctgcccctgttcctggccctcgggaagccgaagaggaggaggtggaagaggaagaagagttggcagagatccacctttgcgtcctctggaactcaggatacctgggaattgcgtactacgacacctcggattcaaccattcattttatgcctgatgcacccgatcacgagtccctaaagctgctccagcgagtgctggacgagattaacccgcagtccgtggtgacctcagctaaacaggatgaaaacatgacacgcttcctaggcaagctggcaagccaggaacaccgcgagcccaagaggccagaaatcattttccttccatctgttgactttggactagaaatcagcaaacagaggctgctgtctggcaattattccttcatcccagacgctatgacagccaccgagaagattttgttcctaagctcgatcatcccctttgactgtcttttgaccgtcagggcacttggaggactcctcaaatttttgggccgacgcagaataggagtggagctggaggactataatgtaagtgtgccaatactgggatttaagaaattcatgctcacccacctggtgaacattgatcaggatacttattctgtgctccagattttcaaatcagaatcacacccctcagtttataaagtcgcaagcggtttaaaagaggggctatccctgttcgggatcctgaaccgatgtcactgcaagtggggcgaaaaactcctgcgactttggttcacaagaccgacgcatgatcttggagaactaagcagccgcctagatgtgatccaatttttcctcctgccccagaacctagacatggcgcagatgctacaccgactgctcggccacattaaaaatgtgcccttaatcctcaagcggatgaaactgtcacacacaaaggtctccgattggcaggtgctctacaagacggtgtatagtgcgctcggactgcgcgacgcctgtcgctctctgccccagtctatacagctttttcgggacatcgcccaagaattcagcgatgatctgcatcacatagcttcccttatcggaaaagtcgtagacttcgaaggctcgctggccgaaaaccgatttaccgtcttacctaatatcgaccccgagattgacgaaaagaaacggcgtctgatgggcctgcctagtttcctaacagaggtcgcacggaaagaactcgagaatctggattcgcggatccctagttgttccgttatctacatccccctgatcgggttcctgttgtccatacctcgcctacccagtatggtggaggcatccgactttgaaattaacgggttggatttcatgttcttatccgaggaaaagcttcattacaggagtgcaagaacaaaggagctagatgccttgctgggtgatctgcattgcgagatcagagatcaggaaactctcttgatgtatcagttgcagtgccaagtcctggcaagagctgctgtgttaacccgcgttttggatctggctagccggctggatgtgctgctggctctcgctagcgcagccagggattacggctactcccgaccgcgatacagccctcaggtacttggggtgaggattcagaacgggcgtcatcctttgatggagttatgtgctcggacctttgtgcccaactccactgaatgcggaggagacaagggtcgtgtgaaagtgatcaccgggcctaattctagcggtaagtcaatatatctgaagcaggttggtttaattacatttatggcgcttgtgggcagcttcgtccccgcagaagaagcggagattggagccgtggacgccatcttcacgcgcatccattcctgcgaaagcatttctctggggctttctaccttcatgatcgacctcaatcagcaggtggccaaagccgtgaacaacgcaacggcgcagtctcttgtgctgatcgacgagtttggaaagggtactaacaccgtggatggcctggcactgctagccgcagttctgcggcactggctggcccgtgggccaacatgtccccacatcttcgttgccaccaattttctaagcttagtgcaactccagttgctgcctcaaggaccactcgtgcagtacctcaccatggaaacctgtgaggatggcaacgatttggtttttttttaccaagtgtgcgagggtgttgcaaaggcttcgcatgccagtcacaccgcagcccaggccggtcttcccgataaactggttgccaggggcaaagaggtgtcagatctcatcagatccggtaaacctatcaaacctgtaaaggacctgctgaaaaagaaccagatggaaaactgtcagacgctggtagataagttcatgaagctcgacctggaagaccctaatctggatctgaatgtcttcatgtcgcaggaggtgctcccggcagctacaagcatcctctag

SEQ ID NO: 23543 - DNA, 2466 bp, Artificial Sequence
  Description of Artificial Sequence: Synthetic coding sequence
atggcttctctgggcgctaacccaagacggactcctcagggccctcgcccaggagcagcaagctcaggatttccatctcccgcacctgtccctggaccacgcgaagcagaggaggaggaagtggaagaagaagaggaactggccgagatccacttgtgcgtgttgtggaattctggctatctagggatcgcatattatgacaccagcgactccaccatccacttcatgccagacgcaccggatcacgaatctctaaagttgctgcagcgcgtcctcgatgagattaacccacagtcggttgtgactagcgccaaacaggatgaaaatatgactcggtttctgggcaaactagccagccaggagcatcgagagcctaagagacccgaaatcattttcttaccctcagttgacttcgggttggagatttccaaacagagactcctaagcggaaactacagtttcatcccagacgcaatgacggctaccgaaaagatcctctttcttagctccattatcccatttgattgcttacttacaccccctggagatctacgctttacccccataccgcttctgattccgagtcaggtgagagccctgggaggactgttgaagtttttaggcaggagaaggattggggtggagctcgaggactataatgtgagtgtcccaattctgggtttcaagaagttcatgctgacacacttggtgaatattgaccaagacacatatagtgtgctgcagatatttaagtcagaatcccaccctagcgtgtataaagtggctagtggccttaaagaaggcctgagtctcttcggcatcctgaaccgctgccattgcaaatggggcgaaaagctgctgagactgtggttcacgcggcctactcacgatctaggggagttatctagtagactcgacgtgatccagttcttccttttgcctcaaaacctggatatggctcaaatgctgcaccgcttattagggcacatcaagaacgtaccactgattcttaagcgtatgaaactgtctcacacaaaggtttcagattggcaggtcctttataaaacagtgtattctgcccttgggctaagagatgcatgcaggtccctaccacaatctatacagctgttccgagacatcgctcaagagttttcagatgatctgcatcatatcgcctcgctgatcggtaaggtggtcgactttgagggctccttggcagaaaatcgattcaccgtgctccctaacattgatcccgagatcgatgaaaaaaaacgaaggttgatgggtcttccctcttttctgaccgaggtagctcgcaaggaattagagaacctcgactctcgcattcccagctgcagcgtgatttatattcccctgatcggcttcctactttccatcccacgcctcccatccatggtggaagcgagcgatttcgagataaacggacttgacttcatgttcctcagtgaggaaaagctgcattatcggtcagctcgtactaaagagctggatgcgttgttaggcgatctgcactgcgagattagagatcaggagacactgctgatgtaccagctgcagtgccaggtgctggcacgcgcagccgtccttacgcgcgtactggaccttgctagtcgcttggatgtgcttctggctctcgcatcagcagctagggactatggctattctaggcctaggtattccccgcaggttctgggggtgagaatccagaatggcaggcaccctcttatggaattgtgcgcccgtacgttcgtgcccaattcaactgagtgcgggggtgacaaagggcgtgttaaggttatcaccggacccaattcttccgggaagtctatttacttgaagcaagttggattaatcacgttcatggcactggtggggtcatttgtgccagctgaggaggccgaaattggtgcggtggacgcaatcttcacgcggatacatagttgcgaaagcatcagtctggggttgagtacattcatgatcgacctgaaccaggttgctaaagccgtgaacaacgccacggcccagagtctggttctcatagacgaattcgggaaaggaaccaacacggttgacggtctggcattgctggcagccgtgttgaggcattggttagcgagagggccaacttgtccccatatctttgtcgccacaaacttcctctcattggttcagctgcaacttttaccccaggggcctcttgtccagtatctgaccatggaaacatgcgaggatggcaacgacctcgtgttcttttatcaagtttctgacctcatacggtctggaaagcccatcaaaccagttaaggatctgctgaaaaaaaaccaaatggagaactgccagacgctagttgacaagttcatgaaactggatctcgaggaccctaacttggatttgaatgtgttcatgagtcaagaagtcctgcctgcggcaactagcatcctttag

SEQ ID NO: 23544 - DNA, 1527 bp, Artificial Sequence
  Description of Artificial Sequence: Synthetic coding sequence
atgtggcctgtgctgttattcgtgttcctgtcacagactgtgtacagtgcgctgggactgcgtgacgcctgtcgatccttgccgcagtccatccagctattccgtgacattgcccaggaattctctgacgacctccatcatatcgcatcattaattggtaaggtcgtggactttgaggggagcctggccgagaaccgcttcacggttctgccaaatatcgatcccgaaattgatgagaaaaagcggaggctgatgggcctcccctccttcctgacggaggtggccaggaaagagctggagaatctggattcccgcataccatcttgcagtgtaatctatatccccctgataggctttttgttgtcgatcccacgacttccaagcatggtggaggcatcagacttcgaaatcaacggccttgatttcatgtttttgagcgaagaaaagcttcattacagaagcgcgaggacgaaggaacttgacgcccttcttggcgacttacactgtgagatcagggatcaggagaccctgctaatgtatcaactccaatgtcaagtgctggccagagcggcagttcttacaagagtgctggacctcgccagtagactggatgtactactggccctggcatcagctgccagagactacggatactctcggcctcggtatagcccccaggtgctcggagtgcgtatacagaacgggcgacaccccctgatggagctgtgcgcacgtacattcgttccaaactcaacggagtgcggcggagacaaagggcgagtcaaggtaatcacgggcccaaactcatctggtaagtcaatctacctgaaacaagttggtctgattacattcatggctcttgttggaagcttcgtgcctgcagaagaggccgagatcggggctgtcgatgccattttcacgaggattcactcttgtgagtctattagtctcggcctgtctactttcatgattgacttgaatcaggtggcgaaggccgtgaataacgcaactgctcagtcgctggtattgatcgacgaattcggcaagggcaccaacactgttgacggccttgccctgctggccgctgtgctgagacactggctggcaagaggtcccacatgcccccacatctttgtggccacgaacttcctttcacttgttcaactgcagttactcccgcaggggcctctggtgcagtatctcacaatggaaacatgtgaggacggcaacgacctggtcttcttttaccaggtatgcgagggcgttgccaaggcctctcatgcctcgcacacagcagcacaagcgggtctgcctgacaagctagtggcgcgagggaaggaagtgagcgacctaatccggagtggtaaacccattaagcctgtgaaggatctgttgaaaaagaaccagatggaaaattgccagactctggtcgataagttcatgaaactggatttagaggatcctaacctggatttgaatgtttttatgtcacaggaggtgctccctgcagctacctccatcctgtag

SEQ ID NO: 23545 - DNA, 2505 bp, Artificial Sequence
  Description of Artificial Sequence: Synthetic coding sequence
atggcttcgctgggggctaaccccagaagaactcctcagggtccaagacctggagccgcttcttctgggtttccttcaccagctccagtgcctgggccaagggaggcagaggaagaggaggtggaggaggaggaagaactggccgagatccacctctgcgtgctgtggaatagtggctacctgggaatagcttactacgacaccagtgatagcactatccatttcatgcccgacgcccctgatcatgagtcactcaagcttctgcagagggtgctcgacgagatcaatccacagtcagtcgtcacctcagccaaacaggacgagaacatgactagattcctagggaaattagcttcacaggagcacagggagcctaagaggcccgaaattattttcctccctagtgtggacttcggcctggaaatttcaaagcagagactcctgtccggaaactacagcttcattccagatgccatgacagctactgaaaagattttgtttctcagctctattattcctttcgattgtctcctgactgtcagggccttggggggtctgttgaagttcctcggacgacgccgaattggagtcgagctggaagattataacgtatcagtgcccatccttggcttcaaaaagttcatgttaactcacctcgtgaatatcgatcaggatacatattcagttcttcagatctttaagagcgaatcacaccccagtgtgtataaggttgcctctggcctgaaggagggactgagcctctttggcattctgaatcgatgccattgcaagtggggcgagaaattgctccgactctggtttaccaggccaacgcatgatctgggcgagctttcctccaggctcgacgtaatccagttcttcttgctcccacaaaacctcgacatggcacagatgctacatagattgttgggtcatatcaagaatgtccccctgatcctcaagcgcatgaaactgtctcacacgaaagttagcgactggcaagtgttatacaaaactgtgtatagtgccctgggcctgagagacgcctgtcggtcgcttccacaaagtatccaactctttcgtgacattgctcaggagttctccgatgacctgcatcatatagccagtttgatagggaaggtagttgatttcgagggctcactcgcagaaaaccggttcaccgtcttaccaaacatcgaccctgagattgacgagaagaagcgcaggctgatgggcctcccgagctttttgacagaagtcgcacgcaaggagctggaaaatctggactccaggattccatcatgctcagtgatttatattcctctaattggattcctcctttctattccacgactgccttcaatggtggaggcgtccgatttcgaaataaatggattggattttatgtttctaagtgaagaaaaattgcactatcgcagtgccagaactaaggagctcgacgcacttttaggagacctccactgtgaaattcgtgatcaggaaaccctgttgatgtaccaactgcagtgccaagtgctagctcgcgcagccgtgctgaccagggtacttgatttagcttcccgactcgacgttctgctggctctggcgagcgccgctcgcgactacggctacagtaggcccaggtactcaccgcaggtattgggcgtcagaatccagaacgggcgacacccgctgatggaactgtgcgctcgtactttcgttcccaacagcaccgagtgtggaggggacaaaggtagggtcaaggttattacgggtcccaactcttcaggaaaatctatctacttgaagcaagtgggtctaataacctttatggccctcgtgggaagttttgtgccagccgaggaggccgaaataggggctgttgatgcaatctttacacgcatccatagctgcgagtcaatttccttaggcttaagcacgtttatgattgacttgaatcaggttgctaaagccgtcaacaatgcaaccgctcagtctctagttctaattgacgagtttgggaagggcacaaacacagttgacggactggccttactggctgcagtattgaggcattggcttgccagaggccctacctgtccacatatcttcgtggccacaaacttcctttcccttgttcagttacagttactgcctcaggggcctctggttcaatatttgactatggaaacctgcgaagatggcaacgatttagtgttcttctaccaggtctgtgagggggtcgccaaggcttctcatgcctcacacaccgcggcacaagctggtctgccagacaagttagtcgcgagagggaaagaggtctccgacctgattcggtcaggcaaaccaataaaaccggtgaaggacctcctcaagaagaaccagatggagaattgtcagactctcgttgacaagtttatgaaactagatctcgaggatcctaatctggacctgaacgtgttcatgtctcaggaagtgctgcccgcagcaacgagtattttatag

SEQ ID NO: 23546 - DNA, 2505 bp, Artificial Sequence
  Description of Artificial Sequence: Synthetic coding sequence
atggcaagcctcggcgctaacccgagacgaaccccccagggaccccgtcccggagccgctagctcagggttccctagtcccgctccagttcccggtcctagggaggctgaagaagaggaagtggaagaagaggaggagctcgccgagatccacctctgtgtcctttggaatagcggttacttgggtattgcctattatgacactagcgactctacaattcatttcatgcctgacgctccagatcacgaatccttaaagttgctgcaaagggtgctagacgaaatcaatccccaaagcgtggtgacttccgcgaagcaggatgagaacatgacccgtttcttgggtaaactggctagccaggaacacagagagcccaaacggcctgaaatcatcttcctcccttcggttgattttgggctggaaattagtaaacagagactattgtctggaaactatagttttattcctgacgctatgacagctaccgagaagatcttgtttctatcatcaataataccttttgattgcctccttaccgtgagggctctgggcggacttctcaaatttctgggcaggcgtcgaattggagtcgagctcgaggactataatgtttccgtgcccatacttgggttcaagaagtttatgctgacgcatcttgttaacatcgaccaggacacctattcggtgttacagatctttaaaagcgagagccacccctccgtgtataaagttgcctctggcctgaaagagggactgtccctttttggcatcctcaaccgatgtcattgtaaatggggagaaaaactcctccggctgtggtttacgcgtccaactcatgatttaggtgaacttagttctcggctggatgtcatccagtttttcctgttgccacaaaacctggacatggcacagatgctacaccgactgctgggacatattaaaaatgtacctcttattctcaaacggatgaaactgtcacacacaaaagtgtctgactggcaagtcttgtacaaaacagtgtatagtgcattagggttaagggacgcatgccgcagcctcccccagtctatacagctattcagggacatcgcgcaggaattctccgacgatctgcatcacatcgctagtctgatagggaaggtggtggacttcgagggatccctggccgaaaaccggtttactgtcttgcccaacatcgacccggagattgacgaaaaaaagagacgcctcatgggcctaccatcctttctgactgaagtggcgcgaaaggagctggaaaacctggacagcagaatcccaagctgtagcgtcatttacatccctctgattggcttcctcctctccatcccacggcttccttcgatggttgaggcctcagacttcgaaatcaatggccttgattttatgttcctctctgaggaaaaactgcactatagaagcgcccgaacaaaggaattagacgctttgctgggcgacctgcactgcgagatccgcgaccaggagacgttgcttatgtaccaactccagtgtcaggtgcttgctagggctgccgtgctgaccagagtattagatttagctagtcgcctggacgtgttactggcgctggcttccgccgcacgagactatggttacagtagacctcgttactcaccccaggtactgggggtgcggatccagaacgggagacacccattgatggagctgtgtgccaggaccttcgtgccaaattcgacagaatgcgggggagacaagggcagggtgaaggttatcacagggcctaacagtagcggcaaatcgatctatcttaagcaagttggcttgatcacctttatggcattggtcggctctttcgtgcctgctgaagaggcggagattggtgcagtagacgctatctttactcgaatccacagctgtgagtccatctcactaggcctcagtacttttatgattgacctgaaccaggtggcgaaagcagtcaataacgccaccgctcagtcactggtgctaattgacgagttcggcaaggggactaataccgtagatgggttggccttgctcgctgccgtgttacgtcactggctggcgagagggccaacctgcccacacatctttgtcgcgactaattttctttcactggtgcagctacagctacttccccaggggcctctcgtgcaatacctgaccatggaaacctgcgaggatggcaatgacctggtgtttttctaccaagtctgtgaaggggtggctaaggcctcacacgcctctcacactgccgctcaggccggtctcccggataagcttgtggcaagaggcaaagaggtcagcgacttgatccgcagcgggaagcccattaagcccgtgaaggacttgctgaagaaaaatcaaatggagaactgtcagaccttggtcgacaaattcatgaaattggatctggaggaccccaatctggatctgaacgtgtttatgagccaagaagtcctgcctgcagcgacttctatcctgtag

SEQ ID NO: 23547 - DNA, 585 bp, Artificial Sequence
  Description of Artificial Sequence: Synthetic coding sequence
atggcaagtttgggagccaatccccgtcgaacacctcagggccctaggcccggtgcagccagttctgggttcccctctcctgctcctgttcccggtccgagagaggctgaagaggaggaagtggaggaggaggaggaactcgctgaaatccacttatgcgtgctctggaactccgggtatctcggaatcgcctactacgatacctccgattccacaatccattttatgcccgatgctcctgaccacgagagtctgaagctgctccagcgggtcctggatgagatcaatccacaatcagttgtgacgtccgctaaacaggatgaaaatatgacccgcttcctgggaaagcttgcttctcaggagcatagagagcccaagcgcccagaaatcatattcttgccgtcagtggactttggcttggaaatttccaagcagcggcttctcagcggcaattacagcttcattcctgacgcgatgacagctacagagaagattctgttccttagttccattataccttttgattgcctactcactgtcagggccctcggtggactgctgaaatttttgggcaggaggagatag

SEQ ID NO: 23548 - DNA, 2469 bp, Artificial Sequence
  Description of Artificial Sequence: Synthetic coding sequence
atggcctcactaggggctaacccaagacggaccccacaggggcctaggccgggtgccgcaagctcaggttttccgtctcccgcacccgttcccggaccccgagaggctgaggaggaggaagtggaagaagaggaggaactagcggagatacatttgtgcgtgctctggaacagcgggtacctgggaatcgcttattacgacacttcggattctacgattcacttcatgcccgatgcccctgaccacgaatctcttaagttgcttcagagggtgttggacgaaatcaatcctcagagtgtggtcacttccgcaaagcaggacgaaaacatgactaggtttctaggcaagctggcttctcaagagcaccgagaacccaaaagacctgagattattttccttccatcagtggattttggcttagagatcagtaagcaacgacttctgagtggcaactattcctttatcccagatgccatgacagctactgagaagatcctcttcctttctagtatcatcccatttgactgtttgctgaccccccctggggaccttcgcttcacccccatcccactgctgatcccatcccaggtacgggcattaggaggcctgctgaaattccttggcaggagaagaatcggagtcgaactggaagactataatgtctccgtccctattttaggctttaagaaattcatgctcacccacctggtgaacattgatcaggacacttattctgtgctgcagatatttaagagcgaaagtcacccttccgtgtacaaagtagcatctggcctaaaagaggggctaagtctattcggcatcttaaaccgatgtcattgtaagtggggggagaaacttctgcggctttggttcacccggcctactcacgatctgggagagcttagcagccgtctggacgtcatccagtttttcttactcccacaaaatctcgacatggctcagatgctccacagactccttggtcatataaaaaacgtgccgctgatcctgaagcggatgaagctgtcacataccaaagtttctgattggcaggtgctgtataagacagtctattcagcactgggtctgagggatgcttgccggagcctgccacaaagtatccagctattccgagatatcgctcaggagtttagcgacgatctccaccacatagcctctctgattgggaaagtggtggactttgaaggctctctggcggagaacaggtttaccgtgctccccaacattgatccagaaattgacgagaaaaagagaagactgatgggcctgcctagttttttaacagaggtggctagaaaagagctggaaaacctggactcccgcattccttcttgcagcgtgatctacatacctctgattggatttttgttgtctattcctcgtctgccctcaatggtcgaggcctcggactttgaaatcaatggactagactttatgtttcttagcgaagaaaagctccactaccgcagtgccagaaccaaggagctcgatgcactgttgggggacctccattgcgaaatccgggaccaggaaaccctgctcatgtaccagttgcagtgtcaagtgcttgcgagggccgcagtccttacgagagtgttggatctcgcaagcaggttagacgttctcctggccctcgcttccgccgctcgagattacggttactctcggcctcgttattcgccgcaggtgctgggagtgagaattcagaacggcagacaccccctgatggaactgtgtgcgcgaacctttgtgccgaactcaaccgagtgcggaggagacaagggtcgtgttaaagtgataaccggtcccaactcatccggaaagtctatctatctgaagcaggtggggcttataacctttatggctttggtgggttctttcgttccggctgaggaggccgagattggggcagttgatgccatattcaccagaatccactcctgcgaaagtatttctctcggactgagcacatttatgattgacttgaaccagcaggtggcaaaagcagtgaacaacgccacagctcagtcactggttttaatcgacgaattcggtaagggcactaacaccgtcgacgggctggccctccttgccgctgttctgcggcattggttagcacgcggtcctacgtgtcctcatattttcgtggccactaattttctatcactggtacagctgcaattactgccccagggacctctagtgcaataccttactatggagacatgcgaggacggcaacgacctggtcttcttttaccaggtgtccgaccttatccgttcgggtaagcccatcaagccagtaaaagaccttcttaagaagaatcagatggagaattgccagactctcgtggataaatttatgaagttggaccttgaggatcccaacctggacttgaacgtatttatgagtcaggaggtccttcccgctgctaccagcattctttag

SEQ ID NO: 23549 - DNA, 471 bp, Artificial Sequence
  Description of Artificial Sequence: Synthetic coding sequence
accgctcagtcgctagtgttgatcgatgaattcgggaagggtactaacaccgtcgatggactggctctgctggcagccgttctgcggcactggctcgctaggggacccacttgcccgcacatcttcgtcgccaccaacttcctttccctcgtgcaattacagctcctgccgcagggacccctggtccaatacctcgtgtgcgaaggggttgcgaaggcttcacacgcctcacataccgccgcacaggccggtctccctgataaactggtggccagaggcaaagaggttagtgacttgatccgttctggcaagcctatcaagcccgttaaggacctcctcaaaaaaaatcagatggagaattgtcagacactcgtggacaagtttatgaaactggacttagaagatccaaatcttgacctgaacgtcttcatgtcccaggaggtgttgcccgcagctacctccatcctttag

SEQ ID NO: 23550 - DNA, 2505 bp, Artificial Sequence
  Description of Artificial Sequence: Synthetic coding sequence
atggcatccctcggcgctaatcctcggcgaaccccacaggggccaagaccaggtgctgcttcttcaggctttcctagtcccgcaccagttccaggccctcgggaggctgaagaggaggaagtggaggaggaggaggagcttgcagagatccacctgtgtgtactctggaattctggttatctagggattgcttactacgatacgagcgattcaactattcacttcatgcccgacgcgccagatcacgaatcgctgaaactcctccagcgcgtgctggatgagattaacccgcagagcgtggttacctctgcaaagcaggatgaaaacatgactagatttctcggaaaactagcgtcgcaggagcaccgcgagcccaaacggcctgaaatcatcttcctgccctcagttgacttcgggctggaaatcagcaagcaaagactgctctccggcaactacagcttcatcccagacgccatgacagcgacagagaaaattctttttctatcatcgatcattcccttcgactgcctattgacggtgagggcacttggagggctgttgaaattcctgggacgacggagaattggggtagagctcgaggattacaatgtcagcgtcccaattctcggttttaaaaaatttatgctaacgcatctagtcaacatcgaccaggatacatatagcgttctccagatctttaagagtgagtcccacccctctgtttataaagtcgcctcaggcctgaaggagggcctctccttgtttggcatcttgaatcgctgccattgcaaatggggcgaaaaacttctgaggctgtggttcacccgccctacccatgatctcggcgaactgtcttcacggctcgacgtgattcaattcttcctcctccctcagaatctggatatggcacagatgcttcataggctgctcgggcacattaagaacgtgcctctgatattgaaaagaatgaagttgtctcacaccaaggtctctgactggcaggtgctgtacaagaccgtgtactccgctctcggcctgcgagacgcctgccgctcactgccccaatcaattcagttatttagagacatcgcccaggaattcagcgacgatctccatcatattgcctctttaatagggaaggtcgttgactttgagggctcactggctgaaaaccggttcaccgtactgcccaacatcgacccagagattgacgagaaaaagaggcggttgatgggactgcccagcttccttacagaagtcgccaggaaggagctggaaaatctggattctagaatcccgtcatgttcggtaatatacatccccttaatcggctttctactgagcattccgaggctaccctccatggtggaagcaagcgactttgagatcaatggactggatttcatgttcctcagcgaagaaaagttgcattatcggtccgcacgcactaaggagcttgatgccctcctgggtgatctccattgcgagatccgcgatcaggaaaccctgctgatgtaccagttacagtgccaggtattggccagagccgctgtgctgactagagtcctggatctggctagtcgcttggacgtgctgctcgcactggcgagcgctgctcgcgattatggctatagccgaccacgatacagcccccaggttctcggagttcggattcaaaatggcagacaccccttgatggaactctgcgctaggacgttcgtcccgaacagcactgagtgcggcggagacaaaggacgggtaaaggttattactggaccgaatagctcagggaagagcatctaccttaagcaggtgggtctcataacctttatggccctggtcggctcttttgtgcccgcagaagaagctgagatcggcgctgtggatgccatctttacaagaatccactcttgtgagagcatttcactcggacttagcacatttatgattgatttaaaccaagtggccaaggctgtaaataacgctacggcacagagtctggtgttgatcgatgagtttgggaaagggacgaacacagtggacggtctggccctcctcgctgcagtgttaaggcattggctcgccagaggccctacctgcccccacatcttcgtcgcaacaaatttcctctccttggtccaactgcaactgcttccccagggaccactcgtccagtacctcacaatggagacatgtgaagacggcaatgaccttgtgtttttctatcaggtgtgtgaaggagtcgccaaggcaagtcatgcttcccacaccgcagcccaggccggtctaccagacaagttggttgcccgtggcaaggaggtttctgatttgattcgctccggtaagcccattaaaccagtgaaagacttgctgaagaaaaaccagatggagaactgtcagacccttgttgataagtttatgaaactggatctggaggatcccaacctggatcttaatgtgtttatgtctcaggaagtcctcccggcagctacaagcatcctgtag

SEQ ID NO: 23551 - DNA, 2505 bp, Artificial Sequence
  Description of Artificial Sequence: Synthetic coding sequence
atggccagtctgggcgcaaatccgaggaggacaccccaggggccaaggcccggtgccgcatcgtccggcttcccctcccctgcacccgtcccaggtccacgtgaggccgaagaggaagaagtggaggaagaggaggagttggctgaaatccacctctgtgttctctggaattctggttatttgggaatcgcctactacgatactagcgattccaccattcacttcatgcccgatgctccagatcatgagagcctgaagctgcttcagagggtgctcgatgaaatcaatcctcagagtgtagtgaccagcgccaagcaggacgaaaacatgacccgattcttgggtaagttggcatctcaagagcatagagagcccaagaggccggagatcatttttttgccctctgtggattttggactcgaaattagcaagcagaggctcctgtcagggaattattctttcatccctgacgcaatgactgccaccgaaaagattctgtttctgagctcaattattccttttgattgccttctaacagtgagggcattgggcggactgctaaagttcctgggacggcgacgcatcggtgtggagctagaagattacaatgtctcagtgcctatcctcgggtttaagaaattcatgctgacccatctggtaaatatagaccaggacacttactccgtgttgcaaatcttcaagtccgagagccaccccagtgtctacaaggtggcttctggcttaaaagagggtctgagcctcttcggtattctgaatagatgccactgcaagtggggagaaaaactgttgagactgtggtttacccgtccaacccacgatttgggcgagctcagcagccggctggacgtgatccagttctttttgctcccgcaaaaccttgacatggcccaaatgcttcatcgactgttaggacacattaagaatgtaccactgatacttaaacgtatgaagctgtcacacactaaggtcagtgactggcaggtcctatacaagactgtttattcagctctgggactgagagacgcctgtcgctcactcccacagtctattcagctctttagggacatcgctcaggagttttccgacgacctgcatcacattgcctctctcatcggaaaggtggtggattttgaaggctcattggcagagaatcgcttcaccgtgctccctaatattgatcccgagatcgatgagaagaagcgcaggctcatggggcttccctcttttctgaccgaggtggctcgaaaagagctcgaaaatctggatagccgtatcccttcttgctccgtgatctacataccacttattggctttctcctttctattcctaggctgccttccatggttgaggcctcagactttgaaataaacggtctggacttcatgttcctgtctgaggagaagcttcattaccggtccgcccgtaccaaagaacttgacgctctgttgggcgacctgcattgtgagatccgggaccaggaaacactcttgatgtaccagctgcagtgtcaagtgctcgcaagagcagctgtgttgaccagagtcctcgaccttgcctccaggctggacgtactgcttgcactggccagtgcagccagggactacggctactctaggccaaggtactctcctcaagtgttgggtgtgcgcatccagaacggccgacatcccctgatggaactctgtgctaggacctttgttccaaactcaacagaatgcggcggagataagggtagagtaaaagttataactggacccaactcgtctggcaaatcaatatatctgaagcaagtgggccttattactttcatggccctggtcggttcctttgtacccgctgaggaagccgaaattggggctgtggatgcaatatttacaagaatacatagctgtgaatcaatcagcctgggcctgtctacctttatgatcgaccttaaccaggtcgccaaggctgtcaataatgcgaccgctcagtctctcgtcctgatcgacgagttcggcaaggggacaaatacagtggatggcctggctctccttgccgctgtactgcgacactggctagcaaggggtccaacatgtccacatatcttcgtggccacaaacttcctgtctctggtgcaactacagttactgccgcagggacctcttgtccagtatctcactatggagacttgtgaagacggcaacgatctggtgttcttttatcaagtgtgtgaaggggttgctaaggctagccatgcgagtcataccgccgcacaggctggccttcccgataaactggtagcacgcggaaaggaggtttcagatctgataagatctgggaagccgataaagccggtcaaggatctccttaaaaagaaccaaatggagaactgtcagaccctcgtggacaaatttatgaagcttgacttagaggacccaaacctggaccttaacgtctttatgagccaggaggttctccctgctgctacaagcattctttag

SEQ ID NO: 23552 - DNA, 471 bp, Artificial Sequence
  Description of Artificial Sequence: Synthetic coding sequence
actgcccagtctttagtgctgatcgatgagttcggcaaggggacaaacacagtggacggattagcactgctggctgctgtcctgagacattggctggctcgcggtcccacctgccctcacatattcgttgctacaaactttctatctctggtgcagttgcagctgttacctcaagggcctctggtccaatacctggtctgcgaaggcgtcgcgaaggcttcacacgcgtctcacacggctgctcaggcgggactccccgacaaacttgttgccagaggcaaggaagtgtctgacctcatcaggagcggtaagcccattaagcctgttaaggaccttctgaaaaagaatcaaatggagaattgccagaccctggtggacaaatttatgaagctggacttagaagatcctaacctggacttgaacgtgtttatgtctcaggaggtgctccccgctgccacttccattttgtag

SEQ ID NO: 23553 - DNA, 2466 bp, Artificial Sequence
  Description of Artificial Sequence: Synthetic coding sequence
atggccagccttggcgctaatccacgccgtacacctcagggcccaagaccaggcgcagcgtcctctggcttcccttctcccgctccggtgcctgggcctcgcgaggccgaggaggaagaagtggaggaagaggaggaactggctgagattcacctatgtgtgctctggaattctggctacttaggtattgcgtactatgatacttctgattctacaatccatttcatgcccgacgcccctgaccacgagtccctgaagctgctgcaaagagttctcgatgagattaaccctcagtccgtggtgacttctgctaagcaggatgaaaatatgaccagatttttaggtaagcttgcctcccaggagcatagagagcccaagcgcccagaaatcatttttctcccatcagtggactttggcctggagatctcaaagcagagactactgtcagggaattattcttttattccagacgctatgacagctaccgaaaaaatactatttttaagctccattatcccatttgactgtcttttaactcctcctggcgatctccggtttacacctatcccacttcttattcccagccaggttagagccctagggggactgctaaagttcctgggtcgtcggcgtattggtgttgagctggaagactacaacgtcagtgtgcccatattggggttcaaaaagttcatgcttactcacctcgttaacattgaccaggatacttactctgtccttcaaatcttcaaaagtgaatcacatccttccgtgtacaaggtggcaagcggtttaaaggaaggactgtcacttttcgggatcttgaaccgatgtcactgcaaatggggagaaaagctactgaggctctggtttacaaggcccacccatgacctgggggagctgtcttcacggctcgacgtgatacagttctttctgctgcctcagaacctggacatggcgcaaatgctccacagattactgggccacattaaaaatgtcccgctgattcttaagaggatgaagcttagtcacactaaggtgtctgattggcaggtgctctacaagaccgtctacagcgccctgggtctcagagacgcctgtcggtctctgcctcagtcaatccaactgtttcgagacattgcccaggaattcagcgacgacctacaccatattgcctccctgatagggaaggtagtagattttgaggggtctctcgctgagaataggttcacagtgctcccaaatattgaccccgagattgatgagaaaaagcggagattgatggggctgccttccttccttactgaagtggcccgaaaggagctcgagaacttagatagtcggatcccctcatgttccgtcatttacatcccactcattggatttctcctgtctatccctcgcctgccgagtatggtggaagctagcgatttcgaaatcaacggactcgacttcatgttcctatcagaagagaaactgcattataggtctgctagaactaaggagctagacgctctcttgggtgatctgcactgcgagatccgggaccaggagaccctactgatgtaccaattacagtgccaggttcttgctagagctgcagtgctaacgcgggtcctcgacctcgcatccagactcgatgtgttgctggccctggcatctgccgctcgcgattatgggtatagccggcctaggtactccccgcaggtcctgggagttagaatccagaacgggagacacccactgatggagctgtgcgcaaggactttcgtcccgaactcgaccgagtgtggcggagacaaggggagagttaaggtaattactgggccaaacagtagcgggaagagtatctacctcaagcaggtgggtctaattacttttatggctcttgtgggctcatttgtccccgcagaagaagccgaaatcggcgcagttgacgccatatttaccaggatccacagctgcgaaagtatctccctcgggctgtccaccttcatgattgatctgaaccaggtagcaaaggctgtgaataacgccacagcccagagtttagttctaattgacgaatttggaaaaggaacaaacaccgtggacggcctcgctctcctggccgcagtgctcagacactggttagctcgtggccctacttgccctcatatttttgtggctacgaactttctttcgctggttcagctccagctgctgcctcagggcccactggtgcagtacctgaccatggagacctgcgaagatggtaatgacctggtctttttttaccaggtgtcggacctgatccggtcaggcaaacctatcaaaccagttaaggatctactcaaaaaaaaccagatggagaattgtcagaccctggttgataagttcatgaaattagatttggaggatcctaatctggatctgaatgttttcatgtcccaggaggtgcttcctgccgctacatccattctttag

SEQ ID NO: 23554 - DNA, 2556 bp, Artificial Sequence
  Description of Artificial Sequence: Synthetic coding sequence
atggcctcccttggcgcaaacccaaggagaacaccgcagggccctagacctggggcagcaagttccgggttcccttcacccgcacccgtgccaggacctagggaagccgaagaagaagaagtggaagaagaggaagagctggccgaaatccacctctgtgtattatggaatagcgggtatctcggtatcgcctactatgatactagcgactcgactattcacttcatgccagatgctccagatcatgagagtctcaaattgctccagcgggtactggatgagatcaacccacagagcgttgtgacttccgccaaacaggacgagaatatgacccgttttctgggcaagcttgcgtctcaagaacatcgcgagccgaaacgtcccgagattatctttctgccttccgttgactttgggctagagatcagcaaacagagactcctgtccggcaattactcctttataccagacgcaatgactgcaaccgagaaaatcctgtttctctcatccattataccctttgactgtctcctgactcccccaggggatcttcgcttcaccccaattccactgttgatcccgtctcaggtgagagccctagggggtctgctcaaattcctggggaggcgcagaatcggtgtcgagttggaggattataatgtgtccgtgccgatccttggattcaaaaaatttatgctgacacacttggtaaatattgatcaggacacatactccgtattgcaaatttttaagagtgagtcacatccatctgtgtacaaagtggctagtgggttgaaggaaggtctttctctctttggcatcctgaatcggtgccactgtaagtggggagagaaattgctgaggttgtggttcactagaccaacacacgacctgggagagctctcatcaagactggatgtgatccaattctttcttctgccccaaaatctggatatggcccagatgctccacaggctgctcggccacataaagaatgtacccctcatcctgaaacggatgaagctgtcacatacaaaagtgagcgattggcaagtcctgtataaaacagtctattccgcattagggctgagagacgcctgcaggagtcttccgcagtcaattcaactatttcgcgacattgcacaggagtttagtgatgacctccaccacatagcttctctgataggcaaggtggtcgactttgaggggagcctcgcagaaaatcgctttactgtacttccaaatatcgacccagagattgatgaaaagaaaagaagattaatgggactgccaagctttctgaccgaggtcgccagaaaggaactggagaatctggatagcaggatcccgtcttgttccgtcatctacatacctcttataggattcttattatccattcccagactgccaagtatggtggaagcgtccgactttgaaattaatggccttgattttatgtttctgagcgaagagaagctccactaccgatctgccagaaccaaagagctggacgctttgttaggagatctccactgcgaaatccgggatcaggaaaccctcctgatgtaccagttacaatgccaggtacttgccagggccgctgtgctcacccgggtgctggacttggcgtcaagactcgatgtactgctcgcactggccagtgctgcgcgagattatgggtactcccgcccacggtattcacctcaggtccttggtgtgcgcatccagaacggaagacaccctcttatggagttatgtgctcggacgtttgtgcctaactcaaccgagtgcggaggagacaaaggcagggttaaggtgattacagggcctaactcctctggcaagtctatttacttgaaacaggtcggcctgattacctttatggctctagttgggtccttcgtgcctgctgaggaagcagaaattggcgcagtggatgccatctttaccaggattcacagttgcgagtcaattagcttgggtctcagtacatttatgattgatcttaatcaggtggctaaagctgttaataacgccacagcccagtcccttgtactgatcgacgagttcgggaagggtactaacaccgtggacggcctggcattactggctgccgtgctgagacactggctcgctaggggccctacatgcccccacatcttcgtcgcgactaatttcctgtccttggtacaattgcaactgctccctcaggggccactcgtacagtacctgacaatggagacttgcgaagatggcaacgacctggtcttcttctatcaggtgtgtgagggcgtagccaaagcttcacacgcaagccatacagctgcacaggcaggtctccccgacaagctggtcgctcggggtaaggaggtttccgaccttatccgttcgggcaaacccatcaaacccgttaaagatctgctgaaaaaaaaccagatggaaaattgccagactctggtcgataaattcatgaaactggatctggaagaccccaatcttgatctgaatgtgtttatgtcgcaggaagtgctgcccgctgccacatcaatcttatag

SEQ ID NO: 23555 - DNA, 1602 bp, Artificial Sequence
  Description of Artificial Sequence: Synthetic coding sequence
atggcacaaatgctacatcggctactcgggcacataaaaaacgtgccccttatcttaaaaaggatgaagctttcgcacaccaaagtgagcgactggcaggtcctatacaagacagtgtacagtgcactgggactgcgggatgcgtgtcgatcactgcctcagagcattcaactgttccgggatattgcacaggaattctcggacgacctgcatcatatcgcatcactgattggaaaggtggtggactttgagggaagcttagccgagaacaggtttacagtgctgcccaacatagatccagaaattgatgaaaaaaaacgtcgactgatgggtctgccaagctttctgactgaagttgcacgaaaagagcttgagaatctggacagcaggatcccgtcttgcagcgtgatttacatcccgttgatcggctttcttctaagcatcccgcgactgccaagcatggtggaggccagcgatttcgagattaacgggctcgactttatgtttctcagcgaggagaaactgcactaccggtcggccaggactaaggaactggatgctctgcttggcgacctgcactgcgaaatcagggaccaggagacgttacttatgtaccagctccagtgccaagtgctggccagggcggctgtgttgacacgggtcctcgacttggcttctcgattggatgtgctcctcgctctggcaagcgctgccagagactatggatattcccggccaagatatagcccccaggttctgggtgtgcggattcaaaacgggcgacaccctctgatggagctttgcgcacgtacttttgtaccaaacagtaccgagtgtggcggagacaaaggacgggtcaaagtgataaccgggcctaatagcagcgggaagtccatctacctaaagcaggtgggattaatcacattcatggctctcgtcggatctttcgtgccggcagaggaggctgagataggcgcagtggatgctattttcacaaggattcattcctgtgagtccatctcactgggcctctctacattcatgatcgatctcaatcaggtcgctaaggcagttaacaacgctaccgcacagtccttagttctgattgatgaattcggaaaggggaccaacaccgtggacggactagccttactggccgcagtactgaggcactggctggcgaggggaccgacttgtccccatattttcgtcgctaccaattttctcagtttagtacagctccagctgctgccacaggggccacttgtccagtatcttacaatggagacgtgcgaagatggtaacgatctggtgtttttctaccaggtgtgtgaaggagtggccaaagcctctcacgcatcacatactgcagctcaggctggtttgcccgacaagcttgtcgcaagggggaaggaggtgtcagatcttattaggtctggtaagcccatcaagcccgtgaaagatctgcttaaaaaaaatcagatggaaaactgccagaccttagtggacaagtttatgaaattggacctggaggacccaaacctggatctgaacgtatttatgtcacaggaggtcctccccgctgctacctccattctctag

SEQ ID NO: 23556 - DNA, 765 bp, Artificial Sequence
  Description of Artificial Sequence: Synthetic coding sequence
atggcctcactcggcgcaaatcctaggagaacccctcaggggccacggcctggagccgcatctagtggattcccttctccagcaccagtgccaggacctagggaagctgaggaggaggaagttgaagaagaagaagagctggccgagatccatctctgtgttctgtggaattccggatacctgggcattgcttactatgatacgtctgactcaacgatccattttatgcctgacgcccctgatcacgaatcactaaaacttctccagagagtgctggacgagatcaaccctcaaagcgtagtcaccagcgctaaacaagacgaaaatatgacccgcttcctcggcaaactggcttcccaggagcatagggagccaaaacgcccagaaattattttcttacccagcgtcgacttcgggttggagatttccaagcagcggcttctttcaggcaattactcattcattccagatgctatgaccgcaacagaaaaaattctgttcctgtcaagtatcattcccttcgactgtctattgaccgttcgggcactgggaggactcctgaagtttctcggtaggcggcgtataggagtggaacttgaggactacaatgtgagcgtccccatcctcggctttaagaaatttatgctgacacacctggtgaacattgatcaggatacatatcgactcgagtgcaatggggcaatatctgcccagtgtaacctgtgtcttctgggctccagcgattctccggcttctgcttcctag

SEQ ID NO: 23557 - DNA, 816 bp, Artificial Sequence
  Description of Artificial Sequence: Synthetic coding sequence
atgttcctgtctgaagaaaagctgcactacagaagtgccagaacaaaggaactggatgccctgcttggggacctccactgtgaaatccgggatcaggaaacacttcttatgtaccaacttcagtgccaagtgctggcaagggcagctgtgctcacccgtgtactagatctcgctagtcgactggatgtgttactcgccctggctagcgccgcacgggattacgggtattcccgcccacgctacagcccccaggtcctcggggtgcgaattcaaaacggacggcatccgctcatggagctgtgtgcgagaacctttgtgccaaactcaaccgagtgcggtggggacaagggacgagtcaaggtgataaccgggccaaacagttctggaaagtctatttacctgaagcaggtaggattaatcacatttatggccttggtaggatcctttgtccctgcagaagaggccgaaatcggagctgtagacgccatttttactaggatccacagctgtgagtctatcagtctgggcttgtccaccttcatgatcgatttgaatcaggtggcgaaggctgtcaacaatgccaccgcacagtctcttgtgctaattgatgagttcggtaaagggaccaatacggtggacggtttggccctgctcgccgctgttctgcggcactggctcgccagggggcctacctgtccacatatttttgttgctacaaattttctttccttggttcagctgcagcttcttccgcaaggccctttggtccaatatctagattggccacgagtgtcagggcaagagggaggcgactag

SEQ ID NO: 23558 - DNA, 1602 bp, Artificial Sequence
  Description of Artificial Sequence: Synthetic coding sequence
atggcccagatgctgcaccgtctgctgggtcatatcaaaaacgttcctttaatacttaagcggatgaagctcagtcatacaaaggtttctgactggcaagtactgtacaagaccgtatactccgctcttggtctcagagatgcctgccgctctctgccacagtctattcagttattccgcgacattgcacaggagttctccgacgacttgcaccatatagcgagtctcataggcaaagtggttgacttcgagggttctctcgccgagaacaggttcacagtattacccaacattgaccccgaaattgatgaaaagaagcggcgactaatgggtctcccatcttttctgaccgaagtggctcgaaaggagctggagaacttggattcaagaattcctagttgtagtgtgatatatattccgctgatcgggttccttctgtccataccgagactgccatccatggtggaggcctccgattttgagatcaacgggctggatttcatgttcctgtccgaggagaagctgcactaccgctctgctcgaactaaagagcttgacgcgctgttaggcgatcttcactgtgaaatcagagaccaggaaactctgctgatgtatcaactgcagtgtcaagtcttggctagagccgcagtgctcacccgggtgttggatttggctagtagactcgatgtgcttttggccctggcatccgccgctcgggactacggctattctcggcctcggtacagcccacaggtgttgggcgtgcggatacagaatggaagacacccccttatggaactgtgtgccaggacctttgttcccaacagtacagaatgtggaggagataaaggccgagtgaaggtgatcaccggacccaattcatccggcaagagcatctaccttaaacaggtcggtctcatcacctttatggccctagttggcagcttcgtgccagctgaggaggctgaaattggcgctgtcgacgcaatcttcactcggattcacagctgcgagagcatttcgctggggctgagtacattcatgatcgacctgaatcaggtggcaaaagccgtgaacaatgccacagcccaatcccttgtcctcattgatgagtttggtaagggcacaaatacggtcgatgggctggcgctcttagcagcagtgctacgacattggcttgctaggggacccacctgcccacatatctttgttgccaccaacttcctgtcgctagttcaactccagctgcttccccaggggccacttgtgcagtatctcacgatggaaacctgtgaggacggcaacgatctagtctttttttatcaagtttgtgagggagtggccaaagctagccacgcatcacacacagcagcccaggccggtctacccgataaattggtagctaggggcaaggaagtgtccgatcttatcagaagtggcaaacctatcaagcctgtgaaggatctgctgaagaagaaccaaatggaaaactgccagactctcgtagataagttcatgaagttggacctagaggaccccaatctggacctgaatgtcttcatgtctcaagaggtgctgcctgcagctacaagcattctttag

SEQ ID NO: 23559 - DNA, 816 bp, Artificial Sequence
  Description of Artificial Sequence: Synthetic coding sequence
atgtttctctcggaggagaagctgcactataggagtgcgagaaccaaagagcttgacgctctgctcggagatcttcattgtgagatcagagatcaggagactttattgatgtatcagttacaatgtcaagttttagcgagagctgccgtgctcacacgagtgctcgatcttgcttcaagattggatgtcctgctggctctggcatcggctgctcgagactatggatactctaggcctaggtactctccacaagtcctcggcgtgcggattcaaaatgggagacacccccttatggaactgtgcgcaagaacattcgtgcctaattctacagagtgtggaggtgacaagggtcgtgtgaaagtgattacaggaccaaacagctcaggcaaatccatctatcttaagcaggtgggactcatcacattcatggcccttgtcgggtcctttgtccccgctgaagaggctgagataggagcagtggacgcaatatttaccaggatccatagttgcgagtctatcagtttggggctctccactttcatgattgatctgaaccaggtggccaaggctgtcaataacgccacggcacagtcactggtccttattgatgaattcggaaagggcacaaatacagtcgacggcttagccctgctggctgccgtattgcgacattggttagccagaggacccacctgcccccatatattcgtggcaaccaacttcttgtcccttgttcaattgcagctgcttccacagggcccactggtccagtatctggattggcctcgcgtgtcaggccaggagggaggcgattag

SEQ ID NO: 23560 - DNA, 765 bp, Artificial Sequence
  Description of Artificial Sequence: Synthetic coding sequence
atggcaagcctgggcgctaacccacggaggacacctcagggcccacggcctggggcagcctctagtggctttccttcccctgcccctgtgcctggacctcgcgaagctgaggaggaggaggtcgaggaagaagaagagctggccgaaattcatttgtgtgtgctgtggaattcaggctatctcgggattgcgtattatgatacttcagacagtacgatacatttcatgccagatgctcccgaccatgagtctctgaagctcctgcagcgagtgctggacgagataaacccccagtccgtcgtgaccagcgccaagcaggacgaaaatatgactcgcttcctcggcaagttagccagccaggagcacagagagcctaagcgaccagagataatctttctgccttctgtggatttcggcttagagatctctaaacagcggctgttatctggcaattattcgtttattcccgatgccatgactgccacggagaagatactgtttctctccagtatcatccctttcgactgtctcctgacagtgcgcgctttgggcggactcctgaagtttctgggtaggcggcgaattggagtggagctcgaggactacaatgtcagcgtcccaatcttaggattcaagaaattcatgctgacacatttagtgaatatcgatcaggacacatatcgcctggagtgtaatggagccatttcagctcagtgcaacctgtgcctattgggatcatccgactctcccgcttctgcttcatag

SEQ ID NO: 23561 - DNA, 765 bp, Artificial Sequence
  Description of Artificial Sequence: Synthetic coding sequence
atggcctccctgggggctaaccctagaaggacaccccagggcccacgtccaggggctgcaagttctggcttccccagccctgcccctgtcccgggacctcgcgaagccgaggaagaagaggtggaggaggaagaggagctggccgagatacacttatgtgtgctgtggaactctggttacctaggaatagcatattacgacacctctgacagtaccatccatttcatgcccgatgcccctgaccatgaaagcttgaagcttcttcagagggttctggatgaaatcaatccccagtccgtggtgacaagtgcaaaacaggacgagaacatgacacgctttctcgggaaattggccagtcaggagcaccgagaacccaaacgacccgagataatttttcttccgagtgttgacttcggcttagagatatctaaacagaggcttctgtccggtaactactctttcattccggatgccatgacggcgacagagaagatccttttcctgagctcgattatcccctttgattgcctgctaacggtgcgcgctctgggagggcttctgaagttcctgggtcggcgacggatcggtgtcgagctcgaggactataatgtctccgttccaattcttgggtttaagaagttcatgctcacacacttggtgaatatagatcaggacacatacaggctggagtgtaatggcgcaataagcgcccagtgtaatttgtgtcttctggggtcatctgactcccctgcctcggcctcttag

SEQ ID NO: 23562 - DNA, 1602 bp, Artificial Sequence
  Description of Artificial Sequence: Synthetic coding sequence
atggcccagatgcttcacagactgctgggtcacattaaaaacgtccccctcatcctgaagcggatgaaactgtcacacaccaaagtgtcggattggcaggttctttacaagactgtctacagcgccttgggattaagagacgcttgcagatccctgccccaaagcatccagctgttcagagacatcgcccaggaattttctgacgatctgcatcacattgctagcctcataggaaaggttgtggattttgaaggatcgttagctgaaaatcgctttaccgtgttgcctaacattgaccctgaaattgatgaaaagaagcgccgattaatgggactgccctccttcttaacagaagtagccaggaaggagttggagaaccttgacagtaggatacccagctgttccgtcatctacataccccttatagggttcctcctgtcaatcccacggcttccctctatggtcgaggccagcgacttcgagatcaatgggctcgattttatgttcctgtcagaagaaaaactgcactacaggagtgctagaacaaaagaattagatgcattgctgggggatctacattgtgaaattcgcgatcaggaaacactcctgatgtaccagctgcagtgccaggttctcgccagggccgcagtgcttaccagggttctagatctcgcctctcggctcgacgtgctcctggccctggccagcgccgctagggattatgggtacagtaggcctcggtactccccacaggtgttgggtgtgcggatccagaacggaagacacccactgatggagctttgcgctcgtacgtttgtacccaattcgactgagtgtggcggagacaaaggccgagttaaggtgatcacggggccaaattcctccggcaaaagcatctatcttaagcaggtcggcctgataaccttcatggctttagtgggatccttcgtgccagccgaagaggccgagatcggggctgttgatgccatcttcacacgcattcactcgtgcgagtccatttcactggggctcagcacctttatgattgatttaaaccaagtcgcaaaggccgttaacaacgcaacagcccagtccctggtgctcatcgacgaatttggaaagggcaccaataccgtggatggcttagccctcctggccgctgtgctccgccattggttagccagaggccctacttgtccacacatttttgtggcaactaattttctgagcttggttcagttgcaactgcttccgcaaggaccactagtgcagtatctcaccatggaaacgtgtgaggacggcaatgaccttgtttttttttatcaggtctgcgagggcgtggctaaggccagccatgctagccacacagctgcacaggcagggttgcctgacaagctggtagccagaggcaaggaggtctccgatctgattcgttccgggaaaccgattaagcctgtgaaagacctgttgaaaaaaaatcagatggaaaactgccagacactcgttgataaatttatgaagctggacctggaagatccaaatctggatcttaacgttttcatgagccaggaggtgctgccagcagccacctccatcttatag

SEQ ID NO: 23563 - DNA, 2556 bp, Artificial Sequence
  Description of Artificial Sequence: Synthetic coding sequence
atggcatctctcggcgcaaacccgagacgcactccccaaggcccacgccctggtgccgctagttccgggtttccatcccccgctccagtgccaggacccagagaggctgaggaggaggaagttgaagaggaggaagagctcgctgaaattcacctttgtgtcctgtggaacagcggatatcttggtatagcttactacgacaccagcgatagtaccattcatttcatgccagatgccccagatcacgagtccctgaagctcctccagagagtcctggatgagattaacccccagagcgtagttacctctgccaaacaggacgaaaacatgacgagattcctcgggaaactagctagccaagaacaccgggaacctaagagacctgaaatcatttttctccccagtgttgactttggcctggaaatctctaaacagcgcttgctgtcaggcaattatagttttatcccagatgcaatgacggccaccgaaaagatcctgttcctctctagcatcattccatttgattgtctgctgacccccccaggtgaccttagattcactcctatccctctgttgattccctctcaggtgagggctctgggaggattactgaaatttctcggcagaagaaggataggtgtggaactcgaggactacaacgtctcagtgcccattctggggtttaagaagttcatgctcacccacctcgttaacatcgaccaagacacatactctgtcctacagatcttcaagtcagaatcacaccctagcgtgtacaaagtcgcatccggactcaaagaagggctgtcgctcttcggcatccttaacagatgccactgcaagtggggagagaagctgttacgcctgtggtttacgaggcctacccatgacctaggcgagcttagttcacgcctggacgtgatccaattcttcctcttgcctcaaaatctggatatggctcaaatgctgcatagattactggggcatattaagaatgttcctctgatattaaaaagaatgaagctgtcacacacaaaagtaagcgactggcaggtcctttataagaccgtttactctgccctgggtctgcgagacgcctgtcgctctctaccccagtccattcaactgttcagggacattgcacaagaatttagcgatgatctccaccatatcgctagcctaatcggcaaggttgtggactttgagggatctttggcagaaaaccgattcacagtcctgccaaatatcgatccagagatcgacgaaaagaagagacgcctgatgggcttgccatcctttttgacagaggtcgccagaaaagagctcgaaaacttagacagccgtataccgagctgttcagtcatttacatcccactgattgggtttcttctaagtatcccccgacttccctccatggtagaggcctcagatttcgagataaacggattggacttcatgtttctgtctgaagagaagctgcattatcgttcagccaggaccaaggagcttgatgccctgctcggtgacctgcactgtgagattcgggaccaggagacactacttatgtatcaactgcagtgtcaagtgttggcaagagccgcagtacttacgcgagtgttggacctcgccagtcggttagatgtactgttggccctcgcttctgcagcacgtgactatggttatagtcggccacgctattcccctcaagtccttggggttcggatccagaacgggagacaccccctgatggagctttgcgccagaaccttcgtgcctaacagcacggagtgcggcggtgataagggaagagttaaggttattacaggtccaaactcaagcggtaagagcatatatctgaagcaagtaggattgataactttcatggctcttgtggggagcttcgtgcccgcagaagaagcagagattggggctgtggatgccatctttacacgcatccactcatgtgagtccataagcctgggtctctctaccttcatgatcgatctcaaccaggtggccaaggctgtcaataacgccactgcacagagcctcgtccttatcgacgagttcgggaaaggaaccaacaccgtggatggcttagcgttactggccgcagtactgagacattggctggcacggggtcccacgtgcccccacatttttgtagccacaaattttctctccctggtgcagctacagctccttccccagggcccactggtgcaatacctcaccatggagacctgcgaagacggaaatgacctggtctttttctaccaggtgtgcgaaggggttgctaaagcctcacatgccagccacacagctgcccaggctggcctccctgataagctcgtggcaaggggcaaggaagttagtgacctcataaggtcaggtaaaccaatcaaacctgtgaaagatctactgaaaaagaaccagatggagaactgccagacgctagtcgataaatttatgaagctcgacctagaggacccaaacctagatctaaatgtgttcatgagccaggaggtcttgcctgctgctacaagcatcctttag

SEQ ID NO: 23564 - DNA, 1200 bp, Artificial Sequence
  Description of Artificial Sequence: Synthetic coding sequence
atggcttcagccgcagcaggcgaagcagaggaaaccactaggctacgcaaacctcgatttagttttgaagaaaaccagattctgattagagaggtccgggctcactaccctcagttatacggggctcagagccgccgtgtgagtgtggctgagagacggcgagtgtgggacggaattgcagccaaaataaatgggatcacctcttggaagaggactgggcaagaagtgcaaaagaggtggaatgactttaagcgccgaaccaaagaaaagttggcgagggtaccccactctactcaaggcgctgggccagctgccgaagacgcctttagcgcggaggaagagactattttcgccatactgggccctggcgtggccgcacccggagccggagctggggctgaggagccgccagccgcaccatcaagccagccaccgcctccatccgcatgccctcagcggtacgtgctgagcgaagatagaagagaagatcgccgtgcagacaccagtgctcacagtaaagcaggctccagtagcccagagccttgggcacggccaagctgcaccccgcaggaggggggatgtcctcgccctaaggagagggagtcccctcccccttctgcactgcaaccagtacaactgcctcgactggccctctcacctcctcctcccgctccccctctacctccaccaccaccattggcccaggtcgcccctagccctccaagccctcctcctcccccacggcctcctcccactttaagtgcctccgatcctagcctcgactttctgcgtgcacagcaggagacagccaacgcaatccgtgagttggccggaaccctaagacagggccttgcaaagttgtcggaggctctgtccgctttgctgcccctgttgccaggcacacccgtagactccttgccacctccacttcctccgcctcctcctccacctccacctccccgtccggttctgcctccacccgcacccaaagtggaaatcacccctgagcccgtatcggtcgtggctgctgtcgtagacggcgctgtggtggccgcaagaggggttatcattgcccctcgctctgaggaaggcgcacccaggccccctccagccccactccctcctcacgatagtccacctcacaaacggaggaagggattcccaactcggaagagaaggggaaggtggaaatccccatag

SEQ ID NO: 23565 - DNA, 708 bp, Artificial Sequence
  Description of Artificial Sequence: Synthetic coding sequence
atgcgaacacaggtgtacgaaggcctctgtaagaactatttttcccttgcagtcttgcagcgcgacaggataaagcttctattcttcgacatcctagtctttctgtcggtgttcctcctgtttttactgttcttggtggatattatggccaacaacactacctctctcggctccccctggcctgaaaatttttgggaggacctgattatgtcttttactgtgagtatggctattggcctggtactgggcggattcatttgggctgtgttcatctgcctgtcgcgtaggcgcagggcaagtgcccctatatcgcagtggagcagctcacgacgatcccggagctcgtatacccatgggctgaaccgcactggcttttaccgccattcaggctgcgaacggaggagcaatcttagcctcgcatcactgacatttcagcggcaggcctccctggaacaagccaattcgtttccaagaaagtccagctttagagcctccacattccatccatttttgcaatgtcctccattgccggtggagaccgaaagccagttagtgacactgccctctagcaacatttcacctacaatctctacttcgcacagtcttagtcgcccagattactggagctccaatagtctgcgtgtaggcctgagtacacctcccccaccagcctatgaaagcataatcaaagccttcccagattcctag

SEQ ID NO: 23566 - DNA, 651 bp, Artificial Sequence
  Description of Artificial Sequence: Synthetic coding sequence
tgaagagacagaattaagctgctgtttttcgacattctggtgttcttaagtgtgttccttctgttcctcctgtttcttgtagacatcatggcaaacaacaccacttctctgggaagcccctggcctgagaacttctgggaagacctcataatgagtttcacagtctccatggctatcgggctggtcttgggcggattcatttgggcggtgttcatttgcttgagtaggcggagacgggcttccgcacccatctctcagtggtcttctagccgccgaagccgctcctcttatacacacggcctgaaccgcacgggcttttaccgacacagcggctgtgagcgaaggtcgaatttgagcctggcctctctcacgtttcagcgccaggcgagccttgagcaggcaaactcgttccctcggaaaagtagctttcgtgcttcaacgttccatccctttcttcaatgcccgcctctgccggttgaaactgagtcccagttggtgaccctacctagtagcaacatcagcccaacaatctcgacgtctcacagtttaagcaggccagattactggagttcaaattctctgcgggtggggttatctactcccccaccccctgcgtacgagagcattattaaagcctttccggactcctag

SEQ ID NO: 23567 - DNA, 1833 bp, Artificial Sequence
  Description of Artificial Sequence: Synthetic coding sequence
atgcagtacagccaccactgcgaacatttattagaaagattgaataaacagcgggaggctggcttcttatgtgattgtaccattgtaatcggcgaatttcaatttaaggctcacaggaacgttttggcgtccttttcagagtactttggcgcaatttaccgaagcacttcggaaaacaatgtatttctggaccagtcccaggtgaaagccgacgggttccagaagctgctcgaattcatctatactggcacgcttaatctagattcctggaacgttaaggagattcatcaggccgcagactacttgaaggtagaggaggtcgtgactaagtgcaaaatcaagatggaagattttgcttttatcgcaaaccctagctccacagaaatctcaagtatcaccggtaatattgaattaaatcagcaaacttgcttgctaactctacgtgattataataatcgagaaaaaagcgaagtgtcgactgatctgatacaggcaaatccaaagcagggcgcactggctaaaaaaagctctcagaccaaaaaaaaaaaaaaggcatttaacagtcccaaaaccggacagaacaagacagttcaatatccatcggacatactcgagaatgcttcagtggagctgtttttggacgcgaataagctgcctactcccgttgttgaacaggtagcccaaattaacgacaatagcgagcttgagttgactagcgtcgttgaaaacacctttccggcacaggacatcgttcatacggtcactgtgaagcgtaagcgagggaaaagccagccaaactgcgcccttaaggagcattcaatgagtaatatcgccagtgttaagtccccttatgaggctgagaactctggagaagagttggatcagcggtacagtaaggcaaagcctatgtgtaatacctgtggtaaagtgttcagcgaggccagttccctgaggagacacatgcgcattcacaaaggcgtcaaaccatatgtttgccacctgtgtggcaaggcatttacccaatgcaaccagctgaaaactcacgtcagaacacacaccggcgaaaaaccctacaagtgcgaactctgtgataagggttttgctcagaagtgccagctggtgttccattctcgaatgcatcacggcgaggaaaaaccttacaaatgtgatgtgtgcaaccttcagtttgctacctcctccaacctcaaaatacacgctcgtaaacattcaggtgagaaaccctatgtctgtgacagatgcggtcagaggttcgcccaagcctcaaccttaacatatcacgtaaggagacacacgggcgagaagccttatgtttgcgacacatgcggcaaagccttcgccgtctcatcttctcttattacccattcacgcaagcataccggggagaagccatatatatgtggtatttgcggcaaaagctttatctcctccggggagcttaacaagcattttcgaagtcacacgggtgaaaggccatttatctgtgagctgtgcggcaattcctatacagacatcaagaatctgaagaaacacaaaacgaaggtgcactccggggctgataagacactggacagctctgctgaggatcacaccctgtcagaacaggattcgatccagaaatccccgctgagcgaaactatggacgtgaaacccagcgatatgactctgcccttggcactccctctcggcacagaggatcatcacatgctgttaccggtgacagacacacaatcccccactagtgacacacttttacgttccacagtcaatggctactcggagcctcagctgatctttctccaacaactctactag

SEQ ID NO: 23568 - DNA, 1833 bp, Artificial Sequence
  Description of Artificial Sequence: Synthetic coding sequence
atgcaatacagtcaccattgcgagcacctgctggagaggctgaacaagcagcgagaggcaggttttctgtgcgattgcaccatcgtcattggcgaatttcagttcaaggcacatagaaacgtactcgcctccttttccgagtacttcggcgctatctaccgctcaacaagtgagaacaatgtgtttctggaccagagccaggtgaaagctgatggcttccagaaattgttggagtttatctataccggcaccctgaacctcgacagctggaacgtgaaagagattcaccaggctgctgattacttgaaagtagaagaggttgtaacaaaatgcaaaatcaaaatggaggatttcgcctttatcgctaacccatcttccactgaaatttcctccataactggcaacatcgagctcaaccagcagacttgcctcctcacactccgagattacaataaccgcgaaaagtccgaggttagcaccgacctaatccaggccaatcccaagcagggagccttggcaaagaaaagctcccagacaaaaaaaaagaaaaaggcattcaattctcctaagactggccagaacaaaacagtgcaatacccaagtgacatcttggaaaacgcctccgtcgagctgtttcttgatgccaacaaattgcctacccctgtggtcgagcaggtggcacagataaatgataattcggagcttgaattaacaagcgttgtcgagaatacctttcccgctcaggacatcgtgcataccgtgactgttaagcggaagcggggtaagagtcagcctaattgtgctcttaaagaacactctatgtccaatattgcaagtgtcaaaagcccatatgaggctgaaaattctggcgaggaactcgatcagagatactctaaagcgaagcctatgtgcaatacttgtgggaaagtgtttagtgaagcctcctccctgaggcgccacatgagaattcataaaggggttaaaccatatgtttgccacttgtgcggaaaggctttcacccagtgtaatcagctcaaaacgcatgtgagaactcacaccggggaaaaaccttacaagtgcgagctgtgtgataagggatttgctcagaaatgccagctagtcttccactccaggatgcaccacggagaggaaaagccctataagtgcgacgtttgcaacttgcagtttgccacctcttcaaatctgaaaatacacgccaggaagcacagcggcgaaaagccgtatgtttgtgaccgatgcggccagcgcttcgcacaggcttcgacactgacctaccacgtgcgcaggcataccggggagaagccatatgtctgcgacacctgcggaaaagcctttgccgtctcctcctctttaattacccatagccgcaaacacaccggggaaaagccttatatatgcggcatatgcggcaagtcctttatttcttcaggcgaactgaataaacactttaggagccacacaggcgagaggcctttcatttgtgagctgtgtgggaattcgtatacagatatcaaaaacctgaaaaagcataaaactaaggtacattctggagccgacaagacgcttgatagcagtgcagaggatcacaccctaagcgagcaggacagtattcagaagtctccactgagcgaaacaatggacgtgaaaccgagcgatatgaccctccccctagccttgcctctcgggaccgaagaccaccacatgctcctgccagtcacggatactcagtcccctactagtgacacgctgctgcggagcaccgttaatggctacagcgaaccccagttaattttcttgcaacaactgtattag

SEQ ID NO: 23569 - DNA, 1503 bp, Artificial Sequence
  Description of Artificial Sequence: Synthetic coding sequence
atgcagtatagccatcactgtgaacatcttcttgagcggctgaataagcaacgggaggccggtttcctatgtgattgcacaattgttattggcgagtttcagtttaaagctcaccgcaacgtactggcctctttctccgaatactttggagccatatacagatctacaagtgagaataatgtgtttttagaccagtcacaagtgaaagccgacggcttccagaagttgttggagttcatttatacagggaccctgaacctggacagttggaacgtcaaagagatccaccaggctgctgactacctgaaagttgaagaggttgtaactaagtgcaagatcaaaatggaagattttgcattcatagccaacccttcaagcacagagatctcctcgatcaccggtaacatcgagctgaaccagcaaacctgcttgcttacactgagggattacaacaatcgggagaagagtgaagtctcgactgacttgatccaagcaaacccgaaacagggtgcactggccaagaagtcatcccagacaaagaaaaagaaaaaagcgtttaactctccaaagactggccagaacaaaactgtgcagtatccctcagacatactggagaacgcgtccgtcgagcttttcttagacgccaacaagctcccaaccccagtggtggagcaggttgcccagattaacgataatagcgagctggagctcacctctgtggtcgagaacaccttccccgctcaagacatagttcacacagtgactgtgaagaggaaaagaggaaagagccagcctaactgcgctcttaaagaacactcgatgtcgaacattgcctcagtcaagagcccctatgaagccgaaaactctggggaggaacttgaccaaaggtactcaaaagcaaaacccatgtgcaacacttgcgggaaagtattcagtgaggcatcctctttgaggagacacatgagaatccacaagggcgtcaaaccttatgtttgtcacctgtgtgggaaggccttcacccagtgcaaccagctgaaaactcatgtgcgcacccacaccggcgaaaagccttacaagtgtgagctttgtgataagggctttgctcagaaatgtcaattagtcttccactccagaatgcatcatggagaggaaaaaccctacaagtgcgacgtgtgcaacttgcagttcgctacctcatctaacctgaaaatccacgccagaaaacactccggagaaaaaccatatgtgtgcgatcgctgtggccaaagattcgcccaggcctctacattgacttatcacgttcggcgtcacacaggggagaagccatatgtatgcgatacttgcggcaaagctttcgcggttagttcttcgttaatcacacatagcaggaagcatacaggagagaagccttacatctgtggtatctgtggaaagtcttttattagtagtggtgagctcaataaacattttcgctcgcatacggtggtatggtcaatgaattag

SEQ ID NO: 23570 - DNA, 1746 bp, Artificial Sequence
  Description of Artificial Sequence: Synthetic coding sequence
atgcagtattctcaccattgcgaacaccttctggaacgactgaacaagcagagggaggcgggttttctctgtgactgcaccattgtgataggagagttccaattcaaagcacacaggaatgtattggcaagctttagtgagtactttggggcaatataccgctccacttctgagaacaacgtattcctggaccagtcccaagtgaaagcagacggattccagaagctgttagaatttatctacaccggaacacttaatttagattcctggaatgtcaaggagatacatcaggcagcagattacctgaaagttgaggaggtcgtcacaaagtgtaaaattaagatggaggattttgcattcatcgccaatcccagctccaccgagattagctccatcaccggcaacattgagctgaatcagcagacctgtcttttgactctccgggactacaataaccgtgaaaaaagcgaggtctccactgacctcatacaggcgaacccgaaacagggagccctcgcaaaaaaatcctcgcaaactaaaaaaaaaaaaaaggcgttcaattccccgaagactggacaaaacaagaccgtgcagtacccatccgatattctcgagaatgcttctgtggagctattcctcgacgcaaacaaattaccaacgcccgtcgtagagcaggtcgcccaaattaacgataatagcgagctagagctgacgtctgttgtggagaataccttccccgcacaagacatcgtgcatactgtgacggtcaaaagaaagcgaggtaagtcccaacctaactgcgccctaaaggaacactctatgtcaaatatcgcctcggtgaaaagcccttacgaagccgagaatagcggcgaagagctggaccagcggtacagtaaggcaaagcctatgtgtaatacatgcggaaaagttttttccgaagcatcatccctcaggaggcacatgaggatccataaaggcgttaaaccgtatgtgtgccatctctgtggcaaagccttcacccagtgcaatcagctgaagactcatgtgcgaactcacaccggggagaagccctacaagtgtgagctgtgtgacaagggcttcgcccaaaagtgtcagctggtgttccactctaggatgcatcacggcgaagaaaagccgtataagtgtgatgtgtgcaacctgcagtttgctacaagctccaacctgaaaattcatgcccgaaaacacagcggggagaagccctatgtttgcgatagatgtggtcagagatttgctcaggcttccaccctgacatatcacgtacggaggcatacgggcgagaagccttatgtgtgcgatacctgtggcaaggctttcgcggtcagctcatctctcataactcactccaggaaacacacaggggaaaagccttacatatgcggaatttgtggcaagtcgttcatcagcagcggtgagctcaacaaacacttcagaagccacactggtgccgataagacgctcgactcctccgctgaagaccacaccctttccgagcaggacagtattcagaagtcgccactgagcgaaacgatggatgtgaagccaagcgatatgaccttacccctggcacttcccttaggtactgaagaccatcatatgcttctccccgtcacagacactcagtcacctacatctgatactctgctacggagcacggttaacggttattccgaaccccagcttatattccttcagcagctgtattag

SEQ ID NO: 23571 - DNA, 1167 bp, Artificial Sequence
  Description of Artificial Sequence: Synthetic coding sequence
atgctcaaagtcaaacgcttagaagagttcaatacttgttataatagtaaccagttagagaaaatggccttctttcaatgtcgcgaggaggtcgaaaaagtgaagtgcttcctggagaaaaactcaggcgaccaggattcccgttccggccataacgaggcaaaagaagtgtggtctaatgcagacctgactgagagaatgcccgtgaagtctaagcgtacctccgcactcgccgtggacatcccagctccccctgctccatttgatcacaggattgtcacggctaagcaaggcgctgtgaattcattttacaccgtctcaaagactgaaattctcggcggtgggaggtttggccaagtgcacaaatgcgaggagacggccacgggactcaagctggctgccaagataatcaaaactaggggcatgaaagacaaagaggaggttaaaaatgaaatctctgtgatgaaccagttggatcacgccaatttaatccagctttatgacgcgtttgaaagcaaaaacgatattgtactggtgatggagtatgttgacggcggagaactgtttgaccggatcattgatgaatcatacaatctgactgagctcgacacgatcctgttcatgaagcaaatttgtgaaggtattcgacatatgcatcagatgtacatcctgcacctcgacctgaaaacgaccagcttccagtgttccaggttcctgatcgacacgtcaatactgcctttatgcctgctcaattgtaggtataagccccgagagaagttgaaagtcaacttcgggaccccagaatttcttgctcctgaagtggtgaattatgattttgtgagcttcccaaccgacatgtggtcggtcggagtaatcgcctatatgctgctcagcggcctcagcccattcttgggggataacgatgccgagacgttaaacaatatcctggcctgtaggtgggacttggaggacgaggagtttcaggatattagcgaggaggccaaggaattcatctctaagctgctgattaaagagaagagttggaggatctcagcaagcgaggcgctcaaacacccgtggctctctgaccataaactgcacagcaggctgaacgcacaaaaaaaaaaaaaccggggaagtgatgcccaagattttgtaacaaagtag

SEQ ID NO: 23572 - DNA, 1167 bp, Artificial Sequence
  Description of Artificial Sequence: Synthetic coding sequence
atgctgaaagtaaagcggttggaggagtttaatacttgctacaattctaatcagctggagaaaatggccttttttcagtgtagagaggaggtcgagaaggtcaagtgcttcctggagaaaaactcgggcgatcaagacagcagatctggtcacaacgaagctaaagaggtctggtccaacgccgatctgacggagcgcatgccagtgaagtctaaaagaacctccgcattggcagtcgacatccccgcaccccctgcgccttttgaccacaggattgtgaccgctaagcagggggcagtgaattccttttacaccgtctccaaaacggaaatcctgggaggcggtcgcttcggacaggtacataagtgcgaggagacggccacaggccttaagctcgcagcaaaaattatcaagacaagaggaatgaaagataaagaagaagtcaagaacgaaatttctgtgatgaaccagctggaccatgccaatctgattcaactgtacgacgcttttgagtcaaagaacgacatagtgttagttatggagtacgtggacggcggagaactgttcgataggatcatcgatgaaagttataacctgactgagctagataccatcttgtttatgaaacagatctgtgagggcattcgccacatgcatcagatgtacattttgcacctggacctgaagcccgagaacattctgtgcgtaaatcgtgatgcaaaacaaattaagattattgattttgggctggctcggcgatataaaccccgtgagaagttgaaagtgaacttcggaacgcctgaattcttagccccagaagtggtaaactacgatttcgtgtcgtttcctacagacatgtggtctgtgggggtgatcgcatatatgctgctgtctggactgagtcctttcctgggcgacaatgatgcagagactctcaataacatcctggcatgtcgctgggacctggaggacgaggaatttcaggacatttccgaggaagctaaagagtttatctcgaagttactgattaaggaaaaatcttggcgtataagcgcctccgaggccctgaagcatccctggctgagtgaccacaaactgcattcgaggctcaatgcacagaaaaagaaaaatcgtggctcggatgcacaggacttcgtaactaaatag

SEQ ID NO: 23573 - DNA, 576 bp, Artificial Sequence
  Description of Artificial Sequence: Synthetic coding sequence
atggcaatgcataataaggctgcgccaccccagatacctgatactcgtcgcgaacttgcagaactggtgaagcggaaacaagagcttgccgaaactctggccaacctggagagacagatttacgctttcgaaggctcctacctcgaagacacacagatgtatggcaatatcatccggggatgggaccgctacttgacgaaccagaaaaattcaaacagcaagaatgatcggagaaacagaaagttcaaagaggcagagcgactgttcagcaaatcatccgtgacatcggccgctgcggtgagtgctttggccggagtgcaagaccagctaatcgagaagcgggagcccggatccgggacagaatctgacacctctccagactttcataaccaggaaaacgagccttcccaggaggaccccgaagacctcgatggatcggtacagggagtgaaacctcagaaagcagcttctagcactagttcaggatctcaccattcaagccacaagaagagaaaaaataagaaccgccacaggatcgacctcaaacttaacaagaagccccgagctgactattag

SEQ ID NO: 23574 - DNA, 579 bp, Artificial Sequence
  Description of Artificial Sequence: Synthetic coding sequence
atggctatgcataacaaagccgcaccaccccagatccccgacacacgacgggaactagcagaattagtcaaaaggaagcaggagctggctgaaacattggccaatcttgagcgccagatttacgccttcgagggctcgtatctggaagacactcagatgtatggaaatatcatccgtggctgggatcgctatcttactaaccagaaaaatagcaactctaagaacgaccggcgtaatcgaaagttcaaggaagctgagcgcctcttctccaagagctccgtaacttctgcggcagccgtgtccgcccttgctggagttcaggaccaactaattgaaaagcgcgagcctgggagcgggaccgaaagcgacacctctcctgactttcataaccaggaaaacgagccatctcaggaggaccccgaggaccttgatggcagcgttcagggtgtgaaaccacagaaagctgcgagcagcacgtcaagcggttctcatcattcctcgcataaaaagagaaaaaacaaaaatagacacagaatgaacgtgagccccaagactgggtggcaccagctacatctgtag

SEQ ID NO: 23575 - DNA, 510 bp, Artificial Sequence
  Description of Artificial Sequence: Synthetic coding sequence
atgtcactgttcttcatcagccaagagactcttgcgaatcttgaacgacagatatacgcgttcgaggggagctatttggaggatacccagatgtacgggaacatcatccgtggatgggacagataccttactaaccaaaagaattcgaacagcaaaaacgaccggagaaaccggaagtttaaagaagccgagcgcctattcagtaagagtagcgtcacttcagccgcagcagtgtccgccctcgccggagttcaagaccagctgatcgaaaagagggagccgggtagcggcacagagtccgacacgtcaccagattttcacaatcaggaaaatgaaccatcgcaggaggacccagaggatctggatggcagtgtgcagggcgtcaagccccagaaagctgcgagctctacgtcaagcggatcccaccattcttctcacaagaagcgtaaaaataagaatagacacaggattgacctgaaattgaataaaaagccccgagcagattactag

SEQ ID NO: 23576 - DNA, 606 bp, Artificial Sequence
  Description of Artificial Sequence: Synthetic coding sequence
atggccatgcacaataaagccgctcctcctcaaatacccgacacaagaagagaactcgcagagcttgtcaaacgtaaacaggaactggcagagactctggccaacctagagcggcaaatctacgcctttgaagggtcatatctagaggatactcagatgtatggaaacatcatccgaggctgggatcgctacttgaccaaccaaaaaaactcgaattcaaaaaatgaccgcagaaacagaaagtttaaggaggcagagagactgttcagtaaatccagcgtcaccagcgcagcggctgtgagcgcccttgctggtgtccaggaccagctcattgagaaaagggaaccaggctcgggaactgaaagtgatactagcccagactttcacaatcaagaaaatgaaccctctcaggaggaccccgaggatctggatggcagcgtgcagggcgtcaagccccaaaaagcagcttcaagtaccagctctgggtcgcatcactcttctcacaaaaaaaggaagaataaaaatcgccacagtccttctggtatgtttgattacgacttcgaaatcgaccttaagctcaacaagaagccaagggccgattattag

SEQ ID NO: 23577 - DNA, 576 bp, Artificial Sequence
  Description of Artificial Sequence: Synthetic coding sequence
atggccatgcacaataaggcagcaccaccacagattccagatacacggagggaattagcagagctcgtgaaaaggaagcaggagctggccgaaacgctggctaacttggagagacagatttatgcattcgaagggtcctatttagaagacacccagatgtacggcaacatcatacgaggttgggataggtacttaactaatcagaagaacagtaacagcaagaatgaccggcgaaatagaaaatttaaggaagctgagaggttgttctccaaatcttccgtgaccagcgcagctgctgtgtctgccctagccggtgttcaggaccagttgattgagaagcgggaaccaggcagtggaaccgaatcggatacaagtcccgacttccacaaccaggagaacgagccatctcaggaagaccccgaggatcttgacggcagcgtgcagggtgtgaagccccaaaaagcagcctctagtacatcaagcgggtcacaccacagcagccataaaaaacgaaagaataaaaacaggcatagcccttccgggatgttcgactacgactttgaatatgtgtactag

SEQ ID NO: 23578 - DNA, 291 bp, Artificial Sequence
  Description of Artificial Sequence: Synthetic coding sequence
atgacatccgcactggaaaactacatcaaccgtactgttgcagtcataacatcggacggcagaatgatcgtgggcaccctcaaggggttcgaccagactataaatctcatcctagatgaatctcacgagagggtgttctcttccagccagggagtagaacaggttgtgttgggattgtatattgttaggggcgacaatgtggccgtcataggcgagatagacgaggagacggacagcgccctggacctgggaaacatccgggctgagccgcttaattcagttgctcactag

SEQ ID NO: 23579 - DNA, 1764 bp, Artificial Sequence
  Description of Artificial Sequence: Synthetic coding sequence
atgagtcagatgttacatatagagataccaaacttcgggaataccgtcctgggctgtctgaatgaacagcggctattgggtctctactgcgacgtgtccatagttgtgaaaggacaggcctttaaggcgcatcgagcagtgctggcagcttcgtcactgtactttcgggacttgttttccggtaactccaaaagcgcatttgaactcccgggaagtgtgccccctgcctgtttccaacaaatactgagcttttgctacactggacgcttaaccatgacagcttcggaacagctggtggtaatgtatacggccggttttctgcagatccagcatatcgtcgagcgcggtacagatttgatgttcaaagtgtctagcccccattgtgactctcagaccgccgtgattgaggacgcaggttcagagccacagtccccttgcaatcaactccagcctgccgcagccgcagcggctccctacgttgtaagccctagcgtgcctatcccgctgcttacccgcgttaagcatgaggcaatggaactcccaccagctggtccagggcttgcacccaaaagacccctggagaccgggccaagggatggcgtggccgtcgccgctggagcggcagtggcagccggtaccgcccctctgaaactgccacgcgtttcgtactatggcgtgccctccctcgccacgctgatacccggaatacagcaaatgccttacccccaaggagagcgtacttcccccggagcaagcagtttgcctactactgattcccccacaagctaccacaacgaggaagatgaagaggacgatgaggcttatgatactatggtcgaggagcaatatggacagatgtatatcaaagcctctggctcttacgccgtgcaggagaaaccggagcctgttcctcttgagtcccgcagttgtgtgctcatccggcgtgacctcgtggccttgccggcttctctgatctcccaaatcggttaccgctgccaccctaaactatacagcgagggcgatcccggagagaaactcgagcttgtggcgggtagcggggtgtatattacacgagggcagctgatgaattgtcacctgtgtgccggagtcaaacacaaggtgctcctgcgaagactgctagcaaccttcttcgatcggaacacactggcgaactcatgtggtaccggcatcaggtcctcaacttccgacccaagtcgcaagccactcgattcacgcgtgctgaatgccgtgaagttatattgccaaaactttgcaccctcctttaaagagtccgagatgaatgtcatcgctgctgacatgtgcacaaatgcgagacgtgtgaggaagcgttggcttccaaagattaagagcatgttgcctgaaggtgtggaaatgtatcgcaccgtgatgggatccgcagccgcatctgtgccactggatccagagtttccccctgctgcggctcaggtgttcgaacaaagaatttacgccgagcgcagaggggacgcagcgacgattgttgccctgcggaccgacgcagttaacgtggatctgtctgctgcagcaaaccctgcttttgacgccggagaagaggtggatggagccggaagtgttatccaggaggttgcagctcccgaaccgctccctgcagacggccaaagtccccctcagccatttgagcaaggcggtggcggtccctctcggccacagacccctgcggctgccgctcgacggccagaaggtacatatgccggaaccctttag

SEQ ID NO: 23580 - DNA, 1764 bp, Artificial Sequence
  Description of Artificial Sequence: Synthetic coding sequence
atgtctcagatgctccatattgagattccaaactttgggaataccgttctgggttgtcttaatgagcagcggctgcttgggctctattgcgatgtctccatcgtcgtgaaggggcaggccttcaaagcgcatagagccgtgttggcagcctcaagtttgtatttccgagacctgttctctggaaactccaagtcagcatttgagctaccagggtccgtgccccctgcctgttttcagcagattttgagtttctgctacactggtaggcttactatgacagccagtgagcaactggtcgttatgtacaccgccggattcctgcagattcaacacattgttgagcgaggaacggacctgatgtttaaagtcagctctccccactgtgactctcaaactgcagtcattgaggacgcaggttctgagccccagtccccctgcaatcaactgcagcccgcagccgctgctgcggctccctatgtggtgagcccgtcggtgccaatccccctgctgacccgcgtcaagcacgaagccatggagctgcctccagcgggaccaggattggctccaaaaagaccactcgagacgggcccaagggacggagtagccgtggccgctggcgctgcagtggccgctgggactgcccctctcaaactgccgcgagtgagctactatggtgtgccctcactggctacccttattccaggaattcagcaaatgccctacccacagggagaaaggacatcacctggcgcatccagcctccccaccactgattcgccgacctcttaccacaatgaggaggatgaagaggatgacgaggcatacgataccatggtagaagagcagtacggccagatgtatatcaaggcctccgggagctatgctgtacaagaaaagccggagcccgttcctttggaaagcagatcctgtgtactcattcgcagagatttggttgctcttcctgcctcgctgatctcccagattggttacaggtgccacccaaagctctattccgagggagacccaggagagaagctggagctggtcgcaggatccggcgtctacattactcgcggtcagctcatgaactgtcacttgtgtgcgggagtgaagcataaggtactgttgaggcgcttgcttgcaacattttttgaccgcaataccctggccaattcctgtggaacaggtattagatctagcacctctgatccaagccggaaacccctggactctagggtgctgaacgctgtgaaactgtactgccagaatttcgccccaagcttcaaagaaagtgagatgaatgtaatcgccgcagacatgtgtaccaacgccagaagagtccgcaagaggtggcttccgaagattaagtctatgctgccagaaggggtagaaatgtaccgaactgtgatgggcagtgccgctgcaagtgtgcctctggacccggaatttccgcctgcggcagctcaggtcttcgagcagaggatttacgctgagagaagaggcgatgccgctacaatagtcgcgttgcgtaccgatgctgttaacgtcgatctgtccgcagcagccaaccccgcatttgacgcgggtgaagaggtggatggtgcgggaagtgtgattcaagaggtggccgcaccagagccactgcccgcagacggtcaaagcccgcctcagcccttcgaacagggaggagggggaccaagtcggccacagacgccagccgcagccgcaaggagacctgaggggacatatgcaggcactttgtag

SEQ ID NO: 23581 - DNA, 3078 bp, Artificial Sequence
  Description of Artificial Sequence: Synthetic coding sequence
atgcatagaaagaaagtggacaaccgcatacggatcctgattgaaaacggcgtcgccgagaggcagcgatcgctattcgtggttgtcggtgaccgtggcaaggatcaggttgtgattctgcaccacatgctgagcaaagctacagtcaaggctagacccagtgtcttgtggtgttacaagaaggagttgggattctcttcccaccgcaagaaacgaatgcgtcagctccaaaagaagatcaagaatggaacactcaatattaagcaggacgacccctttgagttatttatagccgctaccaacatccgctactgttattacaacgagacccataagatacttggcaacaccttcggaatgtgtgtgctgcaggatttcgaggcattaactcctaacctgctggcgcgtacggtggagacagtagaaggtggcggactggtggtcatactactccggacgatgaacagcttgaagcaactgtataccgtgaccatggacgttcacagtagatataggactgaggcacaccaggacgtcgtcgggaggttcaatgagagatttatcctgtctctagcgagctgcaaaaagtgcctcgtgatcgatgatcagctcaacatcctgcccatctcaagtcacgtcgctactatggaggccctcccacctcagacccctgacgagagtcttggcccatccgatttagaattgagggagcttaaggaatctctgcaagacactcaacctgtcggcgtgctcgtggactgttgcaaaacactggatcaggcgaaagcagttctgaagttcatcgagggcatttcagagaagactcttcgatccaccgtggccctgacagcagccagaggacgcggtaagtcagcagcacttggattggctattgctggcgctgtagcgtttggctacagcaatatctttgtgacctcaccaagccctgacaacttgcacaccctgttcgagttcgtttttaaagggttcgacgcgctacagtaccaggagcacttagattacgaaatcattcagtctcttaatcctgagttcaataaggcggtgattagagtcaacgttttccgcgagcacaggcagactatacaatatatccaccccgctgatgctgtcaaactcggacaggccgagctggtggtgattgatgaggcagcagcgatccctctccctttagtaaagagcctattaggaccttacttggtgttcatggcatctacaatcaacggctacgaaggaaccggtcgatccctgtctctgaagctcattcagcagttgagacagcagagcgctcaatctcaagtgagtacaacagctgaaaacaagacaactacaaccgcgcgtcttgcttccgccagaactttgtacgaagtaagtctgcaggagagcattcggtacgcaccaggcgacgcagtcgagaaatggctgaacgacctcctatgtctcgactgtctcaacatcacacgaattgtctcaggctgtcccctcccagaagcgtgtgagctgtactacgtcaatcgggacacactcttttgctaccacaaggccagcgaggtgtttctgcaaaggctaatggcactctacgtagcctcacactataaaaactctcctaatgatctccagatgctatctgacgcccctgcacatcatctgttttgtcttctcccgcctgtgcctccaacccagaacgctctccccgaggtgttagccgtcattcaggtgtgtctggaaggtgaaatcagtagacaaagtattctcaatagcctgagccgtggaaagaaggcttccggtgatctcattccctggaccgtgagcgagcagtttcaagaccctgactttgggggtctttctggaggcagggtggttcgtatcgcagttcaccctgattaccaaggtatgggttacggaagtcgagcgctgcagctcctgcagatgtattacgaaggcaggtttccttgcctggaggagaaggtccttgaaaccccccaggaaatccatactgttagttctgaggctgttagcttacttgaggaagtaatcactcctaggaaggacttgccaccactcctgctgaagctgaacgaacgaccggcagagaggttggactatctgggcgtgtcctatgggctgaccccacgtctgctgaagttttggaagcgcgctggcttcgtccctgtgtacctgcgccagaccccaaatgacctgacaggtgaacacagttgtattatgctgaagacacttactgatgaagatgaagccgatcagggtggatggctcgcagccttttggaaagactttagaaggcgattccttgcccttctcagttaccagttctcaacattttctccgtcgctcgcactgaatataatccagaatcgcaacatgggaaaacccgctcagccggcactgagccgggaggaactggaagcgcttttcctgccgtatgaccttaagcggctcgagatgtatagccggaacatggtggattaccacctcattatggacatgatcccagcaataagtcgcatttatttcctgaaccaactcggggacctggctctgagcgccgctcagtcagcgctccttcttggtataggcctgcagcataaatcagtcgaccagttagaaaaggagatagaactgccttctggtcagttgatggggctgttcaatagaatcattcggaaggtggtgaagctgtttaatgaagtccaagagaaggccatagaagaacagatggtcgctgctaaggatgtggtaatggaaccgaccatgaaaacgttatctgacgacttggacgaggccgctaaggaatttcaagaaaagcacaagaaagaggtcggaaaactcaagtccatggacctgtccgagtacatcattcggggagatgacgaggaatggaacgaagtgcttaacaaagccggaccaaatgccagcattatttcactcaagtcggataaaaaaagaaagttggaggccaaacaggaacctaagcagagtaaaaagctgaagaaccgagaaacaaaaaacaaaaaagatatgaagcttaagagaaagaagtag

SEQ ID NO: 23582 - DNA, 2862 bp, Artificial Sequence
  Description of Artificial Sequence: Synthetic coding sequence
atgcgccagctgcagaaaaaaataaagaatggaaccctcaatatcaagcaggacgatccatttgagttgttcatcgctgctacaaatatccgctattgttattataacgagactcacaagatactcggcaatacctttggcatgtgtgtcttacaggacttcgaagcccttacaccaaatcttctggcgagaacggtcgaaaccgtggagggaggaggattagtggtgatccttttaagaacaatgaattccttgaaacagctgtacacggtcaccatggatgtacacagtagataccgtactgaagcacaccaggacgttgtcgggagatttaacgagcggtttattctgtctttagcgtcctgcaaaaaatgtttagtgatcgacgaccagttaaacattctccctatctcatctcatgtggcaaccatggaggccctcccgccacagacaccggacgagagcctgggtccaagcgacctcgagttaagggaactgaaggaatctttgcaggatactcagccagtgggcgtattggtggactgttgcaagacgttggatcaggccaaagctgtgctcaaattcatcgaaggtatctcagaaaagacccttaggagtactgttgccttaactgccgctcgaggtcgtggcaaatccgccgctctgggactggccatcgccggtgcagttgctttcggatactccaacattttcgtgactagtccaagccctgataacctacacacccttttcgagtttgtctttaaagggtttgacgccctccaataccaggagcacctcgactacgaaatcattcaatccttaaatcctgagtttaacaaggccgtgatcagagtaaatgtgttccgggagcatcgtcagacaatacagtatatccaccctgctgacgccgttaaattgggccaggctgagctggttgtcattgacgaggccgcagccattccgctgcctttggtgaaatctttgcttggcccttacctggtatttatggcctccacaatcaacgggtacgaagggacaggcagatcactgagtcttaagctcatccagcagcttcggcagcagtctgcccagtcccaggttagtactaccgcggagaataagaccacaactaccgccaggctggccagcgccagaactctatacgaagtcagtctacaggagagtatccgctatgccccaggcgatgctgtcgagaagtggttgaatgacctgctgtgcctggattgtctgaatataactcggattgtgagcggctgtccccttccggaggcatgcgagctttattacgttaatagagatacattgttctgttatcataaagcatcggaggtattcttgcagaggctgatggctctctatgtggccagccactacaaaaactcaccaaacgatctgcagatgctgtccgacgcaccagcgcatcatctcttttgcctgttgccaccggtgccgcctactcagaatgctcttcctgaggtcctggcggtaattcaggtctgccttgaaggagaaattagcaggcaaagtatcctgaattcgctgtctcgagggaagaaggcctccggggatctaattccatggacggtgagcgagcagtttcaggaccctgactttggtggattaagtggaggacgtgtggtccggatcgccgttcacccagattaccaggggatgggttatgggagccgcgctctccagctgctgcagatgtactatgaaggtcgatttccgtgtctggaggagaaggtactggaaacgccccaggaaatccacacagtgtcttctgaagccgtgagtttacttgaggaggtcatcacacccaggaaggacttgccacctcttctcctgaaactgaacgaaaggccagctgagcgtctcgactatttaggcgtgagctatggattgacccccaggttactaaagttttggaagagagccggattcgtgccagtctatctgaggcagacgcccaatgatctgaccggagagcatagctgcattatgttaaaaactctcacagacgaagatgaggccgaccagggcggttggcttgcagctttctggaaggatttcaggagacgttttctggccctgttgagctatcagttctcgacgttcagccctagtctagctcttaatattattcagaaccggaatatgggaaagcctgcacagcccgctctgtctcgcgaagagctggaagcattgtttctcccttacgatctaaagaggttggaaatgtattccaggaacatggtggactatcacctgattatggacatgattcccgctatttcccggatctattttctgaatcagttgggggacctcgccctaagcgctgcccagagtgctcttttattaggaattggcctccaacacaagtccgtggaccaactcgagaaagagattgagctcccttctggtcagcttatggggctgtttaaccgaataatcagaaaagtggtgaaactgtttaacgaggttcaggagaaggcaattgaggagcagatggtcgcagctaaagacgttgtgatggagccaaccatgaaaacactgtccgacgacctggatgaggccgcaaaagagtttcaagagaaacacaaaaaggaagtagggaagctcaaaagtatggacttatcagaatacatcatccgcggtgatgatgaagaatggaatgaggttctgaataaagcgggacccaatgcaagcattatcagcctgaagagtgacaaaaagcgcaagctggaagccaaacaagagccaaagcagtctaaaaagttgaagaaccgagaaactaagaataagaaagacatgaagctgaagagaaagaagtag

SEQ ID NO: 23583 - DNA, 711 bp, Artificial Sequence
  Description of Artificial Sequence: Synthetic coding sequence
atgaccagcgagaaagggccatccaccggagaccccactttaaggcgtcgaatcgagccatgggaatttgatgtcttttacgatccgagggagctgcgaaaagaggcttgcctgctgtacgagattaaatggggaatgagccgtaagatctggagatcttccggaaagaacactaccaatcacgtcgaggtcaatttcatcaaaaagttcacttcagagagggattttcatccaagcatgagttgctccataacatggttcttgtcctggtcgccatgttgggagtgctctcaggccattcgcgagttcctgtctagacacccgggagtgacactggtgatttacgttgccaggttgttttggcatatggatcagcagaaccggcagggacttcgggaccttgtcaacagtggtgtaaccattcagatcatgcgcgcatccgaatactaccactgctggaggaactttgtgaactatcccccaggagatgaggcccactggcctcagtatccacctctttggatgatgctgtacgctctcgagcttcactgcataattctgtcattgccaccatgcctgaagatttctaggcgttggcagaatcacctgacttttttcaggctgcacctacaaaactgtcactatcagactatcccacctcacatccttctcgcgacggggcttatccacccaagcgtggcctggcgatag

SEQ ID NO: 23584 - DNA, 870 bp, Artificial Sequence
  Description of Artificial Sequence: Synthetic coding sequence
atgagcgtggaccccgcttgcccgcagagcctgccctgctttgaggccagcgattgtaaggagtcttccccaatgccagtgatctgcggcccagaagagaattacccttctctccaaatgtccagtgcagaaatgccccatacagagaccgtgagccccctaccttcaagcatggatctactgattcaggactcacccgacagttccacctcgcccaagggtaagcagcccacgagtgccgagaagagtgtagcaaaaaaggaggataaagtacccgtaaagaagcagaagactcgcaccgtgttctcatctactcagctctgcgtcctcaatgaccgtttccagcgccaaaagtacctgtccctgcaacagatgcaggagctcagcaacattcttaatctgtcatataagcaggtgaagacgtggttccaaaaccagcgtatgaagtccaagagatggcagaaaaataactggcccaagaactccaatggagtgactcaggggtgcctggttaatccaactggcaatttgcctatgtggtccaatcaaacttggaacaatagcacctggtctaatcagacccagaatatccagtcctggtccaatcactcttggaacacccagacatggtgtacgcagagttggaacaaccaggcttggaactcaccattttacaactgtggcgaagaatccttgcaaagctgcatgcagttccaacctaacagcccagctagtgacctggaggcagccctcgaggcggctggtgaaggtctgaacgtgatccaacaaaccactcgatacttctccacaccacagacaatggacctgttcctcaactattctatgaatatgcaaccagaagacgtgtag

SEQ ID NO: 23585 - DNA, 567 bp, Artificial Sequence
  Description of Artificial Sequence: Synthetic coding sequence
atgcacagggccaggtggctcacaccggtcattcctgcactctgggaggctgaagcaggcaggtctcggggacaggagattgaaactatcttggccaacaaaaagcaatctgcaatgccctgggaccaggatccagaacaaagcaccggtaactattctgaagacgagcagaatggcaagcaaaagtggagagaagagggtgaggcaggtcggaagagagagcgcgagaaagaagaaaagaatgagaaagagctgcaggatgaacaggaaaataagcgcaaaagagaaaatgaaaagcagaagcaatatcctgaaaaaagactggtcagcaagtctctcatgcacactctgtgggcaaagttcaagctcaatcggtgcccaaccatacaggagtcactttccctcagcttcgaattcgacatgacccacaagcagatctctcagtggttttgtaagactcgcaaaaaatacaacaaggagatgtcaaagcgaaagcacaaaaagaagcacatgaggtggcggagtctctgttgccaggggtggtctaggacccctgcgctcaagtag

SEQ ID NO: 23586 - DNA, 2691 bp, Artificial Sequence
  Description of Artificial Sequence: Synthetic coding sequence
atggccgctagggccgtcctggatgaattcacagctcccgctgagaaggcagaactgctggaacagtcaaggggtaggatagagggtctgttcggggtatctctggccgtccttggggcactgggggcagaggagccccttcctgcacgtatatggctgcaattatgtggggctcaggaagctgttcattcagccaaggaatacataaaaggaatatgcgagccggaactggaggagcgtgagtgctatccgaaagacatgcactgtatcttcgttggagcagagagcctcttcctaaaatcactcatacaggatacttgcgcggacctgtgcatactcgatataggcctgctgggaattcgcggaagtgctgaggccgtcgtaatggccaggagccacatccagcagttcgtgaaactctttgagaataaggagaacctgccctctagccagaaagaaagcgaagtcaagcgcgagttcaaacagtttgtggaggcacacgcagacaattacacaatggatttattgatactgccaactagtctgaagaaggagctgctcacattgacacagggagaggaaaatctgtttgaaacaggggacgacgaagttattgagatgcgggactcacagcagaccgagttcacccagaacgcagctacaggcctgaatataagcagagatgagaccgtgctgcaggaggaggcccgtaacaaagccggtacacctgtcagcgaattgacaaagcagatggataccgttctctctagctctccagatgtcctcttcgacccaataaacggcttgacaccggatgaagaagcgctgtccaatgagcggatttgccagaagcggaggttttccgattctgaagaacggcatacaaagaaacaattttcactggaaaacgtgcaggagggcgaaattctccatgacgccaaaacactagccggaaatgttattgcagatctgagtgacagctcagctgatagcgaaaacctatcacccgacattaaggagacgaccgaagagatggagtataatatacttgtaaacttttttaagactatgggttactcacaagagattgtggaaaaagtgattaaggtatacggaccctccaccgagcccctcctgttactggaggaaattgaaaaagaaaataagcggtttcaggaagatagagaatttagcgccggtactgtgtaccctgaaacaaataagacgaaaaacaagggtgtgtattccagcaccaatgaactcactacagactctactccgaaaaagacacaagcacacacccagcaaaacatggtggagaagtttagccagctcccatttaaggttgaggccaaaccttgtacctcaaactgcagaatcaacacattcagaactgtgccaatcgaacagaaacatgaggtctggggttccaaccagaattacatctgtaacacggacccggaaaccgatggtctatcgcccagcgtggccagcccctccccaaaagaggttaattttgtcagtaggggcgctagctcccaccaacctagagtgccactgttcccagaaaatggactccatcagcagcctgagccccttcttccgaacaacatgaaatcagcgtgcgaaaaaaggttggggtgttgcagctctcctcactccaagcctaattgtagtaccctcagtccccctatgcctttgccccagttgctgccctcagtgaccgatgctagatctgctggtcccagcgatcacattgatagttccgtaaccggcgtgcaaaggtttagggacacattaaagatcccctataagctggagctaaagaatgaaccaggcaggactgacttaaagcacatcgtgatagacgggtcaaacgtggcgataacacacggcctgaagaaattctttagttgccgaggaattgcaatcgccgttgagtatttctggaaactcggaaaccgcaacatcacagtttttgtgccacagtggagaaccagacgggaccctaatgtaaccgagcaacacttcttgacccaattacaggaactcggcatcctcagcttaactcccgcaagaatggtttttggagaaagaatagcgtcccatgacgaccgattcctcctgcaccttgcggacaagaccggtggaatcatcgtcacaaatgataactttcgggagttcgtgaacgagagcgtaagctggcgagagatcatcactaaacggctactgcagtacacattcgtgggagatatcttcatggtgcctgatgaccctcttggacgctctggaccgaggttagaggagtttctgcagaaggaagtctgcctcagagatatgcagccactgttgagcgctttaccgaacgtggggatgtttgatccctcattcagggtccctggcacccaggctgcctcgactagccaccaaccgcctacaagaattcaaggagcgccatcatctcattggcttccccaacagcctcacttccctctgctgccggcactgccctcgttgcagcagaatctcccaatgcccgcacagaggtcttctgcagagacgaatgagttgcgggaggccctgctgaagattttccccgattccgaacagagattaaagattgatcaaattctggtggcacacccttatatgaaggacctgaacgcattgtcagccatggtcttagactag

SEQ ID NO: 23587 - DNA, 1848 bp, Artificial Sequence
  Description of Artificial Sequence: Synthetic coding sequence
atggcccagaaaaaatatttgcaggccaaacttacacagtttttgagagaagacaggattcagctgtggaaacctccttacaccgatgagaacaaaaaagtggggctcgccctaaaggaccttgccaagcaatattccgataggctcgaatgctgtgaaaatgaggttgagaaagtcatcgaagagatacgatgcaaagccatcgagcggggaaccggcaacgataactacagaaccactggcatcgcaactatcgaagtattccttcctccaaggctgaagaaagaccggaaaaatctgctcgaaactagacttcacatcacgggccgagaattgagatctaagatcgcggagaccttcggactccaggaaaattacatcaagatcgttattaataaaaaacagttgcagctgggcaagactctggaagagcagggcgtggcacacaatgttaaggccatggttcttgaactgaagcaaagcgaggaggatgctcgcaaaaattttcagttagaggaggaggaacaaaacgaagcaaaacttaaggagaagcaaattcaacggaccaagcgtggactggaaatcctcgccaagagggccgctgaaacagtcgtggatcccgaaatgactccatacctggacatcgcaaatcagacaggcagaagcatccggatccctccatccgagcggaaggccctgatgctggcaatgggataccatgaaaagggacgagcattcttaaaaaggaaggagtacggtatcgccttaccatgcctgctcgatgccgataaatacttctgcgaatgttgtcgggagttgctcgacacggtggataactacgcagtgctgcagctagatatcgtatggtgttactttcggctggaacagctggagtgcctggatgacgctgagaagaaactgaacctggcacaaaaatgttttaagaattgctacggtgagaatcatcaacgactggtgcatataaaagggaattgcggtaaggaaaaggtgttgtttctgcgtttatacctcctacagggcatcaggaattaccatagcggaaatgatgtcgaggcctatgaatacctcaataaggctagacaactctttaaggagctgtatatcgacccatccaaagtggataacttgctgcagcttggattcactgctcaggaagccaggctgggtctcagagcctgtgacggcaacgtggatcacgccgctacacacatcaccaatcggagggaagaactcgcccagatacggaaggaggagaaggaaaaaaaacggaggagattggaaaacataagattcttaaaaggaatgggatacagtacccatgccgctcagcaggtgcttcacgctgcctcgggcaacctggacgaagcattgaagatccttctgtcgaacccccaaatgtggtggctgaatgatagtaacccagagaccgacaaccgccaggaaagccctagccaagagaacatcgatcgattggtctatatgggcttcgatgccctcgttgcagaagcagctctgcgggtgtttcgcggaaatgtccagctcgctgctcagacactggctcataacggcggatcccttcctcctgagctgccgctgtcacctgaggactctctgagcccgccagctaccagcccttcggatagcgccggaacatcgagtgcctccacagacgaagacatggagacagaggccgtgaacgaaatcctggaggacatcccggagcacgaagaagactacctggatagtacgttagaagacgaagagattattatcgcagagtacctctcctacgtcgagaatagaaagtccgccaccaagaaaaactag

SEQ ID NO: 23588 - DNA, 1806 bp, Artificial Sequence
  Description of Artificial Sequence: Synthetic coding sequence
atggcccagaagaagtacttacaagctaaactgactcaattcctgagggaagatcgcattcagctctggaagcccccatataccgacgaaaacaaaaaggttgggttggccctgaaggatctggccaagcagtactccgataggcttgagtgctgcgagaacgaagtggagaaggttatcgaggaaatccgctgcaaagctatcgaacgagggacaggcaacgacaactatcggacaacaggcatagctactattgaagtctttctgcctccacggctaaagaaggaccgaaagaacctgcttgagacaaggctccacatcaccggaagagagctgcgatccaagattgctgagaccttcgggctccaggaaaactacatcaagattgtcatcaacaagaagcagttgcagcttgggaagactctggaagagcagggggttgctcacaatgttaaggccatggtcctcgaacttaagcagtccgaagaggacgctcggaagaactttcagctggaggaggaagagcagaatgaagccaagttgaaggagaagcagattcagagaaccaaaaggggtctggagattcttgccaagcgcgcagccgagactgtcgtggaccctgagatgaccccgtaccttgatatagctaaccagacggggaggagcatccggatccctcctagcgagcggaaggcattgatgctggccatggggtaccatgagaaagggagagcattccttaagagaaaggagtacggaatcgccctcccctgtctgttggatgccgacaagtatttttgcgagtgttgtagagaacttctcgataccgtcgacaactacgccgtgctccagcttgatatcgtttggtgttacttcagactcgaacagctcgagtgcttagacgatgccgagaagaaactgaacctggcccagaaatgttttaagaattgttatggagaaaaccatcaacgactagtgcacatcaaaggcaactgtggcaaagaaaaggtgctgtttctgcgactttacctgctgcaggggattcgtaactaccattctggcaacgatgttgaggcttatgaatatctcaataaagccaggcagctgtttaaggagctgtacatcgacccttctaaggtggataacttattgcagttagggttcaccgcccaagaagctagactgggtctgcgtgcatgcgacggcaacgttgaccacgctgcaacccatataactaatagaagggaagaactggcccaaatccgcaaggaggagaaagagaagaagcggaggcggctggagaatattagattcctgaagggcatgggctactctacgcatgccgctcagcagatcctgctgagtaacccccaaatgtggtggctgaatgacagcaacccagaaacagacaatcgacaagaatcacctagtcaggagaatatcgacagactggtttatatggggtttgacgcattggttgcagaggccgctctcagggtgttccggggaaacgtccagctggctgcacagactctcgcccacaatggcggatccctgcccccagagttgcctcttagtccagaagacagcctctcaccccctgccacttctcccagtgattctgctggaacctccagcgcctccactgacgaggacatggaaacagaagctgtcaatgagatcttagaagacatccccgaacatgaagaagactacctagacagcactctagaggacgaagagattatcatcgccgagtatcttagctatgttgagaaccggaagagcgccaccaaaaaaaactag

SEQ ID NO: 23589 - DNA, 465 bp, Artificial Sequence
  Description of Artificial Sequence: Synthetic coding sequence
atggcccagaaaaagtatctgcaagctaagctcacacaattcctgcgagaagaccgcattcagctgtggaaacctccgtacaccgacgagaacaagaaggtcggtttggcgctgaaagatctcgctaaacagtactctgacaggctcgagtgttgtgagaacgaagtagaaaaagtaatcgaagaaatcaggtgtaaggctatagaacggggtaccggcaatgataattaccggaccaccgggatcgcaacaattgaggtgttcttgcctccacgtctaaaaaaggaccgcaagaatctcctagaaacgaggctccatatcacaggaagagaactgcgctccaaaatcgccgagacatttggtctgcaggaaaactatatcaagatcgttatcaataagaagcagctccagttgggcaagacacttgaggaacagggcgtggctcataacgtgaaggccatgtag

SEQ ID NO: 23590 - DNA, 765 bp, Artificial Sequence
  Description of Artificial Sequence: Synthetic coding sequence
atggcccagaagaagtacttgcaagccaagttgacccagtttctcagggaagacaggatccagctatggaaaccaccttacaccgatgaaaacaaaaaggttggacttgctcttaaagatctagccaagcagtactcagatagactggagtgctgtgagaatgaagtggaaaaagtgattgaagagatccggtgtaaggcaatcgaacgcggtacgggtaatgacaattaccgtaccactggcatcgcaactatcgaggtgttcctgccaccaaggctgaagaaagaccgcaagaacttgctggagacaagactgcatatcactggaagagagttacgcagcaagatagcggaaacttttggattacaggagaattacatcaaaatcgtgattaataagaaacagttgcagctgggcaaaacactggaggaacaaggcgtggcacataacgtgaaagctatggtgttagaactaaagcagagcgaggaagacgccagaaagaactttcagctagaagaagaagaacaaaacgaggccaaacttaaagagaaacaaatccagcggactaaacgcggtctggagatcttagccaagagggccgctgagaccgtcgtggaccctgagatgacaccttaccttgatattgctaaccaaaccggtagatcgatccggatccctccttccgaaagaaaagctttgatgttggctatgggataccacgaaaaaggtagggccttcctgaaacggaaggaatatgggatttag

SEQ ID NO: 23591 - DNA, 495 bp, Artificial Sequence
  Description of Artificial Sequence: Synthetic coding sequence
atggcacagaaaaagtatctgcaagctaaactgacccagtttttgagggaggatcgaattcagctgtggaaaccaccgtacaccgatgagaacaaaaaggttggtctcgccctgaaggatttagccaagcagtactcagaccgactagaatgttgcgagaatgaggtcgagaaggttatcgaggagatccgatgcaaagctatcgagaggggcacagggaacgacaactaccgtactacaggtatcgccacaatcgaggttttcttgccaccaagactaaagaaagaccgtaagaatctgcttgagactaggctgcacatcaccggtagagaattacggtccaaagcagtcagaggcggttttcgcaaatggcacgctacccacatgcgcaggagaattgctgaaacgtttggcctccaggaaaattacatcaaaatagttattaataagaaacagctgcagcttggaccgtacgtgtcctatggcatctcatag

SEQ ID NO: 23592 - DNA, 1806 bp, Artificial Sequence
  Description of Artificial Sequence: Synthetic coding sequence
atggcgcaaaagaagtatctacaggctaagctcacgcagtttcttagagaagatcgaatccagctgtggaaacctccctacacagatgagaataaaaaggtggggctcgcactcaaggacctggccaaacagtattcagaccgtctggaatgctgcgagaacgaggtggagaaagttattgaagaaataagatgtaaggctatcgaaagagggacaggaaacgataactaccgaacaaccgggattgccactattgaagtgttcctgccccctcggttaaagaaagatagaaagaatcttctggagaccagactgcatatcacaggacgggagcttcgcagcaagatagccgagacctttggcctacaagagaactatatcaagatcgtcatcaacaagaagcagctccagctgggtaagacactcgaggaacagggggtagcccataacgtcaaggcaatggttttggaactgaagcagagtgaggaggacgcccgtaagaatttccaattggaagaagaagagcagaatgaggctaaactcaaagagaaacagatccagcgtacaaaacgaggcctggaaatactggccaagcgtgcagctgaaaccgtcgtggaccccgagatgactccatatctggatatcgccaaccagactggaagaagcatacgaattcctccttccgagagaaaagccctcatgctcgcaatgggctaccatgagaaggggcgagccttcctgaagaggaaagaatacggaatagcccttccttgcctgctggatgcagataaatatttttgtgagtgttgtcgtgagctgctggataccgtggacaactatgcagtgctgcagctggatattgtgtggtgttattttaggctggaacagttggagtgcctcgatgacgctgagaagaagctaaacttggcccagaagtgctttaaaaattgctacggagagaaccaccaacgcctggtccacataaaaggcaattgcggcaaggaaaaagttctgttcttaaggctgtacctgctccaggggatccgaaactaccactcgggcaatgacgtagaagcatacgaatacttgaataaggcgcgtcaattattcaaggagctgtacatcgaccccagcaaagtcgacaatctgttacagctcggattcacagcccaggaggccaggctcgggctgcgagcatgcgatggaaacgttgaccatgctgccactcatataactaataggcgagaggagctagctcagatacgcaaagaagagaaagagaaaaaaagacggagattagagaacattcgattcctgaaaggaatgggttatagcacccatgccgcacagcaaatcctgctgtcaaacccccaaatgtggtggctgaacgatagtaatcccgaaactgacaaccgccaggagtcgccgtctcaggagaatatcgatcggctggtttacatgggtttcgatgctctggtggcagaggctgccctgcgcgtcttccgcggaaatgtacaactggctgcccagaccctggctcataacgggggtagcctgcccccagaactgccattgtctcccgaggactcccttagtccaccagcaacctcaccatccgactcagccggaacgtcgtctgcctccacagacgaagacatggagaccgaagcagtgaacgagattctcgaagatatccccgaacacgaagaagactatctggactccactctcgaagatgaggagatcattattgcagagtatttgtcttacgttgaaaaccggaagagcgctacgaaaaaaaactag

SEQ ID NO: 23593 - DNA, 1920 bp, Artificial Sequence
  Description of Artificial Sequence: Synthetic coding sequence
atgaagaccaatggcggaaggtgcagaattagagccctttgctggagtagaagagagtggcggggagccggtatggcccagaaaaagtacctgcaggcaaagttgactcaattcctacgtgaagaccggattcaactttggaagccaccctataccgatgaaaacaagaaggtcggactggctctgaaagatctggcgaaacagtactcggataggctcgagtgttgcgagaacgaagtcgagaaagtgatagaggaaattcgttgtaaagccattgaaagggggactggcaatgataactacaggactaccgggattgctacaattgaagtctttctgcccccaaggctgaagaaggacagaaagaatttactggaaacgcgcctgcatataaccggcagggaacttcggagtaagatcgccgaaacctttggcctgcaggagaactatatcaagatcgtgatcaataagaagcaacttcagctaggtaaaaccctggaggagcagggcgtggcccacaacgtgaaggccatggtccttgagctgaaacagtctgaagaggacgccaggaaaaattttcagttagaggaagaagagcagaacgaggccaagcttaaagagaaacagattcagagaacaaaaaggggcctggaaatcctcgccaaaagagctgcggaaactgtagtggaccccgagatgacgccttatctcgacatagcaaaccagaccggcaggagtatccgcatcccaccatctgagagaaaagcgcttatgctggctatgggataccacgagaaaggccgagccttcctcaaacgaaaggaatatggcattgctctgccatgtcttcttgacgctgacaaatacttctgcgagtgctgtcgagaactgctggatactgtcgataactatgcggtcctgcagctggacattgtgtggtgctactttcgcctcgagcagcttgagtgtctcgatgacgctgagaaaaagcttaacctggcgcaaaagtgtttcaagaattgttatggagagaatcatcaacgtttggtgcacatcaaagggaactgtggaaaggaaaaagtattgtttttgcggctctacctgctgcagggtatccgcaactatcactccggaaatgatgtggaagcctacgagtacctcaataaagcgagacagctgttcaaggaattatacattgacccatctaaggttgataatttactgcagttgggattcaccgcacaagaagcacgcttggggctgcgcgcttgcgatggcaatgtggaccatgctgctacacacattacaaatcgtagagaagagctggcacagatccggaaagaggagaaggagaagaaacgccgtagattggagaacataaggtttttgaaaggaatggggtacagcacccatgccgcacaacaagttctccatgccgctagcggaaatttggatgaggcgctgaaaatcctgctgtccaacccccagatgtggtggctgaacgatagcaatcctgagacagacaaccggcaggaatccccatcacaggagaacattgacagactggtatacatgggcttcgatgccctggtcgccgaggcagctctgagggtgttcagggggaatgtacagctggcagctcaaactctcgcgcataatggcggtagcttaccgcctgaactgcccctgagtcccgaagatagcctctccccgccagccacaagcccgagcgactcggcgggtacaagctctgcttccacagacgaagacatggaaactgaagccgtgaacgagattctagaggatatccccgagcatgaagaagactatctggattccactctggaagacgaggaaattatcattgcagaataccttagctatgtcgaaaacaggaaaagtgccacaaaaaagaactag

SEQ ID NO: 23594 - DNA, 246 bp, Artificial Sequence
  Description of Artificial Sequence: Synthetic coding sequence
atgctcatcaaagttaaaactttaacaggaaaggagattgagatagacatcgagcccacagataaggtggagcgaattaaggaacgtgtggaggaaaaggaaggcatccccccacagcaacaacgcctcatctactctgggaagcagatgaacgacgagaaaaccgctgcagactacaaaatcttgggcggttccgtgctgcacttagtgctggccctgaggggcggaggtggcttacggcaatag

SEQ ID NO: 23595 - DNA, 819 bp, Artificial Sequence
  Description of Artificial Sequence: Synthetic coding sequence
atgtttgtaaaatctgagaccttggagctgaaagaggaggaggacgtgcttgttctgttaggtagcgcttcccccgctttggccgcattgacacccctttcaagttccgctgatgaggaagaggaagaggagcctggcgcttctggaggagccaggaggcagcgcggtgcagaagcagggcagggagccagaggcggagtagccgctggtgccgaaggctgtagacccgcaaggcttctaggcttggttcacgactgtaaacgtcgtccttcaagagctcgcgctgtgtcacggggtgcaaagactgctgaaacagtccagagaattaagaaaactcgaaggctcaaggcaaacaaccgagaaagaaatagaatgcacaatttgaatgctgccttagacgcactgagggaagttttgcccaccttcccagaagatgctaagctgacgaagattgaaaccctgcggttcgcccacaactacatctgggccctcactgagactctgaggttggctgatcattgcggagggggaggcggaggtctccctggtgcgctgtttagtgaggctgtgctgttgtctcccggaggtgctagtgccgcactctcctcttctggggactctccgtcccctgcatctacatggtcatgcaccaacagcccagctccaagcagttccgtctcaagcaatagcacatctccatactcttgtactctgtcgccggcatccccagccggaagtgatatggactactggcagcctccgcctcctgacaagcacagatatgctcctcacctacctatcgctcgtgactgcatttag

SEQ ID NO: 23596 - DNA, 1158 bp, Artificial Sequence
  Description of Artificial Sequence: Synthetic coding sequence
atgccacagaacgtggcaaagacagaacccgtgtctatcctgcagcctcagaccacagtcaaccccgatcgcataaaacagaccctcccctctagcccaacgaccaccaagtcatcaccatccgacccaatgaccactagcagggccaatcaggtgaagattattgtgccaaattccactgcaggcctgattattgggaaggggggagcgacagtgaaagctgttatggagcaatcgggcgcatgggtccagctgtctcagaagcccgacggaataaacctacaagagcgggtcgtgaccgtttcgggggagccagaacagaaccgtaaggcagtcgaactgattatccagaagatacaagaagacccacagagcggctcgtgtcttaacattagctacgccaatgtgactgggcctgtggcgaattcaaatcctaccggaagcccctacgccaataccgccgaagtcctaccaacagcagccgctgcagccggactcctgggccacgccaacttggccggagtggctgcatttcctgcagtgctttcaggattcaccggaaacgacctagtggccattaccagtgcacttaacaccctggcaagttatggttacaatcttaatacactgggactggggctaagtcaggctgcagccacgggggcactggccgctgcggcagcttcagcaaacccagccgcagccgcagcgaatcttctggctacctatgccagtgaagcgtccgcctcaggcagtacggcaggaggaacggccggaactttcgctctcgggtctttagcagccgcaaccgcagcgactaacggatactttggagctgcgtcccctctcgctgccagtgctattctcggcacagaaaaatccactgacggatctaaggatgtggtcgagatcgctgtgcctgaaaatttggttggagctatcttgggcaaaggcggtaaaactctcgtggagtaccaggagcttaccggtgcccgaattcaaattagtaagaagggcgaatttgtgccagggactcgcaaccggaaagttaccatcaccggcacacctgccgctacacaggctgctcagtatctgattacgcagcgtattacatacgaacaaggagttcgagccgctaatccgcaaaaagtcggctag

SEQ ID NO: 23597 - DNA, 546 bp, Artificial Sequence
  Description of Artificial Sequence: Synthetic coding sequence
atgatggcggcagcgccaatccagcagaacgggacgcatactggagtacccattgaccttgacccccctgacagccggaagagacccctggaggccccacccgaggctggctcaacaaagcgtacaaacacaggtgaagatggacaatatttcctgaaggtgctgatccccagctacgcagcgggatctatcattgggaaaggcggacagaccattgttcaactgcagaaagagactggagcaacaattaaactatccaaatctaaggacttctacccaggaactactgagcgcgtgtgcctgatacaagggacggttgaggccttgaatgctgtgcacggcttcatcgctgagaagatccgtgagatgcctcaaaacgttgcaaagactgagccagtctctatcttgcagccacagactaccgttaacccagacagaatcaaacagaccttgccctcttctccgactaccactaagagctctccttctgatccaatgacaacttcacgagccaaccagaagcacaacatctcttggatctcttag

SEQ ID NO: 23598 - DNA, 1452 bp, Artificial Sequence
  Description of Artificial Sequence: Synthetic coding sequence
atgatggctgccgcaccgatccagcaaaacggtactcataccggcgttcccatagacttggatcctccagattcccggaagagaccactggaggctccacctgaggctggatcaacaaaaaggactaacaccggggaagatggacagtattttctgaaggtcctaatcccgagctatgctgcgggatcaattatcggcaagggaggacaaacaattgtgcagctgcagaaagagacgggggctactatcaaacttagtaagagcaaagacttctaccctgggactactgagagagtttgtctgattcaggggaccgttgaagcattaaacgcagtccatggcttcatcgcagagaagattcgtgagatgccacagaacgtcgctaagaccgaacctgtctctatcttgcagccgcagaccacagtgaatcctgatcgaatcaaacaggttaagatcatcgtcccgaatagcacagccggacttatcattggaaaaggcggagccacagtcaaggccgtaatggaacagtctggtgcttgggtgcagctgagccagaaacccgacgggatcaacctgcaggaaagggtggttacagtgtctggtgagcccgaacagaatcgaaaagccgtcgagctgattatccagaagatccaggaagacccacagagcggcagctgcttaaacataagttatgcaaatgtgaccggaccggtcgccaacagtaacccaaccggcagcccctatgccaacacagcggaggtcctgcctactgccgcagcagccgcaggactactcggtcatgccaacttagcaggcgttgcggcatttcccgcagttctatccggctttactggaaatgacttggtcgccataactagtgccctcaatactcttgctagctacggttacaatctgaatactctgggcctggggctcagtcaagctgccgctaccggggcactagcggcagcagcggctagtgcaaatccagcagccgcagctgccaatctcctggccacttacgcttccgaggcctctgcttccggaagcaccgcagggggtaccgccggaaccttcgctttagggtcacttgccgctgcaaccgctgccaccaatggctatttcggcgctgcttctccactggctgcaagcgcgatcttgggcacagaaaaaagcacagacgggagcaaagatgtagtggagattgctgtgcccgagaatctggtgggtgctatccttggaaagggcggtaaaactctggtggaatatcaggagcttacaggcgctcggattcaaatctctaaaaaaggcgagttcgtaccagggactagaaaccggaaagtgaccataaccgggacccctgctgcaacccaggctgcgcaatacctgatcacccagagaataacttacgagcagggcgttcgggctgccaatcctcagaaagttgggtag

SEQ ID NO: 23599 - DNA, 1524 bp, Artificial Sequence
  Description of Artificial Sequence: Synthetic coding sequence
atgatggctgctgctcccatccagcaaaacggcacgcacacaggagtccctatcgacctggatcctccagattcacgcaagaggccactggaggcccctcctgaggccggaagcacgaagcgcactaacaccggagaggacgggcagtatttcctgaaagtcctgatcccgagttacgcagcgggaagcatcatcgggaagggagggcaaacaattgtgcagctccagaaggagacgggggctacaattaagctatccaagagcaaggatttctaccctgggacaactgagcgggtgtgtctgatccaagggacggtggaggccctcaatgccgtccatgggtttatcgccgagaaaatccgggagatgccgcaaaatgttgcgaagacggaaccagtgtcgattctccagcctcagacgactgtgaatccagacagaatcaagcagaccttgccaagttctccaaccacaactaaatcttctcctagtgaccccatgaccacatccagggctaaccaggtaaaaatcatcgtgccaaattcaaccgcaggactcattattggaaaaggcggtgctacagtgaaagccgtcatggagcagtccggggcatgggtccagttatcacagaaacctgatggaataaacctgcaggagcgggttgtaacggtcagcggtgaacctgagcagaaccgcaaagcggttgagctcattatccaaaagatccaagaagacccgcagtccggttcatgcctgaatataagctatgccaacgtgactggtccagtggccaacagtaaccctaccggcagcccctatgctaataccgccgaggtactgcctaccgctgcagccgctgccggtctactcggccacgcaaaccttgctggtgttgccgctttcccagcagtcctcagtggcttcaccggcaacgacctcgtggcaataacgagcgctctgaacaccctggcgtcttacggttacaacctcaacactctgggtctgggactttcccaagccgctgctacaggggctctggccgctgccgctgctagcgctaatccggctgctgccgcagcgaaccttctcgcgacatatgcaagcgaagccagcgcatcgggatccacagccggtggtaccgccggaactttcgcactgggctcactagctgcagcaactgcagcaaccaatgggtatttcggggcagcatctccccttgcagcctccgccattctgggaacggaaaaatctacggatggctccaaggatgttgtggaaatagccgtgcccgaaaatttagtgggcgcaatcctcggcaagggtgggaagacactggtggaataccaggagttgactggcgctcggatccagatcagtaaaaagggggagttcgtgcctggtacaagaaaccggaaggtgaccataaccgggacacccgcagctacacaggcagcccagtatctgattacacaacgcattacctatgagcagggggtcagggctgctaatccccagaaggttgggtag

SEQ ID NO: 23600 - DNA, 1479 bp, Artificial Sequence
  Description of Artificial Sequence: Synthetic coding sequence
atggagccagaggccccagattcacgaaaacgccctctagaaactcccccagaagtggtgtgcacaaagaggagcaatacaggcgaagagggcgaatatttcttgaaggtattaatcccatcatacgccgctggaagcattatcggcaaggggggacagacaattgttcagcttcaaaaggaaaccggcgcaaccatcaagctgagcaaaagtaaagacttctatcctggcaccacagagagggtttgccttgtgcagggcactgccgaggcactaaacgcagttcattcttttatagcagagaaagtccgtgagatcccccaggctatgacaaaacccgaagtggtgaacatcctccaaccccagacgacaatgaatccggaccgggctaagcaggccaagctcatcgtgccgaacagcaccgctggcctcataatcgggaaaggaggcgctacagttaaagcagtgatggagcagtccggcgcttgggtgcagctcagccaaaagcccgaggggattaatctgcaagaaagggtcgtaacggtttctggcgaacctgagcaggttcacaaggccgtgtccgccattgtacagaaggtgcaggaagacccccagtcctcaagttgcttgaacatctcttatgctaatgtggccggtcctgtcgctaactctaaccctactgggtccccctatgcctctcctgctgacgtcctgccggcagccgctgcggcttccgcagccgcagcttctggactgctgggccctgcaggactggccggagtgggagccttcccagccgctcttcctgcgtttagtggtactgatctgttagctatctctacagctttaaacacactggctagttatgggtataacaccaattcgctcgggctgggcctgaattcggcagcagcatccggagttttggccgcagtggctgccggagccaatccggcagccgctgctgccgcaaatcttctggctagttatgccggagaagccggagctgggcctgctggaggggcagctccccctcccccaccaccaccaggcgcattggggtcctttgccctggccgctgctgccaacgggtatctcggtgccggtgccggtggcggtgctggtggcggagggggaccactggtggcagccgcagctgctgccggtgccgctggcggattcctaaccgcggagaaacttgctgcagagtccgccaaagagctcgtcgagatcgccgtccctgaaaacctcgtcggcgcaattttgggaaaaggaggaaaaacgctggtggagtatcaggagctgacaggggctcgtatccaaatctccaagaaaggagagttcctgccagggaccaggaatcggagggtcacaataactgggtctccagccgcaacgcaggctgcccaatacctcatcagccagcgtgtcacttacgaacagggtgtgagagccagcaatccacagaaagtggggtag

SEQ ID NO: 23601 - DNA, 840 bp, Artificial Sequence
  Description of Artificial Sequence: Synthetic coding sequence
atggagaatagtgaaaagacggaggtcgtgctcctggcctgcggttcattcaaccccataacaaatatgcacctgagattgttcgagctcgctaaggactacatgaacggaactggccgatacactgtggtaaagggtatcatcagcccagtgggggacgcatacaagaagaaaggattaatacccgcttatcaccgggtgattatggctgaactggctacaaaaaacagtaagtgggtggaagtggacacctgggagtccctgcaaaaagagtggaaggagacactgaaagtgttgcgacatcatcaggaaaaacttgaggccagtgactgcgaccatcagcagaactccccaaccctcgagaggcctggcagaaaacgtaagtggaccgagacacaagattcgtcgcagaagaaatcccttgagcccaaaaccaaagccgtgccaaaagtgaagcttctctgcggcgctgatctgctggaatcttttgcggtgcctaatctatggaaatccgaagatatcactcagattgtcgcaaactacggactgatctgcgttacgagggctggcaacgatgcgcagaaattcatttatgagagtgatgtcttatggaaacacaggtccaatatccacgtggtaaacgagtggattgcaaatgacatcagctctaccaaaattaggcgagcgcttcggcgaggccagtcaattagatatctggtgcctgatctagtgcaggagtatatcgaaaaacacaatctgtatagttcggagagtgaagaccgaaacgctggagttatcctggccccattacagagaaatacagccgaggcaaaaacctag

SEQ ID NO: 23602 - DNA, 483 bp, Artificial Sequence
  Description of Artificial Sequence: Synthetic coding sequence
atggagaattccgaaaagaccgaggtggtgctcctcgcctgcggatccttcaaccctatcaccaacatgcacttgcgcctgtttgagctagccaaggattatatgaacgggaccggaaggtacacagtcgtaaaaggcatcatttcccctgtgggcgacgcatacaaaaagaagggtttgattccggcttaccaccgcgtgattatggctgaactggcaacaaagaactccaaatgggtggaagtcgatacgtgggagagcctacagaaggagtggaaggaaacgctcaaagtgcttcgccaccaccaggaaaagttggaggcctccgattgcgaccatcagcagaacagtcctaccctggagcggcctgggagaaagaggaagtggacggagactcaggacagttctcagaaaaaatcattggaaccaaagactaaagatggagtgtccttgtaccatcctggatggtccgccgtagcatag

SEQ ID NO: 23603 - DNA, 840 bp, Artificial Sequence
  Description of Artificial Sequence: Synthetic coding sequence
atggagaacagcgaaaaaacggaggtcgtcctcttagcatgtggatcattcaaccccatcacgaacatgcatctccgactgtttgagctcgccaaggattatatgaacggaacaggcagatatacggtagttaagggcataatctcccccgtgggagacgcatacaagaaaaaggggctgattcctgcctaccaccgcgtgattatggcagagctggccacaaagaactccaaatgggtggaggtcgacacatgggagagcctgcagaaggagtggaaggaaaccttaaaagttctgcgccaccatcaagagaagttggaggcaagcgactgtgatcatcagcagaattcacctaccctcgagcgtcccggacgtaaaaggaagtggaccgagacgcaggatagtagccagaagaagtctttggagcccaaaactaaagcagtgcccaaggttaaactgctctgcggcgcagacctgcttgaatcctttgcagtccccaacctgtggaaatcagaggacatcactcaaatagtggccaactacggactcatctgtgtgacccgagcgggaaatgacgcacagaagtttatctatgaaagcgacgtgctgtggaaacaccgctccaatatccacgtagtcaatgaatggatcgcgaacgatatcagttccacgaagatacgcagagctctccgcagagggcaatcaattcggtaccttgtgccagacctggtccaagagtacatcgagaaacacaacctctactcaagtgagtccgaggataggaacgctggtgtcattcttgcccctctccagcgtaacaccgcggaggctaagacatag

SEQ ID NO: 23604 - DNA, 1239 bp, Artificial Sequence
  Description of Artificial Sequence: Synthetic coding sequence
atggctcccgtggagcatgtggtggcagacgcgggtgcttttcttagacacgcggcactgcaagacatcggcaagaatatatacaccattcgtgaagttgtgactgagattagggataaagccactcgcagacgcttggccgtccttccttacgagctcagattcaaagaaccactgccggagtatgtgcgacttgttacggagttttcaaagaagacgggcgactatccatctcttagcgcaactgacattcaggtgttggcactaacataccagctggaggctgaattcgtgggagtatcccaccttaaacaggaacctcagaaagtgaaagtgagttctagcattcagcaccccgaaacgccgctgcacatcagcgggttccacctgccatacaagccaaaacctccgcaggaaacagagaagggacattcagcctgcgagccagagaacctcgagttttcctccttcatgttttggcgcaaccccctcccaaacatcgatcacgagctgcaagagttgctgatcgaccgcggtgaggacgtgccgagtgaggaagaggaggaagaggaaaacggctttgaggatcgaaaggatgacagtgatgatgatggcggaggatggatcaccccctctaacattaagcagatacagcaggagctggagcagtgtgacgtaccggaagacgtcagggtcggctgtctgactaccgacttcgcaatgcagaatgtgctgctacagatgggacttcatgtgttggcagtcaatgggatgctgatccgggaggctaggtcgtacattctgcggtgtcacgggtgctttaagactaccagtgacatgtccagggtgttctgtagccactgtggtaacaaaactttaaagaaagtgtccgtcaccgtgagcgacgacggtaccctgcatatgcacttttcccgtaatcccaaagtgctgaatcctagagggctgaggtatagccttccgacccccaaaggaggaaagtacgctataaaccctcacctgacagaagatcagcgattcccacagctgagactatcccagaaggctagacagaagactaacgtattcgcgccagactacatcgccggagtctctccgttcgtggagaacgatatcagctcaaggtcagcaaccctgcaggttagggattctactttgggggcaggccgtaggcgactcaatcccaatgcgagtcggaagaaattcgtgaagaagaggtag

SEQ ID NO: 23605 - DNA, 1236 bp, Artificial Sequence
  Description of Artificial Sequence: Synthetic coding sequence
atggatggccgagcggagctaccagcttttcctagagcaggggcaccccctctggctgcatctgatacggtgccggcagcccctgagggcgctggagctgctcggcctgcagctccactgcgtcccacctctttttccgttctggacatcttggatcccaacaagttcaattctagaaggaggaggtgtgtgcttctgggaccagttgcccctgccgcatgcgccccatgtgcttcggcaccctgcgcacctgcaccggcagcctctggtcggccaccccgtgccgaagaactggagcggagggccctcgccggtgcgggaggagtcggagccgcaggggctgaaccccctaacgcaggcgatccttttaaagccggagaagctgaaaccaacgacaccaacggctactcatctggaggaggcggtcattctccttccgcagatagcggcgacgaggtaccagatgatgaagacgatgacgaagatgaggcacctgagactgaggccgctcggggagccgaggaggctcgcggaggcggaggaggattgggcgctcgagggtccggttgccaaggagccgctgagaccgatgcaagccccggtgccaccgtggacgaggcggcagcgccaggtcctcgtgagaatagtccggtggctcagggccctcctgggggagccgcagcacccggaggtgctggaaccactccgcaaggaactgccactgcggcaaaaccgaaacgcaaacgaactggaagtgattcgaagtcgggaaagcccagaagggccaggacggcattcacgtacgagcaactggtggctctggagaataagtttaaggctacccgttacctttccgtttgcgaacgtctgaatctggctctgtccctttctttgaccgagacccaggtcaaaatctggttccagaaccggagaaccaaatggaagaaacagaaccctggagcagatacttccgcaccaacagggggaggagggggtcctggaccaggagctggtcctggcaccggtctccctggcggtctctcacctttgtccccctcccctcccatgggggctccgcttggtatgcatgggccagccggttacccagcacacggccctggaggactggtatgtgccgcacagttacctttcctatccagtccagctgtattatcaccctttgttctcggtagtcagacttacggcgctcctgctttctatgctccacacttgtag

SEQ ID NO: 23606 - DNA, 1095 bp, Artificial Sequence
  Description of Artificial Sequence: Synthetic coding sequence
atgatgctgccaagccccgtgacctctacccccttttcagtgaaagacatattgaatcttgagcagcagcatcagcattttcacggggctcacttgcaagctgacctggagcaccacttccacagtgctccatgcatgctggctgcagctgagggtactcagttcagtgatggaggtgaggaggacgaagaggacgagggagagaagctttcgtacctgaatagtctcgctgcagccgacgggcacggcgatagcgggttatgcccccagggctatgtacataccgtcctgagagattcatgttctgaaccaaaggagcacgaagaggaacccgaagtcgtgagggataggagtcaaaaatcctgtcagctaaagaagtccctggaaacagctggcgactgcaaggctgccgaggaatcagagcgtcccaagccgaggagccgcagaaagcccagggtcctcttcagccaagctcaggtttttgagctggaacggagatttaaacagcagaggtatttgagcgcgccagagagagagcatctggccagttccttgaaactgacctcaacgcaggtaaaaatttggtttcagaaccggaggtacaaatgtaagcggcaacggcaagacaaatcactcgaactgggcgctcacgccccaccaccccctcctcgcagagtcgctgtgcctgtcctggtcagagacggcaaaccctgcgtaaccccgagcgctcaagcatacggtgcgccttactccgtgggcgcatccgcttatagctacaactccttcccggcatatggttacggaaattccgcagccgcagcagcagccgctgcagccgcagctgccgcagccgctgcttattcttcaagttatggttgcgcctatcccgctggagggggaggcggtgggggaggaaccagtgccgcaacgactgcaatgcagccagcttgttccgctgcaggcggtgggccttttgttaacgtttctaacctgggcggtttcggcagcggcggttctgcgcagccactacatcagggaaccgctgcaggggctgcttgcgctcagggcacgttacagggcatcagggcttggtag

SEQ ID NO: 23607 - DNA, 1104 bp, Artificial Sequence
  Description of Artificial Sequence: Synthetic coding sequence
atgctcgcggtgggagccatggaggggacacgtcaatctgcattcttactgtccagtcctccactagcggcactgcactcgatggcggagatgaagactcctctgtatccagcagcataccccccacttccggctggccctccaagtagctctagctccagctctagctccagctctcccagtcctccactgggaacacataaccctgggggactgaagcccccagctacaggaggcctttcaagtctcggcagtccccctcagcagctgtctgctgctaccccacatgggataaacgacatcctaagtcgtccctcaatgccggttgcttcaggcgcagccctgccatcggcgtccccatcgggctcatcatcttccagcagcagctccgcatcggccagttccgcaagcgctgccgcagccgctgcggcagcagcggctgcagcagctagctcaccagctggcctcctggcagggttgccgcgattttcaagtttgtcccctcctccaccacctcccggactctattttagtccatcagccgcagccgtagcggctgtgggcagatatccgaagcctctggcagagctgcccggaagaacccccatcttttggcccggagtaatgcagtcgccgccttggagagacgccagactggcctgcactcctcaccagggctctattctcctggacaaagacggaaaaaggaaacatacacgtccaaccttttccggacagcagattttcgcccttgaaaagaccttcgaacagaccaaatatttggctggcccagagagagcccgtcttgcctatagtctcgggatgacagagagtcaggtcaaggtgtggttccagaacaggcgcactaagtggaggaagaagcacgctgccgaaatggcaaccgccaagaagaagcaggacagcgagacggagcgtctgaagggcgctagcgaaaacgaggaggaagatgatgattacaacaagcctctagatcctaactcagacgacgaaaagatcacacagctcctgaagaagcacaaatcttccagtggcggaggtggtgggttgctgctgcatgcgagcgagccagagtcatcttcctag

SEQ ID NO: 23608 - DNA, 834 bp, Artificial Sequence
  Description of Artificial Sequence: Synthetic coding sequence
atggatactaaccgacctggcgctttcgtgctatcgagcgcccctctcgcagcactgcacaacatggcggaaatgaaaacctcattgttcccgtatgctctccagggtcccgctggtttcaaagccccagcattgggtggactgggagctcagttgcccctcggaaccccgcacgggatatctgatatcctggggcgacctgtgggggctgccggaggtggactgttagggggactgccgcgattgaatggcctggcaagcagtgccggagtatatttcggcccagcagcagccgtggcgagaggataccctaagcccctggccgagctgcccggacgaccacctattttctggccgggtgtcgtccaaggcgctccctggagggatcctcgtcttgccggaccagcgcctgccggaggtgtcctggacaaggacggtaagaagaagcactcacggccaacattcagtggacagcagatttttgctctggagaagaccttcgaacaaacaaaatatctggctggcccagagcgggctcggctggcctacagcctgggtatgacagaatctcaagtaaaagtgtggtttcagaaccggcgaactaaatggcggaagcgccacgcagtggagatggcgtctgccaaaaagaagcaagattcggacgctgaaaaattgaaggtcggtgggtccgatgcagaagacgatgacgagtacaaccgccctctggatccaaatagtgatgatgagaagattactcgactgctcaaaaagcataagccttcaaacctggcactggttagcccatgcgggggaggggctggggatgcattatag

SEQ ID NO: 23609 - DNA, 225 bp, Artificial Sequence
  Description of Artificial Sequence: Synthetic coding sequence
atggtggcgctccgaggactgggctccggcctgcaaccctggtgtccacttgacttgagactggagtgggttgacactgtgtgggagttggactttacagagactgaaccgctagaccctagcatcgaggccgaaatcatagagaccggactcgcagcgtttaccaagctctacgaaagtctgttgccctttgctactggcgaacatggtagcatggaagtctag

SEQ ID NO: 23610 - DNA, 108 bp, Artificial Sequence
  Description of Artificial Sequence: Synthetic coding sequence
atggtcgcacttcggggactcgggtccggtttgcaaccgtggtgcccgctggacctgaggctcgaatgggttgacaccgtctgggaactggattttaccgaaacatag

SEQ ID NO: 23611 - DNA, 4497 bp, Artificial Sequence
  Description of Artificial Sequence: Synthetic coding sequence
atggtggcattaagggggcttggctccgggcttcagccttggtgtcctctggacctgcgattagagtgggtagataccgtctgggagcttgactttaccgaaacagaacctttggaccctagcatcgaggcagagatcatcgagaccgggctggccgctttcaccaaactgtacgagtccttgttgcctttcgccactggagagcacggcagtatggagagtatttggacctttttcatcgagaataacgtcagtcattcaaccttggtcgctttgttctaccatttcgtccagatcgtgcataaaaagaacgtgtccgttcagtaccgcgaatacggcttgcacgctgccggtctgtactttctcctgctcgaggtacccggaagtgtggccaaccaggtgttccacccagtcatgtttgacaagtgcatccagacacttaagaagtcgtggccacaggaaagtaatctgaacagaaagcgcaagaaggagcaaccaaaaagtagccaggctaacccgggtcgccacaggaaacggggtaaaccacctcggcgagaggacatcgagatggatgaaatcatcgaagagcaggaggacgagaatatatgcttcagcgctcgcgacctgtcacaaatacgcaacgcgatcttccacctattgaagaatttcttgcgattgctccccaaattttcactcaaagaaaagccccagtgtgtgcaaaactgcatagaggtctttgttagccttacaaacttcgaaccagtgctgcacgagtgtcatgtgacacaggcaagggcactgaaccaggcgaaatatataccagagctggcttattacgggttatatctgttatgctctcctatacatggagagggggataaagtgatctcctgcgtgttccatcagatgctgagcgtcattctcatgctggaggtgggggagggctcacatagggcccctcttgccgtcacttcccaggtcatcaactgtagaaatcaagctgtgcagtttattagtgcgctggtagatgagttgaaggagagcattttccctgtggtgaggatactgttacagcatatctgcgccaaggtcgtcgataaaagtgaatatagaacctttgctgcgcagtctctcgttcagttgttgtcaaagttgccttgcggcgaatacgcaatgttcatagcttggctttacaagtatagtcgctcatctaaaattccccatcgggttttcacgctagacgtggtcttagcccttttggaattacccgaacgggaggtggacaacactctgagtctcgagcatcagaaattcctgaaacacaaatttctggtgcaggaaatcatgttcgaccggtgtcttgataaggcccctaccgtgcgctctaaggccctctctagctttgcacactgccttgaactgactgtgacttctgcgagtgaatccatcctggaactgctgatcaacagcccgaccttctctgtcatcgagtctcatccaggaaccctgctaaggaattcaagcgccttcagctaccagaggcaaacctctaatagatccgagccaagcggcgaaataaatatagacagttcaggtgaaacagtggggagcggagagcgttgcgtcatggctatgctgaggagacggatccgggacgaaaaaactaacgtcagaaaatccgctctgcaggtgttggtgtcgatactgaagcattgtgatgtcagcggcatgaaagaagatctgtggattctacaggaccagtgtagagaccctgcagtgtccgtgaggaaacaagcactccaatccctaacagagttattgatggctcagccaaggtgcgtgcagatacaaaaagcctggcttcggggtgtggttccagttgtcatggattgcgaaagtaccgtgcaggaaaaggctcttgagtttctggaccagctcctgttacagaacattcggcaccactcccacttccattctggcgacgactctcaagtactagcctgggccctgctcaccctgctcactacggaatcgcaggaactcagccggtacctgaacaaggcgttccatatctggagtaagaaggaaaagttctcaccaaccttcataaataatgtgatatcccacaccgggacagaacacagtgcgcctgcctggatgctcctgtccaagatcgcgggaagctcacccagattggattactcccggattattcagtcctgggaaaagattagttctcagcagaacccaaactccaacaccctgggtcacatcctttgtgtgatcggccatatcgccaaacacctccctaagtccactcgagacaaagtgactgacgccgtgaaatgtaaattaaatggattccagtggagtctggaggtcatttcctcagcagtggacgccctccagcggctttgcagagctagtgcagaaacacccgctgaagagcaggagctgctgacacaggtctgcggggacgtgctcagcacctgtgagcatagattgagcaatatcgtgcttaaagagaacggaaccggaaatatggacgaggacctactagtgaaatacatcttcaccctaggggacatcgcgcagctgtgccccgctagagtggaaaaaaggatcttccttctcatccagtctgtgctggcctccagcgctgacgctgaccattccccgtcctctcagggctccagcgaggcacccgcttcccagccaccaccacaggtgcgcggatctgtgatgccttctgtgatcagagctcatgccatcatcacactgggcaagttgtgtcttcaacacgaggaccttgcaaaaaaatccatcccagccctcgtccgagagctggaagtgtgtgaagacgttgccgtacggaacaatgtaatcatcgtgatgtgcgacctgtgcatcaggtacacaatcatggtcgacaaatacattccgaatatcagcatgtgcttaaaagattcagatccctttatcagaaagcagactctgatcctgctgacaaatctcctgcaagaagagttcgtcaagtggaaaggaagcctgtttttccggtttgtctctaccctgattgactcgcatcccgacattgcgtcctttggggagttttgccttgcacacctcctcctgaagcgcaaccccgtgatgtttttccaacacttcattgagtgtatattccactttaacaactacgagaagcacgaaaagtacaataagttcccacagtccgaaagggagaagagactgttcagccttaagggcaaatccaataaagaacgccgaatgaagatctacaagtttctactggaacactttactgacgagcagcgtttcaacattacgtctaaaatctgtctcagcattctggcctgctttgcagacggtattctcccactcgacctggatgcctcggaactgctcagtgacacctttgaggttctgtcatcaaaggaaatcaaactgctagcaatgaggtccaaacctgataaggacctgctcatggaggaggatgacatggctctcgccaatgtggtcatgcaggaggcccagaagaagctgatctcccaggtgcagaaaagaaacttcatcgagaacataattcccataattatatcactgaagactgtcttagagaagaacaagatcccagcactccgagagctgatgcactaccttagagaagtcatgcaggactatcgggacgagctgaaagacttctttgccgtcgataaacagttggcgagcgaattggaatacgatatgaagaaatatcaggagcagttggttcaggagcaggagctggcaaagcacgccgacgtggctggaacagcagggggagctgaagtcgcgcctgtcgcccaagtggccctgtgtttggagacagtgcccgttcccgcaggacaggagaatccagctatgtctccggctgtgagtcaaccctgcaccccccgtgcctccgcagggcacgtggctgtttccagccctactcccgagacgggaccattgcagcggctcttgcctaaggctcgtcccatgtccctgtctaccatcgctatactgaactctgtgaaaaaagctgtggaatccaagagcaggcaccgttctaggtcactaggtgtactgccatttacactcaactctggttctcccgaaaaaacctgcagccaagtatccagttactcattagaacaggaaagcaatggagagatcgaacatgtcactaagcgcgcaataagcacaccagagaagtctatttctgatgtcactttcggcgctggcgtgtcctacatcggaaccccccgtaccccgtcctctgccaaagagaaaattgagggaaggagccagggaaacgatattctttgcctgagcctccccgataagcccccaccccagccacaacaatggaatgtgcgatcacctgcacgaaacaaggacacaccagcttgtagtcgcagaagcctgcggaagacgcccctgaaaactgctaactag

SEQ ID NO: 23612 - DNA, 2667 bp, Artificial Sequence
  Description of Artificial Sequence: Synthetic coding sequence
atgttgctagagtgttttatcaatattaattacattaagaaggaggaagggagacgattccttagctgtctgtttaattggaatattaacttcatcaaaatgatccatgggaccatcaaaaatcagttacaaggtttacagaagagcctgatggtgtatattgccgagatttactttagggcctggaaaaaagcctccggcaagattctcgaagcgattgagaacgattgcatccaggacttcatgttccatgggatacacctccccaggaggtctcccgtccattctaaggtcagggaagtgctgagctatttccaccatcagaagaaagtgagacagggcgtcgaggagatgctgtacagactgtacaaacccatcctctggcggggtctgaaagctagaaattctgaagtgcgttcaaacgcggcactgctcttcgtggaggcattccccatccgcgatcccaatctgcacgccatagagatggactcagagatccagaaacagttcgaggaactgtattcgctgctggaagatccctaccccatggtcagatcgaccggaattttgggcgtgtgcaagatcacatccaagtattgggaaatgatgcctccgaccattctgatagacctgctcaaaaaggtgaccggagaacttgccttcgacacatccagcgccgatgtaaggtgttccgtctttaaatgtctccccatgattctagacaataagctttcacaccctctgctggaacagctgttgccggctctcagatactcattacacgataactcagaaaaggtgcgggttgctttcgtggatatgctgctaaaaattaaggccgttagagccgcaaagttctggaagatctgccctatggagcacattctcgtgcgtctggagacagactcccggcctgtttcccggcgacttgtgtctcttatctttaattcatttctgccggtgaaccagcccgaggaagtgtggtgtgagcggtgcgtgactctcgtgcagatgaatcacgctgccgcaagaaggttctatcaatatgcccacgagcatactgcgtgcacgaacatcgcaaagctgatccacgttattcggcactgtctgaacgcttgcattcaacgagccgttcgcgagccgccagaggacgaggaggaagaagacggccgagagaaggaaaatgtgaccgtcctggacaaaacacttagcgtgaacgatgtggcttgcatggccggacttcttgagatcatcgtgatcctctggaaatctatagatcgcagcatggagaacaataaagaggccaaactctacaccattaacaagttcgcgagtgtgctgccagaatacctcaaagttttcaaggacgatcgctgcaaaattccgctgttcatgctaatgagtttcatgcctgcgagcgccgtgcctccattcagctgtggagtcatcagtactctgcgtagtcgcgaagagggcgcagtcgacaaaagttactgcacgttgctagattgtctctgctcgtggggccaggtaggtcacatcttggaactggttgataattggctgcctactgagcacgcacaggccaaatccaatacggccagtaagggtagggtgcagatccacgacacccgcccagtgaaacccgagctggccctcgtgtatatcgagtacctcctaacacatcccaaaaatcgggagtgccttttatcggccccaaggaagaaactcaatcacttgcttaaggcccttgagacatccaaggccgacttggagtcattgctgcaaacaccaggaggaaagccacggggattttccgaagcagcagctcccagagcttttggcttgcactgtcgcctgagtattcacctgcagcacaaattctgcagcgagggcaaagtctacttgtccatgctggaggacaccggattctggttggaaagcaagatcctgtcattcatccaggatcaggaagaggactacctcaagttgcatagggtgatttaccaacaaatcatccagacgtacctgacagtctgcaaggatgttgtgatggtcgggctaggagatcaccagttccagatgcagctcctgcagcggtctctcggtatcatgcagactgtaaaaggcttcttttacgtttcacttctgctggatatcctcaaagagattacaggtagtagcttgattcagaaaacagattcagacgaggaggtggctatgctgctggacacagtgcagaaggtgtttcaaaaaatgctggagtgcattgccagaagctttcggaaacagccggaggagggactgcgtgtgagtgacgtggaggaacttactccgccagagcatctgtctgacctccccccattcagcaggtgtctgatcggcataatcataaagtccagtaacgtagtccgcagttttcttgacgagctcaaggcttgtgtggcttccaacgacatcgaaggtatcgtctgtctgactgccgctgttcacatcatcttggtaatcaacgccggaaagcacaaaagttccaaagttagagaggttgcagctacagtgcaccgcaaactgaaaactttcatggagattaccctcgaggaggacagtatagaaaggttcctgtatgagagcagctcccgcacactgggggagctgctgaattcctag

SEQ ID NO: 23613 - DNA, 3432 bp, Artificial Sequence
  Description of Artificial Sequence: Synthetic coding sequence
atggagaagcgcgagactttcgtacaagccgtctccaaggagctcgttggggagttcctacagttcgtccagctggataaggaagcaagtgacccatttagtctcaatgaactgctggacgagctaagtagaaaacagaaagaggaattgtggcagagactgaagaatctgctgacagacgtcctgcttgaaagccctgtagatggatggcaggttgtggaagcccagggggaagacaatatggaaactgaacacggttccaaaatgcgaaagagcattgaaatcatctatgcaatcactagtgtcatactcgcttctgtctctgtcatcaatgaatcagagaactacgaggcattgctggagtgcgtcatcattctgaatggcatactctatgcacttcctgagtcggaacgaaaactccagagttccattcaggacctgtgtgtgacatggtgggagaaagggctgcccgcaaaagaagataccggcaaaaccgcgttcgttatgctcctgcgacgatctctcgagaccaaaaccggcgctgacgtgtgccggttatggcggattcatcaggccctatactgctttgactacgacctcgaagagtcaggagaaattaaagatatgctcctggagtgttttataaacattaattatataaagaaagaagaaggacgcaggttccttagttgtctttttaattggaacatcaatttcattaagatgatccacggcacgatcaagaatcagctgcagggtctccaaaaatctttgatggtatacatcgccgagatatatttcagggcctggaagaaagcatctgggaaaatcttggaagctattgaaaacgattgtatccaggacttcatgttccacggcatccatttgcccaggcggtctcctgtccactctaaggtcagagaggtgctgagttatttccaccatcagaaaaaggtgagacagggagtggaggagatgttgtaccggctctacaagcccattctgtggagggggctgaaagctcgcaacagtgaggtgcgcagcaatgcagcgctgctgttcgtggaagcattcccgatcagagaccctaatctgcacgctattgaaatggattcagagattcagaagcagtttgaggaactatactcacttctcgaggacccctaccccatggtgcggagtacaggtatccttggcgtctgcaaaattacgtctaaatattgggagatgatgccacctacaatactgattgacctgctgaagaaagtgactggtgagctagcattcgacaccagctctgcagatgtgcggtgctccgtttttaagtgtctacccatgattctcgacaataagctgtcccatcccttgctcgagcagcttttgccagcactgcgctactcactgcacgataacagcgagaaagtgcgagtcgcatttgttgatatgctcctaaaaatcaaagccgtaagggcagccaagttttggaaaatttgccctatggaacatattttggtacgcttagagactgacagtaggcccgtgtcacgtagacttgtctctcttatcttcaactcctttctgcccgtcaaccagcctgaggaagtttggtgtgaacgttgcgttacactggtacagatgaaccatgccgctgcgaggcgcttctatcagtacgcccacgagcatacagcgtgcaccaatattgccaagctgattcacgtcatccgccactgtctcaacgcttgtattcagcgcgctgttagggaacctccagaagatgaggaggaggaggacggccgagaaaaggagaatgttaccgttctcgacaagaccctgtccgtgaacgatgtggcgtgtatggccggtctgctcgagatcatcgtgattttatggaaatctattgacaggtcaatggaaaataataaagaggccaagttatatacgataaacaaatttgccagcgttctccccgaatatctgaaggtcttcaaggacgacagatgcaaaatacctctgtttatgctcatgtctttcatgcccgctagtgccgtacctccttttagctgtggggttatttccaccctcaggagcagagaggaaggcgcagttgacaagtcctattgtactctgctcgactgcttgtgctcctgggggcaggtaggacacatcctggaactggtggacaattggcttccaacagagcacgcccaggcaaagtctaacacagcctctaaggggcgagtccagattcacgatacccgcccagtgaagcccgaactggcccttgtctacatcgaatacctgctcacacaccctaagaatcgggaatgtcttttgtccgccccaagaaaaaagctaaatcacctcctgaaagcacttgaaacctctaaggcggatctggaaagcctgctacaaacacctgggggtaaacccagaggtttttcagaagccgcagcacctcgggctttcggcctccattgtaggcttagcattcacctgcagcataagttctgttccgagggcaaggtttacctatccatgctagaggacaccgggttctggctggaaagcaaaattttgtcctttatccaggaccaagaggaggactacctcaaactgcatcgggttatctatcagcaaattattcagacctatctgacggtatgcaaggacgtggtgatggtcggactcggtgatcatcagtttcagatgcaactgctgcagcgctcactcggcatcatgcagacagtgaaaggctttttctatgtgtcccttctgttggacatattaaaagagattacggggtctagtctcatacagaagacagactctgacgaggaagttgctatgctcctggacacggttcaaaaggtctttcaaaagatgcttgagtgcatcgctcgcagtttcagaaagcagccagaggaaggactgcggttgctgtacagcgtgcagcggccactgcacgaatttataacagcagtacagtcacgacacacagatacgccagtacaccgtggtgtgctctctacactgatagcgggtccagtagtggagataagtcatcaactcagaaaagtgagtgatgtggaagagctgacaccaccagagcacttatccgatctcccgccttttagccgctgtctgataggaatcattatcaagagctctaatgtggtgcgcagcttcctcgacgagctgaaagcttgcgtggccagtaacgatattgagggaatcgtttgcctgacagccgcagtccatatcatcttggtgattaacgccggaaaacacaagtcctcgaaggtgagagaggtcgccgcaacagtgcatcgtaagctgaaaacttttatggagattacacttgaggaagattccattgaacgcttcttatatgaatcttcatcccgtaccttgggtgaactgctaaactcctag

SEQ ID NO: 23614 - DNA, 3471 bp, Artificial Sequence
  Description of Artificial Sequence: Synthetic coding sequence
atggagaagcgcgagacctttgtgcaggcagtgtccaaagagctggtaggagaattcctccaatttgtgcagctggataaggaggctagtgacccattctccctgaatgaacttcttgatgagttaagcaggaaacaaaaggaagaactgtggcagcgcctgaaaaacctgttgacagacgtgctgctggagtcaccagtggacggttggcaggtggtagaggcccaaggagaggacaatatggaaacagagcatgggtcaaagatgaggaaatccattgagatcatttacgctatcaccagtgtcatcctggcttccgtgtcggttatcaatgagagcgaaaattacgaggccctcctagagtgtgtgattatcctcaacgggatcctgtacgccttgcctgagtcggagcgaaaattgcagagctccattcaggacctgtgcgtgacttggtgggagaaggggttaccagctaaggaggacacaggtaagaccgctttcgtgatgttgcttaggaggtccctggaaaccaagacgggagcagacgtgtgcaggctgtggcgaatccaccaagcattgtattgctttgactacgatttggaggagtctggggaaatcaaagatatgcttctggagtgcttcattaacattaattatatcaaaaaagaagagggacgcaggtttcttagctgtctatttaactggaacattaactttataaagatgatccacgggacaataaaaaaccagcttcaaggcttgcagaagagcctgatggtgtacatcgcagagatctatttccgagcatggaaaaaagcaagtgggaagatcctagaggccattgagaatgattgtatccaagacttcatgtttcacgggatccacttaccccgtcgaagtccagttcattcgaaagtgcgagaggtattgtcctattttcatcaccagaagaaggtgcgccagggcgtcgaagaaatgctttatcggctgtacaagcccattctgtggagggggctcaaagcccgtaactcggaggtgagaagcaacgccgcactgctattcgtcgaagcttttcccatccgggatcccaacttacatgccatcgagatggacagtgagatccaaaagcagtttgaagaactctattccctgttggaggacccttatcccatggtgcggagcacaggcatcctgggcgtttgcaagattacttccaaatactgggaaatgatgcctcccacaattctaatagatctactgaagaaggtgactggggagttagcttttgacaccagtagtgcagatgtgagatgtagcgtgtttaaatgcctgccgatgatcctggacaacaagctgagccacccacttttagagcagttgctgcccgctctccgttattccctgcacgataatagcgagaaagtacgtgttgcgttcgtcgatatgctactcaaaatcaaggccgtgcgggctgccaaattctggaagatctgcccaatggaacacatcttggtgcggctggagaccgatagcaggcctgttagtcgtcggctggtttcactaattttcaatagcttccttcccgtgaaccagcctgaggaggtctggtgcgaacgctgcgttactcttgtgcaaatgaatcatgcagcagccagaagattctaccagtatgcgcacgagcacaccgcctgtactaatatcgccaagttgatacacgtcattcgccattgcttgaacgcctgtattcagcgtgccgttagagaaccccctgaggacgaggaagaggaagatgggagagaaaaggaaaatgtcaccgtgttggacaaaaccctgagcgtcaacgatgtcgcttgcatggcaggacttctggaaattatcgtaattctgtggaaatccatcgaccgaagcatggaaaataacaaagaggcgaagctctatacaattaacaagtttgcaagtgtgcttccggagtacctcaaagtgtttaaggacgaccgatgtaaaatccctctgtttatgttaatgtctttcatgcctgctagtgcggttcctccattctcatgtggagttatttcaaccttgagatctagagaggaaggtgcagtagataaaagttactgtaccctgctagattgcctgtgtagttgggggcaggtcggccatatcttggaactggtggacaactggcttcccactgagcacgcccaggcaaagtcgaacaccgccagtaaaggacgcgtgcagattcacgacacaagacccgtaaaaccggaactggccctggtgtacatcgagtacctgctgactcatcccaaaaatagagagtgcctgcttagcgctccaagaaagaagctaaaccaccttctgaaggctttagagacatcaaaggccgatttagaatccctgctgcaaacccctggcggtaagccgagaggcttttccgaagccgcagcccctcgcgcatttggacttcactgccggctgtctatccacctccagcataagttctgctcagaggggaaggtgtacctgagcatgctggaagacacggggttctggctggaaagtaaaattcttagctttattcaggaccaggaggaagattatttgaagctccatcgggtgatttaccaacagataattcagacatatcttaccgtgtgtaaggacgtggtgatggtcggcctgggtgatcaccaatttcaaatgcagctgctccagcgatctctgggaattatgcaaacagtcaagggatttttctatgtttccctactcctcgatattttgaaggagattacaggatcatccctgatacaaaagaccgacagcgacgaggaggtggccatgctgctggataccgtgcagaaagtattccaaaagatgcttgagtgcattgcaaggtcattcagaaaacaacctgaagagggcctgcggctgttgtattctgttcagaggcccctgcatgagtttatcactgctgtacagtctagacacacagatactcctgttcatcgaggcgttctatccacgctgattgcgggtccggtggtcgaaatctcacaccagctcagaaaggtgtccgatgtggaggaactcacgcccccagagcacttgtccgatctgcctcccttctcccggtgcttgattggcattatcattaagtcttccaatgttgttagatccttcctggatgaactcaaggcctgcgtggcatcaaatgatatcgaggggattgtctgtctgactgctgctgtgcacattatattggtcattaatgccggaaaacataaatccagtaaggtcagggaggtggctgctacagtgcatagaaagctgaagacctttatggaaattacattggaggaggacagtattgaacgctacgaagacctcctatgctgcccgggatgggcactgacacctggattattggactctatctatccttccgccagcgtcccaattggttag

SEQ ID NO: 23615 - DNA, 3432 bp, Artificial Sequence
  Description of Artificial Sequence: Synthetic coding sequence
atggaaaagcgagagacctttgtgcaggcagtcagcaaggaactcgtgggcgagttcctgcagtttgtgcagctggataaggaggcgtcagaccccttcagcctgaacgagctgttggatgaattaagtcggaagcaaaaggaggagctctggcagagactgaaaaatctgctgacagatgtgctcctggagtcaccagtggatggctggcaggttgtggaggcacagggtgaagataatatggaaaccgagcacggatcaaaaatgcgtaaatcaatcgagataatttacgctatcaccagcgtgatccttgcttccgttagcgttatcaacgagtctgagaattacgaagctctgcttgagtgcgtgataatattaaacgggattttgtatgcacttcctgagtccgaacggaaattacagagcagcatacaggatctctgcgtcacatggtgggaaaaaggccttccagctaaggaggatactggcaagactgccttcgttatgttactacggaggtccctggagacaaagacaggggcagatgtgtgcaggttgtggagaatccatcaagccctatattgtttcgattatgatctggaagaaagcggcgagattaaagacatgctgctggagtgcttcatcaacataaattacattaagaaagaggaggggcgaagatttctttcctgtttgtttaactggaacattaactttatcaaaatgatccatgggactattaagaatcagctgcagggccttcagaagtccttgatggtatatatcgctgagatttacttcagagcctggaagaaggctagtggaaagattctggaggccatcgagaacgactgcatccaagatttcatgttccacggaatccacctgccccgacgtagtcccgttcatagtaaagtgagggaggttttgagctactttcatcaccagaagaaggtgcgccagggcgttgaggaaatgctttatagactgtacaaacccatcctgtggcgcggacttaaggcgcgtaattcagaggtgcggtctaatgcagctctgctttttgtggaagcctttccaatccgggacccaaacttgcatgctatcgagatggattcagagattcagaagcaatttgaggagctttacagcttactggaagacccatacccaatggttaggagcactggtattctgggtgtctgtaagattacttctaagtattgggagatgatgccgccaactatcctgatagaccttctgaaaaaagttaccggcgagcttgcctttgatacctcttccgccgacgtgcgttgtagtgtctttaaatgtctcccgatgatccttgataacaaactaagccaccccttgctggagcagctcctccccgctctccggtatagccttcacgacaacagcgaaaaggtgagagtggcatttgtggacatgctcctaaaaatcaaggccgtacgggctgctaaattttggaaaatatgcccaatggaacacatcttagtacgtctcgaaacggactctcggcctgtctcaagacggctggtttcgttaatcttcaacagctttcttcccgtgaaccagccagaagaagtgtggtgcgaaaggtgtgtgaccttagtgcagatgaatcacgctgccgcaaggcggttttaccaatacgcccacgagcacacggcctgtaccaacatagccaagctcatccacgtcatccggcattgtctcaatgcatgtatacagagagcagtgcgggaaccgcctgaggacgaggaagaagaggatggacgagagaaagagaatgtgacagtcttagacaagacattatcggttaacgacgtggcatgtatggcgggtctgctggagattattgtgattctgtggaaaagtatagacaggtccatggagaacaataaggaagctaagctatacacaataaacaaattcgctagtgtcctgccagagtacctaaaggtttttaaggacgaccgctgtaagatccctctctttatgctgatgagttttatgccagccagtgctgtgccccctttcagctgcggcgtgatctccacccttcgctctcgggaggaaggcgcagtcgataaatcttattgcacattacttgactgtctctgctcctgggggcaggtcggtcatatcctcgagctagtcgataattggctgcccacagagcacgcccaagcgaagtcgaataccgcttcgaaggggcgtgtacaaatacacgatactcgcccagtgaagcctgagttggcgttggtgtatatcgagtacctcttaacacatccgaaaaatcgggaatgtctcctctccgcaccccgaaaaaagctgaatcacctcctgaaggccctggagacctccaaggcggacctagagagtctgctacagaccccaggagggaaacctcgcggattttcagaggcggctgctcctagggccttcggtctccactgcagactgagtattcatctgcaacataagttctgtagcgaaggaaaggtgtacctcagcatgctcgaggacaccggtttttggttagaatcaaagatcctctccttcatccaggatcaggaagaggactatcttaaactgcaccgcgttatctaccagcaaattattcaaacctatctcaccgtgtgtaaggatgtcgtcatggtgggcctgggagatcaccagtttcaaatgcaactgttacagaggtccctgggcatcatgcaaacagtgaagggatttttctacgtctccctgctgctggatattctgaaggaaatcactggatcctcccttatccagaagaccgattccgatgaggaagtagccatgctgctggacacggtccagaaagtgttccagaaaatgctggaatgtattgctaggtcctttagaaagcagccagaggaaggcctaagacttctgtattcagtgcagaggcccctgcatgaatttatcacagccgttcaaagccgacacacagatacccccgttcatcggggtgttctcagcacactgatagcgggtccagtagtagaaattagccaccaacttcgcaaagtgagtgatgttgaggagctgacgcctccggagcatttgagcgacttgcccccatttagcaggtgtctcattggcatcatcattaagtcatcaaacgtagtcaggtcatttctggatgagcttaaggcgtgcgtcgcctccaacgacattgaggggatagtctgtctgacagcagctgttcatataatcctcgtgataaatgccggtaaacacaagagttccaaggtgagagaagtggccgctaccgtgcatcgcaagctgaaaactttcatggagattactctggaagaggattccatcgagcgcttcctatatgaatcatcaagccgcaccctgggcgagctgttgaatagctag

SEQ ID NO: 23616 - DNA, 2697 bp, Artificial Sequence
  Description of Artificial Sequence: Synthetic coding sequence
tgactggaggaatccggtgagattaaggatatgctgctagagtgcttcatcaacatcaactatattaagaaggaggagggtcgtcggttcctctcgtgtctattcaattggaatatcaactttattaagatgatccacggcacaataaagaatcagttacagggtcttcaaaaaagcctgatggtgtacattgcagagatttattttcgggcatggaagaaagcttctggtaaaatcctggaggccattgaaaatgattgtattcaggacttcatgttccacggaatccacctgccaagacgctcacccgttcactctaaagttcgggaggtgctctcttattttcatcatcaaaagaaggtgaggcagggcgtcgaggagatgctgtacaggttatataagcctatcctgtggcgcggactgaaggcccgtaattctgaggtgcgatcaaatgcggctctcttattcgtggaggcatttcccatccgggaccctaaccttcacgcgatcgaaatggatagtgagatccaaaagcagttcgaggagctgtacagtctattggaggacccgtaccccatggtgcgctcgaccggcatcctgggtgtttgtaagatcactagtaagtactgggagatgatgccgcctaccatccttatcgacttgttgaaaaaagtcacgggcgagctcgcgttcgacacctcttcagctgatgtgaggtgttccgtgtttaaatgcctgccgatgattctggacaataagttgagccatccactgctggaacagctcctgcctgctctgcggtacagtctccacgataattcggaaaaggtcagggtcgcattcgttgacatgctgctcaagattaaggcggtgcgagccgcaaagttttggaagatctgccctatggagcacattcttgtgcggctcgaaaccgattcaaggccggtgtcccgacgtctggtctccctcattttcaactccttcctgccagtcaatcagccagaggaagtgtggtgcgagcggtgtgttacacttgtgcagatgaaccatgcagcggctaggagattctaccagtatgcccacgaacacaccgcctgcacgaacatagccaagctaatacacgttattcgccactgcctcaacgcatgcatccagcgcgctgtgcgggagccccctgaagacgaagaagaggaggatggccgagaaaaggagaatgtgactgtgctggacaaaactctctctgtgaatgatgtcgcatgcatggccggactgttagaaataattgtgatcctctggaaatcaatcgaccgatctatggagaataacaaagaggcaaagctttacaccatcaacaaatttgcttccgtgctgcctgagtacctgaaagtgtttaaggatgacagatgcaaaatccccctctttatgcttatgtccttcatgccagcatcagccgttccgccattctcctgcggggtaatcagcacgctgcgcagccgggaggaaggcgctgtagacaagagctactgtacccttctagattgcctctgttcttggggtcaggtgggccatatcctggagttagtggacaactggttgcctaccgaacacgcccaggcaaaaagcaacacagcatcaaagggcagagtgcaaatacatgatacacgcccagttaagccagaactggccctggtgtatatagaatacctgctcacccaccccaagaacagggagtgtctactatccgctcctaggaagaaattaaatcatttgcttaaagccttagagacatctaaggctgatttggagagcttgctgcagacccctggtggcaagcctcggggtttttccgaggctgctgcgcctcgagccttcggcctacattgcagactgtctatccatctacaacacaagttctgttccgaggggaaggtgtatcttagtatgctggaagataccggcttttggctggaaagcaagatcctgtcttttattcaggaccaggaagaggattatctcaagctgcacagagtgatctaccaacaaatcatccagacatacctgactgtgtgtaaagatgtggtcatggtgggcttgggtgaccaccaattccaaatgcagcttcttcagagatcactgggcatcatgcagactgtgaaggggttcttctatgtctctctgctacttgatatattgaaagaaataacaggaagcagtttgatacagaagactgactcggatgaagaggtggccatgttattggatacagtccagaaagtctttcaaaaaatgctggagtgtattgcccgatcatttaggaaacagcctgaggagggactgcgggtttctgatgtggaggagctcactccacctgagcacctttcagatttacccccattttcccgctgcctaatcggcataattattaagtcaagcaatgtcgtaaggagctttctggatgaactgaaagcctgcgttgcctctaacgacatagaggggatcgtgtgtcttacagcagctgtgcacatcatactagtcatcaacgctggtaagcataagagctccaaggttcgagaggttgccgctaccgtacaccgtaaacttaaaacattcatggagataactctcgaggaggactcgattgaaaggtttctatacgaatcaagctctcgaacactcggggaactgctcaatagctag

SEQ ID NO: 23617 - DNA, 3471 bp, Artificial Sequence
  Description of Artificial Sequence: Synthetic coding sequence
atggagaagcgcgaaacattcgtgcaggctgtgagcaaagagctggtgggagaatttctccagttcgtacagcttgataaggaggcctccgatccatttagccttaacgaactgctggacgagctgtcaaggaagcagaaggaagaactgtggcagagactgaagaatctgctcactgacgtgctgcttgagagtcccgtggacggatggcaagtcgtcgaggcccagggtgaggataacatggagacagagcatggaagcaaaatgaggaagtccatagagattatttacgctataacctcggttattttggccagtgtcagcgtaatcaacgagagcgagaattatgaggccctgctggaatgtgttatcatcctaaacggcatcctctacgccctccccgaaagcgaacgcaaactgcagtcctcgattcaagacctgtgtgtcacctggtgggaaaaaggcctacccgctaaagaagacactggaaagactgccttcgtgatgctgctcagacgatcactggagacgaagactggagccgatgtttgtcgactctggcgcatccaccaggccctgtactgcttcgactatgacctggaagaatcaggagaaatcaaagatatgctcctcgagtgttttattaatatcaattatattaaaaaggaggagggcagacgcttcctgtcatgtctgttcaactggaatataaattttataaagatgatccatgggactataaaaaaccagctgcaaggactccaaaagtctttgatggtgtacattgcagaaatctactttcgcgcttggaagaaggcgtcaggaaagatcctagaagctatcgaaaatgactgcattcaagacttcatgtttcacgggattcatcttccgaggcgcagccctgtgcattcaaaggtccgagaggtgcttagctactttcaccaccagaagaaggtgcgacagggggtcgaggagatgctctataggttgtacaaacccattctctggcgcggattaaaggctcgtaactctgaagtgagatccaatgctgccctgttgttcgtcgaagccttccctattagagacccgaatcttcacgctatcgagatggatagcgaaattcagaagcagtttgaggagttgtattctttgctggaggatccttatccgatggtgcggagtacggggatcctgggcgtgtgcaaaatcacatccaagtattgggagatgatgccgccaaccattctaattgacctgctgaagaaggttaccggcgagcttgccttcgacaccagctctgccgacgtgagatgctcagtgttcaaatgtctccctatgattctggataacaaactttcccatccgctgctggaacagctgttaccggcactccgttatagcctgcacgataattcggagaaagttcgcgtggcctttgtggatatgctgcttaagatcaaagcagtgcgggcagctaagttttggaaaatctgcccaatggagcatatactggtccgtctcgagactgattcaagacccgtgtcaagacgtctggtcagtttgatatttaattccttcctgccggtcaatcagcccgaggaggtgtggtgcgaacggtgcgtgaccttggtgcaaatgaatcacgctgccgctagacgattctaccaatacgcacacgagcatacagcttgcacaaacatcgccaaattgatccatgtaatacgccactgtctgaacgcgtgtattcaacgcgcagtgcgggaaccccctgaggacgaggaagaagaagacggcagggagaaggaaaatgtgactgttctggataaaaccctcagcgtgaacgatgtcgcctgcatggccggtcttctggagatcatagttatcctctggaaatctatcgacagatctatggagaacaacaaagaggctaagttatacactattaacaagtttgcctccgttttgccggagtacctgaaggtttttaaagacgatagatgcaagatccccctgttcatgctgatgtcatttatgcccgcaagcgcagtgcctccgttttcttgcggggtcatctctaccctgaggagccgggaggaaggtgccgtggacaaaagttattgtacacttctggattgcctctgctcttggggacaagtgggacatattcttgaattggtcgacaattggctgccaactgagcacgcgcaggcaaagagcaatacagccagcaaagggagggtgcagattcatgacacgcgccctgtcaaaccagaactggctctggtgtatatcgaatacctgctcacccacccgaagaaccgggaatgtctcctgagtgctccaaggaagaagttaaaccatctactcaaagcccttgagacaagcaaggccgacctggagagtctgctgcaaacccctgggggaaagcctaggggcttttccgaagcggcagccccaagggccttcgggctgcattgccgcttgtcgatccacctgcagcataagttctgttccgaggggaaggtatacttgtctatgttggaggataccgggttctggctcgaatccaagattctcagtttcattcaagatcaggaagaagattacctcaaattacatcgagtgatttatcagcagataatccagacatatctgactgtgtgcaaggatgtggtgatggtgggccttggggaccaccagtttcagatgcagctcttacaaaggtctttgggtattatgcagactgtcaaaggattcttttacgtttctctcttactagacatcctgaaagagatcactggctcctctttgattcagaaaacagactctgacgaagaggttgcgatgctcctggacaccgtgcagaaagtttttcagaaaatgctcgagtgcattgcccgaagtttccggaagcagcctgaggaggggcttcgcctcttatattcggtgcagcggccactgcacgagtttataacggccgtgcaatcccgccacacagacactccagtgcacagaggagtcctctccaccttgatagccggaccagtggtggagatttcgcatcaactcaggaaggtgtccgatgtcgaggagcttacccccccagaacatctctctgacctccctcctttctcccgctgcttgatagggattattattaagtcgagcaacgtcgtacgttcctttttggacgaattgaaagcgtgcgttgccagtaatgacatcgagggaattgtttgcctgaccgccgctgtgcacattatcttagtgataaacgccggaaaacacaagtcctccaaagtgagagaggtcgccgcaacagtgcatcgcaaattaaaaaccttcatggaaatcaccctggaagaggatagcattgaaaggtatgaagatctcctatgctgccctgggtgggcgctgacacccggattactagacagcatctacccgagcgcgagtgttcctattgggtag

SEQ ID NO: 23618 - DNA, 1794 bp, Artificial Sequence
  Description of Artificial Sequence: Synthetic coding sequence
atggaacacatcctggttcggctagaaacggattcgcgtcctgtttcaagaagactagttagcttaatcttcaattcgttcctgcccgtgaatcagcctgaagaggtgtggtgcgagcgttgtgtcacactggtacagatgaaccacgcagccgctcggagattctatcagtatgcccatgaacacacagcctgtactaacatcgccaagctgattcatgtcatccgtcactgtctgaacgcgtgtattcaacgcgctgttagagaaccacctgaggatgaggaggaggaggacggacgggaaaaggaaaacgtgacagtgctggacaagacgttgagcgttaacgatgtggcctgcatggcgggtttactggagatcatagtaatactctggaaaagcatagatcggtctatggagaacaataaggaggcaaagctttatactataaataagtttgcaagcgtcctacccgagtatcttaaagtctttaaggatgatcgctgcaagatacccctgttcatgttaatgtcgttcatgcccgcatctgccgtccccccattcagctgtggtgtgatctctacactgcgtagtcgcgaagagggcgctgtggacaagtcctattgtacgctgttagattgcttgtgcagctggggtcaggtcgggcacattctcgagctggtggataactggctccccactgaacacgctcaggcgaaaagcaataccgccagcaaagggagagtccagatccacgacacccgccctgtgaagcctgaattggctctggtttatattgagtatctactgactcaccctaaaaaccgagaatgccttcttagcgctccaagaaagaagctgaaccatctgcttaaggctctcgaaacctccaaagctgacttggaatccctgttgcagactcccggaggcaagcctcgcggattcagcgaagcggctgcccctcgcgcatttggcctccattgcagactgtccatccatctgcagcacaagttttgcagcgaaggaaaggtctatctcagtatgctggaggataccggcttttggcttgaatctaaaatactctccttcatacaagatcaggaggaggattatctaaagctgcaccgggtcatttatcagcagatcatccagacttacctgacggtctgcaaggatgttgtcatggtcggactgggagatcaccaatttcaaatgcagcttctgcagcgatcactcggcatcatgcaaacagtgaaagggttcttctatgtgagcctcctgttagacatacttaaggagattacaggctcctctctgatccaaaaaacggactccgacgaggaggtggccatgctgctggataccgtccagaaagtttttcagaaaatgcttgaatgtattgcgaggtcctttcgcaagcagccagaggagggactgagggtgagtgatgtggaggagctgaccccccctgaacacttatctgacctccccccatttagccggtgtctgatagggatcatcattaaaagctcaaacgtcgttcggtcgtttctggacgaacttaaagcgtgcgtagcatcaaacgacatagaggggatagtttgtctgacagctgctgtccacattatcctggtgattaatgccggaaaacataagagtagcaaggttagagaagtggccgcaaccgttcatcgcaagctgaagacgttcatggaaattactctggaggaagactctatagagcgatttctgtacgagagtagtagtaggacacttggcgagttgctcaattcctag

SEQ ID NO: 23619 - DNA, 1716 bp, Artificial Sequence
  Description of Artificial Sequence: Synthetic coding sequence
atggagcatatcctcgtccgcctggagactgacagtaggccagtatcacgaagactggtgagccttatcttcaacagctttctgccagtgaatcagcctgaggaggtatggtgcgaacggtgtgtgacactagtgcaaatgaatcatgccgctgccagacggttctaccagtacgcacacgagcatactgcctgtaccaacatcgcgaagctgattcatgtgatcaggcattgtctaaacgcatgcatccagagagccgtgagggaacctccggaagatgaggaagaggaagacgggagagagaaggagaatgtgacggacgatagatgcaagattcctcttttcatgctcatgtcttttatgccagcatcagcggtgcctccatttagctgcggagttatttccaccctgagatcgcgcgaggagggagctgtggataaaagctattgtaccttactggactgtttgtgctcctggggccaggttggtcacatcctggaactagttgataactggctgccaactgagcacgcacaggccaaatcaaacactgcttcgaagggcagagttcaaatacatgacacccgccctgtgaaacctgagttggccctggtctatattgagtatctcttaacacacccaaagaatcgtgagtgtctgcttagcgcccctagaaaaaaactcaatcatctcctgaaagccctcgagacaagcaaagctgatctggagagcctgttgcagacgcctggagggaagcctcgcggatttagcgaagcagcggctcccagagcgtttggactgcactgccggctgtctattcacctccaacacaagttttgcagcgaaggaaaagtctacctgagcatgctggaagacactgggttctggcttgagagcaagatcctgtcatttattcaggatcaggaggaggactacctaaagcttcatcgggtcatctatcagcagatcatccagacctacctgaccgtgtgtaaggatgttgtgatggtcgggttgggcgatcaccaatttcaaatgcagctgctccaacggtctttaggcatcatgcagactgtaaaagggttcttttacgtgtcactcctactcgacatcctgaaggagataactggatcctctctaatccagaagactgattccgatgaagaggtcgcaatgcttttggacaccgtacaaaaggtgtttcagaagatgctagagtgcatcgcaagaagctttaggaaacaaccagaagaggggctgagacttctctattcagtgcagcggcctctccacgaatttatcacagctgtgcagagccggcacacagatacccccgtccataggggtgtgctgagtaccctgatcgcagggccagtggtggagatcagccatcaacttaggaaagtgagcgacgtcgaggaactaactcctccagaacatctatccgacctcccaccctttagcagatgcctgattggtataatcatcaagtcctcaaacgtagtccgctcattccttgatgagctgaaagcctgcgtggccagtaatgatatagaggggatcgtatgcctaactgcagccgtacatattattctggttattaacgccggtaagcataaaagctctaaagttagggaggtagctgccaccgtgcatcggaagcttaaaaccttcatggaaattacccttgaggaggacagtatcgaacggatttag

SEQ ID NO: 23620 - DNA, 1821 bp, Artificial Sequence
  Description of Artificial Sequence: Synthetic coding sequence
atggaagatgtagaagcccgatttgcgcatttattgcaacccataagggatctcaccaaaaattgggaggttgatgtggcagctcagttgggcgagtatttggaggaacttgatcaaatctgtatttccttcgatgagggtaaaacaactatgaatttcattgaggcggctctgctgattcaggggagcgcatgtgtgtattcgaaaaaggtggaatacctttactccctggtttatcaggccctggattttatatctggcaaaagaagggcgaaacagctgtctagcgtgcaagaggatcgagcaaacggcgtggcctcatctggtgtgcctcaggaggctgagaacgagtttttaagtctggatgacttccccgacagccggacgaacgtcgacctgaaaaacgatcagacacctagcgaagtgttaattatccctctcctacccatggcccttgtggctcccgatgaaatggagaagaataacaacccattatactcccggcagggagaggtgttagccagcagaaaggacttccggatgaatacctgcgtcccccatcctcggggagcattcatgttagagccagagggaatgtcccctatggagcctgccggagtctcccctatgcccggtacccaaaaagacaccggccgtaccgaagagcagcctatggaggtttctgtgtgccgctctcccgttcctgcgcttggattcagtcaggaaccaggcccttctccagagggaccaatgcccctcggtgggggtgaggacgaggacgccgaggaggccgttgagctgcccgaggctagcgccccaaaagccgctctggagccgaaggaaagcagaagcccccaacaatccgctgccttgccaaggcgctacatgctgcgcgagcgcgaaggtgcccctgaacctgcatcctgcgtcaaggagacgcctgacccttggcagtccctggacccttttgacagcctcgaaagtaaacctttcaagaaggggagaccatatagcgtcccgccttgcgtggaggaggccctcggtcaaaagagaaaaagaaaaggagccgctaagctgcaggatttccatcagtggtatctcgctgcttacgcggatcatgccgatagcagaaggctgcgtagaaagggtccctcgttcgcagacatggaggtcctgtactggacgcacgtgaaagaacagttagagactctcaggaagcttcagagacgggaggtggcagagcagtggttgaggccagcggaggaagaccatctggaagactccctcgaggatctgggcgctgcagccgatgatttcctcgagccggaagaatatatggagccagaaggcgctgaccctcgtgaagccgcagatctggatgccgtccccatgtctctgagctatgaggagttagttcgtcggaatgtagaattatttatcgcgacaagccagaagttcgtgcaggaaaccgaactgagccagagaatccgggactgggaggacacagtccagcctctattgcaggagcaggagcagcacgtccccttcgatatccacacctatggggaccagctggtttcccggttcccccagctcaatgaatggtgtccgttcgccgagcttgtggccggacagcccgcttttgaggtctgccgaagcatgttggccagtctgcaactggccaacgactataccgtggaaatcacccaacagcccggattagaaatggcggtggacaccatgagcctgcggctccttacacaccagagagcgcacaaacggtttcagacctacgctgcgccttccatggcacagccctag

SEQ ID NO: 23621 - DNA, 900 bp, Artificial Sequence
  Description of Artificial Sequence: Synthetic coding sequence
atggaggatgttgaagcacggttcgcccacctcctgcagccaatcagagatctcactaagaattgggaagttgacgtggctgctcagctgggagagtatctcgaggagcttgaccagatctgtattagcttcgatgaaggaaagacgaccatgaacttcatagaggccgctcttcttatccagggtagtgcttgtgtatattccaagaaagtggaatacctatattccttggtataccaagctttggactttataagcgggaagaggcgcgcaaagcagctttcaagtgttcaagaagaccgagctaacggcgtggctagcagcggcgtgccccaagaggcagaaaacgagtttctgtcacttgacgacttcccagactcgcggacaaatgtggatttgaagaacgatcaaaccccatctgaggtcttgattatcccgctgttaccaatggctctcgtggctccagatgagatggaaaagaacaacaatccactatatagtcgacagggcgaggtccttgctagcaggaaagactttaggatgaacacatgtgttccccacccccgtggcgcatttatgctggaacctgaaggtatgtcacctatggagcctgctggtgtctcaccaatgcccggtactcagaaagacacaggcaggacagaggaacagcctatggaggtctcagtctgcagatcgccggtcccagcactgggttttagtcaggagcccggtccttcgcccgaaggaccaatgcctctgggaggcggtgaagacgaagatgcggaggaagccgtagagctacctgaggcctcagccccaaaggctgcactcgagcctaaagaatcccggtcaccacagcaagtaggaccaacttggcggcctgcagaacccgagctttag

SEQ ID NO: 23622 - DNA, 1818 bp, Artificial Sequence
  Description of Artificial Sequence: Synthetic coding sequence
atggaggacgttgaggcacgttttgcacacctcctccagccaattcgcgatctgaccaaaaattgggaggtggacgtcgcagcccagctcggagaatatctggaagaacttgatcaaatctgcatttcattcgatgaaggtaagaccacgatgaattttatagaggctgcccttcttatccagggttccgcctgcgtgtattcaaaaaaggtcgagtatctctattcactggtgtaccaggctctggatttcatttctgggaaaagacgggctaagcagcttagtagcgtccaggaggatagggctaatggcgtcgcctctagtggtgtgccccaggaagctgaaaacgagttcctatctctagatgactttcctgattcccgaactaatgtggacctgaagaacgaccaaacaccctcagaagtgctgataatccccctcctgcctatggctctggtggccccagatgaaatggaaaagaataataatcccctgtattctaggcaaggagaagtcctcgccagtcgcaaggattttcggatgaacacctgcgtgcctcatccaaggggcgcatttatgttggaaccagagggcatgagccctatggagcccgctggggtgtctcccatgccagggacccagaaggacactggacggacagaggaacaaccaatggaggtctcagtatgtcgctcaccagtgcccgctctgggattttcacaagagccgggaccgtccccagaggggccaatgcccttgggagggggtgaggatgaggacgccgaggaagctgtggaactgcctgaggcctcagcccctaaggccgcactcgagcctaaggaaagccgaagtccccagcagtcggctgctctccctcgtcggtacatgcttcgagaacgggagggtgccccagagccggcttcatgcgtgaaagagaccccggatccgtggcaatcactcgacccctttgattcgcttgagtccaaaccatttaaaaagggacgcccatattccgtccccccttgcgttgaagaggctctgggccaaaaaagaaagagaaagggggcagcgaagctacaggacttccaccagtggtaccttgctgcctacgctgatcatgcagattcccgcaggctgaggcggaaggggccttcgttcgcagacatggaagtcctttactggacccacgtgaaggaacaattggaaactctccggaagctacaacggagagaagtcgcagagcagtggttacgccctgccgaagaggaccatctggaggatagcctagaggacctgggcgcagccgatgactttctggagccagaagagtacatggagcccgagggcgctgaccctcgagaagccgcagacctcgacgccgtccctatgtcactctcatatgaagagctggtgaggaggaacgttgagctgtttatcgccacctcccagaagttcgtgcaagaaacggaactgtctcagcggatcagagattgggaggacactgtgcagcccctcctccaggaacaagaacagcacgtcccttttgatatccatacatacggcgatcagctcgtgtctaggttccctcaactaaacgagtggtgccccttcgctgagctggtggcaggccaacctgcctttgaggtgtgtaggtcaatgctagcatccctccaattggcaaacgactacactgttgaaataacccagcagcctggtctggaaatggctgtagataccatgagcctgaggctgttgacccaccagcgtgctcacaagcgattccagacatatgctgcaccatccatggcccagccctag

SEQ ID NO: 23623 - DNA, 801 bp, Artificial Sequence
  Description of Artificial Sequence: Synthetic coding sequence
atgcagggctccacaagacggatgggagtgatgacggatgtccaccgacggttcctgcagctgttgatgacccacggagtcctagaggaatgggacgtcaaacggctccagacacattgttacaaggtccatgatcgtaacgctaccgttgataaactggaggatttcattaacaacatcaactctgtgctggagagcctgtatatcgaaattaagcgcggagtgaccgaggacgatggcaggccgatctatgctctagttaatctggcaacgaccagcatctcgaaaatggccaccgactttgccgagaacgagttagatctctttagaaaggccctggagcttatcattgactcagagaccgggtttgctagctcaacaaacatactgaatctggtggatcagttaaaaggtaagaagatgcgcaaaaaggaagcagagcaggtccttcaaaagtttgttcagaataagtggttaatcgagaaggagggtgagtttaccctccacggaagggctatcctagagatggagcaatatatcagagagacctatcccgacgctgttaaaatatgtaacatttgccactcactgcttatacaaggacagagttgcgagacatgtggcattaggatgcatctcccctgcgtcgcaaaatatttccagtccaacgccgagccccgttgccctcactgtaacgactattggccacatgaaatccccaaagtttttgatccagagaaagagcgggaatccggcgtgctcaagtcaaacaagaaatccttgcggtctcggcagcactag

SEQ ID NO: 23624 - DNA, 744 bp, Artificial Sequence
  Description of Artificial Sequence: Synthetic coding sequence
atgcccggtcgcagctccagcaacagtgggagcaccggttttattagcttttccggcgtagagagcgccctctcttccctgaagaattttcaggcttgtattaacagcggcatggacacagcaagttccgtggccctggacttggtagagagccagacagaagtatccagtgaatatagtatggacaaggcaatggtggaattcgctacactcgaccgacagcttaatcattacgtgaaggccgtgcagtctacgattaatcatgtaaaggaggagcgtcccgaaaagatccccgaccttaagctgctggtggagaagaaatttctcgcattgcagagtaaaaattctgacgctgacttccagaacaacgagaaatttgtgcaatttaagcaacagctgaaagagctcaagaagcagtgtggtctacaggcagatcgagaagccgacggtacagaaggggtcgacgaagacatcatcgtgacccaaagccagacgaattttacctgtccaataaccaaggaagagatgaaaaaacctgtgaagaataaggtctgcgggcatacctacgaggaagacgccattgtcagaatgatagaaagccggcaaaaaaggaaaaagaaagcctattgtccacagataggctgcagccatacagacatccgaaagtccgaccttattcaagacgaagcgctacgaagggcaatcgaaaaccacaacaagaagaggcaccgtcattcggaatag

SEQ ID NO: 23625 - DNA, 582 bp, Artificial Sequence
  Description of Artificial Sequence: Synthetic coding sequence
atgcccggaaggtcgagtagcaactccggctctactggattcatctcattcagtggcgtcgagtctgctctcagcagtcttaagaattttcaggcatgtataaactccggaatggacaccgccagctctgtcgcacttgatttagtcgagagccaaacagaggtttcctctgagtactcaatggacaaagcaatggtcgaattcgctactcttgaccggcagctcaaccattacgtcaaggccgtccagagtacaattaaccatgttaaagaagagcggccagagaaaatcccagatctcaaactccttgttgaaaagaaatttctggcactgcagtcaaaaaacagtgacgctgattttcagaacaatgaaaagttcgtccagttcaaacaacaattgaaagaactgaagaaacaatgcggcttgcaggcggatcgggaggcagacggtactgagggcgtggacgaagacataatcgtgacccagagtcagactaattttacttgcccaattaccaaagaagaaatgaagaaaccagtaaagaacaaagtgtgtggccacacttatgaagaagacgcgtag

SEQ ID NO: 23626 - DNA, 138 bp, Artificial Sequence
  Description of Artificial Sequence: Synthetic coding sequence
atgccaggcaggtcaagctccaactctggaagtaccggtttcatcagctttagcggggtggagagtgctctgagctcgctgaaaaattttcaggcctgtatcaactcaggtatggacactgcctcaagcgtcgcctag

SEQ ID NO: 23627 - DNA, 744 bp, Artificial Sequence
  Description of Artificial Sequence: Synthetic coding sequence
atgccaggaagaagtagctcgaatagcgggtcaacggggttcattagcttttccggcgtggagtcggccctaagcagtttgaagaactttcaagcctgcataaatagtggcatggacaccgcatccagtgtggccctggacctcgtggagtcacagacagaggtgtcctccgaatactcgatggataaagctatggtggaatttgccacgctggatcggcagttaaatcattacgtgaaggccgttcagagcactattaatcatgttaaagaagagcggccagagaagattccagatttgaagcttcttgtcgaaaagaaattcctcgcgcttcagagcaaaaatagtgacgcggattttcagaataatgagaaattcgtccagttcaagcaacaattgaaggagctgaaaaagcagtgcggactgcaggcagacagagaggcagacggcactgagggggtagacgaggacatcatagtcacacagtcccagacgaattttacttgtcctataactaaggaagaaatgaaaaaacctgtcaagaacaaggtgtgcggacatacatacgaagaggacgccatagttcggatgatcgagtcccggcagaagcgaaagaagaaagcatattgccctcagattgggtgctcccatacagacattagaaaatcggatctgatccaggacgaggccctacgcagagccattgagaaccacaataaaaagcgccaccgtcactccgagtag

SEQ ID NO: 23628 - DNA, 420 bp, Artificial Sequence
  Description of Artificial Sequence: Synthetic coding sequence
atgcccggaaggagtagctccaactctggcagtactgggtttatcagcttttcaggggttgagagcgccctcagctcccttaagaatttccaggcctgtattaattctggaatggataccgcatcatctgtggccctggacttggtcgagagtcagactgaagtgtccagcgagtatagcatggataaggcaatggttgagtttgccaccctggaccggcagctgaatcactacgtgaaagctgttcagagcactataaatcacgtcaaggaggagcgcccagaaaaaattccggacttaaaattactggttgagaaaaaatttctcgctctccagtcaaaaaattctgacgctgattttcagaataatgaaaagtttgttcaattcaagcagcaactgaaggagctgaagaaacagtag

SEQ ID NO: 23629 - DNA, 705 bp, Artificial Sequence
  Description of Artificial Sequence: Synthetic coding sequence
atgctggacggacgacaacgcaggggctcaaatgctcctacaagcgacatgccgggaactacgctcaaccgctatggccgaacttggcctaggtggggctggctttggaccccgacgggcggtgctctgcggaaacggaaagtcaaagccatggaagttgatatcgaggagcgcccaaaggagctagtgcggaagccttatgtgctgaacgaccttgaagcagaggcgtcactgcccgagaaaaaaggtaataccctcagccgagatctgatagactatgtccgctatatggtggaaaatcacggcgaagattacaaggccatggccgtgatgcgaaggatcaccatcaaaatcccacagaacagatttggtgttcgaagtacgtccattaacgctttcacacagcaaagcggaaaaacttccagcatcctatgccgccgtggcagatggcgatggtccgattggttcacctctcagctacctcaggcagaagcttccccgggtcccgtcaagcttgagcctggctgtaaagccaggagatgctgcgtagcaccagaagagttggcacggtcccacgggatcaggagactccacgtgcacactccacgcagtggcgaggggaccgtgctgcggggatccaacttgtacagctctggcggaagccgtaagtctcagaacttattattctccggctgggttatgtag

SEQ ID NO: 23630 - DNA, 537 bp, Artificial Sequence
  Description of Artificial Sequence: Synthetic coding sequence
atgcctaaggccaagggaaagacgcggcgtcagaagtttggctactccgtgaacagaaagagactcaataggaatgccagaaggaaggccgcacccagaatagaatgcagccatattcggcacgcctgggatcacgctaagtccgtcaggcaaaatttagccgagatgggcttagcagtggaccctaatcgtgcagtccctctccgaaaaaggaaggtgaaggccatggaagttgacattgaggaacgacccaaggagctcgttcggaagccgtatgtcctgaatgacctggaggccgaagcctcactccccgaaaaaaaaggaaacaccctgtccagagatctaatcgattacgtgcgttacatggtggagaatcacggcgaagactacaaggccatggccagagacgagaagaattactaccaggacactcctaagcagataaggagcaagattaacgtgtacaagcggttctatcctgctgagtggcaggacttccttgactctcttcagaagcgaaaaatggaggtggaatag

SEQ ID NO: 23631 - DNA, 696 bp, Artificial Sequence
  Description of Artificial Sequence: Synthetic coding sequence
atgcctaaggccaaggggaaaactaggcgccagaaatttgggtactctgtaaatcgaaagaggctgaatcgtaacgcgaggagaaaagcagcgccaaggattgagtgcagccacattcgccatgcttgggaccatgctaagtcagtcagacagaaccttgctgaaatgggtttggctgtggacccaaatagagctgtgcctttacggaagaggaaagtaaaggccatggaagtcgacattgaggaacgacctaaagagttggtccgaaaaccttacgtgctaaacgacctggaagccgaagcgagtctcccagagaaaaagggcaacacactgtctcgagacctgatcgattacgtgcgctacatggtcgagaaccatggagaggactataagcaatcagggaagacaagctctatcttgtgtcgcagaggaagatggcgttggtccgattggtttaccagtcaattgcctcaggctgaggcttcaccaggtcctgtgaagttagagccaggctgtaaggcaaggaggtgttgtgtggctcccgaagaactggccaggagtcatggaatcagaaggctacaccacgtacatacaccgagatctggcgaaggaaccgtgttacggggaagtaatctctactccagcggtggaagccggaaatcccagaacctgctttttagcggctgggttatgtag

SEQ ID NO: 23632 - DNA, 711 bp, Artificial Sequence
  Description of Artificial Sequence: Synthetic coding sequence
atgcctaaggctaaaggaaagacccgcagacagaagttcggatattcagtaaaccggaagcgcctgaacagaaatgcacggagaaaggccgctcccagaattgagtgttcacacattcggcacgcctgggatcatgctaagagtgtgcgccaaaatttagccgaaatgggattagctgtggatcctaatagggcagtgcccctaaggaagcggaaagtgaaagcaatggaagtggacatcgaggaacgccctaaagagctggtcagaaagccttatgtactgaacgatcttgaagcggaggcaagtctccctgaaaagaagggaaacacgcttagccgggaccttatcgactacgtccgatacatggttgagaaccatggcgaagactacaagtccggcaaaacctcctccatcctgtgtcgccgaggtaggtggaggtggtcggattggttcacaagccagctgccacaggctgaggcatccccgggacctgttaaactcgaacctggctgtaaagccaggagatgctgtgtggcccctgaggagctggccaggagccacggtattcgcagactacacactagggctcattcccccctctggggaaggaactgctcccaaaggcttcagttcatttttatctggggtttcactgagaagcccgagcccgcagtgttcagggtgggagacgtgaatattgtgtgtacctag

SEQ ID NO: 23633 - DNA, 2439 bp, Artificial Sequence
  Description of Artificial Sequence: Synthetic coding sequence
atggggaggaagctggatccaacgaaggagaaaaggggacctggccgaaaggcgaggaagcagaagggggctgagactgagctggtgcgctttctcccagccgtgagtgacgaaaactcaaaacgcctatcaagcagagccaggaagagggcagccaagcgacgcctgggctccgtggaggcacccaaaactaataagagcccagaagccaaacctctcccgggtaagctccccaaaggaatatccgccggagccgttcagactgcaggaaagaaaggtccccagtcactgttcaatgcacctaggggcaagaagagacccgctcctgggagtgacgaagaagaggaggaagaggacagtgaagaggacggaatggtgaaccatggagatctgtgggggtcagaagacgacgcagacaccgtcgacgactatggggcagacagtaacagcgaggacgaagaggagggcgaggccctcctccccattgaacgagccgcacgtaagcagaaagcacgggaggcagcagccggtatccagtggtcagaggaggaaactgaggatgaagaggaagagaaggaggtcactcccgagagcggaccgccaaaggttgaagaagctgatggcggtctgcagattaacgtggacgaggagcctttcgtcctgccaccagccggagaaatggaacaagacgcacaggcgccagatctgcagcgcgtccataagagaattcaagatatcgtcggaatactgcgggactttggtgcacagagggaggagggcaggtctcggagcgagtatttgaatagactgaagaaagacctggctatttactactcttatggtgatttcctgctcgggaaattaatggacctgttcccacttagcgagctggtggagttcctggaggcaaacgaagtgccacggcctgtgaccctgcgtacaaatacactgaaaacacggagaagagaccttgctcaggctttgatcaacaggggcgtgaacctggatcctttgggcaaatggagcaagacagggctcgtagtgtacgatagcagtgtccccatcggtgcaaccccagagtatctggccggacactatatgcttcagggtgctagctccatgctccctgtgatggcccttgcccctcaggaacacgagcgcatccttgatatgtgttgtgccccaggcggaaagactagctatatggcgcagctcatgaagaatactggagtgattttagcaaacgatgcaaacgcggagaggctcaaatctgtggtcggcaatctccacaggctgggcgttacgaacactatcatcagtcattatgacggcagacaattccccaaagttgtcggcggttttgatagagtattgttggacgctccctgcagtgggactggagttatcagcaaagatccggcagtgaagactaacaaagacgagaaggatattttgcgatgcgctcatctgcagaaggaactgttgcttagcgcgatcgattcagtcaacgctacttccaaaactggcggatacttggtgtattgcacctgctctatcacagtggaggaaaatgaatgggtggtggactatgcccttaagaaaagaaacgtacgccttgtcccaactgggctggatttcgggcaagagggctttacacggtttagggaacggcgattccatccttcactgagatccactaggcggttctatccccacacacacaatatggacgggttctttattgccaagttcaaaaagttcagtaattcgataccacagtcacagactggaaattctgagaccgccaccccaactaatgtggacctccctcaggtgattcccaagtccgagaactcatcacaacccgctaaaaaggcaaagggagctgccaaaactaaacagcaactgcagaagcagcagcaccctaaaaaagcctcattccagaaactcaatggaatttctaagggggcagacagcgagttgagtaccgttcctagcgttaccaaaacacaggcgtcctcgtcattccaagacagctcacagccagctgggaaggctgaaggaattcgcgaaccaaaagttactggtaagttaaagcagaggagccccaagctgcagtcttccaaaaaggtagcatttttgaggcagaatgccccacccaaagggactgatactcaaacgcccgctgtgctgtctccttctaagacacaagctacactgaaacccaaagatcatcatcaacccctggggcgagctaaaggtgtggaaaagcagcagttaccagaacaaccttttgagaaagccgcattccagaaacagaatgatacaccaaaggggccacagccccctaccgtatcgcccatccggagcagcaggccgcctcccgctaagagaaaaaagtcacaatcccggggaaatagtcagctgctcctttcatag

SEQ ID NO: 23634 - DNA, 2427 bp, Artificial Sequence
  Description of Artificial Sequence: Synthetic coding sequence
atgggtaggaaattggatcctacgaaggaaaaaaggggacccggacgaaaagcacgtaagcaaaagggcgcagaaacagaacttgtgagattccttcccgcagtgagcgacgagaattccaaaagattgagctccagggctcgaaagcgggcagctaagcggcgattggggtctgtggaggcacccaagacgaataaatccccggaggctaagccattacccggaaagctgccgaaaggagctgtgcagacagctggaaagaagggacctcagagtctgttcaacgccccacggggtaagaagcgccctgctcccggtagcgatgaggaagaggaagaagaggactctgaggaggacggcatggtgaaccacggtgacctgtggggctcagaagacgatgctgacaccgtagacgattacggtgctgattccaactccgaggacgaggaggaaggtgaggcgctgctgcccatagaaagggcagcgagaaagcagaaggccagagaggctgccgctggaatccaatggtcggaggaggagacagaagacgaagaggaagagaaggaggtgacccccgagtcagggccacctaaagttgaagaggctgacggcggactgcagatcaacgtggatgaagaacctttcgtccttccccctgcaggagagatggagcaggatgctcaggcaccggacttgcagagggttcacaaacggatacaggacatcgtgggcatcctgcgcgactttggcgctcagagagaggaaggcagatcgagatcagaatatctgaaccgcctgaagaaagacctggctatttattatagctacggcgactttttactcggcaagctgatggatctttttccactttcagagttggttgagttccttgaggccaatgaggttccacggcctgtaaccttgagaactaacaccttgaagacacgccgacgggatttggcccaagctcttataaacagaggtgtgaacctggaccctttggggaagtggagtaagaccggcctagtggtctatgattcttctgtgcccatcggggctactccggagtatttagcgggacactatatgttgcagggcgcatcctcaatgcttcccgtgatggcactcgcaccacaggagcacgagcgtatcctggacatgtgttgtgctccagggggaaaaacctcgtacatggctcagttgatgaagaacaccggcgtcatactggcaaatgatgccaatgcagaaaggctcaagtcggtcgtgggtaacctgcaccgccttggggtcacaaatacaatcatttctcactacgatggccgacagtttccaaaagttgttgggggtttcgacagagtgctcctggatgcaccctgtagcggcacgggggttatctcaaaggaccctgctgtgaaaactaataaggacgaaaaggatatcttgagatgcgcccatttgcaaaaggaactgttgctgtcggctatcgacagtgtgaacgctacatccaaaacaggtggctacctggtgtactgtacctgctcaatcaccgtggaggagaatgaatgggtggttgactatgccctgaagaagaggaacgtccggttggtgccgaccggtctggacttcggtcaagaaggcttcactcgcttcagagagaggaggttccaccctagcctaagatctacacgcagattctatcctcacacccacaacatggatggcttctttatcgcaaagttcaaaaaattcagtaactctatcccccagagccagacaggtaattctgagactgccacccccacaaacgtcgacctcccccaggttatccctaaaagcgagaattccagccagcccgctaagaaagcaaagggcgctgctaagacaaaacagcaactccagaaacagcaacatcccaagaaggcctcctttcagaaactgaatggaatttccaagggggctgacagtgaactgagcaccgtaccctctgtgactaagacccaggcttccagttcctttcaggattcatctcagccagcaggcaaggctgagggcatccgggagcctaaagtgactgggaaattgaaacagcgctcaccgaaattacagtcgtctaagaaggtcgctttcctgcgtcagaatgcccctcctaagggaacagatacgcagactcctgcggttttgagtccctccaagacgcaggcaaccttgaagccaaaggatcaccaccaaccgctgggcagggccaagggagtggaaaagcaacagttgcccgagcagccttttgaaaaagctgctttccagaagcaaaatgacactcctaagggtcctcaaccccctactgttagccctattcgatcatctcggccaccgccagccaaaaggaaaaagagtcagtccagagggaattctcagctcttactgtcttag

SEQ ID NO: 23635 - DNA, 2439 bp, Artificial Sequence
  Description of Artificial Sequence: Synthetic coding sequence
atgggccgtaagttagacccaactaaggaaaaacgaggcccaggccgtaaggccaggaaacaaaagggggctgagacagagctggttaggttcttgcccgcagtatcggacgagaactcaaagcgtctgtcctcccgggctagaaagcgggctgctaaacggcgactcggctctgtcgaggctccaaaaaccaacaagtctccagaagcgaagccactcccaggaaaattgcccaagggcatctccgccggagccgtccagacggctgggaagaaaggcccacagtctttattcaatgctcccagagggaaaaaaagaccagcccctggtagtgatgaagaggaagaggaagaggactctgaggaggatggaatggtgaaccacggcgacttatggggcagtgaagatgacgccgacaccgtggatgactatggcgcagatagcaattctgaagacgaggaagagggagaagccctactgccgatcgaaagggcggcaaggaagcaaaaagctcgcgaggcggctgctggaatacagtggtctgaggaggagactgaggacgaagaagaggagaaggaagttactcccgaatctggcccacccaaggtcgaggaggccgatggcggactgcagattaatgtggacgaagaacctttcgttttaccccctgctggcgagatggaacaggacgcccaggccccagacctgcagcgtgttcataagcgtattcaggatattgtgggaatcttgagagatttcggcgctcagcgtgaagagggcagaagtaggtccgagtacttgaatcgtctcaagaaagacctagctatctactactcttacggggacttcctactcggtaagttgatggatctcttccccctgagcgaactggtggagttcttagaggctaacgaagtgccccgtcccgttacacttagaacaaataccctaaaaactagacgcagggatctggcacaggctttaatcaataggggcgtcaatttggacccccttggtaagtggagtaaaactggcctcgtggtctacgactcaagcgtccctatcggtgccaccccagagtatttagctggacattacatgctgcagggggcttccagcatgctacccgttatggcattggcgcctcaagagcacgagcgcatacttgatatgtgctgcgcacctggcggaaaaacctcatatatggcacagctgatgaagaatacaggcgtaatattggctaacgacgccaacgctgaacgacttaagtcagtggttgggaatctgcaccgccttggggtcactaataccattatttctcactacgacggtagacagtttcccaaggtggtcggcggatttgatcgcgttcttcttgacgctccatgttcagggacaggcgtcatatctaaagatccagcggtgaagactaacaaagatgaaaaagacatcctgcggtgcgcacatctgcagaaggagctcctcctgtccgctatagacagtgtgaatgctacaagcaaaaccggtgggtatctggtatattgcacctgctcaatcacagtggaagagaacgagtgggttgtcgactatgccctcaaaaagcgcaacgtacgcctcgtgccaaccggcctggacttcggacaggaaggatttactaggttccgcgaacggagatttcacccttccttgcgctccacgcgacggttctaccctcacactcacaatatggatggctttttcattgcaaagttcaaaaagttcagtaactccattccacagtcacagacaggcaactcagaaacagctacaccaaccaatgtggatctcccacaagttatcccaaagtccgagaacagtagccagcctgccaaaaaggccaagggggcagcaaagaccaagcagcagttacagaaacaacagcaccctaagaaggctagtttccagaagctgaatggaattagcaaaggcgctgacagcgagctcagcaccgtcccgagtgtgaccaagacacaagcatcgtcctccttccaagactccagccagcctgcgggtaaggctgagggcattcgcgagcctaaggtgaccggcaaattgaagcagaggtctcctaagctgcagagcagcaagaaggtcgcgtttttacgacaaaacgccccaccgaaagggaccgacactcagacgccagccgtgctgtcacctagtaaaacccaggccactcttaaacccaaagaccaccatcagcctctgggccgtgcaaaaggagtcgagaaacagcagcttcccgaacagccctttgaaaaggcagcatttcaaaaacaaaatgacacccctaaaggccctcaacctcctaccgtgtcccctatcaggtctagcaggcccccacccgctaagcgtaagaagtcacagagcagaggaaactcgcaactgctgttatcttag

SEQ ID NO: 23636 - DNA, 2427 bp, Artificial Sequence
  Description of Artificial Sequence: Synthetic coding sequence
atgggacgaaaactggatcctacgaaggagaaacggggtccagggaggaaagccaggaaacagaagggcgctgaaactgagctggttaggttcctgccagccgtcagcgatgagaactccaagcggctttctagcagagcccgaaagcgagccgctaagcgacgccttgggtcagttgaagcgccaaagactaataagtctcccgaggcgaagcccctgcctggaaaactgcctaaaggcgcagtgcaaactgcaggcaaaaaaggtcctcagagcttatttaacgcccctagagggaagaaacgccctgcccctggctccgacgaggaggaggaagaggaagatagcgaggaagacggaatggtgaaccacggcgacctgtggggttctgaggacgatgccgatacagttgacgactatggagctgacagtaattccgaggatgaagaggagggcgaagccctgctacctatcgagagggcggctagaaagcagaaggccagagaggctgccgctggcattcagtggtctgaagaggaaacagaagatgaggaggaagaaaaggaggtaacccctgaatcaggaccccctaaagttgaagaggccgatggcggtctccagattaacgtggacgaggaaccgtttgtactgcctccagctggtgaaatggaacaggacgcccaggcgcctgacctgcaaagagtgcacaagcgaattcaggatattgttgggatcctgcgtgacttcggagcccagagagaggagggcaggtctagaagtgaatatctgaacagactgaagaaggatctcgcaatttactatagttacggcgatttccttctgggcaagctcatggacttattccccctcagtgagttggtggaatttctagaagccaacgaggtgcctcgtccagtgactctgagaacgaatacactgaagacacgccgtcgtgatcttgcacaggcgcttataaaccggggagttaacctcgaccctctgggaaagtggtccaagaccgggcttgtagtatacgactcaagtgtgcccatcggggcaactccagagtatcttgcagggcactatatgctccaaggagcttcttccatgctgcctgtcatggcactggcccctcaggagcatgagcgtatcttggatatgtgctgtgctcctggcggtaagacctcctatatggcccagcttatgaaaaataccggggtgatcctcgcaaacgatgccaatgccgaaagactgaagagcgtcgtcggcaatctgcataggctgggagtcaccaacacaattatcagccactatgatggacgtcaatttcccaaagtggtgggcggattcgaccgcgtactactggacgcaccctgcagcggtaccggcgtgatcagcaaggatccagcagtgaagactaataaggacgagaaagacatcttgaggtgtgcacacttacagaaggagctcctactttctgcaatcgacagtgttaacgccacctctaaaacggggggttacctcgtctattgcacttgtagcattactgtggaagaaaacgaatgggttgttgactatgccctcaaaaagcgtaatgtccgcctggtaccgacgggtctggactttggacaagaaggattcaccaggttccgcgagaggcggtttcatccgtctcttcggtcaacccggagattctatccacatacccacaacatggacggtttctttatcgctaaatttaaaaagtttagcaacagcattcctcagagccaaactggaaacagtgagactgctacccccaccaacgttgacctcccccaagtcattcccaaatctgagaattctagccagccggcaaaaaaggcaaaaggcgcagctaagacgaagcagcagcttcagaaacagcagcacccaaagaaagcgtcatttcaaaaactcaatgggatcagcaagggggctgacagtgagttaagcacggttcccagtgtcactaaaacacaggcaagcagctcatttcaggacagctctcagccagctgggaaggctgaaggtatcagagagcctaaggtcaccgggaaactaaaacaacgctcgccaaagctgcagtcaagtaaaaaggtcgctttcttgcggcaaaatgcccctcccaaagggacggacacccagactccagcagtattgtctccttctaaaacgcaggcaactctgaagcctaaggaccaccaccaacctctggggagagcgaaaggggtcgagaaacagcagctcccagagcaaccattcgaaaaggcggctttccaaaaacaaaatgatactccaaagggcccacagccaccaacggtttcgcccattcgatcctcaagaccccctcctgccaaacggaagaagtcccagtcccgcggaaattcacagcttctgctgagctag

SEQ ID NO: 23637 - DNA, 2538 bp, Artificial Sequence
  Description of Artificial Sequence: Synthetic coding sequence
atgggacgcaagctggatcccacaaaggagaaaagagggccaggaagaaaagcgcgtaaacaaaaaggagcagaaactgagctggttcgcttcctccctgcagtgtccgacgaaaatagcaagagattatcctctagagccagaaaaagagctgccaaaaggaggctcggtagtgttgaagcccctaagacaaacaagagccctgaggccaagcccttacctggcaaactgcctaagggcatctctgccggagccgtccaaactgctggtaagaaagggccacaatcactctttaacgctccgagggggaaaaagcggccagctcccggaagtgacgaagaggaggaagaggaggacagtgaggaggacgggatggtcaatcacggagatctttggggcagcgaggatgacgccgatacggtggacgactatggagcggatagcaatagcgaagatgaagaggagggagaggctgctggtgtgcagtggttaggcctgggcagtttacagccccctccccctgggttcaagcagttcagctgcctgagttttccctccagttgggatttgcaattgctgccaatcgagagagctgccaggaaacagaaagccagagaagccgcagctgggatccaatggagcgaggaagaaaccgaggatgaggaggaggagaaagaggttacaccagaatctggaccgccaaaagtcgaggaggccgatggcggactgcagatcaatgtcgacgaggagccatttgtgctcccacctgccggagaaatggagcaggacgcccaagcacctgacttacagcgtgtgcataaaagaattcaggatattgtagggatcttgcgcgatttcggcgctcaaagggaggaagggaggagtagaagcgaatacctcaatagactgaaaaaagacctagctatctattactcatatggagactttttactcggaaagcttatggatctctttcctctctccgagctcgtcgaattcctcgaagcaaacgaggttccacggcctgtgactcttagaactaacacactgaaaaccagacgacgcgacctcgcccaggcactgataaataggggggttaacctggatccccttggtaaatggtccaagaccggtctcgttgtgtacgacagttccgtgccaatcggagccacccccgagtatctcgctggccactatatgctgcagggcgcttcttcaatgctgccagtaatggctctggcacctcaggaacacgagaggatcttggatatgtgctgtgcacctgggggtaaaaccagctacatggctcagctgatgaagaatacaggcgtcatccttgctaatgacgctaatgccgaacgcctgaagagtgtggtgggaaatctccaccgattgggagtgactaacacaatcatcagccactacgatggacgccagtttccgaaagtcgtcggcggatttgatcgcgtgctgttggatgccccatgttccggaacaggcgtcatttccaaagatccagcagtaaaaaccaacaaggacgagaaagatattctgagatgcgcccatctgcagaaagaactgcttctctcagctatcgattccgtcaacgcaacatctaagaccggaggttatctggtgtactgtacctgtagcataactgtcgaggaaaatgagtgggtggtcgattatgctctgaagaaaaggaatgtcagactcgtgcctacggggcttgacttcggccaggaggggtttactcgcttcagggagaggaggttccacccctctttgaggtcaacgagacgattttatccccatactcacaacatggacgggttctttatcgccaagttcaaaaaattctcgaacagtataccgcagtctcaaacagggaatagtgaaaccgctacaccaaccaatgtcgacctgcctcaggtgattccaaaaagcgagaacagcagccaaccagccaaaaaggctaaaggcgctgcaaaaacaaagcaacagttacagaaacagcagcaccctaagaaagccagcttccagaaactcaacggaatttccaaaggagctgattcagaactatccaccgttccatctgtgacaaaaactcaggctagctcaagcttccaggactcgagccaacctgccggaaaggctgagggaatccgcgagcctaaggtgactggcaagctgaagcaaagatctccaaagctgcagagctccaagaaagtagctttcctccgccagaacgcccctcccaaaggaaccgatacccaaaccccagccgtacttagcccgagcaagacacaggccacccttaagccgaaggatcaccaccaacctctgggcagggccaagggagtcgagaagcagcagctgccagagcagccatttgaaaaggcagccttccaaaagcagaatgacacacccaaggggccacaacctccgactgtgtctcctattcgctcaagtcgtcctccacccgctaaaagaaagaagtcccagagcagaggcaattcacagctgctgctttcatag

SEQ ID NO: 23638 - DNA, 1887 bp, Artificial Sequence
  Description of Artificial Sequence: Synthetic coding sequence
atgggccgtaaacttgatcctacaaaagaaaagaggggccctggcaggaaggcccgaaagcagaaaggagccgaaactgagttggtgcgcttccttcctgcagtctctgatgaaaactccaagaggctcagttctcgcgcacgtaaacgagcggcaaagcgtaggctgggatccgtcgaagctcccaaaactaataagtctccggaggccaaaccgctccccggaaagctgcctaaaggggctgtccaaacggctgggaagaagggaccccagagcttgtttaacgccccacgcggtaaaaaaaggccggcacctggcagcgatgaggaggaggaagaggaagactccgaagaagacggtatggtgaatcacggcgacctgtggggcagcgaagacgatgccgatactgtggatgactacggtgccgactccaattctgaagacgaagaggaaggcgaggctttgttaccaatcgaaagagctgcccgaaagcagaaagcaagagaggccgctgccggaatccaatggtcagaggaagaaacagaagatgaagaagaagaaaaggaggtgactccagagtcgggacctcccaaggtggaagaggctgatggcggactgcagattaacgttgacgaagagccattcgtattgccgccagccggtgagatggaacaagatgctcaggctcctgaccttcagcgcgttcacaagcggatccaagacatagtgggcattctgagagattttggagcccaacgagaggagggcaggtccagatccgagtatcttaacagattgaagaaggatttggctatctattatagctacggagactttctgctgggcaaacttatggacctcttccccctttcagaactggtcgagttcctcgaggccaatgaagtccctagaccagtaaccctccgcacaaataccctgaaaacaagaaggagagatcttgcacaggctctcattaatcggggtgtcaacttggatcctctggggaagtggtcaaagacaggtctggtggtttacgacagcagcgtccccatcggcgctaccccagaatatctcgcgggacactatatgctccagggagccagttccatgctccctgttatggcgttggctcctcaggagcatgagcggatcttggacatgtgttgcgccccaggaggcaaaacgagttatatggctcagttaatgaaaaacactggcgtgattctcgccaacgacgcaaacgctgaacggttgaagtctgtcgttgggaatctccacaggctgggtgtcaccaacacaataatctcccactacgatggccgacagttcccaaaggtggtcggagggtttgatcgcgtactgctagacgctccttgtagcggaaccggtgttattagcaaagatccggctgtgaaaaccaataaggacgaaaaggacatcctgcgatgcgcacacttgcaaaaagaactactgctctctgcgattgactctgttaacgcaacatccaagaccgggggttacctggtgtattgtacatgttccatcaccgtcgaggagaacgaatgggtcgtggactacgcactgaaaaaacggaatgtccgcttggtacccactggtctggatttcgggcaggagggcttcactagatttagagaacgtcggtttcatccgtccttacggtccactagacgattctacccccatactcacaatatggatggcttcttcatcgctaaattcaagaagttctccaactctatcccccaatcccagacagacggtgtactgttatgtaggtctgggtggacggccgtggtccaatctcagctgattgccacaagtactttccaagtacaggcaattctggtgccacagacacctaagtag

SEQ ID NO: 23639 - DNA, 582 bp, Artificial Sequence
  Description of Artificial Sequence: Synthetic coding sequence
atggccctgagcactgattatgccctgaggacaggtgcgtttgagccggcagaagcctctgtgaatccccaggatctgcaggggagcttacaggaacttaaggaaagagctctgtcccgatacaacctcgtgcggggacagggacctgagaggcttgtttctggcagcgacgatttcaccctgtttctgtggagcccagccgaggacaagaaacccctgacaaggatgacagggcaccaggctctgataaaccaggtcctcttctcccccgactcaagaatcgttgcctctgccagtttcgacaagagcatcaagttatgggacggcagaactggcaaatacttagcttcacttcgcggtcacgttgctgctgtgtatcagattgcatggtccgcggattcacgactgctggttagcggatcctcggacagtacactcaaggtttgggatgtcaaggctcagaagttggccatggacctgccagggcacgctgatgaagtctatgcagtggattggtcaccggatggacaacgcgtcgcttccgggggtaaagataagtgtctaagaatttggagacgttag

SEQ ID NO: 23640 - DNA, 915 bp, Artificial Sequence
  Description of Artificial Sequence: Synthetic coding sequence
tagtcaagtaaagacggaagcgtgcgcatctgggacaccaccgccggacgctgcgagaggatattgactgggcatacacaatccgtgacatgtttgagatggggcggtgacggactgctgtattccgcatcccaggatcggacaatcaaagtgtggcgtgctcatgatggcgtactgtgtcggaccctccaggggcacggccattgggtgaatacgatggccttatccactgattacgctctccgtaccggtgctttcgagccagccgaggcatctgtgaatccccaagatcttcagggctctctgcaggagctcaaagaaagggctctgtctcgctataatttagtgagaggacagggccctgaacggctggtatctggctctgacgacttcacactgttcttgtggtccccggcagaggacaagaagccactgacccgaatgaccggtcaccaggctctgattaaccaggttctgttctctccagattcccggatcgtggcctctgccagtttcgataagagcattaaactgtgggatggaagaactgggaaggatgactttcattctgtcacgtggtgtagttcaggctccagtgctgccgcaaggagttggctgataacaaccagcgctagctgggtccaggttatcctgttgcctcagcctcccaggtacctggcttccttgagagggcacgtggctgcagtataccagatagcatggtcggctgattcccggctgctggtgtccggctcttctgactccaccctgaaggtctgggacgtcaaggcacagaaacttgcgatggatctgcccggtcatgccgacgaggtctacgccgtggactggtcccctgacgggcagcgggttgcatccggcggtaaggataagtgcttacgaatttggcgccgatag

SEQ ID NO: 23641 - DNA, 1458 bp, Artificial Sequence
  Description of Artificial Sequence: Synthetic coding sequence
atggccgcagccgtaccagatgaagctgtggccagggacgtacagagactgctagtccagtttcaagatgaagggggacagctgctcggaagtccgtttgatgtacccgtggacataactccagacagactccagctggtttgcaatgccctgttagcgcaggaagatcccttaccattggcgttctttgtccacgatgctgagattgtgtcgagtctgggtaagaccttagaatctcaggccgtcgagactgagaaagtgttggatattatttatcaacctcaggccatttttcgggtgcgggcagtgacccgttgcacgagtagtcttgagggtcacagcgaggctgtgatctcggtggctttctcaccaactggcaaatatctagcttccggaagtggtgacactaccgtgcggttctgggatctgagcactgagacccctcactttacctgtaaagggcatagacattgggtcctgtcaatcagctggtcccctgatggccgtaaactggctagtggttgcaagaatgggcaaattttgctgtgggaccccagtaccggaaagcaagttgggagaaccctcgcaggacacagtaagtggatcaccggccttagttgggagccgctgcacgctaatcccgagtgccgctatgtcgccagctcctcaaaggacgggtctgtgcggatttgggacactacagcgggaaggtgcgagcgaattttgaccggccatacacagtcggtgacttgcttgcgttgggggggagatgggctgctgtattcagcctctcaagaccggaccataaaagtctggcgggctcatgacggtgtcctgtgccgcactctgcaagggcatggccactgggtgaatactatggccctgtccacagactacgctcttcggaccggggctttcgaacctgcagaggcctcggtgaacccccaagaccttcaaggctctttgcaagagctgaaggaaagagccttaagcagatacaatctggttagagggcagggacctgaacggctggtgtccgggtccgacgactttaccctcttcttatggagtccagctgaagacaaaaagccgttgactcgaatgacgggccaccaggccctgataaatcaggtactgttttcacctgacagccggatcgtcgcgtcagcgagctttgataaatccatcaagctgtgggacggcagaacaggtaaatacttggccagtttaagaggacatgttgctgcggtgtatcagatcgcctggagcgccgactcaaggcttctggtgtcaggatcatcagattctacacttaaggtgtgggatgtcaaggctcagaagctggccatggatttacccggacacgcagacgaagtctacgctgtggactggtccccagacgggcagcgagtggcatccggcggtaaggataaatgcctgaggatctggaggagatag

SEQ ID NO: 23642 - DNA, 1386 bp, Artificial Sequence
  Description of Artificial Sequence: Synthetic coding sequence
atggccgctgcggtgccagatgaagcagttgcccgagatgttcagaggctcctcgttcagttccaggatgagggagggcagctgctaggatcaccctttgacgtacccgtggacatcacgcccgacaggctccagctggtctgtaacgcactgttagctcaagaagaccccttgcctctggcctttttcgtccacgatgcagaaatcgtgagctctctgggtaagaccctggaaagtcaggctgtagaaacggagaaagtactagatattatctaccagccacaggccatctttcgggtgagagcagtgaccaggtgtaccagtagcctcgaaggccactccgaggcggtgatctccgttgccttctcccctacaggcaagtatcttgcatctggcagtggcgataccaccgttcgcttttgggacctcagtacagaaacaccccatttcacctgcaaagggcacaggcactgggtgctgagcatatcttggagtccagacggacggaagttagcttctggctgtaagaatggacagatcttactgtgggagcctcttcatgccaatccagagtgtcgatacgtggcatcttcatccaaggacgggagcgtccgcatatgggacacaactgccggaagatgtgaacgaatcttgacaggccacactcagagcgtgacctgtctgcgctggggcggagacggattgctctactccgccagccaggatcgcaccataaaagtgtggcgagcccacgatggggtgctgtgtagaacactgcagggccatgggcattgggtcaatacgatggcactgtccacagattatgcgctacggacgggggcatttgaacccgctgaggcttccgtaaacccacaagacctgcagggatctcttcaggagctaaaggagcgcgctctaagccgctataacttagtcagaggacagggcccagaacggctggtaagtggaagtgatgattttacactgttcctctggtcccccgctgaggacaagaagcccctgacgcggatgactggtcaccaggctctgatcaaccaagtgctgttctctccagattccaggattgtagccagtgcatcttttgacaaaagcattaaactctgggacggccgaacagggaagtacctggcttcactcagggggcatgtggctgccgtctaccagatcgcctggagtgcagattcaaggctactggtgagtggatcttccgacagcacacttaaagtgtgggatgtgaaggctcagaaacttgctatggacctgccaggacacgctgacgaggtctacgctgtggattggtcccctgacggacagagagtggcatcaggaggtaaagacaaatgcctgcgaatatggagacggtag

SEQ ID NO: 23643 - DNA, 582 bp, Artificial Sequence
  Description of Artificial Sequence: Synthetic coding sequence
atggccctctccaccgattacgccctcaggacaggcgcttttgagcccgctgaagcatcagttaaccctcaggacctgcagggcagcttacaggagttgaaggagagggctctctctagatacaatctggtcaggggccagggtcccgagagactggtatccggatccgatgatttcactctgttcctatggagtccagccgaggacaaaaagccacttacccggatgacaggccaccaggctctcatcaaccaagtgctcttttcaccagattcccgtatcgtggccagcgcaagtttcgacaagtcgattaaattgtgggacggccgtactggaaagtaccttgcgagtctacgcggtcatgtggctgccgtttatcaaatcgcttggtctgcagatagtcgccttctcgtctcaggcagcagcgactctacccttaaagtctgggatgtcaaagctcaaaagttggctatggatctgccaggacatgcagacgaagtttacgctgttgattggagccccgacggccagcgagtggccagcggaggtaaagacaagtgcttgcgtatctggaggcggtag

SEQ ID NO: 23644 - DNA, 756 bp, Artificial Sequence
  Description of Artificial Sequence: Synthetic coding sequence
atgccttccccgaggccacgcggtagccccccacctgctccatccggctctcgggttagacccccaagaagtggacgttcccctgcgccacgcagtcctacaggccctaatacaccacgtgcgcctgggagattcgaaagccctttcagcgtggaggcaatactcgcgaggcccgatccctgcgcccctgctgcatctcagccatcgggctcggcctgcgtgcatcccgcattttggaccgccgctagcctctgtgcaaccggtgggctgccatgggcctgtccaaccagttggttgcccgcatatctgtcagtagggttttaccctgtgcccggtcctcgcgtggcacctgtgtgcggcttgctcggatttggcgtgaccggtctggaattggcgcactgcagcgggctgtgggcttttcccgactgggcgcctaccgaggacttgcaggataccgaacgacagcagaaaagagtgcgcacaatgttcaacctggaacagctggaggaactggaaaaggttttcgccaagcaacacaacctggtgggcaaaaagagggctcaactcgctgcgagactgaagttgactgaaaaccaggtgcgggtttggttccagaaccgacgggtgaaatatcagaagcaacagaagctgagggctgccgtgactagcgccgaagcagccagtctggacgagcctagcagtagttcaatcgcatccatacagtcagatgatgctgagtccggtgtagacggttag

SEQ ID NO: 23645 - DNA, 1110 bp, Artificial Sequence
  Description of Artificial Sequence: Synthetic coding sequence
atgttctgttgcctggggtatgaatggctcagcggtgggtgcaaaacatggcatagtgcgtgggttataaatactctcgcggatcacagacatcggggaacggactttggagggagtccttggctccttatcatcacggtctttctcagatcttacaagtttgcgatctcgctgtgcacgagctacctttgtgtgtcatttctcaagacaatttttccttctcagaatgggcatgatggatctactgacgtgcaacagagagcgagaaggtccaactgcaggcgccaggagggaattaaaatcgtcctggaggacatctttacactatggagacaggtggagacaaaggttcgcgctaaaatacgcaagatgaaagtcacaacaaaggtgaaccgacatgacaagattaacggcaaacgtaagacagcaaaagagcacctcaggaagctgagcatgaaggagagagagcacggggaaaaagagagacaagtgtccgaggctgaggagaatggaaagctggatatgaaagaaatccacacttatatggagatgtttcagagggcacaggcactgcggcgtcgagccgaggattactatcgatgcaagatcacccccagtgcacgcaaaccactatgtaatcgcgtgcgtatggcagcagtagagcaccgccactctagcggactgccttattggccgtaccttactgcggagaccctgaagaatagaatgggacaccagccacctcctcccacacagcagcattccatcatagacaattcacttagcctgaagaccccctccgagtgtgttctctatccactccctccatctgcggatgataatctgaaaactcctcccgagtgtctgctgaccccactgccaccatcggctctcccctcagccgatgacaacctgaaaaccccagctgaatgtttattgtatccattgccaccctctgctgacgacaatttaaagactcctcccgaatgtctcctgaccccacttccgccaagtgctcccccatccgccgacgataaccttaaaacaccacccgaatgtgtatgttctcttccattccatcctcagcgtatgattatcagccggaactag

SEQ ID NO: 23646 - DNA, 1110 bp, Artificial Sequence
  Description of Artificial Sequence: Synthetic coding sequence
atgttctgttgccttgggtatgagtggcttagtgggggttgcaagacctggcactcagcctgggtgatcaatacacttgctgaccaccgacatcgcggaactgattttggcggaagcccatggctcctcatcattactgtcttcctacggtcttacaagtttgctatcagcctgtgcaccagctacttatgtgtgagctttttgaagacgattttcccctcccagaacgggcatgatggtagtacagatgtgcagcagcgggcacgcaggagcaattgtagaagacaggagggaattaagattgtactggaggacattttcactctgtggagacaggtggaaacaaaggttagggcgaaaatacgcaaaatgaaagtaacaaccaaggtcaaccgccatgacaaaattaacggcaagcggaagaccgccaaggagcacctgcgcaagctatccatgaaagagagggagcacggcgagaaggaaagacaggtgagcgaagcagaggaaaatggcaagcttgacatgaaagagatccatacttacatggagatgttccagagggcccaggcccttagacggagagctgaggattattaccgctgcaaaattacgccaagtgccagaaagcctctttgtaaccgagtacgtatggctgctgtcgagcaccgccattcctcaggattaccttattggccgtatctaactgcagaaactctgaagaacaggatgggacaccaacctccgccacccacacagcagcacagtatcattgataactctttaagcctgaagacaccatctgagtgcgtactgtacccgctcccaccctctgccgacgacaacctgaaaactcctcctgaatgcttgctgacccctctgccacctagcgccctgccctcggcagacgataatctcaagacacctgctgagtgtctcctctaccctctccctccatcagcagatgacaacctgaaaacacctccagagtgtctgctgacaccactgcccccatctgctcctccatcagcagatgacaatctgaagacacctcccgaatgtgtgtgttccttgcctttccatccacagcggatgattatctcgcggaattag

SEQ ID NO: 23647 - DNA, 1110 bp, Artificial Sequence
  Description of Artificial Sequence: Synthetic coding sequence
atgttttgttgtctgggatatgaatggctttctggcggatgtaaaacgtggcacagcgcatgggtgatcaatacactggctgaccaccgacacagggggaccgactttggaggcagcccctggctgctgatcattacagtcttccttcggtcctacaaatttgcgatctcactctgtacctcctatctgtgcgtgtcatttcttaagacaatcttccctagccagaacggccatgacggatccaccgacgtccaacagcgcgctaggcggtctaactgcagacgtcaggagggaatcaagattgttcttgaggacatcttcactctttggagacaggtcgaaactaaggttcgggctaaaatccgtaaaatgaaggtgacgacaaaagtgaacaggcacgataaaataaatggaaaaaggaagaccgctaaggagcacctccggaagctcagtatgaaggaacgcgagcacggagagaaagagcgccaggtctctgaggctgaggaaaacggaaagcttgacatgaaagagatccatacatacatggaaatgttccagcgcgcacaggcgctaaggcgtcgcgctgaggattattatcgctgcaaaatcacaccttcagcccgaaagccactctgcaacagagtacgaatggctgcggtcgagcaccggcatagtagtggtcttccctattggccatatctcactgccgagactttaaagaacaggatgggccatcagcctcctcctccgacacagcaacattcaatcatagataattctttaagcctcaaaactcctagcgagtgtgtcctctaccctctccctccctccgcagacgacaatttgaagaccccgcctgagtgcctcctgaccccccttccaccaagtgctctaccaagtgccgacgataatctgaaaaccccagcagagtgcctgttgtatccactgcctccaagcgccgatgacaacctgaaaacaccacctgagtgtctcctgactccattgcccccatccgcccctccctcagcagacgacaatctgaaaaccccccctgaatgtgtgtgttctctccccttccatcctcaacgaatgatcatctcaaggaactag

SEQ ID NO: 23648 - DNA, 699 bp, Artificial Sequence
  Description of Artificial Sequence: Synthetic coding sequence
atgttctgctgcctagggtacgaatggctgtctggcggatgtaagacgtggcatagtgcatgggtcattaataccctggccgatcatagacatcgaggtactgacttcgggggatcgccttggctgctcattatcactgtttttttgaggtcctacaagtttgccatctctttatgtacctcctacctgtgtgttagcttcctaaaaaccattttccccagtcagaatggccacgatggctcgaccgatgtgcaacaaagagcacgacgaagtaattgccgcagacaagagggaatcaagatagtcctcgaagatatttttactctttggagacaggtggaaactaaggtgcgtgccaagataaggaagatgaaggtgacaacaaaggtgaatagacacgataagatcaatggaaagcgcaagacagcaaaggagcatctgcgcaaattgagtatgaaggagcgcgaacatggtgaaaaagagcgacaggtgtctgaagccgaggaaaatggcaagttggacatgaaggagatccatacgtacatggagatgttccagcgggctcaggcactgagaaggcgcgctgaagactattaccggtgcaaaatcaccccatccgccagaaagcccctctgtaacaggtgcacctacaatctcgtgcttccaggatctgaaaagaagtattattcccacgcctag

SEQ ID NO: 23649 - DNA, 699 bp, Artificial Sequence
  Description of Artificial Sequence: Synthetic coding sequence
atgttctgttgcttgggctacgagtggctatcaggcggttgcaagacatggcactctgcctgggtcataaacacattggctgaccaccgccatcgtgggactgatttcggcggaagtccatggctgttgattattactgtgtttctcagatcatacaagtttgcaatttccctctgcactagctacctgtgcgtcagcttcctaaaaacgatctttccctctcaaaacgggcacgatggttcaacggatgtccagcaacgggctagacgcagtaattgccgaaggcaggaaggcatcaaaatagtactcgaagatatattcacactgtggcgtcaggtggaaacaaaagtgcgcgctaaaatacgaaaaatgaaggtaacgacaaaggtgaaccgccatgataaaataaacggaaagcgaaagacggccaaggagcacctgcgcaagctgagcatgaaggagcgcgagcatggggagaaagagaggcaggtaagcgaggccgaagaaaatgggaaactggatatgaaagagatccacacgtacatggaaatgttccaacgtgcgcaggcactccgtcgacgagccgaagattactatagatgcaagattacccctagcgccaggaaacccttgtgcaatagatgtacctacaacctcgtgctgccaggatctgaaaagaaatactactcacatgcatag

SEQ ID NO: 23650 - DNA, 1110 bp, Artificial Sequence
  Description of Artificial Sequence: Synthetic coding sequence
atgttttgctgtcttggatatgaatggcttagtggcggatgtaaaacatggcactctgcatgggtcatcaatactcttgccgaccaccgccatcgcggaaccgacttcgggggatctccatggctcctgatcattactgtcttcttacgaagttataaattcgctatcagcctctgtaccagttacttgtgtgtgtctttcctgaaaacaatctttccatctcagaacggtcatgatggaagcacagacgtgcagcagcgcgcacggagatcaaattgtcgcaggcaggaaggaattaagatcgtccttgaggatattttcacgttatggcggcaggtcgaaaccaaagtgcgagccaaaattcgtaaaatgaaggtcactacgaaagtcaatcggcacgacaaaataaacggtaaacggaagaccgccaaagaacacctgcgcaaactgagcatgaaggagcgggaacacggggagaaagagcgccaagtgtccgaagccgaggagaacgggaagttggacatgaaggagattcatacttacatggagatgttccagagggcccaggcgttacggcgtcgtgccgaggattattaccgctgtaaaattactcctagtgccagaaaaccgttgtgcaaccgtgtaaggatggccgcagtcgagcacaggcactcatcaggtctgccctactggccgtaccttacggctgaaacactgaaaaatcgaatgggacatcagccccctccacccactcagcagcacagcattatcgacaactctctctcacttaagacccccagtgaatgtgtgctctaccctctgccaccaagcgccgatgacaatttgaaaactccccctgagtgcctgcttacacctctcccacccagcgcactacctagcgctgacgacaatctgaaaacccctgcagagtgtttgttgtacccgctgcctccctcagcagatgacaacctcaaaacgccccctgagtgtctgctaacacccctgccgccatctgccccaccttccgcagacgacaatctgaaaacacctccagaatgcgtttgctctctaccttttcaccctcaacggatgataataagccggaactag

SEQ ID NO: 23651 - DNA, 2067 bp, Artificial Sequence
  Description of Artificial Sequence: Synthetic coding sequence
atggaaaacggagtcctggggaatgctttagagggcgtacatgtagaagaagaagagggcgaaaagactgaggacgagtcccttgttgagaacaacgataatattgacgaggaggccagggaagagctgagagagcaggtgtacgatgcaatgggagagaaggaggaggctaagaagactgaggataagtctctcgccaagcccgaaaccgacaaagagcaggatagcgaaatggaaaaaggaggcagagaagatatggatatatcaaagtcagccgaagaaccacaggaaaaggtggatctcacgctcgactggttgactgaaaccagcgaggaggccaaaggcggagccgctcctgaggggccaaacgaggccgaggtaactagtggaaagcccgaacaggaagtgccggacgctgaggaagagaaaagtgtgtccgggacagacgttcaggaggaatgcagggagaagggtggccaggaaaagcaaggggaggtgattgtgtctattgaggaaaaacccaaggaggtgagtgaagagcagcctgtggttacgctcgagaaacagggaactgccgtagaagtagaggccgaaagcctggaccctacggtgaaacccgtagacgtgggtggagatgagccagaggaaaaggtcgtcaccagcgaaaatgaggccggtaaagcagtgctcgaacaattggtagggcaggaggtgcctccagccgaagaaagccccgaggtgaccacggaagccgcagaggcctcagcagtcgaagccggtagcgaggttagcgagaagccaggccaggaggcccctgtgcttcctaaggacggcgctgttaacgggccaagcgtcgtgggagaccagactccaattgaaccgcaaacatcaatcgagaggctgacggaaacgaaggacggtagcggactggaggagaaggtcagggccaagctcgtgccatcccaggaggaaacgaagttgtctgttgaggaaagcgaagctgcaggagatggagtcgatacgaaagtcgcccagggcgcaaccgaaaagtctccggaggataaagtgcagatagctgccaacgaggagacccaggagcgagaggaacagatgaaagagggtgaggagacagagggatccgaggaggacgacaaagaaaatgataagaccgaggagatgccgaatgatagcgtcctcgaaaacaagagtctacaagaaaacgaagaggaagaaattggcaacttggaacttgcttgggatatgctcgatctcgccaagattatttttaagcgtcaggaaacaaaggaagcccaactatacgctgcacaagcacatctcaagctaggggaggtttctgtcgagtccgagaattacgtccaggcggtggaagagttccagagttgtttgaacctgcaggagcagtacctagaggcgcacgaccgattgctggccgaaacgcattaccagctgggtctcgcgtatggatataacagccaatacgatgaggccgtcgcgcagttttcaaagtccattgaggtaattgagaatcggatggccgtattgaatgagcaagtgaaagaagccgaggggagttccgccgagtataagaaagagatagaagaactgaaggagctgttacctgaaatacgcgaaaagatcgaagatgctaaagagagccagcgaagcggcaatgttgccgaattagcattgaaggcaacgttggtcgagagttcgacaagtgggttcacaccgggaggtggaggtagtagcgtgagtatgatcgcatctcggaagccaacagatggagcatcttcttccaattgcgtcaccgacatctcacacctggtgagaaagaagagaaaacctgaggaggaatcacctcgcaaggacgacgctaaaaaagccaagcaagaaccggaggtgaacggtggatccggtgatgcagtgcccagcggcaatgaagtctccgagaacatggaagaagaggctgaaaaccaagcagagagccgcgcagccgtggaaggaacagtcgaagcaggcgctactgtcgaaagtacggcatgctag

SEQ ID NO: 23652 - DNA, 2367 bp, Artificial Sequence
  Description of Artificial Sequence: Synthetic coding sequence
atggctatggaatctacagccactgcggctgtagctgcagagttagtgtccgccgacaaaatcgaagacgtgcccgctccatccaccagcgccgataaggttgagagccttgacgttgattctgaagcgaagaaactcctcggcttggggcagaaacatttggtcatgggtgacataccagccgctgtcaacgcctttcaggaggccgcatcgttgctggggaagaagtatggagagaccgccaacgaatgcggcgaggcatttttcttctacggcaaatcactcctagagctggcaaggatggaaaacggcgtgctcggtaatgccctcgaaggtgtccacgttgaggaggaggagggtgagaagacagaagacgagagcctcgtggagaataatgataatatagatgaggaagcgagggaagagctcagagaacaagtatatgatgcaatgggagaaaaggaagaagctaaaaagacagaggacaaaagcttggccaagccagagacagacaaagaacaggacagcgagatggaaaaaggaggccgtgaagacatggatatttctaaatccgcagaagagcctcaggagaaggtggacctcacgctggactggctcactgagacgtctgaggaggcaaagggtggcgcagcaccagaagggccaaatgaagctgaagttacttccggaaagccggagcaggaggtcccagatgctgaggaggagaagagtgtttcaggcacagacgtgcaggaggaatgcagagagaaggggggacaggagaagcagggagaggtaatcgtgtcaatcgaggagaagccaaaagaggttagtgaagaacagccagtggtaacactggagaagcagggtacagcggtggaggtggaagccgaatccctagacccgacagtgaagccagttgacgtggggggagacgagcccgaagaaaaagtcgtgacctccgaaaatgaggcaggcaaagccgttctcgaacagctcgtaggccaagaggtgcccccagctgaagagagtcctgaggtaaccaccgaagccgcagaagccagtgctgtagaagccggttccgaggtctctgagaagcccggacaggaggcacctgtacttccgaaggatggagccgtcaatgggccatctgtggtcggcgatcagacacctatcgagcctcagaccagcattgagagactgaccgaaacgaaagatggcagtggattggaggagaaagtgcgcgctaagttggttccttcccaggaagaaacaaagttgtccgtcgaagaaagcgaggctgctggcgatggcgtggacacaaaggtcgcccagggtgcaacagagaagagcccagaggacaaggtacagatcgctgctaacgaggagacccaagagagggaggaacagatgaaggaaggcgaggagaccgagggatcagaggaagacgataaggaaaacgacaagacagaggaaatgccaaatgactcggtccttgaaaacaaatctttacaggagaatgaagaggaagagattggtaacttggaactggcatgggatatgctggatctggccaaaattatttttaaacgccaggagaccaaagaggcccaactatatgccgcacaagcacacctaaaactgggagaggtttccgtggaaagcgagaactatgtgcaggcagtggaggaattccaaagctgtctgaaccttcaggagcagtacctggaggcccacgataggttgctggccgagacacactatcaactcggcctggcctacggctataacagccagtacgatgaagccgtggctcaattcagcaagagcattgaggtaatcgagaataggatggcagtactcaatgaacaggtcaaggaagctgaaggtagcagcgctgagtacaaaaaggaaatagaagagttgaaggagcttctcccagaaattagagaaaaaatcgaagatgccaaagagtcccagagatcgggcaacgtcgctgagctggcactgaaggcaacactcgtcgaatcttcaacctcaggttttaccccaggtggtggaggtagctccgtgtctatgatagctagcagaaagccaaccgatggcgcttcatcctcaaactgcgtgactgatattagccacctcgtgcggaaaaaaagaaagcccgaggaggaaagtcctcgcaaggatgacgccaagaaagctaagcaggagccggaagtcaacggtggatcaggggatgcagtaccctctggcaacgaagtaagtgagaatatggaggaagaggcggaaaaccaagccgaaagcagggccgcagtggaaggcaccgtggaagccggtgcgaccgtcgaaagtaccgcttgctag

SEQ ID NO: 23653 - DNA, 1350 bp, Artificial Sequence
  Description of Artificial Sequence: Synthetic coding sequence
atggccatggaatccactgcgactgctgctgtagcggcagagctagtgagtgctgacaaaatagaagacgtgcctgctcctagtacctctgcagataaggtagagagcctggatgtagactctgaagcgaagaagctgttaggtctggggcagaaacacctagtgatgggagacataccagccgctgtgaatgcctttcaggaggccgctagtcttttgggaaaaaagtacggggagacagccaatgagtgcggggaggccttctttttctacggcaagtccctgctggaacttgccaggatggaaaatggggttttgggtaatgcactcgagggtgtacacgtcgaggaagaggagggggagaaaactgaggacgaaagcctcgtcgagaacaacgataatatcgatgaaacggaggggagcgaggaggacgacaaagagaacgacaaaacagaggaaatgcccaacgactccgtgcttgagaacaagtccctgcaggaaaatgaggaagaggagatcggcaatctcgagctcgcttgggatatgctggacctagctaagattatcttcaagaggcaggagaccaaggaagcgcagctttacgctgcccaggcgcacctcaagttaggggaagtatctgtcgaaagtgagaattacgtacaggccgtggaggagttccagagttgcctgaatctgcaggagcagtatctagaagcacacgatcgtctgttggctgaaacccattatcagctggggctggcctacggctataacagccaatatgatgaagccgtggcccagttctccaaaagtattgaagttatcgaaaaccgaatggctgtgctgaacgagcaagtcaaagaagctgagggttcaagcgccgagtacaagaaagagattgaggagcttaaggagttgctcccagaaatcagagaaaagattgaggacgccaaggagtcccagcggagcggcaacgtggctgagctagcactgaaggcgactctggtggagtccagtacttcgggttttacgccaggaggcggaggatcttccgtgtctatgatagcgagcagaaagccaactgacggcgcaagttcctctaactgcgtcaccgacattagtcatctagtgcgtaagaagaggaagcctgaggaggaaagtccccgaaaggatgatgctaagaaggcaaagcaggaacctgaagtcaatggcggtagcggagacgcggtaccttcaggcaacgaagtcagcgagaacatggaagaggaagcagaaaaccaggcagagagcagagctgccgtggaaggcactgtcgaggcgggagcaacagtggaaagcacagcctgttag

SEQ ID NO: 23654 - DNA, 2373 bp, Artificial Sequence
  Description of Artificial Sequence: Synthetic coding sequence
atgttcctactcttgctccacctgcagatcaaatggcgtgccactattaacctcctatcagttactgaggacgggcttcacttcgttgagtattatcttaacagaatcatccacctcgacgtggacagcgaagccaagaagctgctggggctgggccagaaacatttagtgatgggagacataccagctgcggtgaacgcttttcaggaagccgctagcctcttaggcaagaaatacggcgaaaccgctaatgaatgcggggaagctttcttcttctacggtaaaagtctgcttgagctagcaaggatggaaaacggtgtcctaggcaacgcgctggagggggtccacgtcgaagaagaagagggggagaagaccgaagacgaatcacttgtcgagaataacgataatatagatgaagaggccagagaggagctgagggaacaggtgtacgacgccatgggcgagaaagaagaggccaagaagaccgaagataagtcccttgctaaaccagagaccgacaaggaacaggactcggagatggagaaggggggacgagaggatatggatatctctaagtccgccgaggaaccacaggaaaaagtggacctgacactggactggttgaccgagacttccgaggaggccaaagggggagccgcacctgagggtcccaatgaagcagaagtgaccagtggtaagccggagcaggaggtgccagatgccgaggaggaaaagtctgttagtggaacagacgtgcaggaggagtgcagagaaaagggcggtcaggaaaaacagggagaggtcattgtgagcatcgaagagaagcccaaggaagttagcgaggaacagccagtggtgactctggagaagcaaggcaccgcagtcgaggtggaggccgagtccctcgatccaaccgtgaaaccggtggacgttggtggcgacgagccggaggaaaaagtggtgactagtgagaacgaggctgggaaggccgtgctcgaacagctcgttggacaggaggtacccccagctgaggagtctccagaggtcacgacagaggcggctgaagcatcagcggtggaggcgggaagcgaggtgtccgagaaacccggacaagaggctcccgtactgccaaaagacggcgctgtgaatgggccaagcgtggtcggggatcagacccccattgagccacaaacttccatcgagcgcttaactgagacaaaggatggctctgggctggaagagaaagtgcgggctaagctcgtcccctcacaagaagagacaaaactctctgtcgaagagtctgaagccgctggtgacggtgtcgatacaaaagtagctcagggcgcaactgagaaatcgcccgaggataaagtgcagatcgccgcaaacgaggagacacaggaaagagaagaacagatgaaggaaggagaagagactgagggctcagaggaagacgataaggagaacgataagactgaggaaatgcccaatgactcggtactagagaataagtccctgcaggaaaacgaggaggaggaaatcggcaatctcgagctggcgtgggacatgctcgacctggccaagattatattcaaaaggcaggagaccaaagaggcacagctgtacgctgcccaggcccatttgaaactcggggaggtgtctgtcgagagtgagaactacgtgcaagctgtagaagaattccagagttgtttgaacctgcaggagcagtacttggaggcccatgatagactgctggcagagactcactaccagctgggattagcttatggctacaatagccaatatgatgaggctgtcgcacagttctccaagtctatcgaagtgattgagaacagaatggcagtgctcaacgagcaggtaaaggaagctgagggaagcagcgctgagtacaaaaaggaaatcgaggaactgaaggagcttctcccagagataagggaaaagattgaggatgcaaaggaatcacagaggtcaggcaatgtggcagagctggctctcaaggctactctggtcgaatcaagcactagtggcttcactcctggcggtggcggttccagcgtatctatgatcgcctcccgaaaaccaacagatggggcatcgtcttcgaactgcgtcacagacatcagccaccttgttagaaaaaagcggaagcccgaagaggagtcaccaagaaaagacgatgctaaaaaggcaaagcaagaacccgaagtaaatggtggaagcggggacgccgtccctagcggcaatgaagtcagtgagaacatggaggaggaggccgagaatcaggctgagtctagagcagccgtggaggggacggttgaggctggcgctaccgtagaatcgacagcctgctag

SEQ ID NO: 23655 - DNA, 771 bp, Artificial Sequence
  Description of Artificial Sequence: Synthetic coding sequence
atggcaatggagagcacagccaccgccgcagtggctgccgaacttgtttccgctgataagattgaggacgtacccgcaccctccacttcagccgacaaagtggagagcctcgacgtggacagcgaagcaaagaagctccttggcctcggccagaaacacctggtgatgggtgatataccagccgcagtaaacgctttccaagaggctgcctctctgttgggcaaaaagtatggggaaactgccaacgaatgcggggaggccttctttttctacggaaagtccttgttagaattggccaggatggaaaatggtgttctaggaaatgctttggaaggggtccatgtggaagaagaagaaggtgaaaagacggaggatgaatctctggtagaaaacaatgacaatatcgatgagactgagggaagcgaggaagacgataaagaaaacgacaaaacggaagagatgcctaacgattccgttttggagaataagtcgctacaggaaaatgaggaggaggagatcggcaacctagagctcgcctgggacatgctggatttagccaagattattttcaaaaggcaggagacgaaagaggcccagctgtacgctgcccaggctcacctgaagctgggggaggtatcagtcgaatccgagaattacgttcaggcagtggaggaatttcaaagttgtttgaaccttcaggaacagtacctggaggcccatgatcgactgctggccgagacccattaccagctcggcttggcttatggctag

SEQ ID NO: 23656 - DNA, 2175 bp, Artificial Sequence
  Description of Artificial Sequence: Synthetic coding sequence
atggctatggaaagcaccgccacagctgctgttgctgctgaactggtgagtgcggataagattgaggatgtgcccgcaccttcgacttccgcagacaaggtggagcgaatggagaacggcgtcctgggcaatgcccttgagggagttcatgtcgaggaagaggaaggggagaagacggaggacgagtccctggttgagaacaacgacaatatcgacgaggaggctcgggaagagttgcgtgagcaggtgtacgacgccatgggcgaaaaagaggaggctaagaagaccgaggataaaagtctcgccaagcctgaaactgacaaggagcaggacagcgaaatggagaagggaggcagggaagatatggacatttctaagagtgctgaagagccccaggaaaaggtggatctcaccttagactggcttacagaaactagtgaggaagctaagggaggcgctgcccctgagggacccaacgaggccgaggtcacgtccgggaagcctgaacaggaagtaccggacgccgaggaggagaaatctgtctcgggcacggatgtgcaggaggaatgcagagagaaagggggtcaggagaagcagggagaggtgattgtgagtattgaagaaaagcctaaggaggtctcggaggagcaaccggtggtcactcttgagaaacagggtacagctgttgaagttgaggctgaatcattggacccgacggtcaagcctgtagatgtgggaggcgacgaacccgaagaaaaggtagtcacatcagaaaatgaggcgggaaaagcagtgctggagcaattggtggggcaggaagtgcctccggctgaagagtcaccagaagtaacaaccgaagccgctgaggctagtgctgttgaagctgggtccgaggtcagcgagaagccaggacaggaagccccagtgcttcccaaagatggtgctgtgaacgggccatccgtggtcggcgatcagacaccaattgagccccagacctctattgagcgcctgaccgagactaaggacggctcaggactggaggagaaagtcagggccaaactggtgccaagccaggaagagaccaagttgtcagtggaagagtcagaggcggcaggggacggggtggatacaaaggtggcacagggagctacagaaaaaagccctgaagacaaagttcagatcgcagctaatgaagagacccaggaaagggaggagcagatgaaagaaggggaagagactgaaggcagtgaagaggacgacaaggagaatgataagactgaggaaatgccaaacgactctgtgctcgaaaacaagagtttacaggagaatgaggaagaagaaattgggaacctagagctggcgtgggacatgctggatttagccaaaattattttcaaacgacaggaaacaaaagaggcccagttgtacgccgcacaggctcaccttaagctgggcgaggtcagcgtggaatctgagaactacgttcaagccgtggaggagttccagtcttgtctcaacctgcaagaacagtacctggaggcccatgacaggttactagccgaaactcattaccaacttggcctcgcgtatggctacaacagccagtatgacgaagcagttgcacagttctctaaatcaatcgaagtgatcgaaaataggatggcggtgttgaacgaacaggttaaggaggctgaagggtcttcagccgagtataagaaggaaatcgaagaattgaaggaactgttgcccgaaatcagggagaaaatcgaagatgccaaagagagtcagcggagcggcaatgtggcggaactggctctcaaggccactttggttgaatcctcgacgagtgggttcacacccggaggaggtggtagtagcgtctcaatgatagccagtcggaaaccaacagacggggctagcagtagcaactgtgtgaccgacatatcacatttagtcaggaagaagagaaaaccagaggaggaaagccccagaaaggatgacgccaaaaaggccaagcaggagccggaagtcaacggaggttctggagacgccgtgcccagtggcaacgaagtgagcgagaacatggaggaagaggccgagaaccaggcagagagtcgggctgccgtcgagggaactgtcgaggccggagcaacagtcgagagtacagcctgctag

SEQ ID NO: 23657 - DNA, 453 bp, Artificial Sequence
  Description of Artificial Sequence: Synthetic coding sequence
atgcgatcctgttgtgtggtccaggccggtctgcagctgcttgctagctccgaccctccatcttcggccagtcagtcagccaggatcactggtgtcaaccatcggaccccccctagagaaatcaagtccaataaaaccgtactgcacctggccgttcaagccgcaaatcctacccttgtccagctgctgctcgagctaccccgaggcgacctccggacgttcgttaatatgaaggcccacggtaacacagcattgcacatggcagctgcgctgcctcccggtccagcccaagaagccattgtgaggcaccttttggctgctggcgcagatccaacactccggaatctcgaaaacgagcagccagtccatctcttaagaccgggacccggaccagagggcctgagacagctattaaagcgctcacgcgtcgcgccacccggtctctccagctag

SEQ ID NO: 23658 - DNA, 1398 bp, Artificial Sequence
  Description of Artificial Sequence: Synthetic coding sequence
atgtgggtgtgcttgcgagggatcctcgacagtcaggccttttggcatgagactctgcgcaggtgggaatgtctcctggcagaaatgaaggtgtcccgaggcgagagatcccattgcccaacacagactgtcaagaagctgctggaggagcagcgccgacgacaacagcagcagccggacgccggaggagtgcagggccagttcttgcctccgccagaacaacccctcactccctccgtgaatgaggcggtgacgggccaccccccattcccagcccattccgagacagtaggctcggggccttcaagtctgggtttcccggactgggatcccaacacccacgccgcatatactgattccccctactcttgtcccgcttccgccgctgagaatttcctcccgccagatttttaccctcccagcgatcccggacagccatgtcctttccctcaaggcatggaggctggtccctggcgcgtgagcgcacctccaagtgggcctccccagtttcctgctgtggttccgggaccttctctcgaggttgccagagctcatatgctcgcgctgggccctcaacagctactggcccaggacgaggaaggagacacattgctgcatttgttcgcagcccgtggactgcggtgggccgcttatgctgccgcagaggtgctccaggtttaccgcagacttgacatcagggagcacaagggcaaaaccccacttctggtcgctgccgcagcaaatcagcccctgattgtagaggatcttctcaacctgggcgcagagcctaacgcggctgatcaccaaggcagatctgtgttgcatgtggccgctacttacggtctgccaggtgtcttacttgccgtgctaaactccggggtgcaagtcgacctggaggcaagggattttgaaggtttaactccgcttcacaccgccatcctcgcactgaacgtcgctatgcgtccgtcagacctgtgccccagagttttgagcacacaagctagggacagactggactgcgtgcatatgctcttgcagatgggcgctaaccatacttcgcaagagatcaagtctaataaaacggtcctgcacttggctgtgcaggcagccaacccaactcttgtccagcttctgttggagctcccacgaggggatttgcgcacattcgtgaatatgaaagcccatggaaacacggccttacacatggctgcagcactgcctccgggaccggcacaggaggctattgtgcgacacctgttagctgccggagctgatccaacattacggaacctagaaaatgagcagcccgtgcatcttctgcgaccaggcccagggcctgaaggtttgcgccaactcctgaagcgtagccgcgtggcacccccagggctgtcctcttag

SEQ ID NO: 23659 - DNA, 942 bp, Artificial Sequence
  Description of Artificial Sequence: Synthetic coding sequence
atggaggcaggcccatggcgggtgagtgctcctccttccggccctcctcaatttccagctgtggtgcccggaccgtctctagaagtggctagggcccacatgctggctctcgggcctcagcagttgttagcccaagacgaggagggggacacgctgctgcacttattcgctgctcgtggattgagatgggccgcttatgccgcagcagaagtactccaggtttaccggaggcttgacatccgggagcacaaaggcaaaacaccactgctggtagctgccgctgccaaccagcctctcatcgtggaggacctcctaaacttaggcgcagagccaaatgctgctgaccaccaggggagatcagtgttgcacgtggccgctacctacggcctccctggggtgctgctggccgtgctcaatagcggcgtccaggttgacttggaggccagagacttcgaaggtcttacaccactgcatactgccatactagcacttaatgtggcaatgaggcctagtgatctgtgcccacgagtcctatcaacacaggccagagatagactagactgcgtccacatgcttctgcagatgggcgcaaatcatactagccaggagatcaagagtaacaagacagtgctgcacctggccgtacaggctgccaaccccactctagttcaactgctcctggagttgcctcggggagatcttaggacgttcgtgaatatgaaagcacatggtaacaccgcattgcacatggcagctgcgttacctccaggccctgctcaggaggcaatcgtccgccacctgctggccgcaggcgctgatcctacactgagaaacctggagaatgaacagcctgtgcatctactgagaccaggtcctgggccagaaggcctgagacaactgctgaagcgatcacgcgttgctcctccaggccttagctcctag

SEQ ID NO: 23660 - DNA, 543 bp, Artificial Sequence
  Description of Artificial Sequence: Synthetic coding sequence
atgagacccctgacagaggaagagacccgggttatgttcgagaagattgccaaatatattggtgagaatctgcagcttctggtggaccgaccggacggaacttactgcttccggctgcataatgaccgggtctactacgtgtccgagaagatcatgaagctggcggctaatatttctggggataaacttgtgtctctgggcacctgttttggcaaatttactaaaacccacaagttcagactgcatgtgactgccctggactacctagccccatacgctaagtacaaggtgtggataaaaccaggggctgaacagtcattcctgtacggaaatcacgtgctaaagagcgggctgggccgaatcacggagaacactagtcagtatcagggggttgtggtctactctatggccgatattcccctcggcttcggggtcgcagccaagtccacacaagattgcagaaaggtcgaccctatggccattgtcgtgttccaccaggcggatattggtgaatatgtcaggcacgaggaaacactgacttag

SEQ ID NO: 23661 - DNA, 402 bp, Artificial Sequence
  Description of Artificial Sequence: Synthetic coding sequence
atgcggccattaacagaggaagaaactagggtgatgttcgaaaagatcgctaagtacatcggggaaaatctgcagcttctggtcgataggcccgatggcacatattgtttccgattacacaacgatcgcgtgtactacgtgtccgagaaaattatgaaacttgctgctaacatctccggggacaaacttgtgtccctgggtacttgttttggcaaattcacgaaaacacataagttccgcctgcatgtcacagctctggactatctggccccatacgccaagggattcggcgtggccgcaaagagcactcaggactgtagaaaggtcgatcccatggccattgtagtgttccaccaagctgacatcggagaatacgttcgccatgaggagacactcacatag

SEQ ID NO: 23662 - DNA, 249 bp, Artificial Sequence
  Description of Artificial Sequence: Synthetic coding sequence
atggccacttttccccctgcaacaagcgcccctcagcaaccgccagggcctgaggatgaggactcctcgttggatgaatccgacctgtattccctcgcacacagttacctcggcggaggcggacgaaaaggaagaacaaaacgcgaggcagccgcaaataccaacaggccctctccaggcggacatgagagaaagttagtaacaaagcttcagaacagcgaacggaagaaacgcggagcccgaaggtag

SEQ ID NO: 23663 - DNA, 303 bp, Artificial Sequence
  Description of Artificial Sequence: Synthetic coding sequence
atggcgaccttcccgcctgccacctcggcccctcagcaaccaccagggcctgaagacgaggatagcagtttagatgagtcggatctgtactctctggcccactcctaccttggtccgctgattatgccgatgccgaccagcccgctcactcctgcccttgttactggcggaggtgggcgtaaaggcagaaccaaaagggaagccgctgcaaacactaatcggccatctccaggtggacacgagcgcaagctcgtcactaaacttcagaactctgagcggaagaaaaggggcgctaggcggtag

SEQ ID NO: 23664 - DNA, 420 bp, Artificial Sequence
  Description of Artificial Sequence: Synthetic coding sequence
atgacgcactctctagtgtgccccgaaacagtttccagagttagcagtgtcctcaataggaacacacggcagttcggcaaaaagcaccttttcgaccaggatgaagaaacatgttggaacagcgaccaagggccatcccagtgggtcactctcgagtttccgcagcttatccgagtgtcccagcttcagatccagtttcaggggggattcagctctaggcgaggttgcctagagggtagccaggggactcaggccctccacaagattgtcgacttttatccggaggacaataactccttgcagacatttccaatccccgctgctgaggttgaccgcctcaaagttacgtttgaggacgctacagatttctttggccgagtcgtgatctaccacctacgggtgttgggcgagaaggtttag

SEQ ID NO: 23665 - DNA, 1740 bp, Artificial Sequence
  Description of Artificial Sequence: Synthetic coding sequence
atgaacactgccccatctaggccctcccccaccaggcgggacccctatggattcggcgacagccgtgatagccgcagggacagatcacctattagaggcagtccgaggcgggaaccgagagatggccgaaacggccgagacgcacgggattctagggacattagggatcctcgggatctgcgcgatcatcggcatagccgcgatttgcgcgaccacagagattcacgctccgtccgggacgtgcgggacgtgcgggacttgagagactttcgagacctgcgtgattctcgcgatttccgcgatcagagagatcccatgtacgaccggtaccgggatatgagagactccagggacccaatgtatcgcagggaagggtcctacgacagatacttacgaatggacgattactgcagaaggaaagatgactcatactttgatcggtaccgcgatagcttcgatggtcgcggtccacctggccctgagtcacagtctcgggcaaaagaaagactgaagagggaggagcggaggcgagaagaattgtatcggcagtacttcgaggaaatccagaggaggtttgatgccgagcggcctgttgactgctccgtgatcgttgttaacaagcagacaaaggattacgcagaaagcgtggggagaaaagtcagagacctgggaatggtggtcgatctcattttcctgaacactgaggtctccctgtctcaagccctcgaagacgtatcaaggggcggttctcccttcgctatcgtcataactcaacagcatcagatccatagatcatgcaccgtgaacatcatgtttgggacccctcaagaacatcgcaatatgcctcaagctgatgctatggtgctggtggcacggaactacgagcggtacaagaacgaatgtcgcgaaaaggaacgggaagagatcgccaggcaggcggctaaaatggctgacgaggccatccttcaggaacgcgagcgcggtggcccagaggagggagttcggggtggccacccgccagcaatacagtcactgattaacctgcttgcagacaataggtatctgaccgccgaagaaacagacaagataatcaattaccttcgggagagaaaggaacgcctgatgcggagcagcactgattcacttcctggacccatttcgagacagcctctcggcgctacaagtggggctagcctcaagacccagcccagctcccagcccttgcaatccggacaggtgctcccatcagctacacctactccctctgcgcctcccacctctcagcaggagctgcaggctaaaatactgtcactcttcaattctggcaccgtgacagccaactcatcttcagcgtcccccagcgtggccgcaggcaatacccccaaccagaattttagtaccgccgcaaatagccaaccacaacagcggtcacaggcatccggaaaccaaccacccagcattcttggccagggcggaagcgcccagaacatgggaccacggccaggagccccatcgcaagggctcttcggacagcccagtagtcgcctggctccagccagcaatatgaccagccaaaggcctgtatcctctacaggcattaacttcgacaaccccagtgtgcagaaggccctggataccctcatacagtctggccctgccctaagccatctggtgagtcagactaccgcccagatgggacagcctcaagcaccgatgggatcttaccagcgccattactag

SEQ ID NO: 23666 - DNA, 315 bp, Artificial Sequence
  Description of Artificial Sequence: Synthetic coding sequence
atgtacgacagatatagagacatgcgcgattctcgagaccccatgtacaggcgggaaggttcctatgacaggtacctccgcatggatgactactgtcggcgtaaagacgacagctactttgacagatatagggactcctttgacggccgtgggccacctggacccgagagccagtctcgagcgaaagaacgcctgaaacgggaagagagacgccgtgaagagttgtaccggcagtatttcgaggagattcagcggaggtttgatgctgagcggcctgtggattgcagtgtgattgtggtcaacaaacaaacttag

SEQ ID NO: 23667 - DNA, 1278 bp, Artificial Sequence
  Description of Artificial Sequence: Synthetic coding sequence
atgggtagcaaaatgaatctgatcgagcattcacacctccccaccaccgacgaatttagcttttcagagaacctatttggcgttctgaccgagcaggtggctggccctttggggcaaaaccttgaagttgagccctacagccagtatagcaatgtgcagttcccccaagtgcaaccccagatctcatctagttcatattactccaacctgggtttctatccccagcagcctgaggagtggtattcacccggaatatatgagcttaggaggatgccagctgagacactataccaaggcgagactgaggtcgctgagatgcccgtgacaaaaaagccgcgaatgggtgccagtgccggaagaatcaagggggacgaactgtgcgtcgtatgtggggacagggcgagcgggtatcactacaacgcccttacgtgcgaaggctgcaagggtttactaactgagattcagtgtaagagtaaacgcctccggaagaatgttaagcagcacgccgatcagactgtgaatgaggattccgagggccgagacctgaggcaggtcacatccaccactaaaagctgtagggagaagaccgaattaacaccagatcaacagacacttttgcactttatcatggacagctataataagcaacgaatgcctcaggaaataacgaacaaaattctgaaggaagagttctcagccgaggaaaactttctgatactgactgagatggctacaaatcatgttcaggtgttggtggaattcaccaaaaagctgcctggcttccagaccctggaccatgaagatcagatcgccctcctcaaaggttccgcagtggaagccatgtttctgagatccgccgaaatctttaacaaaaagctgcctagcgggcatagcgatctcctagaagagagaatcagaaattctggcatctccgacgaatatattacacccatgtttagcttttataaatccattggcgagcttaagatgactcaggaagagtatgccctcttaaccgccatagtgattctgtccccagatcggcagtatattaaagaccgcgaagcagtagagaaactacaggagcccctactggatgtgctgcagaaactgtgtaaaattcaccagccagagaacccgcagcactttgcttgtctactcggacgactgacagagctaagaacctttaaccaccatcacgccgaaatgctcatgagctggcgggttaatgaccataagttcacaccccttttgtgcgaaatttgggacgtccagtag

SEQ ID NO: 23668 - DNA, 1740 bp, Artificial Sequence
  Description of Artificial Sequence: Synthetic coding sequence
atggaggttaacgctggaggtgtgattgcctacatctcctccagctcatccgccagcagtccggcttcatgccatagtgaggggagtgagaattcctttcagagcagctcctcatccgtgcccagcagtccaaactcctcgaattccgacactaacggcaatccaaaaaacggggacttggctaacatcgagggaatactcaagaatgacaggatcgattgttccatgaagacgtcgaagagcagcgctcccggtatgactaagtcccactctggagtgacaaagttttctggtatggtgctcctgtgcaaggtgtgcggcgatgttgcttccgggtttcattatggggtgcacgcttgtgagggatgcaaaggcttcttccgacggagtattcagcagaacatccagtataagaaatgtctgaaaaacgagaactgtagtatcatgagaatgaatcggaatcggtgccaacaatgtcgttttaaaaagtgcttgagtgtcggcatgagtcgagatgccgtgcggttcgggagaataccaaaaagggagaagcagaggatgttaatcgaaatgcaaagcgccatgaaaacaatgatgaattcacagttctctggacacctgcagaatgacaccttagtggaacatcacgaacagacggctttaccggctcaggaacagctgaggccaaagcctcaactggaacaggaaaatatcaaatccagctcccctccgtcttccgactttgcaaaagaagaagttatcgggatggtgacccgcgctcacaaggatacctttatgtataatcaggagcaacaggaaaactccgccgaatcgatgcaaccgcagaggggggagcgaattccaaaaaatatggaacagtacaacctgaaccacgatcattgcggaaacggtctctcgtcccactttccttgttctgagtcacagcagcacttaaacggccagttcaaaggaagaaatattatgcactatccgaatggccacgccatttgtattgccaatggccactgcatgaacttctccaatgcttatacacaaagagtttgcgatcgggtgccaattgatggattctcacaaaatgagaacaaaaactcgtatctctgcaacactggaggaagaatgcacctggtctgccccctctccaaatccccttacgtggaccctcacaagtcgggccacgagatctgggaagagttctcgatgagttttacgcctgccgtgaaggaggtggtcgagtttgcgaagcgcataccagggtttcgcgacctaagtcagcacgatcaagtgaatcttcttaaagctggtaccttcgaagtgctcatggtgcgtttcgcttcactcttcgatgccaaggaacgtaccgttaccttcctgtccgggaaaaaatacagcgtggacgatctgcactctatgggggcaggagacctgctcaatagtatgttcgaattttcggagaaactcaatgctttacaactcagtgatgaagagatgtctctattcacagcagtggtgctggtttcagccgaccgaagtgggatcgagaatgtcaattccgtcgaggccctacaagagaccctcatccgggctctgcggactctgataatgaaaaaccacccaaacgaggctagcatttttacaaaactgttgctgaaactccccgatctccggagtttgaataacatgcattcagaagagttgttggccttcaaggtgcatccgtag

SEQ ID NO: 23669 - DNA, 1227 bp, Artificial Sequence
  Description of Artificial Sequence: Synthetic coding sequence
atggaggttaatgccggaggagtgattgcatatattagctctagtagtagcgcttcttccccagccagctgtcattctgaggggtccgaaaattcctttcagtcaagtagctcatctgtcccatcctcaccaaatagttcaaatagtgacaccaacggaaatcctaagaatggcgatttggccaatattgaaggaatcctgaaaaatgacagaatagactgctccatgaaaactagcaagtcctcagcccctgggatgaccaagagtcattccggcgttaccaaattttctggaatggtcctcctgtgtaaagtgtgcggagatgtcgctagtggcttccattacggcgtacacgcctgtgaaggctgcaagggtttcttcagaagatccattcaacaaaacattcagtacaaaaaatgtctgaaaaatgagaactgctctattatgcgcatgaatagaaatagatgccaacaatgtcggtttaagaaatgcttgtccgttggaatgtcaagagatgctgtccgcttcggtcgaatcccgaaacgtgaaaagcagcggatgctaattgaaatgcagtcggcgatgaagacaatgatgaattctcagttttctggtcaccttcagaatgacaccttggtcgagcatcacgagcaaaccgccctccccgctcaagaacagttacgccctaagcctcagttggaacaggagaacattaaatcatcatcccctcccagtagcgatttcgcaaaggaagaggtgatcggtatggtgacacgggctcataaggacacatttatgtataatcaggagcagcaggagaactccgctgagtctatgcagccccagagaggggagaggatacccaagaacatggaacagtataaccttaaccatgaccattgtggcaatggcttgtcatctcacttcccctgtagtgaatcccagcagcatttaaatggacagtttaagggaagaaatatcatgcactatcccaacggacatgccatttgcattgccaacggacactgcatgaacttcagcaacgcctacacacagcgtgtgtgtgatagggttcctatcgatggattcagccagaacgagaataagaactcctacctctgcaatacgggtggcagaatgcatctttacagcgtgcatatccaacccaaatttcaccagaagcaacagtaccataccattagctcgctgaatcacgaagtactttag

SEQ ID NO: 23670 - DNA, 1740 bp, Artificial Sequence
  Description of Artificial Sequence: Synthetic coding sequence
atggaagtgaatgccggaggggtaatcgcctacatcagtagttcctctagcgccagctcaccagcatcttgccatagcgaggggtccgagaacagttttcagtctagtagctcctctgtcccatcatccccaaatagcagcaacagtgatactaacggcaacccaaaaaacggtgatctggcgaacattgagggcatcctgaagaacgaccgcatcgattgctctatgaaaacatccaaatcatctgctcccggaatgaccaagtcacacagcggggtgaccaagttcagcggcatggtcctgctgtgcaaagtttgtggagacgtcgcgagtgggtttcactatggggttcacgcctgcgaggggtgcaagggtttcttcagaaggagtatccaacagaatattcagtataaaaaatgcttgaagaatgagaattgtagcatcatgagaatgaaccggaatagatgccagcaatgtaggtttaaaaaatgcctttcggtgggcatgtccagggatgctgtgcggttcgggagaattcccaagagggaaaagcagcggatgctcatcgagatgcagagcgccatgaaaacgatgatgaactcgcaattcagtggtcatctgcagaatgacacgcttgtggagcaccacgaacagactgccctgcccgctcaagagcagctgcgcccaaagcctcagcttgagcaggaaaatatcaaatctagctcgccgcctagctcggacttcgctaaggaagaagtgattggaatggttacacgcgctcacaaagacacattcatgtataaccaggaacaacaggaaaactccgctgagtctatgcaacctcaaagaggagaacgtatcccaaaaaatatggagcagtacaatctgaatcacgaccattgcgggaatggactgtcatcccacttcccgtgctccgagagtcagcagcacctcaacgggcaatttaaagggagaaacatcatgcactacccaaacgggcatgcaatttgtattgcgaatggccactgtatgaacttctccaatgcatacacccagcgcgtttgcgatagggtcccgatcgacggatttagccagaacgaaaacaagaattcgtatctgtgtaacaccggtggcagaatgcatttggtgtgccccctcagcaagtccccatatgtcgatccgcacaaatcaggacacgagatatgggaagaattctccatgagcttcacccccgcagtgaaagaggtcgtggaatttgctaaacgcatcccaggttttcgtgacctgtcccaacatgatcaagtgaatcttctgaaggctgggacttttgaagtgctgatggtgaggtttgcttctctgtttgacgcaaaggagcgcacggttacctttctgagtggcaagaaatactccgtcgacgacctccactccatgggcgctggggacctcctgaattccatgttcgagttttcagaaaaactgaatgcgcttcagcttagtgatgaggagatgtcactgttcactgccgtggtgctggttagcgccgacaggtctgggattgaaaatgtgaactcagttgaagcacttcaggaaacattaatccgtgcccttcgcaccttgataatgaaaaaccatccgaatgaagcatccattttcactaagttgttattgaagttgcccgatcttcggtcccttaataatatgcactctgaggaactcctagcctttaaggtccatccctag

SEQ ID NO: 23671 - DNA, 1449 bp, Artificial Sequence
  Description of Artificial Sequence: Synthetic coding sequence
atggtaatgcagttccaggggcttgaaaaccctattcaaatctctcctcactgtagctgcactccttcggggttcttcatggagatgatgagtatgaaacccgctaaaggggtgctcaccgagcaggtggccggacccttggggcagaaccttgaggtggagccctattcccagtacagcaacgttcagtttccccaggtgcagcctcagatctccagcagcagctattatagcaacctggggttctacccccagcagcctgaggagtggtatagtccaggcatctatgagttgcgaagaatgcccgcagagactctttaccagggcgagacagaagtggctgaaatgccagtgactaagaaaccacggatgggagcctctgcagggaggatcaagggagatgaactgtgcgtggtgtgtggcgaccgtgcatcaggataccattataatgcccttacctgcgaaggctgcaaggggtttttcaggaggtctatcaccaagaacgccgtgtacaagtgtaagaatggcggaaactgcgtaatggatatgtacatgcgcagaaagtgtcaagaatgtcgactgagaaagtgtaaagagatgggtatgctagccgaatgtctcctgactgagattcagtgcaaatcaaaaaggctgagaaaaaatgtcaagcagcatgccgaccagactgtgaatgaagactccgagggaagagacctccggcaagtgacttcgaccacaaaatcctgcagggaaaagaccgagctcacacctgaccagcaaaccctcctccatttcatcatggattcgtacaacaagcagagaatgccccaggaaatcacaaacaagattctcaaggaagagttctcagctgaagaaaacttcctcatattgaccgaaatggctacaaaccatgtgcaggtcctggttgagttcactaaaaagcttccaggattccagacgcttgaccacgaggatcaaattgctctgctcaaaggctcggcagtggaagcaatgtttctgcgatcagctgagattttcaacaaaaagttgcccagcggccactctgaccttctggaagaacgcatcagaaatagtggcatctctgacgaatatatcacccccatgttctctttttacaagtcgatcggcgagctgaaaatgacgcaagaggaatatgctcttcttactgctatcgtcattctgagtcccgacagacagtacattaaagatcgagaggccgtcgagaaactccaggagcccttattggacgtgttgcagaaattgtgcaagatccaccaacccgagaatccccaacacttcgcctgcttactcggcagattgaccgagttgcgcactttcaatcaccaccatgccgagatgcttatgtcatggcgggtgaatgatcacaagtttaccccactgctgtgcgaaatctgggatgtacagtag

SEQ ID NO: 23672 - DNA, 1431 bp, Artificial Sequence
  Description of Artificial Sequence: Synthetic coding sequence
atgggctctaagatgaacttaattgaacatagccacttacctacaactgatgagttttcgttctccgagaatctgtttggggtgctaactgaacaggtcgcaggcccactcggccagaaccttgaggtagagccctattctcaatactccaatgtccaattcccacaagtgcagccacagatctctagcagttcatattactctaacctgggcttctacccgcaacagccggaagagtggtacagccccggtatctatgagcttcgccgtatgcctgccgagactctgtatcagggagaaaccgaggtggccgaaatgccagttactaaaaaacctagaatgggggcttcggccggtcggatcaagggcgatgagctatgtgtggtgtgcggggatagagcttctggctaccattacaacgctttaacttgcgagggttgcaaggggttctttagacggtccataacgaagaatgctgtctataagtgcaagaacggcggaaactgcgtgatggacatgtacatgcgaaggaagtgtcaagagtgccgacttcgcaaatgtaaggagatgggcatgctggcggaatgtatgtataccgggctgctgacggagatccagtgtaagtctaaacgccttcggaagaatgttaagcagcatgcagatcagaccgttaacgaagatagcgagggccgtgatctgaggcaagtcacctccacaaccaagtcctgcagggaaaaaactgaattgaccccagaccagcagacccttctgcattttatcatggattcttacaataagcagagaatgccccaagagatcactaataagatcctaaaggaggaatttagcgcagaggagaatttcctcatacttacggagatggccaccaatcacgtgcaagtcttggtggaatttaccaaaaagttacccggttttcagaccctggatcacgaggatcaaatagctcttcttaagggcagtgctgttgaagcgatgtttctgcgcagtgccgaaattttcaacaagaaattaccctcgggacatagtgacttgcttgaagaacggatcagaaatagcgggatctctgatgagtatatcactcctatgttctctttctacaagagcatcggagagcttaaaatgacccaagaagagtacgccttgctgacggctattgtcatcctgagccccgatcgtcaatatatcaaggatagagaggctgtcgagaagcttcaagagcccctgctagacgtcttacagaagctgtgtaagattcaccagccggaaaacccgcaacattttgcttgcctactagggagactgacagagctccgaacttttaatcaccaccatgcagaaatgctcatgagctggagggtgaatgaccacaagttcacaccactgctgtgcgagatttgggatgtgcaatag

SEQ ID NO: 23673 - DNA, 1419 bp, Artificial Sequence
  Description of Artificial Sequence: Synthetic coding sequence
atgggctctaaaatgaacctcatcgagcactcacacctgcctactaccgatgaattttcctttagcgagaacttgtttggcgtgttaaccgaacaggtggctgggcctctgggacagaacctggaggtcgagccttatagccagtactccaacgtccagtttccccaggtccagcctcaaatcagctccagcagttactattccaatctgggtttttatccacaacagcccgaggaatggtacagccccggtatctacgagttacgcagaatgccagccgaaaccttataccagggggaaacagaagttgcggagatgcctgttacaaaaaagcctcgcatgggggcaagcgccggacggatcaagggggatgaactttgcgtggtatgcggagaccgcgctagtggatatcattacaatgcactcacgtgcgaaggatgtaaagggtttttcaggaggtccatcacaaagaatgcagtgtataagtgcaaaaatggaggaaattgtgtgatggatatgtatatgcgtcgaaaatgtcaagagtgcagactccgcaagtgtaaagagatgggcatgctggcagaatgtttactcactgagatacagtgcaaatccaaacgactccgcaagaacgttaagcagcacgccgatcaaactgtcaacgaagattccgaaggccgtgatcttagacaagtcacctctactaccaagtcctgtagagagaagactgagttgactcctgatcagcagacattactccacttcatcatggattcatataataaacagaggatgccccaggaaatcacgaacaagatcctcaaggaagaattttccgccgaggagaacttcctgatcttgaccgagatggctactaatcacgtccaggtgttagtggagttcaccaagaaattaccaggattccagaccctggaccatgaggaccagatagcactgctaaagggcagcgccgtggaggcaatgttcctgcgttctgcggaaatattcaacaagaagctcccttctgggcactcagacctgctcgaggaaagaatcaggaacagtgggatttccgatgaatacatcacccccatgtttagtttttataaatccattggagaactcaagatgacacaggaagagtatgcccttttaacggcgatcgtcatcctcagtccagacaggcagtatattaaagatagggaagccgtcgagaagctgcaggagcccttgcttgatgtgttacaaaaactgtgcaagatccatcagcctgagaacccccagcatttcgcctgcttactgggcagactaactgaactccgtacttttaatcaccatcatgccgagatgttaatgtcgtggcgggtgaacgaccataagttcacgcccttgctatgcgagatctgggacgtccagtag

SEQ ID NO: 23674 - DNA, 1461 bp, Artificial Sequence
  Description of Artificial Sequence: Synthetic coding sequence
atggtgatgcagtttcaggggctcgagaaccccatccaaataagcccccattgttcctgtaccccctccggttttttcatggagatgatgtcaatgaaacccgctaaaggtgttctgaccgaacaggtcgcaggaccccttggacagaacttggaggtggaaccctattcccagtacagcaacgttcagttcccacaggtgcagccccagataagctcttcaagttactatagcaacctgggcttttaccctcagcagcctgaggagtggtactctcccggaatctacgaacttcgccgtatgccagccgaaaccctgtaccaaggagagacagaagtggctgaaatgccggtgacgaagaagccccgtatgggcgcttctgccggacggattaaaggagatgagctgtgcgttgtctgcggcgatcgggcaagtggttaccactacaacgctctgacatgtgaagggtgcaaggggttcttcaggcgcagtatcacaaaaaatgctgtttataagtgtaagaatggaggaaattgtgtcatggatatgtatatgagaaggaagtgccaggaatgtcgtcttagaaagtgcaaagaaatggggatgcttgcggaatgcatgtatactggactcctgaccgaaatccagtgtaaaagcaagagattacggaagaatgtaaagcagcatgctgatcagacagtcaatgaggacagcgagggtagagatctccggcaagtcacctccaccaccaaaagctgcagagaaaagacagaactcactcccgaccagcagacactcttacacttcatcatggacagctataacaaacagcggatgccccaggagatcacgaataaaattctgaaggaggagttctcggctgaagaaaattttctgatcctaaccgaaatggcaactaatcacgttcaggtgctcgtggagttcacaaagaagctgccgggattccaaacactggaccacgaggatcaaatagctctactaaaggggagcgctgtggaggccatgttcctcagatccgccgaaatttttaacaagaaactcccctcaggacattctgacttactcgaggaaaggatcagaaactcaggaatctccgacgagtatattacccccatgttttctttttataagtcaattggtgagctgaagatgacacaggaagagtatgccctgcttacagccatcgtaatcctgagcccggatcgccagtatattaaggatcgcgaagccgtggagaaactccaggaacccctgctcgacgtgttgcagaaactgtgtaagatccaccaaccagagaatcctcaacactttgcctgtctcctggggagactgaccgagctgcgcacattcaaccaccaccacgcggagatgctgatgtcttggcgagttaatgaccacaagtttacacccctcctctgtgagatctgggatgtccagtag

SEQ ID NO: 23675 - DNA, 1074 bp, Artificial Sequence
  Description of Artificial Sequence: Synthetic coding sequence
atggcgtcgagggaggacgagttgcgcaattgtgtagtgtgcggcgaccaggctacgggttaccattttaatgctttgacttgtgaggggtgtaaaggattcttccgccgtacagtatctaaatctattgggccaacatgcccatttgccggatcatgcgaagtctctaaaacccagagaaggcattgtcctgcttgtcgcttacagaagtgcctggacgcgggaatgcgtaaagacatgattctctcagccgaggccctggccctccgtagagcaaagcaagcccaacggagagcgcagcagacgcctgtgcagttaagcaaggagcaggaagagctaattcggacgctccttggcgctcatacaagacacatgggaactatgttcgagcagttcgtgcaattcagaccccctgcccatctgtttatccaccatcaacctcttccaacccttgccccagtgttgcctctggtgactcatttcgctgatattaacacatttatggtgctgcaggtaataaagttcaccaaagacctgcctgtgttcaggtccctcccgatagaggatcagattagcttgttgaagggcgcagccgtggagatttgtcacatcgttctgaacaccaccttttgtctccaaacccagaattttctgtgcggacctctgcgatacactatcgaggatggggctcgcgtgtcccccactgtaggattccaggttgagttcctggaactcctctttcatttccatggcacgctccggaagctgcagctgcaggagcctgagtatgttttgcttgctgccatggcgctatttagtcccgctccctacctaactgatagaccaggggtgacccagcgggatgagatcgaccagttgcaggaagaaatggctctgacattgcagagttacatcaaaggacagcagcgtcgccctagagataggttcctttacgcaaagctgttgggcttactagcggagctacggagcattaacgaagcctacgggtatcagatccaacacatccagggtctttctgccatgatgcctcttctgcaagaaatttgtagttag

SEQ ID NO: 23676 - DNA, 1074 bp, Artificial Sequence
  Description of Artificial Sequence: Synthetic coding sequence
atggcatctagggaggatgagttgcggaactgtgtggtgtgcggggatcaggccaccggttatcattttaatgctctgacgtgcgagggttgtaaaggtttctttaggaggacggtgagcaagagtattggaccaacctgccctttcgccggttcatgcgaggtctctaagacgcagaggcgccattgcccagcctgcaggctccagaaatgcctggacgcaggcatgcgaaaggacatgatactgtccgcagaagccttggcactgcggagagccaaacaagcacagaggagggcccaacagacacccgtgcaattaagtaaggaacaggaggaactgatccgtaccctcttgggagctcacacgagacacatgggcacgatgtttgagcagttcgtccagttccgcccacctgcccatctgtttatccaccaccagcctcttcctacgctcgctcccgtcctcccccttgtgacccatttcgctgatattaacaccttcatggtgctgcaagtgattaagtttactaaagacctgccggtgtttcgtagcctaccaattgaggaccagatcagtctcctgaaaggggctgctgtagagatctgtcacatcgtcttgaacaccacattttgcctgcaaactcaaaacttcttgtgtggccctctcaggtacacaatcgaggatggcgcacgagtatccccaactgttggctttcaagtcgaatttctggagctactatttcactttcatggcaccttacgtaagctgcaactgcaggagccagagtatgtattgctggctgccatggccctgttcagtcctgcgccttatctcactgatcggcctggtgtcacccagagagacgagatagaccagctgcaggaagagatggccctgaccctccagagttatattaaggggcagcagcgcaggccacgcgacaggttcctatacgccaagctgctgggccttctggcagagctgcgcagcataaacgaggcctacgggtatcaaattcagcacattcaagggctgagtgccatgatgcctcttctccaggagatctgcagctag

SEQ ID NO: 23677 - DNA, 975 bp, Artificial Sequence
  Description of Artificial Sequence: Synthetic coding sequence
atgctgcctaaaagaagccggaggaccgtgagcaaatccattggacccacgtgtccttttgctggaagctgcgaggtgtcaaagacccagcgcaggcattgcccagcatgtaggctgcagaaatgcctggacgccggaatgcgcaaggatatgatcctttctgccgaggcgctggccctgcgcagagcgaagcaggcccaaaggcgggctcagcagacccccgtccagctgtctaaggaacaagaggagcttattcgcaccctgttaggcgctcatacccggcacatgggtactatgttcgaacaatttgttcagttcagaccgcctgctcacctttttatccaccatcagccattgcctaccctggcccctgtattaccgttggtaactcattttgccgacattaacactttcatggtccttcaggtgattaagtttactaaggatcttcccgtttttcgttctttaccaatagaggaccagattagcctccttaaaggcgctgccgtggaaatatgtcatattgtgctgaacaccaccttctgcctccagactcagaactttttgtgcgggccactccggtacacaatcgaggatggagccagagttggcttccaagtcgagttcttagaactgctgttccatttccatggcacactgaggaagctccagctgcaagaacccgagtatgtattgttggccgcaatggctcttttttctcctgcaccctaccttacagaccggccaggtgtgacccaacgcgacgagatcgatcagctgcaggaggagatggccttgacccttcagtcctacatcaaagggcagcaaaggcgacctcgggataggtttctatacgctaagctgctgggcctcctagccgaactcaggtcaataaacgaagcgtatgggtatcagatccaacatattcagggactatccgccatgatgccccttctgcaggagatatgttcctag

SEQ ID NO: 23678 - DNA, 1059 bp, Artificial Sequence
  Description of Artificial Sequence: Synthetic coding sequence
atggcctctcgcgaagacgaattgaggaattgcgtagtctgcggggaccaggctacagggtatcacttcaatgccttaacttgtgagggttgcaaaggattctttcgaagaaccgtgagtaagtccattggacctacctgtccatttgcgggaagctgcgaagtatcaaagactcaaagaagacactgccccgcatgccgactccagaagtgtttggatgcaggcatgcgtaaagatatgatcttgtctgcggaggccctggctttgcgtagagccaaacaggcccagagaagagcacagcaaacccctgtccagctcagcaaggagcaggaagaactgatacgaaccctgctgggggcacatacccgacatatgggcacaatgttcgagcagtttgttcagttcagaccccctgcccacctattcattcatcatcagcctttgcctacattggccccagttctgcctcttgtgacccacttcgccgacataaatacctttatggtacttcaggtcatcaaatttacaaaagatctgcccgtgtttagaagcctccccattgaggaccagatttccctactgaagggcgctgcagtggaaatctgtcatatcgttctgaacacaaccttctgcttgcagacgcagaacttcctctgcgggccattgcgctatactattgaagacggagccagagtctcccccacagtgggatttcaagtggagttcctagaactgctttttcattttcacggaacgttgcgcaagctgcagctgcaagaacccgagtacgtcctgctcgccgctatggctctcttctctccagacaggcctggagttacccagagagacgaaattgatcagcttcaggaagaaatggcactcacccttcagagttacatcaaaggacagcagcggagaccgagggaccgatttctgtacgcaaagctgctgggtctgcttgcagaacttcgatctataaatgaagcatacgggtatcaaattcagcatattcagggcttgagcgccatgatgcctttgcttcaggagatctgcagctag

SEQ ID NO: 23679 - DNA, 1047 bp, Artificial Sequence
  Description of Artificial Sequence: Synthetic coding sequence
atggcctcccgagaagatgaattaaggaactgtgtcgtgtgcggagatcaggcgaccgggtaccatttcaacgcactgacttgtgaagggtgtaagggattttttcggcgtactgtgagcaagagtatcggccctacttgtccttttgctggcagttgtgaagtgagcaagacccagcggagacactgccctgcgtgtaggctccagaaatgcctggatgctggaatgaggaaggacatgatcctgagcgccgaagcactcgcccttcgccgagccaagcaggcacaaaggagggctcagcaaacgcctgttcagttgtcaaaagagcaggaagaactcatcaggaccttgctgggcgcacacactcgccatatgggcacaatgtttgagcaattcgtgcaatttaggcctcctgcccacctttttattcatcatcagcccctcccaacactggccccagtcttgcccctggttacacatttcgcggatatcaataccttcatggtcttgcaggtgatcaaatttaccaaggatttaccagtgtttcgatcattgcctatcgaggatcagattagcctattaaaaggtgcagcagtggagatttgtcacatcgtgctgaatacgacattttgtctgcaaacacagaacttcctctgtggccctttacggtatactatcgaagatggtgccagagtgggcttccaggtagaattcctggagctcttattccattttcacgggaccctcaggaagctgcagcttcaggagcctgaatacgtgctgctggctgcgatggcactgttctctcctgaccggcctggagtaactcagagggacgaaatcgaccagctgcaggaggagatggccttgactctccaatcatacattaaaggccagcaaagacgccctcgcgacaggtttctttatgctaaacttcttggcctgctggcggaactgaggtctatcaatgaggcctacgggtatcagattcaacacatccaagggctctccgcaatgatgcctcttctgcaagaaatctgttcttag

SEQ ID NO: 23680 - DNA, 930 bp, Artificial Sequence
  Description of Artificial Sequence: Synthetic coding sequence
atggccagcagagaggatgaacttagaaattgcgttgtctgcggggaccaggcaacaggctaccactttaatgctctgacctgtgaaggctgcaaaggcttcttccgtagaactgtgtcaaagagcatcggaccaacctgtccgttcgccggtagctgcgaggtgagcaagactcagcggaggcactgtccggcttgtcggcttcaaaaatgtctcgacgccggaatgcggaaggacatgattctcagcgccgaggccctcgcccttcgtagagcaaagcaagcgcagagaagggcccaacagactccagtgcagctctcaaaggagcaagaggagcttataaggaccctgttgggggctcacacaaggcatatgggaacaatgttcgagcaatttgttcagttccgtcctcctgcccacctatttatacaccatcaacccctccccactctagctccggtactgccgctggtcactcacttcgccgacatcaacacatttatggttctgcaggtgattaaattcacgaaagacctccctgtgttccgctctctgccgatcgaggaccaaatctctctgctcaaaggcgctgccgtggagatctgccacatcgtgctgaacaccacattttgcctgcagacacagaatttcctgtgtggaccactccgctacaccatagaagatggcgcacgggatcgccctggtgtgacccagagagacgagattgatcagctccaggaagaaatggccctgactctgcaaagttacatcaagggccaacagaggaggcctagggacagatttctgtatgcgaaattgctgggtctgctcgctgagctacggtctatcaatgaagcatatggctaccagattcagcacatacaaggactcagtgccatgatgccgctgttacaggagatctgctcatag

SEQ ID NO: 23681 - DNA, 945 bp, Artificial Sequence
  Description of Artificial Sequence: Synthetic coding sequence
atggcgtctcgagaggacgaactgcgcaactgcgtagtctgcggcgatcaggccaccggatatcactttaatgctttgacgtgcgaggggtgtaagggtttctttagacgaactgtgtctaagagcatcggccctacctgtcccttcgcgggatcctgcgaggtaagcaagactcaacgacgacactgccccgcttgccggctgcagaaatgcctcgacgctggcatgcggaaagacatgatacttagcgctgaggctctggcacttaggcgtgctaagcaggctcagaggcgggcacagcagactcccgtacagctgtccaaggaacaggaggagctaatcagaaccctcctcggggctcacacacgccacatggggaccatgtttgaacagttcgttcagttccgtcctcctgcacacctttttatccaccatcagcctctgccgacgttagccccagtgctccctcttgtgacccactttgccgacataaacactttcatggttctgcaagtgatcaaattcaccaaggacttaccagtgtttcgatcgctcccaatcgaagatcagattagtctgttgaagggcgcagcagtcgagatatgtcacattgttctcaacacaactttctgcctccagacgcagaacttcctgtgtggaccactgaggtatacaatagaagatggtgccagagcgccttaccttacagaccgcccaggtgtcacacaacgggatgaaatcgatcagttacaggaggaaatggccctgactcttcagagctacattaaaggacagcaacggcgtccccgagaccgttttctgtatgcaaagctgcttggcctccttgccgaattgcgatcgattaacgaagcatatggatatcaaattcagcatatccagggcctgagcgccatgatgcccttgctccaggagatctgttcctag

SEQ ID NO: 23682 - DNA, 948 bp, Artificial Sequence
  Description of Artificial Sequence: Synthetic coding sequence
atgctcccaaaaagatcacgacgaaccgtgagcaagtctattgggccaacgtgtcctttcgccggatcttgcgaagtatcaaaaactcagaggaggcactgccctgcatgccgccttcagaagtgcctggacgctggcatgagaaaagacatgattctgtcggcagaggccctggccctcaggcgagcaaagcaggctcaacgccgagcccagcagaccccagtccagttgtctaaggagcaggaggaacttatccgcacactcctaggagcccacacacggcacatggggacaatgttcgagcagttcgtccagttccgacctccagcccatcttttcattcaccatcagccacttcctacgctggcccctgtgttacctctggtgacgcacttcgccgatatcaacaccttcatggtgctgcaagttataaaattcaccaaggacctgcccgtcttcaggtcgctgcccatagaggaccaaattagcctgctcaaaggtgccgctgtcgagatatgtcatattgttctgaacacaaccttttgccttcaaacccaaaatttcctatgcggtcctttgaggtacacgattgaagatggcgcacgtgtctctcccactgtgggattccaagtggagtttctggaattactgttccactttcacggaactcttcgcaaactgcaactccaggaacccgaatacgtactcctcgcggctatggctttatttagtccagccccataccttactgaccgaccgggagtcacacagcgcgacgaaattgaccagttgcaggaggagatggccttgaccttgcagtcctatatcaaagggcagcagaggcggcctcgagaccgtagccctggtactccatggatccactggagtggcaagatgttagggcctaagattggccctgggagcaagggcgctcagtggctgcagtag

SEQ ID NO: 23683 - DNA, 1023 bp, Artificial Sequence
  Description of Artificial Sequence: Synthetic coding sequence
atggcgtcgcgggaagatgagctgcggaattgtgtcgtctgcggtgatcaggcaactggataccactttaatgctttaacctgtgaggggtgtaaaggatttttcaggcggacggtgtcaaaatccattggacctacatgtccttttgccggaagctgcgaggtgtctaaaacccagcggcgtcattgtccagcctgtcggctgcaaaaatgtcttgacgcaggaatgaggaaagacatgatcctgtccgctgaagcacttgccctgcgacgtgctaagcaagcccagcgaagagctcaacaaacccctgtgcaactttcaaaggaacaggaggaactgatccgcacgcttcttggggcacatactcgccacatgggtacgatgttcgagcagtttgtgcagttccgccctcccgcacatctgtttattcatcaccagccactgcctacgctagcccctgtgctcccactggttacccactttgccgacatcaacacatttatggtgttacaagtcatcaagttcactaaggatctccctgtttttcggtctttgcctatcgaggaccagatcagcctcctgaagggggctgcagtggaaatctgccacatcgtgctcaatacgacgttctgcctccagacccaaaactttctttgtggtccattacggtataccatcgaggatggagccagggtaggtttccaggtggagtttctcgaattgttgttccacttccatgggaccttaagaaagttgcaattacaggagcccgagtacgtactacttgctgcaatggcactgttttccccagccccatacctgacagataggccgggtgtcacccagagagacgaaattgatcaactgcaagaggaaatggcgctaacgcttcagtcctacatcaaaggccagcagaggcgccctcgagatagaagcccaggtaccccctggatacactggagtggaaagatgctgggcccaaaaattggccctgggtcaaaaggcgctcagtggcttcagtag

SEQ ID NO: 23684 - DNA, 921 bp, Artificial Sequence
  Description of Artificial Sequence: Synthetic coding sequence
atgctccctaagagaagtagaaggaccgtcagtaagtccatcggccctacctgcccctttgccggaagctgtgaggtgtcaaaaacacaacggagacactgtccggcatgtcggcttcaaaaatgtttggatgcgggaatgcggaaagatatgatcctgtctgccgaagcattggccctacggagagcaaagcaggcccagagaagggcccagcaaaccccagtccagctgtctaaggaacaagaggagctgattcggactctcctgggtgcacatacacgacatatgggcactatgtttgagcagttcgtgcagtttagacccccagctcatctgttcatccatcaccaaccacttccgacgttagccccagttttgcccctggttacacatttcgccgatattaacacattcatggtgttgcaagtgattaaatttacaaaagatcttcccgtttttcgctctctgcccatcgaagatcagatttcactcctgaagggagcggcagtcgagatttgccatatagtgctcaacaccacattttgcttacagactcagaacttcctctgcggccctctgagatacactatcgaggatggggctcgggtgggctttcaagttgagtttttagaactgctcttccactttcacggaaccctccggaaactgcagctgcaggaaccagaatatgtactattggccgctatggcactcttcagtcccgacaggccaggagtgactcagagggatgagatcgatcaattgcaggaagagatggccttaactctgcagagctatattaagggccagcaaagaaggcctagagatcgttctccgggaaccccttggattcactggtcaggaaaaatgctcggtcctaagattgggcctggcagcaagggtgctcagtggctgcaatag

SEQ ID NO: 23685 - DNA, 1020 bp, Artificial Sequence
  Description of Artificial Sequence: Synthetic coding sequence
atggccagccgagaagacgaattgcggaactgcgttgtgtgcggcgaccaggctacaggttatcactttaacgccctgacgtgtgagggatgcaaagggttctttcgcagaaccgtgtctaaaagtatcgggcctacttgcccatttgccggatcttgcgaagtttccaaaactcagcgtcgtcattgtccagcatgccgtctgcaaaagtgtcttgatgccggtatgaggaaagatatgatccttagcgccgaggcattggccctccgccgagctaagcaggcccagagaagggcccaacagactcccgtgcaattgtccaaggagcaagaggagctgatacgcacgctactcggagcacacactaggcacatgggcactatgtttgaacagtttgtgcagttcagaccacctgcacatctgtttattcaccatcagccccttccaactctagcacctgtgctacctttggtgacacactttgcggacatcaacacctttatggtgctccaggtcatcaagtttaccaaggacctcccggtgtttagatcactgcctatcgaggaccagatcagcctgttgaagggtgctgctgtggagatctgccacattgtgttaaatacgaccttctgcttgcaaacccaaaacttcctctgtggccctctgcgctataccattgaagacggagctagggttagccctaccgttgggtttcaggtggagttcctagaactgctgtttcatttccatggtaccctgcgcaagctgcagctgcaggagccggagtatgtcctgctggcggcaatggccctgttttctcctgatcgacctggtgtcacccagagagacgagatagaccaattgcaagaagaaatggcacttactctgcagtcttacatcaaagggcagcagaggcgacctcgggacagatctcccggtactccatggattcattggtcaggcaagatgttgggccctaagattgggcctgggtctaaaggcgctcaatggcttcaatag

SEQ ID NO: 23686 - DNA, 360 bp, Artificial Sequence
  Description of Artificial Sequence: Synthetic coding sequence
atggctagccgtgaggatgagttgaggaactgcgtcgtgtgtggtgatcaagccactggatatcactttaacgccctgacctgtgaggggtgtaagggcttctttaggaggaccgtgagcaaaagtatagggcctacctgcccctttgccggttcttgcgaagtctccaaaacccagaggcggcactgcccggcttgtagactgcagaagtgtctggacgccggaatgcgtaaggataccagcagctcttcggtgcatccaagccccgctcttgcccaccccggtccttgcgctgcgagtggccatacgctgcgtcggcatcaacattttcacgggaccgcaagccatcaggtttactag

SEQ ID NO: 23687 - DNA, 444 bp, Artificial Sequence
  Description of Artificial Sequence: Synthetic coding sequence
atggccagtagagaggatgagttaagaaattgcgttgtttgtggcgatcaggccaccggttatcatttcaatgcgctgacatgtgagggctgtaaggggttcttccgcagaaccgtgtcaaagtctattgggcctacatgtccatttgctggcagctgcgaagtgtctaagacacagcggagacactgcccagcgtgccgccttcagaaatgtttggatgccggaatgaggaaagacataccatgcccccttaagacgcgcagtcctttctctagggaacagctttggaaaagtgttacctcatactccatccccctctctgtctcgaaacataagacttccagtgccggtctttttgctacgcaactaaaaatggagccagtcacagacctcgaacttccccgagagatgcgtctgatttcgtgcaaacgcagatggcattag

SEQ ID NO: 23688 - DNA, 843 bp, Artificial Sequence
  Description of Artificial Sequence: Synthetic coding sequence
atgcttccaaagcgctctcgcagaactgtaagtaaaagtattgggccaacatgccctttcgctggttcctgcgaagttagtaagacacagagaagacactgtcctgcttgtagattgcagaagtgtctggacgccggaatgcgtaaagatatgattctgagcgctgaggccctagcacttcggagagccaagcaggcccagcggagagcgcagcaaactcccgtacagctgtctaaggaacaggaggaactgatcaggaccttgctgggagcccatactcgtcatatgggcacaatgtttgaacaatttgtacaatttaggcctccagctcatctattcatacaccaccagcctttgcccaccttggcccctgtccttcccctggtcacacattttgccgatatcaacacattcatggttctgcaggtcattaagttcactaaagacctccccgtgttccggtctcttccaatcgaggatcagatttctctactgaaaggtgccgctgtcgagatatgccacattgttctcaacactactttttgccttcagacccagaactttctctgcggtccactcaggtatacaatcgaggacggcgctcgagatcgcccaggggtgacccagcgagacgagatcgatcagctgcaagaggaaatggccctgaccctgcaatcttatataaagggccagcagcgtcgtcctcgtgatcgctttctgtacgcaaagcttctgggtttgttggccgagctccggtccatcaacgaagcctacggataccaaatacaacacatccagggactctccgctatgatgcccctgctgcaggaaatctgttcttag

SEQ ID NO: 23689 - DNA, 891 bp, Artificial Sequence
  Description of Artificial Sequence: Synthetic coding sequence
atggctagcagagaggacgagctgaggaattgtgtcgtatgtggcgaccaggcaacgggctatcactttaacgctctgacttgcgagggctgcaagggtttcttccgcagaaccgtttccaagagtataggtcctacgtgcccttttgcgggtagttgcgaggttagcaagacgcagagacggcactgtccggcatgtcggctgcagaagtgtttagacgctgggatgaggaaggacatgattttgtcagcagaggctcttgcactgcgcagggctaagcaagctcagaggcgcgctcagcagacaccagtgcagctgagcaaggaacaggaagaactaattcgtacgctgctcggggcacacacccgtcacatggggactatgtttgagcagtttgtacaatttcgcccacctgcgcatttgttcatccaccatcaacctttgcccacacttgctcccgttctcccactggtcacacactttgccgatatcaacactttcatggtgctccaagtgatcaagtttactaaggatctcccagtgttccgctccctgcctattgaagatcagatctctctgcttaagggcgcagctgtggagatatgtcacatagtgctgaatacaactttttgtctgcagacacagaatttcctctgcggccctctgcggtacacaatcgaagatggggcacgcgatcgaccgggagttacacagcgtgacgagattgatcagctgcaagaagaaatggctctcaccctgcagtcatacatcaagggccagcagcgcagacccagggatcggagtccaggaacgccatggatccattggtctggaaaaatgctggggcctaagatcgggccaggttccaagggcgcacagtggctccagtag

SEQ ID NO: 23690 - DNA, 825 bp, Artificial Sequence
  Description of Artificial Sequence: Synthetic coding sequence
atgcttcctaagaggagcagaagaacagtgtcaaagtcaataggacccacatgtccatttgcgggaagctgtgaggtcagtaagacgcagcgccgacactgtcccgcttgcaggttacagaaatgcctcgacgccggaatgagaaaagacatgatactgtccgccgaagctctcgcccttcggcgagccaaacaggctcaaagacgggctcagcagacaccagtgcagttatcaaaagaacaggaggagttgattagaacattactcggggcacatacgcgacatatgggaacaatgttcgaacaatttgtacagtttcgccctccagcccacctgttcatccaccaccagcctctacccacacttgcacccgtattgcccctggttacacatttcgccgatataaacacattcatggtattgcaagtgattaagttcaccaaagacttaccagtgttccggtccctgcccattgaagaccaaataagccttctaaaaggagcagctgtggaaatctgccacatcgtgctgaataccactttttgcctgcagactcagaattttctatgcggccctctccgatataccattgaggatggcgcacgggtgtctcccacggttggttttcaagtggagtttctcgagctactgtttcactttcatggaactctgcggaaactgcagctccaggaaccggaatatgttctgcttgctgcaatggccctcttcagtccaggagaacacctgcccaaacctcgtgctttctgttgcactaccagcgctcagattctctctagcctatccccaagtacccaggcgttttag

SEQ ID NO: 23691 - DNA, 273 bp, Artificial Sequence
  Description of Artificial Sequence: Synthetic coding sequence
atgctgccaaagcggtctaggcggacagtaagcaagtccattggacccacatgcccatttgcaggttcttgcgaggtgtctaagacccagcggaggcattgcccggcatgtcgactgcagaaatgtctggatgctggcatgagaaaggataccagctcatcatccgtgcacccaagcccagccttggcgcatccaggaccctgcgccgctagcggccacaccctccggaggcaccagcatttccacggaacagcctcccaccaggtgtattag

SEQ ID NO: 23692 - DNA, 357 bp, Artificial Sequence
  Description of Artificial Sequence: Synthetic coding sequence
atgttgcctaagagaagcaggcggactgtctcaaaatcaatcggcccaacgtgcccctttgcgggttcttgcgaggttagcaaaacccagcggagacactgccccgcttgcaggttgcagaagtgcctcgatgccggaatgcgcaaggatatcccctgtcccttgaagacacgctccccctttagcagagagcagttgtggaagtctgtgacttcatactccattccactctcagtctcgaaacataagacatcttccgcagggctgttcgcaacacaacttaaaatggaacctgtcaccgacctggaactgcccagggagatgaggctaatcagttgcaaacggaggtggcactag

SEQ ID NO: 23693 - DNA, 936 bp, Artificial Sequence
  Description of Artificial Sequence: Synthetic coding sequence
atgttgcctaagagatctaggcgcacagtgtctaagagcatcggccctacatgcccttttgctggctcttgtgaagtttcaaagactcagcgcaggcattgcccagcttgtcggctgcaaaagtgtctcgacgccggtatgaggaaagatatgatcctgtccgctgaggcactcgccttgcggagagctaaacaggcccaaagacgggcacagcagactccagtgcagctctcgaaggaacaagaggagcttatcagaaccctccttggagcccacacaagacacatggggaccatgtttgaacagttcgtgcagtttagacccccagcccatctcttcattcaccaccagccattaccaacactagctcccgttctgcctctggttacccacttcgccgacatcaataccttcatggtcctgcaggtaattaagtttacaaaggacctgcctgtcttcagatcgctgccgattgaggatcagattagtttgctgaagggagccgcagtggagatttgtcacattgtcttgaataccacattctgtctgcagactcaaaattttttgtgtgggccactgagatatacgatagaggacggtgccagggttgggttccaagtggagttcctcgaactgctttttcacttccatggcacgctgcggaaactccaactgcaagaaccggaatacgtcctgctggcagccatggctctgttttctcccgctccctatctaactgaccggcctggagtgactcagagagacgagatcgaccagctgcaggaggagatggccctaaccctgcagtcatatattaaagggcagcagaggaggcccagggacaggagccccggaaccccgtggattcattggtcagggaaaatgttgggacccaagatcggccctggaagcaagggcgctcagtggttgcagtag

SEQ ID NO: 23694 - DNA, 273 bp, Artificial Sequence
  Description of Artificial Sequence: Synthetic coding sequence
atgctgcccaagcggtcaaggaggaccgtcagcaaatcaattggcccaacatgtcctttcgctgggtcctgtgaggtctccaagacccagcgtagacactgcccagcttgccgtctgcagaagtgcttagatgccggtatgcggaaggacacctctagttccagcgtccatccaagccccgcactggcgcaccctggcccttgtgcagcctcgggacacaccctgcgccgacaccaacacttccatggcacagcctcccaccaggtttattag

SEQ ID NO: 23695 - DNA, 960 bp, Artificial Sequence
  Description of Artificial Sequence: Synthetic coding sequence
atgcttccgaaaaggagcagacgcacggtgagcaaaagtatcggacctacctgtccatttgccggaagctgtgaggtgtcaaaaacccagcggagacattgtcccgcttgtagactccaaaaatgtctcgacgccggaatgaggaaggacatgattctgtccgcggaggctctggccctgcgccgtgccaaacaggcccagcggagggcacaacagactcccgtgcaattgagcaaagagcaggaggagctgattcgcacgctccttggcgcacataccaggcacatgggcacaatgtttgaacagttcgtgcagttccgccctcctgcacatctctttatccaccaccaacctttgccaaccctcgcccctgtgctgccacttgtcacacattttgccgacatcaacacattcatggtcctgcaggtcattaagttcactaaggacctccccgtgtttaggtcattacccatcgaagaccagatttcactcctcaagggcgctgccgtggaaatatgtcacatagtgttaaataccaccttttgcttgcagacccagaatttcctgtgcggtcccctgcgctatactattgaagatggcgcacgggttgggtttcaggtggaatttctggaactcctgttccattttcacggaactctgcggaagctgcagctccaggaacctgaatacgtgttgcttgctgcaatggcgctctttagccctgatagaccaggagtcacgcagcgagacgaaatcgaccaactccaggaagaaatggccctgaccctccagtcctacatcaaagggcagcagcgcaggccaagggatcggtttctgtacgcgaaactcttgggacttctggcagagctgcgttcaattaacgaggcatacggttaccagatccagcatatacaggggctctccgccatgatgcctcttcttcaggagatatgttcgtag

SEQ ID NO: 23696 - DNA, 357 bp, Artificial Sequence
  Description of Artificial Sequence: Synthetic coding sequence
atgctacctaaaaggagcagacgaactgtgtcgaaaagcataggtccgacctgccctttcgccggttcctgcgaagtgtctaagacacagaggaggcactgtccagcttgtagattgcagaaatgcctggacgccggaatgagaaaggacatcccgtgtcctctgaaaaccagatcacctttcagcagagagcagctgtggaaaagtgtaacctcctactccattcccctgtctgttagcaagcataaaacctcaagcgccggtctctttgccacacagctgaagatggagccagtgacagacctggagttacctagggagatgaggctgatctcttgcaagagacgatggcactag

SEQ ID NO: 23697 - DNA, 444 bp, Artificial Sequence
  Description of Artificial Sequence: Synthetic coding sequence
atggcatcgcgggaggacgaattaagaaactgtgttgtgtgtggggaccaggcgactggataccactttaatgccctcacctgcgagggatgcaagggctttttccgacggaccgtatctaagtctatcggccctacctgcccatttgccggatcttgtgaagttagtaagacccagcggcgacactgtcctgcctgtcggctgcagaagtgcctcgatgcaggaatgcgtaaagatataccttgccctcttaagactaggtcccccttctctcgcgaacagctttggaaatctgtcacctcatactcaataccattgtccgtgtcaaagcataaaacatcttcagccggtctgtttgccacgcagctgaagatggagccagtcacagaccttgagttgccaagggagatgcgactcatctcatgtaagcggagatggcattag

SEQ ID NO: 23698 - DNA, 273 bp, Artificial Sequence
  Description of Artificial Sequence: Synthetic coding sequence
atgctgcccaagcgcagcaggcggaccgtgagcaaaagcattggccctacctgtccctttgcaggcagctgcgaagtctccaagacccagagacgccactgcccagcttgtaggctgcaaaaatgcctggacgcgggaatgcggaaagacacaagttcgtccagcgtgcacccctctcccgctctggcccaccccggaccatgcgccgctagcggccatactctgagaaggcaccaacactttcatggcactgcatcccaccaggtgtattag

SEQ ID NO: 23699 - DNA, 804 bp, Artificial Sequence
  Description of Artificial Sequence: Synthetic coding sequence
atgttgcctaagaggtccaggcgcacggtgagcaaatctatcggacccacatgtccctttgccggttcttgcgaagtttcaaaaacacagcgcaggcattgtcccgcttgtaggttgcagaagtgcttagacgctggcatgcgaaaagacatgatcctttcagcggaggcactggctctccgcagagccaaacaggcccagaggcgagcacagcagacgcccgtgcagctgtctaaagagcaggaggaactgattcgtacactactaggagcccacactcggcacatgggaaccatgtttgagcaattcgttcaatttcgacctccggctcatctgttcatacaccaccagcccctgccaactctggcacctgtcttacccctcgtgacacacttcgcagacataaacacatttatggtccttcaggtgattaaattcaccaaggaccttcccgtctttcgtagtctgccaattgaagatcagatctctttgttgaaaggagcagctgtcgagatttgccacatcgttctcaacacaacgttttgcctgcagactcagaacttcttgtgtggtccactgcggtacaccatcgaagacggagccagagataggccaggtgtcacccaaagagatgagatagatcagcttcaggaggaaatggcccttaccctgcagagctacattaaaggccagcagcggcgaccgagggaccgctcccctggaacgccctggatccactggagcgggaaaatgcttgggcctaagattggccctggttccaagggcgcacagtggttacagtag

SEQ ID NO: 23700 - DNA, 717 bp, Artificial Sequence
  Description of Artificial Sequence: Synthetic coding sequence
atggcatcgagggaggatgaactgcgaaattgtgtcgtgtgcggagaccaggccacggggtaccatttcaacgcgctgacctgcgaaggctgcaagggctttttcagaaggactgtttccaagagcatcggtcccacgtgccctttcgcgggtagttgcgaagtgtccaagacacagcggaggcactgtcccgcttgccgactccagaagtgcctcgatgccggaatgcgcaaagatatgatcttgtccgctgaggccctagccctgcgaagggcaaaacaggcccagcgtcgcgcacagcagacccccgttcagctgtcaaaggagcaagaggagctgattcgcactctgctgggggctcatacgcgccatatggggaccatgttcgagcagttcgtgcagttcagacctcctgcccacttatttattcatcaccaaccccttccaactctggccccagtgttgcctcttgttactcatttcgccgatatcaataccttcatggtgctgcaggtgattaagttcactaaggacctgcccgtcttccggtctctcccaatcgaagatcagatatcccttctcaagggagccgcagtcgaaatttgccacattgtgctgaatacaacgttctgtctccagacacaaaattttttatgcggtcctctgagatacacaatcgaagacggagccaggggcgagatggttctggaacaatag

SEQ ID NO: 23701 - DNA, 1452 bp, Artificial Sequence
  Description of Artificial Sequence: Synthetic coding sequence
atggccactatcgaagagatcgcccatcagattatcgaacagcagatgggcgaaatcgtgactgagcaacaaaccgggcagaagatccagatcgttacagcactggatcataatacccagggaaaacaatttatactaaccaaccacgatggatcaacaccctcgaaagtaatcctggctcggcaggatagtactcctggaaaagtgtttctgaccacaccagatgcagcaggcgtgaaccaactttttttcaccactcccgatctttctgcccagcacttacagctgcttacggacaattcccccgaccagggacccaacaaagtgttcgacttgtgtgttgtttgcggtgataaagcttctggcagacactacggggcagtaacttgtgaggggtgcaaaggcttttttaaacggtccatccggaaaaatctggtctacagttgtcggggatcaaaagattgtataataaataagcaccacagaaaccgatgtcagtactgtcgtttgcagaggtgtattgcatttggcatgaagcaagacagtgtacaatgcgaacgcaaaccaattgaggtgtctcgagagaagtcatccaactgtgccgcatccacagagaaaatctatatccgcaaagatttaagatccccactcacagccactcctaccttcgtcacggatagcgaatcaactaggagtactggtttgcttgatagtggaatgttcatgaatatccatccttctggagtgaagaccgagagcgcagtgttaatgacgagcgacaaggccgagagctgccagggtgacctatctacacttgccaacgtcgttacctctcttgctaatcttggaaagactaaagacttgtctcagaacagtaacgaaatgtcaatgattgagagtttgagcaacgacgacacaagcctctgcgaattccaagagatgcaaaccaacggcgacgtgagcagggcctttgacacacttgccaaggctttgaatccgggtgaaagcacagcatgtcagagcagcgtggctggaatggaaggctctgtccatctgatcacaggagactcaagcataaactatacagagaaggagggacccttactgtcagacagccatgtcgcatttcggctcacaatgccctcacccatgcccgaatatcttaacgttcactatatcggcgagtccgctagcaggttgctatttcttagtatgcattgggctctaagcattccctctttccaggctttggggcaggagaactctatcagtctcgtgaaagcatattggaacgagctgttcactcttggcctggcccagtgttggcaggtcatgaacgtggctactatcctcgctaccttcgtcaactgtctccataactctttgcagcaggatgcaaaggtgattgctgctttgattcatttcacgaggcgcgctattaccgatttgtag

SEQ ID NO: 23702 - DNA, 1812 bp, Artificial Sequence
  Description of Artificial Sequence: Synthetic coding sequence
atggcaaccattgaggaaattgcccatcagatcattgaacagcaaatgggagagatagtcacggagcagcaaacagggcagaaaatccaaatcgtcacagcccttgatcacaacacgcagggcaaacaatttatcttaaccaaccatgacggctctacgcctagtaaggtgattctcgcccgtcaggattcaacaccgggtaaggtgtttctgacaacgccagatgcggcaggggtgaatcagttgttcttcacaacacccgatctgtcagctcaacatctccagctcctgacagacaactctcctgaccagggccctaacaaggtgttcgacctctgcgtcgtgtgtggtgacaaggcttctgggagacactacggcgctgtcacatgtgaggggtgtaagggctttttcaagaggtcaatccgcaagaacttagtttatagctgcagaggatcgaaggactgtatcatcaacaagcaccatagaaaccgctgccaatactgtcgcctgcaaaggtgtattgccttcggtatgaagcaggactccgtccagtgcgaacgtaaaccaattgaagtgtcgagagaaaagtcgtccaattgtgccgcaagtacagaaaagatttatatccgaaaggaccttcggtcccccctcactgccacaccaacatttgtgacggacagtgagagtaccaggtcaaccggcctgctggacagtggcatgtttatgaatattcatccctctggagtgaaaactgaatctgccgtcctcatgactagcgacaaagctgagagttgtcagggagatctctccaccttggctaacgtggtgacaagcttggcaaatttgggaaaaaccaaagacctgtcccaaaactctaatgaaatgagcatgattgaatctctctctaacgacgacacatcgttgtgcgaattccaggagatgcaaaccaacggagatgtgtcccgagctttcgacacattagccaaagccctcaacccaggggaatccaccgcctgtcagtcctctgtagccggtatggagggatcagtgcatctgatcactggggattccagtattaattacaccgaaaaggaaggccctctgctgagcgatagccacgtagcattcaggctcacaatgcccagcccaatgcccgagtatctgaacgtgcactatataggagagtccgcctctagactgctctttctctcaatgcattgggcactgtcaatacccagttttcaggctctggggcaggagaacagcatcagcctggtgaaggcgtactggaatgagctttttaccctgggcctggctcagtgttggcaggttatgaacgtcgcgactatcctggcaaccttcgtcaactgccttcacaattcgctccagcaggataaaatgagcacagaacggcgaaagttgttgatggaacacatctttaagttgcaggagttctgtaatagtatggttaaactctgtatagatggatatgagtacgcttacctgaaagcaatagtgcttttttcccccgaccacccaagcctcgagaatatggaacagattgagaagtttcaagaaaaagcatacgtggaattccaggactacataaccaaaacttaccctgatgatacttacagactgagccggctcctgctgcgactccccgcactgagacttatgaacgccactataactgaggagctgttttttaaaggactgattggcaacattagaattgactctgtcatccctcacattctgaaaatggagcccgcagattataacagccagattattggtcacagtatctag

SEQ ID NO: 23703 - DNA, 1404 bp, Artificial Sequence
  Description of Artificial Sequence: Synthetic coding sequence
atggctacaattgaggagattgcacaccagataattgaacagcagatgggagaaatcgtgaccgagcagcagacaggccagaagatacagatcgtgactgccctcgatcacaacacccagggcaagcagtttattctcactaaccatgatggttcaaccccctcaaaagtgatcctcgcacggcaggactctactccagggaaagttttcctcactacccctgatgcagccggtgtcaaccagcttttcttcacaactcccgacctttccgcacagcatctgcagctcctcacggataacagtcccgatcagggccctaataaggtctttgatctttgtgtagtgtgcggagacaaagcgtccggcaggcactatggcgcagtgacatgcgaggggtgtaaaggtttctttaagaggtcaattaggaagaaccttgtgtatagttgcaggggctccaaagattgcattataaacaagcaccacagaaataggtgtcagtactgtaggctgcagcgctgtattgcgttcggaatgaaacaggattccgtacagtgcgagcgcaaaccgattgaggttagcagggagaaatcttcgaactgcgcggcatcaactgagaaaatctatatacggaaggatctgaggagcccccttaccgctacccccacgtttgtgacagacagcgagtctacccgcagtacaggcttgttagactccgggatgttcatgaatattcaccccagcggcgtgaagactgaatcagccgtactcatgacctccgataaagctgagagttgccagggcgacctctcaaccttggcaaatgtggtgactagcttggccaatctaggcaagactaaagacctcagccagaattccaacgaaatgagtatgatcgaaagcttaagcaatgacgacactagcctgtgcgagtttcaggagatgcagaccaatggtgacgttagccgagcttttgatacgctggcgaaagcattaaaccccggtgagtctaccgcatgtcagtcctccgtcgcaggcatggaaggatctgtacatctcattaccggtgattcatcgataaattatactgagaaagaaggcccactgctttccgactctcatgtcgccttcaggctgactatgcctagtcccatgccagagtatctgaatgttcactatattggagagagtgcgtctcggcttttgttcctgtccatgcattgggccctatccatccccagctttcaggctctagggcaggagaactctataagcctcgttaaggcttactggaatgaactgttcacactgggtctggctcagtgctggcaagttatgaatgtcgccaccatactggccactttcgtgaattgcctgcacaattctctgcagcaggccgagggctag

SEQ ID NO: 23704 - DNA, 51 bp, Artificial Sequence
  Description of Artificial Sequence: Synthetic coding sequence
atggccactatagaggaaatcgcccatcaaatcatcgaacagcaaatgtag

SEQ ID NO: 23705 - DNA, 969 bp, Artificial Sequence
  Description of Artificial Sequence: Synthetic coding sequence
atgtgccccgtcgataaagcccaccgcaaccaatgtcaggcctgtcggctcaaaaagtgcttacaggcagggatgaatcaggatgccgtgcagaatgagcggcagcctagatcaaccgcacaggtgcacctggactcaatggagtcaaacacggagtcccgccctgaatccctcgttgcaccccctgccccagcgggacggtcccccagaggtccaaccccaatgtccgcggctagagccctggggcatcacttcatggctagccttatcacagcagagacatgcgctaaactggaaccagaggacgctgatgaaaatattgacgtgacatcaaatgatcctgagttcccatcaagcccatactcctcgtccagcccctgcggtctggatagcatccatgaaacctctgccaggctgttgttcatggccgtcaagtgggccaaaaatcttcccgtattttctagtctcccttttagggaccaggtgatcctgctggaggaagcatggagcgaactcttccttcttggggcaattcaatggtccctaccattggatagctgcccactcctcgcaccgcctgaggcatccgccgcaggaggggctcagggccgattgacattagcctccatggaaacaagagtgctgcaggagactattagccgatttagagccctcgccgtggaccctacagaattcgcatgtatgaaggcattagtattgtttaagcccgaaacacggggtctaaaggacccagagcacgtcgaggctttgcaagatcagtcccaggtgatgctctcccagcactcaaaggcccatcacccttcgcagccggtgagattcggcaagctgctactgttattgccatcccttaggtttatcaccgcagaaagaatcgaattgctcttcttccgcaagacaattgggaatacccccatggaaaaactgctctgcgacatgttcaagaactag

SEQ ID NO: 23706 - DNA, 1104 bp, Artificial Sequence
  Description of Artificial Sequence: Synthetic coding sequence
atggagactcggcctacggcactgatgtcctcaactgtggccgctgctgcaccagctgctggagccgctagtaggaaagaatcgcccggaaggtggggtttgggggaggacccaaccggcgtgagtccatcgctacaatgccgcgtctgcggcgattctagcagcgggaaacattatggcatctatgcctgtaacggctgctccggctttttcaagcgttccgtgaggcgacgccttatttatcggtgccaggttggagcgggtatgtgcccagtggacaaagcccaccgcaaccagtgtcaggcttgcagattaaagaagtgcttgcaagctggcatgaaccaagacgccgttcagaatgagcgccagcctcgcagcactgctcaagttcaccttgattcaatggaatcaaatacagagtctcgaccagagtcactagttgcccctcccgcaccagctggcagaagtccccgtggtcctaccccaatgtctgccgcacgcgctctcggccatcacttcatggctagtctcattaccgcagagacctgtgcaaaactcgagcccgaggacgccgatgagaatattgacgtgacctccaacgacccagagttcccgtcttctccttactcgtcgagtagcccatgtgggctggacagtatacacgagaccagtgctaggctcctctttatggcagtcaagtgggccaaaaacctcccagtctttagttcactgcccttccgagaccaagtaatcctgctggaagaggcttggtcagagctgtttctactgggtgctatccaatggtccctgccgctggactcatgtcccctgctagcgccaccagaagcatcagcagcagggggtgctcagggaagacttaccctggcttccatggagacgcgggtgctgcaggaaactatctcccgatttcgcgctctggcggtggatcccactgagttcgcctgcatgaaggcccttgtcctcttcaagcccgaaactcgtgggctgaaagatccggaacatgtggaggccctgcaggaccagagccaggtgatgcttagccaacattctaaagcccaccacccaagccagcccgtcagatag

SEQ ID NO: 23707 - DNA, 1431 bp, Artificial Sequence
  Description of Artificial Sequence: Synthetic coding sequence
atggagcgggacgagcccccacctagtggagggggtgggggaggcggttcagccggattcctggagccgccagccgctctccctccccctccaaggaatggcttctgtcaggacgagctcgcggaattggatcctggaactaacgaccgggctgaacagaggacctgcttgatctgtggcgatagggcaacaggccttcattatgggataatttcctgtgagggctgtaagggcttttttaaacgctccatatgcaacaaacgggtctatagatgttcaagggataaaaactgtgttatgagcaggaagcaaaggaatcggtgtcaatactgccgcctgttgaagtgtctccagatgggaatgaaccgcaaagcaatccgcgaagatggtatgcctgggggaagaaacaaatctattggacccgtgcagatatcggaggaagagatcgaaaggattatgagtggccaggagttcgaggaggaggctaatcactggagcaaccatggggacagcgaccacagctcgccaggcaacagggcaagcgagtcaaatcagccttccccaggctccaccctcagctcaagtcgcagcgtggagttgaacggattcatggcatttcgagaacagtacatgggcatgtccgtcccaccccactaccagtacatccctcatttattcagctattcaggacattcacccttgcttccacaacaagccagatccctggacccgcagtcctattctctgatccaccagttgctaagcgccgaggaccttgagcccctcgggacccccatgttgatagaggacggctacgccgtcacgcaggccgagctattcgcattgctctgtcggctggctgatgagctgctgtttcgccagatcgcctggatcaagaagttgccattcttctgtgaattaagcatcaaagactacacctgtttgctgtccagtacctggcaagaactgattctgttaagctctctgactgtgtattcaaagcaaatctttggagagctggcggacgtaaccgcaaagtacagcccttccgatgaggaactgcacagattcagcgacgagggtatggaggtgatcgaacgtctgatttacctataccataagttccatcagctaaaggtgtcgaacgaggagtacgcctgcatgaaagccattaactttctgaaccaggacatacgtggacttacatcagcctcccagttggagcagcttaacaaaaggtattggtatatttgtcaggactttactgagtataaatatactcaccagcccaacaggttcccggacctcatgatgtgcctacctgagatccgctatatagccggaaagatggtgaacgttccgctagaacagctgcctcttctttttaaggtcgtccttcacagctgcaagacaagtgtgggcaaggagtag

SEQ ID NO: 23708 - DNA, 1428 bp, Artificial Sequence
  Description of Artificial Sequence: Synthetic coding sequence
atggagcgggacgaacccccaccatccgggggtggagggggtggaggttctgccggatttcttgaacctcctgccgcactccctccgcctccacgaaacggtttttgtcaggatgaacttgccgagcttgacccgggaaccaacgacagagccgaacaaagaacctgtttaatctgcggagatagagccaccggtctccattatgggattatcagctgcgagggctgtaagggcttcttcaagcgaagtatttgcaacaagagagtgtatagatgctctcgggacaaaaattgcgtaatgtccagaaaacagcgcaatcgttgtcagtattgtagactgcttaaatgtctgcaaatgggcatgaaccgcaaggcgatcagagaggatggaatgcctgggggacggaataaaagcataggccctgtacagatctctgaagaagaaatagaacgcatcatgagtggtcaggagttcgaagaagaggccaatcactggtctaatcacggggacagcgatcattcttcccccggaaaccgggcatcggaaagtaaccaaccctctccaggatctaccctgtcttctcgttctgtggaactgaatggcttcatggcctttcgggaacaatatatgggaatgagtgtgcctccacactatcagtacattccccacctttttagctacagcgggcatagcccccttctgcctcagcaggcaagatcccttgacccacagtcttatagtctcattcaccagttgctgagcgctgaagacctggagcctctggggaccccgatgctaattgaggatggctacgcggtaacccaggcggaattgttcgctttactgtgtcgcctcgccgatgaactgctctttaggcagatagcctggatcaaaaaactgccttttttctgtgaactgagcattaaagactatacgtgcttactgagctccacctggcaggaactgatcctcctgtcctcactgaccgtttactccaaacagattttcggagaactcgcagatgtgaccgccaagtactccccaagcgatgaagaactgcaccggttcagcgacgagggaatggaggttatcgagagattgatctatttgtaccacaagttccaccagctcaaggtcagtaatgaggaatacgcttgcatgaaggctattaacttccttaaccaagatatcagaggtctcactagtgccagccagctcgagcagctaaacaagcgctactggtacatctgccaggattttaccgagtacaaatatactcatcagccgaacaggtttccagacctgatgatgtgtctacccgagattcggtacattgccggtaaaatggtcaacgtgcccctggagcaactccctctactgtttaaagtggtgttgcacagctgtaaaacatcggtcggcaaagaatag

SEQ ID NO: 23709 - DNA, 1443 bp, Artificial Sequence
  Description of Artificial Sequence: Synthetic coding sequence
atggaacgggacgagccccctccttctggtggcggtggtggcggaggtagtgcgggattcctggaaccacccgctgccctgcccccaccgccaagaaatggtttttgtcaagacgaactcgcggaactcgatccgggtacaatcagcgtgtcggacgaccgcgcagagcagcgaacttgtttgatctgcggtgatcgggcaaccggcctgcactacgggatcatctcatgtgaagggtgcaagggtttcttcaaacgctccatatgcaataagagagtctacaggtgttccagggacaaaaactgtgtgatgagtcgcaaacaaaggaaccggtgccaatactgcagactgctgaaatgcctccaaatgggcatgaatcgaaaagcgattagggaggacggcatgcccggagggagaaacaaaagcatcggacctgtgcaaatttccgaagaggaaatcgaacgaatcatgagcggacaggaatttgaggaggaggctaatcactggtccaaccacggagattctgaccactctagtccgggaaaccgggcttccgagtcgaatcagccatccccaggcagcacgctcagctcctcccgctctgttgagctgaacgggtttatggcttttcgggaacagtacatgggaatgtccgtccctccacactatcagtatattccgcacttattctcgtactccgggcattccccgctactgcctcagcaggctcggagcctagaccctcagtcctatagtctgattcaccagcttcttagcgccgaggatctggagcctctgggtacgcccatgctgatcgaggacggctacgcagtgactcaagctgagctgtttgccctcttatgcaggttggccgatgagctgctattccgccagatcgcatggatcaaaaaacttccttttttttgcgagttgagcataaaagattacacatgcctcctcagctcaacttggcaggagctcattttgctgtccagcttgaccgtctactccaaacagatctttggcgaactggccgacgtgacggcaaagtattcgcccagcgatgaggagttacatcggttctccgacgaagggatggaagtgattgagcgtctgatttacttataccataaatttcaccaactgaaagtgtctaacgaagagtacgcctgcatgaaagctatcaacttcctgaaccaggatatccgcggactgactagcgcctcccagcttgagcagttgaataaacggtactggtacatttgccaggattttacggagtacaaatatacacatcagcctaaccgtttcccggatcttatgatgtgtctcccggagattcgatatatagctgggaagatggtgaacgtccccctggaacagcttccactgttgttcaaggttgtgctgcattcctgcaagacctctgtcggcaaagagtag

SEQ ID NO: 23710 - DNA, 1677 bp, Artificial Sequence
  Description of Artificial Sequence: Synthetic coding sequence
atggcgatccctgggagacaatacgggctcatcctgccgaaaaagacccaacagctacatccagtgctgcaaaaaccaagcgtgttcgggaacgatagcgacgacgatgatgaaacatccgttagcgagagccttcagagagaggccgctaagaagcaggcgatgaagcagaccaaactggagatccagaaagctctagcggaagacgccacagtctacgaatatgatagtatctacgatgaaatgcaaaagaaaaaagaagagaacaaccctaagctcctcctcggaaaagatcgaaaacccaagtatattcacaacctgctcaaagccgtcgagattagaaaaaaagaacaggagaagagaatggagaaaaagattcaacgggagcgagagatggagaagggagagtttgacgacaaagaagcgtttgtgacctcagcctataagaaaaaactgcaagaacgagccgaggaggaggaaagagaaaagagagccgcagcgcttgaggcttgtctcgatgtaactaagcagaaggatttgagtgggttttaccgtcacctgctgaaccaagccgtaggcgaggaggaggtgcctaagtgttcattcagggaagcaaggtctggaataaaagaagagaaaagcaggggttttagtaacgaagtttcttcaaaaaacagaatcccccaagagaagtgtatcctgcagaccgacgtaaaggtggaggagaacccggatgcagattctgactttgacgctaaatccagcgctgacgatgagattgaagaaacacgggtgaactgccggagggaaaaagtcatcgaaactccagaaaacgattttaaacaccaccggagccagaatcactcccgctctccttcagaagaaagaggccactcaaccagacaccacaccaagggtagcagaacaagtagaggccacgagaagcgcgaagatcagcatcaacaaaagcagtcccgcgatcaggagaaccactataccgatagagactaccgaaaagagcgcgacagccaccgacatcgggaagcctcccaccgcgacagtcattggaagaggcacgaacaggaggacaagccccgagcccgagatcagagagaacgctctgacagggtgtggaagcgtgagaaggatcgagaaaagtattcacagagagagcaggagagggatagacaacagaatgatcagaataggccatctgaaaaaggagaaaaagaagaaaagtccaaggctaaggaggagcatatgaaggttaggaaggagcgctatgagaacaatgataaatatagggatagggagaagcgggaggtcggcgtacagtctagtgaacgcaaccaggatcggaaggagagttccccaaactctagggcgaaagacaaatttctcgaccaagagcgatccaataagatgcgcaatatggctaaagacaaagaacgcaatcaggagaaaccgagtaactccgagagcagccttggagccaaacataggctcacggaagaaggccaagaaaaggggaaggaacaagagcggcctccggaagctgtatccaagttcgcaaagcggaacaacgaagagaccgttatgtctgcccgagatagatatcttgcaaggcaaatggcgcgtgtcaatgcgaagacgtatatagagaaagaggatgattag

SEQ ID NO: 23711 - DNA, 1062 bp, Artificial Sequence
  Description of Artificial Sequence: Synthetic coding sequence
ctgaagatgacgaaactggaaattcagaaggcgctggccgaagacgccacagtgtatgagtacgattcgatttatgacgaaatgcagaaaaagaaggaggaaaacaatccaaaactgctgctgggtaaagataggaagccaaagtacatccataatctgctcaaggcagtggagatcaggaagaaagagcaggagaagaggatggaaaagaaaattcagagggaacgggagatggaaaagggagagttcgacgacaaggaggcctttgttaccagcgcctataaaaaaaaacttcaggagcgcgctgaggaagaggagagagaaaagagagccgctgccctggaggcatgcctggatgtaaccaagcagaaagatctgagtggattttaccggcacctcctgaaccaagccgtaggtgaggaagaagtgccaaagtgttcctttcgggaggctagaagtggcatcaaagaggagaagagtcgtggcttctccaacgaggtgagctctaagaaccgaattccccaggaaaagtgcatactgcagacagatgtgaaggtggaggagaatcctgacgcggactctgattttgacgcaaagtcttccgcagacgatgaaattgaggagacacgggtgaactgccggagggaaaaagttattgaaacccctgagaatgactttaaacatcatcgaagccagaaccactcccgctcgccctccgaggagcgcggacactccactaggcaccatactaaaggatcacggaccagccgtgggcacgagaaacgcgaggaccagcaccagcagaagcagtcgagagaccaggagaatcactacacagacagagattaccggaaagagcgagacagccaccgacatcgcgaggcttcacatcgggactcacactggaagcggcacgagcaagaagacaaaccaagggctcgcgaccagcgagagagatctgatagggtgtggaaacgcgaaaaagatcgcgagaaatacagtcagagggagcaggagagggacagacagcaaaatgatcagaatcgcccttcagaaaaatag

SEQ ID NO: 23712 - DNA, 1470 bp, Artificial Sequence
  Description of Artificial Sequence: Synthetic coding sequence
atgttactttgtatgaacatgaccgtattcatgatgaagtgtcgcaagaaggaagaaaataaccccaagttactactgggaaaggaccgtaagcccaagtatatccacaatttactgaaagcagttgagatccgcaagaaagagcaagagaaaagaatggagaagaagattcagcgcgaaagggaaatggagaagggcgaattcgatgacaaagaggcatttgtgacaagtgcctacaaaaaaaagcttcaggaaagagctgaggaggaggaaagggagaagagagctgccgctctggaggcctgtctggatgttactaaacagaaggatctgtctgggttttaccggcatttgttaaatcaggccgtgggcgaggaggaggtgcctaaatgctcctttcgagaggcccgttctggaattaaagaggaaaagagtcgcggattcagcaatgaggtcagcagcaaaaaccgaattcctcaggagaaatgtatcctgcagactgatgtgaaagtcgaggaaaatccagacgccgactctgacttcgatgccaaatccagtgccgacgatgagatcgaggagacacgcgttaattgtcgacgcgagaaagtcatcgagactcccgagaatgacttcaaacaccacaggagccagaaccacagtcgatctccaagtgaagaacgcggtcactcaacgcgccaccatactaagggctcacggacgtccaggggccatgaaaagcgtgaggatcagcaccaacagaagcagagcagggaccaagagaaccattacacagatcgcgattacagaaaggaacgcgacagtcacaggcatagagaggcctctcacagggactcacactggaaacggcatgaacaagaagataagccccgagccagggatcaaagagagcggtctgatcgagtctggaaacgcgagaaagacagagaaaagtattctcaacgtgagcaggaaagggatcggcagcagaacgatcaaaacagaccttctgagaaaggcgagaaggaggaaaaatcaaaggctaaagaggaacacatgaaggtgagaaaggagcgttacgagaataatgacaagtatcgtgacagagagaaacgcgaagttggagtgcagtccagcgagcggaaccaagacaggaaagagtcgagtcccaactccagggctaaggacaagttccttgaccaggagcgttcgaataagatgcggaacatggccaaagacaaagagaggaaccaggagaaaccatctaattcagaatcgtcattgggagccaagcacaggctgacggaagaaggccaggaaaagggtaaggagcaggagcggcctcctgaggctgtaagtaagttcgctaagcggaataacgaagagactgttatgagtgcccgtgaccggtacctggccagacagatggccagagtcaatgccaaaacctacatcgaaaaggaagatgattag

SEQ ID NO: 23713 - DNA, 474 bp, Artificial Sequence
  Description of Artificial Sequence: Synthetic coding sequence
atgggcaaacatgagttcagaagtaacatcccgtgtcacctggtggacattagctgcggtttgccctgctcagcaacacttccttgcgggatgcataagtgtcagaggctctgccataagggagagtgcctggtcgacgaaccttgcaagcagccttgcacgacccccagggccgactgcggccatccctgtatggcaccctgtcacacctcaagcccatgtcctgtgaccgcatgcaaagccaaggtggtggaactccaatgcgaatgcggcagacgaaaagaaatggtgatctgctccgaggccagtagtacctaccagcggttggtgatcgcagcgatctccatggcttctaaaattactgatatgcaactagggggtagcgtcgaaatctctaagcttataaccaaaaaggaggtccaccaggctcgcttggagtgcgatgaggagtgctccgctcttgagcgtaagtag

SEQ ID NO: 23714 - DNA, 2502 bp, Artificial Sequence
  Description of Artificial Sequence: Synthetic coding sequence
atggctgaggctcctcccgtttctggaactttcaaatttaacacggacgccgcagagttcatacctcaggagaaaaaaaattccggactgaattgtgggacacagagaagactcgactccaatcggatcgggagaaggaactattctagtccccctccttgtcacctcagtcggcaggtgccgtatgacgaaatctcggctgtccatcaacactcttaccacccttctggatccaaacctaagagtcaacaaacttcattccagtcatcaccatgcaacaaatctcccaagagccatggcctgcagaaccaaccgtggcagaagctgcgcaatgaaaaacatcacataagagtgaagaaggctcagagcctggccgaacaaacgtctgacaccgccggtctggagagtagcactaggtccgaatcagggaccgatctgagagagcattctccatcagagagtgagaaagaggtggtgggggcagacccacggggtgctaaaccaaaaaaggctacacagtttgtttacagttatggacggggacccaaggtgaagggcaagctcaaatgtgaatggtctaacagaaccactcctaagcccgaagacgcaggccctgagtctactaagcctgtgggggtattccatcccgattcatctgaggctagttcacggaaaggcgtgcttgatggctatggcgcacggagaaacgaacagcgtagatacccacaaaaacgcccaccatgggaggttgaaggggcaagacccaggccgggtcgcaatccgcctaaacaggaagggcataggcacacaaacgccggacacagaaataatatggggcctatcccaaaggatgacttaaacgagcggcctgctaagtctacatgtgattccgaaaacctggctgtgattaataaatctagcaggcgggtagaccaggaaaagtgcactgtgagaaggcaggacccacaagtcgtgtctccatttagcagaggcaagcaaaatcacgtgctcaaaaatgtggaaacccatactgggtctctcatagaacagctgactaccgaaaagtatgagtgcatggtttgttgtgaactggtgcgagttaccgcccctgtttggagctgccagtcctgctatcacgtttttcacttgaactgcatcaaaaagtgggcacgttcgccggctagccaggccgacggacaatctggctggcgttgtcctgcctgtcagaatgtgtctgcccatgttcctaacacttacacatgtttctgtggaaaggttaaaaatcctgaatggtctaggaacgagatcccccatagctgtggggaggtatgccggaaaaaacagcctggccaggattgtccccacagctgtaatcttctgtgccatcccggaccatgcccaccatgtcctgcattcatgacaaaaacatgcgagtgcgggaggaccaggcatacggtgcgatgcggccaggcagtctcagtgcactgtagcaatccatgcgagaatatactgaattgcggacagcatcaatgtgccgaactttgccatggcggacagtgtcagccttgccagattatcctaaatcaggtgtgctattgtggatcaacctcgcgggacgtgctttgcggcacagacgtgggaaagagcgacggatttggcgacttttcatgtttgaagatttgcgggaaggatttgaaatgcggaaatcacacatgctctcaggtgtgccacccccagccatgtcagcaatgtcctcgactgccacaattggtcaggtgctgcccctgcgggcagacacccctcagccaactgctggaactgggtagtagttctagaaagacatgcatggatcccgtcccaagctgtggtaaggtgtgcggaaaacccctcccttgcgggagcctggattttatacatacctgtgaaaaactgtgccacgagggcgactgtggtccgtgcagtagaacgagcgtcatttcttgccggtgtagctttcggaccaaagagttgccatgcacctcgcttaagtctgaggatgcgacttttatgtgtgacaaaagatgtaacaaaaagagactctgtggcaggcacaagtgcaatgagatctgctgcgtggacaaggagcataaatgccccctgatatgcgggcgaaagctgaggtgtggccttcacaggtgtgaggagccttgtcaccgcggaaactgtcagacctgttggcaggcaagctttgatgaactgacatgtcattgcggtgcaagtgtcatttacccgccagtgccttgcggtacaagaccacccgagtgcacacaaacttgtgctcgcgtccatgaatgtgatcaccctgtctatcactcgtgtcactccgaagaaaaatgtcccccttgtacatttctcacacaaaagtggtgtatggggaaacacgagcaaagccattactgggctagcacacagaaaaaacgcagccactacatgaagaagatcccagcccatgcctgcttatag

SEQ ID NO: 23715 - DNA, 3075 bp, Artificial Sequence
  Description of Artificial Sequence: Synthetic coding sequence
atggccgaggctcccccagtgtcaggaacatttaagttcaacacagatgctgccgaatttattccacaagaaaaaaagaacagtgggctgaactgcggcactcagcgccgattagactcaaatcggataggtcgccgtaattacagcagtccacccccttgccacctaagcaggcaggtcccctatgacgaaatttcagctgtgcaccagcatagctaccatccaagcggatccaaaccaaagtcccaacagacttcgtttcagagtagcccttgcaataaatctcccaaaagtcacgggttacaaaaccagccgtggcagaagttgaggaatgagaagcaccatattagggtgaaaaaggcccagagccttgcagagcaaacatcagacacagctggcctcgagagttcgacaagaagcgagtctggcacagatctgcgcgagcactccccgagcgaatctgagaaggaagtggtgggcgctgaccccagaggcgctaagcctaaaaaagcaacacaatttgtatactcatacgggaggggtcccaaggtgaagggtaaactcaaatgtgaatggtcaaatcgaactacccctaagcctgaggatgccggaccagagagtacaaaaccagtgggggtgtttcaccccgatagctccgaggcttcttccaggaagggggtgctggacgggtatggggctagaaggaacgaacagcggagatacccacagaaaaggccaccctgggaggtggaaggcgctagaccacgacctgggcgaaatcctcctaagcaggaaggacatcgacacaccaatgctgggcacagaaataatatggggcctattcctaaggatgacttgaacgaaagaccagcaaagagcacttgtgatagcgagaatcttgctgttattaacaagtccagtaggcgcgttgatcaggagaaatgtacggtgcgtcgacaagatccacaagttgtctcaccttttagtagagggaaacaaaaccatgtgctgaaaaatgtagaaacgcacaccgggtccctgatcgagcaactgacaactgaaaagtacgaatgtatggtgtgttgtgaactagtccgtgtaaccgctcctgtgtggagctgtcagtcatgctaccatgtattccacctcaactgtattaaaaaatgggctagaagccccgcaagccaggcggatggccaaagcggctggcgctgtccagcctgccagaatgtatctgcgcacgtccccaatacctacacgtgtttttgtgggaaagtaaagaatccagagtggtcaaggaacgagatccctcacagctgcggggaggtctgcaggaagaaacaacctggtcaggattgtcctcactcttgcaatctcctgtgtcatccaggaccatgccctccctgtccagcttttatgaccaaaacctgcgagtgcggcagaaccagacatactgtgaggtgtgggcaggctgtgtccgtccattgtagtaatccatgtgagaatatattgaattgcgggcagcaccagtgtgccgaactgtgccacggaggccagtgccagccatgtcagattattctaaaccaggtgtgttactgtgggtccacctcccgagatgtgctgtgtggcacggatgtgggaaagtctgacggattcggagacttttcgtgcctgaagatttgcggaaaagatctcaaatgtgggaatcacacgtgttcacaggtttgtcaccctcagccctgtcagcagtgtcccaggcttccccaactggtaaggtgctgcccctgcggacagacaccactgtcccaattgcttgagctcggaagcagttccaggaagacgtgcatggatcccgtcccatcctgtggaaaagtctgcgggaagcccctgccctgcggctctctcgatttcatacacacttgtgaaaagctctgtcacgagggtgactgcggcccttgttcccgtacctctgttattagctgtcggtgttcgtttcggactaaggagcttccttgtactagcctgaaatccgaggatgcaacctttatgtgtgataaaaggtgcaacaagaagcggctgtgcggacgccataagtgtaacgagatctgttgtgtcgataaggagcataagtgccccctgatttgcggacgtaagcttcggtgtggccttcatcgttgtgaagagccctgccacagaggtaactgccagacatgctggcaagcctctttcgatgagctgacgtgccactgcggagcatccgtaatttatcctccagtcccttgcggcacccggccacccgaatgcactcagacctgcgcgcgagtccatgagtgcgaccatcccgtctatcattcttgtcacagtgaggagaagtgtcccccatgcacttttcttacacagaagtggtgcatgggtaaacacgagttcaggtctaacataccctgccatttagtggatatctcgtgtggattgccatgctccgccaccctgccatgcgggatgcacaaatgtcagcggctgtgccataaaggcgagtgtttggtagacgaaccatgcaagcagccatgcactacccctcgcgcagactgcggtcacccctgtatggccccatgccataccagttcaccctgccctgttactgcctgcaaagcgaaagtggaattgcagtgcgagtgcgggaggcgcaaagaaatggtgatctgtagtgaggcctctagtacttatcagcggattgccgcaatcagcatggctagcaagattacagacatgcagctgggcggtagcgtcgagatcagtaaattgatcaccaagaaagaggtgcatcaggctcggttagagtgtgatgaggagtgcagcgccctggagaggaagaagcggctggcggaagccttccatatatctgaggacagcgatccattcaacatacgctcaagtgggtccaagttttccgactccctgaaagaagacgcccgaaaagacctgaagttcgttagcgatgtggaaaaggaaatggagacccttgtcgaggccgtaaataaggtggaagtggagacgtcccattggacctttctgtag

SEQ ID NO: 23716 - DNA, 3363 bp, Artificial Sequence
  Description of Artificial Sequence: Synthetic coding sequence
atggccgaggctcctcccgtgtctggaacctttaagttcaacacagacgccgcagagttcatacctcaggaaaagaagaactcagggctcaattgcggtacgcaacgccgacttgactctaatcggatcgggcgaaggaactactcttctcctccaccctgtcacctgtctcgccaagtcccttacgacgaaatctccgccgtgcaccagcattcataccacccatccggctcgaagcctaaatctcagcaaacgtccttccagtccagtccctgtaataaaagtcccaaaagccatggcctgcaaaatcagccatggcagaagcttagaaatgagaagcatcacattcgcgtcaaaaaggctcagagcctcgccgaacaaacatctgatacagctggtctcgagagcagcacccggagtgagtccggcactgacctgcgggagcatagtccttctgagtcagaaaaggaggtggtgggggcagacccacgcggagctaagccaaaaaaggccacacagttcgtgtacagctacggtcggggacccaaagtgaaaggaaaactgaagtgtgaatggtcaaatagaacaactccaaagcctgaggacgcaggtcctgagagcactaagcccgttggggtgtttcatcccgattcttcggaggcttcttctagaaaaggggtgttagatggctacggggctcggcgtaacgagcagagacgataccctcagaaacgcccaccttgggaggtggagggagctcggcctcgccctggaagaaatcccccaaagcaggaggggcaccgccacactaatgccggacaccgaaacaatatgggtcccatacctaaagacgacttaaacgagcggcctgcaaagtcgacctgtgacagcgaaaatctcgccgtgattaataaatcaagccgaagggtagaccaggagaaatgcactgtgcggcgacaagacccacaggtggtgagccccttttctagaggaaagcaaaaccatgtgctgaaaaacgtcgaaacacataccggtagcctcatcgagcagctcaccaccgaaaaatatgagtgtatggtgtgctgtgagttagttcgagtgacagcccctgtgtggtcctgccaatcttgctaccacgtgtttcaccttaactgtatcaagaaatgggccagatctcctgccagccaggccgacgggcaatcaggatggaggtgccctgcttgtcaaaatgtgagcgcccacgtgccaaacacttacacttgtttttgcgggaaagtcaaaaacccagagtggagccgcaatgagattcctcactcctgtggagaggtttgtcggaaaaaacaaccaggccaggattgtcctcatagctgcaatctcctgtgtcatcctggaccctgcccaccctgccctgcattcatgacaaagacctgcgaatgtggcagaaccagacacaccgtgaggtgcggtcaggctgtgagcgtgcattgttcaaacccttgcgaaaacattctaaactgtggacagcaccagtgcgcagaactatgccatggcggtcaatgtcagccctgccagatcattctgaatcaagtctgttactgcggatccacatctcgggatgtgctgtgcggcacagatgttgggaaaagcgatggcttcggagatttcagttgtctcaagatctgtggcaaggacctgaagtgcggaaaccacacatgcagccaggtttgtcacccccagccttgtcagcagtgcccaaggcttccccagctcgtgcgttgttgtccatgtgggcagacaccactatcgcagcttctggaactggggagctcatctagaaagacatgcatggaccctgtacctagttgtggcaaggtctgtggtaaacccttgccatgtggcagcctcgacttcatccatacgtgcgagaagctttgtcatgagggtgactgtggtccatgctcaagaacgagtgttattagttgtaggtgctctttcagaactaaggagctgccctgtacctcattgaagagcgaagatgctaccttcatgtgtgacaagcgctgcaacaagaaaagactgtgcggacgtcacaaatgcaatgaaatttgttgcgttgacaaggagcataaatgtcctttgatttgcggcagaaagttacggtgtgggctgcaccggtgtgaggagccctgccaccgcggtaactgtcagacctgctggcaggcttctttcgacgaactgacatgccactgcggcgcttcggttatatacccaccggttccttgcggaactcgccctcccgaatgcactcagacttgcgcaagggttcacgagtgcgaccatccagtgtatcattcatgccacagtgaggagaagtgcccgccttgtaccttccttacccagaagtggtgtatggggaagcacgaattccgttccaacattccatgtcacctggtcgacattagctgcggtctgccgtgctccgcaaccctgccctgtgggatgcacaagtgccagagactatgccacaagggagagtgcctggtggacgaaccatgcaagcagccctgtactactcctcgtgcagattgtgggcatccctgcatggcgccttgccataccagcagtccgtgccctgtcaccgcttgcaaggcgaaagtggagctacaatgcgaatgcgggaggaggaaagagatggtgatctgctcagaagctagctccacttatcaaagaatagctgccatcagcatggcttccaagatcactgatatgcaacttgggggtagcgtggaaattagcaaactcataaccaagaaggaggtccatcaggcgaggctcgaatgcgatgaggagtgttcggctctggagcgcaaaaagcggctggccgaagctttccatattagtgaggactcagatccctttaacataagatcctcaggctctaagttctctgacagcttgaaagaagacgcccgaaaggacctcaagtttgtgagtgatgtcgaaaaggagatggaaaccctcgttgaagcagtgaataagggcaaaaatagtaaaaagagccatagtttcccccctatgaatcgagaccataggaggattatacatgatctggcacaggtctatggtctcgagtccgtgtcttatgactccgaacctaagcgaaacgttgtggtgaccgcgatccggggaaaaagcgtatgtccccctactacactcacgggagtgctggagagagagatgcaggccaggcctccgccacctattcctcaccatcgtcaccagagtgacaaaaatcccggttcctccaatctccagaagataacaaaagagcctattattgattatttcgacgtccaagactag

SEQ ID NO: 23717 - DNA, 2391 bp, Artificial Sequence
  Description of Artificial Sequence: Synthetic coding sequence
atggccgaggcaccccctgtttccggtacttttaaattcaacacagacgccgcagagtttatcccccaggagaaaaagaactcaggtctaaactgcggcacacagcgccgtcttgactctaaccgtatcggcagaaggaactattcgagtcccccaccgtgtcacctctctagacaggtaccttacgacgagatttcagcagtgcatcaacacagctatcatccgtcgggtagcaaacctaaatcccagcaaacatcttttcagtcaagtccttgcaacaagagcccgaaaagtcacgggttacagaaccagccctggcagaagctgcgaaacgagaagcatcatattcgagtcaagaaagcccagagtttggccgaacagacgtccgataccgctggactcgaatcaagtactcggtctgagtctggcacagacttaagggagcacagcccttccgagtccgaaaaggaagtggttggagcagatccaaggggtgctaagcctaaaaaggccactcagtttgtctatagttatggaagaggacccaaagttaaaggaaagctgaaatgtgagtggtccaatagaaccactcctaagcccgaggacgccggaccagaatctacaaagccagtaggcgtcttccatccagactcctctgaagcttctagtaggaaaggcgtactggacggctatggcgcacggcgaaacgagcaacggaggtacccccaaaagcgcccaccctgggaagttgaaggcgctcgtcccaggccaggccgaaatcctccaaagcaggagggacatcggcatactaatgcagggcaccgtaacaacatgggaccaatacccaaggacgatctcaacgagcgcccagcaaaaagcacttgcgattcagagaacctggctgtaattaataagagcagtagacgcgtcgaccaggagaaatgcactgtaaggagacaggacccccaggtcgtgtcacctttctctcgaggcaagcagaaccacgtactgaaaaatgtggaaactcatacaggttccttaatagaacagttgaccacagagaaatatgaatgcatggtgtgctgtgagttggtcagggtaactgccccagtttggtcctgccaatcttgttaccacgtgttccacttaaattgtatcaaaaagtgggcacgcagtccagcctcgcaagccgacggtcaaagcgggtggagatgtcccgcttgtcaaaacgtgtcggcccatgttcctaatacatatacgtgtttctgcgggaaggtaaaaaacccggaatggagtagaaatgaaatccctcacagctgcggtgaagtctgcaggaaaaagcagccgggtcaggattgtccgcattcctgtaatctcctttgtcaccccggaccctgtcccccatgtccagcctttatgactaaaacctgcgaatgtgggcgaaccaggcacaccgtgcgctgtggtcaggcagtttctgttcactgctcaaacccttgtgagaatattttgaattgtggccaacatcagtgcgcagaactctgccatgggggacagtgtcaaccatgccaaattatcttgaaccaggtgtgttactgcgggtcgaccagccgtgatgtactttgtgggacagatgtgggaaaaagcgacggctttggggacttttcatgcctcaagatttgtggaaaggacctcaaatgtggcaaccatacgtgctcacaggtgtgccatccccagccttgtcagcagtgtcccagattgccacagctggtccgatgttgtccttgtggccaaacccctctctcgcaactgctggagctgggctcctcctcccgaaagacttgcatggatcccgtaccgagctgcggtaaagtctgtggcaaacctctgccctgcggaagcctagatttcattcatacatgcgagaaactgtgccacgaaggtgattgcgggccatgtagcaggacttccgtgatctcgtgtcgctgtagcttccgcacgaaggaactcccatgtacctctctgaagtcagaagacgccacattcatgtgcgataaacggtgcaacaaaaaaagactttgtggcagacacaagtgcaacgagatctgctgtgttgacaaggagcacaagtgtcccctcatctgcggtcgcaagctgcgatgcggcttgcaccgatgtgaggaaccctgccaccgcggtaactgccaaacgtgctggcaggctagtttcgacgagcttacatgtcactgtggcgcaagcgtcatctaccctccagtgccgtgtgggactcgtccaccagaatgcacccaaacctgtgccagagtccacgaatgtgaccatcctgtgtatcattcctgtcacagccggtccgttccattagcgctcagctag

SEQ ID NO: 23718 - DNA, 1917 bp, Artificial Sequence
  Description of Artificial Sequence: Synthetic coding sequence
atgcaggtttcgagtctgaatgaggtgaaaatttatagcctctcttgcggcaagagcctgcccgagtggttgtctgacagaaaaaaacgggcactgcagaaaaaagatgtggacgtcagaagaaggatagagctcatccaggatttcgaaatgcccactgtctgtactaccatcaaggtatccaaggatggtcaatacatcttggccacaggcacatacaaaccgcgtgttcggtgctatgatacctatcaattatccttgaaatttgagaggtgcttagactccgaggtagttaccttcgaaattttaagcgacgattactcaaaaattgtctttctccacaacgaccggtatatcgagtttcacagccagtctggcttttactacaaaacgcggattcccaagttcggacgcgatttctcctaccactatccttcttgcgatctgtacttcgtgggagccagttctgaagtttaccgtctgaatctggagcagggcaggtatctgaacccgctgcagacggatgctgctgagaataatgtctgtgatataaactcagtccatggactctttgcaaccgggacaattgagggaagagttgagtgctgggatccacgtacccggaaccgtgttggtctgcttgattgcgcccttaacagtgtaaccgctgactccgagattaattcacttccaaccataagcgctctcaagtttaatggcgcactgaccatggcggttgggactaccacagggcaggggaagatctttacttcactggaacctgaacacgatctcaacgatgtgtgtttatacccaaacagcggtatgttgctcaccgctaatgaaacacccaaaatggggatttattacattcctgtcctcgggccagctcctcgctggtgctcgtttctggataacctgacagaggaacttgaggagaaccctgagtccacagtctacgatgattataaattcgtaacaaaaaaagatctggaaaatcttggcctcacccacctgataggcagccccttcctccgggcatatatgcacgggttctttatggacattcgtttataccataaagtcaaactgatggtaaacccattcgcatacgaggaatacagaaaagacaagattcggcagaagatagaggaaacgagagctcagcgagtgcaactgaagaagctgccaaaggtcaacaaggaactagcgctcaaactgatcgaagaagaggaagaaaagcagaaatctacatggaagaagaaggtgaagagcctacccaacattctgacagatgaccggtttaaggtcatgttcgaaaacccagacttccaggttgatgaggagagcgaggaattccggttgctgaacccattggtatcgaagatcagcgagaagagaaagaagaaattacgtctgctcgaacagcaggagttaagggaaaaggaggaagaagaagagcctgagggaaagccttccgatgccgagagctcagagtcatcagatgatgagaaagcctgggtggaagaggtgcgcaagcagaggcgcctactgcagcaggaggagaaagtcaaaaggcaggagcgtttaaaggaagaccaacagactgtgttgaagcctcagttttacgaaattaaggcaggcgaagagttccgctcattcaaggactctgccacaaaacaaaaattgatgaataagaccctggaagatcgcctcaaaattgaagccaagaacggcaccctttccgtatcagataccaccgtgggctcaaagcaactgacatttactctcaagcgcagcgaacagcagaagaagcagcaggaggcagagaagctccatcgccaggaacggaagcggttgaggcggtctgccggacatctgaagtcgcggcataagaggggccgtagttttcattag

SEQ ID NO: 23719 - DNA, 2067 bp, Artificial Sequence
  Description of Artificial Sequence: Synthetic coding sequence
atgcaggtctccagcctgaacgaagtcaagatctacagcctgagctgcggtaagagccttcctgaatggttaagcgacagaaagaaacgcgcattgcagaaaaaggacgtggacgttagacgaaggatcgagctcatccaagactttgaaatgccgaccgtttgtaccacgattaaggtgtccaaggacggccagtatattttagccactggcacatacaaacccagagtgaggtgttacgacacttatcaactatcactaaagttcgagcggtgcctcgattccgaggtcgttacctttgagatcctcagcgatgattatagcaagatagtgtttctgcacaatgacaggtatatcgagttccatagccaatcagggttttattacaagacacgaattcctaagtttggccgagatttcagttaccactacccttcctgcgatctgtacttcgttggcgcttcctctgaggtgtatcggctcaacctggaacaggggagatacctcaatcctctgcagacagatgcggctgagaataatgtgtgcgacatcaactctgtccacggccttttcgccactggcactatagaggggagggtggaatgttgggaccctagaacacgcaatagagtaggcttattggactgtgctctcaatagtgtgactgcagattccgagattaactccctccctacaatctccgctctaaaatttaatggggcactaaccatggcagtggggaccacaacaggccaagttctgttgtatgacctgagatcagacaagcctttgcttgttaaggatcaccagtatgggctgcccataaagtctgttcactttcaggatagtctggacctgatcctttctgccgatagccggattgtgaagatgtggaataagaacagcggaaaaatcttcacctctctggaaccagagcacgacctgaatgatgtttgcttgtatcctaactcagggatgctgctgacagccaacgaaacacccaaaatggggatctactatatccctgtgctaggcccagcccctcgatggtgttcctttctagacaacttaactgaggaattggaggagaaccccgaatctaccgtttacgacgattataagtttgtcacaaagaaggatctggaaaacctgggactgactcatctgatagggtctccattcctgcgcgcttacatgcacggattcttcatggatatcagactttatcacaaggtgaaactcatggtgaatccctttgcctatgaggaatatcgcaaggacaaaattaggcaaaagatagaagaaacccgagctcaacgagttcagttaaagaagctgcccaaagttaataaggagctggccctgaagctgatagaggaagaagaagaaaagcagaagagtacttggaagaagaaagtaaagtcacttccgaacatactgacggatgaccgctttaaggtgatgtttgagaatccggactttcaggtcgacgaggagtctgaagagttccgcttgttgaatcccctagtctccaagatttcagagaaacgaaagaaaaagttgagactcctggaacagcaggaactgcgggaaaaggaggaagaggaagagcccgaagggaaaccttcagatgcagagtcttcagaatcttcggacgacgaaaaagcctgggtggaggaagtccgcaagcaaaggaggctcctgcagcaggaggaaaaagtgaaacgccaggagcgcctgaaggaggatcagcagactgtcctgaagcctcagttttacgagattaaggccggagaagaatttcgcagcttcaaggactcggccacaaagcagaagctcatgaataagaccctcgaggatagactgaaaattgaggctaaaaacggaacgctgtccgtaagcgatacaacagttggctcaaaacaactgacgttcaccctgaaaagatccgagcagcagaaaaaacagcaagaggctgaaaagctacaccgccaggaacgtaagcggctgcgtcgctctgcgggacacctgaaaagtcgccataagcgaggccgtagttttcattag

SEQ ID NO: 23720 - DNA, 1989 bp, Artificial Sequence
  Description of Artificial Sequence: Synthetic coding sequence
atgcaggtgtcatccctaaacgaggtcaagatttacagtctcagctgtggtaaatccctgcctgagtggttgtccgacagaaagaaaagggcgctgcagaaaaaggatgtcgacgttcgccgacgcatagagctgatccaggatttcgaaatgccaactgtttgtaccactatcaaggtatcaaaggatggccaatatatccttgcgacagtcgtgacattcgagattttgtccgacgattactcaaaaattgtgtttctccacaacgatcgctacatagagtttcatagccagtccgggttctactataaaacacgtatacccaaatttggcagagacttttcataccactacccctcatgcgacctgtattttgttggggcaagttccgaggtatatagactgaacctggagcagggcagatacttgaatccactccagaccgacgcagcagagaataacgtgtgtgatatcaacagcgtccacggactgtttgctaccggcaccatagaaggtagagtagagtgctgggatccaaggactcgaaacagagttggccttttggattgcgccctgaactccgtcacggcagattcagaaatcaacagcctccccaccatcagcgctctcaagttcaatggggcacttactatggccgtgggaaccactacgggccaggtgcttctgtatgacctgcgatctgataagccactgctggttaaagaccaccagtatggcctcccaattaagtccgtgcacttccaggattctctggatctcatactgtccgcggattcgaggattgttaagatgtggaacaagaacagtgggaaaatcttcacctccctggaacccgagcatgacctgaacgacgtgtgtctgtacccaaatagtggcatgctgctcacagcaaacgaaactcccaagatgggaatatactacatcccagtgcttggtccagctccacgatggtgcagcttcctagacaatttgactgaggagctggaggaaaacccagagtcaaccgtttacgatgactataagtttgtcacaaaaaaggacctggagaatctgggcctgacacacctgatcggaagcccttttttaagagcctatatgcatgggttttttatggacatccggctctaccacaaggtgaagcttatggtgaaccctttcgcctacgaggagtataggaaagacaaaatccggcagaaaatcgaagagaccagggcacagagagtgcagctcaaaaagctgccaaaggttaataaagaactagctttaaagcttattgaagaggaggaggagaaacagaagtccacatggaaaaagaaagtaaaatcactgccaaatatactgacggatgacagatttaaagtaatgttcgagaatcctgatttccaggtcgatgaagaatcggaggaatttaggcttctaaacccactcgtgagtaagattagtgaaaagagaaagaagaagctgcggttattagagcagcaagagttgagagagaaggaagaggaggaagagccagagggaaaacccagcgacgcagaaagttccgaatcatcggatgatgaaaaagcgtgggtggaagaagtgcgtaaacaaaggcggctactccaacaggaagagaaggtcaagcggcaggagcggctgaaagaagatcagcagaccgtcctcaagccccagttctatgagatcaaagcaggggaagaattcagaagtttcaaggactctgccacaaaacagaaactgatgaacaagacgctcgaggacagattgaaaattgaagcgaagaacggaacacttagtgtatccgatactacagtcggttcaaaacagctaacattcaccctcaaacggtccgagcaacagaaaaaacagcaggaggcagagaagctgcatcggcaggagcggaagcgtttgcgcaggagcgcgggacacttgaagtcgcggcataaacggggacgctcattccattag

SEQ ID NO: 23721 - DNA, 1917 bp, Artificial Sequence
  Description of Artificial Sequence: Synthetic coding sequence
atgccgacagtgtgcaccaccataaaggtctccaaagatggccagtatatccttgcaactggaacatacaagcctagagttaggtgttatgatacctaccagctgagcctgaagttcgaacggtgccttgacagtgaagtggtgacattcgaaatattgagcgatgattatagcaagattgtatttcttcataacgaccgctatattgagttccattctcaaagcggtttctattataagacccggatcccaaagtttggtcgcgacttcagctaccattaccctagctgcgatttgtacttcgtcggggctagtagcgaggtatacagactgaacctggaacagggccgatatctaaaccccctccagacagatgccgcagaaaataacgtttgcgatattaatagtgttcacggcttgtttgcaaccgggaccatcgaaggaagggtggaatgttgggacccacgaacacggaaccgcgtgggcctactcgactgtgcacttaattcagtgacagccgatagcgagattaacagccttccgaccatcagcgccctcaaattcaacggcgctctcaccatggctgtcggtaccacaactggacaggtgcttttgtatgatctgaggtcggacaaacctttgctcgtgaaagatcatcagtatggtctgcccatcaagtctgtgcactttcaggatagtttggatctgattctctctgcagattcacgaatcgtgaagatgtggaacaaaaactccggcaagatcttcaccagtctggagcccgagcacgatctcaacgacgtctgcctctacccaaactcaggtatgctgcttacagccaatgagacccctaaaatgggaatttactatataccagtgctgggccctgctccgagatggtgctcattcttggacaacctgaccgaagagctagaggaaaaccccgagagtaccgtttatgatgactataagtttgtgaccaaaaaggatttagagaatctcggactgactcatctgatcggttcccccttccttagggcgtacatgcacggcttcttcatggatatacggctgtatcacaaggttaagctaatggtgaatccgtttgcttacgaagagtacaggaaagacaagatcagacagaagattgaagagacgcgcgctcagagagtgcagcttaagaagttgcctaaggttaataaagagctggcactcaagctaatcgaagaagaagaagaaaaacaaaagagtacctggaaaaagaaagtaaagtcactgccaaacattctgacggacgacaggtttaaggtgatgttcgagaatccagattttcaggtcgacgaggagagcgaggagtttcgcctacttaatccattggtttccaagatttcagagaagagaaagaagaaactgcgcttattggaacagcaggaattacgagagaaagaggaggaggaagagcctgaagggaaaccaagtgacgctgagagctccgagtctagcgacgatgaaaaggcctgggtggaggaagtgcgcaagcagcgaagacttctccagcaggaagagaaagttaaacgccaggaaaggcttaaggaagatcaacaaaccgtcctgaagccacaattttatgagataaaggctggggaagagtttcgctcatttaaggactcagcgaccaaacagaaactaatgaacaagactctagaagacaggttaaagatcgaggcaaagaatgggacactgagcgtgtcagacaccaccgttggctctaagcagctgaccttcactttgaagcggtcagaacagcaaaaaaagcagcaggaggctgaaaagctccaccgtcaggagagaaaacggttgagacggtcagccggtcatctgaagtcgcgtcataagaggggcagaagctttcattag

SEQ ID NO: 23722 - DNA, 2160 bp, Artificial Sequence
  Description of Artificial Sequence: Synthetic coding sequence
atggcagccctcgaggaggagtttacactctcctctgtggtgctctctgccggacccgaggggttactcggggtggagcagtcagacaaaaccgatcagttcctcgtgaccgattctgggaggaccgtgatcctctataaggtgagtgaccagaagccccttggaagttggtccgtgaaacagggccagattatcacctgtcctgctgtttgtaatttccaaacaggcgaatatgtggtggtccatgataacaaggtcctcaggatttggaataatgaggatgtcaacctcgacaaggtgttcaaggcaaccttgtcagccgaagtgtaccggattctatccgtccagggtacagaaccgctagtcttgtttaaagaaggcgctgtgcgtgggttagaggctctcctggctgatcctcagcagaaaatcgaaaccgttatcagtgatgaagaggtcattaagtggaccaaatttttcgtcgtgtttagacatcctgtcctcatatttattaccgaaaagcatggaaactacttcgcttacgtccagatgtttaacagtcgaatccttacaaagtatacattgcttctcggccaggatgaaaactctgtgattaaaagttttactgcctccgtggatagaaaatttatcagcctcatgtccctgagcagcgacgggtgcatctatgaaactctcatccccatccggccagcagaccccgagaagaaccaaagcctggtaaaatctctactgctgaaagcagttgtctctggtaatgctcggaatggtgttgcactgaccgctctggaccaggaccatgtcgcggtgctgggtagccccctggctgcaagcaaggaatgcctgagcgtgtggaacattaaatttcagaccctgcagacgagtaaggagctacctcaggggacaagtggtcagttatggtattatggtgaacacctttttatgctgcacggcaaatcactgaccgtcattccatataagtgcgaggttagttcacttgccggtgcactcggcaagctaaaacacagccaggaccctggcacacatgtggtaagccacttcgtcaactgggagaccccacagggctgtgggctggggttccagaattccgagcagtctcgacggatccttcgcagaagaaagatcgaggtgagcctgcaacccgaggttcctccaagtaaacagctattgtctaccatcatgaaagacagcgagaagcacattgaggtggaagtgagaaaattcctggcactcaagcaaacccccgactttcacactgtcattggcgacactgtgacaggactactggagaggtgtaaggcggaaccctcgttctacccacggaactgcttaatgcagctcattcaaacgcatgtcctcagctacagcctgtgtcctgatttgatggaaatcgcactgaagaagaaggacgtacaactgctgcagctctgtctccagcaatttccagatattccagagagtgtcacttgtgcctgcctgaaaatcttcctatcaattggagacgactcattgcaagaaacggacgtgaacatggaatctgtctttgattattctattaattccgtccacgacgagaaaatggaagagcaaaccgagatcctgcagaatggatttaatcctgaagaggacaagtgcaataactgcgatcaggaactgaacaaaaaaccgcaggatgaaacaaaggagtccacctcgtgcccagtagtacaaaaaagggccgctctgctgaatgccattttacattccgcttacagcgaaacatttctacttccacacctcaaagatattccggctcaacacataactctttttttgaagtacctttattttctgtacttgaaatgttctgaaaacgccactatgaccctgcccggaatccacccacctaccttgaaccagattatggactggatctgtctcttactcgatgccaacttcacggtggttgtgatgatgcccgaggccaagcggcttctcatcaatttatacaaacttgtaaaaagccagattagtgtgtattcggagttgaacaagatcgaagtgtcctttcgggagcttcaaaagttaaatcaagaaaagaataaccgtgggctgtatagcattgaggttcttgagctattctag

SEQ ID NO: 23723 - DNA, 1614 bp, Artificial Sequence
  Description of Artificial Sequence: Synthetic coding sequence
atgttcaatagcagaatcctcacaaaatatactcttttacttggccaagacgagaactcagtgatcaaaagcttcacagctagcgtggaccgcaagtttatttctctcatgagtcttagcagtgatggatgcatttatgagactctgatccctatcagaccagcagaccctgagaagaatcagtctttggtcaagagcctccttctcaaggccgtcgtcagtgggaacgcaagaaacggcgtggcattgacagccctcgaccaggaccatgttgccgttctagggagtcccttggctgcctccaaagaatgcctgtccgtatggaatatcaagttccagactctccagacttctaaagagctgccacagggcacgagcgggcagctatggtactatggcgagcaccttttcatgctgcacgggaagtccctgaccgtcattccctacaaatgtgaggtgtctagtctggctggagccttgggaaaacttaaacattctcaagatccgggtactcacgttgtgtcccactttgtcaactgggaaactccccagggctgcggcttgggatttcagaatagcgagcagagccggaggattctgagacggcgaaaaatcgaagtgtctttgcagcccgaggtacctccctctaagcagctgctcagtaccatcatgaaagactcggaaaagcatatcgaagtggaggttcggaaatttctagctctgaaacaaacccccgattttcatacagtgataggtgataccgtgacaggactgttggaaaggtgtaaggccgagccctcattctatcctcgaaattgcttaatgcagctcatccagacgcatgtcttgtcttacagcctctgtcccgatctcatggagatcgctctgaaaaagaaggacgtgcagctgttacagctctgcttgcagcaatttcctgacattccagagagcgtaacatgcgcctgccttaagattttcctgtctattggggacgactccttgcaagagaccgatgtgaatatggaaagcgttttcgactattcaatcaattccgtgcacgatgagaagatggaggaacagaccgaaattctgcagaacgggttcaatccggaggaagataagtgtaacaattgtgatcaggagctgaacaagaaaccacaggacgaaacgaaggagagcactagctgccccgtcgttcagaaacgtgcagctcttttgaacgctatcttgcactctgcgtactcagaaacgttcctcttgccccatctcaaggacatccccgcacagcacattactcttttcttgaaatacctgtattttctgtatctaaagtgtagcgagaacgcaaccatgactctcccgggaatccatccaccaaccctgaatcagatcatggattggatatgtctgctgctcgacgccaatttcacagttgtggtcatgatgccagaagccaaacgtcttctgataaatttgtacaagctggtgaagagccagatttctgtgtacagcgagctgaataagatcgaagtatcttttagggaactgcaaaaactcaaccaggagaaaaacaacaggggcctgtatagtattgaggtgctggagttgttctag

SEQ ID NO: 23724 - DNA, 642 bp, Artificial Sequence
  Description of Artificial Sequence: Synthetic coding sequence
atgggcaggaataagaagaagaagagggatggagacgatcggaggccaagattggttctcagctttgatgaggagaaaagacgcgagtatctgactgggttccataagcgaaaggtagagcggaagaaggcagccatcgaggaaattaaacagcgactcaaggaggaacaaaggaagttacgagaggagcgacaccaagaatatctgaagatgctggcagaaagagaggaagctctcgaggaagccgacgaactggacaggttagtcacggccaagaccgaatccgtgcagtacgatcaccctaaccataccgtgactgtgactaccatatccgatctggacttaagtggcgctcggctcctcggactgacacctcccgaagggggagccggtgaccgtagcgaagaagaggctagttccactgagaaacccacaaaggccctgcctcgcaaatctcgggatccgttactcagccaacgcatcagctctctcacagcctcattgcatgcacatagcaggaaaaaagtgaaaagaaaacatccccgtcgcgcacaggacagcaaaaagccaccgcgagccccaagaaccagcaaggctcaaaggcgtagattgaccggaaaggccaggcactccggtgagtag

SEQ ID NO: 23725 - DNA, 642 bp, Artificial Sequence
  Description of Artificial Sequence: Synthetic coding sequence
atgggcagaaacaaaaagaaaaagcgagatggggatgacaggagaccaagattagtactatcattcgacgaagagaagcgaagagaatacctaaccgggttccacaaacggaaggtggagcgcaagaaagccgcaatagaggagattaaacaaagactgaaggaggaacaaaggaagctacgtgaagaacgccaccaagagtatctgaaaatgcttgccgagcgcgaagaagccctggaagaagccgatgaactagacagactggtcacagctaaaaccgagtccgtgcagtatgaccatccaaatcacacggtgaccgtgacaacaatctccgacctcgacttaagtggcgcacgcttgctgggactcacgccccctgaggggggagctggtgatagatcggaagaagaagccagctccacggaaaaacccaccaaagcattaccgcgtaaatcacgcgatccactgctgagtcagcgaataagttccctgacggcttcacttcatgcacattctaggaaaaaggtgaaaaggaaacaccccagacgggcacaagatagcaaaaaacctccgcgagctcccaggactagcaaagctcaaaggcgtcggctcactggaaaggccagacattcaggcgagtag

SEQ ID NO: 23726 - DNA, 1917 bp, Artificial Sequence
  Description of Artificial Sequence: Synthetic coding sequence
atggagtccgagcgcgacatgtaccggcagtttcaggactggtgtttgaggacctatggagattcagggaaaaccaagaccgtgactcgtaaaaaatacgagagaatcgtacagctgctcaatgggagcgagagcagttccacggataatgccaaattcaagttttgggtgaagtctaagggttttcagttgggccagccagatgaggtgcgaggaggcggagggggagctaaacaagtgctgtacgtgcccgtgaaaactaccgatggagtaggagtcgatgaaaagctgtccctcaggcgtgtagctgtggtcgaggatttttttgacataatctactctatgcacgtggagaccgggcctaacggtgaacagataaggaaacacgcaggccagaagagaacatataaagcgatcagcgagtcctatgcgttcctgcctcgcgaagcagtaaccaggtttctgatgtcatgcagtgaatgccagaagcgcatgcaccttaatcccgatggcactgatcacaaggataacggcaaaccgccaactctggtgacctcgatgattgattacaatatgcccattacaatggcatacatgaaacacatgaagttacaactcttaaactcgcagcaggatgaggatgagtccagcatcgagtcagacgagttcgacatgagcgactcgacccgtatgagcgcggtgaacagcgacctatcttccaatctggaggagcgaatgcagtccccacagaacttacacggccaacaggacgatgactccgcagcggagtcattcaacggaaatgagacgttgggacactccagtattgctagtgggggaactcattctcgcgaaatgggcgatagcaactctgatggcaaaaccggactcgaacaggatgagcaaccactgaatctttcggacagccctctgagtgctcaacttacaagtgagtatcgaatagacgatcacaacagcaacggtaagaacaaatacaagaacttgctaatcagtgatctcaagatggagcgcgaggcccgtgagaacggctctaagagccccgctcactcttacagtagttacgattcagggaaaaatgaatccgtggacaggggcgctgaggacctcagcctcaatcggggagacgaagacgaagatgaccacgaagatcatgacgactccgaaaaggtaaatgaaacagatggggtcgaggctgagcgcctgaaagcgtttaatatgtttgtacggttattcgtcgacgagaatctggatcgcatggttcctatttcaaagcagccaaaagagaagatacaagctattatagactcatgccgcagacagttccccgaatatcaggagcgcgcaagaaagagaatacgaacctaccttaaatcttgcagaagaatgaagaggagcgggtttgagatgtcgcggccaataccatcccatctgaccagtgcagtcgcagagtctatccttgcatcagcctgcgagagtgagtctcgaaatgctgccaagcgaatgcgcttggaacgccagcaggatgagagcgcacccgctgataagcaatgcaagcctgaggccacacaggccacgtactcaacgagcgcggtgcctgggtcacaggacgtcctgtacatcaacgggaatggcacatattcctaccactcatatcgcggtcttggtggagggctgttgaacctcaacgacgcctccagttcaggccctaccgacctttccatgaagcgtcagcttgctacctccagcggtagttcttcaagttccaattcccggcctcagctgagccctaccgaaatcaacgccgtgcgccagctggtggcaggttatcgcgagagtgcagcattcctgctaagaagcgccgatgaactcgaaaatttgatactccagcagaattag

SEQ ID NO: 23727 - DNA, 1269 bp, Artificial Sequence
  Description of Artificial Sequence: Synthetic coding sequence
atgcacgtggaaacaggcccaaatggggagcagatacgcaaacacgcaggtcagaaacgcacctacaaagctatcagtgaatcctacgcatttctgccgcgagaagctgtaactcgtttcctcatgtcgtgttcagaatgccagaaaagaatgcacttaaatcccgatggaactgaccataaagacaatgggaagcctcctacgctggtcaccagcatgattgactataacatgcccattaccatggcatacatgaagcacatgaagctccagctgctgaatagtcagcaggacgaagatgaatccagtattgaatcggacgaattcgacatgtcagatagcactaggatgagcgctgtaaatagcgatctatcgtcgaacttggaagagaggatgcagtctccccagaacctgcacggacagcaggacgacgatagcgctgctgagtctttcaatgggaacgagaccttgggacatagcagtatagcttctggtgggacacattcacgcgaaatgggggatagtaattcagatgggaaaacaggcctcgaacaggatgagcagcccctgaatctatcagattcccccttatccgcacagttaacctctgaatatcggatcgacgatcacaatagcaatgggaagaacaagtacaaaaatctgctgattagtgacctgaaaatggaacgggaggcgagggaaaatggatcaaagagtcccgcacatagttattcttcctatgactcaggcaaaaacgagagcgtagatagaggcgcagaagatctttcacttaacaggggggacgaggacgaggacgaccacgaagaccacgatgatagtgagaaggttaacgagaccgatggcgtggaggctgagcggttaaaagctttcaacgacgagtcagcccctgccgataagcagtgcaagccagaggccacgcaggccacttacagcaccagtgcggtacccggaagccaggacgtattgtacatcaacggcaacggaacctattcatatcattcatatcgtggactgggcggaggattgctcaatcttaatgatgccagtagttccgggccaaccgatctctccatgaaaaggcagttggccaccagttccggctccagctcttcctccaacagccgccctcaactgtctccaaccgagattaatgctgtgagacagttggtagctgggtatcgggagagtgccgcattcctactgcggagtgccgacgaactggagaatctcatattgcaacaaaattag

SEQ ID NO: 23728 - DNA, 600 bp, Artificial Sequence
  Description of Artificial Sequence: Synthetic coding sequence
atggaccagactatgttggacgacagcgcagccgaaagctttaacggtaacgaaacactggggcacagtagcattgcatcaggcggaactcacagccgagagatgggcgactccaactcagacgggaagaccggactcgaacaggacgagcaaccactcaacttgagcgattctcctttgtcagcacagctcacatctgaatacagaattgacgatcataattctaatggcaagaataaatataagaacctgctaatatctgacctgaagatggagagagaagcgagagagaatggatccaagtcccccgcacattcctattctagctatgatagtggcaagaacgagtccgtcgatagaggcgctgaggacttgtccctcaatagaggcgacgaggacgaggatgaccacgaggatcacgacgactccgagaaagtgaatgagacagacggcgtggaggctgaacgactgaaagctttcaattcacgaccgattcccagccacttgacctctgccgtggcagaatctatcctggctagcgcctgcgagtctgagagtcgaaatgccgcaaaacgaatgcgtctggagagacagcagtag

SEQ ID NO: 23729 - DNA, 1062 bp, Artificial Sequence
  Description of Artificial Sequence: Synthetic coding sequence
atgggcgattcaaattccgatggaaaaactgggctagaacaagacgaacagcccctgaacctcagcgattctcccttgagtgcacaactgacatctgagtatagaatagacgatcacaacagcaacggcaagaataagtacaagaatctcttaatttctgatctgaagatggagagggaagctcgagagaatggaagtaaatctcccgctcactcttatagcagctatgactcaggtaagaatgagtctgttgatcggggtgccgaagacctaagcctgaaccgcggagacgaagatgaagatgaccatgaggatcatgatgacagcgaaaaagtgaatgaaacggacggcgtcgaggctgaaaggttaaaagctttcaatatgttcgtgagattatttgttgatgagaatctcgacaggatggtgccaatttcaaagcagcctaaagagaaaattcaggctattatagatagctgtagacgacagttccccgaataccaagagcgtgctaggaagaggattcgaacctatctgaaatcatgtcgaaggatgaaaaggagcggcttcgaaatgtcgcgtcccatcccctcacacctgacatcagctgtagccgagtcaatattagcctccgcctgtgaatcagagagcagaaacgcagccaaacgaatgaggctggagaggcagcaggacgaatccgctcctgctgataagcaatgcaaacccgaagcaacccaagcgacatactctacatctgcagttcctggcagccaagacgtgctgtatattaatggaaatggtacttattcgtaccatagttaccgcggattgggcggaggactcttaaatctcaacgatgccagctccagtgggccaacagacctttccatgaaacgtcaactggctaccagctctggaagttcgtcctcttcaaatagccgaccccagttgagtccaactgaaattaacgcggtgcggcagctcgtggctgggtatagagagagcgccgcatttctcctgcgatccgcagacgagcttgagaatcttatactccagcagaactag

SEQ ID NO: 23730 - DNA, 1260 bp, Artificial Sequence
  Description of Artificial Sequence: Synthetic coding sequence
atgtcctgttccgagtgtcaaaaacggatgcatctcaaccccgatggaacggatcacaaggataacggcaaaccacccaccctcgtcacaagcatgattgactataacatgcccattacaatggcctacatgaagcacatgaagctccaacttcttaatagtcagcaggacgaggatgagtcctcaatagagtcagatgagtttgatatgagcgatagtacacgtatgtctgccgttaatagcgacctgagctctaatctggaagaacgtatgcagtcaccgcagaacctgcatggccaacaggatgacgatagcgccgctgaatccttcaatgggaacgaaacacttggccatagctccattgcttccggaggaacccattctagagaaatgggcgactctaactctgatggaaagacaggccttgaacaggacgagcagcccctgaatctgagcgattctccactgtccgcccagttgacctccgaatacaggattgacgatcacaattccaatggaaaaaataagtataaaaatctcttgataagtgatttgaaaatggagcgggaggccagagaaaacgggtctaagtctccggctcatagctatagctcttacgatagtggaaagaacgaatccgtggaccggggtgccgaggacctgtctttgaaccgcggagacgaggacgaggacgaccacgaggatcatgacgactccgagaaagtcaacgagaccgatggggtcgaggccgagaggctgaaggctttcaatagccgcccaattccatctcatctgacttccgcagtcgccgaaagcattcttgcatcagcatgtgagagcgaatctcggaatgcggcaaaaaggatgcgcttggaaaggcagcaagacgagagcgcgccagctgacaaacaatgtaagccagaggccactcaggccacttattctacatccgccgtccctgggagccaggacgtgctctatattaacggaaatggtacttacagttaccatagctataggggcctgggcggtggcctactgaatcttaatgatgcctctagcagcgggcctacagatctgagtatgaagagacagttggctacttcttccgggtcctcatcaagctcaaacagtcgccctcagctgagtcctactgagattaacgccgttcggcagctagtcgccggatatagggagagcgccgcatttctcctgcgcagcgctgacgaacttgagaacctgatccttcagcagaactag

SEQ ID NO: 23731 - DNA, 1695 bp, Artificial Sequence
  Description of Artificial Sequence: Synthetic coding sequence
atggccgacctgatgcaagaaactttcttgcaccatgcaacagatggtgtgggcgtggacgagaagctttcactgcgacgcgtggcagtggtggaggatttttttgacattatttattccatgcatgttgagaccggcccaaatggtgagcaaatcaggaaacacgcgggtcagaagcggacctacaaggccatatccgaatcatacgcattcttaccgagagaggccgtaaccagattcctgatgagttgctctgaatgccaaaagcggatgcacctcaaccctgacggcactgaccacaaagataacggaaagcccccaactctggtaaccagcatgatagactataacatgcctatcactatggcctatatgaagcacatgaaattacagctcctgaattctcagcaggatgaggacgaatccagcattgaatcagatgagttcgatatgtccgattctacacgcatgagcgctgtgaactctgatcttagtagtaatttggaagagaggatgcagtccccgcagaacctacacggacagcaggacgacgactccgccgctgagagcttcaacggaaacgaaactcttggccactccagtatcgctagcggtgggactcacagcagagagatgggagatagcaactccgatggcaaaactggactggaacaggacgaacagccgctgaatctgtcagattcacctctctctgcgcagttgacaagcgagtaccggatcgacgatcataattcaaacggcaaaaataaatataaaaatctcttaatctcggatctgaaaatggaaagggaagcaagagaaaatgggtctaaatcccctgcacactcatattcatcatatgatagcggtaagaacgagtccgtggacagaggtgccgaggaccttagcctgaaccggggagacgaagatgaggacgatcatgaggatcatgacgattctgagaaagtcaacgagacagacggcgtggaagctgaaagacttaaagcctttaacatgtttgttcgacttttcgtcgacgagaatctcgacagaatggtgcccatcagcaagcagcccaaagaaaaaatccaggcaattattgactcatgccgcagacagtttcctgagtaccaggagagagcaagaaaaaggatacgcacttatctgaaatcctgccggcgtatgaagcgatcaggatttgagatgtcacgccctatcccctcccaccttacatctgctgtagccgaatctatactcgcatcagcgtgcgagtccgaaagccgaaacgcggcaaaacgtatgcggctcgagcgacagcaagatgaaagtgctccagctgataagcagtgcaaacccgaagccactcaggccacctattcaacgtccgcagttcctgggtcacaagacgtgttgtatataaatgggaatgggacgtacagctaccactcttacagaggacttggtggtgggttgctaaatctgaatgatgcatcttcctctggcccaaccgatctgtctatgaagcgtcagctggccactagctcagggtcgagctcatcgagcaattctaggccacagttgagccctactgagattaacgccgttcgccagctcgttgctgggtaccgcgagagtgcagcttttctcctgcgatccgctgatgagctcgaaaatctcatcttgcaacagaactag

SEQ ID NO: 23732 - DNA, 2109 bp, Artificial Sequence
  Description of Artificial Sequence: Synthetic coding sequence
atggctgactccggtctcttgctaaaaaggggctcatgccgttcgacatggctgagggtgaggaaggcaagaccacagttgatcctgagtcggagaccaaggaggaggctgggatccctccggtggtgcggcaggcgaaggttacgctggaggttactgcaagcgcaggcatccggtgtcgattggagggagggagcacggcaagtttcacgtgccgcagctgctagaagacctaataccgctacaccttcccccatcccttctcccaccccagcgtccgagccggagtctgaacctgaactcgaatcagcctcctcttgtcatcgcccactcctgataccccctgttcggcctgtcggtcctgggagggcacttctgctgctgcccgtcgagcagggatttacgttctccggcatctgtagggtgacatgcctatatggacaggtccaggtattcggatttacgatttcccaaggccagcccgcacaggatattttctccgtgtatactcattcctgcctgtccattcacgccttgcactactcgcagccggagaagagcaaaaaggaattgaaaagagaagccagaaacctgttgaagtcacatctgaatcttgatgatagacgctggtccatgcagaacttctccccacagtgtagcattgtgctgcttgagcacctgaaaactgccacggtgaactttattacaagctacccgggttcgtcgtatatattcgtacaagaatcacccacccctcagatcaagccggagtatctggcgcttagatctgtgggaatccggagggagaaaaaaaggaaaggcctgcagctgactgaatcgactctatctgctttggaggagctcgtgaacgttagctgcgaggaggtagacgggtgtcccgtgattctggtgtgcggatcccaggatgtaggcaagtcgaccttcaaccgatatcttataaaccaccttctgaactccctcccctgcgtcgattatctggaatgcgacctgggtcagaccgaatttactccaccaggttgtataagccttttgaacattactgagcccgtgctcgggcctccctttacccatttacgcacaccacagaagatggtgtattacgggaaaccatcttgtaagaacaattacgagaattacatcgacatcgttaagtacgttttttccgcctacaagcgcgaatcccctcttatagtgaatacgatgggttgggttagcgaccaaggtctgctcctgctaatcgatctgattaggctgttatccccctcacatgtggtccagtttaggagtgatcacagcaagtacatgcccgatctcactcctcagtacgtcgatgacatggatgggctatatactaagtctaagacaaagatgcgcaataggaggtttaggcttgcggcattcgctgacgcccttgaatttgcagacgaggaaaaggaatccccagttgagtttaccgggcacaagttgattggcgtgtacaccgattttgcgtttaggattacaccaagaaaccgagaaagtcacaacaaaatccttagggatctctccatcttaagttatcttagccagctacaaccgcctatgcccaagccacttagtcctttacatagtctgactccttaccaggtacctttcaatgccgtggccctgcggataacccatagcgatgtggccccaacccacatactgtacgctgtaaacgccagttgggtcggactctgcaagatccaggacgatgttcgtggttatactaatgggcctattcttcttgcacaaacccccatttgcgattgcctcgggttcggaatatgccggggtatcgatatggaaaagcgactgtatcatattcttacgccagttcccccagaagaacttcggacggttaactgcttgctggtgggtgcaatcgcaattcctcactgtgttctgaagtgccagcggggtattgaaggcactgttccctatgtcacaacagactataattttaagctcccaggcgctagcgagaaaatcggtgcgagagaacctgaagaggctcacaaggagaagccatataggcgtcccaaattctgccgtaaaatgaaatag

SEQ ID NO: 23733 - DNA, 2583 bp, Artificial Sequence
  Description of Artificial Sequence: Synthetic coding sequence
atggctgctagccggtctgcaggggaggcagggccaggtggctcccaaggtcgggtcgttaggatgaagcgccgtggtggccgtggaccaaggagagggcctgccggaggcggagagaaggcattaaaaaggctgaagctggcggtcgaagagtttgtccacgccacatccgagggcgaggccccaggtgggtgtgaagggagaggcgctcccgtgtcctttaggccagggggacggaaatcccgaaaggagctacgaaaagaaaaacggcatctgcggaaggcgcgtcgcctgcaaagaaccgctggccctgagcagggtccaggcctcggcggaaggtctggcgcagaagaggcctcaggccatagacaggatactgaggagcgggcacgacctgcaccaagtagggatcccagtcccccacgtaaaccgagaccttcgagagtgaaggccaaagccaccgcagcaaccgctaagacaaggccctccgctgcagccacggccgcagctcgtaaaagggctttactggccgcaaatgaggaagaagaccgggagatacggaagctggagagatgcctgggactcaacaaacgtaagaaaaaggatggttcctcctctgtacctttgtccttcgcacgcgatggactggactacatactgggagccctcgagtcaggcaagaattctggattatatgatagctccggcgaagaggaagaggatgccggtcagacccttccggaatctgacctggagagcgacagtcaggacgaatccgaggaggaagaggagggggacgtcgagaaggaaaagaaagcccaggaggctgaggctcaaagcgaggatgacgacgaagacacagaggaagagcagggcgaggaaaaagaaaagggggcacaagaaaaaaggcggggaaagagagtgcggttcgccgaagacgaggaaaaatccgagaattcatccgaagatggagacattaccgacaaatctctgtgcggtagcggggagaagtacattcccccacacgtgaggcaggctgaggagaccgtcgactttaaaaaaaaagaagaacttgagcggttaaaaaagcatgtcaaaggactgctcaatcgcctttccgaaccaaacatggcatccattagtggacaactggaggagctttatatggcccatagcagaaaggacatgaacgatactctgacgtccgcattgatgggagcctgtgtgactgctagcgcaatgccctcacgactgatgatggaacacgtgctgttggtttcgattctgcaccatactgtagggatagaggtgggagctcatttcctagaggcagtggttcgaaagtttgacgccatttacaagtatggatcggaaggcaaggagtgcgataacttattcacagttattgcccacctgtataactttcatgttgttcaatccctgctcattttcgacatactcaagaagctaatcgggactttcacagaaaaggatatagaattgatcctcctgatgctcaaaaatgtgggtttctcactccggaaagacgatgcgttaagtcttaaggagctgattaccgaggcccaaaccaaggcatccggcgctggttccgagtttcaagaccagactcggattaggtttatgctcgaaacaatgctcgcactcaaaaataacgacatgagaaagatcccagggtacgatccagagcctgtggaaaaactgcggaagcttcagcgcgctctcgtccggaatgcgggatctgggtccgagacacagctcagggtatcgtgggatagtgttctgtccgcggagcaaaccgggagatggtggatcgtgggctcagcctggtccggcgctccaatgatagataatagccatcacacccatctccagaaacaactcgtcggcacagtaagcagtaagattttggaactggcaaggaagcaacgcatgaatactgacattagacgcaacatattctgtactattatgacttctgaggatttcctggatgcctttgagaagctgctgaaactcggtcttaaagaccagcaagaaagagagattatccatgtcctgatggactgttgtctacaggagaagacttacaaccctttttacgcgtttctggcctctaagttttgcgagtacgagcggcgattccagatgacttttcagtttagcatatgggataagtttcgtgatctggaaaacctgccggctacaaactttagcaatctcgtgcacctggtggctcaccttctgaagacaaagagcctttcactcagcatcttgaaagtcgtggaattctctgagcttgataaacccagagtacggtttttaaggaaagtgctgagcatcttgctgatggagacagaagttgaagacctttcactgatcttcacccgagtgtctgataacccgaaacttggcgtcctgcgggaaggcttaaaacttttcatctctcacttcctgctcaagaatgcccaggcccaccgaagcgccgatgaagccaacgtgctacgagaaaaggccgatctggccacgaagtgcctgcagggtaaggccagtttacggatgtag

SEQ ID NO: 23734 - DNA, 4917 bp, Artificial Sequence
  Description of Artificial Sequence: Synthetic coding sequence
atggctgcagccgcaggagggccatgcgtgcgctcatcgagagaattgtggaccatactgctgggcaggtccgctctccgggagctgtctcagatcgaggccgagctcaacaagcactggagacgtctattagaaggtctgtcctattataaacccccttcaccgtcctccgctgaaaaggtaaaggccaacaaggatgtggcatctccgcttaaggaactgggactccgcatcagcaagtttctcgggctggatgaggagcaaagtgtgcagctcctgcagtgctacctgcaggaggactatcggggaaccagagactcggtcaaaaccgtcctctatttcgagatggcgcctagtgatcttctggttctgacaaaaatgtttaaagaacaaggattcggttctcggcagaccaatcggcatctggtcgatgagaccatggacccatttgtggatcgaatcggatacttcagtgcgttaattctggtcgagggcatggatatcgagagtcttcataagtgcgcgttggacgacaggcgtgagctgcatcagtttgctcaggatgggcttatttgccaagacatggattgtctaatgcttacttttggtgatattccacaccacgcccctgttttacttgcgtgggccctccttagacataccttaaacccagaggagacttccagtgtcgtcagaaaaatcggtggcacagccatccaactgaatgtgttccagtacctgactaggctgctccagtcactagcgtcgggcggaaacgactgtactacatcgaccgcttgtatgtgcgtatatggcttgctgtcattcgttctcacctccctggaactccacaccttgggcaatcaacaggacataatcgacactgcgtgtgaagtgctcgccgatccctctctacctgagctgttttgggggacagaacctacatccggtttgggaattattctggacagtgtctgtggtatgttcccacacctcctctccccactgctccagctgctgcgcgctctggtgtcgggaaaatccacagctaagaaggtgtactcattccttgataagatgtccttttacaacgagctgtacaagcacaaaccgcacgacgttattagccacgaggacgggacattgtggagacgacagacacccaaacttctctaccccctcgggggtcaaaccaacctgcgtataccccaggggacagtgggacaagtgatgcttgacgaccgcgcatatctagtgcgctgggagtacagttattccagctggacgctcttcacctgcgagatcgaaatgttactgcatgtagtcagtacggcagatgttatacagcattgtcagagggttaaaccaattattgaccttgtgcacaaagtaatatccacggacctatccattgcagactgtttactgcccatcacctccaggatttacatgttactccagcggcttactacagtcattagcccccctgtagatgtcattgcctcgtgcgtcaactgcctcactgtgctagcggcaaggaaccccgcaaaagtgtggactgacctgcgccatacaggcttcctccctttcgttgctcacccagtcagttctctctctcagatgatctcggccgagggaatgaacgcaggcggatacggtaatttgctgatgaactcggaacaaccccagggcgagtatggagttacaatagccttcctgaggctcattacaaccctggtaaaaggacagttgggctccacgcaaagtcaaggcttagtcccatgtgttatgtttgtactaaaggagatgctgcccagttatcataagtggaggtataatagtcacggcgtgcgggagcagattgggtgcctgattctagagctaattcatgcaatcttgaacctgtgccatgaaacagatttgcactcgtcccacaccccatctcttcaattcttgtgtatctgctccctggcatacaccgaagctggccagactgtcataaatattatgggaatcggagttgatactatcgatatggtgatggccgctcagcccaggagcgatggcgctgaaggccagggccagggtcaattgttaatcaagaccgtgaaactcgccttttctgtgacaaataacgtcatccgccttaaaccaccttcgaacgtggtctcaccgctcgaacaggcgctgtcccagcacggagcccacggcaacaacctcatagccgtgctggcgaaatacatataccataagcacgatcccgctctacccagactcgctatacagctgctcaagagactggctaccgttgcccctatgagtgtgtatgcttgcctagggaacgacgcagcggctataagggacgcctttctgacccggctgcaatcgaagatcgaggacatgcgcatcaaggtgatgattctggagtttctgactgtggctgtggaaacacagcccggtctgatcgagttgttcctgaacctcgaagtcaaggatggttctgacgggagtaaagagttcagtcttgggatgtggtcttgcctgcacgcagttctggaattgattgactctcagcagcaggacagatattggtgtccacctttactgcatcgagccgcaattgcgttcctccatgccctttggcaggatcggcgagattctgccatgctcgttttgcgtactaaaccaaagttctgggagaatctcaccagtccattgttcgggacactgagtcctcctagtgagacgtcagagccttcaatcttggagacctgtgcactaattatgaagattatctgcttagagatctattacgttgtgaaaggcagtctggaccaatctctgaaggacacactcaagaaattctctatcgagaagagattcgcatactggagtggttacgtgaagtctctagcggtgcacgttgccgaaacagaggggtcctcttgtactagtctgttggagtatcagatgctggtttccgcctggagaatgcttctgatcatcgctaccacgcacgcggacattatgcatctcacagactccgtcgtgcggcgacaactgtttctcgacgtgttggatgggaccaaagctctcttgttggtgccagcctcggtgaattgcctcagactgggtagcatgaagtgcaccttgctgttaattctgctcagacagtggaagcgcgagttaggatccgtcgatgagatcctcggcccactgaccgagatcctggagggagtcctgcaggccgaccagcagttaatggaaaaaaccaaggccaaggtcttctctgctttcatcaccgtgttacagatgaaggagatgaaggtgagcgacattccacaatacagccaacttgtattaaatgtgtgcgagaccctgcaggaagaggtgattgccctgtttgatcaaacaagacactctctagcgctggggtctgccaccgaagacaaagattctatggagacggacgattgttctaggagccggcaccgggaccagcgcgacggcgtctgcgtcctggggctgcacctcgcaaaggaactgtgtgaggttgacgaggatggcgactcctggctgcaggttacaaggaggcttcccattctgccaaccttgctcaccaccttggaagttagtctacgcatgaagcagaacctccattttactgaggccacgctccatttgctcctgaccctggcacgcacccagcagggagcaacagccgtggccggtgcgggaataacacagagcatttgtctgccactgctgtcagtgtaccagttgagcactaacgggactgcgcaaactccatcagctagcaggaagagtctggacgccccaagctggcctggggtttatcgactgagtatgtcactgatggagcaattgctaaagaccctacgttacaatttccttcctgaggcattggactttgtgggagtgcaccaggagaggaccctgcaatgcttgaatgcagtccgcacagtgcagtcccttgcctgcttggaagaggctgatcacactgtgggattcattctgcagctttccaatttcatgaaggaatggcatttccacctccctcagttaatgcgcgacattcaggtgaatctggggtacctctgccaagcatgtacttccctgctgcactccagaaagatgctgcagcactaccttcaaaataagaacggcgacggactccccagcgccgtggcacaacgggttcagcgacctccctctgctgcttccgccgctcccagctcatctaagcagcctgctgccgacacagaggcgtccgagcaacaggcgctgcacaccgtgcagtatgggctactgaaaatcctttcgaaaactctggctgctctgcggcattttacccccgatgtctgtcagattctcctcgatcaaagtctcgaccttgccgagtataatttcctcttcgcattatcattcactacaccaacatttgacagtgaggtggctccctctttcggaactctgttggcgactgtgaacgtagcgctgaatatgctcggcgagctggacaaaaagaaagaacctttgacccaggctgtaggtctgtcaacccaggccgaaggaacccgcacactcaaaagcctcctgatgttcaccatggagaactgcttttatctgctgatcagccaggccatgcgctaccttagagaccctgcagtgcacccaagagacaagcagcgaatgaagcaggaattgagcagcgagttgtccacactgctcagctctctctccagatactttcggagaggggctccctcttcacccgctaccggcgtattgccctccccccaagggaagtccactagtctttccaaagcaagtcctgagtctcaagagccactgattcaattagtgcaggctttcgtgaggcacatgcaaaggtag

SEQ ID NO: 23735 - DNA, 5249 bp, Artificial Sequence
  Description of Artificial Sequence: Synthetic coding sequence
atggccgcagcagcgggaggtccttgcgtaagaagttcccgggaactgtggacaatcctccttggccgttccgccctccgcgagctctcccagattgaggccgaattgaataaacattggcgcagactgctggagggcctttcctactataagcctccaagtccatcttcagcagagaaggtgaaagctaacaaagatgtcgctagccccttgaaagagttaggcttacgaatcagtaagtttctcggcctggacgaggagcagagcgttcagctcctgcagtgttatctccaggaagactaccggggaactagggatagcgtcaaaacggtgcttcaggacgaacgtcagagccaggctttgatcctgaaaatcgctgattattattacgaggaacgaacctgcatactgaggtgtgtgctgcacctgctgacctactttcaggatgagcgtcatccctatcgcgtggagtacgccgactgtgtagacaaactcgaaaaagaattggtctccaaatataggcagcaattcgaggagctttacaaaacagaagcacctacctgggaaacacatggtaatttgatgactgagcgccaggtcagccggtggttcgtccagtgcctccgcgaacagtctatgctgctagagatcatctttctctattacgcctacttcgaaatggccccatctgacttactcgtcctaacaaaaatgtttaaggaacagggctttggtagtcgccagaccaatagacacctggtggatgagaccatggatccctttgtcgaccgcatcggttacttttctgccctcatccttgtagaaggaatggatattgagagcctgcataagtgtgccctggatgacagaagggagctccaccagtttgcccaggatggccttatttgtcaggacatggattgcctcatgctgacctttggagatattccccaccatgctcctgtccttctggcgtgggcactgctgaggcacaccctaaatcccgaggaaacttctagtgtggtgcgaaagatcggagggacagccattcagttgaatgtcttccagtacctgacccggttattacagagtctggccagcggcggtaacgattgcacaaccagtactgcgtgcatgtgcgtgtatggactcttatcattcgtattgacctcactggaactgcacacactgggcaaccaacaagatattatcgacactgcctgtgaagtactggccgatccatcgcttccagaactgttctggggaactgaacccactagcgggctaggtatcatactcgactccgtgtgtgggatgttccctcacctgctctcgcccttactgcagctgctgcgcgctctcgtcagtggcaagtctaccgctaaaaaagtgtatagcttcctggataagatgtccttctacaacgaactgtataagcataaacctcacgacgtgatcagccatgaagatggcacactgtggcgcaggcagacacccaagctgctctaccccctgggtggccagactaacctcaggatcccgcagggcacagtcggacaggtgatgcttgacgaccgcgcatatctcgtccgctgggagtatagttacagtagctggacactctttacgtgcgagatcgagatgctgctacatgtcgtcagtacggccgatgttatacaacactgtcaaagggtcaaacccattattgacctggttcacaaagttatttcaaccgacttgtccatcgccgattgtctcttaccaataactagtcggatatacatgcttctgcagcggctcactacagtgataagccctcctgtagatgtgatcgctagctgcgtaaactgcttaactgtgcttgccgcaaggaacccagctaaggtttggaccgatctccgacatacgggcttcttaccattcgtggctcacccggtgtcgagcctctcccagatgattagcgccgaaggcatgaatgcgggaggatatgggaacctgctgatgaattccgaacaaccccagggggaatatggagttacgatcgccttcctgagactcatcaccaccctcgttaaaggacagctcgggagcacccagagccagggactcgtgccctgtgtgatgtttgtgttgaaggaaatgctgccctcctatcacaaatggcggtacaactctcacggtgtgagagagcagatcgggtgtctcattctcgagctcattcacgccatcctaaacttatgtcacgagactgacttacacagcagccacactccctctcttcagtttttgtgcatatgttccctggcctacacggaagccggacagacggtgatcaacattatgggcatcggggtggatactattgatatggtgatggccgcacagccacggagtgacggggcagagggccaaggtcaggggcagctgctgattaagacagtgaaattggccttcagcgtaaccaacaatgtgataaggctgaaaccaccctcaaacgttgtcagcccactggagcaggccttgtcccaacacggggcacatgggaataacctgatcgccgtcttggccaaatatatctaccacaaacatgaccctgccctgccacgcctggccatccagctcttgaaacgactcgcaacagtcgccccaatgtcggtgtatgcctgcttgggcaatgatgctgcagctatccgagatgccttcctgactcggctgcaatccaagatcgaggatatgcggattaaagtgatgatcctggaattcctgactgtcgctgtggagacgcagcctggcttgattgaactctttttgaacctggaggtgaaagacggcagcgacgggagcaaggaattttctttaggaatgtggtcatgcctgcacgctgtgttagagctgatcgattcccagcagcaggataggtattggtgtcccccactgctccatcgagccgcaatcgcattccttcacgctttatggcaggacaggcgggactcagcaatgctcgtattgaggacgaagcccaagttttgggagaacttgaccagccctctattcggaacactgtcccctccctcagagacatccgagccttcaatcctggaaacctgcgccctgattatgaaaataatttgcctagaaatttactatgttgtcaaaggaagcttggaccagtcccttaaagacactctgaagaagttctccatcgaaaagagattcgcctattggtctggttatgtcaagtccctggcggttcacgtcgctgaaaccgaggggtcgtcctgcaccagcctgctcgagtaccagatgctcgtgtcggcatggcggatgctgctcattatcgctactacgcacgccgacattatgcacctcaccgactctgtcgtgcgacgccagctttttctggatgtccttgatgggacaaaagctctactccttgtgccagcaagtgtcaactgcttaaggctggggtccatgaagtgcacgctgctcctgatcttgcttaggcagtggaagagagagcttggctccgtggacgaaatcctcgggccactgacagaaattctggagggcgttctgcaagccgaccagcagcttatggagaaaaccaaagctaaagtcttttctgcttttatcacggtgcttcagatgaaggaaatgaaagtgagcgacattcctcagtacagccagttggtcctgaacgtttgcgagacactgcaggaagaggtgatagctttgttcgatcagactagacacagtctcgcgctagggagcgctaccgaagacaaggatagcatggagactgatgactgctccagatcgagacatcgtgaccagagggatggggtgtgcgttttaggtctgcacctggcaaaagaactttgtgaggtcgacgaggatggggattcatggctacaggtcacaagacgcctccccattctaccaactcttttaaccactctcgaagtttccctccgaatgaagcagaatctacatttcactgaggccaccctgcatttgctgctgactctggcacgcactcagcagggcgctactgccgtcgccggtgccggaatcacccagtcgatttgtcttcctctgctgtccgtataccagctcagtactaacggcactgcacagacacccagcgcttctcgaaagtccctcgatgctccaagctggcccggagtataccgcctgtccatgtcactcatggagcagctccttaagaccttgcggtacaattttctgccagaagctcttgacttcgttggcgtgcaccaggagcgtactcttcagtgcctcaatgcagtacgaaccgtgcagtccctggcgtgtctcgaggaggcggatcacaccgtgggctttattctccaattgagcaattttatgaaggagtggcatttccatctcccacaacttatgcgtgacatacaggtgaatttaggctacttatgtcaggcatgcacatcactgctgcactcgcgtaagatgttacagcattatctgcagaacaaaaatggcgacgggcttccgagtgctgtggctcagcgcgtacaaagacctccgtccgcagcttccgcggcaccatcaagttccaagcagccagcggctgacacagaagcaagcgaacaacaggccctccacactgttcagtacggtctgctgaaaatcctgtccaagacactggccgctctgaggcacttcacacctgatgtatgtcagatccttttagaccaaagtttggacctggccgagtacaatttcctgtttgctttatcctttacgacccctacttttgacagcgaagtggcgcctagcttcgggaccctgctggctaccgtcaatgtggctctcaacatgctcggcgaattggacaagaaaaaggagccattgacccaagcagtgggcctgtcgacacaagccgagggaacccgtacactgaagtctttgctcatgtttaccatggaaaattgcttttacctactcatcagtcaggcaatgcgctaccttagggacccagccgtacatcctcgagacaagcagcgcatgaaacaggaactcagtagtgaattgtcaacactgctttcctccctatcccggtacttcaggagaggtgccccttcatccccggcaacaggcgtgcttccttccccccaaggtaaaagcacaagtttaagcaaggcgagtccagagagccaggaaccactcatccagctggtacaagcgtttgtccgccatatgcagagata

SEQ ID NO: 23736 - DNA, 219 bp, Artificial Sequence
  Description of Artificial Sequence: Synthetic coding sequence
atgcagttcacctcaatatcaaatagccttacatctaccgccgctatcgggttgagttttacaacaagcaccacgacaacagctacatttactactaataccactacaactatcacaagcgggttcaccgtgaatcagaaccagttactgtctagaggcttcgaaaatctggttccgtacaccagcactgtgcggttcgtgttttacatggagaagtag

SEQ ID NO: 23737 - DNA, 801 bp, Artificial Sequence
  Description of Artificial Sequence: Synthetic coding sequence
atgcagtttacatcgatctcaaacagtttgaccagcacggcagcaatcggcctctcgtttaccactagcacaacaaccacggctacatttactaccaacacaacgactacgattacctcgggctttaccgttaatcagaaccagctgttgtccagaggtttcgaaaaccttgtgccatacaccagcactgtatcagtggtggcaacaccagtgatgacatatggacatcttgaggggctcattaacgaatggaaccttgaactcgaggaccaggagaaatatttcctgctgcaagccacccaggtcaacgcctgggatcacacccttatcgagaatggagagatgatacgaatcctccatggagaagtcaacaaggttaagctggatcaaaagcggctcgagcaggagttagactttatcttgtcacagcaacaggagctagagtttctgctgacctatctagaggagagcacgagagaccagagtggcctccattacctgcaggatgcggatgaagagcacgtcgaaatttataggctggccgagtctatcgacgcacaattgaaacagatggctcaggacttaaaggacgtcgtgaatcacctgaatactttcgagtcttccagcgataccacagatccactgcaccagatttgtcgtatacttaacgcccatatggactcgttgcaatggattgaccgcaactccgggatgctgcgccgaaaagtggaggtggtgaccagagtgttcgaggattacagacacgaggaacacgcacacaatgtgaataccgccttttag

SEQ ID NO: 23738 - DNA, 555 bp, Artificial Sequence
  Description of Artificial Sequence: Synthetic coding sequence
atgcagttcacgagtatttcaaacagcctgacatccaccgctgcaatcgggctgtcatttacaactagcaccactaccacagctaccttcacgactaatacaaccacgaccattacaagcggatttactgtcaaccagaaccaattactttcacgtgggtttgagaatctggtcccatacacaagcaccgtctcagtggttgccaccccagttatgacttacgggcatctcgaggggttgatcaacgagtggaatcttgagctggaggaccaggaaaagtattttctgttacaagctacgcaggtaaacgcatgggaccatacactgatagaaaatggggaaatgattcggatactgcacggcgaggtgaataaggtcaaactggaccagaaacgattggaacaggagctggattttatactgagccagcagcaggagctggaatttcttctgacgtacctggaggagtctacaagagaccagagcggcctgcattacctacaggacgccgacgaggaacacgtcgaaatttcaacaagatcggccgaattctag

SEQ ID NO: 23739 - DNA, 411 bp, Artificial Sequence
  Description of Artificial Sequence: Synthetic coding sequence
atgcagtttacctcaatctcaaactcacttacaagcacggctgccattggcttgagctttactacctcgaccaccaccacggcgacttttacgacgaatacaaccacaacaattactagcggatttactgtgaaccaaaaccagcttctcagtcgcggatttgaaaacttggtcccgtatacaagcacagtgagtgttgtggccacgccagtaatgacctatggtcatttggagggtttaatcaatgaatggaatctggagctggaggatcaggagaagtacttcttacttcaggcgacccaagttaacgcctgggaccataccctgatagaaaatggcgagatgatccgcattctgcacggagaggtcaacaaggttaaactggatcaaaagagactcgaacaggagtag

SEQ ID NO: 23740 - DNA, 597 bp, Artificial Sequence
  Description of Artificial Sequence: Synthetic coding sequence
tgacccgtgatgacatacggccacctcgagggtctgatcaatgagtggaacctggagctggaagaccaagagaagtactttctgttgcaggccacacaggtaaatgcctgggatcacacactgatagagaacggagagatgattaggattctgcacggcgaggtaaataaggttaagttggatcaaaagaggttggagcaggagctcgactttatcctgtcccagcagcaagagctggaattcctgctcacgtatcttgaggagtccacaagagaccaatctggccttcattatctgcaggatgctgacgaggaacacgttgagatctatcggcttgctgaatcgattgatgcccagttgaagcagatggcccaggatctgaaagacgtggttaaccatctcaatactttcgagtcttcttccgatactaccgatcctcttcatcagatttgcagaatactcaatgctcacatggacagcttgcagtggattgaccggaattccgggatgctgagaagaaaagttgaggtcgttaccagggttttcgaggattatcgtcacgaagagcacgcccacaatgtcaacaccgcgttctag

SEQ ID NO: 23741 - DNA, 1383 bp, Artificial Sequence
  Description of Artificial Sequence: Synthetic coding sequence
atggctgaatctgagaatagaaaagaactgtctgagtcaagtcaggaagaggccggaaaccagataatggtcgaggggcttggtgagcatctggagaggggggaagatgctgccgcaggactaggggatgatgggaagtgcggagaggaggcagccgctgggctgggagaggagggtgagaatggcgaagataccgccgcaggatctggagaagacggaaagaagggaggggataccgacgaggactcagaggccgatagacctaaagggctcatagggtatgtcttagatacagactttgtcgagagcctgccagttaaggttaaataccgcgtgctggctcttaagaagctccagacaagagcagcgaacttggaatcaaaatttctgagggagtttcacgatatcgaacggaagtttgcggaaatgtatcagccactccttgaaaagagacgtcagatcattaatgctatctacgagccaaccgaggaagaatgcgaatataagagtgacagtgaggattgtgacgatgaggagatgtgccacgaggaaatgtacggcaatgaggagggtatggtgcacgaatacgtggatgaggatgatgggtatgaggactattattacgattatgccgtcgaggaggaagaggaagaggaagaggaggatgacatcgaagccactggggaggaaaacaaggaagaggaagaccccaagggcatccccgatttttggctgaccgtactgaaaaacgtggatactttaactccacttattaaaaaatacgatgagcctattctgaagctcctgactgacatcaaggtcaagttgtctgacccaggtgagcccttgtctttcaccctcgaatttcacttcaaacctaacgagtattttaagaacgagttgctcacaaagacgtacgtgctcaagtcaaagctggcttactatgacccccatccatatagagggactgcgattgaatattctacaggatgcgagatcgactggaatgaaggcaagaatgttacactgaaaactattaaaaaaaaacagaagcaccgaatctggggcacgattcgcactgtcaccgaagacttccctaaggatagtttttttaatttttttagccctcacggtataacatcgaacggtagggatggtaacgacgactttctgcttggccacaacctaagaacctacataattcctagaagcgtgctctttttcagcggtgacgcgctggagagtcagcaagagggtgtggttcgtgaagtgaatgacgctatctacgacaagattatatacgataattggatggcggcaatcgaagaggtcaaagcgtgctgcaagaatctggaggcgctggtggaggatattgatcgttag

SEQ ID NO: 23742 - DNA, 957 bp, Artificial Sequence
  Description of Artificial Sequence: Synthetic coding sequence
atgtaccagcctctgctggagaaaaggcggcagattattaatgcgatttacgagcccaccgaagaagagtgcgagtacaagagtgacagcgaggactgtgatgacgaggagatgtgtcacgaggagatgtacggcaatgaggagggcatggtccatgagtatgtggacgaagatgacggctacgaggactattactatgactacgcagttgaggaagaagaggaggaagaggaggaggatgatattgaagccacaggggaggagaacaaggaggaggaggatccaaaaggcattcccgacttttggctgactgtgcttaagaacgttgacactctgacccctcttattaagaagtatgacgagccaatcctgaagctactcaccgacattaaggttaagctcagcgaccccggtgagccactttccttcaccctggaatttcactttaagccaaacgaatactttaagaatgagctgctgacaaaaacatatgtgctgaaatctaagctcgcatattacgacccacacccctacagagggactgcaattgaatactctactggatgcgaaatcgactggaacgaagggaaaaacgtgactctaaagacgataaagaaaaaacagaagcaccggatctggggtaccattcgaactgtgactgaggacttcccaaaagactctttttttaacttcttttcaccccacggcatcacctctaatggacgtgatgggaacgatgatttcctattgggacacaacctgcgaacttatatcattccccgttctgttttgttcttttcaggtgatgcacttgaaagtcagcaggagggcgttgtaagagaggtgaacgacgcaatatatgacaaaatcatctatgacaactggatggcagctatcgaggaagtgaaagcctgctgcaaaaaccttgaagcccttgtcgaggacattgatagatag

SEQ ID NO: 23743 - DNA, 489 bp, Artificial Sequence
  Description of Artificial Sequence: Synthetic coding sequence
atgctgtttgggaggatcccattgaggtatgctatccttatgcagatgaggtttgatgggcgacttggattccctggaggcttcgtggatacacaggatcgctcccttgaggacgggcttaaccgcgagcttcgcgaggaactcggggaggcagccgcagccttccgggtggagagaactgattaccgcagctctcatgttggttccggacctagggtcgtggcccacttctacgcaaaaagactaacactcgaggagctactggcagttgaggctggggcaacacgggcaaaggatcacgggttggaagttctaggccttgtgagggtgcccctgtacaccctccgcgacggcgtgggtggtcttcccaccttcttggaaaatagcttcatagggtcagctcgggaacagctcttagaggccctacaggacctagggctactgcagtcagggtcgatatctggtcttaagatcccagcccaccactag

SEQ ID NO: 23744 - DNA, 588 bp, Artificial Sequence
  Description of Artificial Sequence: Synthetic coding sequence
atggcaggggcacggcgactcgaactgggggaagctctggcacttgggagcggttggcgccacgcctgtcatgccttactgtacgccccagatcccggtatgctgttcgggcgtattcccctgcggtacgccatcctgatgcagatgagatttgatggcagactggggttccccggtggatttgtggatacccaggatcgctccctagaagatggcctgaatcgggagttgagagaggagctgggagaagcagcggctgcttttcgcgtcgagagaactgattacaggagtagccatgtgggttctggccctagagtcgtggcacatttctatgcaaagaggttgacactggaagaactgctagcggtggaagccggtgccacaagagctaaagatcacgggctagaggtcctggggctggtgcgtgtacctctctatacgctgcgggacggagtgggagggttgcctacctttcttgagaatagctttatcggaagcgcacgcgaacagttgctggaagcgctccaggacctcgggcttctgcaatcaggttctatctctggcttgaagatccctgcccaccactag

SEQ ID NO: 23745 - DNA, 480 bp, Artificial Sequence
  Description of Artificial Sequence: Synthetic coding sequence
atgcaaatgaggtttgacggcaggctgggctttccagggggtttcgtagacacgcaggatcggtcactcgaagacggcctaaatagagaactaagagaagagcttggagaagccgctgcggcattccgtgtcgagcgaacagattaccgcagctctcatgtgggctccggtcccagagtagtcgcgcacttctacgcaaaaaggttgacactggaggaactgctggccgtagaggccggagctacccgtgctaaagatcacgggctcgaggttctaggactcgtgagggtgcccctttacacgttaagggacggcgttggcggactcccgacattcttagaaaattctttcatcggatctgccagagagcaattgctcgaggctgccttgcacgggccaatgaaaaccgagatgagaactttggtccttggccgtgaaggtagaacctgggagtgcttcctgattggtagcgagcggtag

SEQ ID NO: 23746 - DNA, 684 bp, Artificial Sequence
  Description of Artificial Sequence: Synthetic coding sequence
atggccggagctaggcgcctggaacttggggaagcgttagcccttgggtccggctggcggcatgcctgccacgccctgctgtatgccccagaccccggaatgctgtttggacgcatcccattaagatacgccatcctgatgcagatgcgctttgatggtaggctgggatttccaggaggtttcgtggacactcaagaccgttctttggaggatggtctgaaccgggagctgcgggaagaactgggcgaggcggctgctgctttcagggttgagagaacagactaccgatcctcccacgtcgggagcggaccgcgtgtggtcgctcatttctacgcgaaacgccttacccttgaagaactcctcgccgttgaggccggagctacacgtgccaaggatcacgggctggaagtcggtccggcttgggactcagtccccttccctatatcttcaagtccaaaggcctttagcccgccacggaaacatccttggcggaaggtgttcgcacctctgacactaccttccccccagctgtcatggtggagctgggatagagaccatttatacagtgagctggtgctgcccacgtgggccttttgcaaagggctttcccaccctctgcccggagaaatcctgtctagaactcactcttccatgagcttatgctgtagcctcctgacagtgtag

SEQ ID NO: 23747 - DNA, 768 bp, Artificial Sequence
  Description of Artificial Sequence: Synthetic coding sequence
atgctgagaccccagagaccaggcgacctgcagttaggggcatcgctgtatgagttagtaggctaccggcagccaccttctagttcttcttcctcaacctcctccacctcaagcacgtcatcatcatccaccaccgcgccattgttgccaaaagctgcccgagagaagcccgaggccccagctgagcccccaggtcccggtcccggttctggcgctcatcctggcggatcagcacggcctgacgcaaaagaggaacaacagcagcagctgcgaaggaagatcaacagccgtgagaggaagagaatgcaggatctgaatctagcgatggacgcattgagagaggtgatcctgccatattccgcagcccactgtcagggcgcaccgggacgcaagctgagtaagattgccacccttttactggcgcgaaactatatattactactggggtcttctcttcaggaactcaggcgagccctgggcgagggcgcaggcccagctgccccaaggctcctcctagctggcttgcccctgcttgctgctgcaccgggatctgtgttattggctcccggagccgtgggaccacccgatgctcttcggcctgctaagtatctatccctggccctcgacgaacccccatgcggacagttcgcactgccgggaggcggtgccggtggcccaggtctctgtacatgtgcagtgtgcaagttcccacacttagtgccagctagcctgggactggccgctgtgcaggcacagttctcgaagtag

SEQ ID NO: 23748 - DNA, 816 bp, Artificial Sequence
  Description of Artificial Sequence: Synthetic coding sequence
atgtactacgcagtgagtcaggctcgggttaatgcagtgcccggtactatgctccggcctcagcggccaggcgacctacagctgggtgcctctctgtacgaactggtcggttatagacagccaccatcaagctcctcctctagcacctcctcaaccagctctacgtcatcttcctctacaactgcgccactgttaccaaaggccgctcgggagaagcccgaggccccagcggaacccccaggcccaggacccggtagcggagcccatcccggaggatccgcccgtcctgacgctaaggaggaacaacagcaacagcttaggcgcaaaatcaactccagagaacgaaaaaggatgcaggacctcaatctcgcgatggacgctctgagagaagtgatcctgccctattcagcggctcattgtcagggcgcacctgggagaaaactgtcaaagatcgctaccctcctgcttgcgagaaactacatcctcctgctgggctcaagcctgcaagagttaaggagagctctgggggaaggagctggcccagccgcaccacgtctgctgctggccggtttacctctcctcgcagcagcacccggatctgttctgctggcgcctggggcagtgggacctcccgatgccctgaggcctgctaagtacctctcactcgctctcgacgagccaccatgtggccagttcgctcttcccggtggcggagccggtggcccaggactgtgtacctgcgcagtctgtaaattcccgcacctggtgccggcaagcctcggattggcagccgtgcaggcgcagttctcgaagtag

SEQ ID NO: 23749 - DNA, 99 bp, Artificial Sequence
  Description of Artificial Sequence: Synthetic coding sequence
tgagggcctgggctgtgcacatgcgccgtgtgtaagtttccccatctagtgccagcttcgctgggtcttgccgcagtccaggcccagttctcgaaatag

SEQ ID NO: 23750 - DNA, 1485 bp, Artificial Sequence
  Description of Artificial Sequence: Synthetic coding sequence
atggagctctccctcgaaagcctgggcggactgcacagcgttgcccacgcacaggctggcgaacttctgtcaccgggtcatgccagaagtgcagcagctcagcacaggggactggtcgccccagggcgacccggactggtcgccggtatggcaagcctcctggatggaggcggaggcggtggtggcggaggggctgggggtgctggaggcgcagggtcagctggaggaggagccgacttccgcggtgagctggccggaccactgcaccctgcgatgggcatggcatgcgaggcaccgggactggggggaacttacaccacactcacccctttacagcacctcccacccctcgccgcagttgccgacaagtttcaccagcatgctgccgctgcagctgttgccggagcccacggtggacaccctcacgcacaccctcacccagccgctgcccctcctccgccacccccacctcagaggctcgccgcatccgtttccggttctttcaccctcatgagggacgagagggctgccctcgctagcgtgggccatctgtacggtccatacgggaaggagttgcctgccatgggaagccccttaagcccactgccaaacgccctgccgcctgctctacacggcgctccacagccccctcctccgcctcctccccctccactcgccgcttacgggccaccgggtcacctggcgggagacaaactcctcccaccagccgcattcgagcctcatgctgcattacttggcagagccgaagacgccctggccagaggcctccctggtgggggaggtggaacaggatctggaggagctggctctggttccgccgctggcctgctcgcccctctgggaggcctggccgcagcgggagcgcatggccctcacgggggaggtggcggacccggagggtccgggggtggcccttccgcgggagccgctgcagaggagattaatactaaggaagtcgcgcaacgcatcactgccgagttaaagcgctatagtataccccaggctatattcgctcagaggatactttgcagaagccagggcacgctttccgatcttctgaggaatcctaagccatggagcaagctgaagtccgggagggagaccttcagacgcatgtggaagtggctgcaggagccagagttccaacgcatgtcagctctgagactggctgcctgcaaacgtaaagaacaggagcagcagaaagagcgcgctttacagcctaaaaagcagaggctggtattcactgacttgcagaggcgaactcttatcgcaattttcaaagaaaataagagaccttccaaggaaatgcaagtgacaatttcccagcagctcggactggagttgaatacggtctcaaattttttcatgaatgcccgacgacgctgcatgaacagatgggctgaggagccttccactgcccctgggggacccgcaggggctaccgcaactttctccaaggcatag

SEQ ID NO: 23751 - DNA, 2922 bp, Artificial Sequence
  Description of Artificial Sequence: Synthetic coding sequence
atggcgagcatactcgatgaatacgagaactccctttctcgttctgctgtcttacagccagggtgcccatcagtgggaatcccacactcaggctacgtgaacgctcagctcgaaaaagaggtcccaatattcaccaagcagcgcattgattttactccttcagagcggattacgagtcttgtggttagtagtaatcaactttgtatgagcttggggaaagataccctgttaaggattgaccttggaaaggccaatgagcccaaccacgtggaacttggcaggaaagacgatgccaaggttcacaaaatgttcctagaccacaccggaagtcacctgctgatcgcccttagttccaccgaggtcctgtatgtgaaccggaacggacagaaggttcggccactagcaagatggaagggccagcttgttgaatctgtggggtggaacaaagcactcggcaccgaaagctctacaggacccatactggtgggcacggcccagggccacatttttgaggctgagctgtcggcatccgaaggagggctcttcggcccagcacctgacctgtactttcggccactgtacgtcttgaatgaagaggggggtccagcacctgtgtgctctttagaggccgaaaggggcccagatggacgcagctttgtgattgctacaaccagacagagacttttccagttcataggccgtgcggcagaaggcgcagaggcccagggtttcagcggcttgttcgccgcatatactgaccacccccctccatttagagagtttcccagtaatctgggttattctgagctcgccttctacacgccgaagttacgcagtgctccacgggcattcgcttggatgatgggagacggcgtcttatacggtgcgctggactgcggtcgcccagattccctgttatctgaagagagagtgtgggaataccctgagggggtcggacccggtgcgagcccaccacttgcaatcgtcttgactcagtttcatttcctgctcctgctggccgacagggtggaagctgtgtgtaccctcaccggacaggtggtactgcgtgaccactttctagagaagtttgggccactgaaacacatggtgaaagactcaagtactgggcagttatgggcctacaccgagcgcgctgtgtttcggtatcacgtacagagggaggctcgcgatgtttggcggacatacctcgacatgaaccgctttgatctagctaaggaatactgccgagaacgaccggattgccttgatacagtgctagcacgagaggccgatttctgcttccgccagcgcagatacttggagagtgcaaggtgctacgctctcacccaatcgtattttgaagagatcgctcttaagtttctcgaggccagacaggaagaggctttagcagagtttctccaaaggaagctggcctctctcaaacctgcggaacggactcaggccacactcttaaccacatggttaactgagttatacttgtcaagattaggggcacttcagggcgaccctgaggctctgacgctttaccgcgagaccaaagagtgcttccgcacatttctaagcagcccgcgtcataaggagtggctcttcgctagtcgggcaagcatacatgagctgttagcatctcacggtgacaccgaacacatggtctactttgccgtcattatgcaggactacgagagagtggttgcctaccactgtcagcacgaagcctacgaagaagcccttgctgtgctcgccagacatagagatccacagcttttttacaagttctcccctatcctcattagacacattcctaggcagcttgtggacgcatggatcgagatgggctcacgtctcgatgccaggcagctgatccccgctctggtcaattactctcagggaggcgaagttcagcaagtgtctcaagctatacgttacatggagttctgtgtgaacgtgttgggggaaaccgagcaggcgattcataactaccttttgtcactctacgcgagaggacgcccagacagcctcctggcctatctggagcaagccggtgctagccctcatagagtccactatgatcttaagtatgccctccgcctatgtgccgagcacggacatcacagggcgtgtgtgcacgtgtataaagttttggagttatacgaggaggccgtggatcttgccttacaagtggacgtcgacttggccaagcagtgtgctgacctccctgaagaagatgaggagctgagaaaaaagctctggctcaaaattgcgcgacacgtcgtccaggaggaggaagatgtccaaactgccatggcttgtcttgccagctgcccactcctgaaaatagaggacgtgctgccgttcttcccggatttcgttaccatcgaccattttaaagaagccatctgttcatctctgaaggcatataaccaccacatccaggagctccagcgcgagatggaggaggccactgccagtgcacaacggattcggagggacttacaagagctgaggggtagatatggcacagttgagccacaggacaaatgtgccacctgtgatttccctctgctgaacagacccttctacttgttcctctgtggccacatgtttcacgcggactgcctgttgcaggccgtccgacctgggctgcccgcatataaacaggccaggctggaggagctccagagaaaattgggcgctgcccctccgcctgctaaggggtccgcccgtgcaaaggaagcagagggaggcgctgctactgccggaccatctcgggagcagctcaaagcagacctggatgagctggtggctgctgagtgtgtgtactgcggtgagctgatgatccgcagcattgatagaccatttatcgacccgcagcgctacgaggaggaacagttatcctggctgtag

SEQ ID NO: 23752 - DNA, 828 bp, Artificial Sequence
  Description of Artificial Sequence: Synthetic coding sequence
atgcctaaagtgtttctcgtcaagagacgctctttgggcgtctctgtacggagctgggatgaactcccagatgagaagagggcagacacgtatataccagtcggactgggcaggttgcttcatgatccacccgaggactgccgctcagacgggggatcgtcctcgggcagcggaagctcatccgcgggagagcctggaggagctgaaagctctagtagccctcacgctcccgaatccgaaacccctgagccgggagacgccgaggggccagatggtcacctcgccaccaagcaacgtcctgttgccaggagtaagatcaagtttaccaccgggacctgtagtgatagcgtggtccatagctgcgatctgtgtggaaaggggttccgactgcagcgaatgctcaaccgccatctgaagtgtcataatcaggtcaagcgccacttatgtaccttttgtggtaagggcttcaacgatacatttgatcttaagaggcatgttcgtacccacactggtataagaccctataagtgcaacgtgtgtaacaaggcattcacacagcgctgttctcttgagtcacatcttaaaaagatccacggcgtccagcaacagtacgcatataagcaacgcagagataaattgtacgtgtgtgaagactgcgggtacactggacccacacaggaggacttatacctccatgtgaactctgcccacccgggatcgagtttcttaaaaaaaaccagcaaaaaactggctgccctcctacagggtaagctgacaagtgcgcatcaggagaacaccagcctcagcgaagaagaggagagaaagtag

SEQ ID NO: 23753 - DNA, 1269 bp, Artificial Sequence
  Description of Artificial Sequence: Synthetic coding sequence
atgcaaaatagtcactccggggtgaatcagctcgggggagttttcgttaacggcagaccactcccagactctacgcggcagaaaatagttgaattggcccatagtggagcccgtccttgcgacatctctcggatattacaggtgtcaaacggatgcgtgtctaagattctgggtcggtactacgagacaggctcgatcaggccaagggcgatcggaggatcgaagcccagagttgcaactcctgaagttgtatccaagatcgcacagtacaaaagggagtgtcccagcatctttgcctgggagatcagagaccgattactctccgagggagtgtgtacaaatgacaatatcccttccgtgagctcaataaatagggtactccgcaatttggcatctgagaagcaacagatgggggcagatggcatgtatgataagcttagaatgttgaacggccagacaggttcctggggcactaggcctggttggtaccccggtaccagtgtaccaggacagccaacccaggatggttgtcagcagcaagaagggggtggagagaacaccaattccataagctctaatggcgaggattccgacgaagcccaaatgagactgcaattgaagcggaagctccagcggaatagaacttcttttactcaggaacagatcgaggccctggagaaggaatttgagcggacacactacccagatgtgtttgccagagaacgtctcgccgcaaagatagatctgcccgaagccaggattcaggtgtggttctctaaccgacgggctaaatggagaagggaggagaagctcagaaaccaaagaagacaagcgtccaacactccttcacatatccccatctccagctctttcagtacctccgtctaccagccaatcccgcaaccgacaacacccgtgagctcttttacgtccggctcaatgttagggagaactgatactgctctgaccaacacctatagcgcgttgcccccaatgccttcctttactatggccaacaatttaccgatgcaacctcctgtgccttcccagacctctagctactcttgtatgttgccaacttccccctctgttaatggaaggtcatatgacacctatacacccccacatatgcagacccacatgaatagccaacccatgggcacgtccgggactacaagtaccggccttatcagcccaggcgtcagcgtgcccgtgcaggtgccagggtccgaaccagacatgtctcagtattggccaagactgcagtag

SEQ ID NO: 23754 - DNA, 1311 bp, Artificial Sequence
  Description of Artificial Sequence: Synthetic coding sequence
atgcagaactctcacagcggcgttaaccaattgggaggggtgtttgtgaacggacggccattacccgacagcaccagacagaaaattgtcgagctggctcactcaggcgcacgcccttgcgatatttccagaattctacagacacatgcagacgcgaaggtgcaggttctggacaaccagaacgtgtccaacggttgtgtgtctaaaatactggggaggtactacgaaaccggcagcattaggcccagagccatcgggggaagcaagccacgcgtggcgacccccgaggtggtgagtaaaatcgcccagtataaaagagaatgtccttcaatttttgcttgggagatccgagataggcttttgtctgaaggggtttgcaccaacgacaacattccctccgtctcctctattaatagagtactgcggaaccttgcctctgagaagcagcagatgggtgcagacggcatgtatgataagcttaggatgctgaacggccaaactggctcgtggggcacgcgaccgggatggtacccaggaaccagcgtcccgggacagccaacacaagacggatgtcagcagcaagagggagggggtgagaacactaacagcatcagttcaaatggagaggattctgacgaggcccagatgcggttacagctgaagcggaagctccaacgtaatcgcacctcatttacccaagaacaaattgaggccctggagaaggaattcgagagaacacactaccccgatgtgtttgctagggagcgcctggcagccaaaatcgatcttcccgaggccagaatccaagtgtggttttccaatcgccgagccaagtggcgaagggaggagaaactaaggaaccagcggaggcaggcgtcaaatacccccagccacatcccaatcagctcatccttttctaccagcgtgtatcagcctatcccccagccaacaacaccagtaagctccttcaccagcgggagcatgcttgggaggacagataccgcactaactaatacctactccgccctgcccccaatgccaagcttcactatggccaataacctgcctatgcaaccacccgtaccatcgcagaccagttcatattcttgtatgttgcccacttccccatctgtcaatggcaggtcctacgacacttataccccacctcatatgcagacacatatgaacagtcaacccatgggaacatctgggacaacaagtaccgggctgatctctccaggtgtttccgtgccagtgcaagtgcctggaagtgaacctgatatgagccagtactggcctaggctgcagtag

SEQ ID NO: 23755 - DNA, 1269 bp, Artificial Sequence
  Description of Artificial Sequence: Synthetic coding sequence
atgcagaactcccattccggcgtgaatcagctgggcggtgttttcgtcaatggcagaccccttcccgattcaactcgccaaaagattgtcgaactcgcacactcaggggctaggccatgtgacatctctcggatcttgcaggtttccaatggctgcgtgtctaagattctgggtaggtattatgagaccggttccattcgccctagagctattggtggtagtaagccacgagttgcgacacctgaagtcgtaagcaaaatagcccagtacaaaagagaatgcccaagtatcttcgcctgggagatacgggatcggctccttagcgagggcgtttgtaccaatgataacattcccagcgtgagctcaatcaatcgggtcctcaggaacctggcatccgaaaagcagcagatgggagccgatggaatgtatgataagctgcggatgttgaatggacagacaggcagctggggcactagacccggatggtatcctggcacttctgtccctggccaacccacacaagacgggtgtcagcaacaggaaggcggtggcgagaatacgaacagtatctcgagcaacggtgaggactcagatgaggcccagatgcgactgcagttgaaaagaaaactgcagcgaaaccgaactagctttacccaggagcagatcgaagccctagaaaaggaattcgagcgtacccactaccccgacgtgtttgcgagggagagattagctgccaaaatcgacctgccagaggccaggattcaggtgtggttttccaacaggagagccaagtggagaagagaggagaaactgcgtaaccaacgcagacaagcctcaaacacacccagtcacatccctatttcttcatcgtttagcacatctgtttatcaacccatccctcagcccacaacgcccgtgagctccttcaccagtggatctatgctggggaggacagataccgctctgaccaatacctacagtgccttaccccctatgccatctttcacaatggcaaataatctgcctatgcagccccctgtgcctagccagaccagcagctattcatgcatgctcccgacgagcccttctgtgaacggacgctcttacgatacctacaccccgcctcatatgcagactcacatgaacagccagcctatggggacatccgggactacaagcaccggcctgatctcccccggagtttccgtgcctgttcaggtgccgggttcagagcctgatatgagccagtattggccaagactgcagtag

SEQ ID NO: 23756 - DNA, 1269 bp, Artificial Sequence
  Description of Artificial Sequence: Synthetic coding sequence
atgcaaaactcgcacagtggggtcaaccagttggggggtgtttttgtcaatgggagacctctacctgactcaacccggcagaaaatcgtcgaactcgcacactccggagccagaccctgtgacatttccaggatcctccaggtgtcgaacgggtgcgtaagtaagatcctgggccgatactacgaaacagggtccatacggcctcgggcaatcgggggatctaaacccagggtggccacacctgaggtcgtgtccaaaatcgcacaatacaagagggaatgtcccagcatcttcgcctgggagatccgggacagacttctgagcgaaggcgtgtgcaccaatgacaacataccttccgtctcttctattaaccgtgtgttacggaacctggccagcgagaaacagcaaatgggcgcagacggcatgtatgataagctgaggatgttaaacggtcaaaccggctcttgggggacaaggcccggttggtaccccggaaccagtgtgcccggtcagcctacccaggatggatgtcaacagcaagagggaggcggtgaaaacactaacagcataagttcgaacggcgaggatagcgacgaggcccaaatgagactgcagctgaaaaggaaactgcagaggaataggacttcctttactcaggagcagatcgaagctctggaaaaggagttcgaacgaacccactatcctgatgtgtttgccagagagagactagccgctaaaatagaccttcctgaggccaggatccaggtgtggttttctaaccgcagggccaagtggcgcagggaagaaaagctccgaaatcagagacgccaggccagtaatacgccttcccacatcccgatcagtagctccttcagtacctctgtataccagccaattcctcagcctaccacccctgtgagttcctttactagcggctctatgttgggtaggacggatactgccttaaccaacacctattccgctctgcctcctatgccgagtttcaccatggccaacaatctgcctatgcagcctccggtgccatcacagacctcctcatactcatgcatgcttcccacctcgccatctgtgaatggccgatcttacgacacgtacacgccccctcacatgcagactcacatgaattctcaacctatggggacctcaggaaccacatctactggcctgatctctccgggagtgagtgtgccagtccaggtgccaggcagcgagccagatatgagccaatactggccaaggcttcagtag

SEQ ID NO: 23757 - DNA, 1311 bp, Artificial Sequence
  Description of Artificial Sequence: Synthetic coding sequence
atgcagaactcacactctggagtcaaccagctagggggtgttttcgtgaatggacggccactgccggattccaccagacaaaagattgtggagctggcgcatagtggagctcgtccatgtgacatctcgcggatactccaaactcacgcagatgctaaggtacaggttctggacaaccagaatgtgagtaacggctgtgtctctaaaatcttgggcaggtactatgaaacgggatcgatacgacccagggcaattggtggatccaagccaagggtggccacgcccgaggtagtgagcaagatcgcacaatataagagagagtgcccctccatattcgcatgggagattcgtgatcgtctgcttagtgagggggtttgtaccaatgacaacattccgtcagtgagcagtataaaccgagtccttaggaacctggcctctgagaagcagcaaatgggtgccgacggtatgtacgataaactgcgcatgttaaacggccagacgggctcatggggcactcgcccaggctggtaccccggtacctcagtccccggtcagcccacgcaggacggctgccagcaacaggagggaggcggagaaaacactaattccatctcctctaatggtgaggatagcgatgaggcccaaatgcgcctgcagctcaagaggaagttacagcggaatcgcacctcattcacacaggaacagatcgaagcactggagaaggagtttgagagaacacactacccggacgtcttcgcacgggagcgccttgcggctaagatagacctacccgaggccaggatccaggtctggttctccaaccgccgagccaagtggaggagagaagagaagctgcggaatcaacgccgacaggcctccaatactccttcccatatccccattagctccagtttttctacctccgtataccagccaatcccccagccgactacaccagtgagctcctttaccagcggctccatgctgggcagaaccgatacggccctgaccaatacatattccgctctgccaccgatgcccagcttcacaatggcaaataatctccccatgcagccccctgtgccttcgcagacgtctagttacagctgcatgctgccaaccagcccctctgtgaatgggcgttcttacgatacttatacacctccccacatgcagactcacatgaactctcaaccaatgggcacatccgggaccacttcaacagggctgataagccccggtgtgtcagtccccgttcaggtgcctggctccgagcccgatatgtcacagtactggccccgtctgcagtag

SEQ ID NO: 23758 - DNA, 1269 bp, Artificial Sequence
  Description of Artificial Sequence: Synthetic coding sequence
atgcagaactcgcattcgggggttaaccaactgggcggtgtgttcgtaaatggccgaccactgcctgattcaacccggcagaagatcgtggagcttgcccacagtggcgcacgtccctgcgacattagccgcatcctgcaagtaagtaacggctgcgtgtctaagatactgggaagatactacgagacaggttccattcggcctagggcaatcgggggatccaagcccagggttgccacgccagaggtcgttagtaagatcgcacagtataagagggagtgtccttccatctttgcatgggagattcgagatagactgctcagcgaaggagtctgcacaaatgataacattcccagcgtgtcctctatcaatagggttctgcggaatcttgcaagcgagaaacagcagatgggagccgacgggatgtatgacaagctgcggatgttaaatggccaaaccggctcatggggcacacggcctggatggtaccctggtactagtgtcccagggcagcccacccaggatggttgtcagcaacaggaaggcggtggtgagaacacgaactcaatatcttccaacggagaggactccgacgaggcccagatgcgactccagctgaagcgcaagcttcaaaggaatcgtacctcttttacccaggaacagatcgaagctctggagaaagagttcgaacgcacccattaccctgatgttttcgcaagagagcgcctggctgcaaagatcgaccttccagaagcccgaatccaggtctggttctctaatcgacgtgccaagtggaggcgagaggaaaaattgcggaaccagagaaggcaggcttctaataccccatcacatatccccatcagctcctcattctcaacctccgtctatcagccgatcccccagcctaccacaccagtatcctccttcacttcggggagcatgctgggcagaaccgataccgccctcactaatacctacagcgccctgcccccaatgccctcatttactatggctaacaacctacccatgcagcctcctgtgccgagccagactagctcctacagttgcatgctccctacgagcccctccgtcaacggcaggtcatatgatacgtacacgcctccccacatgcaaacccacatgaattcacagcccatgggcactagcggaaccacaagtaccgggctgatctcaccaggggtgtccgtgccagtccaggtgcccggaagcgagcctgatatgtctcagtactggccccgactgcagtag

SEQ ID NO: 23759 - DNA, 1311 bp, Artificial Sequence
  Description of Artificial Sequence: Synthetic coding sequence
atgcagaattcccatagcggggtgaaccagctcgggggagtctttgtgaatggacgccctctgcctgattctacaaggcagaagattgtggaactagcacacagcggagccagaccgtgcgacatctcccggatcctccagacccacgcagatgccaaggtccaggtactcgataatcaaaatgtgtcgaatgggtgcgtcagcaaaattctggggaggtattacgagacaggtagcattcggccacgcgctatcggaggttccaagccacgggtggcaacccctgaagttgtaagcaagattgctcaatataaacgagaatgtccttcaatcttcgcctgggaaatccgtgatcgactcctgtccgaaggtgtttgcaccaatgacaatataccctctgtatccagtataaatagggtgctgcggaacctggctagcgagaaacagcagatgggagccgacggcatgtacgataagttacgcatgttgaacggccagaccgggagttggggcactagacctggctggtaccccggtacttctgtgcccggtcagccgacccaggatgggtgccagcagcaggaaggtggtggggaaaacaccaacagtatatcctcaaacggcgaagactctgacgaggcgcagatgaggctgcagctgaagcgtaaactccagcgcaaccgaaccagttttacccaggagcagattgaggccctcgaaaaggagttcgagagaacccattatcctgatgtttttgccagggaaagactagccgctaagatcgacctacccgaggcccgaattcaagtttggttcagcaacaggcgggctaaatggagaagggaggagaagctgcgtaaccagcgcagacaggcttctaacaccccaagtcatataccgatctcttcaagtttttccacctccgtataccagcccattcctcagccgacaacccctgtgtcctcctttaccagcggtagcatgttaggaaggacagatactgcactaactaacacgtactcagcactgcctcccatgcctagttttacaatggcaaacaatttaccaatgcagccacccgtaccttcccagacttccagttattcctgcatgctgccaaccagtccctctgtcaatggcagatcatatgacacttacactccaccccacatgcaaactcatatgaattcacagccaatgggaacatccggcacaacttccaccggactgatctcgccaggcgtaagcgttcccgttcaggtgccagggagtgaacctgacatgagtcagtactggcctcgacttcagtag

SEQ ID NO: 23760 - DNA, 1269 bp, Artificial Sequence
  Description of Artificial Sequence: Synthetic coding sequence
atgcaaaattctcactcgggtgtgaaccagctgggaggagtgtttgtcaatggccgacccctgcctgattcaactagacagaagatcgttgaacttgcacattctggagcccgaccatgtgatataagcaggatcctgcaggtatcaaatggttgcgtgagtaagatcttgggacgctactacgagactgggtccatcaggccaagggccatcgggggtagtaagccaagagttgccactcccgaagtggtgtcaaagatcgcccagtacaagcgagagtgtccatccattttcgcttgggagattcgggatagacttctgtcagagggtgtgtgtaccaacgacaatatcccaagtgtctcttccattaacagagtcctgaggaaccttgcgtccgagaaacagcagatgggggctgacggtatgtatgataagcttaggatgctaaacggccagacagggagttggggcacgagaccaggctggtaccctgggacgagcgtccctggccaacccacgcaggacggatgtcaacagcaggaagggggtggggagaatactaactccataagttcgaacggcgaagacagcgatgaggcccaaatgcggctgcagctcaagcgaaagctccagagaaatcgcacttcctttacccaggaacagatcgaagcgttagagaaggagtttgagagaacgcactaccccgacgtgttcgccagagaacgactcgccgcaaaaatcgacctccctgaggcacgcattcaggtctggttcagtaaccgaagagctaaatggaggcgggaagaaaaactgagaaatcagcggagacaggcctcaaatacacctagccatatcccaatttcttctagtttctctacaagcgtttatcagccaatcccacagcccacaactccagtcagctctttcacctctggttctatgttggggagaaccgacactgcacttacaaatacctattccgccctcccacccatgcctagcttcaccatggctaacaacctccctatgcagccccctgtgccctctcagacgtccagttattcatgtatgctccccacaagccccagtgtaaatgggagatcctatgatacttacacacccccacacatgcagacacatatgaattcccagccaatgggcacctccggaaccaccagcacggggctgatcagccccggtgtgtcagtacccgtgcaggtgcctggaagcgagccagatatgagtcagtattggccacggctccaatag

SEQ ID NO: 23761 - DNA, 1311 bp, Artificial Sequence
  Description of Artificial Sequence: Synthetic coding sequence
atgcagaactcacactccggggtcaaccagctgggcggagtcttcgtgaacggccgtccgctaccagactccactcggcagaaaatcgttgaactggcgcactctggcgcaagaccatgcgacatctcccgtatcctgcaaacacacgcagacgctaaagtgcaggttctggataatcagaacgtgagcaacggttgcgtcagcaagatcctgggcagatattacgagacgggatccatccggccacgcgctatcggaggttctaaacctagagtggctacccctgaggtggtgagcaagatcgcccagtataagagagagtgtcctagcatattcgcctgggaaatacgggaccggttactctccgaaggggtgtgtactaacgacaacattccatctgtgagttccattaacagggttctgcgaaacttagccagtgagaagcagcagatgggtgccgatggaatgtatgataagctgcgtatgctcaacggccagacaggtagctgggggacccgtccagggtggtaccccggaacctctgtacctggtcagcctacacaggatgggtgtcagcagcaggagggcggtggggagaacaccaattccatctcctcaaacggggaagactcggatgaggcacagatgcggcttcagcttaaacgcaagctccagcggaacaggacgtctttcacacaagagcagattgaggcccttgaaaaagagttcgagcgcacacactaccccgatgtgttcgctcgggagaggttggctgcaaaaatagaccttccggaggccagaattcaggtgtggttcagtaacaggcgggcaaagtggcgccgtgaagaaaagttgcgaaaccaacgccgacaggcatcgaatacgccctcacatattcctatatcatcttctttctccactagtgtttatcagcccattccccagcctaccacacccgtatcaagcttcacttccggctccatgctgggcaggactgataccgcgctgacaaacacgtactcagcactgccaccaatgccatccttcaccatggccaacaatctccccatgcagcctcctgtgccatcccagacgagcagctattcctgcatgcttccaacctctccttcagtgaacggcagatcttatgatacttacactcctccccacatgcagactcatatgaactcgcagcccatgggcacgagcggtaccactagcacgggacttatctcgcccggagtgagcgtgccagtgcaggtcccaggctctgaacccgatatgtctcagtactggccacgactccaatag

SEQ ID NO: 23762 - DNA, 201 bp, Artificial Sequence
  Description of Artificial Sequence: Synthetic coding sequence
atgcagaatagtcattctggcgtgaatcaattagggggtgtgttcgtaaatggacgccctctccccgatagtacacgccaaaaaatagttgaactggcccattccggcgcacgtccttgtgacatcagtaggatcttacagacccacgccgatgccaaggtgcaggttttagacaatcagaacgtaagcaatggctgttag

SEQ ID NO: 23763 - DNA, 120 bp, Artificial Sequence
  Description of Artificial Sequence: Synthetic coding sequence
atgcaaaactcacactccggagtgaaccagctgggtggggtcttcgtcaacggccgacccctgcccgatagcacaagacaaaagattgtagaattagcgcatagcggcgctcgtccttag

SEQ ID NO: 23764 - DNA, 375 bp, Artificial Sequence
  Description of Artificial Sequence: Synthetic coding sequence
atgcagaactctcattctggtgtcaaccagctgggtggggtgtttgtaaacgggagacctcttcccgatagcactcggcaaaaaatagttgagcttgcgcactccggcgcacgcccatgtgatatatcaagaattctgcagactcacgcagatgcaaaggttcaggtgttggacaatcaaaacgtcagtaatgggtgcgtgtcttcaattaacagggtgttgcgcaacctggcttccgaaaaacagcagatgggggctgacggtatgtatgataagctgagaatgcttaacgggcagactggctcatggggtaccagaccaggttggtacccaggcacttctgtcccagggcagccaacccaggatgggtgctag

SEQ ID NO: 23765 - DNA, 177 bp, Artificial Sequence
  Description of Artificial Sequence: Synthetic coding sequence
atgcagaacagccactccggagtgaaccagttaggcggtgttttcgtgaacggtagaccgctgcctgactcaacgcgccagaagatcgtggagttggcccactctggggcacggccttgtgacattagtcgaatcctccaggtcagtaacggctgcgtttccaaaattctgggctag

SEQ ID NO: 23766 - DNA, 9 bp, Artificial Sequence
  Description of Artificial Sequence: Synthetic coding sequence
atgcagtag

SEQ ID NO: 23767 - DNA, 1134 bp, Artificial Sequence
  Description of Artificial Sequence: Synthetic coding sequence
atgcaggttagtaacggctgtgtgagcaagattctggggagatactacgagacaggttcgatccgaccacgggctatcggcggttctaagccgagggtcgccaccccagaggtggtgagcaaaatcgcgcagtataaacgggagtgcccttccatctttgcttgggagattcgggatcgtctgctctccgaaggagtctgcactaatgacaatattccaagcgtatctagtatcaatagagtcctcaggaatctcgctagcgaaaaacagcagatgggtgccgacggtatgtacgataaactgcgcatgctgaatgggcagaccggaagctgggggactagacccggatggtacccgggaacaagcgtgcccggacagccaacacaggatggctgccaacaacaggaagggggaggcgagaacacgaattcgatttccagcaacggcgaggattcggacgaggcacagatgcgcttacagctgaaaaggaaactgcaacgcaatcggacttcatttactcaggagcagattgaagcgctggagaaagagttcgagaggacccattatcccgatgtctttgcccgagagaggttggccgcaaagatcgatctccctgaagccaggatacaggtttggtttagcaacagacgagcaaaatggaggcgagaagaaaagctgcgcaatcaaaggcgccaggcatctaacacccctagccacattcccatttcgtcttcattcagcaccagcgtctatcagccgatacctcagccgacaaccccagttagttcattcacttctgggtcgatgctgggaagaaccgataccgccctcaccaacacttactcagccctcccacccatgccttccttcacaatggccaataatcttccgatgcagcctccagtgcctagccagacttcaagctactcttgtatgcttcctacaagccccagtgtgaatggtaggtcctacgatacctatactccaccccacatgcagactcacatgaatagccagcccatggggacctccggcaccactagtacaggcctcattagtcctggcgtctccgtccccgtgcaggtcccaggatctgaacccgatatgtctcagtactggccacggcttcaatag

SEQ ID NO: 23768 - DNA, 1389 bp, Artificial Sequence
  Description of Artificial Sequence: Synthetic coding sequence
atgagctccgtcaaaaggagtctgaagcaggaaattgtgactcagtttcactgctctgccgctgaaggcgacatcgctaagctgacaggtattctgtcccactccccctctctgctgaacgagacctccgagaatggttggaccgccctgatgtatgctgctcggaacggccaccctgagattgtccagtttctgctggagaaaggctgcgaccgttccatcgtcaacaaaagtcgccagactgctttggatatcgccgtgttttggggatacaaacacatagcgaatctattagcaacagcgaaggggggaaagaagccctggttcctcacgaacgaagtggaggaatgcgagaattacttcagtaagactctcctggataggaagtccgagaagagaaataactctgactggctgcttgccaaagaatctcaccccgcaacggtatttattcttttttccgatttgaaccccctggtgaccctcggaggcaacaaagaatcctttcagcagccggaagttaggctgtgtcaactcaattacactgacatcaaagactacctggcacagcctgagaaaatcacgctgatttttctgggcgtggagctggagattaaggataagcttctaaattacgctggcgaggtgccgcgtgaggaggaggacggattggtcgcctggttcgcgctggggatcgatcccatcgcagcagaggaattcaagcagaggcatgaaaattgttattttctgcacccaccaatgcccgcacttctacagttgaaagaaaaggaagccggtgtggtggctcaagctcggtcagttctcgcatggcattccaggtataaattttgtccaacttgtggaaatgcaacgaaaattgaggaagggggatacaaaaggctctgtctgaaggaggactgcccctccctgaatggcgtccacaacaccagctatcctagagtagaccccgtcgttattatgcaggtgattcaccctgacggcacaaaatgtctcctgggaagacagaagcgttttccccctggcatgtttacttgcttggcaggcttcattgagcccggtgagactatcgaggatgcagtaagacgggaggttgaagaggaaagcggtgtaaaggttggtcacgttcaatacgttgcctgccagccgtggcccatgccttcttcgttgatgataggctgcttggccctggcagtatcaaccgaaatcaaggtggacaagaatgagattgaagatgctcggtggttcaccagggaacaggtgctggatgtacttactaaaggaaaacagcaggccttcttcgtccctccaagcagggcgatcgctcaccagctgattaagcactggatccgcatcaaccctaatctatag

SEQ ID NO: 23769 - DNA, 84 bp, Artificial Sequence
  Description of Artificial Sequence: Synthetic coding sequence
atgtctccatgcccagaagaagccgctatgcggagagaggtggtaaagcggattgagaccgtggtcaaggatttgtggccatag

SEQ ID NO: 23770 - DNA, 1095 bp, Artificial Sequence
  Description of Artificial Sequence: Synthetic coding sequence
atggctctggccttattagaggactggtgtcgcattatgtccgttgatgagcagaagtcactcatggtgacaggcattcctgcagacttcgaggaagccgagatccaggaagttctccaggagacattgaaatccctgggtcgctatcgccttcttggcaagatctttagaaaacaggagaacgctaacgccgtcctgttggaactattggaggacactgatgtaagtgctattccctctgaggtgcagggtaagggtggagtgtggaaggtgatcttcaagaccccaaaccaagacaccgaatttctagagcgcctcaatctgtttctggaaaaggaaggccagacagtttccggcatgtttcgcgctctgggccaggagggcgtctctcccgctaccgtcccctgcatcagtcctgaattactagcccacctcttaggccaagccatggctcacgcaccgcaacccctgctgcctatgaggtatcgcaaattaagggtctttagtgggagtgccgtcccagctccagaggaggagagttttgaggtatggctcgaacaggccaccgagattgttaaagagtggcctgtgacagaggctgagaagaagcgatggctggctgagtcattgcgcggtcccgcactggatctcatgcacattgtgcaggctgataatccatcgattagcgtggaagagtgtttagaggcctttaagcaggtattcgggtcacttgaaagcaggaggacggcgcaggttagatatctcaagacttatcaggaagagggcgaaaaagtgagcgcctacgttttacgcctagagactctgctgaggcgcgctgttgagaagcgggctattcctcgtagaattgcagatcaggtacgtctcgaacaggttatggccggtgccacgctgaatcagatgctgtggtgccgcttacgcgagctcaaggatcagggaccccctccatcgtttctggaactgatgaaagtgattagggaggaagaggaggaagaggcaagctttgaaaatgagtcgatagaggagccagaggaaagggatgggtacgggcgatggaatcacgagggggacgattag

SEQ ID NO: 23771 - DNA, 1392 bp, Artificial Sequence
  Description of Artificial Sequence: Synthetic coding sequence
atgccactgactttgctccaggattggtgtagaggagaacacctcaatactaggaggtgtatgttgattctcggaatcccagaggactgtggagaagacgaatttgaagaaacacttcaggaagcctgtcggcatttaggcagatacagggtcattggtcgaatgtttcgacgggaggagaacgctcaggctatcctgctggagctcgctcaggacatcgattatgccttactgccacgggagattcccggtaaagggggaccctgggaagtcattgtgaagccccgaaattctgacggcgaatttttaaatcggctcaaccggttcttagaagaggagagacggaccgtctcagacatgaatcgagtgctgggttccgacaccaactgcagcgccccacgtgtcactatctcacccgagttctggacgtgggctcagactctcggagcagctgtgcaacctctcctggaacagatgctatatcgcgaactaagagtgttttccggaaacaccatatctatccccggtgctctggcctttgatgcctggctggaacacaccactgagatgctacagatgtggcaggtccccgagggagagaaaagaagaagactgatggaatgcctccgtggccctgcccttcaggtggtgagtggattacgggcttccaacgcaagtattaccgtcgaggagtgcttagcagccctgcaacaggtttttggccctgttgagtctcacaagatcgcccaggtcaagctttgcaaggcatatcaggaagctggggagaaggtgtcttccttcgttctgcggctggagccgctattgcagcgagctgtcgagaataacgttgtctcccgtcggaatgtaaaccagacaaggcttaagagagtcctttccggggcaaccctgcctgacaaattaagagacaaactaaaattgatgaaacagcgaaggaagccgccaggcttcctcgcgctcgtcaaactcttgcgggaggaggaggaatgggaagccacactgggtccggacagggagtcattggaaggcctggaggtggctcctcggccacccgctcggatcactggggttggagccgtgccgctgccagcctctggaaactccttcgacgtgaggccatcccagggataccgcagacggagggggcgtggccagcacagacgaggcggagtcgcaagggccggatcgagggggtcgaggaaacgaaaacggcacactttttgctattcctgtggggaagatgggcacatccgggttcagtgcattaatccttccaacctgttacttgttaaacagaagaagcaagctgcagtcgaatcaggaaatggcaattgggcctgggataaatcccatccaaaaagtaaggcaaaatag

SEQ ID NO: 23772 - DNA, 1392 bp, Artificial Sequence
  Description of Artificial Sequence: Synthetic coding sequence
atgcccctgaccctgctgcaagattggtgccgtggggagcatctgaacaccaggcgttgcatgctaattctgggaatacccgaggattgcggggaagacgagttcgaggaaactctccaggaggcctgccgtcacctgggccgatatcgcgttatcggacgaatgttccgaagagaagagaatgcacaggctattctgctggagctggcccaggacatcgattacgccttgttgccgagggaaatccccggaaagggtggaccatgggaggtgattgtgaagcctcggaactcagacggcgagttcctaaacagactgaatcgctttttagaggaggaacgacggaccgtgtctgacatgaatagagttctgggaagtgacacaaattgttctgcccctagagtcacaattagccccgagttctggacgtgggcacaaaccttgggagccgctgttcaaccactcctagagcaaatgctgtaccgtgagctcagagttttttcaggtaacacaatctcgatcccaggcgcactggcattcgatgcatggctcgagcataccaccgaaatgttacagatgtggcaggttccagaaggggaaaagagaagacgcctgatggaatgcctgcgaggtccagccctgcaggtggtgagcgggctgagggcatccaacgcgagcatcacagtcgaagagtgtttagccgcactgcaacaggtgttcggacctgtcgagtcacataagatcgctcaggtaaagctgtgcaaagcttatcaagaggccggagagaaagtgagctctttcgtcctgagattggagcctctactccagagggccgttgagaataatgtcgtttcacgcaggaatgttaatcagactagactgaaaagagtgttgtctggcgcaacccttccggataagttgcgcgataagctgaagctgatgaagcaaaggcggaaaccgcctggattcctggccctggtgaagctactacgcgaggaggaagaatgggaagccaccctgggcccagatcgggaatccctggagggtttggaggttgcaccgagacccccagcgcgaatcaccggagtgggggcagttccactgcccgctagcggaaattcctttgacgtccgcccttcgcaggggtaccggcgacgaagaggccgaggtcagcacaggcgcggaggagtcgcacgggcaggctcccgcggaagccgcaagaggaaaaggcacaccttttgctattcttgcggagaggatggtcacattcgggtccaatgcataaacccctctaacctgctgctggtaaagcaaaagaagcaggcggctgtagaatccggcaacgggaactgggcgtgggacaaatcacatcccaagtcgaaggcaaagtag

SEQ ID NO: 23773 - DNA, 1392 bp, Artificial Sequence
  Description of Artificial Sequence: Synthetic coding sequence
atgcctctgactcttctgcaagactggtgtaggggggagcacctcaatacccggagatgtatgctcattctgggcattccagaggactgtggcgaggatgagtttgaagaaacacttcaggaggcatgtcggcaccttggccgatatcgcgtgattggaaggatgtttaggagggaggaaaacgcccaggctatcctgctggaactggcccaggatattgattacgccctgctccccagagagatccccggtaaagggggaccatgggaagtgattgtcaaaccacgaaattctgatggcgagtttttaaatcggctgaatagatttctcgaggaggagcgaaggaccgtgtcagatatgaatagagtcctcggctccgacaccaattgtagtgcccctcgagttaccatcagcccagaattctggacatgggcccagactttaggagccgctgtacagcctctgctggaacagatgctgtaccgggagctcagagtattctcaggaaacacaatctcgattcctggggcactggcctttgacgcctggttggaacataccactgagatgctccagatgtggcaggttcccgaaggcgagaagcgcagaagactgatggaatgtctcagggggccagcattgcaggtggtctccgggttacgggctagtaacgcctcaattactgtggaagagtgtctggccgcactgcagcaggtgtttgggcctgtggagagtcacaaaattgcacaggtgaaattgtgtaaggcatatcaagaagccggagagaaagtgagttctttcgtcctgagactggaacctcttcttcagcgcgctgtagaaaataacgttgttagtcggcgaaatgtgaaccaaacgcgactgaaaagagtgctgagcggcgctactctgcctgataaattacgggacaaactgaaactgatgaagcagaggagaaagcctccaggcttcctggccctcgtcaagctcctgcgggaagaagaagagtgggaagctacactcggccctgatagagaatctctggagggtttggaagtggccccacgccctccggcaagaatcacaggtgtaggagctgtcccgctgcctgcctcaggtaattccttcgatgtgcggccttcacagggttatcgcagaagacggggacgcggacagcaccggagggggggtgtagccagggcgggatctagggggagccgaaagagaaagagacacacgttctgctactcttgtggagaagatggacacatccgcgtccagtgtatcaacccgagcaacctgttacttgtcaagcagaagaagcaggccgctgtggaaagcggcaacgggaactgggcctgggacaagtctcaccccaaatccaaagctaaatag

SEQ ID NO: 23774 - DNA, 759 bp, Artificial Sequence
  Description of Artificial Sequence: Synthetic coding sequence
atggagtcagaaatggaaacacaaagtgccagagccgaagagggcttcacccaggtaacaagaaaaggaggtcgcagagccaagaaaagacaagcagaacagctgagcgctgccggtgagggaggggatgcgggaaggatggacaccgaggaagctagacctgcaaaacgtccagtcttccccccactgtgcggcgatggacttctatctggcaaagaagagaccaggaaaatccctgttcctgctaaccgatacaccccgctgaaagagaattggatgaaaatttttactcccatcgtagagcatctcggcctccaaatcaggttcaacctcaaatccaggaacgtggagatcaggacatgcaaagaaactaaagatgtgagcgccctgaccaaggccgctgacttcgtgaaagccttcatcttgggattccaggtcgaggatgcgctggctctgatcagactcgatgatctgttcctggagtcatttgaaatcacagacgttaaaccactgaagggggaccacttgtctcgcgcaatcgggcgaattgctggaaaagggggaaaaaccaagtttactattgaaaacgtcacgagaacccgcattgtgctggcagacgtgaaagtgcatatcctgggaagctttcagaatattaaaatggcgcgtactgccatttgcaacctgatcctgggcaatcccccatctaaagtgtacggcaatattagggcggtcgcttctaggtctgcggatagattctag

SEQ ID NO: 23775 - DNA, 2322 bp, Artificial Sequence
  Description of Artificial Sequence: Synthetic coding sequence
atgaaaatgcgcggagagaagaggcgggataaggtgaacccaaagtcgagccaacgaaaactcaattggattcccagcttccctacatacgattatttcaatcaggtgacccttcaactgctggacggctttatgatcactctgtccaccgacggcgttatcatttgcgtcgccgaaaatatttcctccctgctgggccacctgcccgctgaaatcgttggcaaaaaattactcagcctactgcccgatgaggagaaggatgaagtttatcagaagattatcctaaagtttccattgctgaattctgaaactcacattgagttctgttgccacctgaagagaggaaacgtggaacacggtgacagctcagcttacgagaacgtgaaattcatcgtgaacgttagagacatttgtaacgaattcccagtggtgttcagcgggctgttttcatcccatttatgtgccgattttgctgcgtgtgtgccacaagaggaccgtctgtatttggtaggcaatgtgtgcatcctgaggacgcagctcctacaacagctgtatacatccaaggcagtgagtgacgaggctgtgctgactcaggattccgatgaggagccattcgtgggagaactgagtagcagccaaggccagagaggccacacttccatgaaggctgtttatgttgaaccagcagctgcagcagcggcagctgccatctccgatgaccagatagatattgcagaagtggagcagtatgggccacaggagaatgtacacatgtttgtcgattccgattcgacatactgctccagcacagtgtttctggataccatgcccgaatcccctgccctgtctttgcaggacttccgaggggaacctgaggtcaaccctctgtaccgggctgatcctgtagacctcgagtttagcgtggatcaggtggattctgtagatcaggaggggcctatggatcagcaggatcctgagaaccccgtggcgcctctcgaccaggccggtctgatggatcctgtcgatcccgaagacagtgtcgacttaggcgctgctggagccagtgctcagccgctacagccttctagcccagtcgcatatgacattatttcccaagaactggaattaatgaaaaagctgaaggagcaactggaggaaagaacctggttattgcacgacgcgattcaaaatcagcagaacgctctggaattgatgatggaccacctgcagaagcagccgaacacattaaggcacgttgtcatccctgaccttcaatctagcgaggccgtccccaaaaagcaacagaagcagcatgctgggcaagtcaaacggcctctgcctcatcctaaagatgtcaagtgcttttgcggcttgagtctgtcaaatagtcttaagaacaccggggagttgcaagaaccctgtgtggcgttcaaccagcaacagcttgtccaacaagaacagcacttgaaggaacaacagaggcaactcagagagcaactgcagcagctgcgggagcagcgtaaagttcaaaagcagaagaaaatgcaggaaaaaaaaaaactccaagagcagaagatgcaggagaagaaaaagttgcaggagcaacgtcgtcagaagaagaaaaaactgcaggagagaaagaaatggcaagggcagatgttacagaaagagcccgaagaggaacagcagaaacagcaattgcaggagcagccgctcaagcataacgtcatcgtggggaacgaaagggtacagatatgtctgcagaacccgagggacgtgtctgtacccctgtgcaatcatcctgtgcggttcctacaggctcaacccattgttcctgtgcagagagccgctgagcagcagcccagtggtttctaccaagacgaaaattgcggacagcaagaggacgaatcccaatccttttatcctgaggcttaccagggaccgccagtgaatcagctgcccctgattgacaccagcaatagtgaggctatctcaagttcgtccatccctcagttcccaattacaagcgattctactatctcaaccctggaaacgcctcaggactatatcaggctctggcaagagctcagtgatagccttggacctgttgtgcaggtgaatacttggtcctgtgatgagcagggaaccctccatggacagcctacctaccaccaggtacaggtgtcagaggtgggagttgaaggacctcctgacccacaggcctttcagggacctgcggcttatcaacccgatcaaatgcggagtgctgagcagacgaggcttatgcccgcagaacaaagggactctaacaagccttgttag

SEQ ID NO: 23776 - DNA, 3069 bp, Artificial Sequence
  Description of Artificial Sequence: Synthetic coding sequence
atgtttagagaagtaaaatattacgctgtgggggacatcgacccccaagtaatccagctgttgaaggcaggtaaggccaaggaggtatcttataacgctctagcaagccacattatttcggaggacggcgacaatccagaggtgggagaggcacgagaggtcttcgatcttcccgtggttaaggtgagtagcgaggacaggtccgccctctgggcgctggtgacgttctatggaggggattgccagctgactcttaataagaagtgcactcacctgattgtccctgagcccaaaggtgaaaagtacgaatgcgctctcaaacgagcctcgatcaaaattgtgacccctgactgggtgctcgattgtgtgagtgagaaaactaaaaaggacgaagccttctatcatcccaggctcatcatctatgaggaagaggaagaagaagaggaagaggaagaggaagtggagaatgaggagcaggattcgcagaacgagggatcaacagacgaaaagagctctccagcatcctcacaggaaggaagcccctctggcgaccagcagttctcaccaaaatcaaacaccgagaaatccaagggcgagttgatgttcgacgacagttccgactccagcccagaaaagcaggagcgcaatttgaattggaccccggctgaagttccccagttggcagccgcaaaacggcgtctgcctcagggcaaagagcctggccttattaacttatgcgctaacgttcctcccgtccctggcaatatccttccacctgaagttaggggcaacctgatggccgctgggcaaaatctgcagtcgagtgagaggagcgagatgatcgccacatggtccccggcagtccgcacattgcggaacataaccaacaatgcggatatccagcaaatgaatcgtccctcaaacgtggctcacattctgcagacgctaagcgccccaaccaaaaacttggagcaacaggtcaatcactctcaacagggccatacaaacgccaatgctgtcctcttcagccaggtgaaggtcacgcctgagacccacatgcttcagcagcaacagcaagcccaacaacaacagcagcagcaccccgtgctccacctgcaacctcaacagatcatgcagttgcagcaacaacaacagcagcagatttcacagcagccgtatcctcagcaacctccccacccctttagtcagcagcagcagcagcagcagcaggcgcaccctcatcaattctcccagcagcagcttcagttcccacagcaacagctgcatcctcctcaacagcttcacagaccccagcagcagctgcagcccttccagcagcagcacgctctgcagcagcagtttcaccagctgcaacaacatcaattgcagcaacaacaattagctcagctgcagcagcaacattccttgctgcagcagcagcagcagcagcagatccagcagcaacagctgcaacggatgcaccaacagcagcaacaacagcaaatgcaatctcagactgcaccccatctctctcagacctctcaggccctccagcaccaggtgccccctcagcagccaccccagcagcaacagcagcagcaaccacctccctccccccaacagcaccagttgttcggacacgaccccgcagtggagatccccgaagagggcttcctgttggggtgcgtattcgctatcgccgactatccggagcagatgtccgataagcagctgctggccacctggaaaagaataatccaagcccatggagggaccgtggatcctacctttacatctaggtgcactcatttgctctgcgagtcccaggtctcatctgcttacgcgcaggccataagggaacggaagagatgtgtaaccgcccactggttgaataccgtgctgaagaagaaaaaaatggtgccaccccatcgcgcactgcatttcccagtggctttcccgccaggcggtaagccctgcagtcagcacatcatcagtgtaaccggcttcgtggatagcgacagggacgaccttaaactcatggcctatctcgccggagctaagtacactgggtatctgtgtaggagcaataccgtgttgatctgtaaagaaccgaccggcctcaagtacgaaaaggccaaggagtggcgcatcccctgcgtcaacgctcagtggctaggtgacattctgctcgggaatttcgaggcactgcggcagatccagtacagccgatatacggccttttcactacaagacccctttgctccaacacagcacctcgtcttaaacctgcttgacgcgtggcgagtcccactgaaagtctcagccgagctactcatgagcatccgactgccccctaagctgaagcaaaacgaggtggctaacgtgcagccttcatccaagagagcacgaatcgaagatgtgcccccaccaacaaaaaagctaaccccggagttgacgccatttgtactgtttacaggttttgaacctgtgcaagtgcagcagtatatcaaaaagctgtatattcttggaggggaggttgctgaatccgcacaaaagtgtacacacctgatcgcaagcaaagtgactaggaccgtgaagttcctgactgcaattagtgttgttaaacacatcgttacgccagagtggctagaggagtgtttcaggtgtcagaaattcatagatgaacagaattacatccttcgagatgccgaagctgaagttctgttctctttttctttagaggagagccttaagagagcccacgtgtccccacttttcaaagccaaatacttttatatcacccccggtatctgcccttccctgtcaactatgaaagcaatcgtcgagtgcgccggagggaaggtcttatctaagcagccttcatttaggaaactcatggagcacaaacagaattcatccttatcagagatcattttgatctcatgtgaaaatgatttacacctgtgtcgcgagtacttcgccagggggattgacgtccacaatgcagagtttgtgctgacaggcgtgctgacccagactttggattatgaatcttacaagtttaactag

SEQ ID NO: 23777 - DNA, 2682 bp, Artificial Sequence
  Description of Artificial Sequence: Synthetic coding sequence
gtccgggtgctgatccaagcaggggcactgtgctggtccctgcccgaactctctcagggggaggtgggcaagggagcctgccctgctgaagtcggaaagcacagggatcacctcccctcaagtgaccccgttcttatgcaggcagaggcctccgtggtgatgtgctgggtctcctcagaggatcggtccgccctatgggccctcgtcaccttctacggtggcgactgtcagctgacactgaataagaaatgtactcatctgattgtgcctgagccgaaaggagagaaatatgagtgtgctctcaagcgggcatccatcaagatcgtcacccccgattgggtcttggactgcgtcagtgaaaagactaagaaggacgaggccttttatcaccctcgcttgattatttacgaggaagaggaggaagaagaagaagaagaagaggaggtcgaaaacgaagagcaggatagtcagaacgaggggtccacagacgagaaatcatcacccgcatcatctcaggaaggtagcccatctggggatcagcagttttcaccgaaatccaatacggagaagtcaaaaggggagctaatgtttgacgatagcagtgatagttcccccgagaaacaggaacggaacctgaattggacaccagccgaagtgcctcagcttgcggctgcaaagagacgtctaccccaaggcaaggagcctggcctgataaacctctgtgcaaatgtaccccctgtccccggtaatatcttgccgcctgaagtccgcggtaatctcatggcggcaggacagaatctgcaaagctctgaaagatctgagatgatcgcaacttggtcccccgctgtgaggacactgcgcaacattaccaataatgccgatatccaacagatgaacagaccctccaatgtcgcacatatcctgcaaaccctttccgcccctacaaaaaacctcgaacagcaggtgaaccattctcagcaggggcacacaaacgcaaacgcggtactattctcgcaggtcaaagtgacgcccgaaacccacatgctgcaacagcagcagcaggcccagcagcagcaacagcagcatcccgttctccacctgcaaccacagcagataatgcagttgcagcagcaacaacagcagcagattagtcaacaaccttacccacagcagccaccccatccgttcagccagcagcaacagcagcagcagcaaccgcctccttcacctcagcagcatcagctcttcggtcacgaccccgcagtggaaatccctgaagagggattcctactcggatgcgtgttcgccatcgctgattaccctgagcaaatgagtgataaacagctgttagctacatggaagcgcattattcaggcgcacggcggaaccgtggatcccactttcacctcccggtgtacccatttgctgtgcgagtctcaagtgtccagcgcgtacgcacaggctattcgtgagcgtaaacggtgcgtcaccgcccactggctgaatacagtcctcaagaagaagaaaatggtgccacctcacagagcgctacactttccagtagcgttcccacctgggggtaagccctgctctcagcatattatcagtgtcaccggcttcgttgactctgatagagacgatctcaaactaatggcctacttggctggagctaagtacactgggtatctgtgccggtcaaataccgttcttatttgtaaggaacccacaggacttaaatatgagaaggccaaggaatggcgcattccatgtgtcaatgctcagtggctgggcgacatactactcggcaattttgaagctctgcgccagatccagtattctcgatacaccgcatttagcctccaagatccatttgctcctactcaacatctagtcctgaatctgctggacgcttggagagtcccactgaaggtatcagcggagttactgatgtcgatcagactgcctcctaaacttaagcagaacgaggtagctaacgttcaacctagttccaagagggctaggattgaagatgtcccaccaccaaccaagaagcttacccccgagctgactcctttcgtcttatttaccgggtttgagcccgtacaggtgcagcagtacattaagaagctttacattctggggggagaagttgctgaaagcgcacagaagtgcacgcacttgattgcctccaaagttacacgcactgtgaaatttctgacggccattagtgttgtaaaacatattgtgactccagaatggttggaagaatgtttccgatgtcagaaattcatcgacgagcagaattatattctaagggacgccgaagcagaagtcctattttctttctccctagaggagtcgcttaaacgggctcacgtgagccccctcttcaaagccaaatatttctatattacccctgggatctgccctagcttgtcaactatgaaggccatcgtggaatgcgcaggtggcaaagtgctcagtaaacagccctccttccgtaagctgatggagcacaagcaaaactcttctctgtccgagataattttgattagctgtgagaacgatctacacctgtgtcgggaatattttgcgcgtgggatcgatgttcataacgcagagtttgtgctcacgggtgtgttaacgcagaccctggattacgagtcctataaattcaactag

SEQ ID NO: 23778 - DNA, 3210 bp, Artificial Sequence
  Description of Artificial Sequence: Synthetic coding sequence
atgtccgaccaggcccctaaagttcctgaggaaatgttccgagaagtgaaatactacgcagtgggcgacatcgatccacaggtgatccaactgctgaaagccggaaaggctaaagaggtcagctacaatgccctagccagccacattattagcgaggacggtgataacccagaagttggagaggcccgtgaagtatttgacctgcccgtcgttaaacccagctgggttattctcagcgtgcaatgcggtactctgctgcctgtcaacggcttttcacccgaaagctgccaaatattcttcgggatcaccgcctgcctgagccaggtatcgtccgaggatcggtccgccctctgggcccttgtgaccttctacggcggagattgtcaactcaccctgaataaaaagtgcacacatctcatcgtgcctgagccaaagggagagaagtatgaatgtgctctgaaacgggcatccatcaagatcgtgacccccgactgggtgttagactgcgtgagtgaaaaaacgaagaaggatgaagccttctatcatccaagattgatcatttatgaggaagaagaagaggaagaggaagaggaggaagaggtggagaacgaagagcaggacagccagaatgagggctctactgacgagaaatcatcccccgcaagtagccaggagggatctccctccggcgaccagcagttttctcccaagagtaatactgaaaaatcaaagggagaactgatgttcgacgatagctcagactcctctcctgagaaacaggagaggaacctgaactggactcctgctgaggtcccccagctcgctgctgctaagcgacgcttgccacagggaaaggagcccggactgatcaatctttgtgccaacgtacctcctgtaccagggaacatactgccccctgaggtaaggggcaatctcatggctgccggacaaaatctgcagtcatccgagaggtccgagatgattgctacatggtcgcctgcagtccgcaccctgcgcaacatcaccaataacgccgatatccaacagatgaaccgcccttctaacgtggctcatatcctccagacactgagtgccccaacaaagaacctggagcagcaggttaaccactcccagcagggacatactaatgccaacgccgtcctcttctcacaggtgaaggtaactcccgagacccacatgctccagcagcagcagcaagcccaacaacagcagcagcagcacccggttctgcacctccaaccgcagcagatcatgcagttgcagcaacagcagcagcaacagatctcacagcaaccctacccccagcagcctccacacccctttagccagcagcagcaacagcagcaacaggcccatcctcatcagttttcgcagcagcaactgcaatttcctcagcaacaactgcacccccctcagcagttgcacaggccccaacaacaactccagcctttccaacagcaacatgctttacagcagcaattccaccaattgcagcagcatcagctccaacaacagcagttagcccagctccagcaacagcactccttactgcagcagcaacagcagcagcaaattcaacagcagcagcttcagcgaatgcaccagcagcagcaacagcagcagatgcagtctcagactgctcctcatctgtcccaaaccagccaggccctgcagcatcaggtcccgcctcagcagcccccacagcagcagcagcagcaacagccaccaccttcacctcaacagcaccagttattcggccatgatccagctgtggaaatccccgaggagggcttcctcttgggatgcgttttcgctatcgccgactatcctgaacagatgtcagacaagcagctcctcgccacatggaagcgtattatacaggcacatgggggtacagtcgatccaacatttacaagtcggtgtacccatctattatgtgaaagtcaggtgagtagtgcttacgcccaggctattagggagcgaaaacgttgtgtaactgcccactggctcaataccgtgctcaagaagaaaaaaatggtgccacctcatcgggcattacactttcccgtggcattcccccctgggggaaaaccctgttcacaacatatcatctctgtaacaggttttgttgatagtgaccgggatgaccttaaactgatggcctatctggctggggcaaagtataccggatatctctgtagaagtaacacagtgttaatatgcaaagaacccacaggactgaaatatgaaaaggctaaagagtggagaattccctgtgtcaacgcacagtggcttggcgacatattgttgggcaatttcgaggccctgcggcaaatccagtactctagatacactgcattctccttgcaggaccccttcgcccctacccagcacctggtcctcaatctactggatgcatggcgagtccctcttaaggtctccgccgagcttctgatgtcaatccgactcccacccaagctcaagcagaatgaggttgcgaacgtgcaaccatcgtctaagcgggcacgtatagaggacgtccccccacctactaagaaactcaccccagagctaacgcccttcgtgctcttcaccggttttgagcccgtgcaggtacagcagtacatcaaaaaactctacatcttaggtggggaggtggctgagagcgcccaaaagtgtacccaccttatagcgtcaaaggtgactcgtaccgtgaagttcctgactgctatctcggtcgtgaagcacatcgtaactccggaatggttagaagaatgctttagatgtcagaaattcatcgatgaacaaaattacatcctacgggacgcagaggctgaggtcctattcagtttttccctggaggagtccctcaagagagctcatgtgagccctctctttaaggctaagtatttttacatcaccccgggaatctgccctagcctaagcacgatgaaagccatcgtcgagtgtgccggagggaaggtcttaagtaagcaaccctcctttcggaaattgatggagcacaaacagaattcctcactatcggagatcatccttatcagctgcgagaacgaccttcatttatgccgggaatatttcgctcggggtatagatgtgcacaatgcggagttcgtgctcacaggtgtcttaacacaaactctcgactacgagagctacaagtttaactag

SEQ ID NO: 23779 - DNA, 3210 bp, Artificial Sequence
  Description of Artificial Sequence: Synthetic coding sequence
atgtccgatcaggctccaaaggtgccagaggagatgttccgggaggttaagtattatgctgtgggcgatatcgacccccaggttatacagctgctcaaggcagggaaggcaaaggaagtgagttacaacgccctcgcgtcccacattatttccgaggatggtgacaaccctgaggtcggagaagccagagaggtgttcgacctgccggtcgtcaaaccgtcttgggttatcctgagcgtgcagtgcggaacactgttgccagtgaacggtttcagcccagagtcctgccaaatctttttcggaattactgcctgtctgtcacaagtgtcctcagaagataggagcgctctttgggcacttgtgacattttacggcggtgactgccagctcacattgaacaaaaaatgcactcaccttattgtgcccgagccaaagggagagaagtacgaatgtgcactgaagcgcgcaagtattaagattgtaaccccagactgggttctggactgcgtaagtgaaaagaccaagaaggatgaagccttttaccatcctcggctgatcatatacgaggaggaggaggaagaggaagaggaagaagaggaggtggagaacgaggagcaggactcccaaaatgagggcagcactgatgaaaagagttctccggcaagctctcaagagggcagccctagcggcgatcagcagttctcccctaaaagcaatactgagaagtccaaaggggaattgatgtttgatgattcctctgatagctctcctgaaaagcaggaacgaaacctgaattggactccggctgaggtgcctcaattggcagctgcaaagcggagactgcctcaggggaaggaacctgggttgatcaatttatgtgccaacgtcccccctgtgccaggaaacatcttgcccccagaagtcagaggtaacctcatggccgcaggacagaacctccagtcgtcagaacggtccgagatgattgccacgtggtctcccgcagttagaacacttaggaacatcacaaacaacgcagacattcagcaaatgaaccgcccttctaacgttgcccacatattacagacattatctgccccaactaagaatttagaacaacaggtgaaccattcacaacaggggcatactaatgccaatgccgtgctgtttagtcaagttaaggtgacacccgagacacacatgctgcagcaacagcaacaggcccagcagcaacaacaacagcaccctgttttgcatctacagcctcagcagattatgcagctccagcagcagcagcagcagcagatttcccagcagccctatcctcagcaaccaccacatccattttcccagcaacaacagcaacagcaacaggcacacccgcaccagttctctcagcagcagttgcaatttccgcaacagcaattgcaccccccacagcagctacacaggccgcagcaacagctgcagccattccagcaacaacacgccttgcaacaacaattccatcagttgcaacaacatcagttacagcaacagcaattggcccaactccagcaacaacactcactgttgcagcagcagcagcagcagcagatacaacagcaacagctacagaggatgcatcaacaacagcagcaacaacagatgcagtcacagactgcccctcacctaagtcagacttctcaggctctgcagcaccaggtccctccccagcagccaccacagcagcaacaacagcaacaacctcctcctagtccccagcagcaccagctatttgggcacgacccagccgtcgagattccagaggagggtttcttattggggtgtgtgtttgcaatcgccgactatcctgaacagatgtcggataagcagctgctggccacttggaaacgcatcattcaggcacacggaggtaccgtggacccaacttttaccagccgctgcacacacctgctgtgtgagagccaggtatcgagtgcctatgcgcaagctatcagggagcgcaagcggtgcgttaccgcccactggctcaatacagttctgaaaaagaaaaagatggtccccccacatcgcgcactgcatttccccgtggcctttcctccgggtggcaagccttgttcacagcatattatttctgtaactggctttgtggatagcgatagagatgatctgaagctaatggcttatctagccggtgccaagtataccgggtatttgtgtcgcagcaacaccgtgctcatctgcaaagagcctactggcctgaaatatgaaaaggcaaaagaatggcgcatcccctgcgtcaacgcccagtggttgggcgatatccttctgggcaattttgaggccttgcgacaaatccaatactcccgctatactgccttctccctccaggaccctttcgccccaacccagcacctggttctgaatctgttagacgcctggagagtcccgctgaaggtctctgccgagttattaatgtccattaggctccctcccaaactcaagcagaacgaggttgctaacgtgcaaccatcttctaagcgcgcacgcattgaggacgtgcccccaccgaccaaaaaattaactccagagctcacaccttttgtgttgttcacaggattcgaaccagttcaagtccagcagtacatcaagaaactgtacatcctggggggagaggtagctgagtccgctcaaaaatgtacacacttaatagcctccaaggtcacccgaactgtcaagtttctcaccgctattagcgtcgtcaagcatatcgtgacaccagagtggctggaggaatgtttccgttgccagaagtttattgacgaacagaattacatcctgcgggatgctgaggccgaagtactcttttcattctctctggaagagagtttgaagcgagctcatgtatccccgctgtttaaggccaaatatttttatatcacaccagggatctgtcccagcttaagtaccatgaaggcgattgtggaatgcgcaggaggaaaagtgctctcaaagcagcccagttttcgtaagttaatggaacacaagcagaattcgtctctcagtgaaattatacttatctcatgcgagaatgatctccatctctgccgagagtacttcgcgcgagggatcgacgtacataacgctgagtttgtgctgaccggagttttgactcaaacactcgactatgagagctacaaatttaactag

SEQ ID NO: 23780 - DNA, 4668 bp, Artificial Sequence
  Description of Artificial Sequence: Synthetic coding sequence
atgtctgaacagacacccgcagaggcaggagcagctggcgcacgggaggatgcatgccgcgattaccaatcctccctcgaggacctgacatttaattcaaaacctcatataaacatgctgaccatcctcgccgaagagaatctcccctttgccaaggagatcgtctctctgatcgaggcgcaaaccgctaaggccccatctagtgaaaaattgcccgtgatgtacttaatggactcaatcgtgaaaaacgtgggcagagagtacctgactgcttttactaagaatctcgtggccacctttatttgtgtgtttgagaaggttgatgagaacactcggaaaagcctttttaagctccgctccacctgggacgagatttttcccctgaagaagttgtatgcactcgacgttcgagttaattcgctcgaccctgcgtggccgatcaagccactgcctcctaatgtgaatacctcttcaattcacgtaaatccaaaattcctgaacaagagcccagaagagccatctaccccaggcaccgtagtctcaagtccctctataagcacaccaccgatcgtccctgacattcagaaaaatctaactcaagaacaactgattagacagcaactcctggccaaacaaaaacaactgctcgaattgcagcagaaaaaactggaactggagctggaacaggccaaggctcagctggctgttagtctttcagtgcagcaagagactagtaatctagggccaggcagtgcgccatccaagcttcatgtatctcagataccacccatggcggtgaaggcacctcaccaggtgccagtccagagcgaaaagtctcgccctggtcccagccttcagatacaggacctcaaagggaccaaccgcgatccacgtctgaatagaatttcacaacactctcatggaaaggatcagagtcacaggaaggaattcctcatgaacacactgaatcaatctgatacgaaaacatctaaaaccattcccagtgagaagcttaattctagcaaacaggagaagagtaaaagtggcgaaaaaattacaaagaaggaactggaccagctggactccaagtcgaagagcaaaagcaagtctccttccccccttaaaaacaagctttcgcatactaaagatctcaagaaccaggaatcagagtccatgagattgagtgatatgaacaagcgggatccaagactgaagaagcacctacaggataagaccgacgggaaagatgacgatgtgaaggaaaaacggaaaactgctgaaaaaaaagacaaggatgaacatatgaagtcaagcgagcatcgactcgcgggatccagaaacaagatcatcaatggtattgtccagaagcaggatactatcactgaagagagcgaaaagcagggcactaagcctggtcgctcctctaccagaaagagatcccgctcacggagcccaaagagcagatccccgatcatccactctcctaaacgtagagaccggcgttctcccaagaggcgccagcggagcatgagccccactagcacccccaaagctgggaagatacgccagtctggcgctaaacagtcccatatggaggagttcaccccacctagtcgggaggatcggaacgcgaaaaggtctacaaagcaggacatccgtgacccaaggcgtatgaagaaaacggaggaagagcgccctcaggagacgactaatcagcatagcacaaaaagcggtacagaaccaaaggagaatgtggaaaactggcagagcagtaagtccgccaagcgttggaaatctggctgggaggaaaacaaatcacttcaacaagtggacgagcatagcaagccccctcatctccgccaccgggaaagctggagctccactaaaggcattctgagtcctagagctcctaaacagcagcaacacagactatccgtggacgccaacttacagattcctaaagagctgacactagccagcaaacgggaattgctgcaaaaaaccagcgaaagactggcctctggcgagatcacgcaggatgatttcctcgtggttgtgcatcaaatcagacagttgtttcagtaccaagagggagtcagggaagagcagcgcagcccgttcaatgataggttccccctcaaaagacccaggtatgaggacagcgacaaaccgttcgtagactctccagcctctcggtttgccggtctagatacaaaccagagactgaccgccttggccgaggaccgccctctgtttgatgggccttctaggccgtctgtcgctagagatggccctacgaagatgatatttgaggggcctaataagttgagtcccaggattgatggacctcctactcccgctagcctgcggttcgatggctccccaggacagatgggaggaggaggccctctccggttcgagggaccccagggccagcttggcggagggtgccccctgcgcttcgagggcccaccagggcctgtgggcacaccattgaggtttgaggggccaataggacaagccggaggaggcggattccggttcgaggggagccctggtttaagattcgaggggtcccccggagggttgcggtttgaggggccaggcggtcaacccgttggcggactcaggttcgagggccatagagggcagcctgtaggtgggctgcggttcgaaggacctcatggccagcccgtcgggggtctgagattcgacaatccacgaggacagcctgttggcggtctcaggttcgaaggtgggcatggcccttccggggctgctattcgttttgatggccctcacggacagcctgggggtggcattcggttcgagggcccactgctgcagcaaggagtagggatgagatttgaaggccctcatggccagtctgtggctggcctccggttcgaaggccagcacaatcagctgggtggtaacctcaggtttgaaggtccccacggccaaccgggagtgggtataagatttgaagggccactggtgcagcaaggaggtggtatgaggtttgaaggccctagcgttccaggaggtggcctgcggatcgaaggtcccctcggccagggcggaccaaggttcgaaggatgtcatgccctgaggttcgacggccaacccggtcagcccagcctgctgccacggttcgacggcctgcatggacaaccaggccctcgcttcgagcgtactccaggacaaccaggtccgcagcgcttcgatggccctcctggacagcaggtccagccacggtttgatggcgtgccacagaggttcgatggaccacaacatcagcaggcttcaagatttgacatccctctaggtctgcagggaacacgatttgataaccacccttctcagcgactggaaagcgtgtccttcaatcaaactggcccttacaatgatccccctggaaacgccttcaatgccccttcacagggactgcagttccaaaggcacgagcagatcttcgattcacctcaagggccaaattttaacgggccacacggaccaggtaaccaaagctttagcaatccactaaatcgagcatccggccactactttgatgagaagaacctgcagtctagccagtttgggaacttcggaaatatcccagccccaatgactgtcgggaacattcaggcgtcccagcaggtgctgagcggcgtagcccagcctgtcgccttcggacaggggcagcagttcctgccagtgcaccctcaaaaccccggattcgttcagaaccctagcggagccttacctaaggcttatcccgacaaccacttgtcacaagttgacgtgaacgagcttttctcaaagttactcaaaaccggcatcctgaagctgagccagaccgatagcgcaacaactcaagtcagcgaggtaaccgcccagccgccaccagaggaagaagaggaccagaatgaagatcaggatgtgccagatctgaccaatttcacagtggaggagctcaaacagcgctatgattcggttataaatcgcttgtataccggaatccagtgttacagctgtggaatgcggttcaccacgtctcagacagacgtgtacgcagatcatctggactggcactatagacaaaacagaacagaaaaggatgtgagcaggaaggtgacgcaccggagatggtactactccctcaccgactggattgagtttgaagagatcgcagatctggaggagcgggcaaagtcccagtttttcgagaaagtccacgaagaggtggttctcaagacccaggaggctgccaaggaaaaagagttccagtcagtgccggctggccctgccggagcagtcgagagttgtgaaatctgccaggaacagtttgaacagtattgggacgaagaggaagaagaatggcatctgaagaatgcaattcgtgtggacggcaaaatttaccacccatcttgctatgaggactatcagaacacatctagtttcgattgtactccctccccctcaaagaccccagtggagaatccgctgaacatcatgctaaacatagtgaagaacgagctgcaagagccctgcgacagcccaaaagtgaaggaggaacgaatcgatacacccccagcctgcacagaagagtctatcgccacccccagtgaaattaaaaccgaaaatgatacggtggagagtgtgtag

SEQ ID NO: 23781 - DNA, 2355 bp, Artificial Sequence
  Description of Artificial Sequence: Synthetic coding sequence
atgtctgagcagaccccagcagaggcaggtgctgcaggtgcaagggaggatgcatgtcgggactaccagagctccctagaggacttgactttcaattcaaaacctcacataaacatgttaactattcttgccgaggaaaacttgccttttgcaaaggagattgtgtcactgatcgaggcacagacggccaaagctccttcctccgagaagctccctgtgatgtacttgatggacagcatcgtcaaaaacgtgggaagagagtatctaacggcctttactaaaaatctggttgccacgttcatctgcgtattcgagaaggtggacgagaacactagaaagagtcttttcaagctaaggtcgacctgggatgagatattccccctcaagaaattatatgctctcgatgtgagggtcaattccctggatcccgcatggccaattaagcccttgcctcccaatgtaaatacaagcagtattcatgtaaatcctaagttcctgaataagtctcctgaggagccgtctacccccggtacagttgtgagctctccatccattagcactcctcctattgttcctgatattcagaaaaacctcacacaggaacaacttatccggcagcaactcctggcaaagcagaagcaactgcttgaactgcaacagaagaagctcgaactggagctagagcaggctaaggcacaactggccgtgtcactgtccgtccagcaagaaacatctaaccttgggccagggagcgccccttctaagctgcacgtgtcccaaatcccccctatggcggtgaaggccccacaccaggtgcccgttcaatcagaaaagtccaggcccggaccttcactgcagattcaggatttgaagggcaccaacagagaccctcgcctcaatagaatttctcagcatagtcatggcaaggaccagtcacacagaaaggagtttctgatgaatacgctaaatcagagtgacactaaaacaagtaaaaccattccatcggaaaagctgaattcgagtaagcaagagaagagtaagtccggagagaagataactaagaaggagctggatcagcttgatagcaaatccaaaagtaaaagcaaaagcccctcacctctcaagaacaagttgagtcacactaaagaccttaagaaccaggaatctgaatctatgcggctgagcgacatgaacaagcgagatccgaggttaaaaaagcaccttcaggacaagacagacggcaaggatgacgatgtgaaagaaaaacgcaagaccgcagagaaaaaagacaaggacgaacacatgaaaagcagcgaacatagacttgcaggatcaaggaacaagatcataaatggcatcgtccaaaaacaggacacgatcacagaggagtccgagaagcagggcacaaaacccggacgcagttccacacggaagagatctagaagtaggagtcccaaatcgcggtcacccatcatccactcacctaaacgcagagacagacgctctcccaagagacgacaaaggtcaatgagcccaacttctacccccaaagcgggaaaaatccgccaatcgggcgctaaacagtctcacatggaagagttcacgcccccatcacgcgaagatcgcaacgcaaaaaggagcaccaagcaggacatccgggatcccagacggatgaaaaaaacagaagaggagagacctcaggagacaacgaatcaacatagtactaaatccgggaccgagcctaaagagaacgtggagaattggcagtcaagtaagtccgccaagcgttggaaatccggttgggaggagaataaaagtcttcagcaggtggatgaacatagtaagccgccacacctgaggcacagagagagctggagtagcaccaaggggatcctgagccccagagccccaaagcaacagcagcaccgtctaagcgtggatgctaacctgcaaatccccaaagaattgacacttgcttcgaaacgcgaactccttcagaagacttctgagaggctggcctctggtgaaataacccaagatgattttttggttgtggttcatcaaattaggcagttgttccagtaccaggagggagtccgggaagagcagaggtccccatttaacgacagattcccactcaaacggccacgctacgaagattccgataaaccgttcgtggacagtcccgcatctaggtttgctggccttgatacgaatcagcggctgactgctttagctgaggatcgcccacttttcgacgggcctagcagaccttctgtggccagggacggacccaccaagatgattttcgaaggaccaaataaactcagtcccagaatcgatgggcctccatag

SEQ ID NO: 23782 - DNA, 4344 bp, Artificial Sequence
  Description of Artificial Sequence: Synthetic coding sequence
atggcccattccaagacgagaacgaatgacggcaagattacttaccctcccggagtcaaagaaatttccgataaaatcagcaaggaggaaatggtgagaagattaaaaatggtggtaaagactttcatggacatggatcaggacagcgaggaggagaaagagctctacttgaacctggccctccacttggcgagcgattttttcctgaagcaccctgataaagacgttcgtctgttggtggcatgttgcctggcagacattttcagaatatatgccccagaagccccttatacatcccctgataaattaaaggatatatttatgtttatcacccggcagctgaaaggattggaagatacaaagagcccccagtttaaccggtatttctacctccttgaaaacatcgcatgggtcaagagctataacatttgcttcgagcttgaggactccaacgagatattcactcagctgtacagaaccctgttcagtgtaattaacaatggccacaatcagaaggtgcatatgcacatggttgacctgatgtcctccatcatctgtgaaggggatacagtcagtcaggagctgctcgatacagtgctcgtaaatctggtacccgcacacaagaacctgaacaagcaggcctacgatctcgccaaagccctccttaaacggaccgcacaggcgatcgagccctacatcactaacttcttcaaccaagtgctaatgctcggcaagacctccatcagcgatctgtcagagcacgttttcgacctcattctcgagctttacaatattgattcccaccttcttctcagcgtgctgccccaattggagttcaaactaaagtccaatgataatgaagagcgcctacaggtggtaaagttattggcgaaaatgttcggcgctaaggactccgagcttgcttcccaaaacaagcccctctggcaatgctacctgggacggttcaatgacatccacgtaccaattcgtctggaatgtgtgaaattcgcctcccactgcctcatgaatcaccctgatcttgcaaaggatttgacggagtatctaaaggtgcggagtcatgaccccgaggaggccatcagacacgacgtgattgtgtcaatagtcaccgccgcaaagaaggacattctgctggtcaacgatcatttacttaactttgttagggagaggactctggataaaaggtggcgggttcgcaaggaagctatgatgggcttggcccagatctataaaaagtatgccctccaatcagcagcgggaaaggatgcagctaaacaaatcgcgtggatcaaggataagctgctccacatctactaccagaactccattgacgaccggcttcttgttgaaaggatctttgctcagtatatggtgccccataatctcgaaaccacagagcgaatgaagtgtctttattatctgtatgcaacgttagatctgaacgccgtcaaggccctcaacgagatgtggaagtgccagaatctgctgaggcatcaggtcaaagacctactagatcttatcaagcagccaaaaaccgacgcttcagtgaaagccatttttagcaaggtcatggtcatcacccgcaatctccctgaccccggaaaagcccaagactttatgaaaaaatttacgcaggtactagaagacgacgaaaagatcaggaaacaactggaggtacttgtgagcccaacatgttcctgcaagcaggcggaaggctgtgttcgcgagattacgaaaaagctgggaaacccgaaacagcccaccaatccgttcctggagatgattaaattcctgctggagcggattgctccagtgcatattgacacggagtctattagtgctctaattaaacaagtgaataagtccattgacgggaccgccgatgatgaagacgagggtgtaccaaccgaccaagcgattcgggctgggctagaactgcttaaagtattgtcttttacccatcctattagttttcattccgcagagacttttgagtctctcttggcatgccttaaaatggacgatgagaaagtcgccgaagctgccctccagatctttaaaaatacaggtagcaaaattgaggaagacttcccacacatccggtctgcattacttcccgtgttgcatcacaaaagcaaaaaaggaccccctcggcaggccaagtacgctattcattgcatccacgccattttcagctcaaaggaaacccaatttgcacagatcttcgagccactccacaagagtctcgaccccagtaacctggagcatttaatcacccctctggttacaatcggccatattgcacttctagctccagaccagtttgccgcaccactgaagtccctagtcgccactttcatcgtgaaggacttgcttatgaacgatcgactgcctggcaagaagacgaccaagctgtgggtgccagacgaggaagtctcccccgagacaatggtcaaaattcaggccataaaaatgatggtccggtggctgctcggcatgaagaacaatcacagtaagtcgggaacctccacactgcgactgttgacgacaatcctccattccgatggcgatctgacggagcaaggtaaaatttcgaagcccgacatgtcgcgcctccgactggcggctgggtcagctatcgtgaaactggcacaggaaccctgctaccacgaaataatcaccctcgagcagtaccaactttgtgccttagcaatcaacgatgaatgttaccaagtgaggcaagtttttgcccaaaagctccacaagggtttaagcagacttcggttacccctggaatacatggcaatctgtgccctgtgtgcaaaagatcctgtgaaggagaggcgagcacacgccagacagtgcctggttaagaatatcaacgtgcggcgtgagtatctgaagcaacacgcagccgtctctgagaagctgcttagtctactccccgagtatgttgtgccatatactattcatctgctggctcatgacccagactacgtcaaggtacaggacatcgaacagctcaaggacgtaaaggaatgcctttggtttgtccttgagatactgatggcaaagaatgaaaacaactctcacgccttcattcggaagatggtagaaaatattaagcaaacaaaggacgcccaggggccagatgatgctaaaatgaatgagaagttatatacagtgtgcgacgtcgccatgaatattatcatgtccaaatcaacaacttattcccttgagtctcccaaggatcctgtgttgccagccagatttttcactcagccagacaagaattttagcaacactaagaactacctgcctccggagatgaagagcttcttcactccaggcaagcctaaaacgaccaacgtgcttggcgcagttaataagccattgtcctctgcgggaaagcagtctcaaacaaaaagctcccgcatggaaactgtgagcaatgccagcagctcttcaaacccttcaagccccggaagaattaagggcagattggattcctccgagatggatcactccgagaacgaagattacaccatgagcagtcccctgccaggtaaaaaaagcgacaaaagggacgattccgatttggtgaggagtgaactggagaagcccagggggcgtaagaagacccccgttacggaacaggaggaaaaactgggtatggacgacttgacaaagctcgttcaagagcagaagccaaaagggagccagcgttcaaggaaaagaggacacaccgcgtccgagtcagacgagcaacagtggccagaagaaaaaaggctgaaggaggacatacttgaaaacgaagacgagcagaattctcccccaaagaagggcaagcggggtcggcctcctaagcctctcggaggcggaacacccaaagaagaacctacaatgaagactagcaaaaagggatccaaaaaaaagagtggaccccctgctcccgaagaggaggaggaggaggagcgccagtctggcaataccgagcagaaaagcaagtctaagcagcaccgagtatctagaagggcccagcagagggccgagtctccggagagttctgctattgagtccacacaatccaccccacagaaaggcagaggccgtccctctaagacgccctcccctagtcagccgaagaaaaacgtgagggtgggtcggtctaagcaggctgccacaaaggaaaacgatagctcagaagaagtcgatgtgtttcagggatcgagtccagtggacgacatacctcaggaagaaacagaggaagaggaggtctctaccgtgaacgtaagacgtcggagcgctaaacgcgagcggcgatag

SEQ ID NO: 23783 - DNA, 3909 bp, Artificial Sequence
  Description of Artificial Sequence: Synthetic coding sequence
atggcccacagtaaaaccagaacgaacgacggcaaaattacttatcctccaggagtcaaggaaatttccgacaaaattagcaaggaagagatggtgaggcgactgaaaatggtcgtgaaaacctttatggatatggatcaggatagtgaagaggagaaggaactctacttgaacctcgcactgcaccttgcttccgatttcttcctgaagcatcccgataaagacgtgagattgctggtagcttgctgtttagccgatatatttagaatctacgccccagaggcaccctatacatcgcccgacaagctgaaagacatttttatgttcatcactcggcagctcaaaggtcttgaggataccaagtccccacagtttaatcgctacttctatctgctcgagaacatcgcctgggtcaaatcttataacatatgctttgaactggaagattctaatgagatttttacgcagttgtaccggactctgttttcagtcattaataatgggcacaaccagaaggtacatatgcacatggttgacctgatgtctagcatcatttgtgaaggagacaccgtttctcaggagctcctggacacagtcttggttaacctggtgcctgcccacaagaacctgaacaagcaggcctacgacctcgctaaagcccttctgaaacgtaccgcccaggccatagagccttatatcacgaatttctttaatcaggtgctgatgttggggaaaaccagcatctctgatctgtcagaacacgttttcgacctgatcctggagctctataacatcgacagtcatttgttactatctgtcctgcctcaactggaatttaaattgaagtccaatgataatgaagaacggcttcaggtggtgaaactgctcgcaaaaatgttcggagccaaggactctgaactcgcctcacagaacaaaccactgtggcagtgctacctgggccgatttaacgacatccatgttcccattcgactcgagtgcgttaagttcgcgtcgcattgtctgatgaatcaccctgacctcgctaaagacctgactgagtacttgaaggtcaggagccacgatcccgaggaggccataaggcacgacgtgattgtgtcgattgtgacagcggcaaagaaggatatccttctggtgaatgatcacttgctgaattttgtgagggagcgcaccttggacaagagatggcgggtgcgaaaggaggcaatgatgggcttagcacagatatacaagaagtacgctctgcagtccgcagccggaaaagacgccgctaagcagattgcatggatcaaagataaacttctacatatctactatcagaacagcatcgatgaccgactgctggtggagcgaatctttgcacaatatatggtgccccataacctggagactacggaaagaatgaagtgtctgtattacctgtacgccactctggatctgaatgccgttaaagcccttaatgaaatgtggaaatgtcagaatctcctccgtcaccaggtgaaggatctcctcgatttaatcaagcagcccaagacagatgcctctgtaaaggctatcttcagcaaagtgatggtcatcactcgtaacctgcccgatcctggtaaggcacaggatttcatgaaaaaatttacccaggtccttgaggacgatgagaagatcaggaaacaactcgaagtcctagtgtcccctacatgcagttgcaagcaagccgaagggtgcgtcagagagattaccaaaaagctgggaaaccccaaacagcccactaacccattcctcgagatgatcaagttcctgctcgagcgcatagcgccagtgcatatcgataccgaatcaatcagcgccctgattaagcaggtcaataagagcatcgacggaactgccgatgacgaagacgaaggcgtcccaaccgatcaggctattcgcgctggattagaactactgaaagtgctctccttcacccatcctatctcttttcactccgccgagacgtttgagtcactgttagcctgcctgaagatggatgatgaaaaggtggccgaagccgctctgcaaatctttaagaacactggttccaagattgaggaagattttccccatatccgatcagccctgctgccagtgctgcatcacaagagcaagaaaggcccacctagacaggctaaatacgctatccactgtatccacgctattttctcgtctaaagaaacccagtttgcacagattttcgagccactgcacaaaagtcttgatccatccaacctcgagcacctcattacgccactcgttaccatcggtcatatagccctcctggctccagatcaatttgctgctccccttaaaagtttggtagctacctttatcgtgaaggatctgttaatgaatgataggctccctgggaaaaaaactaccaagctttgggtacccgatgaggaggttagcccagaaactatggtcaaaattcaggcaattaaaatgatggttcgctggcttctgggtatgaaaaacaaccacagcaaatcgggcacctcaaccctgaggctcctgacaacgatccttcatagcgacggggatctgacagaacaggggaagatctctaaacctgatatgagccgcctaaggttggcagcgggttccgcgatcgtaaagctggcccaggaaccttgttaccacgagattatcaccctcgagcagtatcagctctgcgcactggcgatcaacgatgagtgttatcaggtccggcaagtattcgcccagaagctccataagggactctctcgcctacgcctgcctctggagtacatggcaatttgcgccctatgtgccaaagatccagtgaaagagcgacgcgctcatgccagacagtgtttagtcaagaatattaacgtgcgcagagaatatctcaaacagcatgctgccgtgagtgaaaaattactgtccctgctgcctgagtatgtggtcccctacaccatccatcttctggcacacgacccagactacgttaaggtgcaagacatagaacagttaaaggacgttaaggaatgcctgtggtttgttctggagatcctgatggctaagaatgaaaataattctcacgcctttattagaaaaatggtggaaaacataaaacagaccaaggatgcccagggccctgatgatgcaaagatgaacgagaaactgtatacggtctgcgacgttgcgatgaatattattatgagcaagtccacaacgtactcccttgaatcgccaaaagaccctgttctcccggctcgcttctttactcagccagacaaaaacttttccaatacaaagaattacctcccccctgagatgaagagtttcttcacgcctggcaagcccaaaaccaccaacgtattaggggctgtcaataaacccctttcctcggctggcaaacagagccagacaaagtcttctcgtatggaaaccgtttccaatgcctctagctctagcaacccaagttctcccggacggatcaagggtcgccttgacagctccgagatggaccattcggagaacgaagattacactatgtcttctcctctacctgggaagaagtctgataagagggatgattccgatctggtaaggtccgagctagaaaagccaaggggccgaaagaagacacccgtgacagaacaagaggagaagctagggatggacgatctgaccaagctcgttcaggaacagaaacccaaggggtcacagcgttccaggaagagggggcataccgccagtgagagtgatgagcagcaatggccggaggaaaagaggttaaaagaggacattctggagaatgaggacgagcaaaactccttacctctacaccagaaagacgccagcgatcgcaggacgaccatgcaaatcgtcaaatag

SEQ ID NO: 23784 - DNA, 2115 bp, Artificial Sequence
  Description of Artificial Sequence: Synthetic coding sequence
atggccaacgaaaatcacggatcccccagagaggaggcgtctctgctgtcccacagtcccggtacatcgaatcagagccagccctgttctcccaaacctattagactggtgcaggacctgccggaggagctcgttcacgcaggttgggagaagtgttggtccaggagggagaatagaccctactacttcaaccggtttacaaaccagtcattatgggagatgccggtactcgggcagcacgatgttatttctgaccctctgggactcaatgccacccctctgccacaggatagttcactggtggaaacacccccagccgaaaacaaaccaagaaagagacagctttctgaggagcagccaagtggaaacggtgtcaagaagcccaaaatcgagatccccgtgactcccacaggccagagcgtacctagcagcccatccatacccggaactccaaccctgaagatgtgggggacatcccctgaggacaagcagcaggcagcccttcttcggcctactgaagtttactgggatctggacattcagaccaatgcagttattaagcatcgaggaccatcagaggttcttcccccacaccctgaagtggaactcctgcgttctcagctgattctgaagctgcgacaacattatagggagctgtgccaacaacgcgagggtatcgaaccccctagggagagttttaacagatggatgttggagaggaaggttgtggataagggatccgatccattgctcccctccaattgcgaaccagtcgtgtctccatctatgttcagagagatcatgaacgacatccccatcaggctgagccgcatcaaatttagggaagaagctaagaggttactgtttaaatacgccgaagccgctcggcgtctgatcgagtcccgatccgcttcacccgactccaggaaggtagtgaagtggaatgtggaggataccttttcttggttacgcaaggatcattccgcatccaaggaggactacatggaccggctggaacatctaagacgccaatgcggtccacatgtgtcagccgctgccaaagattccgtggagggaatatgtagcaagatataccacatatctctagagtacgtaaagagaatcagggaaaaacacttagctattctcaaggagaacaacatcagcgaggaggtggaggcgcctgaggtggaacctcggctggtatactgttaccctgtcaggttagcagtgtctgctccccctatgcccagcgtcgagatgcacatggaaaataatgtggtgtgcatacggtacaaaggggagatggtcaaagtgtcaaggaactatttcagtaaactctggctgctgtacaggtactcgtgcatagacgactcggccttcgaaaggtttctcccgagagtctggtgtctgctccgccgttatcagatgatgttcggggttggactgtacgaagggaccgggctccagggcagtttgcccgtccacgtcttcgaggccttgcaccgacttttcggtgttagttttgaatgtttcgcatcccccctaaactgctactttcgccagtattgtagcgcgttccccgacactgatggctatttcggatcccgcggaccttgccttgattttgccccactgtccggatcttttgaggcgaacccgcctttttgcgaggagctgatggatgctatggtatcgcacttcgagagacttctcgagagttccccagagccactttctttcatcgtattcatacccgagtggcgggagcctcccacccccgctttgacgcgcatggagcagtcaagattcaagagacatcagctgattctcccagcattcgaacacgaatacaggtccggcagtcagcatatttgcaaaaaagaggagatgcattacaaagccgtgcataatacggctgtgctctttctgcagaatgacccaggattcgccaaatgggctccgacacctgaaaggctgcaggagctttcggcagcttatagacaaagcgggaggagccatagctcaggatctagctctagctccagcagtgaggccaaagatagagattccggtagagagcaggggccatcccgagaaccccatccaacgtag

SEQ ID NO: 23785 - DNA, 2133 bp, Artificial Sequence
  Description of Artificial Sequence: Synthetic coding sequence
atggccaacgagaatcacggctccccgagggaagaggccagtctcctatcacactcaccgggaacatctaatcagagccagccatgttcccccaaacctatccgattggtgcaggacctgccggaagaactcgtccacgctggttgggaaaagtgctggtctcgaagagagaatagaccatactattttaatcggttcaccaaccagtcgctctgggaaatgccagtccttggtcaacacgatgtgatcagtgacccactgggcttaaacgcaacacctctgcctcaggactctagcctggttgaaacaccaccagcagagaataaacccagaaagaggcagttgagtgaagagcaacccagcggcaatggagtgaaaaagcccaaaatcgaaattcccgtaaccccaacggggcagtcagtgccctcttctccttctattccaggtacgcctactctcaaaatgtggggcacctcgcctgaggacaagcagcaggccgctctgctgcgtccgactgaagtctactgggatctggatatacagacaaacgctgtgatcaaacaccgaggtccctcagaagtcctcccaccacatcccgaggtcgagcttctccgttctcaattgatcctgaaactcagacaacactacagagagctctgccagcagcgggaagggattgaacccccaagagaaagctttaaccggtggatgctggagcggaaggtagtggataaggggtccgatcctcttttgccaagcaattgcgagcctgtcgtttccccctccatgttccgagagattatgaacgacataccaatcagactgagcaggattaaattcagggaagaggcaaaacgtctgctgtttaagtatgctgaggcagctcgtcgcctcatcgaatcgcggtccgccagcccagacagccggaaggtagtgaagtggaacgtggaggacacattctcctggttgagaaaggaccattccgcgagtaaggaggattacatggatcgccttgaacatcttaggaggcagtgcgggccacacgtttccgccgcagccaaggactcagtcgaagggatttgtagcaagatctatcatatcagcctggagtatgtcaaaaggattcgagaaaaacatctggctatcctcaaggagaataacatttccgaagaggtcgaagcccctgaggtcgaaccgagactagtctattgctacccggtgaggctggctgtgtcagctccccctatgcccagcgtcgagatgcacatggagaacaacgtggtttgcatacgttataagggggagatggtgaaagttagccgcaattatttttccaagctctggctgttataccggtactcatgtattgacgacagtgcatttgaacgcttcttgcccagagtgtggtgtctactgcgaagataccagatgatgttcggcgttgggctttacgagggtactggcctgcagggaagcctgccagtccatgtttttgaggcattgcaccggctatttggcgtgtcattcgaatgtttcgcaagcccacttaattgttatttcaggcagtactgctctgctttcccagatacggatggctacttcggctcccgcggaccatgtctggacttcgccccactatccggatccttcgaggcaaatccgcctttttgcgaagagttgatggatgctatggtctcccactttgagcggttgctggaatctagccccgagcctctatccttcattgttttcatcccggagtggcgcgagccacccacgcctgccctgactagaatggagcaatcacgtttcaaacgccaccagctgatcttacccgcttttgaacatgagtaccgatccggatcacaacacatctgcaagaaggaggagatgcattacaaggccgtccataatacagctgtattgtttctgcagaacgatcccggatttgccaaatgggcccctacgcctgagcgactccaggagctgagtgccgcttatagacagagtgggcgaagtcactcctccgggtcttcttcatctagcagctctgaggctaaggatcgggatagtgggagagagcagggccctagtagagagccccaccccgtggcaacattgtttcacctatag

SEQ ID NO: 23786 - DNA, 498 bp, Artificial Sequence
  Description of Artificial Sequence: Synthetic coding sequence
atgagtgtgacattacatacagatgttggggatattaagattgaggtgttttgtgagcgaacgccaaagacctgtgaaatggagagcaggtgcgtgcctcaggccggagtgcagtggagagacctggggagcctgcagcctccacctcctggctttaagcaggttttctgtctttccttaccgcgaaccgggcgtggaggaaacagtatctggggcaagaagttcgaagacgagtacagtgagtacttgaagcataatgtcagaggagtggtttccatggccaataacgggcctaatacgaacgggagccagttctttatcacctatgggaagcagcctcacctagatatgaagtatacggtgtttggcaaagtgatcgatggcttagagaccctcgatgagctggaaaagctcccagtcaatgaaaagacgtatagaccattaaatgatgttcatatcaaagatattactattcatgcgaaccccttcgcccaatag

SEQ ID NO: 23787 - DNA, 486 bp, Artificial Sequence
  Description of Artificial Sequence: Synthetic coding sequence
atgtccgttaccttgcataccgacgtgggtgacatcaaaattgaggtcttctgtgaacgcactccaaagacatgcgagaacttcctagccctttgcgcctctaattattacaatgggtgcatctttcatcggaacatcaaaggtttcatggttcagaccggggaccctacgggtaccggacgcggaggtaactctatctggggcaaaaaatttgaagatgagtattcagagtatttaaagcacaatgtacgtggcgtggtgtccatggctaataacggtcctaacaccaacgggtcacagtttttcatcacctatggaaagcagccccatctagatatgaaatatacggtgttcggcaaagtgatagacggcctggaaaccttggatgagcttgagaagcttccagtgaacgagaagacgtacagaccccttaacgatgtccacataaaagacattacaatccacgccaatccatttgctcagtag

SEQ ID NO: 23788 - DNA, 498 bp, Artificial Sequence
  Description of Artificial Sequence: Synthetic coding sequence
atgtcagtgacgcttcataccgacgtaggagatattaaaatcgaggtattctgcgagagaacacctaagacttgcgaaatggagtcacgctgtgtccctcaggccggagtgcagtggcgagacctgggaagcttgcagcctcctcccccaggattcaagcaggtattttgcctgagcctgcctcgcaccggcagaggcggaaactcaatttggggcaaaaagtttgaagacgaatacagtgagtaccttaagcacaatgtgaggggagtcgtgtctatggcaaataacggacctaacacaaacggaagccagtttttcatcacatacgggaaacagccacatctcgatatgaaatatacagtattcggtaaggttatcgatggactagagacccttgacgaactcgagaagctgccagtgaacgaaaagacgtacaggcctctgaacgacgttcacataaaggacatcactattcatgctaatccctttgctcagtag

SEQ ID NO: 23789 - DNA, 243 bp, Artificial Sequence
  Description of Artificial Sequence: Synthetic coding sequence
atgagtgtcacactgcacaccgacgtcggagacataaaaatcgaggtgttctgtgagcgcacccccaagacctgtgagaattttctcgccctctgtgcatccaactattacaatggctgcatctttcatcgcaatattaaagggttcatggttcagacaggggatccaaccggtaccggaagaggaggaaattccatctggggtaagaaatttgaggatgagtatagtgagtacctaaagtag

SEQ ID NO: 23790 - DNA, 1941 bp, Artificial Sequence
  Description of Artificial Sequence: Synthetic coding sequence
atggcagctgagtccggcagtgattttcagcagcgcagaagacggaggagggacccagaagagccggaaaagaccgagctctccgagcgggagctagccgtcgctgttgcggtatcccaagagaacgacgaagaaaatgaggaacgctgggtcggccctctgcctgtcgaggccacgttagcaaagaagcgcaaagtccttgagtttgagcgggtatatctggataaccttccgtctgcctccatgtatgaacggagttatatgcaccgggatgttataacacatgtagtgtgcaccaaaacagatttcattattaccgcctcacatgatggacatgtcaaattctggaaaaagatcgaggaggggattgagtttgttaagcatttccgctcacacttgggcgttatagagtccatcgccgtgtcatctgaaggtgctcttttttgctcagtaggagatgacaaggcaatgaaggtgttcgatgtggtgaacttcgatatgataaatatgctgaaacttgggtatttccctggccagtgtgaatggatctactgcccaggagatgctatctctagtgtagccgcatcggagaaatcaaccggcaagatctttatctatgacgggaggggagacaatcagcctcttcatatctttgacaaattgcataccagcccactgactcagatccgtctgaatcccgtctacaaggctgtggttagcagcgacaaatcagggatgatcgagtactggactggcccaccacacgagtataaattccctaagaatgttaattgggagtataagacagacaccgatctgtacgagttcgctaagtgcaaggcctaccctacttcggtgtgcttttcccccgatggcaaaaaaatcgccaccattggttcagaccggaaagtccggatattccggttcgtcaccggcaagctaatgcgcgttttcgacgaaagcctcagtatgtttacagaacttcagcagatgagacagcaactgcctgatatggagtttggccgaagaatggctgtagagcgagagctcgagaaagtggacgccgtgcggctcattaacattgtgttcgatgagaccggccattttgttctgtacgggacgatgcttggcatcaaggtgattaatgtggaaactaatcgatgcgttcgcatcttgggcaaacaggaaaatattcgggtaatgcagctcgctctctttcagggaatcgctaaaaaacaccgcgctgcaaccacaatcgaaatgaaggcgagcgaaaaccctgtgctacaaaatatccaagcggatcccacaattgtctgcacctcattcaaaaaaaataggttttacatgtttacaaaacgagaaccggaggacaccaagagcgccgactctgatcgggacgtgttcaatgagaagcctagtaaagaggaggtgatggctgccacgcaggcagaaggccctaagcgcgtgtctgattctgcgattattcacacatcaatgggggatatacacactaagttgtttcccgtggagtgcccaaagaccgttgaaaatttctgtgtacactcccgtaatggatactataatgggcatacattccaccgaattatcaaggggtttatgatccagacaggtgatccaacaggaaccggcatggggggtgaatcaatctggggtggggagtttgaagacgaattccattcgaccctcagacatgatagaccatacacactctctatggccaatgctggatccaacacaaacggctcccagttttttattaccgtggtgcccactccgtggcttgacaacaagcacacagtgttcggaagagtaacaaaggggatggaggtggttcagcgtatttctaacgtgaaggtgaatcctaaaacagacaaaccctatgaagacgtgtctattataaacataaccgtcaaatag

SEQ ID NO: 23791 - DNA, 1851 bp, Artificial Sequence
  Description of Artificial Sequence: Synthetic coding sequence
atgcgcagaactaaaagcgcgggtctggatctgtacctttggagacagcactggcccaggcgcggaaagcagcctcatgaagtcggcatttccaatagctatttagtgctagagttcgaacgggtctatctcgataacctaccgagcgcctctatgtatgaacgcagctacatgcatcgggacgtgataactcacgtagtttgcaccaaaacggattttatcatcaccgcatcccacgacgggcatgtaaagttttggaaaaagatagaagaaggaatcgagttcgtgaaacattttcgcagtcacctgggcgtgatagaaagtatcgccgttagcagcgagggggcactgttctgctcagtcggcgatgacaaggccatgaaagtattcgacgtggttaatttcgatatgattaacatgcttaagcttggttacttccccggacaatgtgagtggatttactgtccaggcgacgcaatctctagtgtcgctgccagcgaaaagtcaaccgggaagattttcatatatgatggccgaggagacaaccaacctctgcacatcttcgataaactccacactagccccctgactcagattcgcctcaatccagtttacaaggcggtggtttccagcgataagtctggcatgattgagtattggacaggacccccacatgagtacaaatttcctaaaaatgttaattgggagtataaaaccgatacggatctctatgagtttgcaaagtgcaaggcgtatcctacttcagtctgcttttctcctgacgggaaaaaaattgcaacaatagggagcgatcgaaaggtacggatctttcggttcgttaccggtaaactgatgcgggtatttgacgaaagcctgagtatgtttaccgagctgcagcagatgcgccagcagcttcctgacatggagtttgggcgacgtatggccgtggaacgggaactggaaaaggtggacgccgtgcgtctgatcaatatagtctttgatgaaaccgggcatttcgtcctctatggaacaatgctgggcatcaaagtgattaatgtggagactaacaggtgtgtccgaatactgggaaagcaggagaacataagagtgatgcagttggccctgttccaaggaatcgcaaagaagcatcgagcggctactacaatcgagatgaaagcctctgaaaaccccgtgctgcaaaatatacaggctgatccaacgatcgtatgcacctcattcaagaagaaccgattttacatgttcactaagcgggaacctgaggataccaagtccgccgactctgaccgagacgtctttaatgaaaaaccatccaaagaggaggtcatggctgccacacaggcggaggggcctaagagggtgtctgatagcgccatcatccatacatctatgggcgacatacacactaagctattcccagtggaatgcccgaagaccgttgaaaacttctgtgtccatagtcgaaatggctattacaacggccataccttccacaggatcattaagggcttcatgattcagacgggtgaccctacggggactggaatggggggtgaaagtatttggggcggtgagttcgaagacgaatttcatagcactctcaggcacgatcgaccatacactctgtcaatggccaacgccggatccaacacaaacggatcacagttcttcatcaccgtcgtgcccaccccttggctggataacaaacacactgtcttcggcagagtgacaaaagggatggaagttgtccagcgaatctccaatgtgaaggtgaatccaaagactgacaaaccctacgaagacgtgagtatcattaacattaccgtgaagtag

SEQ ID NO: 23792 - DNA, 1473 bp, Artificial Sequence
  Description of Artificial Sequence: Synthetic coding sequence
atgaaagtattcgacgttgtcaacttcgacatgattaacatgctgaaactgggctattttcccggtcagtgtgaatggatctattgtcccggagacgcgattagtagtgtcgctgcatctgagaaaagtaccggcaagattttcatttatgatgggcgaggcgataaccagccactgcacatctttgacaagttacatacatcacccctgacccagatccggctcaacccagtgtacaaagcagttgtcagctcggataagtcgggtatgatcgagtactggactggcccaccgcatgagtataaattccccaaaaacgttaactgggaatataaaacagacacggatttgtatgagttcgctaaatgtaaggcttacccaacaagtgtgtgcttctctccggacggcaagaaaatcgccactatcggctctgacaggaaggtaaggattttccggtttgttaccggcaaactgatgcgggttttcgacgaatccctctccatgtttacagagctccagcagatgcggcagcagcttcctgatatggaattcggccgtagaatggccgtggaaagggaactggagaaggtggacgccgtgaggcttattaatattgtattcgacgagaccgggcattttgtgttgtatgggactatgctaggcattaaagtgatcaatgtagagaccaataggtgcgttcgaatactcggaaagcaggaaaatattagggttatgcaattggccctgtttcagggaattgctaagaaacatcgagccgcaactacaattgaaatgaaagcctcagagaatcctgttttgcaaaacattcaggccgacccaaccatcgtgtgcacctcctttaagaaaaacaggttttacatgttcaccaaacgggaacccgaagacactaaatcagcagatagcgaccgcgatgtgtttaacgaaaagccttccaaggaggaggtgatggctgccacgcaggctgagggtcctaagcgcgtcagcgactccgctatcatacatacttccatgggggacatccacacaaagctcttccctgtcgaatgccccaagaccgttgagaacttttgtgtgcattccagaaacggctactacaatggccacacatttcatagaattatcaaaggctttatgatccagaccggtgacccgactggcaccggcatgggtggagagtctatttggggaggtgagtttgaggacgaatttcactccacgctgagacacgaccgcccttacacactctctatggccaacgctgggtccaataccaacggctctcagtttttcattactgtggtgccgacaccatggctggacaacaaacataccgtctttgggagagtcacaaagggaatggaagttgtgcagcgaattagtaatgtaaaagtgaatcctaaaaccgataagccttatgaagatgtgagtattattaatattactgtgaaatag

SEQ ID NO: 23793 - DNA, 906 bp, Artificial Sequence
  Description of Artificial Sequence: Synthetic coding sequence
atggccaccacgaagcgggtgctgtatgttggtggtctggctgaagaggttgatgacaaggtgctgcatgcagccttcatccccttcggggacatcactgacatacaaatccccttggattatgagacagaaaagcaccgagggttcgcattcgtggagttcgaactggcagaggacgccgctgctgctatcgacaacatgaacgagagtgagctgttcggcaggaccatacgtgttaatttggccaagccaatgaggattaaggaaggcagctccaggcctgtgtggagcgacgacgattggttaaagaaattttccggaaagaccttggaggaaaacaaggaggaagagggctctgaaccaccgaaggccgaaacgcaggagggcgaacctatagccaaaaaagcaagaagcaacccccaagtctatatggacatcaagatcggcaataagcccgctggacgcatacagatgttacttcgctccgatgtggtccctatgactgctgaaaattttcggtgtttgtgcacccacgaaaaaggcttcgggttcaagggcagttcatttcaccgcatcattcctcaattcatgtgccaaggtggtgacttcactaatcacaatgggacaggtggtaaatccatctacggcaagaaattcgacgatgagaactttatcctcaagcacactggaccaggactgctgtccatggcaaacagcggacccaatactaacggttcacagttctttctaacatgtgataagacagactggctcgatggaaaacacgtggtgttcggggaagtgactgagggcctcgacgtgttacgccaaatcgaggcccaggggagtaaggacgggaagccgaagcagaaggtgatcatcgcggactgcggggagtatgtatag

SEQ ID NO: 23794 - DNA, 891 bp, Artificial Sequence
  Description of Artificial Sequence: Synthetic coding sequence
atggccacaacgaaacgcgttctttatgttggcggtctggccgaagaggtggacgataaggtacttcacgccgctttcattccgttcggtgacatcactgatattcaaatcccacttgattatgagacagagaagcatcgcggattcgcatttgttgaatttgaactggccgaagatgccgctgccgctatcgacaacatgaacgaatccgaattattcggcaggactatccgcgtaaacttggctaaaccaatgaggattaaggaaggaagtagtcggcctgtctggtctgacgatgactggctgaagaaattctcggggaaaacactggaggaaaataaggaggaggaaggcagcgagcctcctaaggcagagacacaggaaggtgagccaatcgccaaaaaagcccgatcaaacccacaggtgtacatggacattaagatcggtaataagcctgccggtcgaatccagatgcttctgcggagcgatgtggtccccatgaccgccgaaaactttcgctgcctgtgcacccacgagaagggattcggctttaaaggttcttccttccatcggatcattccccagttcatgtgccagggtggggacttcactaaccataatggaacgggcggtaaatcaatttacggcaagaagttcgacgacgaaaacttcatactgaagcatactggccctggtcttctttcaatggccaactctggtcccaacacaaatggctcgcaattcttcttgacttgcgataaaaccgattggctagatggcaagcatgtggtcttcggtgaggtcaccgaagggttagacgtgttgcgccagatcgagaagcaggaggaatctgccatcacctctcagccccgaagctggaaactgacatag

SEQ ID NO: 23795 - DNA, 945 bp, Artificial Sequence
  Description of Artificial Sequence: Synthetic coding sequence
atggcgacaaccaagagggtgctttacgtgggcggtctcgccgaagaggtcgatgacaaagtcctgcacgccgcttttattccattcggtgatatcaccgatatccagatacccttagattatgagacagaaaagcatcgtgggtttgcattcgtggagtttgagttggccgaagatgcggctgccgcaatagacaatatgaacgagtccgagctttttgggagaaccatacgagtcaatctggcaaaaccgatgcgtatcaaagaagggagctctaggcctgtctggagtgatgatgattggctgaagaagttcagcggaaagacgctggaggagaataaggaggaggaggggtcagagccacctaaagctgaaacacaggagggggagccaattgctaaaaaggccaggtccaacccacaggtgtacatggacattaagatcgggaacaagccagccggaagaattcagatgttgctccggagcgatgtggtaccaatgaccgcagaaaatttcagatgcctttgtactcacgagaagggcttcggatttaaaggcagtagctttcaccgcatcattccccagttcatgtgtcagggaggtgattttactaatcataacggcactgggggaaagtcgatttacggcaagaaattcgacgatgagaattttattctgaaacataccgggccagggctcctctcaatggcaaactccggccctaataccaatggaagtcagttcttcctgacgtgcgacaaaactgactggctcgatggtaagcacgtggtcttcggagaggtgacggaggggctagacgttctacgacagattgaggtggcccctgacaccaaggcctctaaagcaaggggaagcagaaaaaataaggacggccaggagcggaattggggaaaatcacagaaggttgaaagccatacaatctag

SEQ ID NO: 23796 - DNA, 6242 bp, Artificial Sequence
  Description of Artificial Sequence: Synthetic coding sequence
atgtctagcagtccttcccgctccgccgcagacatttatatcagggagtatttccacagccatgtcagcggaggccaccctgaagccacgcccttgcgagttatgtacacagaccgcccactgtctcagactgaccccgtgacacttcagtattgctgtttgaccgacgaccgacaggccttcagacccccaacccgcgcagagcttgctagacatcgtgttgtcgtcacaaccacatctcaggctcgggagctgcgcgtgcccgtcggtttctttagccatatcttgattgatgaggccgctcagatgcttgagtgtgaagccctgactccactggcgtacgcgagtcatgggactcggcttgttctcgccggagatcatatgcaggtcacccccagactgtttagtgtggcgcgagctagggccgcagaacacaccttattacaccgcctcttcctgtgctatcagcaggaaactcacgaggtggctcgacaaagtaggctggtattccacgagaattatagatgtaccgacgctattgtctccttcatctcgcggcatttctacgtcgcaaaggggaatccaattcacgctcgcggtaaagtaccgccacatcccagacactaccctctcatgttctgccacgtggccggttcgcctgaccgggatatgagcatggctagttggcttaaccttgctgagatcgctcaagtcgtcgagaaggtccaggaagcttataacacgtggcccagttgttggggagggagggagcagcggtgcatctgcgtggtctctcacggggctcaagtgtccgcattgagacaggaactgcggaggcgggatcttggacaggtgtctgtgggttcattcgagatcctgccgggacgccagtttcgcgtggtggtgctctccaccgtgcacacctgtcagtctctactgagtcccggagcccttgcccctgagttctttactgacgcgagagttctgaacaccgtcttgacccgggcacagtcacaactggtggtcgtcggcgatgcagttgccctgtgctccttcggcgcttgtggcaagctctgggagtcctttatccgagagtgtgtggaacggcactccgtttgccccgaagggctgagtatggagcaggtcgaacagggagtagcccagagacgaagatggcctccccgtggaacacaagcaggggctgcaggtaactgggaggccgcacccgagccagtgggcgaccttgcggaggagcaggccgctgtcgtgaccgcaatggttaaggcagagcctggggacgaagcattgtcacccgcttctagggacattaccgccacaactgctcaaactgaggctgcggctgcccctgccggtgatgccgtcaaagaagacgttgtgcctggggcttgcgcggctggcgcagctgctgccgctggcgttgagtcaaccgaggccgaggacgcagaggcggacttctggccttgggatggcgaactaaacgcagacgacgccatactgcgagagctccttgacgaatcccaaaaagtgatggttaccgtcggtgaggacggtttgctggacacggttgctcgcccagagtctttgcaacaagcgcgtctttacgagaacttaccacccgcagccctgcgaaaactgctccacgctgaaccagagcgttaccggcactgtagctttgtcccggagacattcgagcgggctagtgccatccccctcgacgacgccagctccggtcctatccaggtgcgtgggcgacttgattgtggcatggcttttgccggagatgaagtcctcgtgcagctgctgtccggggacaaggcacccgaggggagactgcggggtcgagttcttggagtgctgaaaaggaaacgtcacgagcttgcattcgtgtgtcggatggacacctgggacccccgaataatggtgcccatcaatggctctgtgacaaagatttttgtcgctgagcttaaagatccaagccaggtgcccatatatagcctccgcaaggggcgactccagagagtcggactcgaaaggctgaccgcggaggcgcgtcactcacgcttattctgggtccagatcgtcttatggcgtcagggattttactatcccctgggaatagtgagggaggttctgccagaggcaagcacctgggagcagggcctgagaatcctggggctggaatattccctgagggttcccccttctgaccaggccacaataacaaaggtgctgcaaaaatatcatacagagcttggccgagtggctggaagacgtgaggattgtcgggcatttctgaccttcacagtggatccccagggggcttgtaatctggacgacgccttatctgtgagggatctgggaccaagatgcgaggtggccgtgcacatcactgacgtggcttcctttgttcctcgagatggcgtcttagacgtcgaggcgcgaagacagggcgcagctttttatgcgcctgggcgagaacccgtaccaatgctgccagcctcactgtgccaggacgtgttgtcacttcttccgggaagggaccgattagccatcagcctgtttctcacgatggaaaaagcttcaggccagttgaaaagcttgagatttgccccatctgtggttcagtccgatcggcaactctcttatgaagaagctgaggaggttatcagacaacaccctggtgcaggccgagagttgccagctcggcttgattccgtagacgcttgcgtggtggccgcttgctatttttctagattgctgcgtaggcaccggctcaggtctgattgtttctatgagcagcctgacgaagacggaactcttggattcagagctgcacacattatggtcaaggagtacatgattcagttcaacagattggttgcagagtttctggtcggatctgagtgtacccgtactgtaactcccctgcgctggcagcccgcacctagatcacagcagctcaaggcactgtgtgaaaaacacggtgacagagttcccctatctctccacctcggacatcatctgcatgggggtggaggttcaccacctgatactagattacacctgttggcctccttgtggaaacaagttcagttcgcagccagaacacaggactacgagcagatggtcgacctggtgactactgatgacatgcacccattcctcgcccctgctggtagagacctgaggaaagctctagagcgctctgctttcgggaggtgtgccaggggtcatcagcaacaaggcggacactattccttgcaggtggactggtacacctgggccacatctccgatcaggcgatatcttgatgttgttctccaacgccagatcttacttgccctgggccatggcggttccgcttactccgcaagagacatagatggactgtgtcaggcattcagtctgcagcacgcattggctcaatcctaccagagaagagcaaggagccttcacctagcggtgcagctgaaggcccaacccctggacaagctgggattcgtggtcgacgttgaagcaggaagtcgctgctttcgcctgcttttccccagcaaccgagagactcttcccgacccttgtcccgtcccgtatgggagtcttcagttggccgaacatcctcacgctcttgctgggagacctggtctccgcctgctgtggcgacggagagtgtactccgcccaaggatcctccccgccactgccactgccgggtaccgtgcccgatcctcacaccctcgccgtggaaacggcgctttggaagcagctgttagaactggtcgagctccagcggtggcctgaggccgctgctctcatccaagaaaagggcgaggcatcccaaagaagggaactcgtgcaggtgcaaaggagtcattgtggacatttcctagaagtggcccgagagctgggtagcggagacactttgcaggtgcagcttggcacatccctgcaacatggatttctggtgcccagtccacaattgtggacggtcgcgccaggcttttccttatgtttggagcacgtggagcgccctggcgactgcttcagcggcagagtgtatagggcccctcgagaccgctacagggacgtggatgaatatgcctgtgtctgggagcccttttgcgcattggagtcagctacaggagcagtcgcagaaaacgacagcgtaacccttcaacacctgagcgtttcttgggaggcttcaaggactccccagggacagctgcagggggcttttcgccttgaagctgctttcctggaagaaaactgtgccgatattaatttttcctgttgctacctttgtatcaggctggagggcctgcccgctcccacagccagcccacgacccggtccttcctctctggggccagggctgaatgtcgaccccggtacatatacgtgggtagcacatgggcaaactcaagattgggatcaggagcggagagcggacagacaagaggctccacggagggtccacctattcgtgcatcatatgggcatggaaaaagtcccagaagaggtgctcaggcccggtacactttttaccgttgaacttctccctaaacaacttccagatctgagaaaggaggaggccgtcagagggctggaggaagcttctcccctcgtcacgagcattgcgctgggccgacccgtgccgcaaccgctctgccgcgttattcccagcaggtttctggaaaggcagacgtataatataccgggagggagacataaactgaatccctcccagaacgtagcagtcagagaggcccttgaaaagccctttaccgtcatccaagggcctccaggcaccgggaaaactattgtgggactgcacatagtcttctggtttcacaaaagcaaccaggagcaggtgcagcccggagggcctccaagaggtgagaagcgcctcggcggtccctgcatcttgtattgcggtccaagcaataaaagcgttgatgttctggccggtctgctattgcgacgtatggagctcaaacctctgcgggtatatagtgagcaggccgaggctagcgagttccccgtccctcgcgtcggtagtcggaagctcctaaggaaatctccacgcgaggggcgacccaatcagagcctgcgatccataacacttcatcatcgcataagacaggcaccaaatccatacagctccgaaatcaaggccttcgacacacggctccagaggggcgagctttttagtagagaagacctggtttggtacaaaaaagtgctctgggaggccaggaagtttgagctagaccgccacgaggttatcctttgtacttgtagctgtgcggcttccgctagcctcaaaatccttgacgtaaggcagatcctggttgatgaggctgggatggcaactgaaccagagaccctaattcccttagtgcagtttccccaggctgagaaggtcgtacttttgggggaccataaacaattgcgacctgtcgtgaagaatgagcgcctccaaaatcttggcttagacagatctctcttcgagcgatatcatgaagatgctcatatgctggatacacagtatcggatgcacgaggggatttgcgccttcccctctgtcgcgttctataagtccaaactgaaaacctggcaagggcttcgaagacccccatccgttctggggcatgccggtaaagagagttgcccagtgatattcggtcatgtgcaaggacatgagagaagtttgctcgtgtcaacagacgaggggaacgagaactcaaaggccaatctggaggaggtggccgaagtcgtcaggataacaaaacagctgaccctggggagaaccgtcgagccacaggatatcgcagtgctgacgccatataacgctcaggcatccgagatctccaaagctctgcgtagggaagggatcgccggtgttgccgtcagttctatcaccaagagtcagggttcagagtggagatatgtgctggttagtactgtgagaacttgtgcaaagagcgacctggatcagcggccaaccaagagttggcttaaaaaattcctggggttcgtcgttgatcctaaccaggttaatgttgcagtgacccgggcacaagaggggctttgtttgattggagaccacctcctgctgcgttgttgtcctctatggaggtctctcctcgacttctgcgaggcgcagcagacactggtcccagcgggacaggtacgggtgtgccggaggccaaccatgccatctta

SEQ ID NO: 23797 - DNA, 7949 bp, Artificial Sequence
  Description of Artificial Sequence: Synthetic coding sequence
atggctgtctgggaggctgagcaactgggcggtctgcagagaggagaccttctgactccacccgcaccagatggcgacggcagaaccgctccattgggtcaacctccaggcgctcagttgtattgtccagcctgcctggtgacttgtcactcacaggaagcattcgaaaaccactgcgcctctagcgagcacgcacagatggtggccttcgatcaggctctcccttgggagcatcgatcgcctcctcccggtttgtcaaaattcgagctctgccccaaacccgatctgtgtgagtatggggatgcatgtacaaaagctcactccgcccaggaactgcaggaatgggtccgacgcactcaggcagtggaactccgcggacaggccgcttggcaggatggccttgtgccatatcaggaacggctgttagcggaataccagcggtcgtcttcagaggtgctcgtgctggccgagaccctggacggtgtaagggtaacctgcaaccagcctctgatgtaccaggcgcaggagaggaagacccagtatagttggacttttgccgtacatagtgaggaaccccttttgcacgtagctctgttaaaacaggaacccggtgctgatttctctctagtagccccagggctccctcctggcagactgtatgccaggggggagagatttcgggttccctcaagcaccgcagatttccaagtcggagtccgggttcaggccgcatctttcggcacctttgagcagtgggtggtgttcgatttcggacgcaggcccgtgctgctgcagaaacttggactgcagcttggccaaggcagaagacccggtccctgtcggaacctggcactcggccacccagaggaaatggaaaggtggcacactggaaacagacatgttgttcctggagtggaaaggacagcggagcagacagcgctcatggccaaatataagggcccagcacttgcgctggagttcaataggtcatcagtcgctagtgggccaatctctccaaccaattatcgtcagaggatgcatcagttcttgtacgaggaagaggccgctcaacaacagctggtcgcaaagctgacactcagaggtcaggtgttcttgaagaccgctctgcaaaccccggcactgaacatgctgtttgccccaccgggagctctctatgctgaagttccggtcccatccagccttatgcctgacacagatcaagggttcttgctaggaagggccgtcagtaccgctctagtggcacctgtaccggctcctgacaataccgtgttcgaggttcggttggagagacgtgcctccagcgagcaggccctttggctcctactccccgctagatgctgtctagcactgggactgcagccagaggcaagacttgtgcttgaagtgcaatttcaaatcgatcccatgacattccgactgtggcaccaagcagttgatacccttccggaagaacagttggtggtacctgacctccccacatgtgctttgcccaggccttggtccgtaccacctcttcgcagaggtaacaggaagcaggaactcgctgtggccctgatcgctgggtgggggcctggagatggccgaagagtgcccccactcttaatatatggtcccttcggcaccggaaaaacgtacaccctggccatggccagtctcgaggttataagacgtccagaaaccaaagtgctaatctgcacccacactaactctgcagccgatatctatattagggaatacttccacagtcacgtgagcggtgggcatcccgaggctacccctttaagagtcatgtacacagaccgtccgctgtcccagactgatcccgtaaccttacaatactgctgtctcaccgacgacagacaggcttttaggccaccaacccgtgccgaactggcacgccatcgcgtggtagtaacgactacaagccaggccagagagctgagagtgcccgtgggctttttttcccacatcctcatcgacgaagcagcccagatgctcgaatgcgaagctctgactccccttgcgtacgcctcccatggcacccgccttgttctagcgggtgaccatatgcaggtgacacccagactcttctctgtggcaagagcacgcgctgcggagcatacactgttacacaggttgttcctgtgctaccagcaggagactcacgaagtggctcgccagagccggctggtatttcacgaaaattatagatgtacagacgccatcgtttcttttatttctagacacttttacgtggccaaagggaaccccatccacgccagagggaaggtcccccctcatccgaggcactatcctctgatgttttgtcatgtggcgggtagccctgacagggacatgagtatggcgtcatggcttaacctagccgagattgcgcaggtcgtcgagaaggtgcaggaagcctataacacttggccatcgtgttgggggggtagagagcagaggtgcatttgtgtcgtaagccacggggctcaggtgagcgctctcaggcaggagctgcgacgcagagatttggggcaggtgagtgtgggcagctttgaaatccttcccggacgccaattcagggtggttgtgctgtccacagtccatacctgtcagagcttactgtccccaggggctcttgcacctgagttctttactgatgcacgggtgctgaacaccgtgctcactagagcccagtcccaactggtggtagtcggggatgctgtggccttatgctccttcggagcctgtggcaagctctgggagagtttcattcgagaatgtgttgagaggcacagcgtgtgtccagagggattgtctatggagcaggtagaacagggcgtggcccagagacggagatggccgccacggggtactcaggcgggtgcagcaggaaactgggaagccgctccggaacccgtgggcgatctggccgaagagcaagcagctgttgtcactgctatggtaaaagcggagcccggagacgaagctttaagcccagccagtcgggatattaccgccacaactgcccaaacagaggcggcagcagcgccagcaggggacgccgtgaaggaagacgtggtgccaggagcttgtgccgcaggcgctgccgctgccgctggcgtggaatctacagaggcagaagatgccgaggcagatttctggccctgggatggtgaactcaatgccgacgacgctattctgcgggagctgctcgacgagtctcagaaagtaatggttaccgtaggtgaggacggtttgctcgacacagtggctcggccagaatctctgcagcaggcccgactctatgagaatcttccacccgctgcccttcggaagctgctgcatgccgaacccgaacggtacagacactgctccttcgtacctgagactttcgagagagcaagcgccatcccacttgatgatgccagttccggtcctatccaggtgcggggacggttggattgcggtatggctttcgctggagatgaagttctcgtccaacttttgagcggcgacaaagctcctgagggtaggctgcggggacgcgttctgggagtgctgaaaagaaaacgccatgagctggcctttgtctgtagaatggatacttgggatccgaggatcatggttcccattaatgggtccgttacaaaaatcttcgttgcagagcttaaagatccaagtcaagtgccaatttactctcttaggaagggacggcttcagcgtgtggggttggaacggctgaccgccgaggccagacattccaggctgttctgggtgcagattgtactttggcgacaagggttttactatcctctggggattgttcgggaggtgctccccgaggccagtacatgggagcaagggctcagaattttaggtctcgagtactctctgcgggtgcctcccagtgaccaagccactatcacaaaggtgcttcaaaaataccacaccgaattgggtagggtcgctggcaggcgggaggattgcagagccttccttacgtttactgtggacccccaaggggcatgcaatttagacgatgcattgagtgtaagggatctagggccacgatgcgaggttgctgtgcacatcacagatgtggcttctttcgtcccgagggacggggtcctggatgtggaggccaggcggcagggagccgctttctacgctcccggtagagagccggtgcctatgctgccagcatctctgtgtcaggacgttctaagtctgctccccggacgggaccggctggcaattagtctattcctgactatggaaaaagcctctggacagctgaaatctttaagattcgccccatcagtcgtccaatcagacagacagctgagctatgaagaggctgaggaggtgatcagacagcaccctggcgctgggagagagttaccagccaggctggactccgttgacgcttgtgtggtggctgcttgctatttttcacggctattgcggagacacagactgcgcagcgattgtttctatgagcagcctgacgaggatggcacccttggattccgcgctgcccatataatggtgaaagaatacatgatacagtttaaccggctggtggccgagtttcttgtcggatcagagtgcacgaggactgtaacaccactgagatggcagcccgctcctcggagccagcagctgaaggctctgtgcgagaagcacggtgacagggtgccgttgtctttacacctcggacatcacctgcatgggggaggtggttcaccacccgacactaggctgcatcttctggccagcctttggaaacaggtacagttcgcggcacgcacccaggattacgagcagatggtcgacctagtcacgacagacgatatgcaccccttcctcgcgccagcagggcgagacctgagaaaggcgctggaaaggagcgctttcggcaggtgcgcacgcggacatcagcagcaaggcggacattattccctgcaggtcgactggtacacttgggccacaagccccatcaggcgatatctagacgtcgtgttgcaaagacagatcctgctcgccttggggcatggcggtagtgcctacagtgccagagatatagatggcctatgtcaggcattctctctgcagcatgcacttgcccaaagctatcagcgcagagccagaagtctgcaccttgccgtccaactcaaagcgcaacccttagataaactgggcttcgtggtggatgtggaggcaggctccaggtgcttcaggttacttttcccttccaaccgagagacgcttcccgacccatgccccgttccatatgggagccttcagctcgccgaacatccccacgccctggccggtagacccggtctaagattgctgtggcgtagacgagtttacagtgcacaaggatcgagtcccccactgcccttaccaggcactgttccagacccacatactctggcagtcgagactgctctgtggaagcagctgctggaattagtggaattacaaagatggcctgaagcggctgcccttatccaggaaaagggcgaggcctcacaacgccgtgaattggtccaggtacagaggtcccactgtggtcactttctggaggtggcaagggaactgggttctggagataccctgcaggtccaactcggaaccagcttacagcacggcttcctggtgccaagtcctcaactgtggaccgtggcaccgggattctctctgtgccttgaacatgtggaacggccaggggattgcttttccggacgcgtgtaccgcgctcctcgcgatcgatatcgggatgtggacgaatacgcctgcgtgtgggagcccttttgtgctctggagtcagctacaggcgctgtggccgagaacgactcagttacactccagcacttatcagtgagctgggaagctagtcggacccctcaggggcaactgcagggggcattcagactggaggcagcctttctggaggagaactgtgccgatattaacttctcctgttgctacctttgtattcggctcgagggtctgcctgccccaacagcttcacccagacctggcccatctagccttggacccggtttgaatgtggatcccggaacttacacgtgggtggcccacggccagactcaggattgggatcaggagcgcagagcagacagacaagaagcaccccgacgggtgcacctctttgtgcaccacatgggaatggaaaaggtgccagaagaggtcctcagaccaggcaccttatttacagttgaactcttgcctaagcagcttcccgacttacggaaagaggaagctgtccgcggactggaggaggcgagtcccttggtgaccagtattgcactgggacgtccagtgccccagcctctgtgtagggtgatacctagtaggtttctagaacgccagacatacaacattcccggtggaaggcataagcttaacccctcacaaaatgtggccgtccgtgaagctttggaaaaaccatttaccgtgattcaggggccaccaggaacgggaaagaccatcgtgggcttacatatagtgttttggtttcacaagtccaaccaagagcaagtccagcccggtggaccaccgagaggcgaaaaacgtctgggcggaccatgtatactgtattgcggcccaagtaataaaagcgtggacgtgttggccggacttctgctccgacgcatggaactcaagccacttagagtttattctgagcaggctgaggcctccgagtttccggtgcccagagtagggagcaggaaacttcttcgtaaatcaccacgagaaggacgccctaaccagtcactgcggagcatcacattacatcaccgaataagacaggctcccaatccttacagtagtgagattaaggcgttcgataccagattgcagagaggtgagctatttagtagggaggatctggtgtggtataagaaagttttatgggaggctcggaaatttgagctggatcgacacgaagttatcctgtgcacatgttcttgtgccgcaagcgccagccttaagatccttgacgtcaggcagatcctggtagacgaggccggaatggcaactgagccagaaacccttatccctctggtgcagtttccacaggcggaaaaggtggtcctgttaggggatcataagcaactgagacctgttgtgaaaaatgagcgcctccagaatctgggattggataggtctttattcgagaggtaccatgaagatgcccatatgctggatactcagtatagaatgcacgaggggatttgtgccttccccagtgttgctttctacaagagcaaacttaagacatggcaaggtttgagacgacctcctagtgtgctggggcatgcaggaaaggagagctgtcctgtgatcttcggtcatgtgcagggccatgaacgaagtcttctggtaagtactgacgaagggaatgagaattccaaagcgaacctggaggaagtggctgaagtcgtgagaatcaccaaacagctgaccctgggacgaacagtagagccgcaggatatagcggtgctgactccttataacgctcaggcctctgagatctctaaggcactaagaagagagggcatcgccggagttgccgtcagttcaattactaaaagccaggggtccgagtggcgctacgtgcttgtcagtactgtccgtacttgtgccaagtccgacctggatcagcgccctaccaagagctggctgaagaaattcctggggttcgtcgtcgaccctaatcaggtcaacgttgctgtgactcgagcccaggagggactgtgcctgatcggtgaccacctgctccttcggtgttgccctctatggcggtcacttcttgatttttgtgaggcacagcagaccttggtgccagctggccaggtcagagtgtgcagacggccaacaatgccctccta

SEQ ID NO: 23798 - DNA, 4995 bp, Artificial Sequence
  Description of Artificial Sequence: Synthetic coding sequence
atggccgcacgaaggggaagacgggatggagtagcgcctcccccatctgggggtccaggacccgatcccggaggcggagcacgaggcagcggctggggtagtcgctcacaggctccatacggtacgctcggggcagtgtccggcggagaacaggtgttacttcacgaggaagcaggagatagcggcttcgtgtccctctctcgcctaggtccaagcctaagagacaaagacctggagatggaagaactgatgctgcaggatgagaccttacttggcactatgcagtcctacatggacgcatcactcatcagccttatcgaggactttggtagcttgggagaatcgagactatctctcgaggaccagaacgaggtgagtcttctcactgccttgactgaaattcttgataatgcagactccgaaaacctgagccctttcgatagcattcctgattccgagctgctggtcagcccaagggaaggctcttccctgcataagctcctcacactgagccgaacgcctcccgagcgcgatctaattaccccggtggaccccctgggtccctctaccggctcctcccgtgggtcgggagtggagatgagcttgcctgaccctagttgggacttcagtccaccttctttcctcgagacctcctccccgaagttgcccagttggcggcctccaagatcccgcccacgctgggggcagagtccgcctccacagcaaaggtcagatggcgaagaggaggaggaggtggcctcgttttcggggcagattctggctggggaactcgataattgcgtgtcctctatccccgattttcccatgcatttggcctgcccagaagaagaggataaagctacagccgctgaaatggccgttccagctgctggcgatgagtccatctcctccctgtcagagttggtcagggcaatgcatccttactgcctccccaatcttactcacctcgccagcttagaagatgaacttcaggaacagccggacgatctcactttgcctgagggatgcgtggttctggagatcgtggggcaggctgcaactgctggcgacgatcttgagatccctgtcgtggtgcggcaagtttcaccgggtccacgcccagtcctgctggacgatagcttggaaacgtcaagcgctctccagcttctaatgcctaccctggagagcgaaacagaagctgccgtgcccaaggttactctgtgcagcgagaaggaaggcctgtcactgaactctgaggagaagctcgacagtgcctgcctcctaaagcctagagaagtggtcgagccggtagtaccgaaagagccccagaatccaccagccaacgccgctcccggtagccagcgcgcacgtaagggccgtaaaaaaaagagtaaggagcaacctgcagcgtgtgtggaaggttacgccaggaggctccggtcatcatcccggggtcagtcgaccgtcgggacagaggtcactagccaggttgacaacctacagaaacagccacaggaggaactgcagaaagaatctgggccattgcagggtaaaggcaaacccagagcctgggctcgcgcttgggcagccgcactcgagaattctagccctaagaaccttgagcggagcgcagggcaatccagtcctgcaaaggagggacccctggatctctaccccaagctggcagataccattcagacaaaccccatacctacccacctctcccttgtcgattctgctcaagcgtcccccatgccagttgattcagtggaggcggatccaaccgccgtaggcccagtattggccggacctgtgcctgtcgacccaggtctggtggacctggcaagtactagttccgagctggtcgaacctctccccgcagagcccgtgctgatcaatcccgtgctagccgattctgccgctgttgatccagctgtggtgcctatcagtgacaatctccccccagtcgacgctgtcccatcaggtcccgctcctgttgacttggccctagtggaccccgtgccgaacgatctgacccctgtagatccagtgctcgtgaagtctaggcctaccgatccgagacggggtgcagtgagttctgccctaggcggatcagccccacagctgctggtcgaatcagaaagccttgaccctcctaagaccataattccagaggtaaaagaagtggttgatagcctgaagatcgagagcggaacttctgcaacaacacatgaggcaagacctagaccgctgagtctctccgagtatcgccgaaggagacaacagaggcaagcagagactgaggaaagaagccctcagccgccaactggcaagtggccatcactgccggagacaccaacaggactcgccgacattccctgtctcgtcatcccacccgcacccgcaaaaaagaccgcactgcagcggagtcccgagactccactggagatttgtctcgtgccggtcggtccctcacctgccagcccctcccccgaacctccagtcagtaagccggtcgccagcagtcccacagaacaggtgccttctcaggaaatgccactgcttgcaaggccctctcctcccgtgcagtctgtgtccccggcagtaccgactcccccttccatgagcgctgccttgcccttccccgcaggaggtctcggcatgcctccatcattgcctccacctccgttgcagcccccttctttaccactgtcaatgggtcctgtgctgcccgacccgttcacacactatgctccactcccatcttggccatgctatcctcatgtatcaccaagtggttacccttgccttccaccgcctcctactgtcccactggtgagcgggactcctggagcctatgcggttccacctacttgtagtgtaccgtgggccccaccgccagcacccgtttctccatactcttccacatgtacatacgggcctctgggttggggccctggcccacagcatgctcctttctggtccacggtgcctcctccccctctgcctccagctagcattggaagagccgtcccgcagcctaaaatggagtctcggggaacccctgccggtcctcctgagaatgtgctccctttatcaatggctcctcctttgagcctggggttacccggtcatggggcaccacagaccgaaccaacaaaagtcgaagtcaaacccgtgcccgcaagtccacaccctaagcataaggtaagtgccctggtgcagagccctcaaatgaaggccttagcatgcgtatccgctgagggggtgacagtggaagagcccgcttctgaacgactgaaacccgagacccaggaaacgcgcccacgagaaaagcctccattgccagccacaaaggcagttcctacacccagacagtcaacagtccctaaactcccggcagtccatcccgcacgcctccggaaacttagcttccttccgacccctcgcactcagggttcagaggatgtagtccaggcatttattagtgagatagggatcgaggcttccgacctatcatccctgctggagcagttcgagaagtccgaagccaaaaaagagtgccctccgccagctccagcggactccttagcagtgggcaattccggtggggtggatatacctcaggaaaaaagacctctcgaccggctgcaagcacccgaactagctaacgtcgcaggacttacccctcctgccaccccgcctcaccagctgtggaagcctcttgccgcagtctcactgttagctaaagcgaaatcacctaagagcacagctcaggaaggcacactgaaacctgagggggtaactgaggccaagcacccggcagccgttcgccttcaggaaggagtccatggacccagtagggtccacgtgggaagcggcgaccatgactactgtgtgcgctcccgcaccccacccaaaaaaatgcctgccttagttataccagaggtggggtctagatggaatgtcaagaggcatcaggatataacaattaagccagtcctctctctagggccagccgctcccccacccccatgcatcgccgctagcagggagcctttggatcaccgtacctcatcagagcaagctgatcccagcgctccatgcctggcccctagcagtctcctcagccccgaggcctcaccctgccggaacgacatgaatacgaggacgccccctgagcccagcgcaaagcagcgctccatgagatgttaccgaaaagcctgcagatctgcttctccttcgagccagggctggcaaggcagacgaggcaggaactcaagaagtgtaagctctggaagcaaccgtactagcgaagcctcaagctctagctccagttccagctcctcaagtcgctcaagatccagaagcctgtccccacctcacaaaagatggcggagatcctcttgtagttcctccggccgttctaggcgttgttcctcgtcctccagctccagttcaagcagtagctcttctagctcatcttcttctagtagcaggagccggtctaggagtcccagtccgcgtaggaggtctgaccgaagaagacgatatagctcttacagatcccacgatcattaccagcggcaaagagtgttgcagaaagagcgcgcaatcgaggagcggagagttgtgtttataggtaagatcccagggagaatgacccgcagtgaactgaaacaacgcttctctgttttcggagaaattgaggagtgcactatccatttcagagtgcaaggagacaactatgggttcgtgacataccgctacgccgaagaagctttcgctgccatcgaatccggccataagcttcgccaggctgacgagcagcccttcgacctgtgcttcggcggacgacgacaattttgcaaaaggtcttactctgacctggatagtaatcgcgaggacttcgatcccgcacccgtgaagagtaagtttgattcccttgacttcgacacgctgcttaagcaggctcagaaaaatctccgcagatag

SEQ ID NO: 23799 - DNA, 4203 bp, Artificial Sequence
  Description of Artificial Sequence: Synthetic coding sequence
atggcagccagacgcggacggcgagacggtgtggcccctccccctagcgggggacccggaccagatcccggagggggagctcgaggaagcgggtggggcagtcgctcacaggctccctacggaacacttggagcagtgagtggaggggagcaggtcttgcttcatgaggaggccggagacagtggattcgtgtctttgtctaggctgggcccttcactacgcgacaaagacctggagatggaagaactcatgcttcaggacgaaacgctgttaggtacaatgcaatcttatatggacgctagtttgatctccttgattgaggactttggctcactaggagaaagcagactgtcactcgaagaccagaacgaggtctcgttattaaccgcactcactgagatactggataacgccgacagcgagaatcttagtcctttcgatagtatacccgactccgaactgctcgtgagtccccgagaagggtcgagcctccacaagctgcttaccctgagcaggactcctccagaaagagatcttataacacccgtagacccgctgggcccttcaactggcagttcccggggtagtggagtagaaatgagtctgcccgacccatcgtgggacttctccccaccttcttttttggagacctcctcccctaaattgcccagctggcgccctcccagaagtcgtccacgttgggggcagtcgccccctccccaacagcgctctgatggtgaagaagaagaggaagtagctagctttagcggacaaattcttgccggagaactggacaactgcgtgtcctccattcctgatttcccgatgcatttggcatgccctgaggaagaggacaaggctaccgcagctgagatggctgtcccagctgcaggcgatgaaagcatttcgtctttgagtgaattggtgcgggcaatgcacccttattgcttaccaaatctgacccacctggcctctctggaggacgaactgcaagagcagcctgacgatctaaccttgcctgaaggctgcgtggtgctggaaatcgttggccaggctgccaccgccggagatgacctcgagatccctgtggtggtaagacaagtgagtccgggaccacgccctgtgctcctggatgacagtctggagacctcatccgctctgcagttgcttatgccaaccctcgaatccgaaacagaagcagctgttcccaaagtaaccttgtgctcggagaaggaaggtctgagtctgaacagcgaagagaaactagactccgcgtgcttgctgaaacctcgagaggtagtcgagccagtggttcccaaagagccccagaatccccctgcgaatgcggctccgggatctcagagggcaaggaaaggcagaaagaaaaaatccaaggagcaacccgcagcatgtgtagaaggctacgcgcgtcgcctccggtcctccagtagaggccagtcaaccgtcgggacagaggtcacctcacaggtggacaatctacaaaagcagccccaggaggaactgcagaaggaaagcgggcctctccagggcaaaggcaaaccgagggcttgggcacgcgcttgggccgcagccttggagaactctagccccaagaatttggagcggtccgccggacagtcttctcctgctaaagagggtcctctggatctgtaccctaaattggctgataccattcagacaaatccaataccaacccatctgtctttagttgacagcgcacaggcctccccaatgccagtggatagcgtggaggcggaccctaccgccgtcggaccagtcctggcaggcccagttccagttgaccctggcctggtcgaccttgcatcgacttcaagcgagttagtggagcccttgcccgcagaacctgtactcatcaaccccgtcctcgctgattctgccgcagtggaccctgctgtggtgcccatctccgacaatttaccacctgtcgacgccgtgccaagtggccctgcaccagtcgatttagcactcgtggaccccgtgcctaatgatctcactccagttgatcctgtcctggtgaaatcaaggcccaccgatcccaggcggggagccgtatcaagtgcgctcggagggagcgcccctcaattgctcgtggaaagcgagtctttggacccaccgaaaaccatcattcctgaagtgaaagaggtggttgattccctgaaaatcgaaagcgggacatccgcaacaacacatgaagccaggccacgccctctgagcctgagcgaatatcgtaggcgccgacagcagcgtcaggctgaaaccgaagaacgatctccccaaccccctactggaaaatggccaagcctgcctgagactccaacgggcttggctgatattccctgcttggtcatccctcccgcacctgccaagaaaacagccctacagaggtcccctgaaactcccctggagatctgtctggtgccagtgggtccctcaccagcctcgccatctcctgagcccccagtgagcaaacccgtcgcgtcctcacctacagaacaggtcccgagccaggagatgccccttttagccagacccagccccccagtccaatctgtgagtcctgcggtgcccacacccccatctatgtccgcagcactgccttttcctgccggaggactgggcatgcccccttccctgcctcctccccctctacaaccgccaagcctgcctctgtcaatgggccctgttctgccggatccttttacacactacgcacccctgcctagctggccttgctatcctcacgtatccccatctgggtatccgtgcctaccacccccacccaccgttcccttggtgtccggaacacccggtgcctacgctgtgccacccacttgtagcgttccctgggcccctcctcccgcacccgtgtctccatattcttcgacgtgcacgtacgggccattgggctggggacccggtccccaacacgccccattctggtcaaccgtcccccctccgcctctcccccctgcaagcattgggcgagctgtgccacagccaaagatggaatcacgcggtactcccgctggacctccagagaacgtcctccccctgtctatggcccctcccctcagcctaggactccctggacacggcgctccacagaccgagcctaccaaagtggaggttaagcctgtacccgctagccctcacccaaaacacaaggtgtcagccctcgtgcaaagccctcagatgaaggcattggcctgtgtgtcagcagaaggggtgactgtcgaggaaccggcttccgagaggcttaaacctgaaactcaggagactcgccctcgggaaaaaccccctctcccagcgactaaggctgtgcctacaccaagacagtccacggtaccaaaactgcccgcagtgcacccggctcgcctgcggaagctgagctttttacccacccccagaactcagggtagcgaggatgtggtgcaggcctttatctccgaaattggtattgaagcctccgacctgtcatcgctgttggagcagttcgaaaagagcgaagctaagaaagaatgccctcctcccgcaccagcggacagcctcgccgtggggaactccggcagcagctgttcctccagcggacggagcagaagatgtagctcgtcttcatcttcttcaagttctagtagtagcagctctagtagctcatccagctctaggtctcgctcacgctccccctcccccaggagacgctccgaccgaaggcgcagatactcctcatatcgctcccatgaccattaccagaggcagagagtgctgcagaaggagagggcaatcgaagaaaggcgagtggtgtttatcggtaaaatcccgggaagaatgacccgcagcgagctgaagcagcggttcagcgtgtttggagaaatagaagaatgtactattcatttccgggttcaaggagataactacgggtttgtgacctaccgctacgccgaggaggcctttgcagcgattgagagtggccacaaattaaggcaggcagacgagcagcccttcgacctgtgcttcgggggacgcagacagttctgtaaaaggagctactcagacttagactctaaccgcgaggacttcgatcctgcgccagtcaaatccaaattcgacagccttgactttgacaccctgctcaagcaagcccagaagaatttgcgcagatag

SEQ ID NO: 23800 - DNA, 537 bp, Artificial Sequence
  Description of Artificial Sequence: Synthetic coding sequence
atggccgatggcaaggccggagatgagaagccagagaagtctcagcgggcaggcgctgccggagggccagaggaggaggcggagaaacctgtgaaaacaaagactgtgagttcaagtaatgggggagagtcaagtagccgttccgcggagaaacgttctgcagaagaagaagccgctgaccttccaaccaaaccaacaaagatttctaagttcggattcgccattggctcccagactaccaagaaggcgtccgcgattagcattaaacttggctctagcaagccaaaagaaaccgtccccaccttggccccaaagactttgtctgtggctgcagcctttaatgaagacgaggactctgagcccgaagaaatgcctcccgaggccaagatgcgcatgaagaacatcggtcgagacacccctactagcgctgggcctaacagcttcaacaagggaaagcatggatttagtgacaaccagaagttgtgggagcgcaatattaagtcacacctcggtaatgtgcatgaccaggataattag

SEQ ID NO: 23801 - DNA, 4950 bp, Artificial Sequence
  Description of Artificial Sequence: Synthetic coding sequence
atggatgacgattcactggacgagctcgtggccaggtcgccaggtcctgacggccacccacaggttggtccagctgaccccgctggagacttcgaagaaagcagcgtgggctcctctggcgacagcggtgacgacagtgactctgaacatggggatggcacagatggggaggacgagggcgcatccgaagaggaagacctcgaggaccgttcaggatctgaggattccgaggatgatggagagacactactcgaggtggccggtacacaggggaagctcgaggctgcagggtcttttaatagtgatgacgatgccgaaagctgccctatctgcttaaatgccttccgcgatcaggccgtcggcacgcccgaaaattgcgcccactatttctgtctggactgcattgtcgagtggagcaaaaacgcaaacagttgtccagtggatcgcacactttttaaatgtatctgtatacgggcacagttcgggggtaagatccttaggaagatccccgttgaaaatacaaaagcctctgaggaagaggaggatcctacattctgtgaggtgtgtggccgaagcgatcgggaagatcggttgctgctgtgtgacggctgcgacgccggataccacatggaatgtctagatccaccgctgcaggaggtacccgtggacgaatggttctgtcccgaatgtgctgcccctggcgtagtgctggccgcagacgccggaccagtgagcgaggaggaggtcagcttactgttggccgacgtcgttccaacaacatcgcggctgaggccgagagctggacgcacccgcgctatagccaggacccggcagtctgagcgggtgagagccacagttaatagaaacagaatatccaccgcgagacgagttcagcacacccccggtcggctgggttccagcttgctcgacgaagccatcgaggccgtggcgactgggctttccacagctgtataccagagaccacttacaccccgaactcccgcaaggcgaaagcggaaaacacggagacgaaagaaggtgcccggacggaagaaaactccctcaggaccgtccgctaaatcgaagtccagtgctacgagaagtaaaaagcgccaacatagggtcaaaaaacgcagaggaaaaaaagtcaaatccgaagctacaactcgcagcagaattgcgagaaccttggggctgcgcaggccagttcattcatcctgtataccctcggtgctgaaaccagttgagccgtccttgggcctgctgcgcgcagatatcggggctgcctctctgtcgttatttggtgacccgtatgagcttgatccattcgatagcagtgaagaattgtcagctaacccgctgagccctctgagcgccaaacgcagggcgttgtcacggtctgcactccagtctcatcaacctgtcgcacgcccagtcagcgtcggactaagtaggcgccgtcttcccgctgccgtacctgaacccgacctggaggaagagcctgtcccagatctcttgggatcaatcctcagtgggcagagcctcctgatgttggggtcttccgacgttattatccaccgtgacggaagccttagcgctaagcgggctgcacccgtatcattccagcggaattctgggtccctttcacgcggagaagaggggttcaagggctgtctgcagcccagggcgctcccctccggttctccggctcagggcccatctggcaatcgcccacagtcaacaggcttaagctgtcaaggccgtagcaggacacccgcacgcaccgcgggtgcccctgtaaggttagacctgcctgcagcccctggggctgtacaggctcgcaacctgtcaaacggtagcgtgccgggattcagacagagccactctccctggtttaatggcaccaataagcacactcttccactcgcttctgccgcatctaagatctcatctcgggacagcaagcccccttgtaggtcagtggtgcccggacccccacttaagcctgcccctcggaggacagacatctctgaacttccaaggatccccaagatccggagagatgatggcggaggacggcgtgacgccgcacccgctcacggacagagcattgagatcccctccgcatgtatcagtcggctgactggcagagagggaacagggcaacccggaagaggcaccagagccgaatccgaggcttccagcagagtccccagagagccgggtgtacatactggttcttctagaccgccagctccaagttcccacggaagcttggctccactggggcctagtcgtggcaagggggtgggcagtacatttgagtctttccgtattaatatcccaggcaatatggctcattcgtcacagttgtcgagcccaggattctgtaacaccttccggccagtcgatgacaaagaacagagaaaggagaatccaagtcctttgttctctataaagaagaccaaacagctgaggtctgaggtatatgacccctcagatccgacgggttccgactctagtgctccgggatcaagtccggagcggagcgggcctggcctactaccttcggaaattacccgtaccatctctatcaatagtccaaaggcacaaacagtccaagcagtgcggtgcgttacttcatataccgtggagagcatttttggaaccgagcccgagccaccactgggtcccagtagcgcgatgagcaaacttcgcggagccgtggctgctgagggagcctcggacactgaacgcgaagagccgacagaaagccagggtctggccgctagactacggagaccttcgcctccggagccctgggacgaagaagacggtgcctcatgctccactttttttggcagcgaagagagaacggtaacatgtgttactgtggttgagccagaagctcccccttcccccgacgtgctgcaggccgctacacacagggtcgtggaactgcggcctcctagccggtcacgctcaacctcttcctcaaggtctaggaaaaaagccaagcgtaaacgcgtctcccgcgagcatggtaggactcgcagcggaacgcggagtgagagcagagacaggtcctcaagaagcgctagtccctctgtgggcgaggaacgccctcgtaggcagaggtccaaggctaaatctcgtagatcttcttccgatagaagctcttcccgggagagagctaagcgaaagaaggcaaaagacaagtcccgggagcacaggagaggtccctggggccactctaggaggacttctcgatcacggtcgggaagcccagggtccagctcttatgagcattatgagagcaggaagaaaaaaaagcgaaggtctgcctctcgacccagggggagggagtgctcgccaacgagctccctggagcgcctgtgtcggcacaaacaccagagggaacggagtcacgaacggcctgatcgtaaggaatctgttgcatggcccagggatagaagaaaacgccgatccagatccccatcaagtgagcaccgagccagggaacatcgtcggcctcggagtagggaaaagtggccccagacgcgcagccactcccctgagcgaaaaggcgctgtgcgtgaggcctctcccgctcctcttgcccaaggagaacccggacgagaggacctccccaccagactacctgctcttggggaggctcatgtctcccctgaagtggcaacagcagacaaggcgccactccaggcccctccagtgctcgaggtggccgctgagtgtgaaccagacgatctagatctggactatggggactccgttgaagctggtcatgtgttcgatgatttctcgagcgacgccgtgttcatccagcttgacgacatgtctagcccaccctcacctgaatctaccgatagcagccccgaaagagacttccccttgaaacccgctctgcccccagccagtctagccgtggcggctattcaaagggaggtcagcctgatgcacgatgaggacccatcgcaaccgccaccgctacccgagggcacacaggagccacacctgctcagacccgatgccgcagagaaggctgaagccccaagctcacccgatgtggcacccgcaggtaaagaagattcaccttccgcatcaggaagggtacaggaggcagccagacccgaggaggtggtgtctcagactcctctgctgcgatctcgggcacttgtgaagcgggtaacatggaacctgcaggagtccgagtccagtgctccagcagaggaccgggcaccgcgagctcctctccatcgtccgcaaaagccgcgagagggagcttgggacatggaagatgtggcaccaacaggggtcagacaggtgttttccgagttgcccttcccgtcccacgttctccctgagcccggattccctgacactgatcctagccaggtttactctccagggctccctccggcacctgcccagcctagctctattcccccatgtgcgttagtaagccagcctactgttcagttcatactgcagggcagccttcctctggtgggttgtggcgctgcacaaacattggccccagttccagctgcactcacaccggcaagtgaaccagcaagtcaggcgacagcagcaagcaacagcgaggaaaaaacaccagcaccaaggctggccgctgagaaaacgaaaaaagaggagtacatgaagaaacttcacatgcaggaacgcgcagtcgaggaagtgaagctggccataaaacctttctaccagaaacgcgaggtgacgaaggaggaatataaggatattctacgcaaggccgtgcaaaagatctgtcattctaagagtggggagattaatcccgttaaggtggctaacttggtgaaggcatacgtagataaataccgccatatgcggaggcataaaaaacctgaagctggagaggagcctcccacacaaggagcagaaggttag

SEQ ID NO: 23802 - DNA, 4947 bp, Artificial Sequence
  Description of Artificial Sequence: Synthetic coding sequence
atggacgacgactctctcgacgagctggtggcacgaagtcctggcccagatgggcatccccaagtgggacctgctgacccagctggtgatttcgaggaatcgagtgtcggatccagcggcgacagcggcgacgacagtgattctgagcacggcgacgggacagacggcgaggatgagggtgcttccgaggaggaagatctggaagacagaagcggcagcgaggactccgaagacgacggagaaacacttctggaagtggcgggaacccagggtaagctggaggctgcagggagtttcaacagcgatgatgacgcggaatcatgcccaatttgcctgaatgccttcagagaccaagctgtcggaacacctgagaattgcgctcattatttttgcctggattgtattgtggagtggtcaaaaaacgccaactcctgccctgttgacaggaccttgtttaaatgtatatgcatcagggcacagttcgggggaaaaatactgcgcaaaattccggtcgaaaacactaaggctagtgaggaggaagaggatcccaccttctgtgaagtgtgcggtaggtcggaccgagaggatcgcctgctactgtgcgacggctgtgatgccggttatcacatggaatgcctggatccacccctccaggaggtgccagtggacgaatggttctgcccagagtgcgcggcacctggtgtcgtgctggcggcagatgccggacctgtgagtgaggaggaagtcagcctgctgctggcagatgtcgttcctactacatcccgcctccgacctagggccggaaggactcgggctatagcaagaaccagacagtctgagcgagttagggcaacggtgaaccggaacagaatctctaccgcgcgtagagtacaacacacacccggacgcctgggcagttccctgctggacgaagccatcgaggccgttgcgactgggctgtccaccgcagtttatcagcgccctttgacccccagaacgcccgcaagaaggaaacgaaagactagacggcgaaagaaggtccccggtaggaagaaaacaccttcaggtccctccgcaaagagtaagagtagtgctacccgctccaaaaaaagacagcacagagtgaagaaacggcgtggaaagaaggtgaagagcgaggccacgacaaggtcacgcatcgcccgaacgctgggtctcagacgaccggtgcactcatcatgcattccatccgtccttaagcctgtggaaccgtcccttggactgcttagggcagacatcggtgccgcttccttgagcctattcggcgacccctacgagcttgatccttttgactctgaggaacttagcgctaacccattgtcgcccttgtctgcgaagcgcagggctctgagccggtccgccctacaatctcatcagcccgtggccaggccagtatccgtgggtctctctagaagacgccttcctgctgctgtacccgagcctgatttagaagaggagccagtcccagacttactggggagcatactgagtggacagtccctgttgatgctgggctcctcagatgtcatcatacatagggatgggtctctgagcgccaaacgcgctgcccctgtgagcttccagcgtaatagcggttcactgtctaggggagaggaggggttcaaaggctgtttacagcccagggccttgccatctgggtctcccgctcagggtccttctggcaatcgcccacagagtaccggcctaagttgtcagggaagatctcgcactccggctagaaccgcgggagcacctgttagactggatctgccagctgctccgggagccgttcaggcgcgtaatctttccaatggtagcgtgccgggattccgacagtcccattcaccctggtttaatggtacgaacaagcatactctgcccctcgcctccgccgctagcaagattagcagccgggactctaaacccccttgcaggtctgtcgtgcccggacctccgctaaaaccagcccctcggaggacagacattagcgagctgccacgaatccccaagatccgtcgggatgacgggggagggagacgggatgctgcacctgcacacggtcagtcaatagagatccctagcgcctgcataagccgcttgacggggagggaaggaacgggccaacccggtcgtggtacacgggctgaatcagaagccagttccagggtccctcgcgaaccaggggttcatactggttcatctaggccgccagccccatcttcacacggcagcctcgccccactgggaccctcccgcggaaagggcgtgggatcaactttcgaaagcttccgcatcaacattccaggcaatatggcccatagctcacagctcagctctcctggtttttgtaacacttttagaccagtcgatgacaaggaacagcggaaagagaatcctagcccactcttctcaatcaaaaagactaaacaacttcgctcagaggtttacgacccaagtgatcctactggatccgacagttcagcgcctgggtcttctccagaacggtccgggcctgggctgctgccaagcgagattacgcgcactatttcaatcaactcacccaaagctcagaccgtccaggccgtgcgctgtgtgacgtcctatacggtcgaatctatttttgggaccgaaccagaacctcccctgggcccatcttcagccatgagcaagttgaggggcgcagttgctgctgagggagcctccgacaccgagcgcgaggagccaaccgaatcacagggcctggctgctaggctccggcgaccttccccacccgagccttgggacgaagaggacggcgctagctgcagtaccttttttgggtctgaagagaggaccgtgacctgcgtgactgtggtggagcccgaggctcctccaagtccagatgtcttgcaggcagctacccacagagtggtggagttgcgcccaccatccagaagccggagcacgtcaagctctaggagtagaaaaaaggccaagaggaagagagtttctagagaacacggcagaactaggtctggaacacgcagcgaatccagggacagaagttctagatctgcctcccctagcgtgggcgaggaacgcccacggagacagagaagcaaagcgaaaagtcggagatcctccagtgaccgaagctcgagtagggagcgggctaaaaggaagaaagcgaaagataaaagccgcgaacataggcggggaccctgggggcacagcaggagaaccagccgtagtagatccgggagtcccggttcatcctcatatgaacactatgagtcgagaaagaagaaaaagagacgctccgccagcaggcctcgcggtcgggagtgcagtcccacctcttcacttgagagactatgccgccacaaacaccagcgggagagaagccacgagaggcctgaccgcaaagaatccgtagcatggcctcgggaccggagaaagcgtcgttctagatcccctagttctgagcatagagcccgagagcacagacggccacgcagtagggagaagtggcctcagacccggagccattcgcctgagaggaaaggagccgtccgtgaagcatcccccgcacccctggcgcagggcgagcccggacgggaggacctgcctacgagacttcctgcactcggcgaagctcatgtgagccctgaggttgccacagccgataaggcccctctgcaggcaccaccggtactggaggtagctgctgaatgtgagcctgatgatctagatctggactatggggactccgtcgaagccggacatgtcttcgacgacttctcttctgatgctgtgttcatccagctcgatgatatgagttctcctccgtcccccgaatcaaccgacagtagcccagagcgggacttccccctgaaacccgctctgcccccagcctctctcgccgtggccgctatccagagagaagtgtctctgatgcacgatgaagaccctagtcagcctcccccactgccagagggcacccaggaaccacatttactcaggcccgatgctgccgaaaaagctgaggccccatcaagccccgatgttgcgcctgctgggaaggaggattccccttcagcatcagggcgagtccaggaggcggctcgcccagaagaagtcgttagtcagactcctctcttgagaagtcgcgctctggtcaagcgagtgacatggaacctgcaggagagtgagagtagcgcccctgccgaggacagggctcccagagctccattgcatagaccacagaaacccagagagggcgcttgggacatggaggacgtcgcacctaccggcgtccgccaagtattctctgaattacctttcccctcacatgtgctgcctgaacctggcttccctgacacagacccgagtcaggtttacagccctggtctgccaccagctcccgctcagcctagctccataccgccttgcgccttggtctcccagccaaccgttcagtttatcctgcaaggcagccttcccttagtgggctgcggcgctgcacagaccttagctcccgtcccggcagctcttaccccagcttccgagcctgcgagccaagcgaccgccgcttccaatagcgaggaaaagaccccggcacctcggctggccgctgagaagaccaagaaggaagaatacatgaagaagctccatatgcaggaaagggcggtggaggaggtgaagctagccattaagccgttttaccagaagcgagaagtcaccaaagaggagtacaaagacattctgcggaaggccgtgcagaaaatatgtcattcaaaaagcggcgagataaaccctgtgaaagtggcaaacctggtcaaggcatatgtggataaataccgccatatgcgcaggcacaaaaagccagaagcaggcgaagagccacccactcaaggcgctgaggggtag

SEQ ID NO: 23803 - DNA, 2115 bp, Artificial Sequence
  Description of Artificial Sequence: Synthetic coding sequence
atgtgggagaagatggaaaccaaaactattgtttatgatcttgacactagcggcggtctgatggaacagatccaggccctcctcgcccctcctaagaccgatgaggccgagaaacggtccagaaagcccgagaaggagcctcggagaagcggacgtgctaccaatcatgactcctgcgattcctgtaaagaaggtggggaccttctctgttgcgaccactgccccgctgcgtttcacctgcagtgctgtaacccaccacttagtgaagagatgttgcctcctggtgagtggatgtgccacaggtgcaccgtgcgcaggaaaaaacgtgaacaaaaaaaggagctggggcacgtgaacggcttggtcgataagtctgggaagcgcaccaccagtccatcctctgacaccgatctgctggacaggtccgctagcaagaccgaactcaaggctatcgcacatgcccgtatactggagcgacgcgcatctaggcctggtacgcctaccagtagcgcctctactgagacccccaccagcgagcaaaatgacgtcgatgaagatatcattgatgtcgacgaggagcctgtggccgctgaacctgactacgtacagcctcagctcagacgaccttttgagctgctgattgccgcagcaatggagaggaatcccacacagttccagctgccaaacgagctgacctgcacaaccgccctgcccggttcaagtaaacggaggaggaaagaagaaaccacgggcaagaatgtcaagaagacgcaacacgaactagaccacaatgggttagtgcctttgccggtcaaggtctgttttacctgcaacagaagttgccgcgtagcaccattgatacagtgtgattattgccccctgctgttccatatggactgcttggaacctcccctaaccgccatgccactcggtcgctggatgtgtccgaatcatattgagcacgtggtcctgaaccagaaaaacatgactctctcgaaccgttgccaggtatttgatagattccaggacacggttagccaacatgtcgtgaaggttgattttttgaacagaatccataaaaaacatccgccaaacaggcgggtacttcaatcggttaagcggaggtctctgaaggtgccagatgctattaagagccagtatcagttcccacccccactgatagcccctgcagcgataagagacggcgagctgatttgcaatggcatccccgaggaatcacagatgcatttgctgaactcagagcaccttgcaacacaggccgagcagcaagaatggctctgcagtgtagtggcgctgcaatgttccattctgaagcatctctcagccaaacaaatgccaagccattgggattcagaacagaccgagaaggctgatatcaagcctgtgatcgtgaccgactctagcgtgacaacatctctgcagaccgccgacaaaaccccaaccccatcgcactaccctttgagttgtcccagcggaatcagtactcagaactccctgagctgctcaccccctcaccaatcccccgctttagaggatatcggttgctcatcatgcgcggagaagagcaagaaaacaccttgtggtactgctaacgggccagtgaataccgaggtcaaagcaaacggtccacatctgtactcttccccgacagatagtaccgatccacggagactaccaggagcaaatacgcccttacctggactgagccacagacagggctggccacggcctctgaccccaccagctgccggaggtctccagaatcatactgtaggcataatcgtaaaaacagaaaatgccacagggcctagttcttgcccccagcgtagcctggttccagttccctctttgccccctagcatccccagctcttgtgcttctatagagaataccagcactctccagagaaagaccgtgcagtcacagatcggaccacccttaacggattcgagaccccttggctctcccccaaatgctactcgagtgttgactcctccgcaggccgctggagacggcatccttgctacaacagcaaatcaacgcttcagcagtcccgcaccatcttccggtgagtgctgttccgcgctcggttag

SEQ ID NO: 23804 - DNA, 3015 bp, Artificial Sequence
  Description of Artificial Sequence: Synthetic coding sequence
atgtgggaaaagatggaaacgaaaacaatcgtttatgacttggacaccagcggcggactgatggagcagatccaggcgttgcttgcacccccaaagacagacgaggctgagaaacggagtaggaagccggagaaggaaccaagaaggagcggcagagctacaaaccacgacagctgtgactcctgtaaagagggtggtgatctactgtgttgcgatcactgccctgctgcattccacctgcaatgttgtaatcctcccctgtccgaggagatgttgcccccaggcgagtggatgtgtcatcggtgcaccgtacggagaaagaaacgggagcagaagaaagaacttggtcatgtgaacgggctcgtcgacaaatccgggaaacgtacaacttcaccgtccagcgataccgacctcctagaccggtcagcctcaaagacagaactgaaggcaattgcccacgctagaatcttggagagaagggctagcagacccggaactcctacctcaagtgcttcaaccgaaacacccacgtccgaacagaatgacgtggacgaggatatcattgacgtggacgaagagcccgtcgccgctgagcccgactacgtgcagccccaacttcgaaggccttttgagctactgattgcagccgctatggagagaaaccctacacaattccagctgcccaacgaactgacctgcacaaccgccttgcccggatcatcaaaaagacgtagaaaggaagagacaacaggtaagaatgttaaaaaaacccaacatgaactggatcacaacggcctcgtgcccctccccgtaaaggtgtgttttacgtgcaaccgaagctgcagagtggctcctctcatccagtgtgactactgcccccttctctttcacatggattgcctcgagccccctcttacggccatgcctctcggcagatggatgtgtcctaatcacatagagcacgtggtcctaaatcagaagaacatgactctcagtaatcgttgccaggtttttgacaggtttcaagataccgtatcacaacatgtcgtgaaggtggacttcctaaaccggatccacaagaagcatcctcccaatagacgggtgcttcagagcgtgaagagaaggagcctgaaagtgccagatgcaataaaatcacagtatcagttccccccacctctgatcgcaccggctgccattcgggacggtgaactgatctgtaacggaatacccgaagagagtcaaatgcaccttcttaactcagagcacctggcaacacaagccgagcagcaggagtggctgtgttcagtggtcgcactgcagtgctctatactgaaacacctgtccgccaaacagatgccctcgcattgggatagcgaacaaaccgagaaggccgatatcaagcctgtcatcgtcaccgacagttctgtgaccacatcacttcagaccgctgataagacacctacgccctcccactaccccttatcatgtccatccggtatctcaacgcagaactctctttcctgttctcctcctcatcagagcccagccctggaggatattggttgtagttcttgcgctgaaaagagcaagaagacgccttgtggcactgctaacgggcctgtaaacactgaggtgaaggctaatggtccccatctttattcatcgccaacagactctactgacccgagacgcctcccgggtgccaacacaccgctgcctggtctgtcccatcgccagggctggcctaggcctctgactccacctgcggctggaggcttacaaaaccacacagttggtatcatcgtaaagacagaaaatgcgactggtccaagtagctgtccccagagaagcctagtccccgtgccgtccctgcctcccagcattccctcttcttgtgcaagtatagagaatacttccaccctacagcggaaaaccgttcagtcgcaaatcggcccacctctgactgattccaggccccttgggtcacccccaaatgcaaccagagtgctgacgcctccccaagccgcaggtgacggtatcctggccaccaccgctaaccagaggttcagcagtcctgcgccatcttcagacggtaaagtctcgcccggaaccctatctattgggagcgccttgaccgtgccgagtttccctgccaatagtaccgcaatggtcgatttaaccaacagtttacgggcattcatggacgtgaacggagaaatcgagataaacatgttagatgaaaagctcattaagttcctcgctttacaaaggattcaccagttgtttccaagcagggtgcagcctagccctgggagcgtgggaacccaccagctagccagcggtggccatcacattgaagtgcaaaggaaggaagtgcaggcccgagcggtgttctacccactcctcggcttggggggtgcagtaaacatgtgctaccgcactctgtacatcggcactggcgctgacatggatgtttgcctgacgaactatggtcactgcaactatgtttcaggtaaacacgcatgcatattctacgacgagaatacaaagcactatgagctcttgaactacagtgaacatggcaccacagtcgataatgtgctatattcctgtgattttagtgagaagacacctcccacacccccttcttccatcgtcgcgaaagttcaaagcgtaatcagaaggaggaggcatcagaagcaggatgaggaaccaagtgaggaagctgcaatgatgtcatcgcaggcacaggggccacagcgcagaccctgtaattgtaaagcctcctcttcttctctgattggcggatctggggctggatgggaggggaccgcactattgcatcatggttcctacattaagctgggttgcctgcaatttgttttctcaatcacggagtttgccacaaaacagccaaaaggggacgcctctctgttacaggacggggtcctggctgagaagctgtccctgaagcctcaccagggccctgttttaagatcaaattctgtcccgtag

SEQ ID NO: 23805 - DNA, 2550 bp, Artificial Sequence
  Description of Artificial Sequence: Synthetic coding sequence
atgtgggagaaaatggaaaccaaaaccatagtttatgatctggacacatccggcggattgatggaacaaattcaggcacttctcgcccctcctaagaccgacgaggccgaaaaacggagcagaaagccagaaaaggagcctcgacgctcaggtagagcaactaaccacgactcgtgtgactcgtgtaaggagggtggcgatctcctctgttgcgaccattgcccagccgcattccacctcttggtttaccaggatttcgttgcccctatatctctgtttcatggcacattccatgatggccctacatgtagttttgcacaaaagagggaacagaagaaggaactcggccatgtgaacggactggttgataagtcgggaaaacgcaccacctcacccagttccgacactgatctactcgacagatcagcgagcaagaccgagttgaaggccatagcacacgctcggatcctagagcgaagggccagcaggccaggcactcctacgtctagcgcatcgacagagactccaacatccgagcaaaatgatgtggatgaggatatcatcgatgtcgacgaggagccagttgccgctgagccggattacgtgcagccgcagttgcgacggccattcgaactcctgatcgcagccgctatggagcggaaccctactcagtttcagctgcccaatgagctaacgtgcacgactgcacttcccggatcttcaaaacgacggagaaaggaggaaactaccggcaaaaatgtaaagaaaacgcagcatgagctggatcacaatggactcgtccccttgccggtcaaggtctgcttcacgtgtaatagatcctgcagagttgctcctctgatccaatgcgactattgcccccttctgttccacatggactgtcttgaacctcccttgacggcaatgcctctcgggcgttggatgtgccctaaccacatcgagcacgttgtcctcaaccagaagaatatgacgttgagcaacagatgtcaggtcttcgaccgcttccaggacactgtatctcagcacgtggtgaaagttgactttctgaacaggattcacaagaagcacccacctaaccgcagagtactgcagagcgttaaaaggcgatcactcaaagttcccgacgctataaaatcacaataccaatttcccccacctctgattgcacccgcagctattagagatggtgaactgatctgtaacggcattcccgaagagtcgcaaatgcacctgctgaattccgagcatctagctacccaggctgagcagcaggaatggctgtgctctgtggtagccctgcaatgcagcatcctcaagcacctgtccgcaaagcaaatgccgagccattgggacagtgaacagaccgaaaaggccgacatcaagcccgtcatagtgactgattccagcgtaactactagcctgcagactgcagataagacgcctaccccgagccattaccctctgtcgtgcccttccgggatctctacccagaactcgctcagttgttcgcctccacatcaatcccccgcactcgaagacattgggtgttcctcatgcgcagagaagtctaaaaagacaccctgtggaacggcgaacggccctgttaacactgaagtgaaagctaatggaccccatctttatagctcacccacagattcaacggatccccgtaggcttccaggcgcaaatactcccctgcccggactgtctcataggcaagggtggcctaggcctttaaccccccctgccgcaggcggtctgcagaatcatacggtaggaattatagtgaaaaccgagaacgccaccgggccatcatcctgccctcagcgctcgctggtgcctgtgccctcgcttccgcctagtatcccgtcctcttgtgcgtccattgaaaacacgtccactctgcaaaggaagaccgtccaaagccagattggcccaccgttgacagactccagacctcttgggtcccctccaaacgcaaccagagtgctcacaccaccccaggcagccggagacgggattctggccacaacagccaaccaacggttctcctcacccgctcccagctctgatgggaaagtgagccctgggactttgtcaatcggaagtgccctgactgtgccgtctttccccgctaatagtactgctatggtagacctcaccaactctctgcgtgccttcatggatgtgaatggcgagattgagatcaacatgcttgatgagaaactgataaagttcctcgcgcttcagaggatccatcagttattcccgtcaagagttcagccctcccccggttctgtaggcactcaccaattggcctctgggggtcaccatatcgagggagctcatgtgcacacctgccaccacattatacggtcaccattgtatgtctgtgagtggtctccctgtctgcacggagaaagcgagctacctgtgtctcagacgtctttgtgtgcctttcatggactgaacaaggcaccatggtttttcagcgaagagagccggaacaagatggccaccactgcattttag

SEQ ID NO: 23806 - DNA, 903 bp, Artificial Sequence
  Description of Artificial Sequence: Synthetic coding sequence
atggattccgattcctgtgctgccgcattccacccggaagaatacagccctagctgtaagcggcgtcggactgtagaggatttcaataagttctgcacctttgtgctcgcctacgctggctacattccatatcccaaggaagaattgcccctgcgcagttccccttctcctgccaatagcactgccggaactatcgactcggatggctgggatgcagggttctctgacattgcaagtagcgtgcccctgcctgtttccgatcggtgtttctctcatctccagcccactttgctccagcgggcaaaacccagtaactttctactggacaggaaaaagacagacaagctgaaaaaaaaaaagaaaaggaagcgcagagattccgacgcacccggaaaagagggctacagaggcggtcttctgaagctcgaagcggctgacccgtatgtggaaactccaacaagtccaaccctgcaggatatccctcaggcaccatctgatccctgcagcggatgggacagcgatacccctagctctggaagctgtgccacagtaagcccagaccaggtgaaggaaataaagacagagggcaaacgcacgatagtccggcaaggcaagcaggtggtcttcagagacgaggattccactggaaacgacgaggacattatggtggatagcgacgacgatagctgggatctggtaacttgcttctgcatgaaaccctttgcgggtcgcccaatgattgaatgtaatgagtgccatacatggattcacctgagctgtgcgaagatacgaaaatcaaacgtccctgaggtgtttgtctgccagaagtgtagggatagtaagtttgatattagacgcagtaacaggtcacgcactggcagcagaaaactgttcttggactag

SEQ ID NO: 23807 - DNA, 2373 bp, Artificial Sequence
  Description of Artificial Sequence: Synthetic coding sequence
atggaggaaaagaggcgaaaatactctatatctagcgataattctgatacaactgatagccacgccaccagtacaagcgccagtagatgtagtaagttaccaagttccacaaagtcaggttggccccgacaaaacgagaaaaagccatctgaagtgtttaggactgacctgatcacagcaatgaagattcccgatagttatcaactgagtccagacgattattatatcctcgctgacccatggcgccaggaatgggagaaaggggtgcaagtgccagcgggagcagaggcaatccccgaacctgtcgtgcgcattctgcctcctttggaagggccacctgctcaggcctcaccctcgtccactatgctgggtgagggttcgcaacctgattggcccggaggcagtaggtacgatcttgacgaaatcgacgcctactggttagaactcataaacagcgaattgaaagaaatggagcgcccagaactggacgagttgacactcgaacgggtgctcgaggaattggagacgctgtgccatcagaatatggctagggcaattgagactcaggaggggctaggtatagaatacgacgaggacgttgtatgtgatgtctgcaggagccccgaaggcgaggacgggaacgagatggtcttctgcgacaagtgtaatgtatgtgtccaccaggcgtgttacggtatactgaaggttcccaccggcagttggctctgccggacttgtgccctcggcgtgcagcctaagtgcttgctgtgccccaaacgcggtggagcattgaagccgacaagaagcgggacaaaatgggttcatgtaagctgtgccctgtggataccggaggtgtcaatcggctgccccgagaaaatggagccgattacaaagataagtcacatacctgcttcgagatgggctctgtcctgctccctctgcaaggagtgcactgggacctgtatccagtgttctatgcccagctgtgtgactgccttccacgttacctgcgcatttgaccacgggctggagatgcgaacgattctggctgataacgacgaagttaaattcaagtcattctgtcaagagcactctgatggcggtccacggaacgagccgacctccgagcctaccgagccctcccaggcaggggaagacttagaaaaggtcacacttcgcaagcaacgtctccagcagctcgaagaagacttctatgaactggttgagccagcagaggtggcggagcggctggacttagctgaagcattggtcgattttatctaccaatattggaagcttaagcgaaaagccaacgccaaccagccacttcttacacccaagaccgatgaagtggataacttggctcagcaggagcaggatgtgctgtataggcggcttaaattgttcacacacctgcgccaggatctggagagggtacggaacctttgctacatggtaactcgacgagagaggactaagcacgctatctgcaaactgcaggagcagatcttccaccttcagatgaagttaatcgagcaggatctctgccggggtctcagcacatcctttcccatcgacggaacctttttcaattcttggcttgcccaatccgtgcagataactgcggagaacatggccatgtctgaatggccgctgaataatggtcatcgagaggaccccgctcccggactgcttagcgaagagttgctgcaggacgaggagaccctgctgtccttcatgcgggatccgagtctgcgcccaggcgatcctgctagaaaggcgagaggaaggactcgacttccagccaaaaagaagccgccaccccctccaccccaagacgggccaggctcgcgcacaacccccgacaaggctccgaaaaagacctgggggcaggatgcgggaagcggcaagggcggacaggggccaccaacccgcaagccaccaagaaggacttctagtcacctcccctcctctccagccgctggcgactgccccattctggctacacctgagtccccaccacctttggctcctgagacgcctgatgaggccgctagcgtggccgctgactccgacgtgcaagtacccggacctgcggcttcccccaagcctctcggacgcctccggcctcctcgggaatcaaaagttaccaggcgacttcctggggcacggcctgacgccggtatgggaccaccctccgcggtggcggagcggcctaaagtgagtctccattttgacaccgagaccgacggatatttctcagatggagagatgagtgactctgatgtggaagcagaggacgggggagtccagcgtggacccagagaggcgggagccgaggaggtggtaaggatgggcgtcctagcatcctag

SEQ ID NO: 23808 - DNA, 2382 bp, Artificial Sequence
  Description of Artificial Sequence: Synthetic coding sequence
atggaagaaaaacgcagaaagtactcgatcagctccgataactcggatacaactgatagccacgccacctctacatccgcctctagatgtagcaaactcccctcttcaaccaagagcgggtggcccaggcagaacgaaaagaaacccagcgaggtgttccgcacagacctcattacagccatgaagatacccgatagttatcagctcagtcctgacgactactacatcctggcagatccttggcgccaggaatgggaaaaaggtgtgcaagtccccgctggcgcagaggcaattccagagccagtggtcaggattcttcctcctctggaagggcctcccgctcaggcgtcccccagctctactatgctgggagaggggagccagccagactggcctggaggatccagatacgatttggacgagattgatgcatattggctggaactcataaattctgagctgaaagagatggagaggccggaactcgacgagttgacgctggagagagtcctggaagagctcgagaccttatgccaccagaatatggctcgagccatcgaaacccaagaagggctggggatcgagtatgacgaggacgtcgtgtgtgacgtttgtcggtcgcccgaaggggaggacgggaacgaaatggttttctgcgacaagtgcaatgtatgcgtccatcaggcatgctatggtatcctgaaggtcccgacaggatcctggttgtgtcggacgtgtgccttgggcgtgcagcccaagtgcttgttgtgcccaaagagagggggagctctgaaacccacccgatccggcactaagtgggtgcacgtgagctgtgcgctgtggatcccggaggtgtccattggctgccctgaaaagatggagcctatcactaagatctctcatatccccgcatcccgatgggccctatcttgttctctgtgtaaggaatgtacaggtacgtgcatacagtgctcaatgcccagttgcgtaaccgcctttcacgttacatgcgcttttgaccatgggctcgagatgcggactattctggccgacaacgatgaagtgaagttcaaaagtttttgtcaggagcattctgatgggggtccacggaatgagcctacatcagagcccacagagcctagccaggctggcgaagatcttgaaaaagtgactctcagaaaacagcggctgcagcagcttgaggaagatttctatgagctggtggagccagccgaggtagcagagagattagatctcgctgaggccctggtagactttatttaccaatattggaagctgaagagaaaagcgaacgccaatcaacccctgctcacacctaaaaccgacgaggtcgacaacctggcccagcaggaacaggacgttctgtataggcgcctaaagctgttcactcacctccgacaagacttagagcgtgtgcgcaacctttgttacatggtcacgcgcagagaacgcaccaaacatgcaatctgcaaactgcaggaacagatctttcacctgcagatgaagttgatagaacaagatctctgccgcgagaggagtggtcgccgtgctaaaggaaaaaaatccgactctaagaggaagggctgcgagggatcaaagggaagcacggagaaaaaagaaaaagtaaaagctggacccgattcagttcttggccaactcgctggactgtccacatcctttcccatcgacggtacttttttcaattcctggcttgcgcaatctgtacagataacggcagagaacatggcgatgagcgagtggccactgaataatggacatcgcgaggatccagccccaggcctgctctcagaggaacttctgcaggatgaagagactcttctctcctttatgcgcgacccttccctccgcccaggcgatcccgctcgtaaggctagaggtagaaccagactgcctgccaagaaaaaaccccctcgacgaacaagcagccaccttccaagcagcccagcagccggagactgtcctattctcgccaccccagagtccccgcctccgctggctcccgagacccccgacgaagctgcatctgtagccgctgattcggatgtccaggttccaggtcctgccgctagtccaaagcccctgggacggctgcgtcctcccagagaatctaaagtcacccgaaggctacccggtgcccgaccagatgcaggaatgggtcctcctagtgccgtcgccgagagaccgaaggtgtctctgcacttcgatactgaaacggatggctacttttctgacggagaaatgagtgacagcgacgtggaggcagaagatggaggcgtacagcgagggcctagggaagcaggagcggaggaggtggttcggatgggcgttctcgctagctag

SEQ ID NO: 23809 - DNA, 768 bp, Artificial Sequence
  Description of Artificial Sequence: Synthetic coding sequence
atggaggagaaaagacggaagtacagcattagtagcgacaatagtgacactaccgacagtcatgccacaagcaccagtgcaagcagatgttctaagttaccgagtagtaccaagtcaggatggccaaggcagaatgagaaaaaacccagcgaggtattcaggaccgatctgattactgccatgaagatcccagattcctatcaactgtccccagatgactattacatactggccgatccctggaggcaggaatgggagaagggggtgcaggtccctgccggtgcggaagccatccccgagccagtggtcaggattttacctcctctggaaggtcctccagcccaggcatccccctcctcaacaatgctgggcgaaggatctcaacccgactggcctggtggctcacgttacgatctggatgaaattgacgcgtattggttggagctgattaactcagagctcaaagaaatggagcggcctgaactcgatgagctcacactggagagggtgctggaagaacttgagacactttgccaccagaacatggcacgcgctatagagacacaggagggacttgggatagaatatgatgaagatgtggtgtgtgacgtgtgccggtcacccgagggagaagacggaaatgagatggtgttctgcgacaagtgcaacgtgtgcgtgcaccaggcctgctatggtatcctgaaagtgcccacaggcagttggctgtgtcgtacttgtgcactgggtgtccagcccaaatgtctgtag

SEQ ID NO: 23810 - DNA, 2376 bp, Artificial Sequence
  Description of Artificial Sequence: Synthetic coding sequence
atggaggagaaaaggagaaagtactccatctcatcggataattccgacactacagactcccacgcgacctctacgtcagcctctaggtgttcaaagcttcccagcagcactaaatctgggtggccccgacagaatgaaaaaaaaccttccgaggtgtttaggacagacctgatcaccgccatgaaaatccctgactcatatcaactctctcccgatgactattatatcctggcggatccctggcggcaggagtgggaaaagggggtccaagttcctgcaggtgctgaagcgattccagaacccgtggttcggatactgccccctttggagggtccacccgcacaggcatcacccagctccaccatgctgggtgaaggctctcagccagattggccaggcggttctcgatacgatctcgatgaaattgacgcctattggctagagttgatcaattctgaactgaaggagatggagagaccagagctggacgagctgacactggagagggttttggaggagctcgagaccctgtgccaccaaaatatggcgagggcaatcgaaacccaggaaggtctgggcatagaatacgacgaagatgtggtctgcgatgtgtgccggtccccggagggggaggatggcaacgagatggtgttttgtgataagtgtaatgtttgtgtccaccaagcatgctacgggatcctgaaggtaccgacaggctcctggctgtgtcgcacctgtgctctaggagtgcagccgaaatgtctgctgtgtccaaaacgcggaggagcgttaaagcctacgcgttcaggtacaaaatgggttcatgtctcctgtgccctctggatccccgaggtttcgatcgggtgtcccgaaaagatggagcccatcaccaaaatctcccatatccctgccagccggtgggctctgtcgtgctctctgtgtaaagagtgcaccgggacatgtattcagtgtagcatgcccagttgtgtcactgcctttcacgtcacatgtgccttcgaccatggacttgaaatgagaacaattctcgcggacaatgatgaagtgaaatttaagtctttttgtcaggagcatagtgatggaggcccaaggaacgaacccaccagtgagcccactgaaccctcccaggccggagaggatctggaaaaggtgacactgcgcaaacagaggctgcagcagttagaggaagacttttatgagctagtcgagccagcagaggtcgccgagcgtctcgacctggccgaggcccttgtggatttcatttatcaatactggaaacttaaacgcaaggctaatgctaaccagcctctgttgaccccgaagaccgatgaagtcgataacctggcccaacaggaacaagatgtgctctatcggaggctgaagctgtttactcaccttcgccaggacctcgagagggtcagaaacctctgctacatggtgactaggagggagcggacaaaacacgcaatctgtaagctccaggagcagatcttccacctacagatgaaactaattgagcaggacctgtgtcgggcaggtctcagcacatcttttcctatcgatgggactttctttaatagttggctggcccagtcagtgcagatcaccgccgagaatatggccatgagcgagtggcctctaaataatggccatcgagaagacccagccccaggccttcttagcgaggagcttctgcaggatgaggaaacccttctgtcatttatgcgggacccttctttacgccctggagatccggctagaaaggccagaggcagaacaagactccccgcaaaaaagaagcctcctcctcctcctccacaggacgggccaggatcacgtaccacccccgacaaagcaccaaaaaagacctggggtcaggatgccggatctggtaagggtggacagggcccacccactcgcaaacctcctagaagaacttctagtcatctgccatcttctccagcggctggggattgcccaatcctggccactccggaaagcccacctccgctcgcaccagaaactcccgatgaggccgcaagtgtggccgcagactctgatgtgcaggttcctggcccagcggcatctccaaagcctcttggcagattgaggccaccccgtgagtctaaggtaactaggcgtctgcctggcgctagacccgatgccggaatgggacctccatccgctgttgcagagaggccaaaggtgagccttcactttgatacagaaaccgacggctatttcagcgacggagagatgtccgacagtgatgttgaggctgaggacggaggtgttcagcggggtccgagagaagcaggcgctgaggaggtggttcgcatgggtgtacttgcctcctag

SEQ ID NO: 23811 - DNA, 2553 bp, Artificial Sequence
  Description of Artificial Sequence: Synthetic coding sequence
atggtgcccacggccgcaattgccgtaggcggatactttctcggcggtatggaggagaaacgacgtaaatactccataagttctgataattctgacacgaccgacagtcacgccacttccacatctgcaagtcggtgctccaagctgccctccagtactaagtccgggtggcccagacagaacgagaagaaaccaagcgaggtttttcgcaccgacctgataaccgctatgaagatcccagattcatatcaattaagccccgacgattactacattctcgcggacccctggcgccaggaatgggaaaagggggtccaagttcctgccggagctgaggcaatccccgaacccgtcgtccggatcttgcctccactagagggaccccctgcgcaagccagccccagcagtaccatgctgggtgagggttcccagcccgattggccagggggttctcgatatgatctagatgagatcgatgcctactggctcgaactaataaattcagaactaaaagagatggagagacccgagctcgacgaactgactctggaacgggttctggaggagctggaaactctgtgtcatcagaatatggcccgagccatcgaaacccaggagggcctaggtatagagtacgatgaggatgtggtgtgtgacgtttgtagaagccccgagggcgaggatggtaacgagatggtgttctgcgacaaatgcaatgtgtgtgttcaccaggcgtgctacgggatcctcaaggtaccaacaggctcatggctttgtcgtacttgtgctctcggtgtccagcctaaatgcctgttgtgcccaaaaagagggggtgccctcaagccgactagatcgggaactaagtgggtgcatgtgagctgtgccctgtggatacctgaagtgagcatcggatgccccgaaaagatggagcccatcacaaaaatttctcatatccccgcttcaaggtgggccctttcatgcagcctatgcaaggagtgtaccggtacttgtatacagtgctcaatgccttcttgcgtgactgcttttcacgtgacgtgtgcgttcgatcacggtctggaaatgcgtacgattcttgctgacaacgacgaagttaaattcaagtcgttctgccaggagcattccgacggcggacccagaaatgagccgactagcgagccgactgagccctcacaggccggagaggacttggagaaggtcaccctgagaaagcagcgtctccagcagctggaggaggatttttacgagttagttgagcccgcagaggttgccgagaggctggatttagcagaagcactggtagattttatttaccagtattggaagctcaaacgcaaagcgaacgctaaccagccgctgcttacacccaagacagacgaggttgataatctcgcacaacaggaacaagatgtgctataccgcagactgaagctgtttactcatctacgacaagatttggagcgcgtacggaatctgtgctatatggtgacgcgcagggaacgcacaaagcacgccatctgtaaattgcaggaacagatcttccatttacagatgaagctgattgaacaggacctctgcagagagaggagcggcagaagggccaagggtaaaaagtctgattctaaacggaagggttgtgagggttcaaaggggtccactgaaaagaaggagaaggtcaaagctgggccagattctgttctgggacagctagctggcctatccacctcctttcctatagacggcacttttttcaattcttggttggcccagagcgttcaaattaccgctgaaaatatggccatgtctgaatggccgctaaataacggccaccgggaagatccagcccctggtctcctgtctgaggagttgttacaggacgaagaaaccctgctgagtttcatgcgagatccatcgctgcggcctggtgacccagctcggaaggcaaggggtcggacgcgcctccctgccaaaaaaaaacctcccccaccccctccccaggacgggcctggaagccgcactacgcctgataaagcgcctaagaaaacatggggccaggacgccggttccggaaaaggcggtcagggacccccaaccaggaagccacccaggagaacatcaagccatctcccctcttctccggcagcgggagactgcccaatattggccactccagagtcccccccacccctggctcccgaaaccccagatgaagctgcaagtgtggccgctgactccgacgtgcaggtgcccggtcctgctgcttcccctaagccactgggcagactgagacccccacgggaaagcaaggtcacacgcagactgcctggcgcacggcctgatgcaggcatgggcccacctagcgccgtggctgagcgccctaaggtcagcctgcatttcgataccgaaactgatggctacttcagcgatggcgagatgtctgacagtgacgtggaggcggaagacggcggtgtccaacgaggcccacgggaagctggcgctgaggaggttgtgagaatgggggttctcgcctcatag

SEQ ID NO: 23812 - DNA, 450 bp, Artificial Sequence
  Description of Artificial Sequence: Synthetic coding sequence
atggaagagaaaaggcgaaagtacagcatcagctccgacaattcagacacaaccgatagtcatgccacatccacctcagcctcccgctgttccaagctgccatcctccacgaagtctggttggcccaggcagaacgaaaagaagccatcggaagtttttaggacggatctgatcaccgccatgaaaattcccgatagctaccagctgtcgcccgacgactactacatcctcgctgatccatggcgccaagagtgggaaaaaggggtccaggtccctgctggtgcggaagcaattcctgaacccgttgttagaatactgcctcccttagaagggcctcctgctcaggctagcccctcctctacgatgttgggggagggcagccaaccggattggcccggtgggtcaaggtacgatctggatgaaattgacgcatactggctcgaattatag

SEQ ID NO: 23813 - DNA, 1053 bp, Artificial Sequence
  Description of Artificial Sequence: Synthetic coding sequence
atggggtgtttctttagtaagcggagaaaggccgataaggagagccgccctgagaatgaggaagagcgccctaaacagtattcttgggaccagcgcgagaaagtcgacccaaaagactatatgttcagcgggttgaaggacgagaccgttggacgcctccccggtactgtggccggacagcaatttctgattcaagactgtgagaactgtaacatctatatttttgaccatagcgctacggttactattgatgactgtaccaattgcatcatcttcttagggcctgtgaaggggtccgtgttcttccggaactgccgagactgcaagtgtacattggcctgtcaacaattcagagtgcgggattgccggaaacttgaggtgtttctgtgttgtgcaacacagccgatcatagagtcatcttctaatataaaattcggctgcttccagtggtactaccctgagttagccttccagttcaaggacgcaggcctgagtatcttcaacaacacctggtcaaatatccatgactttactccagtgtccggcgaattaaactggtctctgctgccggaagacgccgtggtacaagattatgtcccgattcctacaaccgaagagttgaaagctgtgagagtgagcacagaagctaatcgttcgatcgtgccaatttcgcggggtcaacgccagaaaagctccgacgaatcctgtcttgttgttctttttgctggcgattataccatcgctaatgcaagaaaactaatcgatgagatggtgggtaaaggctttttcctggtccagactaaagaagtgtcaatgaaggctgaagatgcccagcgggttttcagagaaaaggcaccagactttctgccactgctgaataagggacccgtgatcgccctcgagtttaacggcgacggggcagtggaggtatgccagctgatagtgaatgagatctttaatggcacaaagatgtttgtctccgaaagcaaagaaactgctagcggggacgtggattccttctataacttcgcagacatccagatgggaatctag

SEQ ID NO: 23814 - DNA, 2472 bp, Artificial Sequence
  Description of Artificial Sequence: Synthetic coding sequence
atgaagcggcataggcccgtgagcagttcagattcctcagatgaatccccctccacctcattcacatccgggagcatgtacaggatcaagtcgaagatccccaacgaacacaagaaaccggcagaagtgtttagaaaagacctgatcagcgcaatgaagctgcctgactctcaccatatcaaccccgatagctattatctctttgctgacacttggaaagaagagtgggagaagggcgtgcaggtgcctgccagccctgataccgtgcctcagccatctctgaggataattgccgagaaagtcaaagatgttttattcatcagaccaaggaaatatatccactgttcatcacctgacactaccgaacccggttatatcaatataatggagcttgctgcctcggtatgcagatacgatcttgacgatatggatattttttggctccaggaactgaatgaagacttggcggagatggggtgcgggccagtggacgaaaacctgatggagaagaccgtcgaggtgctggagagacactgccacgagaatatgaatcacgcgattgagactgaggaaggcctgggtatcgagtatgacgaggatgttatctgtgacgtgtgtcggtccccggattcagaggagggaaacgatatggtcttctgcgataaatgtaacgtgtgcgtgcaccaggcgtgttatggtatactcaaggtgcccgagggaagttggctgtgccgcagctgcgtccttgggatctaccctcagtgcgttctgtgccctaagaaggggggtgcgctgaagacaacaaagacagggacaaagtgggcacacgtgtcttgtgccctatggattcctgaagtatccattgcttgcccagagcgcatggagccaatcaccaaaattagccacataccacctagccgctgggccctggtctgtaatttatgtaaacttaagacaggtgcctgtattcaatgctccattaagtcctgcatcaccgcgttccacgttacatgtgcctttgaacacgggttagagatgaaaactatcctggacgagggagacgaagttaaatttaagtcctactgcctgaagcactcccagaatcggcagaagctgggggaagcggaataccctcaccatcgagcaaaagagcaatctcaggcaaaatcagagaagacttccttaagggcccaaaaactgagagagctggaggaggagttctactctctggttcgagttgaagatgtagccgcagaactgggcatgccaaccctggccgttgattttatatacaattattggaaactcaaaaggaagagcaatttcaataagcccttgtttcccccaaaggaggacgaagaaaacggactcgtacagcccaaggaagagagtattcacacgcggatgcggatgtttatgcacctcaggcaggacctggagcgcgtgaggaatttgtgttacatgatctctaggcgagaaaaactgaagctcagtcataacaaaatccaggaacaaatattcggattgcaggtgcagttgttgaaccaggagatcgacgctgggctacctttaacaaacgcactcgaaaattccctgttctaccctccaccccgaattacacttaaactgaaaatgcccaagagtacgcccgaagaccatcggaatagctccacagagacagaccagcagccgcattcccctgattcatcttcatccgtgcacagcatccgcaatatgcaggtgccacaggaaagcctcgaaatgagaacaaaaagctatcccagatatcctctcgaatccaagaacaatcgcctgctggcttcgctcagtcactcaaggagcgaggctaaggagtctagccctgcgtggcggactcctagcagtgaatgttaccatgggcagagtttgggtaaacctctggttctgcaggccgctcttcacggacagtcaagcattggcaacggcaaaagtcaacctaattcaaagttcgcgaagtctaatggactggagggaagctggtcaggcaacgtgacacagaaagactcgtcctccgagatgttctgtgaccaggagcctgtatttagcccacacctggtcagccaggggagcttcaggaagagcactgtggagcattttagccgatccttcaaggagacaacaaaccgttgggtaaagaacaccgaagatctgcagtgctacgtcaaaccaacgaagaacatgtcccccaaagaacaattttggggtcgccaagttttgcgacgctcagctggtagggccccttaccaggaaaatgatggctactgcccagatctggaactcagcgactccgaagctgaatctgatgggaacaaggagaaagtgcgggtgcgcaaggactcaagcgaccgcgaaaacccgccacacgattcccggagggactgccatggcaagtctaagacccatcccctctctcattcttcaatgcagaggtag

SEQ ID NO: 23815 - DNA, 561 bp, Artificial Sequence
  Description of Artificial Sequence: Synthetic coding sequence
atgaagagacatagacctgtcagtagcagcgatagctccgatgagagccccagtacctcctttaccagtggatccatgtataggatcaagtctaaaatccctaatgaacacaaaaagcctgctgaggtgtttaggaaggacttgatttccgctatgaaactgccagactcccaccatattaaccctgacagctattatctgtttgccgacacatggaaggaagagtgggagaagggggtgcaggttcccgctagcccagatactgtcccccaaccttccctgaggatcatcgctgaaaaggttaaagacgtcctctttataaggcccaggaaatatatccattgcagctctcccgacacaactgaaccgggatatatcaatatcatggaacttgctgcatcagtttgtcgctacgatctggacgacatggatatcttctggctgcaggaactgaacgaggatctggccgagatgggatgcggcccagtggatgaaaatcttatggagaagacagtggaagtgttggagagacattgtcacgaaaacatgaatcatgcatag

SEQ ID NO: 23816 - DNA, 345 bp, Artificial Sequence
  Description of Artificial Sequence: Synthetic coding sequence
atgaaacgacaccgtccagtttcgtcatcagacagcagcgacgaaagcccgtcgacttcttttacctctggctctatgtaccggattaagagtaaaatccccaacgaacacaaaaaaccggctgaagtctttcggaaagatctcatctccgcaatgaagctccctgacagtcatcacattaaccctgactcctactatcttttcgccgatacctggaaggaagaatgggaaaagggcgtgcaggtcccagcgtctccagacaccgttccccagccttcacttcgcattatcgcagaaaaagtgaaagacgtcctctttatccgcccaagaaagtatattcactag

SEQ ID NO: 23817 - DNA, 1632 bp, Artificial Sequence
  Description of Artificial Sequence: Synthetic coding sequence
atgactaagcaccctcccaaccgcaggggcatctcctttgaggtgggcgctcagctggaagcaagggacagattaaaaaattggtatccggctcacattgaggatattgattatgaggaaggcaaggtcttaatccactttaagcggtggaatcaccgatacgatgagtggttctgctgggattccccttacctgagacccttggagaagatccagctgcgcaaagagggactccatgaggaagacggtagctccgagtttcaaatcaacgagcaagtgctggcttgctggtcggattgcaggttctaccctgcaaaggtgaccgcagttaataaagacggtacatacacagtgaagttttacgacggtgtagtgcaaactgtcaagcacattcacgtcaaggccttcagcaaagaccagaatattgtggggaacgctcgccctaaggaaacggatcataagtctttaagctcgtctcccgataagcgcgaaaaattcaaggagcagcgtaaggcaactgtcaacgttaagaaagataaggaggacaagcctttgaaaactgagaagaggccgaaacaacccgacaaggaaggaaaactgatttgcagcgagaaagggaaggtgtcggaaaaatcacttcctaagaatgagaaggaggataaggagaatattagcgagaacgatcgtgagtattcaggtgacgctcaagtggacaagaaacccgaaaatgacatagtgaagtcaccgcaggagaacctgagggagcctaagaggaagcgcggaaggcccccttccatcgctccaactgcagtagattctaactcacaaacactgcaacccatcactctggagttgaggaggaggaagattagcaaaggctgtgaagttcccttaaaacggccacggctcgacaagaatagttcacaagaaaagtccaagaattactctgagaatacagacaaagacctatctagacgaaggtcctcacgcttgagcaccaacggaacgcacgaaatcttggaccccgatttagttgttagtgaccttgtggacactgatccactccaggacacactcagcagtacaaaggaatctgaggagggacagctgaaatcggctctcgaggccggacaggttagcagcgccctcacatgtcactctttcggcgacggtagtggggctgctggcctggagttgaactgtccttctatgggagagaatactatgaaaaccgaaccaacctccccgctcgttgagctacaggagatttctactgtagaggttactaatacattcaagaaaactgacgatttcggttcttctaatgcccctgccgtggacctggatcataaattcagatgtaaagtggtggattgccttaagttctttcgaaaagccaaacttctccattaccatatgaaatatttccacggcatggaaaagtcactcgaacccgaggagtcccctggaaagagacatgtgcagacccgtggcccttccgccagtgacaagccatctcaggagactttgactagaaaaagggttagtgcctccagcccaaccacaaaggataaggaaaagaacaaagaaaagaagtttaaggaatttgtccgggtgaaaccaaaaaaatag

SEQ ID NO: 23818 - DNA, 1650 bp, Artificial Sequence
  Description of Artificial Sequence: Synthetic coding sequence
atgacgaaacacccgccaaaccgaagaggtataagctttgaggtcggcgcacaactggaagcaagagaccggctgaaaaactggtaccccgctcatattgaggatattgactatgaagaggggaaagttctgattcatttcaagagatggaaccatcggtacgatgagtggttttgctgggattcaccatatttgaggcctctggagaagatacagttgagaaaagaggggctgcacgaggaggatgggagcagcgagtttcagattaacgagcaggttctggcgtgctggtcagattgccgtttctaccctgcgaaagtgacagctgttaacaaagacgggacgtatacggttaagttttatgatggagtggtccagacggttaagcatatacatgtgaaagctttttcaaaagatcagaacatcgtcggcaacgcaagaccgaaagaaaccgatcacaagtctctctccagctcacccgacaagagggaaaaattcaaagaacagcggaaggcgacggtcaacgtcaagaaagacaaggaagacaagccactaaagaccgagaaaaggccaaagcagcctgataaagaaggtaagctgatatgctcggaaaaaggcaaggtatcagaaaagagcctccctaaaaatgaaaaggaggataaagagaacatttccgagaatgaccgggagtactctggagacgcgcaggtggacaaaaagcccgaaaatgacattgtgaaatcaccacaggaaaacttgcgagaacccaaacggaagagaggcagacctccctctatcgcacctacggcagttgatagcaacagtcaaacactgcagcccattaccctggagctgcgcaggagaaagatatccaaaggatgtgaggttcctttgaaacgacccaggctcgataaaaacagtagtcaggagaagagtaagaattactcggagaacaccgacaaggacctgtctcggaggcgctcatctagattatccaccaacggaacccacgaaattctggatccagatttggttgtcagtgatctcgtagataccgatccattgcaggacaccctctcctcgaccaaagaaagcgaggagggtcagctgaagtccgctttagaggccggacaagtctccagcgccctgacatgtcactcgttcggagacggttccggcgctgctggcctagagctgaactgtccctctatgggcgagaatactatgaagaccgaacccaccagccccctggtagaactacaggagattagcaccgttgaagttaccaataccttcaaaaagaccgacgatttcggttcaagcaacgctccagctgtcgatctggatcataaatttcgctgtaaagttgtcgactgcctgaagttttttagaaaggccaaactactccactaccatatgaagtacttccacggtatggaaaagtcactggaacctgaagagtcgcctgggaagcggcacgttcaaacccgcggaccctcggccagcgacaaaccatcacaggagacactgactaggaagcgtgtgtccgcttcttcgcctacaacaaaggataaagaaaaaaataaggagaaaaaattcaaagagttcgtccgagtcaagcccaagaagaaaaagaaaaagaagaagtag

SEQ ID NO: 23819 - DNA, 3039 bp, Artificial Sequence
  Description of Artificial Sequence: Synthetic coding sequence
atgactaagcacccaccaaaccgccgtggcatttccttcgaagtaggggctcaactggaagctagagacaggcttaagaattggtatcctgcccatatagaggacattgactacgaggaggggaaggtactcatacactttaagcggtggaatcaccggtatgacgagtggttttgttgggacagtccctatttgagacccctcgagaagatccagcttcgcaaagaggggctgcacgaggaagacgggtcttccgagttccaaatcaatgagcaggtgcttgcatgttggtccgactgtaggttctacccggcaaaggtaacggctgtcaacaaggatggaacttataccgtcaagttttatgatggcgtggttcagacagtgaagcacatacatgtgaaagcctttagtaaggaccagaatatcgtcggcaatgctcgcccaaaggaaacagatcacaagtccctcagctcaagtcctgacaagagagaaaaattcaaggagcagcgaaaggccactgtgaatgtgaaaaaagataaggaggacaagcccctcaaaaccgagaagagaccaaaacagcctgacaaggagggaaagttgatctgctccgaaaagggcaaggtgagcgaaaagagtctccctaagaacgaaaaggaggataaagagaacatctctgaaaatgacagggaatacagcggggatgcgcaggttgacaagaaaccggaaaatgacattgtgaaatccccccaggaaaacctgcgtgagcctaaacgcaaacggggtcgtcctcctagtattgctcctactgccgtggatagcaacagccaaaccctacagcctataacactggaattgaggcgccgtaagatctcaaaaggctgcgaagttcccttaaagaggcccaggcttgacaaaaacagttcccaggagaagtccaagaactactcagaaaatacggacaaagatttgagcagaaggaggagctccagactttctacaaatggaacacatgagatcctggaccctgatctggtcgtgtcagatcttgtagacaccgaccccttacaggacactctctcctcaacaaaggaaagtgaggaaggacaactgaaatctgccctcgaagcaggacaggtcagctccgccctgacatgtcattccttcggcgacggaagcggcgcagctggtctggagctcaactgcccaagcatgggagagaacaccatgaagaccgagccaacaagcccactcgtggagctgcaggaaatttctaccgtggaagtgactaacaccttcaaaaagaccgatgattttggcagctcaaatgctccagctgtggatttggatcacaagtttaggtgcaaggtggtggattgtctgaaatttttccgtaaggccaaattgctgcactaccatatgaagtacttccacggcatggagaaaagcttggagccagaggaatcccctggcaagcgccatgtccaaaccaggggcccttccgcttctgacaagcccagccaggagactcttacgcgaaaacgtgtgtcagcctccagtcctaccaccaaggacaaggagaagaacaaggagaaaaagtttaaggagtttgtcagagtcaaacccaagaaaaaaaaaaagaaaaagaagaagacgaagcccgagtgcccatgctctgaggagatttccgacacaagtcaagagccaagcccgcctaaggccttcgcagtgaccagatgtggcagttctcacaaacctggcgttcatatgtccccccagctgcacggccctgagagcggccatcacaaaggaaaggtgaaagctctggaggaagacaacttgagcgaatcctcctcggagagcttcttatggagcgatgatgaatatggccaggacgtggacgtgaccacaaatccagacgaggaactggatggcgatgaccgctatgactttgaagtggtgcggtgcatctgtgaagttcaggaggaaaacgacttcatgattcagtgcgaggagtgccagtgctggcaacacggcgtctgtatgggtctccttgaggagaacgtcccagagaagtatacttgctatgtgtgtcaagacccgcctgggcagcgacctggcttcaagtattggtacgacaaagagtggttatccaggggtcatatgcacggtctggcattcctggaggaaaattattcccatcagaacgctaagaagatcgtggcaacacaccagctcctgggggacgtgcaaagagtcattgaggtgctacacgggctgcagttgaagatgtccatcttgcagtctcgagagcacccggaccttccgctctggtgccagccatggaagcagcattctggggaggggagaagtcacttcaggaatatccccgtcacggatactcgaagcaaggaagaagcgccatcttatcggacccttaacggcgctgtcgagaagcctaggcctctggctctccctctccctaggtccgtggaagagtcatacattacgtcagaacactgttaccagaagcccagggcctactatcccgcagtcgagcaaaagttagtcgttgaaacacgagggtcagccctcgacgacgccgtgaacccattgcatgagaatggcgatgatagcctttccccacggctggggtggcccttggaccaggaccgcagcaagggagattccgaccccaagcctgggagccctaaagtgaaggaatacgtgtcaaagaaagctttgcctgaggaggcacccgcacggaagctgctagatcgtggtggagaggggctcttgagcagccagcaccagtggcagttcaatctcctgacccatgtggagagcctgcaggacgaagtgacccaccgtatggactccatcgaaaaagaattagacgtgctggagagttggctggattataccggtgagctagagccccctgaaccgctggcgcgactcccccagctgaaacactgcattaagcagctgctgatggacttaggtaaagttcagcagatagcattatgctgttcaacatag

SEQ ID NO: 23820 - DNA, 819 bp, Artificial Sequence
  Description of Artificial Sequence: Synthetic coding sequence
atgacaaagcacccccctaaccgaagggggatctcattcgaagtgggcgctcagctggaagctcgcgatcggctgaagaactggtaccccgcacatatcgaagatattgattacgaggaaggcaaagtactgatccattttaagcgatggaaccatcgttacgatgagtggttttgttgggatagcccatatctgcgacctttggagaaaatacagctgcgcaaagaagggttgcacgaggaggacggtagttcggaattccagatcaatgagcaagtgctggcatgctggtctgattgtcgcttctacccagctaaggtcacggctgtcaacaaggatggaacctacacagtcaaattttacgatggggtagtacagactgtaaaacatatccacgtcaaagctttttctaaagaccaaaatatcgttggcaatgcaagacccaaggaaacagaccataagagtttatctagtagccccgacaagagggagaagttcaaagaacaaagaaaggctactgtgaatgtgaaaaaggacaaagaagacaaaccactgaaaaccgagaaacggcctaagcagcccgacaaagagggaaaactcatctgttctgagaaggggaaagttagcgagaaatcgcttcccaaaaacgaaaaagaggacaaagagaatatttctgagaatgatcgggaatacagtggagacgcccagaaaacacggcagacaccctttcactccagctattgttgcggctttaagctctcaaactttgcgacaaacaatatcggaaccgagaaaaaagaaaatattaagcggatgtag

SEQ ID NO: 23821 - DNA, 2289 bp, Artificial Sequence
  Description of Artificial Sequence: Synthetic coding sequence
atggaaggcccacggtcctcaacccatgtaccactcgtgctgccactgcttgtcctgcttcttctggccccagccagacaggccgcagcccagagatgtccacaggcctgtatctgtgacaactccaggcgccacgtagcctgtagataccagaatctgacagaagtacctgacgccattcccgaactaacccagagacttgacctgcaagggaacctcctgaaagtgattccagccgcagcttttcagggtgtgcctcacctcactcacctcgacctgcgccactgcgaggttgagctggtggccgaaggcgcattccggggactcggcaggctgctgctgctgaacctggcatcaaatcaccttagggagcttcctcaagaggccctggacggattaggctctttgcgaaggctcgaacttgaagggaacgcactggaggagcttcgtccaggcacattcggcgctcttggtgctctggccacgctaaacctagctcataatgcacttgtatacctgcccgcaatggccttccagggactgttgagagtgaggtggctgaggctgtctcacaacgctctgagcgtgctggctcccgaagcattagcagggctgccagcgctgagacgactttctctgcaccataatgagctccaggccctgcccggtccagtgttgagtcaagctcgtgggctagcacggctcgagctaggacataatcccctgacctacgccggtgaggaggacgggctggccttacctggtctacgcgaacttcttctggatggtggcgctttgcaggccctcggtcctagggctttcgcccattgtcctcggctgcataccctggacctccggggaaatcaactcgacaccctgcctcccttacaaggcccagggcagcttcggcgactgcgattgcagggtaaccctctttggtgcggttgccaagctcgccctctcctggagtggctcgctagggctcgagttcgctcagatggggcttgccaagggcctagacgccttcgcggagaggcccttgatgcgttgcggccatgggacctgagatgccccggtgatgctgcccaggaggaggaggagctggaagaacgcgcagtcgctggcccaagggctccacctcgtggaccccctaggggtccgggagaggaacgtgctgtggcaccctgtccccgtgcttgtgtctgtgttcccgaaagtcgccattcttcctgtgagggctgcggtttacaggccgtcccaagaggctttccctcagacacccaactgcttgacttgcgtagaaatcacttcccctccgtgcccagggcagcctttcctgggttgggtcacctggtgagtctacacttgcagcactgtggaatcgcagaacttgaagcaggcgcacttgccggactagggagactgatatacctgtatctctcagataatcagctggctggactcagcgccgctgccttagaaggcgctccaagattagggtatctgtacctggagcgaaaccgatttctccaggtgccaggggctgcccttcgtgcgctcccatcgctgttttctcttcacttacaggacaacgctgtggacaggcttgctcctggcgacctagggcgaacaagagcgctaagatgggtatacctgagcgggaaccgcatcactgaggtgtcattgggtgccttgggcccagccagagagctggaaaagctacatctggaccgcaaccagctccgtgaagtccctacaggcgcactagaagggttaccagctctgctagagctccagttgtcgggtaaccccctgcgcgctctccgtgacggggcattccagcccgtcggaaggagtctgcaacacctttttctgaatagtagtgggctggaacagatctgtcccggtgcatttagcggacttggaccagggcttcagagtctgcacctgcagaagaatcaactgcgggcactgcccgcattaccctctttgagccagctagagctgatcgacctaagctctaaccctttccactgtgattgccagctgttgcctctgcaccgctggcttacaggcctcaaccttagggtgggggctacatgtgccacccctcctaacgcacggggacagagagtgaaggctgcagccgcagtgtttgaggattgtccagggtgggcggctcgaaaggccaagagaactcccgcttctcggccaagcgcaaggagaacccctattaaggggcgtcagtgcggagctgacaaagtcggaaaggagaagggtcgactctag

SEQ ID NO: 23822 - DNA, 1146 bp, Artificial Sequence
  Description of Artificial Sequence: Synthetic coding sequence
atgaaaaccgtcaaagagaagaaagagtgccagcggctcaggaagagtgccaagacacggagggtcacccagcgcaagccttcaagcggtccagtgtgctggctctgcctcagggaaccaggagaccccgagaaactgggtgagtttttgcagaaagacaatattagcgtgcattatttctgcctcattctgagttccaaactcccccaaaggggtcagagtaaccgagggttccacggctttctccctgaggacattaaaaaggaagctgcccgagctagcaggaagatttgcttcgtatgtaaaaaaaaaggagccgcaatcaactgccagaaggatcagtgtctgaggaacttccacctaccatgcggccaagaaaggggctgtttgtcacagtttttcggcgaatacaaaagcttctgtgacaaacatagacccacccagaatatccagcatggccacgtgggcgaggaaagctgtatactctgttgcgaggacctctcccagcagtccgtagagaacattcagtcaccctgttgcagccaggcaatctatcacagaaagtgtatccagaaatacgcccacacaagcgccaaacacttcttcaagtgtccacaatgtaacaacaggaaagaattcccacaggagatgctgcgcatgggcatccacattcccgacagagatgcagcctgggaactcgaacccggagcattctccgatctttatcagcgataccagcactgtgacgctcctatttgcctgtatgagcaaggtagggattcctttgaggacgagggacgctggtgcctgattctgtgcgctacttgcggaagtcacggcacgcaccgggactgctcgagccttagatcgaactcaaagaaatgggagtgtgaggaatgctctcctgccgctgcaacagattacatccccgagaattcaggtgacatcccatgttgtagctcaacttttcacccagaggagcacttctgtcgcgataatacactcgaggaaaatccaggcctgagctggactgactggcccgaaccttctctcttggagaagcccgagtcctctagaggtcgaaggtcatactcctggaggagcaaaggagtgcgaatcacaaattcttgcaaaaaatctaaatag

SEQ ID NO: 23823 - DNA, 1029 bp, Artificial Sequence
  Description of Artificial Sequence: Synthetic coding sequence
atgaaaaccgtgaaagagaaaaaagagtgtcagagactcagaaagtcagctaagactaggagagtgacacagcggaaaccctcctctggcccagtgtgttggctttgcttaagagaaccaggagacccagaaaagttgggcgagtttctgcagaaggacaacatttcagtccattacttctgcctgattttatcttccaagctgcctcagagaggccagtctaataggggattccacggcttcctgccagaagacatcaagaaagaggctgcacgggcatctcgaaaaatttgttttgtctgtaaaaagaaaggggctgccattaactgtcaaaaggatcagtgtctgaggaacttccaccttccctgcggccaggagagaggatgcctgtcacagttctttggcgagtacaaatccttctgcgataaacaccggcctacccagaacattcagcatggacatgtgggcgaggagagctgcattctgtgttgtgaggatctgagccagcagtccgtggaaaatatccagtcaccttgctgttcccaggcaatctatcatcgcaagtgtatccaaaagtacgcccacacctctgccaaacacttctttaaatgccctcagtgcaacaaccggaaagagttcccccaagagatgttgagaatggggattcatattccggaccggcgttggtgtcttatcctctgcgcaacatgcggaagccacggcacacaccgagattgcagcagtttgcgatccaattcaaagaaatgggaatgcgaggaatgctccccagccgcagccacagattacatccctgagaactccggcgatatcccctgctgcagtagcacatttcatcccgaggaacatttttgccgggataacaccctggaagagaaccctggtctgtcctggaccgattggccggagccaagcctcctcgagaaacccgagtcttccaggggccgtcgaagctatagttggaggtccaaaggggtgcggatcacaaactcttgtaagaagtctaagtag

SEQ ID NO: 23824 - DNA, 873 bp, Artificial Sequence
  Description of Artificial Sequence: Synthetic coding sequence
ttcaatagaaagatatgctttgtttgcaaaaaaaaaggagccgctataaattgccaaaaggatcaatgtttacgcaatttccacctgccctgcggccaggagcgtggttgcctgtcccagttctttggggagtataaaagcttctgcgataagcaccgcccaacccagaatattcagcacggccatgtcggcgaggagtcgtgcatcctgtgctgcgaagacctttctcaacaaagtgtggagaatatccagtcgccttgttgcagtcaagccatttatcatcggaagtgcatccagaaatatgctcatactagcgccaaacacttttttaagtgtccacagtgtaacaatcgcaaggagtttccccaggagatgctcaggatgggcatccacatcccagattctcgcgacgccgcatgggaactggagcctggcgcatttagtgacctgtaccaacggtatcagcactgcgatgcccctatctgcttatacgagcagggccgagactcttttgaggacgaaggacgctggtgtcttatcctgtgcgctacatgtggttcccatggcacacaccgggactgcagctccctcaggtctaattccaagaagtgggagtgcgaggagtgttcccccgctgcagccacagactacatacctgagaactccggggacatcccctgttgttcctcgacattccacccggaggaacacttttgcagagacaacacactggaggagaatccaggcctttcctggactgactggcccgagccatccttgctggagaaaccggaatcctccagaggcagaagaagctacagctggcgtagcaagggagtccgcatcaccaacagttgcaagaaaagcaaatag

SEQ ID NO: 23825 - DNA, 642 bp, Artificial Sequence
  Description of Artificial Sequence: Synthetic coding sequence
atgttgcgcgagccaggagaccccgaaaaactgggagagttcctacaaaaggataacatcagtgtgcattacttttgcttgatcctgtcttccaaactgccacagcgagggcagtcaaaccgagggtccatggatttttgcctgaagacatcaaagagacgccaacccggtctgcttggaaggtcggctttgtgtgcacgcaagagagagctgctgagcacggctcgccgtatctccgcctccgagacgagtatatgcttagtggcgaagaaaggggtggcgtttcataatttcctggagtcaaccaaccactttgtcactaacatagctcagcataggaccagcaacatggggatgtgggggaggaaagcggcttcatatgtggtgaaaacatacccaaacagagttctgcgtacatccagggccagggtagttgtcaaaccctcaacaacggctagcgcataccgtaatatgcccacccaccagcaatctatctcatctaacgttcacagcgtcaccatcgaaagagtttcatcacgaaacgccgaaaacggtaacagctatagcaggcaggaggtggtacctcactccgtctgttacatgagaatccccaggaatccacagggattactgctctcctag

SEQ ID NO: 23826 - DNA, 72 bp, Artificial Sequence
  Description of Artificial Sequence: Synthetic coding sequence
atgaagactgtcaaagagaagaaagagtgtcaacggttgagaaagtcagccaagacccgaagagtaacctag

SEQ ID NO: 23827 - DNA, 1146 bp, Artificial Sequence
  Description of Artificial Sequence: Synthetic coding sequence
atgaaaaccgtaaaagaaaaaaaggaatgccagaggctgcggaaaagtgccaagaccagacgggtaacccagcggaaaccgtcttccgggcctgtttgctggctgtgtctcagagaaccaggggaccccgagaagttgggagaattcctgcagaaagacaatatttccgtgcattacttttgtctgatcctgagcagtaaacttccccagagggggcagagcaacaggggctttcatggatttttaccggaagacattaagaaggaggcggcacgggctagtcggaagatctgctttgtgtgtaagaagaaaggggctgcaattaactgccagaaagatcagtgcctccgcaactttcacttgccctgcggacaggagcggggttgcctgtcgcagtttttcggggaatataaatctttctgtgataaacaccgcccaacgcagaacatccagcatggacacgttggagaggaatcttgtattctctgttgcgaagatctctcacagcagagtgtggagaatatacagtcaccatgctgcagtcaggcaatctaccaccgcaaatgtattcagaagtatgcgcatactagtgccaaacatttcttcaaatgcccccagtgcaacaatcggaaggaattcccgcaggaaatgttgagaatgggtatccacatcccagatcgcgacgccgcatgggaactagaaccaggagcttttagtgacttataccagaggtaccagcactgcgacgctccaatatgtttgtatgagcaggggagagactcttttgaagatgaaggtcggtggtgcctgatcctgtgcgctacatgtgggtcgcatggaactcacagagactgctcatccctgcgaagcaactcaaaaaagtgggaatgtgaagaatgcagcccagcagcagctaccgattatattccagagaactccggcgacatcccatgctgttcctctacattccatcctgaggaacatttctgtagggataacaccttagaagaaaaccccggactcagctggacggactggccagagccttccctgctggagaagccagaaagttctcggggacgacggtcgtacagctggaggtctaagggagtccgaatcaccaactcctgcaagaaatccaagtag

SEQ ID NO: 23828 - DNA, 1557 bp, Artificial Sequence
  Description of Artificial Sequence: Synthetic coding sequence
atggaccagactcctccagccaggccagagtacctcgtctctggcattaggaccccacccgttaggaggaactcaaagctggcaacattggggcgtatcttcaaaccctggaagtggcggaagaagaagaatgagaagttgaagcagacaactagcgcactcgagaagaaaatggccggaaggcagggacgcgaagaattaattaaaaaagggctgctggagatgatggaacaagatgctgagtccaaaacctgcaaccccgacggtggaccacggtccgttcagtccgagcctcccacacctaagtcagagacgttaacctcggaggacgctcagcccggtagtcccctggccaccgggaccgatcaggtgagcctggataagccactcagcagcgcagctcacctggatgacgccgctaaaatgcctagcgctagttcaggagaggaagccgacgctgggagcctcctccccactactaatgaactcagccaggcactcgcaggcgctgacagccttgattctccgcctcgacccctggaacgcagtgttggtcagctcccatctcctccgctgctaccaaccccccctccgaaagcctctagtaagactacaaagaatgtgacaggacaggcgacactctttcaggcctcaagcatgaaatccgccgatccgagcctccggggtcaattgtctacccccactggctccccacacctgaccactgtccaccggcctctgccaccttcacgcgttattgaggaactccaccgcgctcttgcgactaaacataggcaggactcttttcagggcagagagtctaaaggttcccctaaaaaaagactcgacgtaaggctctctagaacatcgtcagtggagcggggaaaggagcgggaggaggcttggtccttcgacggcgcacttgagaacaaaaggaccgctgcgaaggagtctgaggagaataaggaaaaccttattattaactccgagctgaaagacgatctgttgctgtatcaggacgaggaagcgctgaacgactcgatcatatccggaactctgcccaggaaatgcaaaaaagaactgttggctgtgaaactgagaaacaggcctagcaagcaggagcttgaggataggaacatcttcccgaggcgcactgatgaggagcgacaagagatcaggcaacagatagagatgaagctctctaagcgcctgagtcagcggccagcagtggaggagctggagcggaggaacatactgaaacagcgtaatgaccagaccgaacaagaagaacgacgggagatcaagcaacggcttacaagaaaacttaaccagcggccaactgtcgatgagctgcgcgaccggaaaattcttatccggtttagtgattatgtcgaagtagctaaggcccaggactacgaccgcagggccgataaaccctggacacgactatcggccgcagataaagcagctatccgtaaggagctcaacgagtacaaaagtaatgaaatggaagtgcacgcctctagtaaacacttaactagatttcaccgtccatag

SEQ ID NO: 23829 - DNA, 1347 bp, Artificial Sequence
  Description of Artificial Sequence: Synthetic coding sequence
atggaccaaacgcctcccgctcgacctgaatacttggtcagcgggataagaacgcccccagtgcgacggaatagcaagctcgccactctcggacgtatctttaagccatggaagtggagaaaaaagaagaacgagaagttaaagcagaccaccagcgccctggaaaagaagatggcgggtaggcaggggagggaggagctgatcaagaaagggttattggagatgatggagcaagacgccgagtctaagacttgcaaccctgatggcggtcctaggtcggtacaaagtgaacctcctacacccaaaagcgaaaccttgacatcagaggacgcacaacccggatcccccctagctaccggcacagatcaggtgagtctcgacaaacctttgtcatctgccgctcatctggatgatgcaggccaggcaacactgttccaagcttcttctatgaagtcggcagacccttcattgaggggacagctcagtacccctactgggtctccgcaccttacgactgtgcaccgccctctgccaccttccagagtgatcgaggaattgcacagagcgttagccactaaacaccggcaggactcatttcaggggagagaatcaaaggggagcccgaagaagagactggatgtgcgtctcagccggacaagttctgtggaacggggaaaggaaagagaggaggcatggtcatttgatggagcgcttgagaataagcgtaccgctgccaaagagagcgaggaaaacaaagaaaatctcatcataaattctgaactaaaggacgacctcctcctataccaagacgaggaggccttaaacgatagtattatctccggcacactgccacgaaaatgcaagaaagaactgctggctgttaaactgagaaacagaccctccaagcaggagctggaggacaggaatatttttcctaggcgtactgatgaggagcggcaagaaattaggcagcaaattgagatgaagctgtccaaaagactgtctcagaggccagcagtggaagagttagagaggcgcaatattctcaaacaaaggaatgatcaaactgaacaagaagagcggagagaaataaagcaacgtttgacccgcaagctgaaccagaggccgacagttgacgaattaagagacaggaagatcctaatccgcttttctgattacgtcgaagtggcgaaagcacaggactacgaccgaagagcggacaaaccttggacacggctaagcgcagccgataaagccgctatacggaaggaattgaatgaatataaaagtaacgagatggaggtccacgcttcatctaagcaccttacaaggtttcataggccctag

SEQ ID NO: 23830 - DNA, 1680 bp, Artificial Sequence
  Description of Artificial Sequence: Synthetic coding sequence
atggccgcatccgaggacggaagtggatgcctggtcagcagaggaaggagccagtcagaccctagcgtgttgactgactcaagcgctacctctagcgccgatgccggtgagaacccagacgagatggatcagacaccccctgccaggcccgaatatctcgtgagcggtattcgcacaccccctgtgcggaggaatagcaagctggcaacactgggaaggatctttaagccttggaagtggcgcaaaaaaaagaatgagaagctgaagcagacgacaagtgccttagaaaagaagatggctggcagacaggggagggaggaactgatcaagaaagggttactcgagatgatggaacaggacgctgagagcaaaacctgcaatcccgatggaggtccacgctcagtccagtcagagccacctaccccaaagagtgagacgttgacaagtgaggatgctcagcctggctctcccctggctacagggactgaccaggttagtttggacaagcccttgtcctcagccgcacatctggatgacgctgctaaaatgcccagcgcttcatcgggcgaagaggcagatgctggctccctgctgcccaccaccaacgagctctcacaggccctggccggagcagattccctggacagcccacctcgtcctctagaaagaagtgtaggccagctcccatccccccctctcctgcctactccccctccgaaggcctcctctaagaccactaaaaatgtgacaggccaggccactttgttccaagcgagcagcatgaagtctgccgacccgtcactgcgtggccagctaagcacgcccaccggctcaccacacctcaccaccgtccacaggccactcccaccttcacgagttatagaggagctacaccgagccctggccacaaaacatagacaagatagctttcagggtcgtgagagtaagggttccccaaagaaaaggcttgatgtgaggctctcccgaacctcctctgtggagcggggtaaagaacgggaagaagcctggtcatttgacggcgctttagagaataagcggaccgccgcaaaagaatccgaggaaaacaaggaaaacctgatcatcaactctgagttaaaggacgatttactgctttaccaagatgaagaagcgctgaatgattccatcatttccggaactctgcccagaaagtgcaagaaggagctgcttgctgtcaagcttcgaaacaggccttccaagcaggaacttgaggatcggaacatcttccctagaagaacggacgaagagcgtcaggagatcaggcagcagatagagatgaaactttctaaacggctgtctcagcgtcccgcagtggaagagttagagcggagaaacatcctaaaacagagaaatgaccagaccgagcaagaggaaaggagggagataaagcagaggctgactagaaagctgaaccagcgaccgactgtcgacgaactccgggaccgaaaaatcttgattaggttcagcgactacgtcgaggtcgccaaggcccaagattatgatcgcagggctgataagccttggacccgtctttcggccgcagacaaggcagctatacgtaaagagctcaacgaatacaagtcgaacgagatggaggttcatgcctcttccaagcacttaacacggtttcataggccgtag

SEQ ID NO: 23831 - DNA, 1557 bp, Artificial Sequence
  Description of Artificial Sequence: Synthetic coding sequence
atggatcaaacccccccagccaggccagaatatctcgtctctggcatccgtacccctccagtccgtaggaactcaaagctggccacgctgggcagaattttcaagccatggaagtggcgaaagaagaaaaacgagaagctcaagcagaccaccagcgcactcgagaaaaagatggctggcaggcaggggagagaggagctcataaagaaggggctcctcgagatgatggagcaggatgctgagtcaaagacatgcaaccccgacggcggacctcgctctgttcagtctgaaccgcctactcccaagtccgaaacactcaccagcgaagacgctcaacctgggagcccactggcaacaggaacagaccaagtgtcgctggacaagcctctctcatctgccgctcatctggacgatgcagccaagatgccctctgcatcaagcggcgaggaggccgacgcgggatcacttttgccaaccaccaacgagctgtcacaggcgctggcaggcgcagactcgctggattcacctccacggccattggaaagaagcgtggggcaactccccagcccgccactgttgcccacaccgcctcccaaggcctctagtaagacaaccaaaaatgtgacgggacaggcgaccctgtttcaggccagttcaatgaaatctgcggacccctctctccggggacagctgtcgacaccaaccgggagtccccatcttacaacagtgcaccggccactgcccccttcgcgggtgattgaagaacttcacagagcgcttgccaccaaacatcgtcaggattcatttcagggcagggaaagcaagggatctccaaagaaacggttagatgtcagactatctaggaccagctcggtcgaacggggtaaggagcgcgaagaggcctggagttttgatggagcactcgaaaacaagcggaccgcagctaaagagtccgaagagaacaaggagaacctcatcataaatagtgaattgaaagatgatctactgctgtatcaggacgaggaggcgctcaatgattcgatcatcagcgggacactgcctcgcaagtgtaaaaaagaacttttggccgtgaaactgcgcaacaggccaagtaaacaggagctggaggatcgaaacatctttccacggaggactgacgaggagagacaagaaattagacagcaaatcgaaatgaagttgtccaagaggttatcgcaacgccctgccgttgaggagctcgaacggagaaatattctcaagcagaggaatgaccaaaccgagcaagaggaaaggcgagagatcaagcagcggctcacacggaagctgaaccagcgaccgactgtcgacgagctgagagatcgcaagattctcatccgattttcggactacgtcgaggtagccaaggcccaagattatgaccggagagccgataagccctggaccaggctgtctgcggctgataaggccgcaataagaaaggaactcaacgagtacaagagcaacgagatggaggtccacgcatcctccaagcacctgacccgattccacaggccctag

SEQ ID NO: 23832 - DNA, 1347 bp, Artificial Sequence
  Description of Artificial Sequence: Synthetic coding sequence
atggatcagacgccacccgcacgacccgagtacctggtcagtggaataaggacacctcctgtgaggcgcaactctaagctggctaccttaggaagaatcttcaaaccatggaaatggaggaaaaaaaaaaacgagaagctaaagcagacaacttccgcactcgaaaagaagatggctggcaggcaaggccgtgaagaactgataaaaaagggattgttagaaatgatggagcaagacgccgagtctaaaacatgcaaccccgacggcggaccacgaagcgtgcagagtgaaccaccgactccaaagagcgagacactgacatccgaggacgctcagcctggttcaccattggctaccggaactgaccaggtgagcttagataagccactcagcagtgctgcgcatctggacgacgccggtcaggctactctgttccaggcttccagcatgaaaagcgccgacccctcccttaggggacagctcagtaccccaactggttccccacatctcactaccgtgcacagaccgctgccccctagtcgcgtgatcgaggagctccatagggccctggccacaaagcacaggcaagattcttttcaaggacgcgaaagcaagggctcccctaagaagcgtctggatgtgagactttcacggacatcatccgtagagcggggtaaagagcgcgaagaggcatggtcattcgatggcgcattggaaaacaaacgaaccgctgccaaggaatccgaggagaacaaggagaacctgatcattaacagcgagctgaaggacgatctcttattgtatcaggatgaggaagcgttgaacgactctattatcagcggcaccttgccgcgaaagtgcaagaaagaacttcttgccgtgaagttacgaaaccgtccatccaagcaggaattggaggaccgaaatatcttccctcggagaacagatgaggaacggcaggaaattagacagcaaatcgaaatgaaactgtccaagagactgtcccagcggcctgcggtggaggaacttgagcggcgaaatatactgaagcaacgcaacgatcagacggagcaggaagagcgccgtgagatcaagcagcggttgactcggaagttaaaccagcgccctaccgtggacgagctgcgcgataggaaaatcctcatccggttctctgattatgtcgaggtagccaaagcgcaagattatgacaggcgggctgataagccctggactcgccttagcgcagcagacaaggccgcaataaggaaagagctcaatgaatacaagtctaacgaaatggaagtgcacgcctcttcaaaacatctgacaaggttccataggccttag

SEQ ID NO: 23833 - DNA, 126 bp, Artificial Sequence
  Description of Artificial Sequence: Synthetic coding sequence
atggcggcttcagaggatggttctggctgtcttgtatcgagaggaaggtcccaaagcgatcccagtgtgttaaccgattcctccgcaacatcttccgcagacgctggagaaaatccggatgaatag

SEQ ID NO: 23834 - DNA, 1557 bp, Artificial Sequence
  Description of Artificial Sequence: Synthetic coding sequence
atggaccaaactcctcccgcacgccctgaatatctggtgtcaggcattcgaacacccccagttcgaaggaattcaaaactggctactttgggccgtatttttaagccctggaagtggcgcaagaaaaagaatgagaagcttaagcagactaccagcgccctggagaagaagatggccggtcggcagggacgcgaagaactcatcaagaaagggctgctggaaatgatggagcaggatgccgagtccaagacttgcaatcccgatggaggaccacgctcagtgcagtctgagcctcccactcccaaaagtgaaaccctgacatccgaagacgctcagccaggatccccattggcgaccggaaccgaccaagtgtcccttgataaaccgctgagttcagctgcccatctggacgatgcagccaaaatgcctagcgcttccagcggtgaggaggcagacgcgggaagcctgctgcccaccaccaatgagttatctcaagccttggctggcgctgattccctggactcgccacccagacctctggaaagaagtgtgggacagttgccctccccaccactcctacccacccccccaccaaaggcttcttccaaaaccactaaaaatgtgaccgggcaggcaactcttttccaggcttcttccatgaaatctgcggacccctccctgagggggcagctgtcaaccccgacagggtctccacacctgacaaccgtgcaccggccacttccaccttctcgtgtgatcgaggaactccatcgggctcttgcaaccaaacatcggcaggattcattccaggggagggaaagcaaggggtcacctaaaaaacgcctggacgtgcggctgtcaaggaccagcagtgtagagagaggcaaagagagggaagaagcatggtcttttgatggcgctctggagaacaagagaaccgcagccaaagagtcggaggagaacaaggagaatctaattatcaattcggagcttaaggacgatttgcttctctatcaggacgaggaagccctgaacgactccatcataagcgggacccttcccaggaaatgcaaaaaagagctgttggcagtaaagttgcgaaacaggcccagtaagcaggagttggaagatcggaatatctttccacggaggaccgatgaggaacgccaggagataaggcagcagattgagatgaagttgtcaaaaagattatctcaacgtcccgctgtggaggagcttgaaagaaggaacatccttaagcagagaaacgatcagacagaacaggaggaacggagggagattaaacaaagactgacccggaagctcaaccagcgccctaccgtagatgagctgcgggatcggaaaattcttattcgcttcagcgactatgtggaggtcgcaaaagcccaagactatgatagaagagccgacaaaccctggaccaggttgtctgccgctgataaagccgcaatccgcaaggagctgaacgagtataagtcgaacgagatggaggtgcacgcttcatctaagcacctcactcggtttcataggccctag

SEQ ID NO: 23835 - DNA, 2430 bp, Artificial Sequence
  Description of Artificial Sequence: Synthetic coding sequence
atgtacgaggccttgcccggacctgcaccagaaaacgaagacggtctcgtcaaagtcaaggaggaagacccaacctgggagcaggtgtgtaacagccaagaaggaagttcccacacccaagagatatgtcgtttgcgcttcaggcacttttgttatcaagaagcacacgggccacaggaggctctggcccagctgagggaactatgtcatcagtggcttcgaccggagatgcataccaaagagcagattatggagctgctggttctagagcaatttttaaccatattgcctaaggagctgcagccgtgcgtcaagacttatcctctggagagcggtgaggaggccgtcacggttttagaaaaccttgagacagggtcaggcgacacggggcagcaggcttccgtgtatatccaaggccaggatatgcatcctatggtggcggagtatcagggcgtctccttggagtgtcagtctctgcagctgctgccgggtatcacgactctaaaatgtgaaccgccacagcggcctcaggggaaccctcaggaagtcagcggacccgtaccacacggtagcgcccacctccaggagaaaaaccccagagacaaagctgtggtgcccgtcttcaaccctgttcggtcacagacgttggtgaaaaccgaagaagagaccgcacaggccgttgccgcagagaagtggagccatttgtctctgacccgacgcaacctatgcgggaactctgcccaggagaccgtgatgtccctgtcccccatgaccgaagaaatcgtgactaaagacagactctttaaagctaaacaggagacctccgaggagatggaacagtccggtgaggcttccggtaaacctaaccgggagtgtgccccacagatcccctgcagtacccctatcgccacggagcgaactgtggcacacctcaacacactgaaggaccgccaccctggcgacctctgggcccgaatgcatatttcaagccttgagtatgccgcaggcgatatcacccgaaagggacgcaaaaaagataaggccagggtgtcagagctgctgcagggtctctctttcagtggtgactctgatgtggaaaaggataatgagcctgagatccagcccgctcagaaaaagctgaaggtgtcatgttttccagaaaagagctggacaaaaagagatatcaaaccgaatttcccctcatggagcgctctcgactcaggcttgctgaatttgaaatcagaaaagctgaaccctgtcgagctgtttgaattatttttcgatgatgagaccttcaacctgattgttaatgaaacgaacaactacgcaagccagaaaaatgtctcactggaggtgacagtgcaggaaatgagatgtgtctttggcgttctactgctgagtggctttatgcgacacccccgtcgggagatgtactgggaagtgagcgatactgatcagaatctggtgcgagatgcgatccggcgtgatcggtttgagctcatcttctctaacctgcacttcgcagataatggacacctggaccaaaaagataagttcacaaaactgcgtccactgattaaacagatgaacaagaatttcttgttatatgcacccctagaggaatattactgtttcgacaagtcaatgtgcgagtgcttcgacagtgaccagttcctgaatggtaagcctattagaataggctacaaaatttggtgcggcaccaccacacagggatatttggtgtggttcgagccttaccaggaggagagcacaatgaaggtggatgaagatcccgacctggggctggggggaaatcttgtcatgaactttgctgacgtcctgcttgagagaggacagtacccttatcacctgtgcttcgatagttttttcacatcggtgaaactactctccgcattaaaaaaaaagggtgtgagagctacgggaaccatacgtgaaaacaggactgagaagtgtcccttgatgaacgtggaacacatgaaaaaaatgaaaaggggctatttcgattttaggatcgaggaaaacaatgagattatcttgtgtcgatggtatggcgatggtatcatttcactctgcagcaatgcggtgggcatcgagcctgtgaacgaggttagttgctgtgacgccgataatgaggagatcccccagatatctcagccaagcattgttaaggtgtacgatgagtgcaaagagggagtggcaaaaatggatcaaatcatcagtaaatatagagtacggatcagatcgaaaaagtggtactcaatcttggtatcctacatgatcgacgtggcaatgaacaatgcctggcagctgcaccgggcatgtaaccccggagccagcctggaccccctggattttcggaggtttgtggcccacttttatctggaacataacgcgcacctcagcgattag

SEQ ID NO: 23836 - DNA, 2430 bp, Artificial Sequence
  Description of Artificial Sequence: Synthetic coding sequence
atgtacgaagccctgccaggtcccgcaccagagaacgaagatggcctggtcaaggtaaaagaggaggatcctacctgggagcaggtgtgtaactcacaagagggcagctcccacacccaagagatctgtcgcctgagattccgacacttttgttatcaggaggcccacgggccacaggaggccctcgcccaactccgggaactctgccatcagtggctgaggcctgagatgcatacgaaggagcaaattatggagctgcttgtgctggaacagtttttgactatattgcccaaagagctccaaccttgtgtaaagacatatccattagaatccggggaagaggcggtaacggtgttggagaacctggaaaccggttccggtgacacaggccagcaagcaagtgtgtatattcagggccaggacatgcacccaatggtggcagagtaccagggggtcagcttagaatgccagagcttgcaattattgccaggtatcaccacactgaagtgcgagccccctcagcgtcctcagggtaatcctcaggaggtgtccggtcctgttccccatggctcagctcacctacaggagaagaatccgagagataaagctgtcgttcccgtatttaacccggtgagaagtcagactcttgtgaaaacagaagaggaaaccgcccaagccgtggctgctgaaaagtggtctcaccttagtctgacaagacggaacctgtgtggtaacagcgctcaggagaccgtaatgagtctttctcctatgacagaagaaattgtaacaaaggaccgccttttcaaagctaaacaggaaacatctgaagaaatggagcagtctggcgaggcttccggcaagcctaatagagaatgcgcaccacagatcccctgctcaacaccaatcgctaccgagcggactgtggctcatctaaacacgcttaaggatcgacatcctggagacctgtgggctcgcatgcacatctcatcactcgagtatgccgcaggagacataacccgcaaaggaaggaagaaagacaaagctagagtttctgagctgcttcagggtttatcgttttctggggattcagacgttgaaaaagacaacgagccggaaattcagccggctcagaaaaagctgaaagtgagctgctttcctgagaaatcctggaccaaacgcgacattaagcccaatttccccagctggagcgccctagacagcggactcctaaatctaaaaagcgagaagctgaacccagtcgaactgtttgagctgttctttgatgacgaaacattcaacttgattgtcaacgaaaccaacaattacgcctcccaaaaaaatgtcagcctggaagtaactgtccaggagatgaggtgcgtattcggggtgctgttactttctggctttatgcggcatccacgcagggaaatgtattgggaagtgtccgataccgatcagaacctcgttcgggatgcaatccgacgggaccggttcgagctgatcttttccaacctgcattttgcagataatggtcatctggatcaaaaggataaattcaccaagctgagaccactgatcaaacaaatgaacaagaatttcctactgtatgccccattggaagagtattactgctttgacaagtctatgtgtgaatgtttcgattctgatcagtttctaaatggtaagccaatccgcattggctataagatctggtgcggtacgactacccaaggatacctcgtgtggttcgaaccgtatcaggaggaatcaaccatgaaggtcgatgaggatcctgatttagggttggggggaaacttagtgatgaacttcgctgatgtcctgttggagcggggacagtatccgtaccatctgtgctttgattctttctttacatctgtgaagctactgtctgccctgaaaaaaaagggggtccgcgcaaccggcaccatccgtgagaaccgcaccgagaaatgccccctcatgaatgttgaacatatgaagaaaatgaaacggggttatttcgatttccgcatcgaagagaacaatgaaatcattctctgtcgttggtacggtgacggcattatttcattgtgtagtaatgcagtggggattgagcccgtgaacgaggtaagttgctgcgacgcagacaatgaagagatcccgcaaatcagtcaaccgagtattgtgaaagtttatgatgaatgtaaggaaggagtggccaagatggaccagattattagcaaatatcgcgttcgcatcaggagcaaaaaatggtacagcattctcgtctcctatatgattgacgtagctatgaataacgcatggcaactgcaccgcgcttgtaatccaggtgccagcctggatcctcttgacttccgtcgcttcgtggcacacttctatctcgagcacaacgctcaccttagcgattag

SEQ ID NO: 23837 - DNA, 2418 bp, Artificial Sequence
  Description of Artificial Sequence: Synthetic coding sequence
atgtgggatcaggggggacagccttggcaacaatggccattgaatcagcagcagtggatgcaatcattccagcaccaacaggatccatctcaaattgactgggccgctctggcgcaagcctggatagcacagcgcgaagcatcaggtcagcagagcatggtggagcaacctcctgggatgatgcccaacggccaggatatgtcgacaatggaatccggacctaataatcatggtaacttccagggagacagtaacttcaaccgaatgtggcagccagaatggggcatgcaccaacagccccctcacccccctcctgaccagccctggatgccaccaacccctggcccaatggacatcgtcccaccttcagaggactccaattcccaagactcgggcgagtttgccccagataatcgccacatctttaaccaaaacaatcacaactttgggggtcccccagacaatttcgccgtgggtcctgtaaaccagttcgattatcaacacggggctgccttcgggccacctcagggcggattccatccgccttactggcagccaggcccaccagggcctccagccccaccgcagaatagaagagaaagaccatcctcctttcgagaccgccagaggagccctattgcattacccgtcaagcaagagcctcctcaaattgatgctgtcaagcggaggacactgccggcatggatccgcgaaggtctggaaaaaatggaacgagaaaagcaaaaaaagctggagaaggagaggatggagcagcaaaggagccagctgagcaagaaggagaagaaagccaccgaggatgccgaggggggagacggtcctaggctgccgcagaggtctaagtttgactccgacgaggaggaagaagataccgaaaacgttgaagccgcaagcagcggcaaagttactagatcgcctagtccagtcccgcaggaagagcacagtgaccctgaaatgacagaggaggaaaaagagtaccagatgatgcttttgaccaaaatgcttctgactgaaatcctcctggacgtgacagatgaagagatctactatgttgccaaagatgctcacagaaaagccaccaaagctcccgctaagcagctggcccagagtagcgctctcgcttctctcacagggctgggtggcctaggaggttacgggtctggagattctgaggatgagcgatccgatagaggtagtgaaagttccgacactgacgatgaagagttacggcaccgtatcaggcagaagcaagaagcattctggagaaaggaaaaggaacagcagctgctgcacgataaacagatggaagaggagaagcagcaaaccgaacgagttacgaaggagatgaatgaattcatccacaaggagcaaaatagcctctctctcctcgaggcgcgagaagcagacggcgatgttgtaaatgagaagaaacgcaccccaaatgaaactacgtctgtgctggaaccaaagaaagagcacaaggagaaagagaagcaggggaggtccagatcaggaagcagctcctcagggagtagtagtagcaatagcaggacttcttccacttcttccaccgttagcagcagcagctattctagttccagcggctcctctagaactagcagccggagctcctcaccgaaaagaaaaaagagacattctcggagccggtcccccaccatcaaggcacggcgttcaagaagccggagttactcccggagaattaagatcgagtctaaccgcgctcgcgttaagattcgggataggcgaaggagtaacaggaattcaatcgagcgggaacggagaaggaataggtcccctagtagggagaggcgcaggtcacgctcacgcagtagagaccggcgaaccaaccgagcttcaagaagcaggtctagggatagacgcaaaatcgacgaccaacgcggaaacctgtcagggaactctcataaacacaagggtgaagccaaagagcaggagcggaaaaaggaacggtcccggtctatcgataaggatagaaaaaagaaggataaggaacgcgaaagggagcaggacaagcgtaaagagaaacagaagcgagaagagaaagacttcaagtttagttctcaggacgacagactgaagcggaaacgtgaatccgaaagaacattctcaagatccggttctatctcggtcaagatcatcaggcatgattcccggcaagattcaaaaaaaagtactaccaaggattcgaagaaacattctggcagtgactcatccggacggtcgtcatccgaatccccgggatctagcaaagaaaaaaaagccaaaaagccgaagcacagtcgctctcggtctgtcgagaagtctcaacggtcggggaagaaggcctctcgaaagcataaatccaagtctagatcacggtag

SEQ ID NO: 23838 - DNA, 2418 bp, Artificial Sequence
  Description of Artificial Sequence: Synthetic coding sequence
atgtgggatcaaggcggacagccatggcagcagtggccccttaatcagcagcagtggatgcagagctttcagcaccaacaagatcccagccagatcgactgggctgctctcgcacaagcctggatcgctcagcgggaggccagtggacagcagtcaatggtcgagcaacctcctggtatgatgcctaatggacaagacatgtctaccatggaatccggcccaaataatcatggcaactttcaaggggactccaactttaatcgcatgtggcagcctgagtgggggatgcaccagcagccgccacacccccctccagaccagccatggatgccccctacccctgggccaatggatattgtgccacccagcgaagatagcaacagccaagactccggagagttcgccccagataacaggcatatcttcaatcagaataatcataacttcggtgggccacccgacaactttgctgtgggtccagtgaatcagttcgactatcagcacggcgcagcctttggacctccacagggagggtttcaccctccttactggcagcctggacctcctggccctcccgctccgcctcagaaccgacgtgagagaccttctagtttcagggatagacagcggtctcccattgctttaccagtgaaacaggagccaccgcaaatagacgctgtgaagcggcgtacactcccagcatggattcgtgagggtctagaaaaaatggagcgcgagaaacaaaagaagctggagaaggaacggatggaacagcagagatcccagctctcaaaaaaggaaaagaaggccactgaggatgccgagggtggcgatggaccaaggctcccacagcgctcaaaattcgattcagatgaggaagaagaagacactgagaatgttgaagctgcttcttccggaaaggtcactcgctccccttcaccagtcccgcaagaagaacactcagacccggagatgactgaggaggaaaaagagtatcaaatgatgttactcactaaaatgcttcttactgagatcctgcttgatgtgactgacgaagaaatttactacgttgccaaggatgcccacagaaaggcgacaaaggctcctgcaaaacaattggcgcagagctccgccctggcttccctaacgggattgggagggctcgggggatatggctccggagatagtgaggatgaacggtccgatcggggatcggagtctagcgatacagatgacgaagagctcaggcaccggatacgacagaaacaggaagccttttggcgtaaggagaaggaacaacaattgctccatgacaaacagatggaagaagagaaacagcagactgaacgcgtaacaaaggagatgaacgagtttatacataaagagcaaaattctctgtctcttctggaggccagggaggcagatggcgacgtagtcaacgagaaaaaacgtactccgaacgaaactacaagcgtactggagcctaagaaggaacacaaggaaaaagaaaagcaggggagaagccgatccggatcttctagcagcggctctagctcgtcgaatagcagaacatcatctactagctctaccgtgagttctagtagctatagctcctcaagtggaagctcacgcacctcttcaaggtcgagcagcccaaagaggaaaaagcgacacagtcggagccggtcgccaacaattaaggctagacgaagtcgctctagatcctactccagaaggatcaagatcgaaagcaatagagccagggtcaagatcagagaccgtcggaggtccaataggaactctatagaacgggaaagacgcaggaaccgaagtccttcacgggagcgcagaagatctagatctcgcagccgcgatcgtagaacgaaccgagcttccagatccagaagtcgcgacaggcgaaagatcgacgaccagcggggaaacctgagtggaaattcccacaaacacaagggagaagccaaagaacaggagaggaagaaggaacgatccaggtctatcgacaaggatcggaagaaaaaagacaaggaacgcgaacgagaacaagataagaggaaggaaaagcagaagcgagaagaaaaagacttcaaattcagttcccaggatgaccggttaaagagaaaacgcgagtctgagagaacctttagtagaagtggcagcataagcgtcaagataataagacatgacagtagacaagactctaagaagagcaccaccaaagactcaaagaaacattctggctctgattcttcggggcgtagttcttctgaaagccctggatccagcaaagaaaaaaaagctaaaaaaccaaagcactcacggtcgagaagtgttgagaaaagccagaggtcggggaagaaggcctctcgaaaacacaagagtaagtctcgcagtcggtag

SEQ ID NO: 23839 - DNA, 1830 bp, Artificial Sequence
  Description of Artificial Sequence: Synthetic coding sequence
atggagtccaccgcttatcccctgaatttaagtttaaaagaagaggaagaagaggaggagattcaatctcgggagctggaggacgggccagcagacatgcaaaaagtgcgtatctgcagtgagggtggttgggtgcctgccctcttcgatgaagtggctatttatttcagcgatgaggaatgggaagtattgacagaacaacagaaagcattgtaccgggaggtgatgaggatgaactacgaaacagtgttgtccctcgaattcccattccccaaaccggacatgattactcgcctcgagggtgaagaagaatcccagaattccgatgagtggcaactgcaaggtggaactagcgcagagaacgaagagagcgatgtgaaaccccctgactggccgaacccaatgaatgcaacgtcacagtttccccaacctcagcatttcgactccttcggactgaggcttccgagagatatcactgagctgcccgaatggtccgaaggataccctttttacatggccatggggtttcccggttatgacctctcggcggatgacattgcgggaaagttccagttctcccggggaatgagacgatcttatgacgcgggtttcaagctgatggtggttgagtatgccgagtctacaaataactgccaggctgccaagcagttcggagtgttggagaagaatgtgcgagattggcggaaagtgaaaccccaattgcagaatgcccatgccatgcggagagccttccggggacccaaaaatggtcggtttgccttggtggatcagcgagtagctgaatatgtgcgatacatgcaggccaagggtgatcctatcactcgtgaagccatgcagctcaaagccctggaaatcgcccaggagatgaacatacctgaaaaaggcttcaaggcttcactgggctggtgcaggcggatgatgcggagatacgacctgtctctccggcacaaggtccccgtaccacaacatcttccagaagacctcacagagaaattagtgacctaccagaggtcagtcctagccctcagacgggcacatgactacgaagtggcacagatgggaaacgcagatgagactcccatctgcttagaggttccatccagagtcaccgtagataaccagggagagaagcctgtactggtgaagaccccaggacgagagaagctcaaaatcacagctatgctcggggttctggccgatggcagaaagctcccgccatacattatcctgagggggacctatattcctcctggcaagttcccgagcggaatggagatcagatgtcatagatatggatggatgaccgaagatctgatgcaggactggctggaggttgtctggagacgaaggactggggctgtacctaaacagcgagggatgttgatactgaatggcttccggggtcacgcaacagacagcgtcaagaactccatggagtccatgaatactgatatggttatcataccagggggtttgacttctcagctccaagtactggacgttgtggtgtacaagccacttaacgactcagtaagggcccagtattcaaactggctcctggccggaaatctcgcgctgagccctactgggaacgctaaaaagcccccattgggactatttctagagtgggtcatggttgcatggaattctatctcctcagaatctatagtacagggattcaagaagtgccatatttcctccaaccttgaggaagaagacgacgtgctttgggaaatcgagtctgagctccctggcggaggggagcctcccaaggattgtgacaccgagtccatggccgagtccaattag

SEQ ID NO: 23840 - DNA, 1830 bp, Artificial Sequence
  Description of Artificial Sequence: Synthetic coding sequence
atggaatctactgcatacccgttgaacctctccctgaaagaggaagaggaggaagaagagatccaatccagagaacttgaagatggccctgctgacatgcagaaagtccgaatttgcagcgaggggggatgggtgcctgctctgttcgatgaagtcgctatttatttcagcgatgaggagtgggaggtgcttaccgagcaacagaaagcattgtatcgagaagtcatgcggatgaattacgaaactgttctctcactggagtttcccttccccaagccagacatgatcactcgactcgaaggtgaggaagaatcccagaacagcgatgagtggcagctgcagggcggtacttcagccgagaacgaggagagcgacgtcaagcctccagattggcctaatcctatgaacgctacctcgcagtttcctcagccacaacatttcgattctttcggtctgcgcctgcctcgtgacataaccgagctgccagaatggtccgaagggtacccgttttacatggcaatggggtttcctgggtacgacctctcggccgacgatatagccggtaagttccagttttccagaggaatgcggcgtagctacgatgctggatttaaactgatggttgtcgagtacgccgagagtaccaataactgtcaggcagccaagcagtttggggtgctcgagaaaaatgtccgggactggcgtaaagttaagcctcagcttcagaacgcccacgccatgcgccgagccttcagggggccaaagaacggcaggtttgcgttggtcgaccagcgagttgctgagtacgtgcgttacatgcaagccaagggggacccaatcactcgcgaggctatgcagttgaaggccctggagatcgcacaggagatgaatatccccgaaaagggcttcaaggcaagccttggctggtgtcggcgaatgatgcgtaggtacgatctgtctcttcggcataaggtcccggtgccccagcacctccccgaagacctgacagagaaattagttacataccagagatcggtgcttgcgctccgtcgtgctcatgactacgaggttgctcagatggggaacgctgacgagactcccatctgtctggaggtcccgagtagagttaccgtggacaatcagggcgagaaaccggtcctcgtgaaaactcccggtagagagaaactgaaaattacggccatgctaggcgtgttagccgatgggagaaaattgccgccatacatcatcctcagggggacatacataccaccaggcaagttcccttccggaatggagattaggtgtcatcgctacggatggatgacggaggacctcatgcaggactggcttgaggtggtgtggcgtcgcaggactggggcagtaccgaaacagaggggaatgcttatccttaacggttttaggggccacgccacagatagcgtgaagaatagcatggaaagtatgaacaccgatatggtcataatcccaggaggccttaccagccaactacaagtcctcgatgtagttgtgtacaaacctctaaacgacagtgtccgcgcacagtattctaattggctactagctgggaaccttgcactttccccaaccggaaacgccaaaaagcctcccctgggtttgtttctggagtgggttatggttgcctggaacagtatttcttctgaatcaatcgttcaaggttttaagaaatgccacatcagttccaatctcgaggaagaagacgatgtcctgtgggagatcgagtccgaactgccgggtggaggggagccgcctaaggactgcgacaccgagtccatggccgagtccaactag

SEQ ID NO: 23841 - DNA, 630 bp, Artificial Sequence
  Description of Artificial Sequence: Synthetic coding sequence
atggagagcaccgcctatcctttgaacctgtctttaaaggaggaggaggaggaggaggaaattcagagtagagagctcgaggacgggccagcagacatgcagaaggtcaggatttgttcagaaggcggttgggttccagctctgttcgatgaagtggctatttactttagcgacgaggagtgggaagtgctaactgagcaacagaaagcactctacagagaggtgatgcgaatgaactatgagactgtgctttctctcgagttcccattcccgaagcccgatatgattactcgactggaaggagaggaggaatcacaaaactcagatgaatggcagctgcagggcggaacctccgctgagaacgaggaaagtgatgttaaaccgcctgactggcccaaccctatgaatgccacgagccaattcccccagcctcagcatttcgatagctttggtcttcgtctcccaagggatattactgagctgcccgagtggtccgaaggctacccattttatatggccatgggattcccgggatacgatctgagcgctgacgacattgcagggaagttccagttctctaggggcatgagaagatcatacgatgccggattcaagctgatggtggtttag

SEQ ID NO: 23842 - DNA, 1575 bp, Artificial Sequence
  Description of Artificial Sequence: Synthetic coding sequence
atggagtttccctttcccaagcccgatatgataacacgacttgagggggaggaagaaagtcagaacagcgacgagtggcagctgcaggggggaacctcagccgagaatgaggagagcgatgtgaagcctcctgattggccaaatcctatgaacgccacgagccagtttcctcagccccagcactttgacagcttcggcctcagactccctagggacattaccgagctgcccgaatggagcgaaggctaccccttctacatggctatggggttcccagggtacgatctcagtgctgatgatatcgccggaaagtttcagtttagtaggggaatgcggaggtcatatgatgccggattcaagctgatggttgttgagtatgccgagtctactaataattgtcaggccgctaaacagtttggcgtgcttgaaaagaacgtgagggactggagaaaagtcaagccacagctgcaaaatgcccacgctatgagaagggctttcaggggcccaaaaaatggcaggttcgctctggtggatcaaagggttgccgaatatgttagatacatgcaggcaaagggggatccaattactagagaggctatgcagctgaaagccctagaaatagcccaagaaatgaatatccctgaaaaaggattcaaagcttccctgggttggtgccggaggatgatgcgtaggtacgatctgagtctacgccacaaagtcccagtaccccaacacctacctgaggatttaaccgagaaactcgtgacttaccagagatccgtcctggcattgagaagagcccatgattacgaggttgcacagatgggaaatgctgacgaaaccccaatatgcctggaggttccttcaagggtgactgtggacaaccagggtgagaaaccggtgttggttaaaacgccaggaagggagaagctcaaaataacagccatgctcggtgtgctcgcagacggaaggaagctgccaccatacattattctccgcggtacctacatcccgccaggcaaatttccttcaggcatggaaattcgctgccacagatacgggtggatgaccgaggacttgatgcaggactggctggaagttgtctggagacgccgaacaggggctgtgcctaaacaacgtggcatgcttatcctaaacggattccgtgggcacgccacagactccgtcaagaatagcatggagagcatgaacacagatatggtgattatccctggaggactgacgtcccagctgcaagtgctggacgttgtcgtgtataaacctctcaacgacagcgtgagggcccagtatagcaattggctgttggccggtaacctcgccctctcacctacaggaaatgcgaagaagcccccactgggactatttctggaatgggtaatggtcgcatggaactcgatcagtagcgagagcatcgtgcagggcttcaaaaagtgtcacatatcttccaatctagaggaggaagatgatgtcctgtgggagattgaatcagaacttccaggtgggggtgagcccccaaaggattgcgacaccgagtccatggcagaatccaattag

SEQ ID NO: 23843 - DNA, 2211 bp, Artificial Sequence
  Description of Artificial Sequence: Synthetic coding sequence
atgaaggagatgtctgctaacaccgtgcttgacagccaacggcagcaaaagcattatggaattaccagcccgatctccctcgcctcacctaaagaaattgaccatatttatacacagaaactcatcgatgctatgaagccattcggcgtttttgaggacgaggaagaacttaaccatcgactggtcgtgcttggcaagctgaacaatttggtgaaggaatggatttccgatgtgagtgaaagcaagaatctacctccttctgtggtggcaaccgtggggggaaaaatcttcaccttcggctcctacagactgggcgtgcacaccaagggagcggacattgatgccctttgcgtggctccgagacatgtggaacgctctgatttcttccagtccttcttcgagaagctcaagcatcaggacgggatacgtaacttacgagccgtggaggacgcattcgtacctgtaatcaagtttgaattcgacggtatcgagatcgatctcgtgttcgcgaggctcgccattcagaccataagcgacaacctggatctgcgggacgatagcaggttgagaagtcttgatataaggtgtatccgctctctgaacggctgtcgggtgactgatgagattctgcacctcgtccctaacaaggagacttttcggctgaccctccgggcagttaagctatgggcgaagcggcgtggtatctattcaaacatgcttggatttctggggggtgtttcctgggccatgctcgtcgccaggacctgccagctctacccgaatgccgctgcttccactttggtgcacaagttttttctcgtatttagcaaatgggagtggccaaatcctgtgctcctgaaacagccagaagagtcaaatctgaatcttcccgtgtgggaccccagagtgaacccttctgatcggtaccacctaatgcccattatcacccccgcttatccacagcagaactctacgtacaatgtgtccacaagcacaaggactgtaatggtggaggagtttaaacagggacttgccgtgacagatgagatcttgcagggcaagagtgattggtctaaactcttagaaccaccaaatttcttccagaagtataggcactatattgtccttacagcatccgcttccacagaagagaatcacctggagtgggttgggctcgtggaaagtaagattcgtgtgctggtcggtaacctggagcgtaatgagttcattacgttggcgcacgttaacccacagagtttccccggaaacaaagagcaccataaggacaacaactacgttagcatgtggttcttagggataatcttcaggagagtggaaaatgctgagagcgtgaacatcgatctgacctatgatattcagtcgtttaccgatacggtttaccggcaggcaaacaacatcaatatgctcaaagagggcatgaagattgaagctacccacgttaaaaaaaaacaactccaccattatctccccgctgaaatcctccagaagaaaaaaaagcagagcttgtcagacgttaacaggagctctggcggactgcagtctaagagactgagtctggacagcagctgcctggatagcagtcgcgatacggacaatggcactccctttaacagtccggcatctaagtcggattccccgtctgtaggtgaaacagagaggaactctgctgagccagccgctgtgattgtcgaaaagcctctgtcagtgcccccagcacaggggctttccatccctgtcattggagccaaggtggattcaacagtgaagacagttagtcctcctaccgtgtgtactattccaacagtggtcggcagaaatgtgattccgagaattacgaccccacacaaccccgcacaggggcagccccaccttaatggaatgtctaatattaccaagacagtcacccccaaacggtcccacagccccagcattgatggaacgcccaaaaggctgaaggacgtggaaaaattcattcgactggagtccacattcaaagatccccgtactgcagaggaacgaaaacgaaagtctgtggacgcgataggcggagaaagtatgcctataccgaccatcgatacaagccggaaaaagagactgccatctaaagaattacccgacagctcctccccagtaccagctaacaatatccgagttatcaagaattcaatccggttgactcttaacagatag

SEQ ID NO: 23844 - DNA, 1212 bp, Artificial Sequence
  Description of Artificial Sequence: Synthetic coding sequence
atgcccatcattacaccggcatatcctcagcagaattccacctacaatgtttcaacctcaaccagaaccgtgatggtggaagaatttaagcaggggttggctgtcacagatgagatccttcaggggaagtccgactggtccaagcttctggagccaccaaatttcttccagaaatataggcactacatagttttaactgcgagcgcctccacagaggagaaccatttggaatgggtgggcctggtcgaatctaaaatcagagtgcttgtcgggaatctggaaaggaatgagttcatcacactggcccacgtgaacccacagtcttttcccggtaacaaagaacatcacaaagataataattatgtttccatgtggttcttgggcattatctttcgcagggtggaaaatgccgaatcagtgaatatcgacctgacctacgacatacagagcttcaccgataccgtctaccgccaagcaaacaatatcaacatgctgaaagaaggcatgaagattgaggctacgcacgtcaaaaagaagcagctgcatcactaccttcccgcagaaattctgcagaagaagaaaaaacagtccctgtccgacgtgaatcggtcctcggggggactccagagtaagcgactgtcactggatagctcatgcctggactctagtagagacacagataacggaactcccttcaactccccagctagtaagtctgactcacctagcgtgggagaaactgaacgtaactctgccgagccagccgctgtcattgttgagaagccactctctgtcccccctgcgcagggactgtcaatccctgtgatcggggcaaaggtcgattccacagtgaaaacggtttctcctcctaccgtgtgcaccataccaacggtggtaggcaggaacgttatcccacggatcacgaccccccacaacccagcccaagggcagcctcaccttaatggaatgagtaacatcaccaaaactgtgacacccaagcggtcgcactctcccagtatcgatgggacacccaagcgcctgaaagacgtcgaaaaggacgctattggcggagagagtatgccaatcccaacaattgacacctccaggaagaaaaggctgccgagcaaggaactgcctgacagtagctctcctgtccctgccaataacatccgggtgatcaagaatagcatacgcctgaccctgaatcgctag

SEQ ID NO: 23845 - DNA, 1149 bp, Artificial Sequence
  Description of Artificial Sequence: Synthetic coding sequence
cggactgtgatggtcgaggaatttaaacagggcctggctgtgaccgacgagattctgcagggtaagagcgattggtctaagctgctcgaacctcctaatttctttcagaaatacaggcattacatcgttttaactgcctccgcctccaccgaagagaatcacctggagtgggtaggactggtggagtccaaaatcagggtacttgttgggaacctggagaggaatgagttcatcaccctagcacatgtgaatccccaaagctttcctggaaataaggagcatcataaagacaacaattatgtctcaatgtggttcctgggcatcatctttaggagagttgaaaacgcggagtccgtgaacatcgatctgacttacgacatccagtcctttacagataccgtctaccggcaggctaacaacatcaacatgctcaaagaaggaatgaagattgaggcgacacacgtcaaaaagaaacagcttcatcattacttgcccgctgagatcctgcaaaagaaaaagaagcagagcttgtctgatgtcaaccggtccagcgggggtttgcagagcaaacgcctgtcactggacagcagctgtctcgatagcagccgggacaccgataatggcaccccctttaatagccctgctagcaaatccgattctccatctgttggtgagacggagcgcaatagcgccgagcctgcagcggtcattgtggagaagcccctatccgtgccccctgctcagggtctgagtatcccagttatcggggcaaaggtggatagcaccgtgaagacagtatctcctcccaccgtttgcactatcccgaccgtcgtgggtcgaaatgttatccctaggataactacaccacataaccccgcacaggggcagccccatcttaatggcatgtctaatatcaccaagaccgtcacaccaaagagaagccactcgccatctatcgacggcactcctaaacggttgaaggacgtcgaaaaagacgccattggcggtgaatccatgcccatcccgaccatcgataccagcaggaagaaacggctgccttccaaggagctccctgactcctcatcccctgtgcccgctaataatatccgggtgattaagaattcgattaggctaacgctgaatcgctag

SEQ ID NO: 23846 - DNA, 642 bp, Artificial Sequence
  Description of Artificial Sequence: Synthetic coding sequence
atggcagtcttatccgcccctggactgagaggctttcggatcctggggttgagaagctccgtgggaccagcggtccaggctcggggtgtacatcagtctgtggcaaccgacggcccttcttcaacacagccagcgctgccaaaggcaagagccgtggcgcctaagccttcgtccagaggcgaatacgttgtggcgaagctcgacgacctagtcaactgggcacggaggagctcactgtggcctatgacctttggccttgcctgctgcgctgtggagatgatgcacatggccgctccgagatacgatatggacagatttggagtagtattccgcgcatcacctcgtcagtcagatgtgatgatcgtggccggaactttaaccaataaaatggcccctgctctccggaaggtgtacgaccaaatgcccgaacctcggtacgttgtgtcgatgggatcttgtgccaacgggggaggctattatcattactcgtattctgtcgttagaggctgcgaccggattgttccagtcgacatatacatccccggttgccccccaactgcagaggctctcctctatggcattctgcaattgcagaggaagattaagagagaacgtaggctgcagatctggtataggcggtag

SEQ ID NO: 23847 - DNA, 1035 bp, Artificial Sequence
  Description of Artificial Sequence: Synthetic coding sequence
atgcaccggactacacgcatcaaaattacagagctgaatccccacctgatgtgcgccctgtgtggaggctacttcattgacgcaaccaccatagttgaatgtcttcatagcttctgcaagacttgtatcgtgagatatctcgaaactaacaagtattgccctatgtgtgacgtgcaggtccacaagacccgcccacttctgtcaattagatcagataaaacattacaagacatcgtctacaagctggtgccgggtctctttaaggatgaaatgaaacgaagaagagacttctatgctgcatacccattaactgaggttcctaatgggagtaacgaggaccgcggagaggtgctggagcaggaaaagggcgctctttctgacgatgaaattgttagtctgtcaattgaattctatgaaggcgcacgcgaccgggacgaaaagaagggaccactggagaatggggatggggacaaagagaaaaccggtgtgagattccttagatgccccgctgcaatgacggtcatgcacctggctaaatttttgcgaaataagatggatgttccgagcaagtataaagtggaagtcttatatgaagacgagccccttaaagagtattacaccctcatggacatcgcttacatttatccctggaggcgaaatggaccgctgcctctgaagtaccgcgttcagcccgcttgcaagcgactgacattggccactgtcccaacaccatctgaaggcactaacactagcggagctagcgagtgtgagtccgtgagcgataaagccccttctccggctacactgcctgctacttcctccagcctcccctctccagccacgccctcccatggtagccctagttcacacggaccacccgcaacccacccaacgtctccaacccctcccagtacagcgtctggagcgaccactgccgcaaatggtggaagtcttaattgcttgcaaacccccagttcgacaagcagaggcaggaagatgaccgtcaatggtgccccagtccccccactgacatag

SEQ ID NO: 23848 - DNA, 729 bp, Artificial Sequence
  Description of Artificial Sequence: Synthetic coding sequence
atgctgacccggaagatcaagctgtgggacatcaatgctcacattacatgccgtttatgttccggatatctgatcgatgccacaacagtgaccgagtgcctacataccttttgtcggtcctgtctggttaaatacctcgaggaaaacaatacctgtcccacatgtaggattgtgatccatcagtcccatcccctgcagtatatcggccacgaccggactatgcaggacattgtttacaaactcgtgcccggattgcaggaagcggagatgcggaaacaaagagagttttatcataagttgggcatggaggtgcccggagacataaagggcgagacctgctcagctaagcagcatctggatagtcatagaaatggagaaaccaaggctgacgattcctctaataaggaagccgcagaagagaaaccagaggaagacaatgactatcaccgaagcgatgagcaagtttcgatctgtctggagtgtaattcgagcaaattgcgcggtctgaagcgcaaatggatacgatgcagtgcccaggcaacggtcctacacctgaaaaaatttatcgctaagaaattaaatttgtcttcctttaatgagctggatattctttgtaatgaggaaatacttggtaaagaccacacactgaaattcgtggtggtgactcggtggcggttcaaaaaagcccctctgcttctgcactaccgcccaaagatggacctcctttag

SEQ ID NO: 23849 - DNA, 123 bp, Artificial Sequence
  Description of Artificial Sequence: Synthetic coding sequence
atgctgacccgcaaaattaagctttgggatattaatgctcacatcacttgtaggttatgctccggttacctcatcgatgcgacgacagtgactgaatgccttcataccttctgcagatcctag

SEQ ID NO: 23850 - DNA, 189 bp, Artificial Sequence
  Description of Artificial Sequence: Synthetic coding sequence
atgctgacccggaagatcaagctgtgggatattaatgctcacatcacctgtagactgtgctcgggttatttgatcgatgccacaaccgtgaccgagtgcctccataccttctgccgctcctgcctggttaagtacttggaggagaataatacctgtccaacctgcagaattgtcatccatcagtcctag

SEQ ID NO: 23851 - DNA, 330 bp, Artificial Sequence
  Description of Artificial Sequence: Synthetic coding sequence
atgctgacccggaaaatcaagctgtgggacatcaatgcacatatcacatgccgtttatgtagtggttatctcatcgatgctacaaccgttacagagtgtctgcacactttctgtaggtcatgtctcgtaaagtacctggaggaaaacaacacctgtcctacctgtagaatcgtgatacaccagagccaccccctgcagtacattggccacgatagaacgatgcaggatattgtctacaagctcgtgccaggattacaggaggcagagatgcggaagcagagggaattttaccacaagctaggaatggaagtgccgggtgacatcaagtag

SEQ ID NO: 23852 - DNA, 729 bp, Artificial Sequence
  Description of Artificial Sequence: Synthetic coding sequence
atgctgacgcgaaagatcaagctctgggacatcaacgcacatatcacctgccgtctctgcagtggctatctgattgatgccacaaccgtcacagaatgcctgcataccttctgtcggtcatgtcttgtcaagtacttagaagaaaataacacctgccccacctgtcggatcgtaattcatcaatcacatcctttacaatacatcggacacgatcggacaatgcaggacatcgtttataaactggtgcccggtctacaggaagccgagatgcggaagcagagggaattttaccacaagctgggaatggaggtacctggagatattaagggcgagacatgcagcgcgaagcagcaccttgatagccatcgcaacggcgagaccaaagcagatgacagctcgaataaagaggccgcagaggagaagccagaagaggacaacgactatcacaggagtgatgaacaggtgtccatctgcctcgagtgcaatagtagtaaacttaggggccttaaacgtaagtggatcagatgcagtgctcaggccactgtgcttcacctcaagaaattcatcgccaagaagctaaacctgtcatcttttaacgaactcgacatcctgtgtaatgaagaaatcctgggcaaggatcacactctcaaattcgtcgtggtgaccagatggagattcaagaaggcacccctgctgctgcactaccgccctaagatggatctactttag

SEQ ID NO: 23853 - DNA, 729 bp, Artificial Sequence
  Description of Artificial Sequence: Synthetic coding sequence
atgctaacaagaaagataaagttgtgggatattaacgcgcatatcacatgccgtctgtgttccggatacctcattgacgctacaacagtcacagagtgcttacacacattctgcagatcctgtctggttaagtacttggaggagaataacacttgccccacatgccgcatagtcatacaccagagccaccccctgcagtatattggtcatgacaggactatgcaggacatcgtgtataagcttgttccgggactgcaggaagccgaaatgcgcaagcagcgcgagttctatcataaactcggcatggaagtcccaggagacatcaaaggcgaaacgtgttctgccaagcagcacctcgacagtcacagaaacggcgaaacaaaagccgatgactccagcaacaaagaggctgctgaagagaagccggaagaggacaatgattaccatcgctctgacgagcaagtatctatttgcttggagtgtaatagcagcaaactccgcggattaaagcgaaagtggattaggtgctctgcccaggctacagtgcttcatctgaagaagtttatcgcgaagaagctcaatctaagctctttcaatgaactggacatcctgtgcaatgaagaaatccttgggaaggaccacactctcaaattcgtggttgtgactaggtggcggtttaagaaagccccacttcttctgcactatcgacctaagatggacctcttgtag

SEQ ID NO: 23854 - DNA, 627 bp, Artificial Sequence
  Description of Artificial Sequence: Synthetic coding sequence
atgactgtatgccgcagctgcctagtcaaatatctagaggagaacaacacatgccccacctgccgcattgttatccaccagtcacatccactacagtatatcggccatgatagaaccatgcaggatatagtctacaagttagtgcctggactgcaggaagcagagatgagaaaacaaagagagttttaccataagctaggcatggaagtccccggagacatcaaaggagagacttgcagtgcaaaacagcatttggattcgcatcgtaacggcgaaacaaaagccgacgacagcagcaacaaagaagcagctgaagagaagcccgaggaagacaacgattaccatcgttccgatgaacaggtctctatttgtctcgaatgtaattcttccaaactgaggggattgaagagaaagtggattcgctgctctgcccaggccacagttctccacctcaagaaatttatagccaaaaaactgaaccttagcagcttcaacgaactagacatcttatgtaacgaggaaattctgggaaaagatcacactcttaagtttgtcgtcgtaacgaggtggagattcaaaaaggccccacttctgttgcactatcgccctaaaatggacttgctctag

SEQ ID NO: 23855 - DNA, 3015 bp, Artificial Sequence
  Description of Artificial Sequence: Synthetic coding sequence
atggagacggagtcagaacagaattctaatagcacaaatggaagctcctcctccgggggaagcagtagaccacagatcgctcagatgtctctgtacgagcgccaggcagtacaggcactccaggcactccagcgccagcccaacgccgctcaatactttcaccagtttatgctccagcaacagctgtccaatgcgcaactgcactctctggcagctgtccagcaggctactattgcagcgtcacggcaggctagctcaccgaacaccagtactactcagcagcaaaccacaaccactcaggcctccataaatttagcgaccacgagtgccgcacagttgatttcaaggagccagtccgtcagcagtccaagcgctactacattgacccaatctgtgctgttaggtaatactacctcgccaccccttaatcagtcccaggcccagatgtacctgagaccgcagctggggaacctcctccaggtgaacagaaccctggggcgaaacgttccccttgcctcccagctcatcctgatgcccaacggagctgtggccgctgtccagcaggaggttcccagtgcccaatctcctggtgtgcacgctgatgccgaccaggtgcagaacctcgctgtgcgcaatcagcaggccagtgcccagggccctcagatgcaaggatccacgcagaaagcaatcccccctggggcatcgccggttagctccctgagccaggcgtctagccaggctctcgctgtggctcaggcctcttccggggctaccaaccagtctctgaacctgagccaggcagggggaggttccggcaattccatccccggaagtatggggccagggggagggggacaggcacacggcggactgggccagctccccagttcggggatggggggtggcagttgccccaggaaagggaccggtgttgtacagcccttgcctgccgcacaaaccgtcacagttagtcagggcagccagacggaggcggagagcgctgcggctaagaaggctgaagcagatggatccggccaacaaaacgttggaatgaatctaacccgcaccgccacccctgcccctagccaaacgctcatcagttctgctacctatacccagattcagcctcactctctgatccagcagcaacaacaaatccatctccagcagaagcaggttgtgattcagcaacagatcgctattcaccaccagcaacagttccagcacaggcagtcccagctgcttcacaccgctacccatctccaattggcccagcagcaacaacaacagcagcagcagcaacaacagcaacagcagcctcaggcaacaacgctgactgctccgcagccccctcaggtgcctccgactcagcaagtcccaccaagtcagtcacagcaacaagcccagacactggtggtgcaaccgatgctccagtcctcacctctctctctcccccctgatgcagcacctaagcccccaattcctattcagtcaaagcctcccgtggcaccaattaagccccctcagctgggtgctgcaaagatgtccgcagcccaacaaccacctccacacattcctgtccaggtggtgggaacaagacagcctgggaccgcccaagctcaggctcttgggctggcgcagttggctgccgctgtgcctacctcaagaggaatgcccggaacagtgcagtctggccaagcccatctcgcttcctccccaccttcttctcaggccccaggcgctcttcaggagtgtccacccacacttgcccctgggatgactttagcgcctgtccaaggcactgcccacgtggtcaagggcggagccactacatccagccctgtggtggcgcaagtgccagcagccttttacatgcagtccgtacaccttcctggcaaaccccagaccctcgccgtgaaacgaaaggccgactccgaagaggagcgagacgacgtgtccaccctcggatccatgctgcctgccaaggcctctcccgttgctgaatctccgaaggtgatggacgagaaatcttccctcggcgagaaagcagagtctgtggctaatgtgaacgctaatacaccgagttccgagctcgtcgctctcacccctgcaccctccgtcccccctcctacacttgccatggtctcgaggcaaatgggcgattccaagcctccgcaagctatcgtcaagccccaaattctcacccacattatcgaaggcttcgtgatccaagagggcgcagagccattccctgtcgggtgcagtcagcttctgaaggaatccgaaaagccactgcaaactggattgcccacaggcctgaccgagaaccagagtggcggtcccctgggagtggactccccatccgctgaactcgacaagaaagcgaacctcctaaagtgcgagtattgtggtaagtacgcacccgctgaacagttcaggggtagtaaaaggttttgtagtatgacctgtgctaaaagatataacgtctcatgtagtcatcagttccggcttaagcgcaagaagatgaaggagtttcaggaggccaactacgccagggtgcggaggagagggccaaggcgaagctctagtgacattgcccgagctaaaattcagggtaaatgccacagagggcaagaagatagctctagggggagtgataactcatcctatgacgaggcccttagccccacatcaccaggcccactttccgtgagggccggtcatggcgaacgggatttaggtaaccccaacactgcaccccctacccctgagcttcatggaataaatccagtcttcctgtctagcaacccgtctagatggagcgtggaagaggtatacgagttcattgcttctcttcagggttgtcaggaaatcgcagaggagtttaggtctcaagaaattgacggccaggcccttctgctattgaaggaagagcacctgatgtctgcgatgaatatcaaactaggccctgcccttaagatttgtgccaagattaatgtgctgaaagaaacctag

SEQ ID NO: 23856 - DNA, 1833 bp, Artificial Sequence
  Description of Artificial Sequence: Synthetic coding sequence
atgcagggctccacgcagaaagctatccctcctggggcttcccctgtctccagcctgtcacaggcgtcctcccaggcactagcagttgcccaggcctcttccggggctaccaaccaatcacttaacctgagccaggctgggggaggcagcggcaattcgattcctggaagcatgggaccaggaggaggcggacaggcccatggaggactgggacagctacctagctcaggcatgggaggaggttcttgtccacgtaagggtacaggtgtcgtgcaacccctgcccgcagcgcaaaccgtgaccgtctcccagggctcccagacagaagcggagagcgcagccgcaaaaaaggctgaagcagatgggtctgggcagcagaacgtcggcatgaacctcacacgcaccgccactcccgctccttctcagactctgatttcatctgccacctacacacagattcagccacattctcttattcagcaacagcagcagatacacctgcaacaaaagcaggtggtgattcagcagcaaatcgcgatccatcatcaacagcaatttcagcatcgacagagtcaactgctccacactgccacccatctgcaacttgcccagcagcagcagcagcagcagcaacagcaacaacaacagcaacagccacaagccactactctgaccgcccctcagcctccccaggttcctcccacacagcaggggaagccccagaccctggcggtgaagagaaaggccgatagcgaagaggaacgagatgatgtcagtactctgggttctatgctcccggctaaggcttccccagtggccgagtcacccaaagtgatggacgaaaagtcatcactgggcgagaaagccgaaagcgtcgcaaatgtgaatgcaaacacccctagtagcgaattggtggccctgactccagcccctagcgtgcctccaccaaccttagcgatggtgtcaagacagatgggcgattccaaacctcctcaagccatcgtgaagccccagatcctgacgcatattatcgagggtttcgttattcaagagggggctgaaccattccctgtgggttgttctcaactgctgaaggagtcagagaagcccttgcagacaggtctgccaaccggattaacagaaaatcaaagcggagggcctcttggtgtggactccccgtccgcagagttggacaaaaaagcgaacctgcttaaatgcgaatactgtggaaagtacgcccctgcagaacagttcagaggaagcaagcggttttgctcaatgacctgcgccaagcgatataacgtgtcatgtagccatcagttcaggctgaaacgcaagaagatgaaggagttccaggaggccaattatgctcgtgtcagacggaggggaccgagaaggtcatccagcgatatcgcacgggcaaaaatccaagggaagtgccacaggggtcaggaagactcatcccgcggatcggacaattccagctatgatgaagctctgagcccaacatctcccggtccattatctgtcagagccggtcatggggagcgagacttgggtaacccgaataccgcgcctccaactcccgaattgcacggcatcaaccctgtctttttgtcctctaatccctcccgctggtctgtggaggaggtctacgagtttatcgctagcctccaggggtgccaggaaatcgcagaagaattccggtcacaagagatcgatgggcaggcactactgctacttaaggaggagcacctgatgtcggccatgaacatcaaactggggcctgctctaaagatatgtgcaaagatcaacgttctcaaagaaacctag

SEQ ID NO: 23857 - DNA, 519 bp, Artificial Sequence
  Description of Artificial Sequence: Synthetic coding sequence
atggaaactgagtccgagcagaattctaattccacaaacggatccagttctagcggtggctcatcccgccctcagatcgctcaaatgagcctgtatgaacgtcaagcagtgcaggccttgcaggcgctgcagaggcaaccaaatgcagctcagtacttccatcagttcatgttgcagcagcagctaagtaacgcccaactgcactcgctcgcagcagtgcaacaagctactatagccgcaagtaggcaggcttcttcgccgaacaccagcaccacccagcagcaaacaaccaccactcaagcatcaatcaatttagcgaccacttcagccgctcagttgattagtaggagtcagtccgttagtagtccctccgcaacgactctgacacagagtgtcctgctggggaacactacctctcccccactgaatcaatctcaggcacagatgtacctgagacctcagctgggtaaccttctgcaggtgaacagaacactcggaaggaatgtgccactcgcctag

SEQ ID NO: 23858 - DNA, 3015 bp, Artificial Sequence
  Description of Artificial Sequence: Synthetic coding sequence
atggaaaccgagtctgaacagaacagtaatagcaccaacggaagctcttctagcggcggttcctcaagacctcagatcgcccaaatgagcctttatgagaggcaggccgtacaggcactgcaggcccttcagagacagccaaacgctgcacagtacttccaccagttcatgctgcagcagcaattgagtaacgctcagttgcactcactagcagctgtccagcaggccactatagctgctagtagacaggcctctagccctaacacttctacgacccagcaacagacaactacaacccaggcctctattaaccttgccaccaccagcgcagctcagcttataagcaggtcccaatcggtcagctcaccatcagccacaaccctgacacagtctgtcctgctaggaaacacaacatcccccccactgaatcagagccaagcacagatgtacctacggccacagctagggaaccttttgcaggtgaacaggacactcggcagaaatgttccgctagcctcgcagctaattctgatgcccaatggggctgtggccgctgttcagcaagaagtgcctagcgctcaatccccaggtgtgcatgcagatgccgatcaagtgcagaacctggccgttagaaatcagcaggcctccgcccagggccctcagatgcagggatcaacgcaaaaagccatccccccaggcgcatcccccgtgagctcgctctctcaggctagcagccaagccctggccgttgctcaagccagtagcggcgctacgaaccaaagcctcaatctgtcacaggccggtgggggtagcggcaactcaatcccagggtctatgggccctggcggaggcggacaagcccatggtggacttggccagctgccgtcttcaggaatgggcggaggctcatgcccaagaaaggggaccggagtcgtgcagcccctgcccgctgcccagactgtaacggtgtcacaggggtcccagacagaagctgaatctgctgctgcgaaaaaggcggaagctgatgggtccgggcaacagaatgttggtatgaatctgacacgaacagctacacccgctccctctcaaaccttgatttcttcggctacttatacccagatccagccacactccctgatccagcagcaacagcagattcacctgcagcagaaacaagttgttatccagcagcaaatcgcaatccatcaccagcagcaatttcagcatcgacagagtcaactcctgcacacagccactcaccttcagttggcccagcagcaacagcagcaacagcagcaacagcaacagcagcaacagccccaagctactaccctcaccgcccctcagcccccacaggtcccacctacacaacaggtgcccccatctcagagtcagcaacaagcacagactctggtggttcaacctatgcttcagagctcacccctgagcttaccgcctgatgcggctcccaaaccccctatccctatccagagtaaaccacccgtggcccctatcaagccccctcagctgggagcggcaaagatgtctgcagcacagcagccaccaccccatatccctgtgcaggttgtcgggacccgacagcccggaaccgcacaggctcaggctctagggttggcccagttagctgccgctgtgcccacctcccgcggaatgcctggtaccgtgcagagcggacaggcccacctagccagctctcccccttcgagccaggcaccgggtgcactacaagagtgtcctcccacacttgctcccggaatgactctggcacctgttcaaggcactgctcacgtagttaagggcggagcaacgacttccagcccagttgtggcccaggtcccagccgctttttacatgcaatccgttcatttacctgggaaaccccaaacgttggccgtgaaacgaaaagctgattctgaggaggaaagagatgatgtgtcgactttggggagcatgcttcctgccaaagcttccccagtagctgagagtcccaaagtaatggacgaaaagtctagtctgggagagaaagcggaaagcgtcgccaatgtgaatgcgaacactccatctagcgaacttgtggctctcacacctgccccaagcgtccctccgccaacgttagcgatggtttcaagacagatgggtgattccaaaccacctcaggctatcgtaaaaccccagattcttacccacatcatcgaaggctttgtaatccaggaaggcgcagagcccttcccggtcggctgtagtcagcttttgaaagagtccgagaagcccttgcagactggtcttcccactggtctgactgagaaccagtcggggggaccactcggcgtggactcaccgagtgctgagctggataagaaagctaacttgctgaagtgcgaatactgcgggaagtacgcacccgcagagcagttcagggggtcaaaaagattttgctccatgacttgtgcaaagcgctataatgtgtcctgctctcaccagtttcgtttaaaacgcaagaagatgaaagagtttcaggaagctaactacgccagagttagaagacgagggccaaggaggtcaagtagtgatattgcaagagcgaagatccaggggaaatgtcatcgcggacaggaggacagtagtagaggatcagataactctagctacgacgaggcacttagtcccaccagccctggcccactttctgtaagggctggtcacggggaaagggatcttggcaaccctaacaccgcccctcccacacctgagctgcacggaatcaaccctgtttttctttctagtaaccctagtcgttggtccgtggaagaggtgtacgaattcatcgcttctctgcaaggatgccaggagattgccgaggagttcaggtctcaggaaattgatggtcaggctcttttgctcctgaaggaggagcacctgatgtcggcaatgaacatcaagctcggcccagcacttaaaatctgcgcgaagatcaatgtccttaaggagacctag

SEQ ID NO: 23859 - DNA, 3015 bp, Artificial Sequence
  Description of Artificial Sequence: Synthetic coding sequence
atggaaacagagtctgaacagaactcaaactctacaaacggttccagctcctccggtgggtcctcaagaccacagattgcgcaaatgtccctgtatgaaagacaggctgtgcaggcactgcaagcacttcagcgacagccaaacgctgcccaatattttcaccagttcatgttacaacagcaactttcaaacgctcagctacatagcctagccgcagtgcagcaggccacgatcgcagctagtagacaggcctcctctcctaacacctctacgacccaacagcagaccacaaccacacaggcatccatcaaccttgccactacttccgctgcccagctaatctcacgctcgcaatccgttagttccccctcggccacaaccctgacacagtcggtgctcctgggtaacactacaagccctccactcaaccagtcgcaagctcagatgtacctgcgccctcagctagggaacctgctgcaggtgaaccggacactcggaaggaatgtgcctctagcatcacaactgattctgatgcccaacggcgctgtggccgcagtgcagcaggaagtgccctccgcgcagagccctggagtacacgcagacgccgatcaggtccagaatttggctgtgcgtaatcagcaggccagcgcgcagggccctcagatgcagggttcaacacagaaggctatcccacccggtgcttccccggtgagcagcctgagtcaggcttcttctcaggcactggcagtggcccaagcatcttccggcgcaactaaccaatccctgaacctatcccaggctgggggtggaagcggcaatagtattccgggaagcatgggacccggaggtgggggtcaggcacacggcggtctgggacagctccctagcagcggcatgggcggtggcagttgccctcgcaagggcactggtgtagtgcagcccctgcccgcagcccagaccgttaccgtctctcagggcagtcagaccgaggccgagagtgccgctgccaagaaggccgaggccgacggcagtggccaacagaacgtagggatgaatttgactcgtaccgcaacaccggcaccttctcaaactctgatctccagtgccacttacacgcagatccagccacatagtttgatccagcaacagcaacagatccacctccagcagaagcaagttgtgatccagcagcagattgccatccaccaccaacaacagttccagcaccgccaaagccagttgctgcacacggccacacacctgcagctggcccagcagcagcaacagcagcagcagcagcagcagcagcagcagcagccccaggcaaccaccctcacggcaccccagccaccgcaagtaccaccaacacaacaggtcccgccttcacagtctcagcaacaagcacagaccctcgtcgttcaacccatgctccagtcatcccccctgtcccttccacctgacgctgctccgaagccacccatccctatacaatctaagccccctgtggctcccatcaagcctccccagttgggggctgccaagatgagcgccgctcagcagcccccaccacacattcctgtgcaggtcgtcggtacaagacagcctggtactgcccaagcccaggccttaggacttgcgcagttggccgcagccgtgcccacatctcgcggaatgcctggaactgtccagagcggacaggcccatctcgccagctcccctcccagcagccaagctcccggtgcactccaggagtgccctcccacactcgcccctgggatgaccctggccccagtccagggcaccgcacacgttgtaaagggaggagccacaacgagcagcccagttgtggcccaggtgcccgctgctttctacatgcagtccgttcatctaccaggaaagccccagactttggctgttaaacgtaaggcagactccgaagaagagcgggatgatgtctccaccttgggcagcatgctgcccgcaaaagccagccctgttgccgagagtcccaaggtcatggatgaaaagtccagtcttggggaaaaggccgagagcgtggcaaatgtgaacgccaacacccccagctctgaattagtcgcactaaccccagccccatccgttccgcctcccaccctcgccatggtatcccgacagatgggagacagcaaaccaccacaagctatcgtgaaaccacagattcttacgcatatcatcgaggggttcgttatacaagaaggcgcagaacccttccccgtcgggtgttcccaattgcttaaggaaagtgagaagcccttgcagacaggattacctacaggcttaactgagaatcaaagtggagggccactgggcgtcgattctccatcagccgagctggacaaaaaggcaaacctcctgaagtgcgagtactgcggaaagtacgcccctgctgaacagtttaggggaagcaagaggttttgtagtatgacttgcgcgaagcggtataatgtaagctgttcccaccagttcaggctaaagcgtaaaaagatgaaggagtttcaagaggctaactacgctcgtgtgagacgtaggggcccacgcaggtcaagctcagatattgctcgcgctaaaatccagggaaagtgccataggggccaggaagattcctcccggggttcagacaatagttcctacgatgaagccctcagccccacatctccagggcctctctccgtgagggccggtcacggcgagagagaccttggtaatcctaacaccgcccctccaacccccgaattacacggaatcaatcctgtatttctctcttccaatccaagccggtggagcgtcgaagaggtgtacgagttcatcgcttccctgcaaggctgccaggagatagctgaagaatttcgtagtcaggaaatcgacggacaggccctcctcctgctcaaggaagaacatctgatgagcgctatgaatatcaagctcggaccagccttgaagatctgtgccaaaattaacgtccttaaagaaacatag

SEQ ID NO: 23860 - DNA, 2577 bp, Artificial Sequence
  Description of Artificial Sequence: Synthetic coding sequence
atggaaaacgaacttccagtacctcacactagttcttctgcctgtgcaacatcctcaactagcggtgcgtcgagcagttccggatgcaataatagcagttcaggtggctccggaaggcctaccggcccacaaataagcgtgtactcggggatccctgatcgtcaaactgtgcaggtgatccaacaggctctacatcggcagccatctactgcagctcagtatcttcagcagatgtatgctgcccaacagcaacacctgatgctgcagactgctgctcttcagcagcagcacctgtcctccgcccagctccagagcctggccgcagtccagcaggctagcctagtaagcaacaggcagggaagtacctccgggtctaacgtgtcagcgcaggcccctgcccaaagttctagtatcaatttggcagcatcgcccgcagccgctcaactcctcaatagggctcaatcagttaactctgcggcagcctccggcattgcccagcaggcggtgttgttagggaatactagcagccctgctctgacagccagtcaggctcagatgtatttgagggcccagatgctgattttcactcccacagctactgtggcaacagtacaaccagagctcgggacaggatctccagccaggcctcctacacccgcacaggtgcaaaacttgacactcagaacacaacagactcccgctgccgcagcttctggtcctaccccaacccagcccgttcttccgtccctagcactcaaacctacgcctggtggtagccagccactccctacccccgctcagtccaggaatacggcacaggccagccccgcaggggctaaaccaggaattgcagactctgtgatggagccacataagaagggcgacggtaatagttctgttcccggatccatggagggcagggccggactctccaggaccgtcccggcagtggcggctcaccctcttatagccccagcatatgctcagctacagccccatcagctcctgccacaaccttccagtaaacacctccagcctcagtttgttattcagcagcagccacagcctcagcagcagcagcctcctccccagcagtctagacccgttctgcaggccgagcctcatccacagctggcatcagtgagtccctccgttgctttgcagccttccagcgaggctcatgccatgcctctgggccctgtcacacctgcactgcccctgcaatgcccaactgcaaacttgcacaaaccaggcggatcccagcaatgccatccccctacacctgacaccggcccacagaacggacatccagagggagtcccacacactccacagcgacggttccagcacaccagcgcggtgatcctgcagctacagcctgcgagtcctccccagcagtgtgtcccagatgattggaaggaggtcgctccaggggagaagagtgtgcctgaaactagatctgggccatcaccccatcaacaggctattgttaccgccatgcccggtggtcttcctgtccctacttctcccaacatccagccctcacctgctcatgagaccgggcagggcattgtacacgcccttacagacctgagctcgcctggaatgacttcagggaacggcaattcagcttcctcaatcgccggtacagcaccacagaatggtgaaaataaaccacctcaggcaatcgtgaaaccccaaatccttacacatgtgatagagggttttgttattcaggaaggcgctgaaccttttccagtcggcaggtcttccctcctcgtgggcaacctgaaaaagaagtacgcacagggctttctgcctgaaaagctcccccagcaggaccataccaccacaaccgatagcgaaatggaggagccctatttacaagaatctaaggaagaaggggctcccctcaagctgaagtgcgaactgtgtggaagggttgacttcgcgtacaaattcaagcgcagcaagcgattctgtagcatggcctgtgcgaagaggtacaacgttgggtgcactaaaagggtggggctctttcattcggatcggagcaagctccagaaggccggagccgcaactcataaccgtcggagggcttccaaggcctccctgcctccgttgacaaaagacaccaaaaaacagccaactggtaccgtgccgctgtcagtcaccgccgcacttcagcttacccacagccaggaggacagttcaaggtgcagcgataacagcagctacgaggagcccctgagtcctatctcagcaagctcctctacatcacggagaaggcagggccagcgcgacctcgagctgcctgacatgcatatgcgggacctagttggcatgggacatcacttcctgccctccgagccgacaaagtggaacgtggaagacgtgtacgaatttatacggtctttgcctggatgtcaggagattgcagaagagtttcgcgctcaagaaatcgacggccaggcacttttactgttgaaagaagaccatctgatgagtgcaatgaacatcaagctaggcccagctctcaaaatctatgccagaataagtatgttgaaggattcttag

SEQ ID NO: 23861 - DNA, 1305 bp, Artificial Sequence
  Description of Artificial Sequence: Synthetic coding sequence
tgtttgagaggtggctgttctcccagggctcctgccgctcgagcacgacagcctagacctcccccagccctcccacctaggccccgagccccagtgcctgcctctcgacccggacggccactattaactcctgcacgaccttgcggtagaatgcgcagaggctccccaggacccaggttgggaggaagccgcggagaaagacgacccgctcgagctcgggatcccgctcgcgtcgggccaggcgagggactccgaagacccgcaaggcctggacctgcagggccttggactgagactgggcagggaatcgtgcacgcactgactgatctgtccagtcctggtatgacttccggaaacggcaattccgcctccagcattgcagggacagcacctcaaaacggtgagaataagcctcctcaggccattgtgaagccgcaaatcctaacacacgtaatcgaaggtttcgttattcaggagggggctgagctctcgcgctgggacgccagactgctagtagggaatctaaagaagaagtatgctcagggctttctgcctgaaaagttgccccagcaggaccacaccactaccacggactctgagatggaggagccatatctgcaggagagcaaggaggagggagccccattgaagttgaagtgtgagctatgtggacgggttgattttgcctacaagtttaagaggagtaaacggttctgttcaatggcgtgtgctaaacgttacaacgtgggttgtactaagcgcgtgggactgttccacagcgatagatccaagttgcagaaagcgggagctgctacccacaaccggcgacgaccggcaaagcctgtgtgtcatcacctgccacgcattccacggagctcccagcaagccctctgcccttttcgtttactgctgttgtgtctaacccactcacaggaagatagcagtcgctgctcagacaactcatcatacgaggagccgttaagcccaatatctgcctcctcctccacatctgccggtgataaagccagcggaacgtggagcagccccacttgcatatgcgggacatggtgggcctgggataccacatcctgccaggtgtcccaccaggttaatgtggaggacgtatacgaatttattagaagcttgccaggttgccaggagatcgcagaagagttccgagcccaagaaatcgacgggcaagcactcctgctgttgaaggaggaccacttaatgtctgccatgaatattaagcttggtcctgcgctaaaaatctacgcacgcattagcatgctaaaggatagctag

SEQ ID NO: 23862 - DNA, 954 bp, Artificial Sequence
  Description of Artificial Sequence: Synthetic coding sequence
atgacaagcggcaatggcaactccgccagctctattgcgggaactgcccctcagaatggagagaataaaccacctcaggccatcgtcaaaccccagattctaacacacgttatcgagggctttgtcatacaggagggcgcagaaccttttccggtcgggagaagctcgctgcttgtaggcaacctgaaaaagaagtatgcgcagggttttctcccggagaagctaccccagcaggaccataccaccaccactgactccgagatggaggaaccatacctgcaggagtccaaggaggaaggcgcaccattgaagttaaaatgtgaactttgcggcagggtagatttcgcctataagtttaagcgaagcaagagattctgctccatggcttgcgcaaagagatataatgtgggatgtaccaaaagagtcggcctttttcactccgatcgcagcaaactgcagaaagctggcgctgcgacccataaccgcaggagggcctccaaagctagtctaccacccttgacaaaagatacaaaaaaacaacctaccgggacagtgccactcagtgttacggccgctctgcagctcacacatagccaggaagatagttcgcgctgctctgataattcatcgtatgaggaacctctgtctcctatcagcgcctcctcttcaacaagccgcagaagacagggacaaagggatctggagttacccgacatgcacatgcgcgatctcgtcggcatgggacaccacttcttaccatcagaaccgacaaaatggaacgtggaagacgtgtatgaatttatcaggtccctaccgggactgccaagctccttccccaaaggccacgaaactagtatctacagcctcagcaagcatttgcgacactcaaggtttcctcagagcccaagcgggtcctgtctgtggcccgtcctcagaccgcgacctcatctctag

SEQ ID NO: 23863 - DNA, 972 bp, Artificial Sequence
  Description of Artificial Sequence: Synthetic coding sequence
atgacctccggcaacggcaactctgccagctccattgctgggaccgcgcctcagaacggagaaaacaaaccacctcaagccatcgtgaagccccagatcttgacccacgtgatcgaggggttcgtgattcaggagggagctgagccgttccccgttggcagaagtagcttgttggtggggaacctgaaaaaaaaatatgcccagggcttccttcctgaaaaattgccacagcaggatcacactacgaccacagattctgaaatggaagaaccatacctgcaagaatctaaagaagaaggggcaccattgaagcttaaatgcgaactttgtggtagggtcgatttcgcgtataaatttaagagatccaaacggttctgctccatggcatgtgctaagaggtataacgttgggtgcaccaagagagtgggactattccattccgaccggagcaagctccagaaggcgggtgccgctacacacaacagacgcagagcctccaaggcatcactgcctcctctgacgaaagatactaagaaacagccaacaggaaccgtgcctctgagcgtcaccgcggctcttcagctcactcatagtcaggaagatagctcccggtgtagtgacaactcctcttatgaggaaccacttagccccatatcggcctcctcaagcacaagccggcgacgccaagggcagcgggatttggagttacccgatatgcatatgcgggatctggtggggatgggacatcacttcctcccctcagagccaacaaaatggaacgtggaagacgtgtacgagtttatcaggagcctcccaggttgtcaggagatcgccgaggagttccgtgcacaagagattgatggccaggcccttctgttgttgaaggaggatcacttaatgagcgccatgaacataaaactgggacccgctctgaagatctacgctagaatcagcatgctgaaagattcatag

SEQ ID NO: 23864 - DNA, 1395 bp, Artificial Sequence
  Description of Artificial Sequence: Synthetic coding sequence
atgcctctgggaccagtgacacccgctctgccactgcagtgtccaacagcaaatcttcacaagccaggaggctcccagcagtgtcacccccctacccccgacactggaccacagaatgggcatccggagggggtgccccacacaccacagcggaggtttcagcacacatcggctgtgatactgcaacttcagcccgctagccccgttcctcaacaatgcgtccctgatgattggaaggaagtggctcctggggaaaagtcagtgccagagacacgttcgggacccagtcctcatcagcaggctatcgttacagccatgccgggaggtctacctgtcccaacttcccctaacatacagcccagcccggcacatgaaacaggccaaggtatagtccatgcactcaccgatctgtcaagtcccggaatgacatcaggtaatggaaatagtgcatcctccatcgcagggaccgctccacagaacggggaaaacaagccccctcaggcaattgtaaaaccacagattttaacccatgtaatcgagggttttgtgatccaggaaggtgcggagccattcccagtgggacgctcctcactcctggtgggcaacctgaaaaaaaaatacgcacaggggttcctgccggagaaactgccacagcaggaccataccaccaccactgatagtgagatggaagaaccttatctgcaggaatcaaaggaggagggggcaccactaaaacttaagtgcgaactgtgtggtagagtagactttgcctataaattcaaacgctccaagaggttctgttccatggcgtgcgccaaacgatacaatgtcggttgcaccaagcgcgtaggcctgtttcactcggacagatcaaagcttcagaaggccggagccgcaacccataaccgccgaagggcttccaaagcctctctgcctccgttaaccaaggacacgaagaaacagcccactgggactgttcccctgagcgtgaccgcggctctccagctaactcactcccaggaagattcatccaggtgttccgataattcttcttacgaagagcctctgagccctatcagtgcttccagttcaacctccaggcgtcggcagggtcagagagacttagaactccccgatatgcacatgcgtgacctggttggcatgggccaccattttctgccaagcgaacccacaaaatggaatgttgaggacgtttacgaattcattcgaagtttaccagggtgtcaggagatcgctgaagaatttagagcccaggaaatcgacggccaggcacttttactactaaaggaggatcatctaatgagcgccatgaacatcaaacttggccctgccctgaagatctatgcccgaatctctatgctcaaagattcatag

SEQ ID NO: 23865 - DNA, 2580 bp, Artificial Sequence
  Description of Artificial Sequence: Synthetic coding sequence
atggagaatgagttgcccgtcccgcatacaagcagttctgcatgtgcgaccagctcaacgtccggagcctctagctccagcggatgcaacaattcttcctccggagggtcaggcagaccaacaggccctcagattagcgtgtactctggtattccagatcggcaaactgtgcaagtgatccagcaggctctccaccggcaaccttccaccgcagcccagtatttgcaacaaatgtatgcagctcagcaacaacatctgatgttgcagacagccgctttgcaacagcaacatctgtcatccgcccaacttcagagtctggcggcagtgcagcaggccagcctcgtcagcaataggcagggcagcacctctggctcaaatgttagtgcacaggcacctgcccagagctcttctattaatctggctgctagccccgctgcagcacagttactcaacagggcacaatccgttaattccgccgcagcaagcggaattgcccaacaggccgtcttgctgggcaatacatcaagtccagcgctcactgcgtcacaggcccaaatgtatctgcgcgcacagatgctgattttcaccccaactgccaccgtcgctaccgttcaaccggagctcggcacagggagtccagcacgacctcccacccctgcacaggtgcaaaacttaaccctgaggacccaacagacacctgctgccgctgcaagcggcccaactcccacccagccagtgctaccaagcctcgccttaaaaccaacacctggagggtctcagcctcttcccactcctgcccaatcaagaaataccgcccaggcctctcctgccggtgcaaaacctgggatcgccgactcagtgatggagccacacaaaaagggggatgggaacagttccgtgcctgggtctatggagggcagggccggtttgtcccgaaccgtccctgcagtggcagcccacccgctgattgcgcctgcctacgcccagttacaaccccatcagctgttgccccagcctagtagcaagcacttgcaacctcagttcgtgattcagcaacagccccaaccacagcaacagcagccgccacctcagcagtctcgccctgttttacaggccgaaccgcatccacaactcgcatccgtcagtccctcagtggctcttcaaccttcatctgaagcgcatgctatgcctctcgggccagtgacacctgctcttccactgcagtgccccactgcaaacctccacaaacccggaggttcacaacagtgtcaccctccaactcctgatacaggaccccagaacggtcatccagagggcgtaccccatactccacagcgccgatttcagcacacaagcgccgtcattctccagctgcagccagcctcccccgttccccagcagtgcgtgcccgacgattggaaagaagtggctccgggtgagaaatccgttccggaaaccaggtccggtccatctccccaccagcaggccatcgtaactgcaatgcctggaggcctgcctgttccaacgagcccaaacatacaaccctcccctgctcacgagactgggcagggcattgttcatgcgcttaccgacctcagttcccccggaatgacctctggtaatggtaattcggcgagtagcatcgcgggaacagcgcctcagaatggcgagaacaagcccccacaggccattgtgaaaccgcagattttaactcacgtgatcgaagggttcgtgatccaggaaggcgcagagccgttccctgtaggcagatctagtcttttggttggcaacctgaaaaaaaagtatgcccaaggctttctgcccgagaagctaccacagcaggaccacaccaccacaactgactcagagatggaagagccttacttgcaggaatcgaaggaggagggagcccctctcaaactcaagtgcgaactctgtggtagagtggattttgcgtacaagttcaaaaggtccaagcggttctgcagtatggcgtgcgccaaacggtataacgtgggctgtaccaaaagagtgggcttgtttcactcagacaggagtaagctgcagaaagccggagctgctacacacaaccgtaggagggcctcaaaggcatccctgccccctttaaccaaagatactaaaaagcagcctaccggcaccgtgcctcttagtgtcactgcagcactccagctgacgcactcccaagaagattccagccgttgtagcgacaatagctcatacgaggagcctcttagcccaatctctgcgtcatcctcaactagcaggaggcgacaaggtcagcgagatctggagctacccgacatgcacatgagggacctggttggaatgggacaccattttcttccatcagagcctacaaagtggaacgtggaggatgtgtatgaattcattcgttcactccccggatgtcaagaaatcgccgaggagtttcgcgctcaggaaatcgacggccaggctctgctgcttctaaaggaggatcacctcatgtccgccatgaacataaaactcggacccgcactgaagatctacgcgcgtatctcgatgctaaaggattcctag

SEQ ID NO: 23866 - DNA, 2490 bp, Artificial Sequence
  Description of Artificial Sequence: Synthetic coding sequence
atggagaacgagctccccgttccacatacgtcgagctcagcgtgtgcaacgtcctccaccagtggggcttctagctcaagcggctgcaataattcatctagcggcggttccggccgacctaccggtccccagatatcggtgtactcaggaatccctgacagacagaccgtgcaggtgattcagcaggctctacaccgtcagccgtcaaccgccgctcagtacctgcagcagatgtacgcggcacagcaacagcacctaatgctacagactgccgctctgcaacagcaacacctaagttcggcccagctgcagtccctcgctgcggtgcaacaagcctccctggtctctaatcgacagggctccactagcggaagtaatgtctccgcgcaggcaccagcacagtcctccagcattaacctcgccgcaagccccgcagcagcgcagctgctgaacagggcacaatctgtcaactccgcagcggcttcagggatagcacagcaggctgtgcttctgggaaatacatcttctccggctttaactgccagtcaggcgcaaatgtacctacgtgcccaaatggtgcagaacctgacactgcggactcaacaaactccggctgccgcagctagtggacccactcccacccagccggtcctccctagtctcgccctgaagccaacaccagggggttcacagcccttacctacgcctgcacagtctcgaaatacagctcaggcctcacctgctggagccaaaccaggtatagctgatagcgtaatggagccacacaaaaagggcgatggaaacagcagcgttccgggatccatggaagggcgtgccggtttaagtagaactgtgcccgcagttgcagcacaccctctcatcgcacccgcttatgcccaattacaaccccaccagttgctgccacaaccgagcagtaagcacctccaaccgcagtttgtgatccagcagcagccacagccccagcagcaacagcctccaccacagcagagccggcctgttttgcaggctgaacctcacccccaactggcgagcgtctcccctagcgtcgccctgcagcccagctctgaggctcatgccatgcctcttggacccgtgaccccagccctccctctgcagtgccccaccgccaatctgcacaaacctggaggctctcagcagtgccatcccccaactccagacaccggcccacagaacggccaccctgaaggcgtaccgcacaccccccaacgacggttccagcacacgtccgccgtgattcttcagctccaacctgctagccctccacaacagtgcgtgccggatgattggaaagaagttgccccaggggagaagtcagttccagagacccgcagcgggccatctccacaccaacaggccatcgtgaccgccatgcctgggggtctgcccgtgccaacttccccaaacatacagccctccccagcgcacgagacaggccagggcatcgtgcacgccctaaccgatctaagctctcccggaatgactagtgggaacggcaacagcgccagctctattgctgggaccgccccacagaacggagaaaacaaacctccacaagcgattgtcaagccccagatacttacccacgtcattgagggattcgtgatccaggagggggctgaaccgtttcccgttggccgaagttccttgcttgttggaaacttaaagaagaagtacgcccaaggcttcttgcctgagaaacttccccagcaggatcacaccaccaccacagactcagaaatggaagagccatatcttcaagagtcaaaagaagagggggcacccctcaagctgaaatgcgaattgtgcgggcgagtcgatttcgcgtataagttcaaaaggagtaagcgattttgctcaatggcatgtgctaagagatacaatgtcggctgtacaaaacgcgtgggactgttccacagcgaccggagtaagttacagaaggctggcgcagctacacacaatcggcgacgggcttcaaaagccagtctgccgcctctgacaaaagataccaagaaacagcctaccggaacggtcccgctgagcgtgacggctgcactgcagctcacacatagtcaggaggactcttccagatgcagcgataattctagttacgaggagcccctgagtcccatttcagcatcttcttctacctctaggaggcggcagggacagagagatttggagctgcctgacatgcatatgagagacttggtgggtatgggacatcacttcttaccaagcgaacccactaaatggaatgttgaagacgtgtatgaatttatacggtctttgccaggttgccaggaaattgcggaggaatttcgtgcacaggaaatcgatggtcaagcgctgcttctcttaaaagaagaccatttgatgtccgctatgaacatcaaactaggcccagccctgaaaatctatgcaaggatatctatgttaaaagactcctag

SEQ ID NO: 23867 - DNA, 561 bp, Artificial Sequence
  Description of Artificial Sequence: Synthetic coding sequence
atggacaccgagcccaaccctggtacctctagcgtatccactaccacttcttccaccacgaccaccactatcaccacaagctccagccgtatgcaacagccacagatcagtgtctacagtggttccgataggcacgctgtgcaggctttgcatcggccaccttcatccgccgcacagtacctccaacaaatgtacgccgcacaacagcagcatctcatgctacacactgcggctctgcagcagcagcatctctcttcttcacagcttcagagcttggctgcagtgcaggcttctcttagcagcggacgcccaagtaccagcccaacgggctctgtcactcagcagtcatccatgtctcagaccagcatcaacctgagcaccagtccaacccccgcacagctcattagtcggtcccaggcttcatctagcacctctggtagcatcactcagcaaacaatgctcctcgggagcacgtctccgacattgacagccagtcaagcacagatgtacttacgagctcagatggttagatatgaactcccaaacttcttcagcgtatag

SEQ ID NO: 23868 - DNA, 744 bp, Artificial Sequence
  Description of Artificial Sequence: Synthetic coding sequence
atggcagaggcagagtttaaggaccactccactgcaatggataccgagcccaatcctggtacctcttccgtgtcaacaactacaagctccactactaccacgaccattaccaccagtagtagcagaatgcagcaacctcagatcagtgtttacagcggaagcgacagacatgccgtgcaggtgatccagcaggcactgcatcgacccccatccagtgcggctcagtaccttcagcagatgtatgcagctcagcagcagcatcttatgctgcacactgccgcattgcagcagcagcatctttcatcctcccagctgcagtctctcgccgcagtgcaggcctccctgagctctggcaggccatccacctcccctacgggttcagtgacgcagcagagtagcatgtcccaaacatctattaacttaagtaccagtcccacccccgcacagttgatcagtagatctcaggcatctagcagcacgagcggatcaatcactcaacagacaatgcttcttggctccacaagccccacactcacagcttcgcaagcccaaatgtacctccgagcacagatgctgatctttaccccagccaccactgtggccgctgtgcagagcgatatccccgtggtctcttcctcttcttcttccagctgtcagtccgctgcaactcaggtccaaaatctcaccctacggagccagaaacttggggtgctgagctcatcacaaaatggcccacctaagtag

SEQ ID NO: 23869 - DNA, 444 bp, Artificial Sequence
  Description of Artificial Sequence: Synthetic coding sequence
atggctgaagccgagttcaaggaccacagtaccgccatggacaccgagcccaacccgggaacctctagtgtctccaccactaccagttcaacaactactactaccatcactacttctagctcaaggatgcagcagccccagatttcagtgtactctggctctgatcgccacgctgtgcaagcattgcacaggcccccaagtagtgccgctcagtatctgcagcaaatgtatgctgcccagcagcagcacctgatgctgcacaccgctgccctccaacaacagcatttaagttcttcccagctgcagtccctggcagcagtccaggctagcctgagttcaggccgacccagcaccagtcctactggctccgtgacacagcagagtagcatgtcacagacatccgtaagttcattgaattttttttttcttgacctcaagttctag

SEQ ID NO: 23870 - DNA, 486 bp, Artificial Sequence
  Description of Artificial Sequence: Synthetic coding sequence
taacggtggaatcgtaaacctgacaaccagagcctcggccataggggcagacggcctagcggcccagatggtgcggcacgcgaacatatcctgcgccagctccctattacctatccttctgcggaagaagacctcgcctcacatgaggactcagtgcctagcgcaatgacaactagactgaggcggcaaagtgagcgtgagagggaacgcgaattgagagacgtgagaatccgcaagatgccagagaacagcgacttgctacctgtggcacagacagaacctagcatttggaccgtcgacgatgtctgggccttcattcactctctaccagggtgccaggacattgcagatgaattcagagcccaggagattgatggccaggcacttctgctgctcaaggaggatcacctgatgagtgccatgaacatcaagcttgggccagctttgaagatttgtgccaggatcaattccctcaaggagagctag

SEQ ID NO: 23871 - DNA, 2952 bp, Artificial Sequence
  Description of Artificial Sequence: Synthetic coding sequence
atggataccgagcctaacccaggcacaagttcagtgtcaacaacgactagttcgaccaccaccactaccatcaccacatcctccagtaggatgcaacagccccaaatctccgtttactcagggtccgaccgccacgccgtgcaggtgatccaacaggccttacaccgccctccttccagcgctgctcagtacttacagcagatgtacgcggctcagcagcaacacctgatgctgcacacggccgctctgcagcagcagcacctatccagctctcaattgcagtctctagcagctgttcaagccagtctgtcctccggcagaccttcgacgtcacctactgggtctgtaacacagcagtcaagcatgagccagacatccatcaatctgagtacgtcgccaacccctgcccagctcataagtcgctcacaggcaagttcttcaacctcgggaagtatcacccagcagaccatgttactcggctcaacttcccccacgttaaccgccagccaggctcaaatgtacttaagagcccagatgctgatctttacccccgctacaactgtcgctgccgtgcagagcgatatccccgtcgtgtcttcttcctcgagctcttcatgccagtccgctgccacccaggttcaaaatctcaccctgcgctctcagaaacttggggttttgagctcctcccagaatggtcccccaaaatccacgtcccagacccagagcctgacaatctgccataataagaccacggttacgagcagcaagatctctcagagggacccctctcctgagtcaaacaaaaagggagagagcccatccttggaatcgcgctctaccgcagtgaccaggacctccagcattcatcagctgatcgcgccagcctcatatagccctatccagcctcactccctgattaaacaccagcagatcccgctgcactcacccccatcaaaagtctcccaccaccaacttatcttgcagcagcagcagcagcagatccaacccatcacgcttcagaactccacacaagacccccctccgagccaacactgcattccgctacagaaccatgggctccctccagcaccaagcaacgcgcagagtcagcattgcagccccatccagtcccatccaagccctcttactgtttcgcctaaccaatctcaatcagctcaacaaagcgtcgttgtgagcccaccgcctccccactcaccatcccagtcacctaccataattatccacccccaagctctgattcagccccatcctctggtgtctagcgccctgcagccgggaccaaacctccagcagagcaccgctaatcaagtgcaggccactgcacaactcaacctcccttctcacctgcctctgccagctagtcccgtcgtgcacatcggccctgtgcagcagtctgcgctggtgagccccggtcaacagatcgtctctccttcacaccagcagtactcctcactgcaaagctccccaatccctatcgcctccccaccacagatgtccactagccctcccgcacaaattcccccattgcctctccagagcatgcagagcttgcaggtccagcctgaaatcctgagccagggacaagtgctcgtgcaaaatgccttggtctccgaagaggagttgcccgctgcagaggctctcgtccagctacctttccagacactcccgcctccgcaaacagttgccgtgaacctccaggtgcagcctcctgcccctgtagatcctccagtggtttatcaggtagaggatgtctgtgaggaggaaatgcctgaagagagtgatgagtgtgtgagaatggacagaaccccacctccccctacgctcagtccagcagcaatcacagtgggacgaggtgaggatctgacatccgaacaccctctcttggagcaggtggaattacctgctgtggcttccgtatccgcctcagtcattaaaagtccatccgatccttcccacgtgagcgtcccgccacccccacttctgctccctgctgccaccactcgatccaactctacttccatgcactcaagtattccaagtatagagaacaaaccacctcaggccatagttaagcctcagattcttacacatgtaatcgaagggttcgttattcaggagggactggaacctttccctgtgtctcgtagttccctgttgatagaacaacccgtcaagaagaggccactgcttgacaaccaggttatcaacagcgtgtgcgtgcagcctgaactgcagaacaataccaagcatgctgataacagctctgatactgagatggaggacatgatcgctgaggaaaccctggaggagatggattccgagcttctaaagtgcgagttttgcgggaaaatgggatacgcaaacgagtttttacgctcgaaacgattttgtacaatgtcctgtgctaagagatacaatgtctcctgctcaaaaaagtttgcactaagcaggtggaaccgcaaaccagacaaccagtccctggggcacagaggacgaagacctagcggtcctgatggagcagcacgcgagcacattcttcgccagttacctatcacttaccccagtgccgaagaagatttggcaagtcacgaagactcagtgccttcagcgatgacgaccagattgcgccgacagagcgaacgggaacgggagcgtgaactaagagatgtgagaattcgtaaaatgccagagaatagcgacctgctgcccgtggcgcagaccgaacctagcatctggaccgtcgatgacgtgtgggcattcatccactctctaccaggttgtcaagatatcgctgacgaattccgagcacaggagatcgatggacaggcgctgctcttactgaaagaggaccacctgatgtcggctatgaacatcaaattggggccagcacttaagatttgtgctagaatcaattctctaaaggagtcttag

SEQ ID NO: 23872 - DNA, 2988 bp, Artificial Sequence
  Description of Artificial Sequence: Synthetic coding sequence
atggctgaagcggaatttaaggatcattccacagccatggatacagaaccaaacccaggcacatcatccgtttctacgactactagctcaacaaccaccactaccatcactacatcttcttctcggatgcagcaacctcagatttccgtgtattcagggagcgatcggcacgcagtgcaggtcattcagcaggcccttcaccgccctccctcctcagcagcccagtatttacagcaaatgtacgccgcacagcagcagcatctgatgctgcacacagcggctctccagcagcagcatctgtcctcatcccaattgcagagcctggcagccgtccaggcaagcttgtcttcagggaggcccagtacctccccgactgggagtgtaactcagcagagctcaatgagtcaaacaagcatcaacctgtcgacgtcacccacaccggcacagctaatttctcgaagtcaggcgagcagttccaccagcgggtccatcacacagcaaaccatgttgttgggcagtactagtcccaccctcacagcatcccaagctcagatgtacctccgagcccagatgcttatcttcacacctgccacaaccgtagccgcagtgcagagcgacattcctgttgtatcaagtagttccagtagcagctgccagagtgccgctacccaggtccagaatctgacgctgaggtcacagaagctgggggttctgtcgtcgagccagaacggcccacccaaatcaacatctcaaactcagagcctcaccatctgccacaacaaaacaaccgtgactagtagcaagatttcccagcgggacccgtccccagagtcaaacaagaagggcgagtcaccttccttagagagtaggagcaccgccgtcaccagaacctccagtatccaccaattgatagccccagcttcttattcccctattcaaccccatagtctcattaaacaccagcagatccccctgcatagtcccccatccaaggtgtcccatcaccagctcatactgcagcaacagcaacaacaaattcaacccattacactgcaaaatagtacccaggatccgccaccgagtcagcattgtatcccacttcaaaaccacggattgcctcccgctccctcaaacgctcagagccagcattgttcacccatccaatcccacccttcaccgttgaccgtcagtcccaaccagtcccagtcggcccagcagtcagtcgttgtgtctcctccccctcctcacagtcctagccagtcgcccacaataatcatccacccccaggctctgatccagcctcaccctcttgtgtcttcagcattgcaaccgggacccaatctccaacagagcacagctaaccaggtccaagccacggctcagctgaatctcccaagtcacctgcctctgcctgcatcacccgtcgtccacattggtccagtgcagcaatctgctctcgtctcacccggacagcaaatcgtgtcaccgagccaccagcaatattcatctctgcagagcagtccaatccccatagcgtccccccctcagatgtcaacctcccccccagctcagattccaccccttccactgcagagcatgcagtctcttcaggtgcagccagaaatcttgtctcagggtcaggtgctcgtacagaacgcactggtgtccgaggaagagctccccgcagccgaggcactagtccagcttccatttcagaccctgcccccaccacaaacggtggccgtgaatcttcaggtccagcctcccgctcccgtggatcctcctgtggtgtatcaagtcgaggacgtgtgtgaagaagaaatgcccgaagaatctgacgaatgcgttagaatggataggacaccgccaccccctaccctctccccagccgcaatcaccgtgggtcgcggtgaagacctgacttccgaacatccgttgctggaacaagtggaattgcccgctgtggccagcgtgtctgcaagcgtgataaagagcccctcggaccccagtcacgtttctgtgcctccacccccactgttgctgcccgcagccacaaccagaagtaactctaccagtatgcatagcagtattcctagtattgagaacaagccaccccaagctattgtcaaaccccaaattctgacccacgtgattgaaggctttgttattcaagagggccttgagccctttcctgtgtccagatccagtttgctgatagaacagccagtgaagaagcggcctctgttagataatcaggtgattaatagcgtctgtgtacaaccagagctgcagaataataccaaacatgccgataactcttcagatactgagatggaagacatgattgccgaggaaaccctcgaagaaatggacagtgaattgttgaagtgcgaattctgtgggaagatgggctatgccaatgagttcttgaggtcaaaaagattttgcaccatgagctgcgccaaacgctacaatgtttcatgtagtaagaaatttgcactatctaggtggaatcgtaagccagataatcaatctttgggtcataggggaagacggcctagcggccctgacggagccgctcgtgagcacattcttcggcagttaccaatcacctatcccagtgccgaggaagacctggcatctcacgaagactccgtccctagcgcgatgacaactaggctccgtcggcagagtgagcgagagagggagagggagctccgcgacgtgcgcatccggaagatgccagagaactcggacttgctgccagtcgcccaaaccgagccctccatttggactgttgacgacgtttgggccttcatacactctctccctgggtgtcaggacattgcagacgagtttcgggctcaagagattgacggtcaggcactcctcttactcaaggaagatcatcttatgagcgccatgaatataaagctgggccctgcactgaagatatgcgctcgcattaattccttaaaagagagctag

SEQ ID NO: 23873 - DNA, 456 bp, Artificial Sequence
  Description of Artificial Sequence: Synthetic coding sequence
atggccgaggccgagttcaaggaccacagcaccgcaatggatacggaaccaaaccccggaaccagctcagtgtccacgacaacctcaagtacgaccacaacaactatcaccacatcaagcagcaggatgcagcagccccaaatttccgtttacagcggctccgatcgtcatgcagtccaggtcattcagcaagcgctccaccggcctcccagtagtgcagctcagtatctgcagcagatgtacgcggctcagcagcagcaccttatgctgcacacagcggctctgcagcaacaacatctgtcatctagccaacttcagagccttgccgcagtacaagcaagtctgtcctccgggaggcctagcacttctcccacgggtagcgtgacccagcagtccagcatgagtcagacgagtgtgagctctctcaacttcttttttctcgatctgaaattctag

SEQ ID NO: 23874 - DNA, 1797 bp, Artificial Sequence
  Description of Artificial Sequence: Synthetic coding sequence
atgtcggcttcagcccagcagctggccgaggaactacaaatattcggactggactgtgaagaggccctcatcgaaaagctcgtggaactctgtgttcagtacggccagaacgaggaaggaatggtgggagaacttattgctttttgtacaagtacgcataaggtgggattgactagtgagatcctgaattcattcgagcacgagttcttgagcaaaagactgtccaaggctagacactccacttgcaaggactccggacacgccggtgccagggatatcgtgtcaattcaggaattgattgaagtcgaggaggaggaagaaattctgctgaactcttacactactccttcgaaggggagccagaaaagggcgatttcaacacccgaaaccccactgacaaagagatcggtgagcactagatcgccgcatcaactcctgagtcccagctccttctcaccatctgctacaccatcacagaaatacaacagtagatctaataggggagaagtggtgaccagcttcggcttagcccaaggagtgagctggtctggtcgcggaggggctgggaatattagcttgaaggtgctcggatgccctgaggctctcactgggtcttacaagagtatgttccaaaaactccccgatatccgggaggtcttgacttgcaagattgaagagctcggatccgagctgaaggagcattataaaatcgaggcgttcacccctctgctggccccagctcaagaacccgtgactttattaggtcagattggctgcgacagtaatggaaaattgaataacaagtcagtaatcctggaaggcgaccgggagcactcaagcggggctcagatacccgtcgatctatctgagctcaaagagtattctctctttccaggccaggttgtaataatggagggaatcaatacgacaggtcgtaagcttgttgcgacaaagctttacgaaggcgtcccgctgcccttctatcagcctacggaagaggacgctgatttcgaacagtcgatggtgctcgtcgcgtgcggcccttataccacctctgactcaattacatacgatcctctgctcgatttaatcgcagttattaaccatgatagaccagatgtgtgcatcctattcggtcccttcctcgatgcaaaacacgagcaggttgaaaactgtctgctgacatctccatttgaggatatcttcaagcagtgtctcaggacgatcattgaagggacccggtctagtggcagccatctcgtgtttgtgcccagtcttagagatgtacatcatgaaccagtttatccccagcctcccttttcttattctgatctgagccgcgaggacaaaaagcaagtgcaattcgtgagtgagccatgtagtctgtcaataaatggcgtgatttttggcttaacctccaccgaccttctctttcacttgggagcggaggagatcagctcttcgtccggaacttcagaccgattctccaggatcctcaagcatatcctgactcagaggtcttattatccactgtatcccccacaggaagatatggcaatcgactatgagtccttttacgtatacgcccagctgccagtgaccccagacgtgctgatcataccaagtgaattgcgctacttcgtgaaagatgttctcggatgtgtctgcgtgaaccccggaagactgacaaagggacaagtcggaggcacgttcgctcgcttgtacctccgcagaccagctgctgacggagctgaaagacagtctccctgcattgctgttcaggttgtccgaatctag

SEQ ID NO: 23875 - DNA, 1086 bp, Artificial Sequence
  Description of Artificial Sequence: Synthetic coding sequence
atgtttcaaaaactcccagatataagagaagtcctcacatgtaagatcgaagagctgggctccgagttgaaggagcactacaaaatagaagctttcacacctttgctcgcgcctgcccaggagcctgtgacactgttgggtcaaatcgggtgtgactctaatggcaaattaaacaataagtccgtgatcctcgagggggacagggaacactccagtggtgcccagattccggtggacctatcagagttaaaagagtattctcttttcccgggtcaagtcgtgataatggagggtatcaacacaactggccgaaagttagtagctactaaattgtacgagggcgttccgctgcccttctaccagcccacggaagaagatgccgatttcgagcagtcaatggtcctggtggcctgcgggccatataccacatctgatagcatcacgtacgaccccttactcgacttgatcgctgtgattaaccatgatcggccagacgtgtgtatcttgtttgggcctttccttgacgcgaagcatgaacaggtcgagaattgcctcttaacatctccctttgaggatatttttaaacagtgcctaaggacaatcatcgagggcactcggtcaagcggaagccatctggtcttcgttccttcgttgagagatgttcaccacgaacccgtgtatcctcaacctcccttcagttattctgacctgagccgcgaagataagaaacaagtgcagttcgtgtcagagccctgttccctaagtattaatggagttatctttggcctgactagcactgacctcctgttccatctgggagcggaggaaattagctcgtcctctgggaccagcgacagattctcacgaatactgaagcacattctgactcaacgcagctattatcctctgtaccctccccaagaggatatggccattgattatgagtcattctacgtgtacgcccagctgcccgtaacgccggacgtgctgatcatcccttctgaattacgatatttcgtaaaagtcgggcttaacagcgcttttagtcaaaagcaccagaaccccgtgttcgacttccccttttag

SEQ ID NO: 23876 - DNA, 1485 bp, Artificial Sequence
  Description of Artificial Sequence: Synthetic coding sequence
atgttgccaaaacggaggcgggctcgagtcggatcaccttccggcgacgctgcttcttccacgcccccttcaaccaggttcccaggcgtagcaatttacctggtcgagccgcgaatgggcagaagccgacgcgctttcctcaccggcctagccaggagcaaaggctttcgagtgctcgatgcctgctcatccgaagctacccacgtcgtcatggaagaaacgtccgccgaggaggccgtctcatggcaggagagacggatggctgcggctccacccggttgcacaccacctgccttactggacatatcctggctgacagaaagtctgggtgcaggccagccagtgcctgtggagtgtcggcataggctcgaggtggccggaccaaggaaaggtcccctgtctccagcctggatgccagcatacgcctgtcagagacccactccccttacacaccacaatacaggactcagcgaggctcttgaaatactcgccgaagccgctgggtttgaagggagtgaaggtcgtttgctcaccttctgtcgggctgcatccgttctcaaagcactcccatcaccagttactacattgagtcagctccagggcctgccccactttggggaacattccagccgtgttgtgcaagaactcctggagcacggagtctgcgaggaggtggagagagtgcggaggtcagagcgataccaaacaatgaagttgttcacccagatcttcggagtcggcgtcaaaactgcagacagatggtacagagaaggcttgcgcactctcgatgatctgcgggaacagcctcagaaactgacccagcagcagaaagcagggttgcagcaccaccaagacctgagtacacccgtgctccgtagtgacgtggatgccctccagcaggtggtcgaggaggccgttggacaggcactcccaggggcaaccgttactttgaccggtgggtttcgtcgcggaaaactgcagggccatgatgtggacttcctgatcactcaccctaaggaaggccaagaagccggacttctgcctagggtcatgtgccgtctccaggaccagggactcatcctataccaccaacatcagcacagttgttgtgagagtcccactagactggctcagcaaagtcacatggatgcatttgaacgatccttttgtatctttcggctgccccagccgccaggagccgctgtcgggggttccacacgcccatgcccttcatggaaggctgtcagggtggacttggtggtagccccagtttctcagttcccatttgctttattaggctggaccggctccaagcttttccaaagagaactccgccgattttctagaaaagagaagggtttgtggctgaactcacacgggctttttgacccagagcagaagacattttttcaggcagcctccgaggaagacatcttccgtcacctgggattggagtacctgccacctgaacaacgcaacgcctag

SEQ ID NO: 23877 - DNA, 1374 bp, Artificial Sequence
  Description of Artificial Sequence: Synthetic coding sequence
atgctccccaagcggaggcgtgccagagtgggctctccttccggagatgccgcatcatctacacctcccagcacacgctttcctggggtcgcaatttatctcgtcgagcctcggatgggcagatccaggagagcatttctcaccgggttagcccgtagtaagggctttcgggtgctggacgcctgcagctccgaggccacccacgtagtcatggaagagacatccgccgaggaggccgtgtcgtggcaggagaggcgcatggcggctgctccaccaggctgtaccccacccgcattattagacatttcttggctcacggagtctctcggcgctggccagcctgtacccgtggaatgtcgacaccggttagaggtggccggtcccagaaaaggcccactcagcccagcctggatgccagcctacgcctgccagcgcccaactcccttgacccatcacaacacgggattgagcgaagccctcgagattttagcggaagcagccggttttgagggctctgagggcaggttgctgacgttttgtcgcgctgcctctgtcctaaaagcccttcctagccctgtgaccaccctgagccaattgcagggtctgccacactttggagagcattcctcaagagtggtccaagagctgcttgaacacggggtgtgcgaggaggtcgagagagtgcggagaagtgagcgctatcagactatgaaattgtttacccaaatcttcggagtgggggtaaagactgctgatcgctggtaccgggagggtctcagaactctggatgacttacgagagcaaccacagaagctgacccagcagcaaaaggctgcaccacccggaccagagcacccctctcccgcagttcggtgtcgctgtcctgccgctggcggagggggatcttgtggagcaggtcctgcatggggacaccgacacgcggataggcgtctaccacaggggctcatcctgtatcaccagcaccagcatagctgctgcgagtcccctacaagactggcccagcagtcacatatggacgcttttgagcgctctttctgtatcttccggctgccacagccacctggcgctgcagtcgggggatcaaccagaccatgtccatcatggaaggccgtcagggtggacctggtcgtggctcctgtgtcccagttcccctttgccttactgggatggaccggcagcaaactcttccaaagggagttgaggaggtttagccgtaaggaaaagggcctctggctgaacagccacggactgtttgacccggagcagaaaaccttctttcaagcagcttccgaggaggacattttcaggcatctcgggctcgagtacctcccacctgagcagcggaatgcctag

SEQ ID NO: 23878 - DNA, 1527 bp, Artificial Sequence
  Description of Artificial Sequence: Synthetic coding sequence
atgttgcccaagagaagaagagcgagggtggggagcccctcgggggatgcagctagcagcaccccccctagcacgaggttccccggagtggcaatttatttggtcgaacccaggatgggccgatcaagacgggcttttctaacaggtctggcacgttcaaaagggtttcgagtgctggacgcttgctcctcagaggcaacgcatgtggttatggaggaaaccagtgctgaagaggcggtttcctggcaggagcggagaatggctgccgcaccccctggctgcacccctcctgccctcctggacataagctggctgaccgaatcacttggtgcgggtcagcccgtgcctgtcgaatgtcggcatagacttgaggtggctggaccacgaaaagggcctctatcaccagcctggatgccagcatacgcctgtcagagaccaactccactcacgcaccataacacaggactgtctgaggccctggaaatactcgcagaggcagctgggttcgaagggtcggagggtcgcctcctgaccttttgtcgtgccgcaagcgtgctgaaagcactgcctagtcccgtgaccacactgtcccagctacagggcctccctcattttggcgagcattcttcccgcgtggtccaggagctcctagagcacggtgtctgcgaagaggttgaaagggtgcgaagatccgagcgggctccagctccccctggaccagaacacccgagccctgctgtccgatgtagatgtcctgccgcaggaggcggaggaagctgcggagccggacctgcctggggccaccggcacgcggatcggaggcttccccagggattaatcctgtatcatcagcaccagcactcttgctgcgagagtcctacgcgtttggcacagcagtctcatatggatgcctttgaacgctctttttgtatttttcggttgccccagcctcccggagcagcggtcggcggttcaacccggccatgcccgagttggaaagccgttcgcgtggatctggtggtggcccctgtctcacaatttccgtttgcacttctgggctggaccggatctaaactgtttcagagagaactgagacgcttctccagaaaggaaaagggcctctggctcaactctcatggcctttttgaccccgaacaggggagcagttctgggaaaacaccacggagtcgaaaaagctgcttctgttgcagaaggcacttttcaaaacgcttacagcggaagaccagctctgatacatgggcgctgtccacgttcctgcagtccagggagacccccgaacccgcatgtgttccgcactttcactctggaaactgggccgctcccaacctcgcaaccgaatgcctgcaagctgatatgctccctccagatcctcacctgcacccttcacctcctcgccctggtagcagtggaggacagctgtgtctgcaggaccagttgtccccatgctggtgtgctgccggttgcgacgaagtaggagccctttctgcttctctgattacggtgtag

SEQ ID NO: 23879 - DNA, 480 bp, Artificial Sequence
  Description of Artificial Sequence: Synthetic coding sequence
atgctgccaaagcggagaagggcaagagtgggcagcccctcaggagatgctgcaagtagcaccccccctagtactagatttccgggtgtcgccatttatctggtcgaacctcggatggggaggtcacgaagagcatttctgacaggtctggcaagaagtaaagggttcagggtcctcgacgcctgctcttccgaagctactcatgttgtgatggaagaaacatccgccgaggaggctgtgtcttggcaggagcgacgaatggcagccgcaccccctggatgcactcccccagctctccttgatatatcttggctgacagagtctctgggcgctggacaaccagtcccggtggaatgtcgccatcgcttggaggaggccctagagattctggcggaggccgctggcttcgaagggtcggagggcagactgctaactttctgtcgggctgcaagtgtcctcaaggccttgccttccccctag

SEQ ID NO: 23880 - DNA, 729 bp, Artificial Sequence
  Description of Artificial Sequence: Synthetic coding sequence
atgttacctaagaggcgacgggctagagtgggctctccttccggagacgcggcaagctcaacccctccaagtaccagattccctggcgtcgctatttatttggtggagcccaggatgggtaggtctaggcgcgcattcttgacagggctggctaggagcaagggatttcgcgtgctcgatgcctgctcctcagaagctacccatgtagtgatggaagagacctcagctgaggaagccgtgagctggcaggaacgaagaatggccgctgccccacccggttgtactccccctgccctgctggatatttcttggctcacagagtccctgggagcaggacagccggtgccggtggaatgtaggcacaggctggaagttgctggtcccaggaaggggccacttagtcccgcttggatgcctgcctacgcttgccagaggccaactcccttgacacatcataatacaggacttagcgaggcgttggaaatactggctgaagctgctgggtttgaaggcagcgaggggagattgctgacgttctgccgtgccgcatcagtgttgaaagcactgcccagccccgtcaccaccctctctcaactacaaggtcttccacattttggcgagcatagttctcgagtcgtgcaggaactccttgaacacggagtatgcgaggaggtggagcgggttcggcgtagcgaatcaagctcccctcgaagctccggcagcgtatag

SEQ ID NO: 23881 - DNA, 813 bp, Artificial Sequence
  Description of Artificial Sequence: Synthetic coding sequence
atgctccctaagcgtcggagggccagagtaggcagcccttcaggcgacgctgcctccagcactcctcctagcaccaggttcccgggagtcgctatctacctggttgagccaaggatgggacggtcccggagggcgtttctcacaggccttgctcggagcaaggggttccgggtactcgacgcttgttcatccgaggcgacccatgtcgttatggaagagactagtgccgaagaagctgtgtcctggcaggagaggcggatggcagcagcaccccctggatgtactcccccagcccttctggatatctcttggctcaccgaatctttgggggcaggccagcctgtgccggtggaatgccggcacagactggaggtggctgggccacgtaagggcccactcagccctgcgtggatgcctgcatatgcctgccagcgtcccacacctctgacccaccacaacacaggactgtcagaggccctagaaatattggcggaggctgctggcttcgaaggtagtgagggtaggctccttacattttgccgcgcagcatctgttctgaaggccctgcctagccctgtgacgactttgtcccagctgcaggggctgcctcactttggtgaacattcatccagagtggttcaggaactattggagcacggagtgtgcgaagaggtggaaagggttcgaagatctgagaggtatcaaactatgaaagtgcggagggcgggtctgggcccaactccgggaatgagttgccccggtaacgataatactgttcataccatgcacggagaggcgaatcgcggttcatag

SEQ ID NO: 23882 - DNA, 5163 bp, Artificial Sequence
  Description of Artificial Sequence: Synthetic coding sequence
atgttaattagcaaaaacatgccatggcgtcgccttcagggaatcagcttcggtatgtacagcgctgaggagttgaagaaactgtccgtgaaatcaataaccaaccccaggtacctggacagtttggggaacccctccgccaatggcctctacgacctcgccctgggtccagccgacagtaaggaggtttgcagtacttgtgtccaagacttttccaattgttctggccatcttggacatatcgagctgccactgacggtatacaatccattgctgtttgataagctctatttactgttaagaggctcctgtctcaattgccacatgctcacgtgtccccgagccgtcatccacctgctgttgtgccaactaagggtcttggaagtgggcgctctgcaggccgtctatgagctcgagaggatcctgaaccgattcctggaagagaaccctgacccttccgcatctgagatcagagaggaactggagcagtacacaacagagatcgtccaaaataacctgttaggatcccagggagcgcacgtgaagaatgtctgcgaatctaaaagcaagctgatagcgctcttctggaaagctcacatgaacgccaagaggtgtcctcactgcaagaccggaagatctgtcgtgagaaaagagcataacagtaagttgactattacattcccagcaatggtgcacagaactgctggtcaaaaagattccgaacctttgggaattgaggaggcgcaaattggaaaacgcggttacctcactccaacaagcgcccgtgaacatctttcggccctgtggaagaacgaggggttctttctgaattacttgttctccggcatggacgacgatggcatggaatctcgcttcaaccccagcgtatttttcttggattttctggtggttccaccttcacgctatcgcccagtctctcgtctgggcgatcagatgtttactaatggacagaccgtcaaccttcaagcggtgatgaaggatgtggtccttatcagaaagctgctggcactcatggcccaggaacagaagctgcctgaagaagtggccaccccaacaacagacgaggagaaagactctttgatcgctatcgacaggtccttcctatcaacactgcccggacaatctcttatagacaaactttataatatctggattcggctccaatctcacgtgaacatcgtttttgactccgaaatggataaactcatgatggacaaataccctggaattaggcaaattttggagaaaaaggaagggctatttcggaagcacatgatgggaaaaagggtcgattatgcagccagatccgttatctgcccggacatgtatataaacaccaacgaaatcggaatcccaatggtatttgcaacaaagttgacttacccgcagcccgtaacgccgtggaatgttcaggagttgcggcaggctgttattaatggtcccaacgtccaccccggtgcgagtatggtaatcaatgaagacggaagcagaacagctctgagtgcagtggatatgacccagcgagaagccgtggctaagcagttattaaccccagcaacaggggcacccaagcctcagggtacaaaaatcgtgtgtcgacacgtcaaaaatggcgatatattgctgcttaacaggcagcctaccctgcacagaccgagtatccaggcccatcgagcacgcatcctccctgaagaaaaagtgttgagactgcactacgccaattgcaaagcctacaatgctgattttgacggcgacgaaatgaacgcccacttccctcaatctgaactaggtcgggcagaggcatatgtgctggcctgcacagatcagcaatatctggtgcccaaagacggtcagcctttggcaggcttgatacaagatcatatggtcagcggtgcctcaatgactacccgagggtgtttttttactcgggagcattacatggaactggtgtacagaggcttaactgacaaagtcggcagagtgaagctgctgtccccttccattctgaagcccttccccctgtggactggcaaacaggtggtatctaccttgttgataaatattataccagaagatcacatccccctgaaccttagtggtaaagccaaaatcacaggcaaagcgtgggtcaaggaaacacccagatctgtgcccggatttaacccggattctatgtgtgaaagtcaagtcatcatccgagaaggcgagctcctgtgtggcgttttggacaaagcccactatggaagctccgcctacggactggtgcactgttgttatgagatttacggaggcgagacttctggcaaggtcctaacatgtcttgctcggctatttacagcatatcttcagttgtacaggggctttaccctgggggtcgaagacattctggtcaaaccgaaggcagacgtcaaaaggcagcggatcatcgaagaaagcactcattgtggaccacaggccgttcgagcagctctgaacctcccagaggccgcaagctatgatgaggttcggggaaagtggcaagatgcacatctcggaaaggatcagcgcgacttcaacatgatcgaccttaaatttaaagaggaggtgaaccactattccaacgaaatcaataaggcatgcatgccctttggtctgcatagacagtttcccgagaattccctgcagatgatggttcagtcaggcgctaagggtagcaccgtgaatacgatgcagatttcatgtctgctgggacagattgaattggaaggccgtcggccacccctcatggccagtggcaaaagtctgccctgtttcgagccttatgagttcaccccgagagccggaggattcgtgacaggaagattcctgactggcattaagcctccagagttctttttccattgtatggctgggagggaaggtctagttgacactgccgtaaaaacctctagaagcggctacttgcaacggtgtatcattaaacacctcgaggggctggtggttcagtacgaccttaccgtgagggactccgacggctcagtagtgcagttcctgtacggtgaggacgggttagatattcctaagacccaatttctccagcccaagcagttcccatttttggccagcaattacgaagttattatgaagagccagcatctgcacgaagtgctgagtcgcgcagatcccaagaaagccctgcatcactttcgagcgattaagaagtggcaatcaaaacaccctaataccctgctgcggagaggggcattcttgagttactcccagaagattcaagaggccgtcaaggcactgaagcttgaatccgagaataggaatggcagaagcccaggaacccaggagatgttaagaatgtggtacgaactggatgaggagtcccgaaggaaatatcagaagaaagcggctgcatgccctgaccctagcctaagcgtttggagacctgacatttatttcgcctcagtgagcgagacatttgagacaaaggttgacgattactcccaagagtgggcagcccagaccgagaagagttatgaaaagtcagaacttagtcttgaccgactgaggactcttctccaattaaaatggcagcgctcactgtgcgagcctggagaagcggttggattgctagcagctcagtctattggagaaccatctacccagatgacactgaacactttccattttgctggaagaggcgaaatgaatgtgacccttgggattcccagactgcgcgagattctcatggtcgcatccgctaacatcaagactccaatgatgagtgtgcctgttctgaatacaaagaaagctctgaagcgcgtgaagagcctaaagaagcagctcacccgcgtctgcctcggcgaggtcctgcagaagattgatgttcaggaaagcttttgtatggaagaaaagcagaataaattccaggtgtaccagcttcgcttccaattcttgccacatgcatactaccagcaggagaagtgcctgcggccagaggatattctccgttttatggaaacccggttcttcaaacttctgatggaaagcattaaaaaaaagaacaataaagccagtgcctttagaaacgtgaatacgcgtagggctacacaacgtgacctcgataatgctggcgagctggggcgtagtcgtggcgaacaggaaggtgatgaggaggaggaaggtcatatcgtcgatgccgaagcagaggagggagacgctgacgccagcgatgctaaacgcaaggagaagcaggaggaggaggtcgattatgagtccgaagaagaggaggagcgtgaaggcgaagaaaacgacgacgaggatatgcaggaagagcgcaatccccaccgcgagggagctcgcaaaacgcaggagcaggacgaagaagttgggcttggaacagaggaggatccctccttaccagctctgctgacacagccccgtaagccaacgcacagccaagagccacagggacccgaagctatggagcggagggtgcaagccgtgagggaaattcaccctttcatcgatgattatcagtatgatacagaggagagtttgtggtgtcaggtgaccgtgaagctgcccctgatgaaaatcaacttcgacatgtcatcccttgtcgtgagcctcgcccacggagcagtaatctacgcaacgaagggtattacacggtgtttgctgaacgagacgacgaataataaaaatgaaaaggaactggtgcttaatacggagggaatcaacctccctgaactctttaagtatgccgaggtcctggatctgcggagactgtatagcaatgacattcacgccatcgccaacacctacgggatcgaggccgcattacgggtcatcgagaaggagatcaaggacgtcttcgctgtgtacgggatcgctgtcgaccccagacatctgtcattggtagccgattacatgtgttttgagggcgtgtataagcccttaaatcgattcggcatccgttctaattcatcccccctgcagcagatgaccttcgagacatctttccagttcctcaagcaggcgaccatgctaggttcacacgatgagctgagatccccgtctgcctgcttggtcgttgggaaggtggttaggggcggaactggcctcttcgagctgaaacagcccctgcggtag

SEQ ID NO: 23883 - DNA, 4979 bp, Artificial Sequence
  Description of Artificial Sequence: Synthetic coding sequence
atgctcattagcaaaaatatgccatggcgacggcttcaaggcatttcttttggcatgtacagcgcagaagagctgaaaaaactgagtgtgaaatctattactaacccgaggtacctggatagtctgggaaatccaagcgcaaatggcctgtatgatctggccctgggcccagccgactctaaagaagtatgcagcacatgcgttcaggactttagcaattgcagtggccatctcggacacattgagctcccgttgaccgtgtacaacccactcctatttgacaaactgtacctactcctgcgtggcagttgcctgaactgccatatgctcacctgccccagagctgtcatacatctattgctctgccaactacgggtgctggaggtgggggctctgcaggctgtgtatgagttggagcgcatcctgaacaggtttctcgaggagaatccagatcccagtgcttcagagatcagagaggaactggaacaatacacaacagaaattgtccagaacaaccttctgggcagtcaaggtgcccatgtgaaaaacgtatgcgagtccaagagtaaacttatcgcccttttttggaaggcccacatgaatgccaaaagatgtccacattgcaagaccgggcgatcggtggtcagaaaggagcacaacagcaaactgacgataacattcccagctatggttcaccgtaccgctggtcagaaagattctgagccgctggggatcgaggaggctcagatagggaagcgaggttaccttacacctaccagtgcgagggaacacctgagtgcattatggaagaacgaaggcttcttcttgaattatctcttctcaggaatggacgatgatgggatggaatccagatttaatccctccgttttttttttagactttttggtcgtgcccccttctagatacaggcctgtgagtaggctaggggaccagatgtttaccaacggacagacggtaaacttgcaggcggtgatgaaggacgttgtactgatccgaaagttgctggccttgatggcccaagaacagaagctgcccgaggaagttgccacgcccaccactgatgaggaaaaggatagtcttattgcaatcgatcgctctttcctgtctaccctgcctgggcagtctctgattgataagttgtacaacatttggatccgcttgcagtcccatgtcaatatagtcttcgattcagaaatggacaaactaatgatggacaagtatccaggcatacggcagatattggaaaaaaaagagggtctatttcggaagcacatgatggggaaaagggtagactacgcggctaggtcagtgatatgtccggatatgtatattaacaccaatgagatcggaatccccatggtattcgccaccaaattgacctacccacaacccgttactccctggaatgtacaggagctgagacaggctgttataaatggccctaacgtgcatcctggtgcctctatggtcatcaatgaagatggaagccgcaccgcactctctgcagtcgacatgacacaaagggaagccgtcgccaagcagctgctgacacctgcgacaggcgctcccaagccccagggcactaagatagtatgtcgccatgtaaagaacggagatatcctcctgctgaaccgtcagccaactctccatcgtccgagcatccaggcccatcgcgcaagaatcctccccgaagagaaggtgctgagactgcactatgctaactgcaaagcctacaatgccgatttcgacggtgatgagatgaacgcgcactttccacagtctgaactggggagagcagaggcttacgtattggcatgtaccgatcagcagtatctggtgccaaaggacggccagcctctagcaggactcattcaagaccacatggtctcaggggcttctatgaccacccgtggatgcttctttacaagagagcattatatggagctggtgtaccggggtctcacagataaagtgggccgtgtcaaattgctgtcccccagcattttaaaacctttcccactgtggactggtaagcaagttgtcagtacactccttatcaatatcattcccgaagatcacattccgctcaatctgtctgggaaagctaagatcaccggcaaagcctgggtcaaagaaacccccaggtccgtcccaggcttcaatcccgacagcatgtgtgagtcacaggtgattataagagagggtgagctcctgtgtggcgtcctggataaagcccattatggcagttctgcctacggcctggttcactgctgttacgaaatctatggaggagagacatccggcaaggtgctgacgtgcctagcccgactgttcaccgcgtatctgcagctgtacagaggcttcacgctgggagttgaggacattttggtaaagcccaaggcagacgtgaagagacagagaattattgaggagtctacacactgtggcccacaggcggtgagggcagcactgaacctgcccgaggcagcttcgtatgacgaggtccgaggtaagtggcaggatgcccacctgggcaaggaccagagggattttaacatgatagacctcaaattcaaggaggaagtcaaccattacagcaacgagattaataaggcgtgcatgccatttggtttacacagacagttccctgaaaattcgctccaaatgatggtgcagagtggcgcaaaagggagcacagtgaacacaatgcagatctcatgcctactcggccagatcgaactcgaggggagacggcctccgcttatggccagcgggaaatccctaccatgctttgagccgtatgagtttacgcccagggctgggggatttgtgaccggaaggttccttaccggcatcaaacctccagaatttttctttcactgtatggccggacgtgagggactggtcgatacagctgtcaagacgagccgcagcggctacctgcaacgctgtattattaagcacctggagggacttgtggtccagtatgacctaaccgtgcgagatagcgatgggagtgtggttcagtttctgtacggtgaagacggactggacatccctaaaacccagtttctccaacccaagcagtttcctttcctcgccagcaattacgaggtcattatgaagagtcaacacctccacgaggtcctctccagggccgaccctaagaaagcactgcatcatttccgggctattaagaagtggcagagcaagcaccccaacaccttgttgagaagaggcgcattcttgtcatactcccagaaaatacaggaggccgtgaaggccctgaaactagaatccgagaacagaaatggacgatccccaggtactcaggaaatgctgcggatgtggtacgagctggatgaggaaagcaggcgcaagtatcagaagaaagcagccgcttgtcctgatccatcacttagcgtctggcgccctgatatttacttcgcgtccgtctctgagactttcgaaacaaaggtggacgattactctcaggagtgggccgctcagaccgagaagtcatatgagaaatccgaactatccctggaccggcttcgtacattgctacagttgaaatggcagaggagtttgtgcgagcccggtgaagcagttggactgttggccgcacagtcaattggagagcccagtacacagatgactctgaataccttccatttcgccggacggggtgagatgaacgtaaccttaggcattccccgactgcgcgagatcctgatggtggccagtgccaacattaaaacccctatgatgtccgttcccgtcctgaataccaagaaggcactaaaacgggttaagagtctaaagaagcagctgacacgggtgtgcctaggggaagttcttcagaagattgatgtccaggagagcttttgtatggaggagaaacagaataaattccaagtgtaccaactccggtttcaatttctcccgcacgcatactaccagcaagagaaatgcttgcgccctgaggacattctgaggttcatggagacacggttctttaaactgctgatggagtctattaagaaaaaaaacaacaaagcctccgctttccggaacgtcaatacacggagagccacccagagggacctggacaacgccggtgagctcgggcgtagtcggggagagcaagagggggacgaagaagaggagggccacatagttgacgccgaagccgaggaaggagacgcagacgcctccgatgctaagaggaaagaaaagcaagaggaggaagtagactacgagagcgaggaggaggaagagcgcgagggggaagaaaacgatgatgaggacatgcaggaggaacgaaacccacatcgagagggggctagaaagacacaggagcaggatgaggaggtgacagttaaactccctttaatgaaaatcaattttgacatgtccagtttggtggtaagcctcgcacacggagctgtgatttatgccaccaagggaattactcgttgcctcctgaatgagacaacaaataataagaatgagaaggaactggtgctcaatacagaaggtatcaacctgcctgaactatttaaatatgccgaagtactcgacttgcgtcgtctttatagcaacgacatacatgccatcgctaacacctatggtattgaggccgcattgcgcgttatcgagaaggagattaaagatgtgttcgctgtttacggtattgcagtggaccctaggcatctgagcctagtcgcggattacatgtgctttgagggagtgtacaagcctttgaatcggttcggcattaggtctaactcatcacctttgcagcagatgacatttgagacaagctttcagttcctaaagcaggccactatgctcggaagtcatgatgaattacggtccccttcggcgtgcttggtggtaggcaaggttgtaagaggaggcacaggcctctttgagcttaaacagccactccggta

SEQ ID NO: 23884 - DNA, 3408 bp, Artificial Sequence
  Description of Artificial Sequence: Synthetic coding sequence
atggatcctggctcccgctggcggaacctcccgagtggcccatccttaaaacacctgactgatccctcctacggcattccgagagagcaacaaaaagcagccctccaggagctcactcgggctcacgtcgagagctttaactatgccgtgcatgaaggcctgggcctggctgtacaggccattccaccattcgagttcgcgttcaaagacgaacggatcagcttcacaatacttgacgctgtgatctccccacctaccgttcccaaaggcacaatttgcaaggaggctaacgtctaccctgcggagtgccgcggtaggagatccacctacaggggaaaactcaccgccgacatcaattgggctgtgaatggcattagtaaggggatcatcaaacaattcctcggttatgtccccatcatggtgaagagcaagctctgtaatctccgcaacttgcctcctcaagctttaattgaacatcatgaagaggcggaggagatggggggttacttcattattaatggtattgaaaaagtaattcggatgctgataatgccccgacgtaacttccctattgccatgatccgccctaagtggaagacgcgtgggccaggatacacacagtacggcgtgagcatgcactgtgtgcgagaagagcatagcgctgtgaatatgaacttgcactacttggagaatggaaccgtgatgttgaacttcatatacagaaaagaactcttctttctgcccttgggttttgctctgaaagccctcgtgtcttttagcgactatcaaatctttcaagagctgatcaaaggaaaggaggacgattcgttcttgcgcaactcagttagccagatgctccgcatcgtcatggaggaaggatgttcaacccagaaacaggtactgaattacttgggagaatgtttcagggtgaagctgaacgtgcctgactggtacccgaacgaacaggctgctgagttcctattcaatcagtgcatctgcattcacctaaagagcaataccgaaaaattctacatgctgtgcctcatgacacgcaaactattcgctctcgccaagggtgaatgtatggaggacaatccggatagcctcgttaatcaagaagtcctgaccccagggcagctctttctgatgttcctcaaggaaaaacttgaggggtggttagtgtccattaagattgcctttgacaagaaggcccagaaaacttctgtgtcaatgaataccgacaatctcatgcggatttttaccatggggatcgacctcacaaagccattcgaatatctctttgccacaggtaacctcagaagtaaaaccggtctggggcttttacaggatagtgggttgtgtgtggttgccgacaagctgaatttcatccgttacctgagtcacttcagatgcgtccatagaggagctgactttgcgaagatgaggaccacaactgtgcgtcggcttttacctgaatcttggggttttctttgtccagtgcatacccctgatggagagccctgtgggttaatgaatcatctgacggcagtttgtgaagtggttacccagttcgtgtacacagcttctatacctgcacttttgtgcaacctaggagttacacccatcgatggcgcaccacatcgcagttattctgaatgttacccagtcctgctagacggggtgatggtggggtgggtggacaaggatttggcaccaggaatcgcagacagtctccgccacttcaaggtattaagggagaagaggatcccgccttggatggaggtagttctaattccaatgacggggaaaccttcgttatatcccggactgttcctgttcactactccttgtcggctagtacgccctgtgcagaacctggcgctgggaaaagaagagctgattgggactatggagcagatctttatgaacgtcgcaattttcgaggacgaagtgtttgctggtgttacaacacaccaggaactgttcccacactccctgcttagtgtgatcgccaactttatccccttttcagatcacaatcagtcgcccaggaatatgtaccagtgccaaatgggaaagcagacaatggggttcccattgctgacctatcaggacaggtccgacaacaaactttaccggctgcagactcctcagtcaccactggtcagacccagcatgtacgactactacgatatggataactatccaatcgggacaaacgctatcgtcgcagtcatatcttatacaggttacgacatggaggatgctatgattgttaacaaagcctcatgggaacgtggatttgctcacgggtcagtttataagtcagagttcattgacctgtccgagaagatcaaacagggcgactctagcctggtgtttggaattaaacccggagatccacgagtcctgcaaaagctggatgacgacggcctgcctttcatcggcgcaaagctgcaatatggagacccctattattcgtatctgaaccttaatactggcgaatcctttgtgatgtactacaagagcaaggaaaactgcgtagttgataatattaaagtgtgttccaacgacacggggtctgggaagtttaaatgcgtctgcattacgatgagagtgccccgaaatccaaccattggtgacaagttcgcctcaagacatgggcagaaagggatactgtcccgactgtggcctgcagaggacatgccttttacagagtcaggtatggtgcccgacatattgttcaacccgcacggattccctagccggatgaccataggaatgctgatcgaaagtatggcagggaagagcgctgcacttcacggtttgtgtcatgacgccacacctttcatcttctctgaggaaaattcagccctggaatatttcggggagatgctcaaagcagcgggatataatttttatggcacagagcgcctttacagcggcatcagcggattggagctcgaggccgacatcttcatcggagtggtgtactaccagagactgcggcacatggtgagtgataaattccaggtgaggacgactggggcaagggatcgtgtgacaaatcagcctatcggtggtagaaatgtacagggagggattagatttggcgaaatggagagagatgctctgctcgcccacggcacgagtttcctgctgcacgataggctttttaactgctccgaccgttccgtggcccatgtttgtgtgaaatgtggctcattgctctctcccctcctagaaaaaccgcctccgtcttggagcgccatgaggaataggaagtataactgtacgctctgttctagaagcgacacaatagacacagtatcggtgccctacgtgtttcgctacttcgttgccgagctcgctgcaatgaacataaaggtgaagcttgatgtagtatag

SEQ ID NO: 23885 - DNA, 3240 bp, Artificial Sequence
  Description of Artificial Sequence: Synthetic coding sequence
atggaccctggctcacgatggcgcaacctcccaagcggaccttccttgaaacacctgacagacccttcatacggcattcccagggaacagcagaaggccgcattgcaggagctgacacgggctcacgtcgagtcattcaactatgcagttcacgagggacttgggttggccgtccaggccgacatcaattgggctgtgaatggaataagcaaaggcatcatcaagcagttccttggttacgtgccaattatggtgaaaagtaagctgtgcaacctcaggaacctccctccacaggcactcattgagcatcacgaagaagcagaggaaatgggtgggtatttcataattaacgggattgagaaggtgatacgcatgcttattatgccaagaaggaacttcccgatcgccatgataaggcccaagtggaaaacccggggtcctgggtacactcagtatggcgtgtcaatgcattgtgtgagggaagaacactctgcagtcaacatgaacctccactacttggaaaatggcaccgttatgcttaattttatctataggaaggaactgttttttctacccttgggatttgcactcaaggccctggtcagtttttctgattaccagatatttcaggagctcattaaaggtaaggaagatgactcctttcttaggaattccgtcagtcaaatgttgaggattgtaatggaggaagggtgttctacacagaaacaggtgctaaactatctgggcgagtgttttcgggttaagttaaatgtcccagactggtatcccaatgagcaggctgctgagttcctcttcaatcaatgcatttgcattcacttaaaatccaatactgaaaaattctacatgttatgcctaatgactagaaaactgttcgccctggctaagggcgagtgtatggaggataaccctgattccttggtaaaccaggaggtgctgacccctggacaattgttcttaatgttcctcaaggagaagctggaggggtggcttgtctctattaaaatcgccttcgataagaaggcccagaagacttcagtcagtatgaataccgataacctgatgcgcattttcacgatgggtatcgatcttacaaaaccctttgagtacttatttgcgacaggaaacctcaggagcaaaacagggctaggacttcttcaggattctgggctgtgcgttgtagccgacaaactcaattttatccgctatctgtcccacttccgctgcgttcatcggggagccgatttcgccaaaatgaggactactactgttaggaggcttctgccagaatcatggggattcctgtgtcccgtacacaccccagacggggaaccctgcggactcatgaaccatctgaccgctgtgtgtgaggtcgtgacccagttcgtgtacacagcgagcattcccgcactactctgtaatctgggagtcacacctatcgacggtgctcctcaccgtagctacagcgaatgttaccctgtgctactggacggggtcatggtcggctgggtggacaaggatctggcgccagggatagccgacagcctgagacatttcaaggtgcttcgagaaaaacgcatccctccctggatggaggtggtgcttatccccatgactggtaaacccagtctgtaccccggactatttctgtttacaacaccatgccgactcgtccgtccagttcaaaatctggccctgggcaaagaggaactcatcggaacaatggagcagattttcatgaacgtggctatatttgaagatgaggtgttcgctggcgtgaccacccatcaggagctgtttccgcactcactgctgtcagtgatagccaatttcattcctttttcggaccacaatcaaagtcctaggaacatgtatcagtgtcaaatggggaaacaaacaatggggtttcctctcctgacttaccaggatagatcagacaacaagctgtaccggcttcagaccccccagtcacctctggtgagaccatccatgtacgattattatgacatggataactaccccatcggaaccaacgctatcgtggccgtgattagctatactggatatgacatggaggatgccatgattgtgaataaggcttcctgggaacggggatttgctcatgggtcggtatacaagagcgaattcattgacctaagtgagaaaatcaagcagggcgactcgagtctcgtattcgggattaaacctggcgaccctagggtactacagaagctggatgatgacggattacctttcataggagccaaacttcagtatggcgatccttactatagctacttgaatctgaacacaggagaaagttttgtcatgtattacaagtctaaggaaaattgcgttgtggacaatattaaggtatgttccaacgatactggctccgggaaatttaagtgcgtgtgcataacaatgcgcgtgcctcgcaaccctacgatcggcgataaattcgcatctcgccacgggcagaagggcatcctttcacgcctgtggccagcagaggacatgcccttcaccgagtccggtatggtgcccgacattttgtttaacccccacggatttccatctaggatgacgattggtatgttgatagaatctatggctgggaaaagcgccgctctgcacgggctatgccatgatgctaccccttttattttctccgaagaaaattctgcgttggagtatttcggtgagatgttaaaagctgctggatataatttttacggaaccgagagactctactccggcatctcaggattggaactggaagccgacattttcatcggcgtggtatactatcaaagactgcgtcatatggtcagcgataagttccaggtgcggacgacgggcgctagggatagggtcactaatcagccaatcggaggtcgaaatgtgcagggtggcattaggtttggtgaaatggagcgagacgcactgttggcgcacggaacttccttcctgctgcatgatcgcttgtttaactgttcagaccggagcgtggcccacgtgtgtgtcaagtgtggcagcctactgagcccattgctggaaaagccacctccttcctggtccgcaatgagaaatcgcaaatataactgtaccctgtgtagcagatcagacaccatagacaccgtcagcgtgccatatgtgttcagatattttgtcgcagaactggcagctatgaacatcaaagtcaagctggacgtcgtgtag

SEQ ID NO: 23886 - DNA, 345 bp, Artificial Sequence
  Description of Artificial Sequence: Synthetic coding sequence
atggacccaggtagcagatggcgcaatttgcccagtggcccatctctgaaacacttgaccgatccttcttatggcatcccaagagagcagcagaaggctgcgctccaggaactgactcgagcacacgtggaatcattcaattacgctgttcacgaagggctcggactcgccgtgcaggcaataccaccattcgagttcgcatttaaggacgaaagaatctccttcaccatcctggatgcagtcatatctccaccgactgttccaaaaggaaccatatgtaaggaggccaacgtgtaccccgctgaatgccggggaagacgttctacatacagaggtaagctctag

SEQ ID NO: 23887 - DNA, 387 bp, Artificial Sequence
  Description of Artificial Sequence: Synthetic coding sequence
atggaccccggatctcgctggcgcaacctgccttccggtccaagtctcaagcatctcaccgatccttcttatggtattccaagggagcagcagaaagcagcccttcaggagctgaccagagcacatgtggaatcctttaactatgcagtgcacgagggcttgggcctcgctgtgcaggccatcccacccttcgagtttgccttcaaagatgaacgcatcagtttcaccatactcgacgctgttatcagccccccaaccgtgcctaagggcacaatctgtaaagaggcaaacgtgtatcccgcagagtgtagaggacgccgatcaacatacagaggcaaactcacggccgatattaactgggccgtcaatgggatcagcaaaggatag

SEQ ID NO: 23888 - DNA, 1380 bp, Artificial Sequence
  Description of Artificial Sequence: Synthetic coding sequence
atgaacgtggccatcttcgaggatgaggtgttcgcgggtgtgacaacccaccaagagctgttcccccatagtctgttatctgtgatcgcaaattttatcccgttctccgatcacaatcagtctcccagaaacatgtatcagtgtcagatgggtaagcagaccatgggatttcccctgctcacatatcaagatcggagtgataacaagctttaccgcctgcaaaccccccaaagtcctctggtcaggcccagtatgtacgactactatgatatggataactaccctattggaactaatgctattgtggctgtgatctcatacaccggctatgatatggaggacgccatgatcgtcaacaaggcatcttgggaaagaggcttcgcacatggctctgtgtacaaatccgagttcatagatctgtccgaaaagataaagcagggcgacagtagtttagtcttcggcatcaaacccggtgaccccagggtgctccagaagctagatgacgatggcctgccattcattggagctaaactacagtacggggatccttactattcctacttgaacttgaacacaggagaatcattcgtgatgtattacaaaagtaaggaaaattgcgtggtggacaacattaaagtgtgtagcaacgacactggttcaggtaaattcaaatgcgtttgcatcaccatgcgggtacctcggaacccaacgatcggggataagttcgcttctcgccacggacagaaaggtatcttgtcaagattatggcccgcagaagacatgccattcacggaatctggaatggttccagatatcttatttaacccccatggctttccatcccggatgacaatcgggatgctcattgaatcaatggcgggaaagtccgccgcactccacgggttgtgccacgatgccaccccgtttatcttttccgaggagaactcagctctcgaatacttcggagaaatgctgaaggctgcaggctacaatttctacggcaccgaaagactgtactctgggatctcaggcctggagctggaagcggacatttttatcggggtggtctattaccagagactgaggcatatggtttcggacaaatttcaggtgcgaactactggtgccagagatcgagtaacgaaccagcccatcggcggtagaaacgtccaaggagggatcaggttcggagaaatggagcgtgacgcgctgcttgcccacggcacaagcttcctactgcatgatagactttttaattgttccgaccgcagcgtagcccacgtttgcgaagtctggcagttcacattgtctaccgtgggcgaggctactcccttccttgtttgccacgcacagcagaaaattcagctgtattccgtttag

SEQ ID NO: 23889 - DNA, 2775 bp, Artificial Sequence
  Description of Artificial Sequence: Synthetic coding sequence
atgcattgtgtgcgtgaagaacacagcgctgtcaatatgaatctccattacctggaaaatggaaccgtgatgctgaatttcatttaccggaaagaactcttcttcctaccactcgggtttgctctgaaggccttggtctccttttctgattaccaaatattccaagagctcatcaagggaaaggaggacgattcatttttgaggaacagcgtcagccagatgctgagaattgtaatggaggaagggtgttctacccagaagcaagtcctgaactatctaggtgagtgtttccgagtaaaactgaacgtcccagattggtatccaaacgaacaggctgcagagtttttgttcaatcaatgtatctgtatccacctgaagtcaaacacagagaaattctatatgctttgccttatgacacggaaactgttcgccttggcgaaaggcgagtgtatggaggacaacccagactctctggtgaaccaagaggtcctgacccctggtcagctctttctgatgttcctcaaggagaaactcgaaggctggctcgtgtcaatcaagatcgcctttgacaagaaggcacagaagacctcagtctcaatgaatactgacaaccttatgagaatctttacaatgggcattgacctgacgaaaccgttcgagtatctgtttgctaccggaaaccttagatccaagacgggccttggactgcttcaggacagcggcttatgtgtcgtagctgataagctgaatttcatcaggtaccttagccacttcaggtgtgtgcatagaggagcggacttcgccaaaatgcggaccactactgtgcgtaggctgctgcccgaaagctggggcttcctctgccctgtccacaccccggacggagaaccatgtggccttatgaaccatctgacagctgtttgtgaggtggtgacacagttcgtgtacacagcttctatcccggcactgctgtgcaatttaggtgtgacaccaatcgatggtgcccctcacagaagctattccgagtgctatcccgtgctgcttgacggcgttatggtcggctgggtggataaggatctggctccaggaattgcggactccctgaggcacttcaaagtgctacgcgaaaaacggatcccaccctggatggaagttgtgttgatacccatgacaggaaagccctctctgtaccccggactattcctgtttactacaccgtgcagactggtccggccagtccagaatcttgctctgggtaaggaagagctaatagggactatggagcaaatatttatgaatgtggctattttcgaagatgaggtattcgcaggtgttactacacatcaggagttgtttccacattcactacttagtgtgattgccaacttcatcccattttccgatcacaaccaatccccgaggaacatgtaccagtgtcagatgggaaagcagactatgggcttccctctcctgacctaccaggacaggtctgataacaagctgtacaggctacagactccacagtcacctctagtccggccaagcatgtatgactattacgatatggataactaccccatcgggactaacgccatcgtcgccgtaattagctacacaggctatgacatggaagatgccatgattgtgaacaaagctagttgggaaagaggctttgcccacggaagcgtctacaaatcagagttcattgacctatccgagaaaattaaacagggggattcttcactggtgtttggaattaagcctggggacccccgagtgctgcaaaaactcgatgacgacggccttccttttattggagccaagcttcagtacggagatccatactattcttaccttaatctgaatacaggcgagtcctttgttatgtactacaagtccaaagagaattgcgtggtggataatatcaaggtttgtagcaacgacactggtagcgggaagttcaaatgtgtttgcattaccatgcgggtaccaaggaatcccacgattggggacaagtttgcctcccggcacggacagaagggcattctgagccgactgtggccagcagaggacatgccatttacggagtccggcatggtcccagatatccttttcaacccccacggtttcccctccaggatgaccattggcatgttaatcgagtccatggcaggcaaatcagctgcactacacggtctctgccacgatgccacaccgtttatattctccgaggagaatagcgcgctggagtattttggtgagatgctgaaagccgctggctataatttttacggaactgagagactatacagcggcatcagtggtctcgagctggaagccgacattttcatcggggtggtatattaccagcgactgcgccacatggtgagcgacaagtttcaggtccggacaactggcgcacgggaccgggtaaccaatcagccaattggcggacgcaatgtacagggaggcatccgttttggcgagatggaaagggacgctctgctggcccacgggaccagtttcctgctgcatgacaggctattcaattgtagcgacaggagtgtagcccacgtctgtgtcaaatgtggatcacttttgtccccattgctcgagaagcctcctccatcttggagtgccatgcgcaacaggaagtataattgtactttatgcagtcgttctgatacaattgatacagtctctgtcccctacgtgttccgttacttcgtggccgagctggcagcgatgaatattaaggtgaagctggacgtcgtctag

SEQ ID NO: 23890 - DNA, 3522 bp, Artificial Sequence
  Description of Artificial Sequence: Synthetic coding sequence
atgcgggctaaggaagcagcagaaacagggctcagaccattactgccagcctgcaccgagaggcttgcttctggggtctatcgcgagaccggcgtgcggtgcgctggcggtcacatggaccccggtagtcgctggaggaacctcccctccggtcccagcctcaagcatcttacagatccctcctacggcatcccccgagagcagcaaaaagcagctctgcaggagttgacaagggctcacgtggaaagttttaactacgccgtgcatgaggggctcggccttgctgtgcaagctattccaccttttgagtttgcttttaaagacgagagaatatcctttaccatcctggacgccgtgatcagccctccaaccgtgcccaagggcaccatttgcaaagaggccaacgtctatccagccgaatgccgcggtcgacgaagcacataccgtggcaaattgaccgccgacatcaactgggccgtgaatggaatcagcaagggcatcataaaacagttccttggatacgtgccgataatggttaagtccaaactctgcaatctgcgcaatctcccccctcaggccctgatcgagcaccatgaggaagctgaagaaatggggggatattttatcatcaatggtattgagaaggtcatccggatgctcataatgcctaggaggaattttcccatagccatgatccgcccaaagtggaagaccaggggacccggttatacccaatacggcgtttccatgcattgcgtcagagaagagcatagcgcagtgaacatgaatctgcactaccttgagaacggcactgtgatgttgaacttcatctatcgcaaggagctgtttttcctaccgctggggtttgctttaaaagctctggtttccttttcagactaccagatattccaggagttgataaaaggaaaggaggacgactcctttctgcggaattccgtttcccagatgctgcggattgttatggaggaaggctgctcaacacagaaacaggtcctgaattatctgggtgagtgttttagagtcaagttgaacgttcccgactggtacccaaatgaacaggccgctgaattcttgtttaaccagtgcatctgcatccacttaaagtccaacacagagaagttctacatgctttgcctaatgactcgcaagctgttcgccttagccaagggagagtgcatggaagacaacccagactccctagtgaatcaggaggtcttgaccccgggacagctgttcctgatgttccttaaggagaagcttgaaggctggctggtgtccatcaagatcgctttcgataagaaagctcagaagacaagcgtaagcatgaacacagacaacctcatgcgcatcttcacaatgggaattgatttaacaaaaccttttgagtatctcttcgcgactggtaacctccgttcgaagacgggcttagggctgttacaagacagcggcttatgcgtggtggcagacaaactgaactttattcgttacctgagccatttccgatgcgtgcaccgcggagcggattttgcgaagatgaggacaaccacagtccgacgccttctccccgagtcctggggcttcctctgtcccgtgcacactccggacggggaaccatgtgggctgatgaatcatctcaccgctgtgtgcgaggtggttacccaatttgtatacacagcgagcattccagcactgctgtgtaacttaggggtgacccccatcgacggagctccacaccgctcttatagcgagtgctaccctgtgctacttgatggagtcatggtcggctgggtcgacaaggacctggccccagggattgctgattcccttcggcactttaaagtcttacgcgaaaagcgtatcccaccttggatggaggttgtgctgatcccgatgaccgggaagccaagcctgtatccaggactcttcctgttcaccactccatgcaggctggttcgccctgtgcagaacttagcgctgggcaaagaagagttgatcggtacaatggaacagatcttcatgaatgttgccatctttgaggacgaggtatttgctggggtcacaacgcaccaggaactctttcctcactccctgctgtccgtgattgccaactttattccattcagtgaccataaccaatcccccagaaatatgtaccagtgccagatggggaagcaaactatgggcttcccgctgctcacctatcaagaccgctcggacaacaagttataccggctgcaaacacctcagagtccccttgttcggccatcaatgtacgactactatgacatggacaactatcccatcggcacaaatgccattgtggctgttatcagctacacgggatacgatatggaggacgcgatgatcgtcaataaggcatcttgggaaagaggctttgctcacggctctgtgtacaaatcagaatttatcgacctgagtgagaagattaaacagggagacagctcactcgtgtttgggatcaaaccaggcgatccccgtgttctccagaaactcgacgacgatgggctcccctttatcggggctaaattacagtacggcgatccctattactcttacctcaacctcaacacgggcgagagctttgttatgtactacaagagcaaagagaactgtgttgtggataacatcaaggtgtgctctaacgacacggggtccgggaagttcaaatgtgtatgcattactatgagagtgccaaggaatccaacaatcggggataaatttgctagcagacatgggcagaaggggattctttcaagactgtggccagccgaggacatgcccttcaccgaaagcggcatggtgcccgatattctgtttaacccccacggttttccctcgcgtatgaccattggaatgctgatagagtctatggcaggaaagtcggccgcactgcacggcttgtgccatgacgcgaccccttttatcttcagtgaagagaatagcgctctagaatattttggggaaatgttgaaggccgcaggctacaacttctacggaactgaacgtctgtattctggtattagcggcctggaactggaagcagatatcttcattggggttgtctattaccagagactgcggcacatggtctccgataaatttcaagtgagaactaccggcgcaagagacagagtgaccaatcagcctatcggcggacggaacgtgcaagggggaatccgctttggagagatggagcgcgatgcactgctggcccacggaacttctttcttactgcacgaccgcctgtttaactgttccgacaggagcgtggcccatgtgtgtgttaaatgcggtagcctgctttcacccctccttgaaaaaccaccaccttcctggtccgctatgcggaacagaaagtataactgcactttatgctctcgaagcgacaccatcgacacagtgtcggtcccatacgtcttcaggtacttcgtggcggagctggctgctatgaacatcaaagtgaagcttgacgttgtgtag

SEQ ID NO: 23891 - DNA, 3525 bp, Artificial Sequence
  Description of Artificial Sequence: Synthetic coding sequence
atgtacgatgccgacgaagacatgcagtacgatgaagacgatgacgagatcacccccgatttgtggcaagaggcgtgttggattgtgatttcttcttactttgatgaaaaggggctggtccggcagcagctcgactcattcgacgagttcatccagatgagcgtccaacggatcgtggaggatgcacctcctatcgatcttcaggcggaagcacagcacgcttctggcgaagttgaggagcccccaaggtacctcctgaagttcgagcagatttacctctctaaacccacgcattgggaaagagatggtgctccttccccaatgatgccgaacgaggccaggctccggaacctaacctattctgccccattgtatgtcgacataaccaagacagtgattaaggagggagaggaacaacttcagacacagcaccagaaaacctttattggtaaaatccccatcatgctgcgctcaacgtactgcctgctgaacggcctgaccgatagggacctatgcgagttaaacgaatgccccctggatcccggtgggtatttcataattaatgggtccgagaaggtgctcattgcgcaagaaaagatggcaacaaatactgtgtatgtgtttgcgaaaaaagactccaagtacgcctacacgggcgagtgccggtcttgcctggagaattcctcgcggcctacatctactatctgggtcagtatgttagcgaggggaggccagggtgccaagaaatccgccattggccagaggatcgtggctacattgccatacatcaagcaggaggtacccatcatcatcgtctttcgtgcactgggctttgtatctgaccgtgacattctggaacatataatctatgatttcgaggatccggaaatgatggagatggtgaagccctcgctggacgaagccttcgtgatccaggaacaaaacgtagcattgaacttcatcggctcccgtggcgcaaagcccggagtcacaaaggagaaaagaatcaaatatgccaaagaggtgctgcagaaggaaatgttgccccatgtgggagtctcagacttctgcgaaactaaaaaggcctactttctgggctatatggtgcaccggctgctcctggcggcactgggcaggcgcgaactggatgatcgcgatcactacgggaataagcgactggatttagccggaccactcctggcattcctcttccgtggtatgttcaagaatctgctgaaggaggtcagaatctacgcacagaaattcattgatcggggaaaggacttcaatcttgaattggctattaagacacgcatcatatccgatggcctgaagtacagcctggcaactggaaattggggcgaccaaaagaaggctcaccaagccagagcgggagtctcgcaagtgctgaatcgattaacatttgcctcaaccctgtcccatttgaggagactaaactcacccatcgggcgagatgggaaactagccaaacctcgacagctgcataacacgctgtggggtatggtgtgcccggcagagactccagagggccatgctgtcggcctggtcaagaacctcgctctgatggcgtacatttcagtcgggtcacagccttctcctatcctggagttcttggaagaatggtccatggaaaacctggaagaaattagtcccgctgcaatcgccgatgctactaagatttttgtcaacgggtgctgggtgggcattcacaaggaccccgagcagcttatgaacaccctgcgtaaactgcgccgtcaaatggacattattgtaagcgaggtgtccatgatcagagatataagggaacgagaaataaggatatacacagacgccggaagaatttgcaggccgttgctcattgtcgagaaacagaagcttctgctgaaaaaaaggcacatcgatcagctcaaagaacgggagtacaacaactactcatggcaagacctcgtcgcgtctggagttgtggagtacatagatacactggaggaggagaccgtcatgctcgcgatgaccccagacgacctccaggagaaagaagtcgcttactgttcaacgtatacccactgcgagatccacccctctatgattctgggcgtgtgtgccagtattattccattccccgatcacaaccaatcccctcggaatacatatcaaagtgccatggggaagcaggcaatgggggtgtacatcacgaactttcacgtgagaatggatacactggctcatgttctgtactacccacagaagccactggtcaccactagaagtatggagtatctgagattccgcgagctccccgcaggaatcaactccattgtggccatcgcgagctacactggctacaatcaggaggactccgtcattatgaatcggtccgccgtggatcgtggcttttttagaagcgtgttctacagatcttataaagagcaagaaagcaaaaagggtttcgaccaagaagaagtgttcgagaaaccaactagagagacctgtcagggaatgagacacgctatttatgacaagcttgatgacgacggcttgatagcccctggagtgagagtcagcggagatgacgtgataatcggcaaaaccgtaacgctcccagaaaatgaagacgagctagaatccacgaaccggagatataccaagcgagattgctccacatttctaagaacaagtgagactgggattgtcgaccaagtgatggtgacattgaaccaggagggctacaaattttgtaagattcgggtgaggtctgtcaggatccctcaaatcggcgataaatttgcatcccggcatggacagaaaggtacttgcgggattcagtaccggcaagaggatatgccgtttacttgtgaggggattacacctgacatcataattaacccccatgcgattccttcaaggatgacaattggtcacctgatcgagtgcctccaggggaaggtgtccgcgaacaagggagaaattggcgacgcaacaccatttaacgacgctgtgaatgtacaaaagatctcaaacttgctctccgattacggatatcatcttcggggaaacgaagtgctgtacaacggctttacgggcaggaaaatcacaagccaaattttcattggccctacatactatcagcgactgaaacacatggtggatgacaaaatacactccagagccaggggccctatccagatcctgaataggcagcctatggagggaaggtctagggacgggggtctacggtttggcgagatggagcgcgattgtcagatagctcacggtgccgcacagttcctaagggagcgtttgttcgaggcctccgacccctaccaggttcacgtgtgtaacctgtgcggaatcatggctatcgctaatacacgaacgcatacttatgaatgtcggggatgtagaaataaaactcagatctcattagtgcgaatgccgtatgcatgcaagctgctgttccaggagctgatgtcgatgtccatcgctccgagaatgatgtccgtgtag

SEQ ID NO: 23892 - DNA, 3525 bp, Artificial Sequence
  Description of Artificial Sequence: Synthetic coding sequence
atgtacgacgccgatgaggacatgcagtatgacgaggacgatgatgagattacccccgacctgtggcaagaagcctgctggattgttatttcatcatattttgatgagaaagggctggtcagacagcagctggactcctttgacgagttcatccagatgtccgtgcagcgtattgtggaggacgcacccccaatagatctacaagccgaggcccagcatgcttctggggaggtagaggagcctcctagatatctgttgaaatttgagcaaatttacctaagcaagccaacccattgggagcgggacggcgctccgtcacctatgatgccgaacgaggctcgtctgcggaatctgacctacagcgctccactctacgtagatatcactaagacagtgatcaaagagggcgaggagcagctacagacccaacaccagaaaacctttataggcaagatacctattatgcttagatccacctactgcctgctcaatgggttgacggaccgcgatctgtgcgaactaaatgagtgccccctggatccaggtggttatttcatcattaacgggagcgagaaggtgttgatcgcgcaggaaaaaatggcgaccaatacagtctatgtgtttgcgaagaaggattctaagtatgcatacacaggagaatgccgatcctgtctggagaactcgagtcggccaacaagtaccatctgggtctctatgctcgcgcgagggggtcaaggggctaagaagtcagccattggccagcggatcgtagcaactcttccatatatcaaacaagaagttcccatcatcattgtcttcagagctctgggttttgtctccgatcgtgatatcctggagcatatcatttacgacttcgaagatcctgaaatgatggaaatggtgaagccctcattagacgaagcgtttgtaattcaggaacagaacgtcgcgctgaatttcataggcagtcggggagctaagccaggcgtaaccaaagaaaaaagaatcaagtacgctaaagaggttcttcagaaagagatgttacctcacgtgggcgtgagcgacttttgtgaaactaaaaaagcctattttctcgggtatatggtgcaccgactcctgttggccgctctcggtcggagggagcttgatgaccgcgaccactacggcaacaaacgtttggatttggcaggtcccctgctggcctttttgttcagggggatgttcaagaacctccttaaggaggtgagaatttacgcccagaaatttatcgaccgaggcaaggactttaatctggagctcgcaattaaaacgcggatcatcagcgatgggctgaagtactcactggccacaggaaactggggagaccagaagaaagctcaccaggccagagcaggggtgtcgcaggtgttaaaccggctaaccttcgcctcaactttatctcacctcagaagattgaatagccctatcgggagagacggaaaacttgccaagcccagacaactgcataatactctatggggaatggtatgtcctgcagaaacccccgaaggccacgctgtgggcctggtgaagaatctggccctcatggcctatatttccgttggatcgcagccttcacccatcctggagttcctcgaagagtggtctatggagaatctggaggaaatctctcccgcagccattgcagacgcaaccaaaatctttgtgaacggctgttgggttggcattcacaaggaccccgaacagttgatgaatacactgaggaagctcagaaggcagatggatattattgtttccgaggtcagcatgatcagagacatcagggaaagggagattagaatctacactgacgccggtagaatctgtcgcccacttctgatcgtggaaaaacagaaactcctacttaagaaaaggcatattgatcagctgaaggaacgcgaatacaacaactactcctggcaggacttggttgcaagtggggtggtggaatacattgacacactggaagaagagaccgtgatgttggccatgactccagatgatctacaggaaaaagaagtggcctactgctcaacttacacacattgcgagatacatccatccatgatactgggtgtatgcgcatccattatccccttccctgaccacaaccagagcccaagaaacacctaccagtccgcaatgggaaagcaggctatgggagtctatataacgaattttcacgtacggatggacactctcgcccatgtcctttactatcctcaaaagccattagttaccacgcgttcaatggaatacctgcgtttccgagaacttcctgccggaatcaattccatcgttgctattgcaagctacaccggctataaccaggaggacagtgttattatgaataggtcagctgtggataggggattttttcggtcagtattttatcgctcttacaaggagcaggagtctaagaagggatttgatcaggaagaggtcttcgaaaaacccacacgcgaaacatgccaaggcatgcggcacgccatttacgacaaactggatgatgacggattaatcgcccctggggtacgggtgtctggggatgatgtgatcatcggcaagaccgttactctgcctgaaaatgaggacgagctcgaaagtaccaatcggagatatacaaaaagagattgctccaccttcctgcggacctccgagactgggatagtggaccaggtgatggtcaccctgaaccaggagggctacaagttttgtaaaatcagggtccgctcagtcaggataccccaaattggcgacaagttcgccagtcgtcacgggcagaagggcacctgtggaatccagtaccgtcaggaggatatgccttttacctgtgagggcattacgcccgacatcattatcaatcctcatgccatcccaagtcgcatgacaattggtcacttgattgagtgcttgcaggggaaggtttcagctaataagggcgagatcggcgatgctaccccattcaacgacgctgtaaatgtccagaagatttcaaaccttctctctgattatggctaccatctcagggggaatgaggtcctatataatgggtttactggcaggaaaatcacgtcccagatttttatagggccaacatactatcagcgtctgaagcacatggtcgatgacaaaatccactccagagctagaggacccatccagattctgaataggcagcccatggagggtcgaagtagggacggcggtctccgcttcggggaaatggagagggactgtcagattgcccacggggcagcgcagttcttaagggaacgactcttcgaggcctccgatccatatcaggtgcacgtctgcaacctatgcgggatcatggcgattgctaacacgcgtacacacacatatgagtgtcgagggtgtagaaacaagacccaaatttctttagttcgcatgccctatgcgtgcaagctcttgttccaggaactgatgagcatgtccatcgccccacggatgatgtcagtttag

SEQ ID NO: 23893 - DNA, 429 bp, Artificial Sequence
  Description of Artificial Sequence: Synthetic coding sequence
atggcagccggaggatcagatccacgtgcgggagatgtggaggaggatgcatcgcagcttattttccctaaagagttcgagaccgctgagacccttctcaatagtgaggtccatatgctgctagaacaccgcaaacagcagaacgagagcgccgaggatgaacaagaactttccgaggtgttcatgaagaccctcaactatacagctcgcttcagcagattcaagaaccgcgaaacgatcgcatccgtccgatccctgttgttacagaagaaactccataaattcgaactggcttgcctggccaacctctgccccgaaacggcagaagaatcaaaagctttgatcccttccctggagggcaggttcgaagacgaggaactgcaacagatactggatgacattcaaaccaagaggtctttccagtactag

SEQ ID NO: 23894 - DNA, 348 bp, Artificial Sequence
  Description of Artificial Sequence: Synthetic coding sequence
atgaatgcacccccagcgtttgagagtttcctgctctttgaaggagagaagatcaccataaacaaggacactaaagtgccaaatgcttgtttgtttactatcaataaggaggaccacactctgggcaacatcattaaatcccagctgcttaaggacccacaggttctgtttgctggatacaaagttccccaccctctggaacataagataattataagagtccagactactcccgactatagccctcaagaagccttcactaatgccattaccgatctaatctccgagttgtccctactggaagaaaggtttcgcacatgtctactaccacttcgacttctgccctag

SEQ ID NO: 23895 - DNA, 348 bp, Artificial Sequence
  Description of Artificial Sequence: Synthetic coding sequence
atgaacgccccacctgctttcgaaagtttcttattattcgaaggagagaaaattactatcaataaggatactaaagtacctaacgcctgtctctttaccattaataaagaggaccatacactcggaaatataataaagtcccagctcctgaaagacccacaggtgctatttgccggatacaaagtgccgcaccccttggaacacaagataataattagggttcaaacaacgcctgattacagcccgcaggaggcatttaccaatgcgataacggacctgatctctgagttgtcactgttagaagagagattccgtacgtgtctgctgccactgcgtctgctcccgtag

SEQ ID NO: 23896 - DNA, 1107 bp, Artificial Sequence
  Description of Artificial Sequence: Synthetic coding sequence
atgtgcagcctgccgcgaggattcgagcctcaagcacctgaggacctggctcagcgctcattggtggagctccgggagatgctaaaaaggcaggagcggctcctcagaaacgagaagttcatctgcaaactccccgacaaaggaaagaaaatttttgactcatttgcaaagttgaaagcagctatagctgagtgcgaagaggtgaggcgcaagtctgagttgttcaatcctgtcagtctggattgtaaactgaggcaaaaagcgattgccgaagttgatgttggaactgacaaggcccagaattctgacccgattctcgacacctcttccttggttcccggatgctcctcagtggataacatcaagagcagccagacctctcagaatcagggcttgggacgaccaactctggagggagatgaagaaacttccgaggtggagtacaccgttaacaagggaccagcatcatccaaccgcgatagggtccctccctctagcgaagccagtgagcatcatccgaggcacagggtttcctcccaagctgaggatacctcatctagttttgataatctctttatagacagactacagcggatcacaatcgccgatcaaggtgaacaacagtccgaggaaaacgcttccacaaaaaacctgactgggttgtcctccggcaccgagaaaaagcctcactacatggaagttttagaaatgcgagccaaaaatcctgtgccccagctgaggaaattcaaaacaaacgttctccctttcagacagaacgattcctctagtcattgccaaaaaagtggttcacccatcagcagcgaggagcggaggagaagggacaagcaacatctggatgacataaccgccgcacgcctcctgccacttcatcacatgccaacccagttgctgagcattgaagagtcactcgctctccaaaagcagcaaaaacagaactatgaggagatgcaagcgaagctggccgctcagaagcttgccgaacgcttgaacatcaaaatgcggagctataatcccgaaggagagagctcaggccgataccgcgaagttcgagacgaggacgatgattggtcctccgatgaattttag

SEQ ID NO: 23897 - DNA, 636 bp, Artificial Sequence
  Description of Artificial Sequence: Synthetic coding sequence
atgtgtagcctgccgagagggttcgaaccacaggcaccagaggatctggcacagaggtctctcgttgagctgagagagatgcttaagcgccaggaacggttgttgagaaacgagcttcagcgaattaccatcgctgaccagggcgaacaacagtcggaggagaacgccagtaccaaaaacctgactggtttgagctctggtaccgagaaaaagccgcactatatggaagtcctggaaatgagagcgaaaaatcccgtacctcaactacggaagttcaagaccaacgtacttccgtttcgccagaacgatagttcaagtcattgccaaaaatccgggagccccatttctagcgaagaacggcgaaggagggacaagcagcacctggacgatatcactgccgctaggctcttacctctacaccacatgcctactcagttgttgagcatcgaagaatccttggccctgcaaaaacaacagaagcaaaattacgaagagatgcaggcgaagctcgccgctcagaagttggctgagagacttaacattaagatgcgttcttataaccctgaaggggagagctcgggtcgatatagggaggttcgcgacgaagacgacgactggtcttccgacgagttttag

SEQ ID NO: 23898 - DNA, 1092 bp, Artificial Sequence
  Description of Artificial Sequence: Synthetic coding sequence
atgtgttctcttcctcggggttttgaacctcaagcacctgaagacttagcccagagatcactggttgaactgcgtgagatgctcaaaagacaggagcgcctattgcgcaacgagaagttcatctgtaagttgccagacaaaggaaagaaaatttttgattcatttgcaaaactcaaggccgcaatcgctgagtgtgaagaagtgagacgaaagagcgaactgttcaatcccgtttctctggactgcaagcttcgccaaaaggccatagcagaggtcgatgtcggcaccgacaaagcccagaactcagacccgatcctcgataccagttctctggtccccggatgttcctccgttgataatatcaagagctcccaaacttcccagaaccaggggttaggacggcctactttggagggggatgaggagactagcgaagttgaatacactgtcaacaagggtccagctagctcgaaccgagatcgtgtccctccttccagtgaagcgtccgaacaccatcctaggcatagagtgtcctctcaggctgaggatacttcttcgtcttttgacaacctcttcattgacagactgcagaggattaccattgccgaccaaggagagcaacagtccgaagagaacgcgtcaacaaagaacctaactgggctaagttccgggacagagaagaagcctcactacatggaagtactcgagatgcgcgctaaaaaccctgtgcctcagctgaggaagtttaaaacgaacgtgctcccatttcgtcagaatgacagctcaagccattgccagaagagcggcagccctatatcctcagaggaacgtcggaggagagataagcagcacctggacgacattaccgccgctcggctgctacctctccatcatatgcctactcagctactgtcaatcgaggagtctctggcactccagaagcagcagaagcagaattacgaggagagacccttctactcccctcagtatcgctcttcaatgaatctgctttcattggccgcagcagcaaaagataccaggggatccaaatcggggaagatgggaagtctggctctgcttactaagctgtag

SEQ ID NO: 23899 - DNA, 1605 bp, Artificial Sequence
  Description of Artificial Sequence: Synthetic coding sequence
atgacacaagccgagatcaaactgtgctctctcctattgcaggaacacttcggagagatagtcgagaaaataggagtccacctcatcaggaccggatcccagcccttacgagtaatcgcccacgatactggaacctcactggaccaagtgaaaaaggcactttgtgtactggtgcagcataatttagtgagctaccaggtgcacaaacggggtgtggttgaatacgaggcccagtgctctagagtgctgagaatgctgcgctatcctaggtacatctacactaccaagactctgtattccgatacaggcgaactgattgttgaagagctgctgctaaatgggaaacttacaatgtctgcagtcgtgaagaaggttgccgacagactgaccgagaccatggaagacggcaagactatggactatgcagaggtgagcaacacctttgtgaggctggctgacactcactttgtgcaacgctgtccctctgttccaaccaccgagaactctgaccccggaccccctcccccagcacccacactcgtcataaacgaaaaggacatgtacttggtgcccaaactgagcttaattgggaagggaaagcgacgcagatcctcagacgaagacgccgctggcgaaccaaaggctaagaggccgaaatatactactgacaataaggagcccattcccgacgatggcatctactggcaggcaaacttggatcgcttccaccaacactttagagaccaggccatcgtctccgcagtagctaatagaatggaccagacaagttctgagattgtccggacaatgctcagaatgagtgaaatcacaacttcaagctcagcccctttcactcagccgttgtcatcaaacgaaatttttaggtcactgcccgtgggctataacattagcaagcaggtgttggaccagtatctcaccttactcgcagacgatcctctggaattcgtggggaaatcaggcgattcggggggagggatgtacgtgatcaatttgcataaagctctggcgtctctggctaccgctaccctggagagcgttgtgcaagaacgctttgggtcccgctgtgcacggatcttccgactcgttctccagaagaagcatattgaacagaaacaggtcgaggatttcgctatgatacctgccaaagaggccaaagatatgttatataagatgctgtcagagaactttatgtctctacaggagattccaaagaccccagaccatgccccaagccgtaccttttacctgtacacagtgaatattctttccgccgctaggatgctgctccaccgatgctacaaatccatcgccaatctgattgagcgccgacagtttgagacgaaggagaataagaggctcttagagaagtcccagcgggtggaggcaattattgcatctatgcaggcgacgggggcagaggaggcccagttgcaggagatcgaagagatgataacagcccctgaaaggcagcagctggagaccctgaaaaggaatgtgaacaagctcgatgcatcagaaattcaggtggatgagacaatcttcctgctcgagagctacattgaatgtacaatgaagagacagtag

SEQ ID NO: 23900 - DNA, 1236 bp, Artificial Sequence
  Description of Artificial Sequence: Synthetic coding sequence
atgacccaagcagagattaaactatgcagcctcctcctgcaggagcatttcggagagatagtcgagaagatcggtgtccatttaattaggacgggcagccagcctctgcgggttatcgcccacgataccggaaccagcctcgaccaggtgaaaaaagctttgtgcgttctagtccagcacaatttagtctcttaccaagtgcacaaaagaggcgtggttgagtatgaagcacagtgttctcgggtgctgcggatgctgcgataccccagatatatttacacaacgaagaccctgtacagcgacactggtgagttaatcgtggaggaactcctgctaaacgggaagctgactatgagcgccgtcgtaaagaaagtggcggaccgcctgacagagacaatggaagatggcaagacaatggattacgcggaagtctctaatacatttgtgcgtcttgcggacacacacttcgtacagcgctgtccatctgtgccaaccaccgaaaacagtgacccgggaccccctccgcctgcgcctaccctagtgatcaatgagaaagacatgtacctggtcccaaagctttccttaatcgggaaagggaaacgtcgcaggtcatctgacgaggatgccgctggagagccaaaggctaagagacccaaatacacgaccgacaacaaagaacctatcccagatgacggcatatactggcaggcaaatctagacagattccatcagcatttcagggaccaggccattgtgtccgctgtggcgaataggatggaccagactagcagtgaaattgttagaacaatgctccgcatgagcgagatcaccacgagtagcagcgccccttttacacaacccctttccagtaacgagatcttcaggtctctgcccgtgggatataatattagcaagcaggtgctggatcagtatctgacgctgctggcggatgacccgctggaatttgtgggcaagtccggcgattctgggggtgggatgtacgtgattaatctccacaaagcactcgcttcattggcaacagcgaccctcgagtcagtggtccaagagcgtttcgggtcccgctgcgccaggatcttccgcttggtcctgcagaaaaaacatatcgaacaaaagcaagtagaggatttcgcgatgataccggctaaggaagcaaaggatatgctatataagatgctgtccgagaacttcatgtctcttcaagtcggctgccagtag

SEQ ID NO: 23901 - DNA, 1197 bp, Artificial Sequence
  Description of Artificial Sequence: Synthetic coding sequence
atgagtgagggcaatgcagctggcgaaccctcaacacctggcggacctagaccacttttgaccggggctaggggcttaatcggtaggagaccagccccacccctgacgccagggaggctgcctagtatccgaagcagagatctgactctgggcggagttaagaagaagacattcacgcctaatattattagtcgaaaaatcaaggaggagcctaaggaagaggtgacagttaaaaaggagaagcgcgagagagatcgggaccgacagcgcgagggccatggcaggggacgtgggaggccggaagtgattcagtctcatagtatttttgagcaaggtccagctgagatgatgaagaaaaagggcaactgggataaaaccgtggatgtgtcagatatgggccctagccacataatcaacattaaaaaggaaaagcgggaaaccgatgaggaaacaaagcagatcctcaggatgctggaaaaggatgacttcttagacgatccagggctgagaaatgatactcggaacatgcccgtccagctgccactggcccactccgggtggctattcaaagaggaaaatgatgaacctgatgtaaaaccctggttggccggtccgaaagaggaggacatggaggtggatattcccgctgtaaaagtgaaagaagagccccgagacgaagaggaagaagctaaaatgaaagcgccacccaaagcagctcgcaaaactcccggactgccaaaggacgtgtcagtcgccgaactgctgcgcgagctatcactgaccaaagaggaggagctcttatttctccagctccctgacactcttccaggtcagccacctacacaagacattaagccaattaaaaccgaggttcagggggaagatggacaggttgtcctgatcaaacaggagaaagaccgagaggctaaattggccgaaaatgcctgtacactcgccgatctcactgaaggacaggtgggcaagctgctcatccggaagtccggacgcgtacagctcctgttggggaaggtaactttggatgttactatgggaactgcttgttcatttctgcaggagctcgtgtccgtcggactgggggattccaggacaggagaaatgaccgtgctcggccacgtcaaacataaactggtgtgttccccagactttgagtcactcttggaccacaagcaccgatag

SEQ ID NO: 23902 - DNA, 1197 bp, Artificial Sequence
  Description of Artificial Sequence: Synthetic coding sequence
atgagcgaagggaacgccgcaggtgagccttccacccccggaggacccaggccgctgctaacaggggcacgcggtcttatcggacgtagaccagcgcctcccttgacaccaggcagactgccaagtattcgatctagggacctaaccctgggaggggtcaagaagaagacattcacgccaaacattatcagcaggaaaatcaaggaggagcccaaagaggaagtgacagttaaaaaagagaagcgggaacgcgatagggatcgacaacgagaagggcatggaagggggagagggcgacctgaggtgatccaatctcactccatattcgaacaagggcctgccgagatgatgaagaagaaggggaactgggataagacagttgatgtcagcgatatggggccatcccacattattaacatcaagaaggaaaagagagagactgacgaggagaccaaacagatcttgcggatgctggagaaggatgatttcctcgacgacccgggtctcagaaatgatacacgcaacatgccagtgcagctgccactagcacactcggggtggctgtttaaagaagagaatgatgaacctgacgttaagccatggctcgctgggcctaaggaggaagatatggaagtggacatccccgcagtcaaggtgaaggaggagccccgagacgaggaagaagaggcaaaaatgaaagctcctcccaaggctgccaggaagactccagggttacccaaggacgtgtcagtggctgaacttttaagggagctaagcctaaccaaggaagaggagctgctcttccttcaacttcctgacactctgccagggcagccccctacacaggatattaaaccgatcaagaccgaggttcaaggggaagacggacaagtagtgttaattaagcaggaaaaagatcgcgaggccaaactggctgagaatgcttgcaccctggcagacctgaccgaaggacaggttggcaagctcttaattcgcaagagcggcagggtgcagctgctgttaggtaaagtgactttggacgtgacgatgggcacggcatgttccttcttgcaggagttggtgtccgtcgggctaggcgactccaggacgggagaaatgacagttctgggccacgttaaacacaaattagtctgctctcccgatttcgagtctctgctcgatcataagcacaggtag

SEQ ID NO: 23903 - DNA, 2127 bp, Artificial Sequence
  Description of Artificial Sequence: Synthetic coding sequence
atggctaacgaggaggatgatcccgttgttcaagagattgacgtatatttggctaagagcctcgccgaaaaattgtacctttttcagtaccccgtgaggcctgcttccatgacttacgacgatatcccacacctgtccgctaagattaagcccaaacaacaaaaagtcgagttggaaatggcaattgataccctgaaccctaactactgcaggtcaaaaggcgagcaaattgccctcaacgtcgacggggcatgcgccgacgagacatccacatattcaagcaagttaatggacaaacagaccttctgttcatcccagacaacaagtaatacaagtaggtatgccgctgccctttacaggcagggtgaacttcacctgacgcctctacacggtattttacagctgcgaccaagcttctcctatcttgacaaagctgacgccaagcaccgcgaaagagaagccgcaaacgaagctggagactcaagccaggacgaagcggaggacgatgtgaaacagattaccgtccgattttccagaccagaaagcgaacaggcgcgacagcggcgtgtacagagctacgaatttctgcaaaagaagcacgctgaagagccctgggtccacctgcactactatggcttgagggactcacgctctgagcacgagcgccagtacttattgtgtcccggttcctccggcgtcgaaaatacagagctggtgaagtccccatccgaatacctgatgatgcttatgcccccaagtcaggaggaggaaaaagacaagcccgtggcccctagtaatgttctatctatggcacaactgaggaccctgccactcgctgatcagatcaaaatcttaatgaagaacgtgaaggtaatgcccttcgccaatctgatgagcctactgggaccttctatcgattctgtggccgtcctcaggggaatccagaaggttgccatgctggttcagggtaattgggtcgtgaaatcggacattctgtatcctaaggatagctcttcaccacatagcggagtgcccgcagaagtactgtgccgcggtcgggacttcgttatgtggaaattcactcagagcaggtgggtcgtccggaaggaggtcgccactgtcactaagctatgcgccgaagatgtgaaggacttcttagaacatatggccgtagtccgaatcaataagggatgggaattcatcttaccgtacgacggtgagttcataaagaagcatcctgacgtggtgcagaggcagcatatgttatggacaggcatccaggcaaagctggagaaggtgtataacctcgtaaaagaaacaatgcctaagaaacctgatgcccaatcaggtccggctggcctggtctgcggggatcagcgcatccaagtggcgaagactaaagcccaacagaaccatgccttgcttgaacgggaattgcagcgacgcaaagaacagctgcgcgtacctgccgtccccccaggggttaggatcaaagaggagcctgtcagcgaggagggagaggaagatgaggaacaagaggcggaggaagaacctatggatacctctcccagtggtctgcactccaagctggctaatggtctacccctggggagagcggctggaactgactcatttaatggtcacccccctcagggttgcgctagtacacctgtcgccagagaattgaaggcctttgtggaagccactttccagagacaattcgtcctcacgctcagcgaacttaagcgactctttaacctgcacctggcaagcctcccacccggtcataccctgttctccggcattagtgaccgcatgttacaagacaccgtccttgccgcaggttgtaagcagattttggtgcctttcccaccacaaactgccgcatccccggacgaacagaaagttttcgctctctgggagagtggagatatgtcggaccagcacagacaggtgttattggaaatcttttccaagaactacagagtgaggaggaacatgatccagtcgcggttgacccaggagtgcggggaggacctttctaaacaggaagttgacaaagtgctcaaggactgctgcgtgagttacgggggaatgtggtatctgaaggggactgtacagagctag

SEQ ID NO: 23904 - DNA, 2001 bp, Artificial Sequence
  Description of Artificial Sequence: Synthetic coding sequence
atggccaatgaggaggacgaccctgtggttcaagagatcgacgtctatctggccaagtctctcgctgaaaaattatatctattccagtaccctgtgcgcccagctagtatgacgtatgatgacattccgcatctgagcgcgaagatcaagccgaagcaacagaaagtggaactcgagatggcaattgatactcttaatccgaattactgcagatccaaaggcgagcagatagcactgaatgtagacggcgcttgtgcagatgaaacatcaacctactcttctaaacttatggacaagcagactttctgttcatctcaaacgacctctaatacatcccgctacgccgctgcattatataggcagggggagcttcatctgacgccactgcatggcatcctgcagttgcggccatccttctcttacttagataaggcggacgctaagcacagagagagggaagctgctaatgaagccggagattcctcacaggatgaggccgaggatgacgtaaagcagatcactgtacgcttcagcagaccagagtccgagcaggcccgacagcgaagagtgcagtcctatgagtttcttcagaagaagcatgccgaggagccctgggtgcatctgcattactatgggctgcgtgactcacggagcgagcacgagcgccagtacctgttgtgtcctggctccagcggggtagagaacactgagttagtgaaatcaccctcggaatacctgatgatgctgatgcctccttcacaggaggaagaaaaggacaagcctgtggccccttctaacgtgctgtcgatggctcagctgagaactttgcctctggcagaccagataaagatcctgatgaaaaacgtcaaagtcatgcctttcgcgaatctgatgtctctgctaggcccatcgatcgattcggttgctgtactgcgcggaattcagaaagtcgccatgttggtccagggaaattgggtggtgaagtctgatatcctatacccaaaggattccagctctccacactccggtgtgccagcagaagttttgtgtaggggacgagattttgtgatgtggaagttcactcagtcacgatgggtagttcggaaggaggtggccacagtgactaagctgtgcgccgaagacgtaaaagacttcctcgaacatatggcagtcgtccggatcaacaagggatgggaattcattctgccttatgatggggaattcatcaaaaaacatcccgatgtagtgcaaaggcagcatatgctctggactgggattcaagcaaaactggaaaaggtgtataatctagtgaaggaaaccatgccaaagaagccggatgcacagagcggcccagccggattagtgtgtggcgaccaacgcatccaagtggctaagacaaaagcccagcaaaaccatgctcttcttgagagggagttgcagcggcgtaaagagcagttacgtgtgcctgctgtgcccccaggcgtgcgcattaaggaagagcccgtgtccgaagagggagaagaggacgaagagcaggaagccgaagaagaacccatggacacctctccttctgggctgcactcaaaactcgctaacggtttgccattggggagggccgctggtaccgactcatttaacggacacccccctcagggatgcgcatcaactccagtggcacgtgagcttaaagcctttgttgaagccactttccagaggcagtttgtcttaaccttgagcgagttaaagaggcttttcaacctccacctggctagcttgcctcctggccataccctgttctccggaataagcgaccgcatgcttcaggataccgtgcttgcggcagggtgcaagcaaatattggtcccgtttccaccccaaactgcagcctctcccgatgagcaaaaagtctttgcactctgggagtcaggggatatgtctgaccaggattgctgtgtctcatatggtggcatgtggtacctgaaaggcactgttcaatcctag

SEQ ID NO: 23905 - DNA, 2019 bp, Artificial Sequence
  Description of Artificial Sequence: Synthetic coding sequence
atggccaatgaagaagacgacccagtggtgcaagagatcaagccgaagcagcagaaggtagaactagaaatggccatcgacaccctcaacccgaattactgtagaagtaagggtgaacagatagctctgaatgtggacggagcttgtgcagatgagacgagtacgtactcatcgaaactaatggacaagcagactttttgcagctcgcagacaactagtaacactagcaggtatgcagccgctctgtatagacagggcgaattgcacctcactccgttgcacggaattctgcaattgcgaccatcatttagctatttggacaaggctgacgccaagcaccgcgagagagaggccgctaatgaggccggagacagctcccaagatgaagcagaagatgatgttaagcagatcacagtccggtttagtcgccctgaatcagaacaggctcgccaacgccgagttcaaagctatgagtttttgcagaagaagcacgctgaggagccttgggttcatttgcattactatggcctgcgcgacagccggtccgagcacgaacgacagtatttactgtgcccaggctccagcggcgtcgaaaacacggaactggtgaagagcccatctgaatatcttatgatgctcatgcccccttcccaggaggaagagaaagacaagcctgtcgccccatccaacgtcttaagcatggcccagctgcgcactctgccactcgcagatcagatcaagatcctgatgaagaacgtcaaggtgatgccctttgccaatctgatgagtttactggggccttcaattgattccgtagccgtcctccggggaattcagaaagtagcaatgctcgtccagggaaattgggtggtaaaatccgacattctttatcccaaggactcaagctccccccactccggggtgcctgcagaggtgctgtgccgaggcagggactttgttatgtggaagttcacccagagcaggtgggtcgtcagaaaggaggtcgccaccgtgaccaaactatgtgccgaagatgtcaaagacttcctggaacacatggcagtggtgaggattaacaaggggtgggaattcatattgccttacgatggtgaatttatcaagaaacatcctgacgtggttcagcgccagcacatgctttggacaggcatacaggcaaaactcgagaaggtgtacaacctggttaaagaaaccatgcccaaaaaacctgatgcccagagtgggcctgcgggactggtgtgtggcgatcaacgaatacaggtcgccaagacgaaagctcagcaaaaccacgcgctgttggagagggagcttcaaagaagaaaagaacagctcagagtacccgcagtccccccaggtgtgagaataaaagaagagccagtgagtgaggaaggtgaggaggacgaagaacaagaagctgaggaagaacccatggacacgagccccagtggcttgcattctaagctggcaaatgggcttcccctgggaagggctgcagggactgattccttcaatggacacccgccacagggatgcgcctcaacccccgtggccagagagctgaaggcatttgtggaggccacatttcagaggcagttcgttctcaccctctctgagctcaagcgcctattcaatcttcacctggcctcattgcccccaggacacactctgttctcgggcatctccgatcggatgctccaggacacggtgctcgccgctggatgcaaacagattctcgttccctttccaccacagactgcagcttccccagacgaacagaaggtttttgctctgtgggaaagcggagacatgtcagatcagcacaggcaggtcttgctagagattttttcaaaaaactaccgggtgagacgtaacatgatacagtccagactgacacaggaatgtggtgaggatttatcgaaacaggaggttgacaaggtattgaaggattgttgcgtgagctacggcggaatgtggtatctgaaaggaaccgtacagagctag

SEQ ID NO: 23906 - DNA, 2064 bp, Artificial Sequence
  Description of Artificial Sequence: Synthetic coding sequence
atggctaacgaggaagatgatcccgtggtccaggagattgacgtctacttagcaaaaagcctggccgagaagctgtacttgtttcagtatcccgttaggccagcttccatgacctatgacgacattccccacttgagcgctaaaatcaaacctaagcaacaaaaagtcgagctagagatggcgatagataccctcaatcctaactattgtcggagtaagggcgagcagattgctctgaatgtggatggagcatgcgctgacgaaacatctacatactcgagcaaactgatggataagcagactttctgctccagtcaaactacctccaatacgagtagatatgccgcagccctgtataggcagggcgagctgcacctgacccccttgcacggcattcttcagctacgcccatccttctcctatctggacaaggctgacgccaagcacagagaacgtgaagcagcgaacgaggccggtgactcgagccaggacgaagcagaggacgacgtcaagcagataacagtaaggttcagcagacctgagtccgaacaggccagacaacgaagggtccagtcatatgagttcttgcagaagaagcatgccgaggagccttgggtacacctgcactactacggactgagagattctaggagtgaacacgagagacaatacctactctgcccaggcagttccggggtagagaatacagagctggtgaagtcacctagcgaatacctgatgatgctaatgcctccatcccaagaggaagagaaagacaaacccgttgccccttctaacgttttgtctatggcccagcttcgtaccctgcccttagctgaccagatcaagatccttatgaaaaacgttaaagttatgcctttcgccaatctcatgagcctgttaggcccatccattgattcagtcgctgtgttaagaggcatccagaaagtcgccatgctcgtgcaggggaactgggtggtgaagtctgacatactgtaccccaaagacagcagctctcctcattccggagtccccgctgaagtactatgtcggggaagagattttgttatgtggaagtttactcagtcccggtgggttgttagaaaagaggtcgctacagttaccaagctgtgcgccgaggacgtgaaagattttctcgagcatatggccgttgttaggattaataagggctgggaatttattctcccgtacgatggagaatttattaaaaagcatcccgacgtagtccagcggcagcatatgctatggaccggtatacaagctaaactcgagaaagtgtacaacctggttaaagaaactatgcctaagaagcccgacgcccaaagtggacccgctggtctggtatgtggagatcagagaattcaggtagccaagacgaaagcccaacaaaatcacgcactgctggagagagaactgcagagacgcaaagaacagctgcgggtgcccgctgttcctccgggagtgaggatcaaagaggagcccgtttcggaggagggggaggaggatgaggaacaggaagcagaggaggaacctatggatacctcgccttccgggctgcattcaaaattggcaaacgggctgcctctggggagagcggcaggcaccgactccttcaatggtcatcctccccaaggatgcgcaagcactccagtcgccagggagttgaaggcattcgtcgaggccacctttcagcgacagttcgttctgacattgtctgagctcaagaggctgttcaaccttcacctggcaagcctgcccccagggcacaccctgttctccggaatcagcgatcgtatgctgcaagacacggttctcgccgcagggtgcaagcagattttggtaccgtttcctcctcagactgccgcttctcctgacgagcagaaggtttttgctttgtgggagtccggggacatgtccgatcagagtcgattgacgcaggagtgtggtgaagatttgagcaaacaggaagtggataaggtgcttaaggattgctgcgtttcatatggcggtatgtggtatcttaagggaacagtccagagttag

SEQ ID NO: 23907 - DNA, 951 bp, Artificial Sequence
  Description of Artificial Sequence: Synthetic coding sequence
atggctgaagtcaaggtgaaggtgcagccacccgacgccgatcccgtggagattgaaaatagaattatcgagctgtgtcatcaatttccccatggaatcactgaccaggttatacagaacgaaatgccccatattgaggcccagcagcgagccgtggctattaataggttactgtccatgggacagctcgatctgcttcgatctaacacagggttgctctatcggattaaagatagtcagaacgccggtaaaatgaaaggtagtgacaatcaagagaaattggtgtaccagatcatagaggacgcaggaaataagggcatttggtctcgcgacatccgctacaagagcaacttacctctgacagagattaacaagatccttaaaaacctcgaatcgaagaaacttattaaagccgtcaagtctgttgctgcctcgaaaaagaaggtatacatgttgtacaatctacagccagacagatccgtcacagggggagcttggtattccgatcaggatttcgaaagtgaatttgtggaagttctgaatcagcagtgctttaaatttctgcagtcaaaggcggagacggctagagaatcaaagcagaatcctatgattcagcggaatagcagcttcgcttcctcccacgaggtctggaaatatatctgtgaattgggaatttctaaggtggaattgtcaatggaggacattgaaaccatcctcaacacccttatctacgacggcaaggtggagatgacaatcattgccgcaaaagagggtacggttggcagcgtagacggtcacatgaagctgtacagggccgtgaatcctataattcctcctaccggtctcgtgagggcaccctgtgggttatgccccgtgttcgatgactgccacgagggcggtgaaatcagcccgtctaactgtatctacatgacagagtggctcgaattctag

SEQ ID NO: 23908 - DNA, 672 bp, Artificial Sequence
  Description of Artificial Sequence: Synthetic coding sequence
atggctggaaataagggtcgcggtcgtgcagcttacacatttaacatcgaagcggtggggttctctaaaggtgagaagcttcccgacgtggtcctcaagcctccacctctttttcctgacacagattacaagcctgtacctctcaaaaccggcgagggagaggaatatatgctggccctaaagcaggagctgcgagagacaatgaaaaggatgccctattttatcgaaactcccgaggagcgacaggatatagaacgttatagtaaacggtatatgaaggtgtataaggaggagtggatccccgattggaggcgattgcccagggaaatgatgccaaggaataagtgtaaaaaggccggaccaaaacccaaaaaggcaaaggacgctggaaagggaacgccgttgacaaacaccgaggacgttctgaagaaaatggaagaattagaaaaaaggggcgatggcgaaaaaagcgatgaagaaaacgaggaaaaggaggggtcaaaagagaagagtaaggagggagatgacgacgatgatgatgacgccgcagagcaggaggagtatgacgaggaagaacaggaggaggaaaatgattacataaacagctatttcgaagatggagacgattttggtgcagactctgacgataacatggacgaagccacatactag

SEQ ID NO: 23909 - DNA, 672 bp, Artificial Sequence
  Description of Artificial Sequence: Synthetic coding sequence
atggcagggaataagggacgcggtcgcgctgcgtatactttcaacattgaagccgtggggttttcaaagggcgaaaagttgcccgacgtcgttctaaaaccaccccctttgttccccgataccgattataaaccagtgccacttaaaaccggtgaaggggaagaatacatgctggcactcaagcaggagctgagagaaactatgaaacgaatgccttattttattgagaccccagaggaacgacaggacattgaacgatacagcaagagatacatgaaggtctacaaagaagaatggattcctgattggagaaggctgccacgtgaaatgatgcctaggaataagtgcaagaaagccggtccgaagcctaaaaaagcaaaggatgccggtaaagggacaccactcaccaacaccgaggacgtcctgaagaagatggaggaactcgagaaaagaggagacggtgagaagtcagatgaggaaaacgaggagaaggaaggtagtaaagaaaagtccaaggagggcgacgatgacgatgacgatgatgctgccgaacaagaagagtatgatgaagaggagcaagaagaagaaaacgactatattaactcctacttcgaggacggagatgatttcggcgcagattcagatgacaatatggacgaagctacgtactag

SEQ ID NO: 23910 - DNA, 528 bp, Artificial Sequence
  Description of Artificial Sequence: Synthetic coding sequence
atgtttgttctggttgagatggtcgacacagttcggattccgccatggcagttcgaaaggaagttaaacgattctattgccgaggagctgaacaagaagcttgcaaataaggtagtttacaatgtcggactttgcatatgcctcttcgatatcaccaaactggaggatgcatacgtcttccccggtgacggagccagtcatactaaagtttccttaggattcttcgacgacatacttatccccccagagtctttgcagcagcctgccaagtttgacgaggctgagcaagtctgggtttgggagtatgagaccgaagagggcgctcacgatctctatatggacacaggcgaagagattcgctttcgggttgtggacgaaagctttgtcgatacctcacccaccggcccatcctctgctgacgccacaacttcctcagaggagcttccaaaaaaagaggcaccatacacgctcgtgggtagtattagtgaacctgggttaggtcttttgtcatggtggactagtaactag

SEQ ID NO: 23911 - DNA, 615 bp, Artificial Sequence
  Description of Artificial Sequence: Synthetic coding sequence
atgttcgtattggtggaaatggtggataccgtgagaataccaccctggcagttcgagcgtaagctgaacgactccattgcagaggaattgaacaaaaagcttgccaacaaggtagtctacaacgtcggtctctgtatctgcttgttcgatattactaagctagaagacgcatacgtgttccccggagatggggcatcccataccaaggtacattttaggtgtgtagtatttcacccgtttctggacgaaatcttaattggaaagatcaagggttgcagccccgaaggggtgcatgtgagcctcggatttttcgatgatattctgattccaccggagtctctgcagcagccggcaaagttcgacgaggcggagcaagtatgggtctgggaatacgaaacagaagaaggcgctcatgatctttacatggatactggagaagagattcggtttcgggttgtggatgaatcatttgtagacacgtcacctactgggcctagcagcgccgacgctactacctccagtgaagagctgccaaaaaaggaggccccatacaccttggtgggtagcatctcagaaccgggactgggcctcctgtcctggtggacttcaaactag

SEQ ID NO: 23912 - DNA, 615 bp, Artificial Sequence
  Description of Artificial Sequence: Synthetic coding sequence
atgttcgtgcttgtggaaatggttgacacggtacgcattcctccatggcaatttgagcgcaagctgaacgattcaattgcagaggagctgaacaaaaaactcgccaataaagttgtatacaatgtgggcctgtgcatttgtctgttcgatatcactaaattggaggatgcttacgtatttcctggggacggcgctagccatacaaaggtccacttcaggtgtgtcgtttttcacccattccttgatgaaatcctgatcggaaaaatcaaggggtgctctcctgagggcgttcatgtgtcgctgggttttttcgatgacattttgatcccccctgaatcactgcagcagccagctaagttcgatgaagctgaacaggtctgggtatgggagtacgagaccgaggaaggcgcacacgatctctacatggataccggggaagagattaggttcagagtcgtggatgagagctttgtagacacctcaccaacaggcccatccagcgctgatgccaccacctctagtgaggagctccctaaaaaggaggccccttatacactggtcgggtcaatttctgagcctggcctagggttgctctcatggtggacctccaattag

SEQ ID NO: 23913 - DNA, 615 bp, Artificial Sequence
  Description of Artificial Sequence: Synthetic coding sequence
atgtttgtgctggtggagatggttgacactgttcgcatacccccttggcaatttgaacgcaaattgaatgacagcattgcagaggagttgaataaaaagctcgctaataaagtcgtatataacgtcggcttgtgtatctgcctctttgacataactaaactggaggatgcctatgttttccctggagatggcgcttcccacacaaaagtacacttccggtgcgtggttttccatccttttctggatgaaatcctgattggcaagatcaagggttgtagtccagagggagtacacgtcagcctggggtttttcgacgatatcttgattccccctgagtctctgcagcagcctgccaaattcgatgaggcggaacaggtctgggtgtgggaatatgagactgaagaaggtgcgcatgacttgtatatggatactggtgaggagatacgcttcagagtggtggatgaatcctttgtagatacatctcctacggggccttcctcagccgatgccaccacctcttccgaggagctgcctaaaaaagaagctccatataccctggttggctcgatctctgaacctgggttgggcctgttatcctggtggaccagcaattag

SEQ ID NO: 23914 - DNA, 327 bp, Artificial Sequence
  Description of Artificial Sequence: Synthetic coding sequence
atgctcctgttttgccccggatgtgggaatggcttaattgttgaggaaggccaacgctgtcataggttctcgtgcaatacatgcccctatgtccacaacatcaccaggaaggtgaccaatcgtaaatatcctaagctcaaggaggtggacgatgtcctgggaggcgctgctgcctgggagaacgtggattcgaccgctgagtcttgtcccaaatgcgaacaccccagagcatacttcatgcagctccagaccaggtccgccgacgagcccatgaccacgttctataaatgttgtaatgctcagtgcggccacagatggagggactag

SEQ ID NO: 23915 - DNA, 771 bp, Artificial Sequence
  Description of Artificial Sequence: Synthetic coding sequence
atgagcaggaagaagactccaaagtccaaaggtgcttcgacacctgcggctagcactcttcccactgccaacggtgcaaggcccgctagaagcggtactgccctgtcagggcctgatgcccctccaaatggccctttgcagcccggacgaccctctctgggcggtggtgtggacttctatgacgtcgcattcaaggttatgttagtgggcgatagcggtgtggggaagacttgcctgctcgtcaggttcaaggacggtgcgttcctagcgggaactttcatcagcaccgttgggatagacttcagaaacaaggtgcttgacgtggatggcgtcaaagtgaaactccagatgtgggacacggccggacaggagagatttaggtcagtgacacatgcctactacagagacgcacatgcgctcctgcttctgtatgacgtgaccaataaagccagcttcgataatatccaggcttggctgaccgagatccacgagtacgctcaacatgacgttgccctaatgttgctgggcaacaaggtagacagcgcccacgaacgcgtggttaagcgagaggatggtgagaagttggccaaggaatacggacttccctttatggaaacaagtgctaagactgggctgaacgtcgacttggcgttcacagccatcgctaaagagttaaaacaaaggtctatgaaagctccttccgagcccagattccggctgcatgattacgtcaagcgggaaggcagaggcgcttcctgttgcagaccctag

SEQ ID NO: 23916 - DNA, 1668 bp, Artificial Sequence
  Description of Artificial Sequence: Synthetic coding sequence
atggatggcgttgtgactgacctaattaccgtgggtctcaaaagaggctccgatgagttgctcagctcaggcatcatcaatggtcctttcacaatgaactcaagtactccatccaccggggtgtatgcgaacgggaacgattccaaaaaattcaagcgggatcggcctccctgttcacccagcagggttctgcacctgcggaaaattccctgtgacgtgacagaggcagaaataatatctttgggacttccgttcggcaaagtgaccaatctcctgatgctgaagggtaagagccaggcctttctggagatggccagcgaagaggccgcagtgacaatggtgaactactatacaccaatcactccacatctgagaagccagcctgtctatattcaatattccaaccacagagaactgaaaactgacaatctgccgaatcaagcccgagcacaagcagccctgcaagcggtgtcagcggtccagtctgggtcactcgccttatctggaggcccatcgaatgaagggaccgtgctgcccggtcagtctccagttctgaggatcatcatcgagaatttgttctaccccgtcaccttagaagtactgcatcagattttctccaaatttggtaccgtactcaagataatcaccttcactaagaataatcagtttcaggccctgttgcagtatgcagatcccgtaaatgcccattatgctaaaatggccttggacggccagaatatctacaacgcttgttgcactctaaggattgacttctccaagctcacttccctaaacgtaaagtataacaacgataagtctagggatttcaccaggctcgacttgcctaccggtgacggacagccaagccttgagccaccaatggccgctgctttcggagccccagggatcatcagctccccgtatgccggagccgctggatttgcacccgcaattggctttccacaggctactggactgtccgtccccgctgtgccgggagctctcggcccactgacaataaccagcagcgctgttaccggccgtatggccatccccggagcctcaggcatccctggcaatagcgtcctgctggtgacaaacctgaaccccgatttgatcaccccacacggtctcttcatcctgttcggcgtgtatggtgacgttcatagagtgaaaataatgtttaataaaaaagaaaacgcactggttcagatggcggatgccaatcaggcccaattagctatgaatcacctttcaggtcagcgcctgtatggaaaagttcttcgtgctacattgtcaaaacaccaagccgtgcagttgccccgtgaagggcaggaagaccagggactgacaaaggacttttctaattcccccttgcatagatttaagaaaccaggctcaaaaaactttcagaacatttttcctccgtctgccaccctccatctaagcaacatccctccgtcagtcacagtggatgacctaaagaatctctttatagaagctggatgttccgtgaaggcattcaagttctttcaaaaagataggaagatggccctcatacagctgggttccgtcgaggaggctatacaggccttgatcgagctacacaaccacgatctgggtgagaatcaccacttgcgggtctcctttagcaaatccaccatctag

SEQ ID NO: 23917 - DNA, 1374 bp, Artificial Sequence
  Description of Artificial Sequence: Synthetic coding sequence
atggccttcctcgagatggcctctgaggaggctgccgtgactatggtaaactactatactcctatcacgcctcatctgcggagccagcctgtctatattcagtattcaaatcacagggaactcaagaccgacaatcttcctaaccaggctcgcgctcaagccgctctacaggccgtttcagccgttcagtcaggctctctcgccctgagcgggggaccatcgaacgaggggactgtgctgcccggacagagcccagtgttgaggataataatcgaaaacttgttctacccggtaacactggaggtactccaccagatcttcagcaaattcggcactgtcctaaagatcatcacattcacaaagaacaaccagtttcaggcactgctccagtacgctgaccccgtgaacgcccactacgcaaagatggccctcgacggccagaacatttacaatgcatgctgcactttacggatcgacttcagcaagctaacttcattgaatgtcaaatacaataacgataagagccgggactttacacgtttggatttgccaaccggcgacggtcagccctctcttgagccaccaatggctgccgctttcggagcgcctgggattatctcctctccttacgccggtgcggcaggttttgcccctgccattggtttccctcaggctactggattgtctgtacctgcagtgcctggtgccctggggccattgaccatcacctcttcagccgtgaccggaagaatggccattcctggtgcaagcgggatacctgggaattccgtgctcctggtgaccaatctgaaccccgatcttatcacacctcacgggcttttcatcctgttcggcgtctatggcgatgtccaccgagtcaaaataatgttcaacaagaaggagaatgccctggtccagatggcagatgctaaccaggcccagcttgccatgaaccacctgtccgggcagcgactgtatggcaaagtgctgcgggcaacactcagcaagcaccaagcagtccaattgccccgagagggccaagaggatcaaggcctgactaaggattttagcaattcaccccttcacaggtttaaaaagcccggtagtaagaatttccagaatatttttccaccctcagctactctgcatctcagtaacataccacctagtgtgaccgtggatgatcttaaaaacttgtttatcgaagctggctgtagtgttaaagcttttaaatttttccagaaagacaggaaaatggccttaatccagctcggctctgtggaggaggcaatccaggctctgattgagctgcacaatcatgacctgggagagaaccatcatctgagagtgagtttttccaagtccaccatctag

SEQ ID NO: 23918 - DNA, 1659 bp, Artificial Sequence
  Description of Artificial Sequence: Synthetic coding sequence
atggatggggtcgttactgatctgataacggttggactgaagaggggcagtgacgaactgctgagcagcggaatcatcaacgggccattcaccatgaattcatccactccaagcacggccaacggcaacgactccaagaaattcaagagagacaggcccccttgttccccatctcgagtgctgcacctgcggaagattccatgtgatgtgacggaggctgaaattataagcctcgggctcccctttggtaaggtgactaacctcctcatgttgaaaggaaagagccaagcattccttgagatggccagtgaggaagctgcagtgacaatggtgaactactatacccctattactccacatttgcggagccagcctgtctatatccagtattctaatcatcgagagctgaaaaccgataatttgcccaaccaggcaagagctcaggcagctcttcaggccgtgtctgccgtgcagtctggatcactcgctctgtcaggcggaccaagcaatgagggcacagtgctcccagggcagtccccagtgctccgaattatcatcgagaacttattttatccggtgacactcgaagtcttgcatcaaatctttagcaagtttggcacagtactcaagattatcacatttacaaaaaacaatcagtttcaagcactgttacagtacgctgatccagtcaatgctcattacgctaaaatggcattggacggacagaatatctataatgcctgttgcactttgaggattgatttttctaaactcaccagcttaaatgttaaatacaacaatgacaaatcccgggacttcactaggttggacctgcccaccggggatgggcagccatctttggagccccctatggccgctgctttcggcgcacccggaatcatctcgtccccttacgctggggctgctggctttgctcccgctattggctttccccaggcaaccggactgtccgtccccgctgtccccggagcactcggacctctgactattacttcctccgcggtgactgggaggatggcaatcccaggggcttcagggatccccggtaattcggtcttgcttgtcacaaacctgaatccagatctgattaccccacacggcctcttcatcctgttcggcgtctacggagacgtgcacagggtcaagatcatgttcaataaaaaagagaacgccctcgtgcaaatggccgatgccaaccaagctcaattggctatgaaccacttgtcagggcagcgcctatatggtaaagtgttgcgtgcaaccctttcaaagcatcaggcagtacaacttccaagagaaggccaggaagatcaagggctcactaaggatttctctaatagtccgcttcatcgcttcaaaaaacccggatccaaaaactttcaaaacatttttccaccctctgcgacccttcacctgtctaacattcccccttctgtcaccgtggatgacctcaagaatttgtttatcgaggccggatgcagtgtgaaagcttttaagttcttccagaaggaccggaaaatggccctgatacaattgggcagcgttgaagaggctatccaggccttgatcgaactgcacaatcatgacctcggcgaaaaccatcacctgcgggtcagcttctctaagtccacaatctag

SEQ ID NO: 23919 - DNA, 1575 bp, Artificial Sequence
  Description of Artificial Sequence: Synthetic coding sequence
atgaactcctccactccaagcacaggcgtctacgccaatggaaacgatagcaaaaaatttaaacgagaccgtcccccttgcagcccttcacgagtattgcacttaaggaaaataccctgtgatgtcaccgaagccgaaattattagtttggggctgcctttcggcaaagtgaccaacctgctgatgctcaaagggaagtcacaagcattcctagaaatggcttcagaagaggccgcagtcaccatggtgaattactacacacccatcaccccacatttacgttcacagcccgtgtacatccagtattccaaccatagagagctgaagactgacaacttgcctaaccaagcacgggctcaggctgctttacaggccgtatctgctgtacagtctggttccttagccctcagcggcggacccagcaatgaggggacggtattgcccggacagtcccccgttttacgcattataattgaaaatctgttttaccccgtcaccctggaggtactccaccaaatcttcagtaaatttggtaccgtgctcaaaataatcacgtttaccaaaaacaatcagtttcaggccctgcttcagtacgccgatcctgtcaatgctcattatgccaagatggctttggatggacagaatatttacaatgcgtgctgtacactgcggattgactttagtaaactcaccagtctcaacgtgaagtataacaacgacaaatcccgggacttcacgaggctggacctccctacgggggatggacaaccctctctcgagccacctatggccgcagcatttggcgctccaggtattatctctagtccctatgccggagctgccggatttgcccctgccattggcttccctcaggcaaccggcttgagtgtgccggctgtgcctggagcactcggaccacttacaataacaagcagtgcagtaaccggcagaatggccattccaggtgcatccggtatacctggaaactctgtactgctagtcacaaacctcaaccctgacctcattactccgcacggcctcttcattctgtttggcgtgtatggtgacgttcaccgcgtgaaaatcatgttcaataagaaagaaaatgctctcgtgcagatggctgacgcgaatcaggcccagttggctatgaatcatttgtcaggccagaggttgtacgggaaggtgcttagagctaccctatctaagcaccaagcggttcagttgccgcgagaaggacaggaggaccaaggtttgacaaaggacttctcaaactcaccactccatcgctttaagaagcccggtagcaaaaacttccagaacatctttcctccctccgctaccttgcatctgtcaaacatccctccttctgttacagtggatgatctgaagaatctcttcatagaagcaggctgctctgtcaaagcctttaaattctttcaaaaagatcggaaaatggcactgatacagctgggatctgtggaggaggccatacaagccttgatagagctccacaatcatgacctaggggagaaccatcatctcagggtgtccttctctaaaagtaccatttag

SEQ ID NO: 23920 - DNA, 234 bp, Artificial Sequence
  Description of Artificial Sequence: Synthetic coding sequence
atggatggagtggttactgacttgatcaccgtcggcttgaagaggggctccgacgagctcctttccagcgggataatcaatggcccatttaccatgaatagcagcaccccatccactggggtgtacgcaaatggcaatgatagcaagaagtttaaacgtgaccggcctccatgcagccccagtcgcgtgctgcacctgaggaaaattccttgtgacgtaacggaggctgagtag

SEQ ID NO: 23921 - DNA, 1677 bp, Artificial Sequence
  Description of Artificial Sequence: Synthetic coding sequence
atggatgcaagccccagccctttctcacttccaaaaaaactcaacgaattgagtgctcgcagggggtctgatgaactcctttcaagtggaattattaatggacctttcactatgaatagctcaaccccgagcaccgcaaatggaaatgactccaagaagttcaaaagggatcgccctccatgcagtccaagccgggttctccaccttaggaagatcccctgcgatgtaaccgaagctgagataatctctctgggtttaccattcggcaaggttacgaacctgctcatgttgaaaggcaagagtcaagcctttttagagatggcctcggaagaagcggctgttacgatggtgaactactacacgcctattaccccacatctgcggtcccagccagtgtacattcagtatagcaaccaccgagagctgaagacagataacttgcccaatcaggctcgcgctcaggccgcactccaagccgtttccgcagtgcagtcaggtagcctcgctctaagtgggggacccagtaacgagggcactgtgctccccggacagagtcccgtgctgaggatcatcattgagaacctgttctaccccgtgaccctcgaagtgctacaccagatcttttccaagttcggaactgtcttgaagatcatcacatttacaaagaataatcaatttcaggccttgttgcagtatgccgatccagttaacgcccactacgcaaaaatggccttagatggccagaatatttataacgcatgctgcacacttcgcatcgacttcagtaaacttacaagtctgaacgtcaagtacaataacgataaaagtagagatttcacgaggttggacctgcctaccggcgatggccagcccagcctcgagcccccaatggctgcagcatttggggctcctggcatcattagcagcccttatgcaggagccgcaggcttcgcacccgctattggcttcccccaggccaccggacttagtgtgcccgctgttccaggcgcacttgggcctctcacaattacatcttcagccgtcacagggagaatggcgatcccaggcgcttccggcatccccggaaatagcgtgttattagtgacgaatctcaatcccgatcttatcacacctcatgggcttttcattcttttcggggtatacggagacgtccaccgggtgaagatcatgtttaataaaaaggagaacgccctggttcagatggcagacgccaatcaggcccagttagccatgaaccacttgtcaggtcaaagactgtacggaaaggtgttacgcgcaactttgagcaagcatcaggccgtccagctacctagagagggacaggaggaccagggactcaccaaagacttctcgaattctccactgcaccgctttaaaaaacccggaagcaagaacttccagaatatattccccccttctgctactctccacttgagcaatattcctccatctgttaccgtggacgacttgaagaatctgtttattgaggcaggatgttccgtgaaggctttcaaattttttcaaaaggatagaaaaatggcccttattcagctaggaagcgtggaggaggctatccaggcgttaattgaactgcacaaccacgacctaggcgaaaaccatcacctgcgtgtgagcttctctaaatccactatatag

SEQ ID NO: 23922 - DNA, 1500 bp, Artificial Sequence
  Description of Artificial Sequence: Synthetic coding sequence
atggaaaacggccagtctaccgctgccaaattaggactgccaccactgactcccgaacagcaggaagctcttcaaaaggccaaaaagtacgctatggagcagtctatcaagagcgtgcttgtgaaacagaccatcgctcaccagcagcagcagctgacaaatctgcagatggccgcacagaggcaacgtgctctggccatcatgtgtcgggtgtacgtcggctctatttactatgaactcggggaagacaccattagacaagcattcgccccttttggcccaattaagtcaattgatatgagttgggatagcgtcactatgaagcacaagggcttcgccttcgttgagtatgaagtgcctgaggcagcccaactggcacttgagcagatgaactccgttatgcttggcggacggaatatcaaggttggcaggccttccaacattgggcaggctcagccaataatcgatcagctggcagaggaggccagggcattcaatcgtatctacgtagcttccgtccatcaggacctcagtgacgacgatattaagagcgtctttgaagcttttgggaagatcaaaagctgcactctagcacgagaccccaccacgggcaaacacaaaggctacggtttcatcgagtatgagaaggcccaatcatcacaggacgcggtctcgagtatgaacttgtttgacctcgggggacaatacctgagagtcggcaaagctgtcactcctcctatgcctcttcttacacccgcaactccaggcggattgcccccagcagctgcggtcgccgctgcagcagcaacagccaagatcacagcacaggaagctgtggctggggctgcagtgctgggcaccctggggacccccggacttgtcagcccagctctcaccttggcccaacctctcgggactctgccacaagccgttatggccgctcaggctcccggagtaatcactggtgttaccccagccagaccaccgatccctgtgaccattcccagcgtaggtgtggtcaacccgatcctcgccagtccgcctacactcgggttgctcgagcccaagaaggaaaaagaggaagaagagctctttcccgagtccgagcgacctgagatgctgtcagaacaagagcacatgtctatcagcggctctagcgcccgacacatggtgatgcagaagttgctgcgcaagcaggagtcaacagtaatggtgctgaggaacatggtggatcccaaggacatcgatgacgacctggagggcgaggtcaccgaagaatgcggtaaattcggtgctgtgaacagagtcatcatctaccaggaaaagcagggagaggaggaggacgcggaaattatagtgaaaatttttgtggaattctcaatagcttcggaaacccataaggcaatccaagccctaaatggtcgatggtttgccggtagaaaggttgtggccgaggtctacgaccaggagcgctttgacaactccgacttgtcagcctag

SEQ ID NO: 23923 - DNA, 1629 bp, Artificial Sequence
  Description of Artificial Sequence: Synthetic coding sequence
atggccaccgctaccattgccctgcaggtgaacggtcagcaaggaggtggaagcgagcccgctgccgcagcagccgtagtcgcggcaggcgacaagtggaagccaccacagggtacggattcaataaaaatggaaaacggccagagtacggccgctaagctcggtctgccaccattgacaccagaacagcaggaagcgctccagaaagccaagaagtacgccatggagcagagcattaagtctgtcttagtgaaacagacaatcgctcaccagcagcagcaattaactaaccttcaaatggcagcccagcggcagagggccctagcgattatgtgccgtgtctacgtaggctctatctactatgaacttggcgaagatactattaggcaggcttttgcccctttcggacccatcaagagtattgatatgtcgtgggactcggtaaccatgaaacacaagggttttgcctttgtcgaatatgaggtgcccgaggccgcacagctagctctggagcagatgaactctgtgatgctcggcggaaggaatataaaagtcggcagacccagcaatatcggccaggctcagccgattattgaccagctggctgaggaggcaagagcttttaataggatctatgtggccagcgtgcatcaggatttaagtgatgatgacatcaagagtgtgtttgaggcttttgggaagataaagtcatgcacactcgctcgggaccctacaacaggcaaacacaaaggctatggctttattgagtacgaaaaggcccagagctcacaagatgcggtctcgagcatgaatctctttgatttggggggacagtaccttagagtgggtaaagccgttactccgccaatgcctctcctgacccctgccacccccggagggctgccccctgccgctgctgtggcagctgccgcagccaccgcaaaaatcactgcccaggaagccgttgctggcgcagcagtgttaggcacgctgggtacgccgggtctcgtctcacctgccctgacccttgcacagcccctgggcacccttccccaggccgtgatggcggctcaggcaccaggggttatcactggcgtgacgcctgctcgaccacccatccctgtgacaattccaagcgtcggtgttgttaacccgatcttagcaagtcctcccacactgggtttgctggagcccaaaaaggaaaaggaagaagaggagctgttcccggagagcgagcgcccagagatgctcagtgaacaggagcacatgtccattagcggctccagcgctagacacatggttatgcagaaactcctccgaaaacaggagtccacagtcatggtgctccggaatatggtcgatcccaaagacatcgatgacgatttagagggagaggtaaccgaagagtgcgggaaattcggtgctgtcaatagggtcataatataccaggagaaacagggagaagaggaggatgccgagatcatcgtaaaaatttttgttgagttctccattgccagtgaaactcacaaggctatacaggcactcaacggcagatggttcgctggacggaaagtggtcgctgaagtctacgatcaggaacggttcgacaatagcgatctctcagcatag

SEQ ID NO: 23924 - DNA, 1551 bp, Artificial Sequence
  Description of Artificial Sequence: Synthetic coding sequence
atggagaatgggcagtccactgctgccaagcttgggttgcctccgctgactccagaacagcaggaggcgctgcaaaaggctaaaaagtatgcaatggaacaatcaatcaagtctgtcctggttaagcagactatagcccatcagcaacaacaactcacaaatttgcaaatggccgctgtgaccatgggatttggggatcctctgtctcctctgcagtcaatggcagcacaacggcagcgtgccttggcaatcatgtgccgagtttatgtgggaagcatttactatgagctgggggaggatactatacgacaggcattcgcacctttcggaccgataaagtcgatagatatgtcctgggacagcgtcactatgaaacacaaagggtttgctttcgtcgaatacgaagtccccgaagcagcccagctggctctcgagcagatgaacagcgttatgttaggtggacggaacattaaggtcggcagaccctccaatataggacaagcccagcccataatcgaccagctcgcagaagaagctagggcttttaacagaatctatgtggcgagcgtgcaccaagacttatctgacgatgacataaaaagcgtgtttgaagcctttggtaagatcaagtcctgtactttggccagggaccccaccactggtaaacacaagggctatggctttatagagtacgaaaaagctcagtcatcacaggacgcggttagtagcatgaacctttttgaccttggcggacagtacctaagagtaggaaaggccgttactcccccaatgccactccttaccccggctacgcccggagggttgcctcccgctgctgccgttgccgcagccgcagcaactgctaaaatcactgcccaggaagcagtggccggagctgccgtcctaggaacactgggaacccctggccttgtgagcccagctctgactctggcccagccactgggcaccctcccccaagctgtcatggctgctcaggccccaggtgtaatcacaggcgtgacgccagcccgaccaccaatccccgttaccataccctcagttggagtagtcaacccaattttagcgtctccccctactctggggctgttagagcctaagaaggaaaaggaagaagaggagctctttcccgagagcgagagaccagagatgttatcagagcaggaacatatgtcaatttcagggtcttccgcgagacatatggtgatgcagaaactgctgcggaagcaagagtccaccgtaatggtgttacggaacatggtggatcccaaggacatagatgatgatttagaaggcgaggtgaccgaggaatgtggaaaatttggcgcagtaaatagggtgatcatctatcaggagaaacagggtgaggaagaagacgccgagatcatagtgaagatttttgtggaattttccatcgcctctgagacccataaggccattcaagctctaaacgggaggtggttcgctgggagaaaggtggtggccgaggtgtacgaccaggaacggtttgacaacagcgacctctcagcgtag

SEQ ID NO: 23925 - DNA, 1680 bp, Artificial Sequence
  Description of Artificial Sequence: Synthetic coding sequence
atggctaccgccactatcgcactgcaggttaacggccagcaagggggtggttccgaaccggctgcagcagccgcagtcgtggccgcaggggacaaatggaagccacctcaaggaacagacagcatcaagatggagaacgggcagtctacagccgctaaactcggcctgccccctctgacaccggaacagcaggaggccctacagaaagctaaaaaatacgcaatggaacagtcaataaaatcggttctggtgaagcagacaatcgctcatcagcaacagcaattgacaaatctgcagatggccgctgtaaccatgggctttggtgatccccttagtccgctgcagtcgatggcagcacagcgacagcgtgccctggctatcatgtgccgcgtatacgtcgggagtatctactacgaacttggagaggacacgatcagacaagccttcgcgccttttggtcctattaagtctattgatatgtcatgggacagtgtgaccatgaaacacaaggggtttgcatttgtggagtacgaagttccagaggctgcccaattagctctagagcagatgaactcagtgatgctggggggaagaaatattaaggtgggccgaccatcaaatatcggacaagcccagccaataatagaccagctcgccgaagaggctagagccttcaaccgaatctatgttgccagtgtccatcaggatctgtccgatgacgacattaagtctgtatttgaggcatttgggaaaataaagagttgtaccctcgctagagacccaaccaccgggaagcataagggatacggcttcattgagtatgagaaagcccaaagttctcaggatgccgtctctagtatgaacctctttgacctgggaggacagtatttgagggtgggcaaagcagtcacccctcctatgccgctgcttacaccagcaacaccgggtggcctgccccctgccgcagccgtcgcagccgctgcggcaactgccaagataaccgcacaagaagccgtagccggagctgctgtgctcggaaccctcgggaccccaggactggtctcacctgcactgacattagcacagcccctaggcaccctcccgcaggctgtaatggccgcacaagctccgggagtgatcacaggagtaacccccgcaaggccccctatccccgtgactatcccttccgtcggggttgttaatcccatccttgcgtccccccctaccctgggattgcttgagccaaagaaggagaaggaagaggaagagttattccctgagtcagagaggcccgaaatgttaagcgaacaggagcatatgtccattagcggatcttccgcacgtcacatggtaatgcaaaaattactgcgaaagcaggaatccacagtaatggtgctccgtaatatggtggacccaaaagatatcgacgatgacctggagggtgaggttactgaagaatgcggcaagtttggtgctgtcaaccgggtcatcatttaccaggagaagcaaggtgaggaagaagatgctgagatcatcgtcaaaatatttgttgagttctctatcgcgtccgagacccacaaggccattcaggccctaaacggtcggtggttcgccggacgcaaggttgtggccgaggtctatgaccaagagcggttcgacaattccgacctgagtgcatag

SEQ ID NO: 23926 - DNA, 2232 bp, Artificial Sequence
  Description of Artificial Sequence: Synthetic coding sequence
atgaataacccatctgagacctcaaaaccaagtatggaatctggtgatgggaatacaggtactcagaccaacggcctcgatttccagaagcagcccgtgccagtggggggagccatctctactgctcaggctcaggcttttctcggtcatctacaccaggtgcaattggccggtactagtctccaagcggcagcccagtcattgaacgtgcaatccaagtcaaacgaggaatccggagacagtcagcaaccaagtcagccgtcccaacagccctcagtgcaagccgctattccgcagacccagcttatgctcgcgggtggtcagatcacaggtttgactctcacgcccgctcaacaacagctgcttctgcagcaagcccaggcacaagcccaacttctggccgcagccgtgcagcagcatagtgcatcccagcagcatagtgcggctggggcaactatttcggcatccgcggctactcccatgactcagattcccctcagtcagccaatccagattgctcaggacctgcaacagctccagcagttacagcagcaaaacctgaacctgcaacagtttgtcttagtacaccccacaacgaacttacagccggcacagttcataatctcgcaaaccccacagggccaacagggcctgttgcaggcacagaatttgttaacccaactgccacagcagtcccaggcgaatctgctgcaatcccagccatcaatcaccctaacttcgcagccagcgacccccactcgaactatcgccgctacacccatccagaccctgccacagtcccaaagtactcctaagcgcattgacactccaagcctggaggagcccagcgacctcgaggaactggagcagtttgccaaaaccttcaaacagcggcgtatcaaactgggatttacccaaggcgacgtgggtttggcgatgggtaagctgtatggcaacgatttcagccaaaccacaatttcccgcttcgaggcgttgaacttgagctttaagaatatgtgcaagcttaagcctctgctggagaagtggcttaacgacgccgagaatctgtcctccgattcttccctatcatctccaagtgccctcaattcccccggtatcgagggtctcagtcgccgtaggaagaagcgcacaagcatagaaaccaacatccgggtcgctttggagaagagctttctggaaaaccagaaaccaacgagcgaggaaataactatgatcgccgatcagctaaacatggaaaaggaagttattcgcgtgtggttttgcaaccgcagacagaaagaaaagcgcatcaaccccccaagtagcggcggtacttccagcagtccaattaaggcaatttttccgtccccaacatctttggttgccacaacaccaagtttggtgacctccagcgcagccactacattgacagtttctccagtactgccactcacgtccgccgcagttacaaatcttagcgtgacaggtacatctgacactacttcgaataacaccgccaccgtgatatctactgcgcctcccgcatcctcagctgttacctccccttccctaagcccgtctcctagcgcgagtgcatccacgagcgaagcttcgagtgctagcgagactagcactacccagacaaccagcacgcccctgagcagccccctgggaacctcacaggtgatggttacagcctctgggctgcaaactgccgctgccgcagctctacagggtgcagcccagcttccagccaacgctagcttggctgctatggctgctgctgccggattgaatccctcactaatggctccttctcagtttgcagcaggtggcgcactgctcagtctaaatcctggcaccctgtccggcgctctgtctccagcccttatgagcaactccacgctggcaacaatccaagcactggcctctggtggctcactgccaatcacatcgctggacgctaccggaaatttggtctttgcgaacgctggaggtgcgccaaacatcgtgaccgcaccactattcctgaacccgcagaacttgagcctgttaactagtaaccccgtgagcctggtatctgccgctgcagcctcggcaggcaacagtgcccctgtggcatctctgcacgctactagcactagtgccgaaagtattcagaactcacttttcactgtagcaagtgcgtctggagcagccagcactaccacaactgcttccaaagcccagtag

SEQ ID NO: 23927 - DNA, 2268 bp, Artificial Sequence
  Description of Artificial Sequence: Synthetic coding sequence
atgctagattgctccgattatgtcctggactctagaatgaacaatccttccgagacaagcaagccgtctatggaaagtggggacggcaataccggcactcagacaaacggactagacttccagaagcagccagtccctgtgggaggagcgatttccacagcacaggcccaagccttcttgggtcacctgcatcaggtacagctggccggaacatctttacaggcagcagcacagagtctcaacgtccagtcaaagtcaaacgaggagtccggtgactcacaacagcctagccagccttctcagcagccttcagtgcaggccgctatcccccagacacaactcatgctggctggtggacaaattacaggtctgacacttacaccagcccagcagcagctgcttctgcagcaggctcaggctcaggcccagctcctagctgcagctgttcagcagcatagtgcttcgcagcaacatagcgccgctggcgctaccatctcagcctccgccgctacccccatgactcagatccctctgtctcagcctatccaaatcgctcaggatcttcaacagttgcagcaactgcagcagcagaacctgaatctccaacagttcgtgttggtgcacccaacgacaaatctgcagccagcccaattcataatctcgcagacaccccagggacaacagggtctgctgcaagcacagaatcttctaacccaactgccgcagcagtctcaggctaacctgttgcagagccaaccgagcatcacactgacctcacagcccgctactccaacccggacaatagcagctacgcctatccaaactctgccccagtctcaatctacccctaagcgaatagatacaccgagcctagaggagccttccgacctggaggaactggagcagttcgcaaaaacatttaaacagcgtaggataaaattgggatttacgcagggagatgtaggcctcgccatgggcaagctgtacggcaacgatttcagtcagaccacaattagtagatttgaggccctgaatctctcttttaaaaatatgtgcaagctaaagcccctcctggaaaagtggctgaacgatgctgagaatctgagctctgacagcagcctcagctcaccctccgcactgaactctcctgggatagaggggctgtctcggcgaagaaagaagagaacgagtattgaaacgaatatacgggtcgccctcgaaaagagttttcttgagaaccaaaagcctacttccgaagaaatcacaatgatcgccgatcagctaaacatggaaaaggaagttatcagagtttggttctgtaatcgcagacagaaggagaagaggatcaaccctccctcttctgggggtactagcagctcacccattaaggccatttttccaagcccaacaagtctggtggctacaacaccttccctggtgaccagcagtgcagccacgactctaaccgtgtctcccgttctgcctctgaccagtgccgcagtgactaacctttcggttaccggtacaagcgatacaacatctaataatactgccaccgtaatcagtacggcccctccggcatctagcgcagtcacctctcccagtctgagcccctcacccagcgctagcgcctccacttcagaggcctcatccgcctctgaaacaagtacgactcaaacaacatccacccccctaagctctccattggggacctctcaggtgatggtcaccgcgtctggattgcagactgctgcagccgctgccctccaaggagccgcacagcttcccgctaacgcgtcactcgcagcaatggctgcggctgccggtctgaacccgagtctgatggctcccagccagtttgctgccggtggggctctcctcagcttgaacccgggaactctttcgggtgctctctctccggcacttatgagtaactctacactggctaccattcaggccctggcctcagggggtagcctccctataacgtcactggatgccaccggtaatcttgtgttcgcaaacgccggtggcgctccaaacattgtgacggcgcctttgttccttaacccacaaaacctctccctgctgacgtctaatcccgtcagtctggtgtcggccgctgcagcgtcagctggtaatagtgcccctgtggcctccctgcatgccacaagcacctcagctgagtccatccagaacagtttgttcacagtggcctcagctagcggtgccgcttccacaactacaacagcgtccaaggcacagtag

SEQ ID NO: 23928 - DNA, 2226 bp, Artificial Sequence
  Description of Artificial Sequence: Synthetic coding sequence
atgaaaacaaggatgaagatctttgtgatgatacattttcatctcatgaacagtacccagaccaacggcctagatttccagaagcagccggtgcccgttggcggagccataagcacggcccaggctcaagcctttctgggacacttacaccaggtgcagctggccggaacttcattacaggctgccgctcagagcctcaacgttcagtctaaaagtaacgaggagtctggcgattcccaacagcctagccagccgtcccagcagccttcagtccaggctgcgattccccagactcagctaatgctggctggcggacagattacaggcctgacccttaccccagcccagcaacaattgcttcttcaacaagcacaggctcaagctcaactgctggcggcagccgtgcaacagcattctgcctctcaacagcattcagcagccggagctaccatctccgcctccgctgccaccccgatgacgcagatccccctatcccagccaatccagatcgcccaggacttgcagcaactgcagcagcttcagcaacaaaacctgaatttacagcagtttgttttagtgcacccgaccacaaatctgcagccggctcagttcatcatctcacagacaccccaaggtcagcaggggttattgcaggcgcagaacctcttaacccagttgccacaacagtcacaggccaacttactgcagagtcagccctctataacgctgacgtcacaacctgcgactcccacgcgcactatagcagctacgccaatccagacgctccctcagtctcagtccacacccaagcggatcgacacacccagtctggaagagccgtccgatctggaggagctcgagcaatttgctaagacctttaagcagaggagaattaaactgggcttcacccaaggcgacgttggcctcgcaatgggcaaactttacggcaacgatttttcccagacaacgattagtcgattcgaggctctcaatttatccttcaagaacatgtgtaagctcaagccactactggagaagtggttgaacgacgccgagaacctgagttccgattcttccttgagttctccatcggccttgaacagcccgggaattgaaggactttctcgcagaaggaagaagagaacttccatcgagaccaacatacgagtagccttggagaaatcgttcttagaaaaccagaaacccacctccgaggaaatcacaatgattgccgaccaactgaatatggagaaagaggtgataagagtctggttttgcaaccgtcggcagaaggagaagaggattaatccccctagctcaggtgggacatcttctagcccaataaaagcaattttcccatctcccacctccctagtggcaaccaccccatccctagtgacgtctagtgcagcgaccacactgactgtttctccagttctccccctgaccagcgccgctgttactaatctgtcagtgactgggacctctgacacaacgtccaataatacagccactgtcatctcaaccgccccacccgcatctagcgccgtcaccagcccaagcctgagtccttcaccctctgctagcgctagcacatctgaggcttcttcggcctcagaaacttctactactcagacaacaagtacacctctgagctcaccccttgggacaagccaagtgatggttacggcctctgggctgcaaactgccgctgcagctgcacttcagggggctgcccagctgccagccaacgcgtctctggcggcaatggccgcagccgcaggcctcaacccctccctgatggccccatctcagtttgcagcaggaggggctctcctcagcttaaatcctgggaccttatctggcgctctatctccagcactgatgtccaactcaacattagcaactattcaggccctggcctctggaggttcgctaccgattacctcactcgatgctactggaaatctggtctttgcaaacgcgggtggggcacccaacattgtgacggcacccctctttttgaacccacagaatctctccctgctaacttcaaatcctgtctccctggtcagcgccgcagccgcaagtgccggaaactctgccccagtcgcctcactgcacgccacaagtaccagcgccgaatcgattcagaacagtctttttaccgttgcctctgcctccggagctgcaagcactacaaccactgccagcaaagcacagtag

SEQ ID NO: 23929 - DNA, 2301 bp, Artificial Sequence
  Description of Artificial Sequence: Synthetic coding sequence
atggcagacggcggagctgcaagccaagatgagagcagtgctgcggcagccgctgcagccgattctcgcatgaacaatcccagcgagaccagcaaaccttctatggagtccggagacggaaatactggaactcagactaatgggctcgattttcaaaaacagccagtccctgtggggggagccatttccacagcgcaagcccaggcgttcttggggcatctccatcaggtacagctcgccggaaccagccttcaggccgcagcgcaatctttgaatgtgcaaagtaagagcaatgaggagagcggagattcccagcaacctagccaaccttcccagcaaccctccgtgcaggccgctatccctcaaactcaactgatgctcgctggaggacagatcacaggtctcacacttaccccggcacagcagcaattgctcctgcagcaggcccaggcacaggcccagctgttagcagcagccgtccagcagcactctgcctcccagcaacactcagcagccggagccactatttcagcatccgctgctacacccatgactcagatccctttgtcccaacctatacagatcgcgcaggacctgcagcaactgcagcagctgcagcagcaaaaccttaaccttcaacagtttgtcctggtccaccccacaaccaatttgcagcccgcacagttcatcatatcccagaccccccaagggcaacaggggttgcttcaggctcaaaacctgctgacccaattgccacaacagagtcaagctaatctcctccagagtcagcccagtatcactctcacctctcagcctgctacaccaacccgaactatcgcagcaactccaattcagactctgccgcagtcccaatctactcctaaaagaatagataccccctcattagaggaaccttcagatctggaggaactggagcagttcgcaaagacatttaagcagagaagaatcaagttggggtttacacagggcgacgtgggtctcgcgatgggaaagctatacggcaacgacttctctcaaactacaattagtaggttcgaggctctcaacttatcatttaaaaacatgtgtaaattaaaacctctcctcgaaaaatggctaaacgatgcagaaaacctgagcagtgactcatcactcagctctccctccgccctcaatagccctggaatcgaggggttaagtcgcaggcgcaagaagcgcacatcgatcgagactaatattcgtgtcgctttggagaagagttttttagaaaaccaaaagcccactagtgaggagatcacaatgatcgctgatcagctcaacatggaaaaggaggtcatccgagtctggttttgcaatcggcgacaaaaagaaaagcggattaaccctcccagcagcggcggaacctcttcgtcgcctatcaaggctatcttcccaagccccacttcactggtggcgaccactccctcattagtcacgtccagcgcagccaccacactcacggtctcccccgtgctgccccttaccagcgccgctgttacaaatcttagcgtgacaggaacttctgacacaacttctaataataccgctaccgtcatcagcacagcacctccagcgtcctcagccgtcacaagcccgagtcttagtccgtccccatccgccagtgcatccaccagcgaggcttcctctgcgagcgaaaccagtaccacacaaaccacatctacaccattgtcatccccacttggcacctcacaagtgatggtgactgcaagtggcctccagactgccgcagccgcagcattgcagggagccgctcaactgccagcaaatgcaagcctcgccgctatggcagcagctgccggattaaacccttccctgatggcaccttcacaatttgcggctggaggcgctctactcagtctcaacccaggcacacttagcggtgctctgtctccagcgctgatgagcaatagcaccctggctactatacaggctctggccagcggtggttcactgcccatcacaagtctcgacgctaccggaaatctagtattcgcaaacgccggaggagccccaaacatcgtgaccgcccctctgttcctgaacccccagaacctctccttgctgacaagcaaccccgttagcctcgtttccgccgctgcggcaagcgctgggaactccgcaccggtagcatcactccatgccacttcaacatccgcagaatccatccagaatagcctgttcacggtagcaagcgcctctggtgctgctagtactactaccacggcttccaaggcccagtag

SEQ ID NO: 23930 - DNA, 1962 bp, Artificial Sequence
  Description of Artificial Sequence: Synthetic coding sequence
atgaacaatccatctgagacctccaaaccatcgatggaatccggcgacgggaatacaggaacgcaaacgaatggcctggatttccagaagcaacccgttccagtcggaggagccatcagtaccgcccaggcccaggcgttcctgggccacctccaccaggttcagttggcaggtacaagcctgcaggctgctgcccagtcattgaacgtgcagtccaagtcgaatgaagaatctggagattcacaacagccatcccagccatcacaacagccaagtgtgcaagccgcaattcctcaaactcagctcatgttagctggagggcagatcacaggactgacactgaccccagcccaacagcagctcctgcttcagcaagctcaggcccaggcgcagctgctcgcggctgccgtgcagcagcactcagccagtcagcagcattcagctgctggtgctactatctcagcctcagccgctacacccatgactcagattcccctcagccagccgattcagatcgcacaggacctccagcagctgcagcagttacagcagcagaacctgaatctccagcaattcgtgttggtgcacccaacaacaaatctacagcctgcccagtttatcatctctcagacgccccagggccagcaagggttgctgcaggcccaaaatttacttacccagctaccgcagcaaagtcaggcgaacctgctacagagccagcctagcattacattaacttctcagcccgcaacaccaaccagaactattgccgcaacccctatccagaccctcccccagagccagagcacccccaagcggatagataccccgagtctcgaggaaccctcagatcttgaggaacttgagcaatttgcaaagactttcaaacagcgcagaatcaaactcgggttcacacaaggcgacgtaggtcttgccatgggcaaactgtatggcaacgacttctcccagacaaccatatctagattcgaggccctgaacttgagtttcaaaaacatgtgtaaactgaaacctttgttggagaagtggcttaatgatgctgagaacttgtcctccgatagcagcctttcttcaccctcagccttaaatagcccaggtatcgaaggactctcaaggaggcgcaaaaaacgcactagtattgagacaaatatccgtgtggcgttggagaaatcattcctcgaaaaccaaaaacctacatccgaggaaattaccatgatcgccgaccagctgaacatggagaaggaggtgatcagagtttggttctgtaatcggaggcagaaggaaaagcgtataaaccccccttcctcgggcggtacgtcttcttcaccaatcaaggctatatttccgtcacctacctctctggtggcaacaaccccttccttggtaacaagcagcgccgctacgaccctgactgtgagccccgtgctacccttgacaagtgcagctgtcactaatttgagtgtcacaggcacatcagataccaccagcaataacaccgcaacagtgatctccacggccccacccgcttcttccgccgtgactagtcctagtctgtccccatcaccctccgccagcgcttctacctcagaggcttcctcagcaagcgagacaagcacgacgcagactacatctacccctctatccagcccgctcggaacttcacaggtcatggtgacggctagtggactgcaaacagccgcagccgcagccttgcagggcgctgcacagcttcctgccaacgcttcacttgctgccatggcggcagctgccggtctgaaccctagtctgatggctccaagtcagtttgctgcaggtggggcactcttatccctcaacccaggcacattgtcgggcgctctctctccagccctaatgagtaactctacactggccaccatccagggactactgcacgggctagaaaactttctaacaaaaaactag

SEQ ID NO: 23931 - DNA, 2112 bp, Artificial Sequence
  Description of Artificial Sequence: Synthetic coding sequence
atggcagacggcggagctgctagtcaggacgagtcttcagctgccgctgcagcggctgctgatagcaggatgaacaacccttcagaaacaagtaaaccatccatggagagcggggacggaaacacggggacacagacaaatggcctggactttcagaaacagcctgtgcctgttggcggagcaatctccacagcgcaagcccaggcatttctcggccatctgcaccaggttcagctcgccggaacctcactacaggctgctgcgcagtcccttaacgtacaatccaaatccaatgaggagtctggggactcccaacagccctcacagccgtctcagcagccatccgttcaggcagctattccgcagacacagcttatgctggctggcggtcagattacaggcgacctacagcaactgcagcagctccaacagcagaatttgaatctccagcaatttgtgctcgtccatcccacgacaaatcttcagccggctcagttcattatttctcagacccctcagggacagcaaggactgttgcaggctcagaatctgctgactcagctgccccaacagagccaggcaaaccttttacaaagtcagcctagcatcaccctaacatcccagcctgccacccccaccaggactatcgccgcaaccccgatacagacactgcctcagtcccaatctaccccgaagcggattgacactcctagcttggaagagcctagcgatctcgaggaattggaacaattcgcaaagacattcaaacagcgccgaattaagctggggttcacccaaggcgacgtgggcctggccatgggtaaattgtatggtaacgatttctcccagaccacaatcagcagatttgaggccttgaatctgtcctttaaaaacatgtgcaagctgaagccgctactggagaaatggctgaatgacgccgagaatctgtccagcgattcctcactgtcttcaccatctgctctcaactcccccggtatagagggactcagccgtcgcaggaaaaagcgtacgtcaatcgagactaatatcagggttgccctggagaaatcctttctcgagaaccagaagcccaccagcgaagagattaccatgatcgccgaccagctgaacatggagaaagaggtgatccgggtttggttttgtaaccgtagacagaaagaaaagcgaatcaatcctccatcctctggtgggaccagttcctcacctatcaaagccatcttcccatctcctacaagccttgtggccaccaccccatccctggttacaagtagcgccgctactacgcttaccgtgtctcctgtcctcccattgactagtgccgcagtaactaatttgagtgtgactggcaccagcgatacgacttccaataatactgcaacggtcatttccacagcccctcccgcttcttccgccgttacgagtcccagcttgtcccccagtccatccgccagcgcctctacatccgaggcttcaagtgcatcggagacctcaacgacgcagactacaagcacgccacttagtagcccactggggacttcccaggtcatggtgaccgcctctgggttgcagacagcagctgcagccgctctgcaaggcgctgcgcagctgccagccaacgcttcccttgctgccatggccgctgctgctgggctgaatccgagcttgatggcccctagccagtttgccgctggcggtgccctgctgtctttaaaccccggaacactgtccggggcactgtcacctgcccttatgtctaactcaacactggccacgatacaggcactcgcctccggcggaagccttcctattacaagtctggatgctactggcaatctggtctttgccaatgctggcggagccccaaatattgtcacagctccgctgtttcttaatccacagaacctgtcactcctgacctctaatcctgtatcattagttagcgctgctgctgcatccgctggcaactcagcgccagtggcctcactgcatgcgactagtacttcagcggagagcatccagaatagtctctttactgtagcttctgcatctggtgccgcttcaaccacaactaccgcttctaaggcccaatag

SEQ ID NO: 23932 - DNA, 279 bp, Artificial Sequence
  Description of Artificial Sequence: Synthetic coding sequence
atgaacaacccctctgagacctccaagccttccatggagtcaggggatggtaatacaggtactcagacgaacggcctggacttccagaagcagccagtccctgtgggaggggctatcagcaccgcccaggcacaggccttcctcggccacttacatcaggtccaactggcaggaaccagcctgcaggccgcagcccaaagcctcaacgtgcagagcaagagcaatgaggaatctggagactcccagcaaccaagtcagccctcccagcagccttcatag

SEQ ID NO: 23933 - DNA, 765 bp, Artificial Sequence
  Description of Artificial Sequence: Synthetic coding sequence
atgaataacccgtctgaaacatcaaaaccctccatggaatccggcgatggcaacacgggtacacagactaacggcctcgatttccagaaacagcctgtacccgttgggggagctatttctaccgcgcaagcccaagcctttttgggccatctccatcaagtacagctggcaggcacttccttacaagccgcagcccagagcctgaacgtgcagtccaagtccaacgaggaatcgggtgactcacaacaaccatctcagcctagtcagcagcctagtgtacaggccgctatcccgcagactcagctgatgctggctgggggtcagatcacaggcctgactttgacccctgcacagcagcagctactcctccaacaagcacaagcccaagcccagctgctcgcagctgcggtccagcagcactccgcaagtcaacagcacagtgctgccggagccacaatctccgccagcgctgccactccaatgacccaaatccctctttcacagcccattcaaatagcccaggatcttcaacagctccagcagctccaacagcagaacctgaacctccagcagtttgttctggttcaccctaccaccaatctgcagccagcccagtttatcatatcacaaactccccagggccagcagggcctcttacaggcccagaatctgctgactcaactaccccagcaaagtcaggctaacttactgcagtcacagccatcaatcaccttgacctcgcagatctggccaagccctgcatag

SEQ ID NO: 23934 - DNA, 342 bp, Artificial Sequence
  Description of Artificial Sequence: Synthetic coding sequence
atgaacaacccaagcgagacgtctaaaccttcaatggagagcggggacggtaatactggaacaggtaccgcagctggttgttgttctgcggcagcattacgtcagccggctgcccagtgctgctggtctcaccatttgcgtctttgctgccacgctcacgacgctgacccacccgtgagtgcgcatactgatcggacagggagtagcactacagctacggcatcaacagccgagagtcagcccgcaaccgtttgtgtcggcgcatctaaccaccagttcgccgcaagcgctgtatatcatttgactgacgcaccaggaccggcaggtagccctgccagttag

SEQ ID NO: 23935 - DNA, 2232 bp, Artificial Sequence
  Description of Artificial Sequence: Synthetic coding sequence
atgaacaatccttccgagacatctaaaccaagtatggagagtggcgatggcaatacaggcacccagacaaacggccttgatttccaaaagcaacccgtgcccgtgggcggagccatcagcaccgcccaggcccaggcatttctaggacacctgcaccaagtgcaacttgccggtactagtctgcaggcggctgcccaatcgctgaatgtgcaatcaaagtccaacgaagaatctggggacagccagcagccgagccagccgagtcaacagccctcagtccaggctgcaatcccccagacccagctaatgctcgccggaggacaaattactggtttgacacttacgcctgcccagcagcaactgcttctgcagcaggcccaggctcaagcacagctcttagcggctgctgtgcagcagcattctgcttctcagcaacactctgccgctggggctaccatttctgcgtccgccgcaacacccatgactcagatccctctgagccagcctatccagatagctcaggacctgcaacagctgcaacagttacagcagcagaatctgaacctgcagcaattcgtcctagttcatcctactacgaatcttcagccagcacagtttattataagccagacaccccagggacagcagggactgctccaggcgcagaacctgctgactcagctccctcagcaatcacaggcgaatctgctgcagagccagccatccatcaccctgacctcccagcccgcaacacctacacgcacaatcgccgctacacccatccagacactgccacagtcacagtctacgcctaagcgcatagacacgccttccctggaggagccaagcgatctggaggaactcgagcagtttgccaagacgttcaagcagaggaggatcaaactgggctttacacaaggcgatgtgggtcttgctatggggaaactctacggtaacgacttctcacagacaacaatcagtaggtttgaagccctaaatttgagctttaagaacatgtgcaaattaaagcccctactagagaaatggctgaatgacgcagaaaatttaagcagcgacagctctctgagctctcctagcgctctgaattctcctggaattgaaggtctgtctcggagacggaaaaagcgaacttcgatagaaactaatatccgagtcgccctggagaagtctttccttgagaaccaaaagccaacaagcgaggagatcaccatgatagccgatcagctgaacatggaaaaagaagtgattagagtctggttttgcaatcggcgtcagaaggaaaaacgaattaatcctccgagttctggcggaacatcttcgtctcctataaaggcgatcttccctagtcccaccagtcttgttgctactacccccagcttggtcacctcatcggctgctactacactcactgtatcccctgttctgccattaacatctgcggctgtcacgaacctttcagtgaccggtacaagcgacacaacctccaataacactgcgaccgtgatctctaccgcgcctcctgcctcctccgccgtcaccagtccaagtctgtcaccctcaccctcggcctccgcgagcacatctgaggcctcctccgctagtgagacttcgaccacccagacaacaagcacaccgttgagcagtccactggggacatctcaagtgatggtaactgcaagcgggctgcaaacggcagcagcggctgccctccaaggcgcagcccaactacccgctaatgcaagtctggctgccatggccgcagccgctgggttgaaccctagcctaatggcgccttctcaattcgctgcgggaggcgctctgctgtctttgaaccctggtaccctgtccggcgcacttagccctgctctcatgtctaacagcactctggctacaattcaggcccttgctagcggcggatccctcccgatcaccagcttggatgccactggtaatctggtgtttgcgaatgcagggggagctcctaacatcgtgacagcgcctctgttcttaaatccacagaacctgagcctgcttacctctaaccccgtgagtctcgtttccgccgctgctgcctccgcaggtaatagcgcacccgtcgcgtctctacatgcgaccagcacatccgctgaatccatacaaaactccttgttcaccgttgcctccgcgagcggcgcagcctcaaccacgaccacagcttctaaagcccaatag

SEQ ID NO: 23936 - DNA, 411 bp, Artificial Sequence
  Description of Artificial Sequence: Synthetic coding sequence
atgaataacccttctgagacttctaagccaagtatggagtcaggggacgggaacaccggaacccagaccaatggtctcgattttcagaagcagcccgtacctgttggtggagccatatccaccgcccaggcccaagcattcttgggacacctacaccaggttcagctggccggtacctccctgcaagccgctgctcaaagtctaaacgtccaatcaaagagtaatgaggaaagcggcgactcccaacaaccttcccaacctagccagcagccatcagttcaggctgctatccctcagacgcagttgatgttagcgggaggacagatcaccggcctcaccctgacacccgctcagcagcagctgctgctccaacaggcacaggctcaggcccagctgttagctgccgcttag

SEQ ID NO: 23937 - DNA, 1587 bp, Artificial Sequence
  Description of Artificial Sequence: Synthetic coding sequence
atggccgacgggggtgccgcatcccaggacgaatcgagcgctgctgcggctgccgctgccgactcccggatgaacaatcctagtgagacctcaaagccgtcaatggaatcaggcgacggaaatacagggacacagacaaacggattagactttcaaaaacaacctgtcccagtgggaggcgcaattagtacagcacaggcgcaggctttcctcggacatctgcatcaggtgcagttggccggaacctcattgcaggccgctgcccagtccctgaacgtgcagagcaaatccaacgaggagagtggtgatagccaacagccctcccagccctcccagcaacctagcgtgcaagctgccattccgcagacccaattgatgctggccggaggacaaattacaggtttgacattaacgccggcacagcagcaattactgttgcagcaggctcaggctcaggcccagctgttggcagcggctgtgcagcagcatagcgcttcccagcaacatagcgcagcgggagctacaatctcggcctcggccgctacaccaatgactcaaataccgcttagccagccaatccagatagcacaggacttacagcagctacagcagctccagcagcagaatctcaaccttcagcagttcgtgcttgttcatccgacaactaacctccagcccgctcagttcatcatcagccagactccccagggtcagcagggactgctccaggctcagaatctgctgacacaactgccccagcagtcacaagccaatttgctacagtcacagccctccatcacactcacaagccagcctgctactcccactaggaccatagcagccacccccatccagaccctgccacagagccagagcacaccaaagagaatcgatacacccagccttgaagaacccagtgacctggaagagctcgaacagtttgccaagaccttcaaacagcgacgaatcaaactgggattcacacaaggggacgtgggcctcgccatgggcaagctctacggaaatgatttctcccagacaacgattagtaggttcgaggctctgaacctcagcttcaaaaacatgtgtaagctgaaacccctgctggagaagtggctaaacgatgcagagaatctttccagtgattcatccttgtctagccccagtgctctgaattccccagggatcgaaggcctgagcagacgcaggaagaaacggacatctattgaaacgaacatccgagtcgcattggagaaatcttttctggagaaccagaagccgactagtgaagaaatcactatgatagcggaccaattgaatatggaaaaggaagtgataagagtctggttttgcaatcgaaggcaaaaggagaagagaattaatccaccctctagcgggggaacttccagctcacctattaaggctatttttccctctccaacaagcttggtagccacgaccccgtcccttgtgacatctagcgccgctaccaccctgacggtgtccccagtcctcccattgaccagcgccgcagtcaccaacctgagcgcccttcagacccctccccctacaacacagcagccttag

SEQ ID NO: 23938 - DNA, 165 bp, Artificial Sequence
  Description of Artificial Sequence: Synthetic coding sequence
atgaacaaccccagcgaaacgtctaagcctagtatggagtctggcgacgggaataccggaacccaaactaacggtctggactttcagaagcagccggtgccagtgggtggcgcaatatccaccgcccaggcgcaagccttcctggggcatctccaccaggtatag

SEQ ID NO: 23939 - DNA, 2268 bp, Artificial Sequence
  Description of Artificial Sequence: Synthetic coding sequence
atgctggattgctctgactacgtcctcgatagcaggatgaacaatccttctgagacgagcaagcctagcatggagtccggagacgggaatacagggacacagactaacggtctcgacttccagaagcaacccgtccctgtgggaggggcaatcagcactgcgcaggcacaggccttcctcggccatctacaccaagtgcaactggccggaaccagcctacaagccgcagcacaaagtttgaacgtccagagcaagtctaacgaagaatccggggacagccagcagccaagtcaaccttctcaacagcctagtgtgcaggccgctattccacagacccagcttatgctcgccggtggacagattactggccttactctgactcccgctcagcagcagcttctgttacaacaggctcaagcacaggcccagctccttgcagccgcagtgcaacagcatagtgccagccagcagcattccgctgcaggagcgacaatctccgcctcagccgcaacacccatgacgcagatcccactgtctcagccaattcagatcgcccaggacctccagcaattacagcaattacagcaacaaaatttgaatctgcagcagtttgtcctagtccatcctactacgaacctgcaacccgcacagtttataattagtcagacgccacaaggacagcagggactcctacaggcccagaacttgttgacgcagctaccccagcaatcacaggccaatctcctgcagagccagccatcaattacgttgacctcgcagcccgctactcctactaggactatagcagctacacccatccagaccctgccacaatctcagagtactccaaagcgaattgatacacctagcttagaagagccgagcgacttagaggaactggaacagtttgccaagacctttaaacagcgtcgcattaaactggggttcacccaaggcgatgtggggctcgcaatgggcaaactgtacggcaacgacttctctcagaccactattagccgctttgaggccctgaatctttcctttaagaacatgtgcaagctaaaacctctcctagagaagtggctcaacgacgccgagaatctaagctcagactccagcctgtcttccccgagcgctttgaattctccaggaattgagggcctgagcagacggcgaaaaaagcgcacctcaattgagactaatatacgtgtggccttggagaaatcattcctagaaaatcagaagcccaccagcgaggaaatcacaatgatcgccgaccagctcaatatggagaaggaagttatccgggtgtggttctgcaatcggagacagaaagagaagcgtatcaatcctccttcgtcaggaggcaccagctcaagcccgatcaaagccatttttcctagtccgactagcttggtggctaccaccccttccctggtcacctcctctgccgcaaccactctgaccgtgtcccccgttttacctctcactagcgccgcagtgactaacctttccgtgactggtacatcggatactacgagcaacaacaccgctaccgtgatttcaacagcaccccctgcctcctccgccgttacctctccttcgctgagtccttcaccctccgcgtcagcatctacttccgaggcatcttctgcgtccgagacctcaaccacccagaccacaagtactcctctctcatcacctctgggcacctctcaagtgatggtcaccgctagtgggctccagactgccgctgcagcggcactgcagggagccgcacaactgcccgctaacgcaagcctggcagcaatggccgcagcagccggattaaacccatctttgatggcaccttcacagttcgctgcagggggagctctcctttccctgaacccaggcactttgtcaggcgctctttccccagccctcatgagtaacagcactttagcaacaatccaagctctggcttccggtggcagcctcccaattacctccttggacgccaccggaaaccttgtgttcgcaaatgcagggggagcccctaatatcgtgacggctccccttttcctgaatccacagaatcttagcttgctaacgagtaaccccgtttcactggtaagcgccgctgccgcaagcgccggaaatagtgccccagtagcatcactgcacgccacaagtacctccgcggaaagtattcagaactcactgtttactgtggcttccgcgtccggggcagcttctacaaccaccacagccagtaaggcccaatag

SEQ ID NO: 23940 - DNA, 1230 bp, Artificial Sequence
  Description of Artificial Sequence: Synthetic coding sequence
atgatgatgatgagtctgaattcgaagcaggccttcagcatgcctcatggcggttccctccatgtagaacccaagtatagcgcactgcactctacgtcacccggaagcagtgcaccaatagccccttccgcgagctccccatcttctagttccaacgccggagggggtggcggaggaggagggggaggcggaggcggaggcggacgctcatctagtagcagctccagcggatctagtggcggaggagggtccgaggctatgagacgggcttgtttacccacacctccttctaatatattcgggggacttgatgagagcctgttggcacgagcggaggctttggccgctgtcgacatcgtcagccagagtaagtcgcatcaccaccacccccctcatcacagtcctttcaagcctgacgcgacctatcataccatgaatactatcccgtgtacgtcagcggcaagctcttcctctgttcctatctcccatcccagtgcactggcaggtactcaccaccatcaccatcatcaccatcatcatcatcaccagccgcatcaggccttagagggcgagctgttagaacatctgagcccgggattggccttgggagccatggctggtcccgatggcgcagtggtttccacacctgcacatgctcctcacatggccacaatgaacccaatgcatcaagcagctctgagcatggcacatgctcacggtctcccatcacacatggggtgcatgtctgacgttgacgcagatcctagagacctggaagctttcgctgaacgatttaaacagaggaggatcaagctgggcgtcacccaagccgatgtcggatctgctctggccaacctgaagataccaggagttgggagtctgtcccagtccactatctgccgttttgagtcgcttactctcagtcacaacaacatgatagctctgaaaccgattctgcaggcttggttggaagaagctgagaagtctcacagggagaagctgacaaagcctgagctgttcaacggtgccgagaaaaagcgtaagcggacgagcatagcagccccagagaaaagaagtctggaggcttacttcgccatccaaccccgaccatcctcagaaaaaatcgcagccatagctgagaagcttgacttaaagaagaacgttgtgcgcgtgtggttctgcaaccaaaggcaaaagcagaaaagaatgaagtacagtgccggaatttag

SEQ ID NO: 23941 - DNA, 906 bp, Artificial Sequence
  Description of Artificial Sequence: Synthetic coding sequence
atgcctggaataagcagccaaatcttgacaaacgcccaggggcaggtgatagggactcttccatgggtggtgaactcggcctctgtcgcagcccctgctccagcccagagcttgcaggtccaggcagttaccccacagctgctcctcaatgcccagggtcaagtaatcgctacgctcgcttccagtccattgccacctcccgtggctgttaggaagccaagtactcctgaatcccccgcaaaaagcgaagttcagccaatccagcctaccccgacagtgccccaacctgctgtggtgatcgcgagccccgctcccgcagcaaagccgtcagccagcgcaccaatccctattacatgttctgaaactcccactgtgagccagctggtgtctaaaccacacacgccatccctggatgaggacggcattaacttagaggagatcagggaatttgccaagaattttaaaatccgaaggctttctctcggtcttactcagacccaggtgggccaggctcttacagctacggagggccctgcatactcccagagcgcaatctgtaggttcgagaagttagatataacgcctaagtcggcccagaagcttaagccagtcctggagaagtggctaaacgaagccgaacttcgcaaccaagaagggcagcagaacctgatggaattcgtgggcggtgaacccagtaaaaaacgcaaacgcagaacatcttttaccccccaggctatcgaagcattgaacgcatacttcgaaaaaaatccactcccaaccggtcaagagattacggagatagcaaaagagctaaactatgatagagaggtggttagggtatggttttgcaatcggcgtcagacactaaaaaataccagcaagctgaatgtgttccagataccttag

SEQ ID NO: 23942 - DNA, 906 bp, Artificial Sequence
  Description of Artificial Sequence: Synthetic coding sequence
atgcctggaataagctcgcaaatcctgaccaatgcacagggccaggttattggtaccctcccttgggttgtgaactctgcttctgtggccgctcctgctccagcacagagcctgcaagtccaggcagtcactcctcagctgctgctgaacgcacagggacaggtgattgccacactggctagtagtcctctccccccaccagtggctgtccggaagccatctactccagagtctcccgctaaaagtgaggtccagcccatccagcctactccgacagttcctcagccagccgtcgtcatagcatccccagctcctgcagccaagccgagcgcatcagcccctattcccattacctgcagcgagaccccaactgtatcacagctggtgtctaagccacacacaccgagcctagacgaggatggcataaatctggaggagattagggaatttgctaagaactttaagattagaaggctcagcttaggtttgacccagacgcaggttggccaggccctgactgcaaccgaaggtccagcatatagtcagtctgctatctgcaggttcgaaaaattggatattacccccaagtctgctcagaagttaaagcccgtgttggagaagtggctcaatgaggcggaactgcggaaccaggagggccagcagaacctgatggagttcgttggcggagagccttccaaaaaaagaaagcgccgaacatcttttaccccccaggcaatcgaagctcttaacgcgtacttcgagaagaaccccctacctacgggacaagaaattaccgaaatagctaaggaactgaattacgaccgggaggtcgtgcgtgtgtggttctgcaatcggaggcagacccttaagaatacgtcgaaacttaacgtgtttcaaatcccttag

SEQ ID NO: 23943 - DNA, 90 bp, Artificial Sequence
  Description of Artificial Sequence: Synthetic coding sequence
atgcctggcatcagcagtcagatcttgacaaatgctcagggtcaggtcattggcacactcccgtgggtcgtgaattccgcctccgtatag

SEQ ID NO: 23944 - DNA, 906 bp, Artificial Sequence
  Description of Artificial Sequence: Synthetic coding sequence
atgccaggtatttctagccagatcttgacgaatgctcagggacaggtgataggcactctgccttgggtggtgaactcggcctccgtggcagcaccagcgccagctcagagcctgcaagtgcaggcagttacacctcaattactgctcaatgcccaagggcaagtcatcgctactcttgcttcatcaccgctgccacctcccgttgccgtccgcaaacccagtactccggaatctccggctaaaagtgaggtgcaaccaattcaaccgacccctaccgtgccccagcctgccgtcgtgattgcatcgcctgctccagcagccaagcctagcgcttctgctcctattcctatcacttgctctgaaacaccaacggtatcccagctggtgagtaaaccccatacccccagcctggacgaggacggtattaacctcgaggagataagggagttcgcaaaaaattttaagatccgcaggctgtctttaggcctcacacagacccaggttggccaagcactaacagctactgagggaccagcatactcccagtccgctatttgccgtttcgagaagctggatattactcccaagagcgctcagaagctcaaacctgtgctcgaaaaatggctgaatgaggcggagctcagaaatcaggagggtcagcagaatctgatggaattcgtgggcggtgagccaagcaagaaaaggaagaggcgcaccagctttaccccacaggcgatagaagcactgaatgcctatttcgagaagaacccattgcccactggtcaggagatcactgagattgccaaggaactgaactatgatcgcgaagtggtgcgggtctggttttgtaaccgcagacagacgctgaaaaacacatcaaaactgaacgtgttccagatcccgtag

SEQ ID NO: 23945 - DNA, 1020 bp, Artificial Sequence
  Description of Artificial Sequence: Synthetic coding sequence
atggctgctgcagcagctgcagccctggagtcatggcaggctgctgcaccgagaaagcgcagatctgctgccagacggcctcggagaagggaagccgcacctagaggaagggaggcagcccctaggggacgggaggccgctccccgtggcccagaagcagagtttgagtctgattctggagtggtattacggagaatctgggaggcagagaaagatttatttatatccgacttttggtccagtgcactagagaccataaacagatgtttgaccaagcacctagaacagctgaaggctcccgtgggcacgctctcagatatttttggcaacttgcacctcgactctttaccagaagaatccgacgtagccaccgactccatcccccgtgagatccttgtgactggaacttgtcatcttaagtgcgtgtgttatggtatcgggaattttgctacctgcattgtggctaggaaccagcttactttcttgctgttactgctggaaaagtgccagatccctcgaagccactgttgggtgtacgatccgctcttctcacaactggagattgaggtgttaaacactctcggagtgactgtgctcagcgaaaatgaagagggtaagaggagtattcgcggtgagccaacaatattttatatgctccattgtggcacagctttgtacaataacctactgtggagcaactggtctgtcgatgcccttagcaagatggtgattattggcaactcttttaagggactcgaggaacgcctcttggcacgcatcttacagaaaaactacccttacattgctaagatcctcaaaggattggaggaactcgagtttccccaaactagccaatatatggatatcttcaacgacacctctgtgcattggttccccgttcagaagttagaacaattaagtattgatatctgggagtttagagaagagccagattatcaggactgtgaagacctggaaatcattcggaacaaaagagaggacccttctgcgacggactag

SEQ ID NO: 23946 - DNA, 2064 bp, Artificial Sequence
  Description of Artificial Sequence: Synthetic coding sequence
atggaaagggtgaatgacgccagttgcggtccgtcaggctgctacacttaccaggtgtctcggcacagcaccgaaatgctacataaccttaaccagcaacgcaaaaacggaggccgtttttgcgacgtgctcttacgtgtcggagacgagagcttccccgctcaccgcgctgtgctagcggcatgttcggagtattttgaatccgtgttttctgcacagctcggggacggtggcgcagccgatgggggtcccgcagatgttggaggggcaactgccgctcctggcggtggtgcgggaggctcccgggagctggaaatgcacacaatttcgtcgaaggtattcggcgacattttggatttcgcatataccagtagaatcgtggtaagactagaaagtttccccgaactgatgacagcagccaaatttctgctgatgcgtagtgttattgaaatctgccaggaggtcattaagcagtctaacgttcaaatcttggtccccccagccagagccgatattatgctgttccggcctcctggcacttccgacctcggctttccactggacatgaccaacggggcagcactggctgccaattctaacggaatagcgggttccatgcagcccgaggaggaggccgctcgcgctgcaggcgcagcaatagccggacaggcctctctgcccgttctcccaggcgttgaccggctgccgatggttgcgggtcctctgagccctcagcttctcacatcccccttcccaagtgttgccagctccgcgcctccactgacggggaagaggggaagagggagaccgaggaaggctaacctcctcgactccatgttcgggagtccaggtggtttaagggaagccggaatcttgccttgcggactgtgtggcaaggtgtttacagacgctaacaggcttcggcagcacgaagcccagcatggcgtgacgagtctgcagcttggttatattgacctgccaccacctagactcggcgaaaacggactacctatctctgaggatcctgacgggccaagaaagcgatcacggacccgtaagcaggtcgcctgcgagatttgtggcaagatctttagggacgtgtatcacttaaatcgccataagctgtcgcattccggagaaaaaccatactcatgtcctgtctgcggcctacggttcaagcgtaaggaccgaatgtcttaccatgtgagatcccatgacgggtcggtaggtaaaccttatatctgccaaagttgcggcaagggctttagcagacctgatcatctgaatggacacattaagcaagtgcatacctcagagaggccccacaaatgccagacttgcaacgcctcctttgcgacaagggacaggctgcgctcacacctcgcctgccacgaagataaggtgccctgccaggtgtgcggaaaatacctacgcgcagcatacatggcagaccatttaaagaagcactccgaggggccttccaacttctgttccatttgcaataggggatttagcagcgccagttacctgaaggtgcatgtgaagacacaccatggggtgccactgccccaagtaagtcgacatcaggaaccgatccttaacggtggcgctgccttccactgcgctcgaacctatggaaataaagaggggcagaagtgttctcaccaggatccgatcgagtcaagtgacagttacggagatctgagcgacgcaagcgatctgaaaacccccgagaagcagtccgcgaacgggtcattctcctgtgacatggcggtgcctaagaataagatggaatctgatggggagaaaaagtatccttgcccagaatgcggtagcttttttagatcgaaatcatatttaaacaagcatatccaaaaagtccacgttagggctctgggtggcccactgggcgacctcgggccagctttgggcagccccttctcgccgcagcaaaatatgagtctattggaatctttcgggtttcagatcgtgcagtccgcattcgcttcttccctggtggatccagaggtcgatcagcagcctatgggaccagaaggcaagtag

SEQ ID NO: 23947 - DNA, 1926 bp, Artificial Sequence
  Description of Artificial Sequence: Synthetic coding sequence
atggagagggtgaacgatgcgagctgtggacccagcgggtgttacacataccaggtgagcagacactctaccgaaatgctgcacaacttgaatcagcaaaggaaaaacgggggacgattttgcgatgtccttttacgcgtaggggatgagagctttccagcacaccgggcagtactcgcggcttgctctgaatactttgagtcagtgttctccgcacagctgggggatggcggagcggcagacgggggtcccgctgatgtgggcggtgcaaccgctgcacccggtgggggagcgggaggttctagagagttggaaatgcataccatttcatcaaaagtattcggggatatcctggattttgcctatacctctaggattgtggttcgactggagagcttccctgaactcatgacagctgcgaagtttctgctgatgagaagcgtaattgagatatgccaggaagtgatcaaacaatctaatgtgcagatcctggtcccccctgcccgagctgatattatgctgttccgacctcccggtacctctgatctcggattcccattggatatgactaacggagccgcactggcggctaactctaacggcattgctgggtcaatgcaaccagaggaggaagcggcaagggctgccggtgctgccattgccggtcaagcgtccctccctgtcctccctggtgtagaccgactaccgatggttgccggtcctctgtcacctcagctattaacgtctcccttcccaagcgtcgctagctccgccccaccactcacaggcaaacgcggacgaggccgtcctaggaaggctaacctgctcgactcaatgtttggctcacccggtggcctgcgcgaagcaggaattctgccatgcgggctgtgcggtaaggtgttcactgatgccaacaggctgcggcagcatgaggcccagcatggggtaaccagcctgcagctgggatacattgacctgcctccgcctcggctaggcgagaacgggttgccaatctccgaggatccagacgggccacggaaaagaagtcggacccgtaagcaggtcgcgtgtgagatctgtgggaaaatctttcgggatgtttatcacctgaaccgccacaagctgagccatagcggggaaaaaccttactcatgccctgtctgcggactacgatttaaaagaaaggacagaatgagttatcacgtccggtcccacgatggttctgtgggaaaaccatacatttgtcagagttgtgggaagggtttttctcggccagatcatcttaacggtcacataaagcaggttcacacatctgagcgtccccataagtgccagacatgtaacgcaagcttcgccacgagggaccgcctgaggtcacaccttgcatgccacgaagataaggtcccctgccaggtgtgtggaaaatacctcagggccgcttatatggcggaccacctgaaaaaacactctgaggggccttcaaatttttgttccatctgtaatcgcgaaggtcagaagtgcagtcaccaggatccaattgagtcaagcgactcctatggcgacctgtccgacgcttcagatttgaaaacacccgagaagcagagcgctaacggctcctttagctgtgatatggcagtgccaaagaacaagatggagagtgatggcgagaagaagtatccctgccctgaatgtggaagctttttccgcagcaagtcttatcttaacaagcacatccagaaagtgcacgtgagggcgctgggaggtcccctcggagacctgggacctgccctgggcagccctttttccccacagcaaaatatgtccctgcttgagagcttcggcttccagatcgtgcagtctgcctttgcctccagcctggttgaccccgaggtggaccagcaacctatgggccctgaaggcaagtag

SEQ ID NO: 23948 - DNA, 1614 bp, Artificial Sequence
  Description of Artificial Sequence: Synthetic coding sequence
atggagcgggtgaacgacgcaagttgcggcccaagcggatgttacacttatcaggtctctcgtcactcaactgagatgctgcacaatctgaaccagcagaggaagaatggaggcaggttctgcgatgtcctgctgcgggtgggcgatgagtcattccctgctcaccgcgcagtcctggcggcttgctccgagtactttgagagtgtgttctctgcccagctgggagacggaggcgctgctgacggtgggcctgccgacgtagggggagcaaccgccgcacctggcggaggggcaggtggtagtcgggagctggagatgcacaccattagttctaaagtgttcggggacatcctggatttcgcctatacctcccggatagtggtgagactggagtcatttcccgagctgatgaccgccgctaaatttctgttgatgcgcagcgtgatagagatctgtcaagaagtgatcaagcagtctaacgtgcagatcctggtgccgcctgcaagggcagatataatgctttttagacctccaggcacatccgacctggggttccccctcgacatgacaaacggcgctgccctcgctgctaattctaacggcatcgccggttccatgcaacctgaggaagaggcagccagagcggcaggggcagcaatcgctggccaggcttccctgcctgtgcttcccggtgtagacaggcttccaatggtggcaggcccactgagccctcagctgctgacatcaccctttccatccgtggcctccagtgcacctcccttgacaggcaagcggggaagggggcgaccacgaaaagcaaaccttttggattctatgtttggttcccctggaggactgagggaggctgggatcttgccatgtggattatgcgggaaggttttcactgacgctaacaggctgaggcagcatgaggcccaacacggcgtgacaagcctgcagttgggatatatagaccttccgccaccaagactgggggaaaatgggctgccaatatctgaggatcctgatgggccacgaaagcggagtcggacacggaagcaggtcgcttgtgagatctgtggaaagatttttagggacgtctaccatctgaatcgacataagctctcccattcaggcgagaaaccttactcgtgtcccgtttgtggattgcggtttaaacgaaaggacaggatgtcataccatgtgcgttctcatgatggatccgttggcaagccatacatttgtcagtcatgcggcaaaggcttttcacgacctgaccatttgaatgggcatattaaacaggtccataccagcgagcgccctcacaaatgccagacctgtaacgcttcttttgctacccgagatcggctgagatcccacttggcctgtcatgaggacaaagtcccctgccaagtctgtggcaagtacttacgtgccgcttatatggccgatcacctgaaaaagcactccgaaggcccaagtaacttttgtagcatttgtaatcggggtcttcaggcccctggggctcatcctgaatggggcagttcagtgcccttacgtcaagacttgtggcagcagcgacgtccagaaatgctgaccagcggcagcgactag

SEQ ID NO: 23949 - DNA, 1104 bp, Artificial Sequence
  Description of Artificial Sequence: Synthetic coding sequence
atgatgggtagcgtgctgccagctgaagctctggtgctcaagactggactaaaggcccctggactggcgctggcggaagtgataacttcagacatcctgcattccttcctgtacgggcgatggaggaatgtgctgggagaacagctgtttgaggataagtctcatcatgcatcgcctaagacggcatttactgccgaggtcctcgcccaaagcttctcgggcgaggtgcagaaattatctagtttagtgctcccagctgaagtcattatcgctcagagcagcatcccaggcgaagggttaggcatcttcagcaaaacctggatcaaagccggtaccgagatgggacccttcacaggcagggttatcgctcccgagcacgttgacatatgcaaaaataataacctgatgtgggaggtgttcaatgaggacggtaccgtacggtacttcattgacgcctcacaagaggaccacaggtcttggatgacctacattaaatgtgcacgaaacgaacaggagcagaacttggaagtcgtgcagatcggtacctccatcttctataaagccatagaaatgataccgccagaccaggaactacttgtttggtacggcaatagccataacacatttcttggtattccaggggtgcccggactggaagaagaccaaaagaagaacaagcacgaagacttccacccggctgacagcgccgcaggtccagcgggaagaatgcgctgtgtcatttgccaccgcggattcaatagccgttccaaccttcgcagccacatgcgcatccatacactcgacaagccattcgtgtgcaggttctgcaatcgcagattctcacagtccagcaccctgaggaaccatgttaggctgcatacaggggagcgcccttacaaatgtcaggtgtgccagagtgcctactcccagcttgctggcttgcgggctcaccagaaaagcgccagacatcgccctccaagcactgcgttgcaggcccattcccctgccctccctgctccccatgctcatgcgcctgctctcgcggcagctgcagcagcagccgcagccgcagccgctcatcacttacctgccatggttctctag

SEQ ID NO: 23950 - DNA, 2154 bp, Artificial Sequence
  Description of Artificial Sequence: Synthetic coding sequence
atgcatggggcagcccgagcaccggcaacctccgtgtcggctgactgttgtatccccgcaggcctacggctgggacccgtacccggtacctttaagctcggaaaatacctctctgacagacgcgagcctggccctaaaaagaaagtactgacgattcagacaagtgcccaccaagttcggatggtccgcggagaactggtggacgaatccgggggttctcccctcgagtggatcggattgatacgcgcagccaggaactcacaagagcaaacgctggaggctattgcagacctgccgggtggacagatcttttacagggctctacgagacgtgcaacctggcgaggagcttaccgtctggtacagcaattcccttgcccagtggtttgatatcccaacaaccgccacacctacccacgacgaaaagggtgaggagcggtatatctgctggtattgttggcgcacttttagatacccaaatagcttgaaggcacacctgagattccattgtgtttttagtgggggaggcggaggcgcttttctgcaccacgaacacgccgcaaggcagggtgccgtccccgctgccgatgggctaggcttatcgcccaagcccccagccccagacttcgccgctccttcgcaggctggaacgttgaggccgcatcctctgggtccgccacctgtacaggcctgcggtgcacgagaaggtatcaagagagaggcttctagcgctccatctgcaacttcccctaccccgggaaagtgggggcagcccaaaaagggtaaggagcaactggatcgcgcactcgatatgagcggtgccgctcgcggtcaaggccatttcctcggcattgtgggtggcagcagcgcaggagttggctcgctggctttctaccctggggtgcggtcagctttcaaaccggcaggactggcccgagctgcagctgctgcccacggtgatccatatagggaagaaagctcatccaaacaaggagccggtctggcgctggggaggctgctgggtggaggcagagcgtgcggaaggcccggtagcggcgagaacagcgctgcagggggagctggccaccaccaccaccaccacgctcatcaccaccatcacccaaaatgcctgttggccggagatcccccaccccctccaccccctgggctgccctgctcgggggcactccgcggattccccctcctctccgtgccccctgaagaagcatcagcctttaaacacgtggagcgcgcaccacccgctgcagccgctctgcccggtgccagatacgctcaattgcctcccgctcctgggttgcctttggaacggtgtgcactgcctcccctggatcccggaggcctcaaagcttatcctgggggtgagtgtagccaccttcccgcagttatgccggcttttactgtctacaatggggagctgctgtacgggagccccgctactaccgcttactatccattgaagttacattttggcggactactgaaatatcccgagtccatcagttatttttccggacccgctgctgctgctctcagccccgctgagctcggaagcctagcttccatcgacagggagatagcgatgcacaatcaacagctctctgagatggctgctggaaagggcagagggaggctcgattccggtaccctaccgccagcagttgcggcagcgggagggacaggaggagggggatctgggggtagcggtgccggtaagcccaagacaggccacctgtgtctgtactgcggaaagttatattctcgcaaatacggacttaaaatacacatgcgcacccatactggctataaaccactcaagtgcaaggtgtgcctgcgccctttcggggacccttcaaatctaaacaagcacatcagactccatgcagagggaaacaccccctatcgctgcgaattttgcggaaaagtgcttgttcggcgaagagacctggagcgacatgttaagagccgccacccaggccagtcactcctggctaaggcaggcgatggacccggagctgagccaggctacccacctgagcccggagaccctaagagtgacgatagtgatgtggatgtctgtttcacagatgaccagtccgacccagaggttggaggcggtggggagcgcgacttatag

SEQ ID NO: 23951 - DNA, 2124 bp, Artificial Sequence
  Description of Artificial Sequence: Synthetic coding sequence
atgcacggggctgcacgggctccagcgacttctgtctcggcagactgctgcattcccgctggactgcggctgggcccagtgccgggtacattcaagcttggcaagtatctgagtgacagacgcgaacccggacccaagaagaaggttcgtatggtgagaggagaattggtcgatgagtcagggggatctccactggagtggatcgggctaattcgtgctgcacgaaatagtcaggagcagacccttgaagccatagctgacctccccggtggacagatcttttaccgagccttgcgggacgttcagcccggagaggagctaacagtgtggtacagcaattcactggcccagtggttcgatattccaacaaccgcgactccgacgcatgatgagaagggggaagaacgctacatctgttggtactgctggaggaccttcagatatcccaactcattgaaagcccacctaagatttcactgtgtttttagcggaggtggcggaggggcatttcttcatcacgagcatgcagccaggcaaggcgcagtgccagcggctgacggactgggcctgagcccaaagcccccagcacccgacttcgcagcgcctagtcaggctggaaccttgcggcctcacccattggggccaccacctgttcaagcatgcggcgcaagagaggggattaagagagaagccagtagcgccccatccgccacttcccctacacctgggaagtggggccagcccaagaagggcaaggagcaattggacagagctctagacatgtctggggcagccaggggccaggggcacttccttgggatcgtgggaggatccagtgccggagtaggaagtctggcattttatcccggagtgcggtctgcctttaaaccagccggtttagcaagggcagcggcagctgctcatggggacccctatcgagaagagtcctcaagcaagcagggagccggactcgcgctggggcgtctgctcgggggtggtcgcgcatgcggcagacccggttctggagaaaacagtgctgctggaggcgctggtcaccatcatcaccaccatgcccatcaccaccaccatcccaagtgcctgctggcgggtgacccaccaccgcctcccccaccaggcctaccttgctcaggagcactgagaggcttccccttactgtctgttccaccagaggaggctagcgcttttaagcacgtggaacgagcacctcctgccgctgcggcactgcctggtgctcgctacgcacaacttcctcctgccccagggctccctctggaaaggtgtgctttgcccccactggacccgggaggccttaaggcttaccctggcggagagtgttcccatttaccagccgtcatgccggctttcacagtctataatggagaactgctctatggcagtcccgctaccactgcctactaccctcttaagttacatttcgggggtctattaaagtaccctgagagcatatcttatttctctggccctgcggcagcagctttgagtcctgcggaattaggcagtctggcatctatcgaccgggagatcgccatgcataatcagcagctgtcggaaatggctgccggtaaaggacgtgggagactggatagcggtacattaccacctgctgtcgccgcagcagggggaacgggcggaggtggttccggcggaagcggcgcaggcaagcccaagacaggacacctgtgcctgtactgcgggaagctctatagccggaaatatggactcaaaatacacatgcgcactcacacaggttacaagcccttgaaatgtaaagtgtgcctacgcccattcggggacccgtcgaatctgaataaacacatccgtctacatgccgagggaaacacgccataccgctgtgagttctgcggcaaggtcctagtccggcgacgcgacctggagcgacacgtcaagagccgtcatcccggacagtctttactggctaaagcaggtgacggtccaggagcggaacctggctatccaccagagccaggggatccaaaatcagacgactccgatgtggatgtttgtttcaccgacgatcagagcgatcctgaagtcgggggtggcggagagcgcgatctgtag

SEQ ID NO: 23952 - DNA, 4524 bp, Artificial Sequence
  Description of Artificial Sequence: Synthetic coding sequence
atgcctagaagacgtccgccagcgagcggagctgcacaattcccagagcgtatcgcaacgcgatctcccgacccgattcccctttgtacatttcagcgccagcccagagccgcacccgtgcagccaccctgtaggctattcttcgttacatttgcgggatgcggccacagatggagatccgaaagcaaacccggttggatctcaaggtccaggtctggaatcgcccttcgcgcagcccgacccccaggatctagcccccctagacccgctgcacccaggccaccccctcccggtggggttgtcgccgaggctcctggagacgtcgtgattcccagacctagggttcagcccatgcgcgtggccaggggcggaccatggacacccaaccccgcattccgagaggctgaatcgtggtctcaaattggcaaccaacgtgtttctgaacagcttctggagactagtttggggaacgaggtgagcgacacggagcctctgtctcccgcttccgccggactccgccgaaaccctgccctgccccctgggccttttgcccaaaacttcagctgggggaaccaggagaacctgccaccagcactggggaaaatagccaatggcggtggcaccggtgcaggcaaagcagagtgtggctatgagaccgagagtcatcttctggagccgcatgagatcccgctcaatgtgaacacccataagttctctgactgcgaatttccttatgagttctgcaccgtatgcttttcaccctttaaactcctgggaatgagcggtgttgagggcgtctggaaccagcacagcagatctgcttcaatgcacacattccttaatcactctgctaccggtattcgggaggcaggctgtcgaaaagacatgcctgttagcgaaatggccgaggatggtagcgaggaaatcatgtttatttggtgtgaggactgttctcagtatcacgatagtgagtgcccggagctgggccctgtcgtgatggtgaaggactcattcgtgctctctcgcgctcggagctggcctgcaagcggccacgtgcatacacaagctggacagggcatgcgcggatacgaagatagggatcgagctgatccacaacagctcccggaggcggtccccgctggcctggtcagaagactcagcgggcaacaattgccttgtaggtccacattgacatgggggagactgtgccaccttgtagctcagggcagaagctctctgccgccaaatcttgagattcgtagacttgaagacggggcagagggagtattcgccatcacccaattagtcaagagaacccagtttgggccttttgaaagccgacgcgttgccaagtgggaaaaagaatcagcctttcctctgaaagtattccagaaggatggccaccccgtctgctttgacacaagtaacgaagacgactgtaactggatgatgctggtgagacccgctgccgaagccgagcaccagaatctaacagcttaccaacacggatccgatgtctacttcacgacctctagggacatccctcccggtacagaacttagagtgtggtatgctgccttttacgccaagaaaatggacaagcccatgctaaaacaggctggatctggcgttcatgctgcaggtactcccgagaactctgcacccgttgagagcgagccctcccagtgggcatgcaaggtgtgttctgcgacttttctggaactgcagctgctgaatgagcaccttctgggacatctggagcaggcaaagtcgctacccccaggaagccagtctgaagcagcggctccggagaaagaacaagacaccccacggggtgaacctcctgctgtccccgaatccgagaatgtcgctacaaaagagcagaagaagaaacctcgcagaggcaggaagcctaaggtgagcaaggccgagcaacccctggttatcgtcgaagacaaggaaccaactgagcaggtagctgaaattattacggaagttccacccgatgagcccgtgtcagctacaccagacgagagaattatggagcttgtactgggcaagttggccacgacgacaaccgatacatcctcagtacctaagtttacccatcaccaaaacaacaccattacattaaagcgctcactcatcctgtcctctcgccatggcatccgtaggaagttaattaaacaactcggagaacataagagagtttatcagtgtaacatttgttctaagattttccaaaattcatccaacctgagtcgacatgtgagatcacatggtgataagctgttcaagtgcgaggaatgcgcgaaacttttttccagaaaagagagcttaaagcagcacgtgagttacaaacactccaggaatgaagtcgatggggaataccgttaccgatgtggtacctgcgaaaagacgtttagaatagaaagcgccctagaattccataattgccggactgacgacaagacctttcaatgtgagatgtgttttcgcttcttttctacaaattccaacctgtcgaagcataagaaaaagcatggggacaaaaagtttgcctgcgaggtatgttctaaaatgttttacagaaaggacgtaatgctcgaccatcagcgccgtcatctagaaggggtgaggagagttaagcgggaagacctggaggctggcggagagaaccttgttcgatataagaaggagcccagcggctgccccgtatgcggaaaagtgttctcgtgtcgcagcaacatgaacaagcatctactgactcatggtgataagaaatacacttgtgagatctgtggccgaaagttctttagggtggatgtgctacgtgatcacatacatgtacactttaaagatatcgccctgatggacgaccaccagagggaggagtttattgggaagattggcatctcatcagaagagaacgatgacaactccgacgaatcagctgacagcgagccccacaaatatagctgcaagaggtgtcagttgacattcggtcggggaaaagagtatctgaagcatatcatggaagtgcataaagagaaaggctatggctgcagtatctgtaatcggcgattcgccttaaaagcaacctatcatgcccatatggtcattcatcgggagaacttgccggacccgaacgtgcagaaatatatccacccctgtgagatatgtggccgtattttcaacagcataggcaacctggagagacacaaattaatccacactggggtaaagtctcacgcttgcgagcaatgcggtaaaagttttgctaggaaggatatgctaaaggagcatatgcgggttcacgacaacgtgagggaatatctatgcgccgaatgcggcaaggggatgaagaccaaacacgcactaaggcaccatatgaaactgcacaaaggaattaaagagtacgagtgcaaagaatgtcacaggcgattcgctcaaaaagtcaacatgctcaaacattgcaaaaggcacacagggattaaagatttcatgtgcgaactttgcggcaagacatttagcgagcggaacacaatggagacccataaactaatccataccgtgggaaagcagtggacttgtagtgtctgcgacaagaaatacgtcactgagtacatgctccaaaagcacgtacagcttactcacgataaggttgaggcacagagttgccaattgtgtggtacgaaggtgagtactcgcgcatccatgagcaggcacatgagacggaagcatccggaagtgctggctgtgcgcatcgacgatctcgatcacctgcccgaaaccacaaccatagatgcctcatccataggcatagttcagccagagctgacgctcgagcaggaagatctggctgagggcaaacacggaaaagcagcaaaacgatcccacaagcggaaacagaagcccgaagaggaggccggagccccagtgccggaggacgctacattttctgaatacagcgagaaggagactgagtttactggatcagtaggagatgagacgaactctgccgtccagtcaatacagcaagtggtggtaactttgggggatccaaatgttaccaccccgtcaagtagtgtcggcctgactaacatcaccgtgaccccaataaccaccgcagcggctacacagtttacaaacctccagcctgtcgcggtgggtcatctgaccactccggaaagacaactgcagttggacaactcaattctcacggtaacgttcgacactgtgtccgggtcagccatgcttcacaatcgccagaatgacgttcagatccatcctcagcccgaggcctccaatcctcaatccgttgcccacttcatcaatctaacgactctggtgaacagcataactccactagggtcccagttgtccgatcaacaccctctgacgtggcgcgcagtgccgcagaccgacgtcttgcctcccagccaaccacaagccccaccgcaacaggctgctcagcctcaggtccaggccgagcagcagcagcagcagatgtattcatattag

SEQ ID NO: 23953 - DNA, 1557 bp, Artificial Sequence
  Description of Artificial Sequence: Synthetic coding sequence
atggccgaggatgggtccgaggaaatcatgtttatttggtgcgaggactgtagccagtatcatgactctgagtgtcccgagctgggtcccgtggtaatggttaaagattccttcgttctgtcacgcgctagatcctccctcccacctaatttagagatacggaggcttgaagacggggcagaaggggtgttcgctatcactcagttggtcaaaaggacacagtttggccctttcgagtctagaagagtggccaagtgggaaaaagagtccgcctttcccctgaaggtatttcaaaaagacgggcaccccgtgtgcttcgacacaagcaatgaggacgactgcaactggatgatgttggtgagacctgccgcagaggctgaacaccagaatctcacagcttatcaacatgggtccgatgtttactttaccacaagccgagacattccccctggcacagagttgagggtttggtatgctgcgttttatgccaagaaaatggacaagcccatgctgaagcaagccggaagcggagtgcacgccgcaggaacccccgagaacagcgcacccgtagaatctgagccttcacagtgggcctgtaaggtgtgttcagcaaccttcctggagctgcagctgctgaatgagcatctgctcggacatctggaacaggcaaaaagcctgccccctggaagtcaaagtgaggctgccgctccagaaaaggagcaggacacccctcgtggcgagccaccagctgtgccggagtcagagaatgtggcgactaaggaacaaaagaaaaaaccacggaggggacggaaacccaaggtctccaaagctgaacagcccctggtcatcgtcgaagacaaggaacctacggagcaggtcgctgagataatcaccgaggtgccaccggatgagccagtgagcgctacccctgacgaacgaattatggagcttgtgctggggaagctagccaccactacaactgacaccagttccgtgcccaagtttactcaccaccagaataatacaatcaccttaaagaggagccttatactgtcatcccgtcacggtatcaggagaaaattgatcaaacaacttggcgaacacaagcgcgtttatcagtgcaacatatgtagcaaaatttttcagaattcgtccaatctttctaggcacgtacgttcacacggagataaattgttcaagtgtgaggagtgtgcgaagctcttcagtaggaaggagagcttgaagcaacatgtgagctacaaacacagccggaacgaggtagatggtgaataccgctaccgatgcggcacatgcgaaaaaactttccggatcgaatccgccctcgaattccacaactgtcgaactggcctgatcgcccaccccggagagggaggcccaggaggaagtaggctgcgagatctgccggctacaagtcctagcaccaggcgttcgaccgccacgagatccctccctgttcgctcagcagctcggtgctcaaccgcaaggacatcatgctggacgacatccgccggaacctggaagacatgcgcggcttag

SEQ ID NO: 23954 - DNA, 3537 bp, Artificial Sequence
  Description of Artificial Sequence: Synthetic coding sequence
atgccccgtaggcgaccaccagcatccggtgctgctcagttcccagagcgcattgcgaccagatcccctgaccccatccccctgtgtaccttccagagacaggttagcgagatggccgaggacggatcagaagagatcatgtttatttggtgtgaagactgctcccagtatcacgacagcgaatgccccgagctgggccctgtggtcatggttaaggactccttcgtgctcagtagggctcgaagtagcctgcccccaaacttagagattcggaggctggaagacggtgcagaaggggtcttcgcaattacacagctcgttaaacggacccagtttgggccatttgagtcacggagagtggccaaatgggagaaggaatctgccttccccctgaaagtgttccagaaagacgggcatcctgtttgttttgacacctctaatgaagacgattgcaactggatgatgctcgtcaggcctgccgcagaagccgaacatcaaaacctcaccgcctatcaacacggctccgacgtgtactttaccaccagtagagatatcccacctggaaccgagcttcgcgtctggtatgccgcattctacgctaagaaaatggacaagcctatgctcaagcaggccggaagtggcgtgcatgcggctggaactccagagaatagtgcacctgtggagagcgagcctagccaatgggcctgcaaagtgtgctcagccacgttcctggagctgcagctactgaatgagcatctactgggtcatttggaacaagcgaagtctttgccacccggaagtcagagtgaggccgctgcacccgagaaggagcaggacactccaagaggtgaaccccctgctgtccccgagtcggaaaacgtagcaaccaaggaacagaaaaaaaagcccagacgcggaaggaagccgaaggtgagcaaagcggagcagcccctcgtcattgtcgaggataaagagccaacggagcaggttgcagaaataataacagaggtccccccagacgagcccgtctccgctacaccagatgaaagaatcatggaactagtgctgggcaagttggccaccacaaccactgatacgtcctcagtcccaaaattcactcaccaccagaataataccatcaccctcaagcgctctttgatcctctccagtcggcacggaattagacggaagttgattaaacagctgggcgagcataagcgagtctaccaatgtaatatttgttccaaaattttccagaatagcagcaacctgagcaggcacgtgaggtctcacggggataaactgtttaagtgtgaggaatgtgccaagctctttagccgcaaagaaagcctcaaacagcacgtgagctataaacactcacggaacgaggttgatggagagtatcggtaccgttgcggaacttgcgaaaagaccttcagaattgagagtgctctggagttccacaactgtaggaccgatgacaaaaccttccaatgcgagatgtgctttcgtttttttagcacgaactcaaacctgagcaaacataaaaaaaaacacggcgacaaaaagttcgcctgtgaggtgtgctctaagatgttctacaggaaggatgtgatgttagatcaccagagaagacatttagagggagtacgcagggtgaagcgggaggatttagaggctgggggagagaatttggtgagatataagaaggagccgtccggctgtccagtttgtggcaaagtcttctcttgtcgcagtaatatgaacaaacatctgctgacccacggcgacaaaaaatatacttgcgagatctgtggtaggaaattctttcgagtagacgtgctcagagatcatattcacgttcattttaaggatatcgccctgatggatgaccatcagcgcgaagagtttatcgggaaaataggaatttcaagcgaggaaaacgacgacaatagtgatgaaagcgcagactcagagccacacaaatattcatgtaagcggtgtcagttgaccttcggcaggggcaaagagtatctgaaacacataatggaagtgcataaagagaaaggttacggctgtagcatttgtaaccggaggttcgcgctgaaggccacctaccacgcccacatggtcatacaccgggagaacctgccagaccctaacgttcagaaatatatacatccatgtgagatctgtggtagaatcttcaacagcattggtaacctcgagcggcataaactgatccataccggtgtgaagtcccacgcctgcgagcagtgcggtaagagcttcgctcggaaagatatgctgaaggagcacatgagagtgcatgataatgttagagagtatctctgtgctgagtgtgggaagggaatgaaaaccaagcacgcactccgacatcacatgaagcttcataaaggtattaaagagtatgagtgcaaggaatgccatcgtcggtttgcgcagaaggtcaatatgctgaagcattgcaagcgccacacgggcataaaggatttcatgtgcgaactgtgtggtaagacatttagcgaacggaacaccatggaaacacataagctgatccacacagtgggaaaacaatggacctgttctgtttgcgataaaaagtacgtcaccgagtacatgctgcagaagcacgtacagttgacccatgataaggtggaagcacaatcctgccagctctgcggcactaaggtgtcaaccagggccagcatgtctcggcacatgcgaagaaagcacccagaggtgctggctgtaagaattgacgatttagatcacctgccagaaacaacaaccattgacgctagctccataggcatcgttcagcctgaactgaccctggagcaagaggatctcgccgaaggcaaacacgggaaagccgcaaagcggtcacataagcggaagcaaaagccggaggaggaagcaggcgctcccgttcccgaggatgcaacgtttagcgagtattcagagaaggaaacagaattcaccggaagtgtgggggacgaaactaacagtgccgtgcagagcattcagcaggttgtggtcaccttgggcgatccgaatgtgacaacgccctcttcttccgtgggtctgactaatattaccgtaacccccatcactacggcagccgctactcaatttaccaacttgcagcctgtcgcagtgggccatctaaccacaccggagaggcaactccagctggacaactccatattgactgtgacattcgatacagtgtctgggtcggctatgctgcataacaggcaaaacgacgtgcagattcatccccagccagaagccagcaacccgcagtccgtggcgcactttattaacctgaccaccctggtgaatagcattacacctctgggaagtcagcttagtgatcagcatcccctgacatggcgcgcagtgccccaaaccgacgtgttgccgccttcacaaccccaagccccacctcagcaggcggcacagccacaggtccaagccgaacaacagcagcagcagatgtattcttattag

SEQ ID NO: 23955 - DNA, 4524 bp, Artificial Sequence
  Description of Artificial Sequence: Synthetic coding sequence
atgccccgaagaagaccacccgcatcgggagccgcacagttccccgagcggatcgctacgcggagtcctgaccctatacctctttgcaccttccaaaggcagcctcgcgctgcccctgtgcaaccgccatgtagattgttcttcgtcacatttgctggctgtggccaccgatggcgctctgagtccaaacccggatggatttcccgatcaaggagcggaattgccttgcgagctgctcggcctcctgggtctagtccacccaggcctgcagctccaaggcctccacctcctggaggcgtcgtcgcggaagcccctggagatgtcgtaatcccccgtcccagagttcagcccatgcgtgtggcacggggtggtccctggaccccaaatccagcttttcgcgaggcggaatcttggagtcagatcgggaaccagcgcgtgtctgaacaactgctggagacatcgttaggcaacgaagtctctgacacagaacccctttccccggcttccgctggactgcgccgtaaccctgcattgccaccaggaccatttgctcagaacttcagctggggtaatcaggaaaatttgcctccggctttggggaagattgccaatggcggagggaccggcgctgggaaagctgagtgcggatatgagactgagagtcacctacttgagccccacgaaatccctctgaacgttaatacccacaagttctccgactgcgagttcccctacgaattctgcacagtgtgtttctctccttttaagttgctaggaatgagtggagtggaaggcgtgtggaatcagcactctcggtcggctagcatgcacaccttcctgaaccactccgccacggggatccgagaagctggttgccgcaaagatatgcctgtgtccgagatggccgaggacggcagcgaggaaatcatgtttatttggtgtgaggattgtagccagtaccatgattcagagtgcccggaactcggcccagtagtgatggtgaaggacagctttgtgttatcaagagctaggtcatggcccgctagtgggcacgtccatacccaggctgggcagggcatgcgaggatatgaggatagagaccgcgctgatccccagcagctgccggaggccgttcccgcaggcctcgtcaggcgcctctcaggtcaacagctgccctgtaggtccactctgacatgggggcgactttgtcacttggtcgcgcagggcagaagttcactgcctcctaacctcgagattaggagattggaggatggcgcagaaggggtatttgcaatcacgcagctggtgaaacgcacccagttcgggccattcgagagcagacgcgttgcaaaatgggaaaaggagagtgccttccccttaaaagtcttccagaaagacggccatcccgtgtgcttcgacacgtctaatgaggacgattgtaattggatgatgttggtgaggcccgctgctgaggccgagcatcagaacctaacagcctatcaacatggctccgacgtgtatttcaccacttctcgcgacatcccacccggaacagaattgagggtctggtatgcagctttctacgcaaagaaaatggataagccaatgctgaagcaggcgggatctggagtgcatgccgctggcacaccagaaaactccgcgccagtagagagcgagccatctcaatgggcctgcaaggtctgttccgccacctttctagagctgcagctgctgaacgaacatctgctaggccatttggagcaggcgaagagtctgccaccaggatcccagtcggaggcagccgctcccgagaaagaacaagacacacctagaggagagccgccagccgtccctgagtccgagaatgtcgcaacaaaagagcagaagaaaaaacctaggcggggacggaagccgaaggtgagcaaagcagagcagccgcttgttatcgtggaagataaggaacccaccgaacaggttgccgagatcataacggaggtcccaccagacgagccagtgtccgctacacccgatgagcgcattatggagctcgtgctcggcaagctggccacgaccaccaccgacacatccagcgtgcccaaattcacccatcatcagaacaataccataacgctcaagagatcactgatcctgtcttcgaggcacggcattagacggaagctgatcaaacagcttggggagcataaacgagtgtaccaatgcaacatttgcagcaaaatttttcagaacagctcaaatctctcacggcatgtcaggtcacatggagataagctatttaaatgtgaggaatgcgccaagttattcagcaggaaagaatctttgaagcagcatgttagttacaagcactccaggaatgaggtcgatggggagtataggtacaggtgcggcacttgtgagaagacatttcgtatcgaatctgcacttgagtttcataattgtaggactgacgacaaaacgtttcaatgcgaaatgtgcttccgattcttttccaccaattctaacctgtccaaacacaaaaaaaagcacggcgataaaaaatttgcgtgtgaagtttgtagtaaaatgttttaccgaaaggatgtgatgcttgatcaccagagacgtcacctggagggcgtgcgacgcgtcaaaagggaggaccttgaggccggaggcgagaatttagtgaggtataaaaaagagccatccggatgtcctgtgtgcggcaaagtcttctcatgtcggtcaaatatgaataagcacctcctgacacatggcgataagaaatatacctgtgagatctgcgggagaaaatttttccgagtcgatgtgctacgagatcacattcacgtccattttaaggacatcgccctaatggacgaccaccaacgtgaggaatttatcggcaaaataggaatctcaagtgaggagaacgatgataactctgatgagtcagccgactctgaaccccataagtactcatgcaaaagatgtcagcttaccttcggaaggggaaaggagtacttaaagcacattatggaggtgcacaaggagaaaggatacggttgctccatctgcaatcgtagattcgcgctgaaggccacctatcatgctcacatggtgatacacagggaaaatctacccgaccctaacgtgcagaagtatattcacccctgcgagatttgcggcaggattttcaacagcatcggaaatctcgagagacataagctaattcacacaggcgtgaaatcccacgcttgcgagcagtgtggtaagtcgttcgcacgaaaggacatgctgaaagaacacatgcgcgttcacgacaatgtgcgtgaatatttgtgtgccgagtgtggaaagggcatgaaaacaaaacacgcgttacggcatcacatgaagctgcataagggtattaaggaatatgaatgcaaggagtgccaccgccgttttgctcagaaagtcaacatgcttaagcactgcaagcgtcacaccggcataaaagattttatgtgcgagttatgcggaaaaacgttttccgaaagaaataccatggaaacccataaactgattcacactgtcggaaaacagtggacctgcagcgtgtgcgataagaaatacgtgacggaatatatgctgcagaagcacgttcaactcacacatgacaaagtcgaagcccagtcctgccagctctgcgggaccaaggtgtcgacccgcgctagcatgtctaggcacatgcgcagaaaacatcccgaagtcttagctgtcagaatcgatgatcttgatcacctccctgagacgacaaccattgatgcaagttcaatcggtatcgttcagcccgaactgaccctggagcaggaggacctggcagagggcaagcacggcaaggccgctaagcgctcccacaaacgaaagcagaagccagaggaggaagccggagctccggtccctgaggatgctacattcagcgagtactcagagaaggaaactgagtttactggctctgtcggggatgagactaattcggcggtgcagtccatacagcaggttgttgtgaccctgggcgacccgaacgttacaaccccttcttcaagcgtcgggttgacgaacattacagtgactccgataacaactgcggcagctacacagtttacaaacttgcagccagtggctgtggggcaccttaccacaccagaaagacaactgcagctggacaactccatcttgacggtaacattcgacactgtctctggaagcgccatgttgcacaaccgacagaacgacgtgcagatacacccgcagcccgaagcctcaaaccctcagtctgtcgcccactttataaatctgacaaccttagtcaacagtattacccccctcggatcccagttgtcagatcaacatccactgacgtggcgggcagtccctcagaccgacgtgctgccaccatctcagcctcaggcacccccacagcaggccgctcagccacaggtacaagccgagcagcagcagcaacaaatgtatagctattag

SEQ ID NO: 23956 - DNA, 1437 bp, Artificial Sequence
  Description of Artificial Sequence: Synthetic coding sequence
atggctgaagatgggtccgaagagattatgtttatctggtgcgaagattgcagccagtaccatgattcagagtgtcctgagctagggcctgtggtgatggtgaaagactccttcgtcttgtcccgggctagatctagcctgccccctaacctggaaataagacggttggaagatggtgcggagggagtattcgctattacacagctcgttaaacgaactcagttcggaccatttgagtccaggagagttgccaagtgggaaaaggaaagtgcatttcctttgaaggtcttccaaaaggatggccatcccgtttgcttcgacacctcaaacgaggatgactgcaattggatgatgctggttaggccggcagcagaagcagagcaccaaaacctcacggcctaccagcacggatccgacgtatactttactacatccagggacatccccccaggtaccgagttgcgtgtgtggtacgccgctttctacgcaaagaaaatggataaacctatgctcaagcaggccggaagcggcgtgcatgccgctggcactccggagaactcagcacccgttgaatcggaaccaagtcagtgggcatgcaaggtttgttcggcaacattcttggaactgcaacttttgaacgagcatttactcggtcacttggaacaggccaagagcctccccccaggatcccagtccgaggcagcagccccagaaaaagaacaggacactccacgcggtgaacccccagcggtgcctgaaagcgagaatgtggcaacaaaagagcaaaaaaaaaagccccgaaggggaagaaaacctaaagtgtcaaaggccgaacagcctcttgtgattgtcgaagataaggagccaactgagcaggtcgcagaaattatcactgaagtccctcctgacgagcccgtatctgcaactccggacgaacgaatcatggaactcgtcctggggaagttagcaaccaccacgacagatacctcctcagtccctaagcatggaattcgtcgtaagcttattaaacagcttggggaacacaaacgagtgtatcaatgcaacatctgctcaaaaatattccagaattcctcaaacttgtcacgtcacgtgcgtagtcacggggacaagttatttaagtgtgaggagtgcgctaaattgttctctcggaaggagtctctcaagcagcatgtgtcttataagcacagccggaatgaggttgacggggagtaccgataccggtgcggtacctgcgaaaaaacatttagaatcgagtccgcgctggaattccataactgccgcaccgccaccagtccctcaacgagacgctctaccgccacgcggtcactccctgtccggtccgctgccaggtgttccacagccaggacatcatgttggaccacatccgccggaacgtggaaagagtgtggtgaatag

SEQ ID NO: 23957 - DNA, 3426 bp, Artificial Sequence
  Description of Artificial Sequence: Synthetic coding sequence
atggcagaggacggaagcgaagaaataatgtttatctggtgcgaggattgtagtcaatatcacgacagcgagtgccccgaactgggtcctgtggtgatggtgaaggactccttcgtgctgtctcgggctcggtccagcctgccccctaacctggaaatcagacggctcgaagatggggctgagggcgtttttgcaatcacccagttagtcaagcgcacacagttcgggccattcgagtcaaggcgagttgcaaagtgggagaaagagtccgcatttccactgaaagtgttccagaaggacgggcatccagtgtgtttcgataccagcaacgaagatgactgcaactggatgatgctcgtgcgccctgccgctgaggcagagcaccagaacctgacagcctatcagcacggctcggatgtgtactttaccacaagtagggatatcccccctgggaccgagctgcgggtgtggtacgcagcattctacgccaaaaagatggataagccgatgcttaagcaggccggttcgggcgtgcatgctgccggaactccagaaaacagcgcacctgtggaatccgaacccagccagtgggcctgcaaggtctgcagcgctactttcttagagttgcagctgctcaacgaacacctgttggggcatctagagcaggcgaaatctcttccccctggaagtcagagcgaggctgccgcaccagaaaaggagcaggacactcctcgtggagagcctccggctgttccagagagcgagaacgtagctacaaaggaacagaagaaaaagcctagacggggacgcaaacccaaggtgagcaaagcggaacagccactcgtgatcgtcgaggacaaggagcccaccgagcaggttgcagagataattaccgaggtgccccctgatgagcccgtgagcgctacacccgacgaacgaataatggagcttgtattgggcaagctggcaacaacaactacagacaccagcagtgtcccaaaattcacacaccatcagaacaacactattacactgaagagatcactgatactgagctcccgccacggcattaggcggaagctcattaagcagctgggtgagcataagcgcgtataccagtgtaacatttgttcaaaaattttccagaattcctctaacctttctaggcacgtgagaagtcatggtgacaagttgttcaagtgtgaagaatgcgccaagttgttcagcagaaaggagagcctgaagcagcacgtgagctacaaacatagtcggaatgaagtggacggggagtaccggtatcgctgtggtacttgtgaaaagacattccgtatcgagagtgcactagagttccacaattgccggactgatgacaagaccttccagtgcgaaatgtgttttcggtttttctcaactaatagtaatctgagtaaacacaaaaaaaagcatggggataaaaagttcgcctgtgaggtctgcagcaagatgttttaccgcaaggacgtgatgctggatcatcagagaagacacctggagggggtgcggcgagtgaaacgcgaggatctggaggcaggaggcgagaatcttgtccggtataagaaggagccatccgggtgtccagtgtgtggcaaggttttttcatgcagatccaacatgaataagcatctgctgacccacggggacaagaagtacacctgtgagatctgcggcagaaagttcttccgcgtggatgtgttgagggaccatatccatgtgcatttcaaagatatagctctgatggatgatcaccagcgggaggaatttattggcaagatcggcatcagttctgaggagaatgacgataacagtgacgagagcgccgactcagagccccacaagtactcttgcaagcgttgtcaactgaccttcggtaggggcaaagagtaccttaagcacataatggaggtacataaagagaaggggtacgggtgtagtatttgtaacaggcggtttgcactaaaggcaacgtaccacgcacacatggtgatacacagagagaacttacccgacccaaatgtgcagaagtatatccacccctgcgagatctgcggaaggatcttcaatagtattggaaacctcgagaggcataagctgatacacacaggggtgaaaagtcacgcttgcgaacaatgcggcaaaagcttcgcaaggaaggatatgcttaaggaacatatgcgggtgcatgacaatgtgagggaatatctgtgcgctgaatgcggtaaaggtatgaaaactaaacatgctttacgtcatcacatgaaattacacaagggcatcaaggaatacgagtgtaaagagtgccacaggcgctttgcccaaaaggtaaacatgctgaagcactgtaagaggcacaccgggataaaggactttatgtgcgaactttgcggtaagaccttttctgaacggaatacaatggagacacacaaactgatacacactgtaggcaaacagtggacttgcagtgtgtgtgacaaaaagtatgtcacagaatatatgttgcagaaacatgtgcaactgactcatgacaaggtggaagcacagagctgtcagttgtgtggaaccaaagtcagcaccagagcctcaatgtcccgccacatgaggaggaagcacccagaggtgctggccgtccgtatcgatgacctggaccacctacctgagaccaccactatcgacgcgtcttccataggcattgttcagccagagctgactctggagcaggaggacctagccgaggggaaacacgggaaagcagcaaaaagatctcacaagaggaaacagaaacctgaagaggaggccggagcacccgtgcctgaagacgccaccttctctgagtactccgaaaaggaaacggagttcacaggcagtgtgggtgatgagaccaattctgccgtgcagtcgatccagcaagtggtcgttaccctcggagatcctaacgttacgactccctcaagctccgtcggactgactaacatcaccgttacccctataacaacagcggctgctacccagtttacgaatctgcaacctgttgccgtgggtcacctaaccaccccagagcgtcagctccagcttgataactcaatcctgaccgtgactttcgacacagtgtctgggtctgccatgctgcataataggcaaaatgacgtacagatccatcctcagcccgaagcttctaatccacagtcagtggctcatttcattaatctcaccacgctggtcaatagtataacaccccttggctcacagttgtctgaccagcaccctcttacctggcgggcagtcccacagaccgacgtgcttccaccaagccaaccgcaggcccctccgcagcaggctgcccagccgcaagtacaggctgaacagcagcagcaacaaatgtatagctactag

SEQ ID NO: 23958 - DNA, 1668 bp, Artificial Sequence
  Description of Artificial Sequence: Synthetic coding sequence
atgccaagacgacgcccacccgcatcaggtgccgctcagttcccagagagaatcgctactaggtccccagacccaattcccctctgcaccttccagaggcaggttagcgaaatggctgaagacggaagcgaggagataatgtttatttggtgtgaggactgctcccagtatcatgatagcgaatgtccagaattgggaccagtggtgatggttaaggatagttttgtactaagtagggcccgtagctccctgccccctaatctggagatccggagattggaagatggagctgagggcgtcttcgccattactcagcttgtgaaaaggacccagtttgggccttttgagagcaggcgcgtcgcaaaatgggaaaaggaatccgcatttcctctgaaagtttttcagaaagacggccaccccgtgtgcttcgatacctctaatgaagacgactgcaactggatgatgctggtaagaccagccgctgaagcggaacaccaaaatctgaccgcctaccagcatggcagtgacgtgtactttacaacttcaagggacataccacccggaaccgagctaagagtgtggtacgccgctttttacgctaagaagatggacaaacctatgttaaaacaggccggatccggtgtccatgcggcagggacgccagagaatagcgcaccagtagagagcgagccatcgcagtgggcctgtaaggtgtgttcggctacattcctagaactgcagctactgaatgaacacctgctgggacatttggagcaagctaagtctttgccccctggaagccagtcagaggccgctgcgcctgaaaaagagcaagatactccaagaggagaaccacccgcagtccctgaatctgagaatgtggcgacaaaggagcagaagaagaaacctcggagaggacgcaaacccaaggtcagcaaagccgaacagcctctggtgatagtcgaagacaaagagccaactgagcaggtggccgagataatcaccgaggtgccacctgatgagcctgttagtgctacccccgatgagcgcattatggagcttgtgttgggcaagctggccaccactaccactgatacctctagcgtgccaaagtttacacatcaccagaataacaccatcactttgaagagaagccttattctttcgtcacggcacgggattcgacgtaaactgataaagcagttgggagagcacaagcgcgtgtaccagtgtaacatctgctctaagatatttcagaactctagtaacctgtccagacacgtgaggtcacatggcgataaactcttcaagtgtgaagagtgtgctaaactcttctccaggaaggagtcattgaagcaacacgtgtcttacaagcactcccgcaacgaagttgacggcgaatatcgataccgctgcggtacctgtgaaaagactttcagaatcgagagcgcccttgaatttcataactgccgtaccgggctaatagcccaccccggagaggggggacccggaggctcccggctgcgcgatctgcctgccacgagtccttctacccggagaagtacagcaacgaggagtctacccgtgagaagtgctgcgaggtgctctactgccagaacgagttgctggactacgtctgcagggacttggaaggagtgtggagaatag

SEQ ID NO: 23959 - DNA, 3486 bp, Artificial Sequence
  Description of Artificial Sequence: Synthetic coding sequence
atggccgaggatgggagcgaggaaattatgttcatttggtgcgaagattgtagccaatatcacgactcagagtgccctgagctgggccctgtcgttatggtcaaggactctttcgtactgtcacgggctcgcagtagcttgcccccaaacctggaaatccggaggttggaggacggggctgagggtgtgttcgctattacacagctggtgaaaaggacacagtttgggccttttgaatccaggcgcgtggccaagtgggagaaggaatcagcatttcctcttaaggtattccagaaagatggtcaccctgtgtgcttcgatacatcgaatgaagatgactgcaactggatgatgctagtcagaccagcagctgaagctgaacatcagaatctcacggcctaccagcacggatccgatgtatatttcaccacttcacgcgacatcccccctggcaccgaactccgggtttggtatgctgcattctatgctaagaaaatggacaaaccaatgctgaagcaagctgggtcaggggttcatgccgcagggactcctgagaatagcgctccagtggagtccgaaccttcacaatgggcatgtaaagtgtgctctgctacctttctggagctccagcttcttaacgaacatctccttggccaccttgagcaagcaaagtcgctgcctcctggatctcagtctgaggcagcagcaccagagaaagagcaggatacaccccgaggcgaacctccggctgtgcctgagtccgagaacgtggccactaaggaacagaaaaaaaaacctcgcagggggcgtaaaccgaaagtttctaaggcggagcagccattagtgattgtggaggacaaagagcccaccgagcaggttgcagagattatcactgaggtgccgccagacgagcctgtatctgcaacaccagatgagcggataatggagctggtgctgggaaaattagcgactacaaccactgatacttcgagtgttcctaaatttacacaccaccagaataacacaattacattaaagcggagtctgatactgtcatcaaggcatggaatacgtcggaaactgattaaacagctcggagagcacaaacgagtgtaccagtgcaacatctgttccaagatcttccagaactcttcaaacttatctcgccacgtacgatcgcatggcgataaactttttaaatgtgaagagtgcgctaagctgttctcaaggaaagagagccttaaacaacacgttagttacaaacatagcagaaatgaggtggatggcgagtaccgctaccgatgtggaacgtgcgaaaagaccttccggatcgagagtgctctggaattccacaattgccggacaggtttaattgcccaccccggagaaggcggtccaggcggaagtcgactccgtgatctgcccgacgataagacatttcagtgcgaaatgtgcttccggttcttctcaaccaactctaacctctcgaagcataagaagaaacatggggataaaaaattcgcttgcgaggtgtgttcaaaaatgttctataggaaggatgttatgctggaccaccagaggagacatcttgagggagtccgtcgagttaaaagagaggatctggaggctggtggtgagaatctggtcagatataaaaaagaaccctcggggtgtcccgtctgcgggaaagtatttagctgtcggagcaacatgaacaagcacttgctgacccacggggataagaaatacacgtgtgagatctgcgggagaaagtttttccgagtggacgttttgagggatcatatacatgtgcacttcaaggatattgctcttatggacgaccatcagcgggaggagtttattggcaagattgggatcagctcggaagagaacgatgataattctgacgaaagtgccgacagcgagccacacaagtacagctgcaagcggtgtcagctgaccttcggcagaggcaaggagtacctgaagcacattatggaggtacataaagagaaggggtacgggtgctcgatctgtaaccgcagattcgccctgaaagcgacttatcatgcccacatggtgattcacagagagaacctgccagaccctaatgtgcaaaaatacattcacccttgtgaaatctgcggcaggatctttaactcgattggcaatctcgagcgacacaagcttatccacaccggggtgaaaagtcacgcctgcgagcaatgcgggaagagcttcgcaagaaaagatatgctgaaagagcatatgcgagtacacgacaacgtccgggaatacctgtgcgccgaatgtggtaaaggcatgaaaaccaaacatgcgttgagacaccatatgaagctacacaagggaattaaggagtatgagtgtaaggagtgtcacaggagattcgctcaaaaggttaacatgctgaaacactgcaaaagacataccggaatcaaagattttatgtgtgaactgtgtggaaagaccttctccgaaaggaacacaatggagacccataaacttatccatactgtcgggaaacagtggacgtgctccgtatgcgacaaaaagtatgtcacagagtatatgctgcaaaaacatgtgcagctgacacatgacaaggtcgaggctcagtcatgtcaactgtgtggaacaaaggtgtctacaagagcttccatgagccggcacatgcgccgaaagcatcccgaagtcctggccgtcagaattgacgatctagatcatttacctgagacaaccacaattgatgcgagtagcattggcattgtgcagccagaattaaccttggagcaagaagatctggcggagggaaagcacgggaaggccgctaagaggtcccataagcgcaagcagaagccagaggaagaagccggtgcccctgtacctgaggatgcgacattttccgagtatagcgaaaaagagactgagttcacaggatctgtcggcgatgaaacaaactcagctgtccagtctatccagcaggttgttgttacattgggtgaccctaatgttacgactccgtcaagcagtgttgggctcactaacatcaccgtgactcctattacgaccgccgctgccactcaattcaccaacttgcaacctgtggccgtcgggcacctcaccactccggaacggcagttgcagctggataactcaatccttaccgtcacattcgacactgtcagcggctccgccatgctgcataatagacagaacgatgtgcagatccaccctcagcccgaggcctccaatccccagagcgtggctcacttcatcaatttgactactctggtgaatagcatcacaccactcggctcgcaacttagcgatcagcacccactaacatggagggccgtccctcagaccgatgtgctgccaccgtctcagccacaagcgcctccacagcaggctgctcagccacaggtacaagccgagcaacagcagcagcagatgtattcgtattag

SEQ ID NO: 23960 - DNA, 1788 bp, Artificial Sequence
  Description of Artificial Sequence: Synthetic coding sequence
atgctgaaacccggtgatcctgggggtagcgcattcttaaaggtggatccagcatacctgcagcattggcagcagttatttccacacggtggtgccggaccactgaaaggatctggagctgcgggactgctgtccgcaccgcagcctctacaaccaccccctccccctccacccccagagcgggctgaaccaccacccgactcactgcgaccacggccagcatctctgtccagcgcctcctctacaccagctagcagctctacttccgcatcctccgcctcatcctgcgccgcagcggctgccgctgccgcactagctggattgtcagctctacctgtgagtcaactgcccgtttttgccccactggctgctgcggctgtggcagccgaacccctacctcccaaagaactctgtcttggcgctacctctggacccggacccgtcaagtgcggaggcggagggggagggggaggtgaaggcagaggcgcacctcggttcagatgctctgcggaagaattggattattacctctacgggcagcagcgtatggagatcattccacttaaccagcacacctctgatccaaataatcggtgtgatatgtgtgcggataatcggaatggagaatgtccaatgcacgggccactccacagcttgcgacggctggtcggtacctcatccgccgcagctgcggcacctccacccgagctgcccgagtggctgcgggacttaccacgggaggtgtgtctgtgcacatctactgtgccaggtttggcatatgggatttgcgccgcacagcgcatccagcaaggcacatggataggccctttccagggcgtgctgctgccaccagaaaaagtgcaagcgggtgcggtaaggaacacacaacatctctgggagatttacgaccaggatggaactctgcaacacttcattgacggcggagagccgtcgaagagctcttggatgagatacattagatgcgcacgccattgtggcgagcaaaatctgaccgtggtccagtacaggtccaacattttttaccgagcatgtatcgacatcccacggggtactgagttgcttgtgtggtacaatgattcgtatacctctttcttcggcattcccctgcaatgcattgcacaggacgagaatttgaacgtcccaagcacagtaatggaagctatgtgcaggcaagacgccctgcaacctttcaataagtcttcaaaactcgccccaaccacccagcagcgttctgtggtgttcccccagacaccttgttcaaggaatttcagtctgcttgacaagagcggacccatagagagtgggttcaatcagataaacgtgaagaaccaacgagtgctggccagccctacctctaccagccagctgcactctgagttttcagactggcacctgtggaagtgcggtcaatgttttaaaacgtttacacagaggatactcctacagatgcacgtgtgtacccagaatcccgacaggccctaccaatgtggtcactgctcacagtccttttcacaaccgtctgaactgcgtaatcatgtggtgacccactcatccgacagacccttcaagtgtggctactgcgggagagcattcgccggagccaccacactgaataaccatattaggactcatactggcgagaagccctttaagtgtgaacgctgtgaaagatcctttacccaggctacccagctgagcagacatcaaagaatgccaaatgagtgtaagccgataactgaatcgcccgaatcaattgaggtcgattag

SEQ ID NO: 23961 - DNA, 516 bp, Artificial Sequence
  Description of Artificial Sequence: Synthetic coding sequence
atgtgccaaaattttttcatcgacagttgtgcagcccacggcccacccacttttgtgaaggatagcgctgtggacaaagggcatccaaaccgaagtgccctgagtcttccaccaggccttcggatcgggccttctggtatcccacaagcaggtcttggcgtgtggaacgaagcatccgaccttcccctaggactacactttggaccatacgagggccgtatcaccgaagacgaggaggcggcaaactccgggtactcttggctcatcacgaaaggacggaactgctacgaatatgtcgatggtaaagataaaagctctgctaactggatgaggactaaggcaagggatccatccatgtccctgatgctgtccggactgtttaagtctaaaatttcgcagagtacttgtggtacccagtccctcctttccgagctacctaggacgatctgtaagaaaacaagtccaaccagggaaagcctacctagagggtctgagagcggcgctgcaattttttag

SEQ ID NO: 23962 - DNA, 516 bp, Artificial Sequence
  Description of Artificial Sequence: Synthetic coding sequence
atgtgccagaattttttcatcgattcatgcgccgcacacggaccgcctaccttcgtgaaagattcagcagtggacaagggccaccctaacaggtcagctctgagcctgcctcctgggctgcggattggaccgagcggaatacctcaggctggtcttggcgtatggaacgaagcttctgacttaccactgggactgcattttggtccctacgagggtcgaattacagaggacgaggaggctgccaattcgggttactcctggttaataactaaagggaggaactgttacgaatacgtcgatgggaaggataagagctccgctaactggatgagaactaaagcaagggatccttccatgtccttgatgttgtcgggactgtttaagagcaagatcagtcagtccacatgcggaacccagtccctgctttccgagctccctagaaccatctgtaagaagactagccccactcgtgagtcactgccaagaggctcggagtcaggtgcagccattttttag

SEQ ID NO: 23963 - DNA, 417 bp, Artificial Sequence
  Description of Artificial Sequence: Synthetic coding sequence
atgtcgcctgaacgaagtcaggaggagagcccagagggtgatactgagcgcacagaacgcaaacctatggtgaaggacgccttcaaagatatctccatctactttaccaaagaagaatgggccgagatgggcgattgggaaaagacccgctaccggaatgtcaagatgaattataatgccttgatcactgtaggtctgcgggctaccagacccgcatttatgtgccataggcggcaagccattaaactgcaggtggacgacaccgaagatagcgatgaggaatggacaccaaggcaacaggtgaagccaccctggatggcgttccggggagaacaatccaaacatcaaaagatcgtgcggtgcgtaagaacgtcctcccttacagccgtcctcctgatggggccacttcacctttag

SEQ ID NO: 23964 - DNA, 1479 bp, Artificial Sequence
  Description of Artificial Sequence: Synthetic coding sequence
atgagtcccgaacgatcccaagaagaatcaccagaaggtgacactgaacgcacagaacggaagcccatggtaaaggacgcatttaaagacatttcgatttatttcacaaaggaagagtgggcagaaatgggcgattgggaaaagacacggtataggaatgtcaagatgaactataatgccttgattactgtcgggctgagagctacgcgcccagcatttatgtgccacaggcgtcaagcaattaaactgcaggtggacgatacagaagactccgacgaggagtggactcccagacaacaggtgaagcccccatggatggcttttagaggagagcagagcaaacaccagaagggcatgcctaaggcctctttcaataatgaatcctccctgcgcgaattgtctggaactccgaatctccttaatacttccgattcggagcaggcacagaagccggtatcccccccaggagaagcctccacctctggtcagcacagtaggcttaagctggaactcagacgtaaagagacagaaggcaagatgtactcacttcgagagcgcaaaggccatgcctataaggagatttccgagccacaggacgacgactacctatactgtgagatgtgtcagaacttcttcatagatagttgtgcagcccacggtccccctactttcgtgaaggactccgccgtggacaaaggccaccctaatcggagtgcgctgtccctgccaccgggactgaggattggtccctccggtattcctcaagcgggactaggcgtgtggaacgaggcatccgaccttcctcttgggctccactttggcccttatgagggtagaatcactgaagacgaagaggccgctaattccggttacagttggctgattacaaaaggtcgaaattgctatgagtacgtcgacggcaaagataagagctctgccaattggatgcggtatgtgaactgtgcacgagacgacgaggagcagaatcttgtagcttttcagtaccacagacagattttttatcgcacatgtagagtgattaggcctggatgtgagcttctggtttggagcggggacgagtacggccaggaattgggaatccggtcaagtatcgaacctgcagagtcattgggacaagccgtgaattgttggagcggaatgggcatgtcaatggcacgtaactgggcatcttctggggcagcatctggcaggaagtcttcctggcaaggagaaaaccagtcacagagatccatccacgttcctcacgctgtgtggccatttcaagtcaaaaatttttccgttaacatgtggaacgcaattacgccgctcaggaccagccaggatcacctccaggaaaatttcagcaaccagagaatccctgcgcaggggataagaatcagatcagggaatatccttatccacgctgccgtgatgactaagccgaaggtgaagagaagcaagaagggtcccaactcttag

SEQ ID NO: 23965 - DNA, 2070 bp, Artificial Sequence
  Description of Artificial Sequence: Synthetic coding sequence
atggaggatacaggaattcagcgcggtatctgggacggggacgctaaagctgtgcaacagtgtctaacagacatctttaccagcgtgtacaccacctgtgatatcccagaaaacgcaatatttggaccttgcgttctgagccacaccagcttatatgacagcattgcgttcatcgcgctgaaaagtactgataagcgaaccgtcccatacatcttcagggtcgatacctcagctgccaacggtagctctgagggattgatgtggcttcggctcgtgcagagcgcccgagataaagaggagcagaacctggaggcctatatcaaaaatggacagctgttttaccggtctctgcgaagaatcgctaaggatgaggagcttctcgtgtggtatggaaaggagctgaccgagctgctgctgctctgtccttccagaagccacaacaagatgaacggtagctccccttacacatgtctggagtgttcccagaggttccagttcgagtttccatacgtggcgcatctgcggttcagatgtcccaaaaggttgcattccgctgacattagtcctcaggacgagcaaggaggcggagtcgggaccaaggatcacgggggtgggggaggaggagggaaggatcagcaacaacagcagcaggaggcgccacttggtccaggccctaagttttgcaaagcaggacctttgcaccattatccctcaccaagccctgaatcttctaacccctctgctgctgcaggcggttcttcagccaagccaagcaccgactttcacaatctggcacgagagctggaaaacagccggggagggagctcctgctcccccgcacagagcctaagttctggaagtggatccggcggaggtggaggccatcaggaggcagagctatcacccgacggcattgcaaccggcggaggtaaaggtaagcgcaaatttcccgaggaggctgccgaaggcggtggcggagccggacttgtgggtggtaggggacggtttgtcgaacggccattaccagcaagcaaagaagacttagtttgtaccccacaacagtatagggcctcaggctcctacttcggcctcgaggaaaacggacggctcttcgcgccaccctcacccgaaaccggagaggccaagcgctctgcttttgtagaagttaaaaaggctgctagggctgcaagtttgcaggaggaaggaacagcagacggcgcaggggtcgcctccgaagaccaggacgccggaggaggcggaggcagcagtactcctgcggctgcttcgcctgtgggagcagagaaacttctagcccctagaccgggtggtccactcccatctcggctcgaaggaggtagtcccgctaggggttccgcctttacctcagtgccacagctgggcagcgccggaagtaccagcggcggaggtggaactggggctggtgcagctggtggcgcaggcggtggacagggtgccgctagcgatgagcgaaaatctgcattctcccagcctgcacggagctttagtcaactatctcctctcgtactcggtcagaagctgggcgcactggagccgtgtcatcctgccgatggcgtggggcctacgaggttatatccagccgctgcagatcccttagcagttaagttacaaggagccgcagatctgaacggaggttgcgggagcctaccctccggtgggggaggtcttccaaaacagtcgccattcctctatgctaccgccttttggccaaaatcgtcggccgcagctgcagccgctgccgcagcggcagccgctggccctttgcagctgcagctgccctctgccctgacactgctgcccccttcattcacctcactttgtctgccggcacagaattggtgcgccaagtgtaacgcctcttttaggatgacgtcagatctcgtttatcacatgcgctcccaccacaagaaggagtacgcaatggagccactggtaaagcggagacgagaggaaaagctcaaatgtccaatttgcaacgagagctttcgggagcgccatcatttgagccgccacatgacctcccacaattag

SEQ ID NO: 23966 - DNA, 2070 bp, Artificial Sequence
  Description of Artificial Sequence: Synthetic coding sequence
atggaggacaccggaattcagcgcggaatatgggatggggacgccaaagcagtacagcaatgcctcactgatattttcacctctgtatacactacatgtgacatcccagaaaatgccatcttcgggccatgcgtgttgagccatacatccctgtatgattctatcgcgttcatcgctctgaagagcacggataagcgcactgttccctacatattcagggtggacacaagtgcagccaatggatctagcgaggggctgatgtggcttagactggtccagtctgctagggataaggaagaacagaatctggaggcatatatcaagaacggccagttgttctaccgtagtcttagaaggattgcaaaggacgaagagctacttgtgtggtacggcaaggagctgacagagctacttctcctgtgcccctcgaggtctcataacaagatgaacggatctagcccatacacgtgcctggagtgttctcagcggtttcagttcgaatttccttacgttgcccatttgaggttcaggtgccctaaaagactccactctgcagacatttcacctcaagatgaacaggggggtggggtgggcaccaaagatcatgggggaggcggaggtggcggtaaagatcagcagcagcagcagcaggaggccccactgggacccggtcccaagttttgcaaagctggcccactacatcattatccatctccctcccctgaatcgagcaatccttcagctgctgcagggggatcgagtgccaagccatctacagatttccacaatcttgcacgcgagctggagaacagcagaggcggaagctcttgttctcccgctcagagcctgagttccgggtccggatctggcggaggcggtggacatcaggaagccgagctaagccccgacggcattgctacaggcggaggaaagggtaaaaggaaattccccgaggaggccgcagaaggtggtggcggtgccggactggttgggggaagaggccgattcgtggaaaggccgttaccagctagtaaggaggacctcgtttgcacacctcaacaatacagagccagcggtagctattttggactggaggagaacggaaggcttttcgcacctccgagcccagaaaccggcgaggccaagcggtcagccttcgtggaggtgaagaaggcagccagagctgcgtcccttcaggaggaggggaccgctgatggagctggggtcgccagcgaggatcaggacgcaggaggaggaggaggcagctcgacccctgccgctgcatcccctgtgggagccgaaaaactattagccccaaggcccggtggccctctgccttctcgactggagggcggatcacctgctcgtgggtctgcattcacatccgtgcctcagcttggatccgctggatcgacgtcagggggtggtggtacaggggcaggggctgccggaggcgctggaggcggtcagggcgcagcatccgacgagcgtaagagcgccttctcacagccggcacgcagcttctcacagctgagtcctctcgtgctagggcaaaagctgggggctctagagccgtgccatcctgccgacggcgtgggtccaacaagactctatccggctgccgcagatcccctcgccgtgaaactgcagggagccgcagacttgaacggtgggtgcggaagccttccaagtggaggcggaggcctaccaaaacagtcacccttcttgtatgcaactgcattttggcccaagtcgtccgccgcagccgctgccgcagctgccgctgccgcagcaggtcccttgcagctgcagttaccgtccgcgcttacgctgctgccaccatctttcacttcattgtgtcttcctgcacaaaattggtgcgccaaatgtaacgcatcatttagaatgacatccgacctcgtgtatcacatgcgctcccatcataagaaggaatacgcaatggagccactagtgaagagacgccgagaggaaaaactcaaatgtccaatttgcaacgagagcttccgagaaaggcaccacctgtctaggcacatgaccagccataattag

SEQ ID NO: 23967 - DNA, 2070 bp, Artificial Sequence
  Description of Artificial Sequence: Synthetic coding sequence
atggaagacacaggcatccaacgtgggatatgggacggagacgcgaaagccgtccaacaatgtctgactgatatcttcacttccgtgtacacaacttgcgacatccccgaaaatgcaatatttggcccttgcgttctgagtcatacgagtctctatgattctattgcattcattgccttgaagtctaccgacaaaaggaccgtgccttacatcttccgagtcgatactagcgcagctaatgggtcatcagagggccttatgtggctcaggctcgtacagagcgccagagacaaggaggagcaaaatttggaggcctatatcaagaacggccaactgttttatagatctctgcgccgtattgctaaagatgaagagttgctggtgtggtatggtaaagaacttactgagctgttgttgctgtgccccagcagaagccacaacaagatgaacgggtcgtcgccctacacatgcctggaatgctcccagagattccagtttgagttcccctacgtggcccatctgagatttagatgccctaaacgcctgcatagtgctgatatttcaccacaggacgaacaggggggaggcgtcggtacaaaagaccacggtggtgggggaggcggaggtaaggatcaacaacagcaacagcaggaggctcctctagggcctgggcctaagttctgtaaagccggaccgttgcatcactacccttccccctcccctgaatccagcaacccaagcgctgcggcaggaggatcttccgccaagcccagcactgactttcacaacttggctcgtgaattggagaattctcgagggggttcctcttgtagtccagcccagagcctaagcagcggctctgggagcggcggaggtggcggtcatcaggaggctgaattatccccagacggcattgccactggtggaggaaagggaaaacgcaagtttcccgaagaagccgcagagggcggtggaggggcagggctcgttggcggacgaggtagattcgtggaacgccctctgccggctagcaaggaggacctcgtgtgtacaccccagcagtaccgggcaagcggcagttattttggtctggaggagaacggcagactatttgccccaccaagtcccgaaaccggcgaggctaagaggagcgcttttgtagaagtaaaaaaagccgctagagcggcatctctgcaagaagagggcaccgctgatggagctggtgttgccagcgaagaccaagacgccggtgggggtggaggaagttccaccccggcagccgcaagccctgtgggggcagagaagctgctggcaccacgcccagggggtccgctcccttccagactggagggcggtagtccggcaagaggatccgcattcaccagcgttcctcaacttgggagtgccggatccacgtcaggtggcggtggtaccggcgcaggcgctgcgggtggtgccggagggggtcagggggcagcaagcgacgaacggaaaagcgcatttagtcagccggctcgatccttctcacagctgagtccgcttgtccttgggcaaaaactaggagccctggagccctgtcatcccgctgatggcgttgggcctacaaggctatatccagccgctgcagatccactcgccgtgaaactgcagggggcagctgaccttaatggaggctgtggaagcctgcccagcggaggtgggggactgccaaagcagagtccgttcctttatgctacggctttctggccaaagtcgtctgccgctgccgctgccgctgcagccgctgccgcagccggacccctgcagctacagctgccaagtgccttgacccttttgccaccctccttcactagtctctgtctgccagcccagaactggtgcgccaagtgtaatgccagctttagaatgacatctgacctcgtgtatcacatgagatcccaccataagaaggagtatgctatggagccgttggttaaaaggaggcgggaagagaaactcaaatgcccaatctgtaatgagtcatttagggagagacatcatttgtcccgacatatgacctctcacaattag

SEQ ID NO: 23968 - DNA, 1287 bp, Artificial Sequence
  Description of Artificial Sequence: Synthetic coding sequence
atggaagacaccggtattcaacggggtatatgggacggggacgcaaaggctgtccagcagtgtctgactgatatctttaccagcgtttataccacctgtgatattccagaaaatgcgatatttggcccttgcgtcctgtcacacacatctctttatgattcaatcgcatttatcgctctcaagtccaccgacaaaaggacggtcccttatatttttagagtcgatacttctgctgcaaatggatccagcgaagggctgatgtggttacgtttggtccagagcgcccgagataaagaagagcagaatctggaagcctatatcaaaaatggtcagttattctaccggagcctgaggcgtatcgcgaaggacgaagagttacttgtttggtacgggaaggaactgaccgagcttctgttgttgtgcccatctcggagccacaataaaatgaacggaagcagtccctacacctgtttggagtgtagtcagcgattccagtttgaatttccgtatgtggcacatctgaggttcaggtgtcctaaacgcctccacagcgctgacataagccctcaggacgaacagggtggcggagtcggcacaaaagaccacggtgggggaggaggcggtggcaaggatcagcagcagcagcagcaggaggccccactgggtcctggcccaaagttctgcaaggctgggccacttcaccactaccccagtcccagccctgaatcttccaaccccagtgccgctgccggaggctcatccgccaaaccttcaacagattttcataaccttgccagagagcttgagaactccagagggggaagcagttgttctcctgctcagtctttaagcagcggttcaggaagcggagggggaggaggtcatcaagaggccgagctgagccccgacggaatagcgaccggtggcggtaaagggaaaaggaagttccctgaggaagccgctgagggtggcggtggagccggtctggtgggcggtcgtggcagattcgtggaacgtcccctgccagcgagcaaagaagacctggtctgcactccccagcagtaccgggcatcaggcagctattttggtttggaggagaatgggaggttgttcgcacctccctcccccgaaaccggggaggccaaaaggagcgctttcgtcgaggtcaagaaggcagcacgcgcagcctcgctgcaagaggaaggcaccgctgatggagctggtgtggcctctgaggaccaagatgctggcggtggtggcggatcaagtacaccggcagcggcttag

SEQ ID NO: 23969 - DNA, 1125 bp, Artificial Sequence
  Description of Artificial Sequence: Synthetic coding sequence
atggcagctcctccgcgacccgctccctctccaccagcaccaagaagacttgacacgtcagacgtcctacagcagattatggcgatcacagaccagtctctggacgaagcgcaggcgaggaagcacgcccttaattgccatcgcatgaagcctgctctgttttcagtgctttgtgagatcaaggaaaagacagtggtgagtatccggggaatccaggacgaggatccccctgatgcccaattgctgagactcgacaacatgctgctggcagaaggcgtgtgccggccagaaaaacgcggtcgaggtggggctgtcgcaagagcgggaacagcgacacccggtgggtgccccaacgacaactccatcgaacacagcgattacagggccaagctgtcacaaataaggcagatttaccactccgaactggaaaaatacgaacaggcttgcagagagttcaccacacacgtgacgaacctcctgcaggaacagtctaggatgcgccctgtgagtcccaaggagatcgagcgaatggtgggtgcgatccatggaaaattcagcgccattcaaatgcaactgaaacagagtacctgcgaagctgtcatgacgctcagaagccgccttctggacgccagaagaaagaggcggaatttttccaagcaggccaccgaagttttaaacgagtacttctactctcacctgaacaacccttacccatccgaagaggccaaagaggaactggccagaaaaggtggattgaccatatcgcaggtgtctaactggttcggaaacaagaggattcggtataagaagaacatggggaaattccaagaagaggcgacaatctatactggtaaaactgccgtagacacaacggaggtcggggtgccagggaaccatgctagctgtttgagtacaccatctagcgggagcagcggcccattcccgctgccctccgcaggtgacgcctttctgacattacgcaccctcgcatctctacagcccccacctggtggcggttgtctccagtcacaggcccaggggtcctggcagggtgccactccacaacctgcaacagcttccccagccggagaccccggatcaattaactcttcaaccagcaactag

SEQ ID NO: 23970 - DNA, 945 bp, Artificial Sequence
  Description of Artificial Sequence: Synthetic coding sequence
atgctggtatctggcagacggaggttgcttaccgtgttgctgcaggcccagaagtggccatttcagcctagcagggacatgcgcctggtacaattcagggcccctcacctggtgggccctcatctcgggttggagaccggcaacggaggaggagtcatcaacctgaacgcctttgaccccacactgcctaagacaatgacccagttcttggaacaaggtgaagctacgctcagtgtcgcaaggcgagcactcgccgctcagctcccagttttgccacggtccgaagtcaccttcttggctcctgtgacccgcccagataaagtcgtatgtgtgggaatgaactacgtggaccattgtaaagagcagaacgtgccagtcccaaaggaaccgatcattttttctaagtttgcctcctctattgtgggcccatatgatgaggtagtcctacctccacagagccaggaagttgattgggaggtcgagctagccgtggtgattgggaagaagggaaagcacatcaaggccacagatgccatggcacatgttgccggttttacggttgctcacgacgtttctgcccgtgattggcagatgaggagaaatggcaagcaatggctgctcggaaagactttcgacacattctgccccctagggcctgccctagtgaccaaagacagcgtggcagaccctcacaacctcaagatctgctgtagagtgaatggagaagtagtgcagagcggtaataccaatcagatggtgttcaagactgaagacctgattgcatgggtgagtcagtttgttaccttctaccctggggatgtgattctcacgggcacgcctcctggggtgggagtgttccgtaagcctcccgtgttcctaaagaaaggagatgaggtgcagtgtgagattgaggagctgggagtgattattaacaaagtcgtgtag

SEQ ID NO: 23971 - DNA, 1059 bp, Artificial Sequence
  Description of Artificial Sequence: Synthetic coding sequence
atgagcgttcagaacagcgggtggccccatcaagaggactctcctaagccccaggatccagggccaccagctaacagcgatagcgactctggacaccttccgggagaagatccagaggatactcacgcccagggtccggcagtgctgagtttagggtcactgtgtctagatacaaatcaggcaccaaactggaccggcctgcagaccttgctacaacaactaccaccacaggacatcgacgagagatactgtctggcactgggcgaagaagaacgagccgaattgcagctgttctgtgcccgaagaaagcaggaggccctgggccagggggttgctaggctggtgttaccaaagctggagggtcacacatgcgagaagtgccgggagctgctcaaacccggtgagtacggtgttttcgctgccagggccggagagcagcgctgctggcaccagccatgctttgcatgtcaggcgtgcgggcaggcacttataaacttgatttacttttaccatgatggccagctttattgtggacgtcaccatgccgagctgctgcgcccacgctgtcctgcctgcgaccaactcattttttcatggcggtgcaccgaggctgagggacagcgctggcatgaaaatcatttctgctgtcaggattgcgcgggacctctgggaggcggaaggtatgcactaccgggtgggagcccttgttgtccttcctgttttgagaatcgctacagcgacgccggttccagttgggctggcgctctcgagggccaggcattcttgggggctcccccaccgcatcccccagatccaagcctaggtgccagaagctcccatcgggcatcattggccggagcttttcaggggccacccgaacctacaccaagaagaggccgaggatgtggagcacgtctgcctccgcgacgcggacggcgtacaccgagcggaggaggtgggggaccctggcgcggactgtcagctgctgcagccgctagaaccgctcagggactggggggtgctggcggatgggcaagcccacctcttgccgcagtttag

SEQ ID NO: 23972 - DNA, 939 bp, Artificial Sequence
  Description of Artificial Sequence: Synthetic coding sequence
atgagcccgcagggcccagcggtgctctccctggggtcgctgtgtttagacaccaaccaggcacctaattggacaggcctccagaccctgctccaacagctaccccctcaggacatcgatgagcgctactgtctggcactgggcgaagaagagagggccgagctccagctgttttgcgcaagacggaagcaggaggctttgggacaaggggttgccagactcgtgctccccaaactggaagggcacacgtgtgagaagtgtcgcgaactgctcaagcctggggaatacggggtgtttgccgctcgcgcaggagagcagcgctgctggcaccagccgtgcttcgcttgccaggcttgcgggcaagcactgatcaacctgatttatttttatcacgacggacagctctattgcggcaggcaccacgctgagctgctgcgacccagatgccctgcctgcgaccaactgatcttcagttggcgctgtactgaggccgagggccaaaggtggcacgaaaaccacttctgctgccaggattgtgcagggccacttggtgggggaagatatgccctcccagggggttcaccgtgctgcccttcatgcttcgaaaaccgttacagcgatgccggaagcagctgggccggtgccctagaagggcaagccttcctgggagctcccccacctcacccacctgacccgagtctgggggcacgctcttcccacagggccagtctagccggagccttccagggcccaccagaacccacacccaggcggggacgcggatgtggcgcacggctccccccacgacggggacggcgtactccatcagggggaggtgggggtccttggcgtggcttaagcgctgccgctgccgcaaggacagcccagggtcttggaggcgcaggcggttgggcctccccgcctcttgccgcagtttag

SEQ ID NO: 23973 - DNA, 1035 bp, Artificial Sequence
  Description of Artificial Sequence: Synthetic coding sequence
atgagccctcaagggccagccgtcttaagtctgggaagtttatgcttggacaccaaccaggcacctaactggacaggcttacaaacgctgctacaacaactccccccacaggacattgatgaacgttactgtctggcgctgggggaagaggagagagccgaactccagctgttttgcgccagaaggaaacaggaagctctcggacagggggtggcaagattggttctacccaagctggaaggtcatacgtgcgagaaatgcagggagttacttaaacctggggaatatggggttttcgcagcgagagccggtgaacagagatgctggcaccagccatgtttcgcctgtcaggcctgtggacaggccttgatcaacctcatttatttctaccatgacggccagctgtactgcggtcgccaccacgccgagctgctgcggccacgctgtcctgcctgcgaccagctgatcttttcatggcgttgcaccgaggctgaaggccagaggtggcacgagaaccatttctgttgtcaagactgcgctggccctttgggcggaggtagatacgccctccccggagggtcaccatgctgtccttcatgctttgagaataggtactcagatgcagggagtagctgggctggggcactcgaaggtcaggcttttttaggcgaaacgggcctcgatcgcacggaaggcagggaccagacctctgttaactccgcgaccttgtcacgcaccttactcgccgctgccggaggatcatcactccagacgcagagaggcttgccgggtagctctccacagcaggaaaatcgtcccggagacaaagccgaggcgccaaaaggccaggagcagtgtaggctcgaaacgatccgggatcccaaagacacacccttcagcacatgttcatctagctcggacagcgagcctgagggtttcttcctgggagagaggcttccccaaagttggaagacaccaggcagcctgcaggctgaagactccaacgcctcaaaaacacattgcaccatgtgctag

SEQ ID NO: 23974 - DNA, 1155 bp, Artificial Sequence
  Description of Artificial Sequence: Synthetic coding sequence
atgtcggtccagaattcaggctggccccatcaagaggattccccaaagccgcaggaccctggcccaccagccaactctgatagcgactccgggcacctacccggtgaagaccctgaagatactcacgcccagggccctgctgtgctgtctctcggcagtctgtgcctggataccaaccaggcacccaattggaccgggttgcagacactgttacagcaactgccgccacaggatattgacgaacggtattgcctagcactcggggaagaggagagagctgagctgcagttgttttgcgcgaggaggaagcaagaggccctgggacagggcgttgctcggctggtcttgccaaaactcgaaggtcatacctgcgaaaaatgccgtgaactgctcaaacccggagaatacggcgtttttgctgcgagagcaggagaacagagatgttggcatcagccttgtttcgcatgccaggcttgcggccaggccctgatcaatttgatctacttttaccacgatggccagctttactgcggaaggcaccacgcggaactcttaagacccaggtgccctgcgtgtgaccagttaatattctcctggcgatgcaccgaagccgagggacagcggtggcacgagaaccacttctgttgccaggattgtgcgggtcccctggggggtggtaggtatgccttgcctgggggttctccctgctgtccctcctgttttgagaaccgctactctgatgccggtagcagctgggctggagcactggaaggccaggcatttttgggggagacaggactcgatcgaactgaggggagagatcagaccagcgtcaattcggctacactctcgcggacactcttggcggctgcaggcggtagttctttgcagacgcagcggggactccctggatccagccctcagcaggaaaatcgccctggagataaggcagaggcacctaaagggcaggaacaatgtcgattggagactattagggatcctaaggacacgccattttccacatgctcaagcagcagtgactctgaacctgagggcttcttcttaggagaacgcttgccccagagctggaagacacccggaagcctgcaggctgaagactcaaacgcctcaaagacgcactgcactatgtgctag

SEQ ID NO: 23975 - DNA, 213 bp, Artificial Sequence
  Description of Artificial Sequence: Synthetic coding sequence
atgtcagtgcaaaattccgggtggccgcatcaggaggattctcccaagcctcaggacccgggtcccccagcgaattcggattcggatagcggccacctcccgggagaagaccctgaagatacccatgcacaggagtttctgtcactgcatctgctgagaacctggggcttcgattttaaattgattcatatgagtattcactacctctcctag

SEQ ID NO: 23976 - DNA, 474 bp, Artificial Sequence
  Description of Artificial Sequence: Synthetic coding sequence
atgaaaaatccagataaagcagtgcctattcccgaaaaaatgagtgagtgggcaccccgacccccacctgaattcgtccgggacgtcatgggctcttccgcgggagcaggctccggggaatttcacgtgtacagacatctgcgtaggcgagaataccaacgccaggattatatggacgcgatggcagagaaacagaaactggacgcggaatttcaaaagcgattggaaaagaacaaaattgccgcagaagaacaaacggctaagaggcgaaagaagcgcacgaggagtgcccagggcgctggcgtgcagcaactgtgtggtgggatttggaaccgcggaggcggaggaagtgcgcagttccaccacggtgcaatgaccatgttcgccactgcgtcagcttggaacctggcccgagctgtcacacgccgagagcggagattgtttggtagcttctctcccgcacggacgaggtag

SEQ ID NO: 23977 - DNA, 555 bp, Artificial Sequence
  Description of Artificial Sequence: Synthetic coding sequence
atggcttctccagctgcatccagcgtgcgtccgccacggcctaagaaagagccacagacgctagtcatccccaagaatgccgcagaggagcagaaactgaagctggaacgcctcatgaagaacccagacaaagcggttccaattcccgagaagatgtctgaatgggcgcctaggccccctccggaatttgttagggacgtcatgggcagctctgccggagcaggatcaggcgaattccacgtttacaggcatctgcgccgtcgcgagtatcaacggcaggattacatggacgcaatggccgagaaacaaaaattggatgctgaattccagaaacggctggaaaagaacaaaattgctgcagaagaacagaccgccaagcgcaggaagaaacgtcagaagcttaaagagaagaaacttcttgccaaaaagatgaaactcgagcagaaaaaacaggaaggccctggacagcctaaggagcaggggagttcatcctctgccgaagcgtcaggtaccgaagaggaggaggaagtgcctagcttcaccatgggtagatag

SEQ ID NO: 23978 - DNA, 555 bp, Artificial Sequence
  Description of Artificial Sequence: Synthetic coding sequence
atggcctcccctgcggctagtagcgtgcggcctccacggccaaagaaggaaccacaaactctggtgatccccaagaacgctgctgaagagcaaaagctgaagttggagagattgatgaagaacccagacaaagccgtgccaataccagaaaaaatgtctgaatgggccccaagaccacccccagagttcgtgcgcgatgttatggggtccagtgctggcgctggttccggtgagtttcacgtctacaggcacctgcggagacgggaatatcagagacaggattacatggatgctatggctgaaaagcaaaagctggacgctgagtttcagaagcgccttgaaaaaaataagattgccgcagaggagcaaacagctaaaaggcgtaagaaacgccagaaactgaaggagaagaaactactggccaaaaaaatgaaactggagcagaagaagcaggaaggcccagggcaacctaaagaacagggctctagttcctccgctgaggcatctggcacggaggaggaggaagaagtcccctcgttcaccatgggacgctag

SEQ ID NO: 23979 - DNA, 3075 bp, Artificial Sequence
  Description of Artificial Sequence: Synthetic coding sequence
atgagtaacgctaaagaacgtaaacacgcaaagaaaatgagaaaccagcccacaaatgtgaccctgtcttccgggtttgtggccgatcgtggcgtgaagcaccactcaggaggtgaaaagccctttcaggcccagaaacaggagcctcaccctggcacatcccggcagagacaaacgagagtgaatccacacagcctgccagaccctgaagtgaatgaacagtccagctctaagggaatgtttaggaagaaaggaggttggaaggcaggccctgagggaaccagtcaggagatcccaaaatacattacagccagtactttcgctcaggccagggctgcggagatctcagcaatgcttaaggccgtcacccagaaatcttcaaacagtttggtgtttcagactctgcctcgacatatgcgtcgacgggcaatgtcacacaatgtcaaaaggctgccgagacggctgcaggagatcgctcagaaagaagctgagaaagccgtccaccagaagaaggagcattccaagaataagtgtcataaagccaggcggtgccacatgaatcgcacccttgagtttaaccgccgtcagaagaagaacatttggctggagacccacatctggcacgccaagcggttccacatggttaaaaagtggggttactgtctcggtgaacggcctacggtgaaatcccaccgggcatgctatcgagcgatgacaaataggtgccttctccaggatctgtcttattactgctgtttagaactaaaggggaaggaagaagagattctcaaagcactttccgggatgtgcaatattgatactgggttaacgttcgctgctgtgcactgcttgagtggcaagaggcaggggagcctggtgctgtacagggttaacaagtacccacgcgagatgcttggaccagtgacatttatctggaagtcacagcgcaccccaggggatccaagtgagtctagacaactgtggatctggctgcacccaaccctaaagcaggatatcctcgaggagataaaggccgcatgtcaatgcgtggaaccaataaagtctgctgtttgcatagcagatccattacctacacccagtcaggaaaagtcccagacagaactccctgatgagaagattgggaagaaaaggaagcggaaggatgacggcgagaacgcgaagcccatcaagaaaatcatcggggacggtacccgggatccttgcctgccttacagctggataagcccaactactggcattattatctctgatttaacaatggagatgaaccggttcaggctcatcggaccgctttctcactccattctaacggaggctatcaaagcggctagcgttcataccgtgggcgaggatactgaggaaacccctcataggtggtggattgagacttgtaagaagcctgactctgttagcctgcactgccggcaggaggctatctttgaactccttggcggaataaccagccccgcagaaataccagctgggactatcttgggtctgactgtcggcgatccccgtattaacctcccacaaaaaaagagcaaggccctgccaaatccagagaaatgccaagacaacgagaaggtgcgccagctcctccttgagggagtacccgtcgaatgcacacactccttcatctggaaccaggacatctgcaagtcggttacagagaataagataagcgatcaagatctcaatagaatgagaagtgaactcttagtgcccggatcacagttgatactgggcccacacgagagtaaaatacccatcttgcttatacagcagccaggcaaagttactggagaggatagactcgggtggggatcgggttgggatgtgctgctcccgaagggctggggtatggcattctggatcccctttatctaccggggagtgagagttgggggtttgaaggagtccgccgtccactctcagtataaacggagtcctaacgtgccaggagactttccagactgccctgcaggcatgctcttcgcagaggagcaagcaaagaatttacttgaaaagtacaagaggcgacctcccgctaagaggccaaactatgtaaagctgggcactctcgcgccattctgctgtccatgggagcagttgactcaggattgggaaagtcgagtgcaggcttacgaagagccaagtgtagcatcgtcccccaatggcaaagaatctgatttgagacgctccgaagtcccctgcgccccaatgcccaaaaaaacacatcaacccagtgatgaagtggggacttcgattgagcacccacgtgaggcggaggaagtgatggatgccggttgtcaggagtcggctgggccagagaggataacggaccaggaagctagcgagaaccacgtggctgcaaccggcagccacctgtgcgtcctgagaagccgaaagctgctcaaacaactgtccgcttggtgcggccctagtagcgaggacagcagaggcggtcggagagcccctgggcgaggccaacaggggctcacccgagaggcatgcctgagcattctcgggcattttccacgggctctcgtgtgggtctccttgtccctgctgtccaaaggtagcccagagccccataccatgatctgtgtgccagccaaagaagacttccttcagttgcatgaagactggcactattgcggtccacaagagtccaaacacagtgacccttttagatcaaaaattttgaagcagaaagaaaagaaaaagcgtgagaagaggcaaaagccagggagggccagctctgatggacccgcaggggaggagcccgttgcaggccaagaggcactcacacttgggctgtggtccggccctctcccaagggtcactctccactgctccagaactttgctaggatttgtgactcagggcgacttcagcatggccgttggctgtggagaggcacttggattcgtgagcctgaccggactgttggatatgctgtccagccagccagctgctcaaaggggccttgtgctcctcaggccaccagcttcgctccagtaccgttttgctcgaattgccatagaagtgtag

SEQ ID NO: 23980 - DNA, 3075 bp, Artificial Sequence
  Description of Artificial Sequence: Synthetic coding sequence
atgtcaaatgcaaaggaacgcaagcatgccaagaagatgagaaaccagcccaccaacgttaccttgagtagtgggttcgttgccgaccgaggcgtgaagcatcattccggaggggagaagcccttccaggcgcagaagcaggagccgcatcctgggacgtcccggcagcgacagactcgggtgaatccgcattcactgcctgatccagaggtcaacgaacaaagtagttcaaaaggcatgtttaggaaaaaaggtgggtggaaggctggtcctgaaggcacgtctcaagaaatcccaaaatatatcaccgcgtcgacctttgcacaagctcgcgcagccgagatcagcgctatgctcaaagccgtgacccagaagtcctccaacagcctcgtgtttcaaactctccctagacatatgcggaggcgagctatgagtcataatgtgaaaaggctgcccaggcgactgcaggagatcgctcagaaagaagccgagaaagctgtgcaccagaaaaaagaacacagtaagaacaaatgccacaaagccaggagatgtcatatgaataggacccttgagttcaatcggagacagaagaaaaacatatggttggaaactcacatttggcacgctaagagattccatatggttaaaaaatggggatactgtctgggagaaaggccaaccgtgaagtcccatcgcgcttgctaccgggctatgaccaataggtgcctgctgcaggacctctcgtactattgttgtctcgagctgaaagggaaagaggaggaaatcttaaaagcgctttcgggcatgtgcaacatagatactggcctgacttttgcagctgtgcactgtctgagtggaaagcggcagggatccctggtgctctacagggtgaataagtatcccagagaaatgctgggacctgtgacatttatctggaagtcacagagaacaccgggtgacccatcagagtcccgccagttgtggatttggttgcacccgacactgaagcaagatattttagaagaaattaaggcagcctgtcagtgcgttgaacctatcaagtctgccgtgtgcattgcggaccctctgcccacaccctcccaagagaaatctcagactgagttgcctgatgagaaaattggtaagaaaaggaaacgcaaggatgatggcgagaacgccaagcccatcaagaagatcataggcgacggcacgcgtgatccttgtctcccatactcttggatatcccccaccaccggcataataatatctgatctcaccatggagatgaatcggttccgcttgattggcccattgtctcattctatcctgactgaagctatcaaggccgcatccgtgcacactgtgggtgaggacactgaggaaaccccccataggtggtggatcgaaacatgtaaaaaaccagactccgtgtcgctccattgcagacaagaagcgatctttgagttgctgggagggatcacctctcctgcagaaatccctgcaggaaccatactgggcctgactgttggagatccccgtattaatctgcctcagaagaaaagcaaggcacttcccaacccagaaaaatgtcaggataacgaaaaagtcaggcaactgctcctagagggcgtacccgtggaatgtactcacagcttcatttggaatcaagatatctgtaagagcgtgaccgagaacaaaatctccgatcaggaccttaaccggatgcgctccgagctgctggttcccggatctcagctcatcctgggaccacacgaaagcaaaatcccaattctcctcatccagcaacccggtaaagtgacaggggaagatagactcgggtggggctccggctgggacgtgctgcttcccaagggctggggcatggccttctggatcccttttatctatcgcggagtgcgggtgggagggctgaaggagtctgctgtgcactcgcaatacaagcgcagcccaaacgtgcccggtgacttcccggattgcccagcgggaatgttattcgcagaagaacaggcaaaaaaccttttagagaagtataagagacggccacctgccaaaaggccaaactacgtcaaactgggtaccttggcccctttctgctgtccctgggagcaattgacccaagactgggagtcacgggttcaggcctacgaagaaccaagcgtcgctagcagcccaaacggcaaggagagcgacctccggagatctgaggtgccttgtgctcctatgcctaagaagactcaccagccaagtgacgaggtgggcactagtattgaacatcccagggaagcagaggaggtgatggacgcaggctgtcaggaatccgcagggcctgaacgtatcaccgatcaagaggcctcagaaaatcacgtggcagccacgggttctcatctgtgcgttctgagaagtagaaagttgttgaagcagctgtctgcctggtgtgggccaagctctgaagactctagaggcggtcgcagagcacctggccgaggccagcaggggctcacacgggaagcatgtttgtccattcttggccacttccctcgcgcactggtatgggtgagtttgagccttctttccaaggggagtccagagccccatactatgatctgcgtccctgcaaaagaggattttttgcagctgcatgaggattggcactattgtggcccacaagagtccaaacactcagaccccttcagatccaaaattctcaagcagaaagagaaaaaaaaaagagagaagagacagaaacctgggcgagcatcctctgacggcccagcaggagaggaaccagtcgcaggacaggaagcgctgacattgggtctgtggagcggacccttgcccagagtgaccctgcattgctcccgcaccctactggggttcgttacgcagggggatttcagtatggcggtgggttgcggggaggcgttaggcttcgtatccctaaccgggttgctggatatgctatctagccagcccgctgcccagaggggattagtgcttttgcgtcccccagctagcttgcagtatcgattcgcacgcattgccatcgaagtgtag

SEQ ID NO: 23981 - DNA, 552 bp, Artificial Sequence
  Description of Artificial Sequence: Synthetic coding sequence
atgtcgaatgcgaaggaacgaaagcatgccaaaaagatgaggaatcaaccaactaacgtgactctgtccagtgggttcgtcgcagatagaggagtcaaacatcacagcggaggagaaaaacccttccaggcccagaaacaggaaccccacccaggtacctccaggcaacggcagacacgcgtgaatccacactctttgcctgaccctgaagtgaacgagcagtcctcatccaaaggaatgttccggaagaaagggggttggaaggccggacctgaggggaccagtcaggagattcccaaatacatcactgcaagtacattcgcacaggctcgcgcagcagaaatctcggcaatgctgaaggccgtcacacagaagagctctaacagtctggtattccagaccctcccgagacacatgcggaggcgtgccatgtcccataatgtgaaacggctgccccgtaggctgcaggaaattgcccaaaaggaggccgaaaaagctgttcatcagaaaaaggagcactccaaaaacaagtgtcacaaagcaaggcgctag

SEQ ID NO: 23982 - DNA, 297 bp, Artificial Sequence
  Description of Artificial Sequence: Synthetic coding sequence
atgtggaatcccaatgctggcggaccgcctcatccagtgccacaacctggttatcctggatgccaaccgctggggccttatcctcctccttaccctcccccagctcccggtatacctcccgtcaatccactagccccagggatggtgggaccggcagttatcgtcgataagaagatgcagaaaaaaatgaagaaagcccacaaaaagatgcacaagcatcaaaaacaccataaatatcacaagcatggaaaacactcttccagttcgtcttcaagcagcagtagcgactctgattag

SEQ ID NO: 23983 - DNA, 447 bp, Artificial Sequence
  Description of Artificial Sequence: Synthetic coding sequence
atgtggaacccgaatgcgggacaacccggtcccaatccctatccccctaacatcggatgccccggaggctctaatcccgcacaccctccgccaatcaacccacctttcccacccggaccttgcccaccacccccaggggcaccacacgggaatccagctttcccacccggagggccacctcacccagtaccgcagcctggttacccaggctgccagccactgggcccttacccgccaccttatcccccacccgctcccggtattccacctgtaaaccctttagctcctggtatggtgggcccagccgtgatcgtggacaagaaaatgcagaagaagatgaaaaaggcgcataagaaaatgcacaagcaccagaagcaccacaaataccacaagcacggcaagcactcctctagttccagcagctcctcatcctccgacagcgactag

SEQ ID NO: 23984 - DNA, 489 bp, Artificial Sequence
  Description of Artificial Sequence: Synthetic coding sequence
atggggtatctggattctatcggatggagaacgcatctgaatatgtggaacccaaacgccggtcaaccaggacccaatccataccccccaaacatcgggtgcccaggcggttctaaccctgctcaccctcccccaataaatcccccatttcctcctggcccatgtcccccacctcccggagcaccccacgggaatcccgcattccctcctgggggtccacctcaccccgtcccccagccaggatacccagggtgtcaaccattggggccatatccaccgccatacccgcctcccgctcctggcatacctcctgtcaaccccctagctcccggtatggttgggcctgctgtgatcgtcgacaagaagatgcagaaaaagatgaaaaaagctcataagaaaatgcacaaacaccagaagcatcataagtaccataaacacggaaagcactcctcctcctcctctagctcttcgagttccgatagtgactag

SEQ ID NO: 23985 - DNA, 447 bp, Artificial Sequence
  Description of Artificial Sequence: Synthetic coding sequence
atgtggaatcccaacgcaggacaacccggaccaaatccttatcccccaaatatcgggtgtcctggcggttccaaccctgcccatcctcccccaattaacccaccattcccccctggcccatgtcctccaccccctggcgctccgcacgggaatcccgctttcccgccaggcggacctccacacccagtgccccagcctgggtatccaggttgccagccactgggtccttaccccccaccctaccccccacccgctcctggaatacccccagtgaaccccctcgcccctggaatggtggggcctgccgtcatagtggataagaagatgcaaaaaaagatgaagaaagctcataagaagatgcataagcaccagaagcaccacaaataccacaaacatggcaaacacagttcgtctagtagctccagcagtagcagcgacagcgactag

SEQ ID NO: 23986 - DNA, 447 bp, Artificial Sequence
  Description of Artificial Sequence: Synthetic coding sequence
atgtggaatcccaacgccggacaacccggaccaaacccctaccctcctaacatcggatgtcctggcggttccaatccagctcatcctccccctattaaccctcctttcccccctggcccttgcccaccacctccgggagcccctcatgggaatccagccttcccaccaggtgggcctccacaccctgtgccacaaccgggatatcctggatgccagcccctgggcccatacccgccaccctaccctccgcctgccccaggcattccacctgttaatcccctggcaccaggaatggtgggccctgcagttatcgtggacaagaagatgcagaagaaaatgaaaaaggcacataaaaaaatgcacaagcatcagaagcatcacaagtaccacaaacacggcaaacattcctctagctcttcttctagctcgtcttccgactccgattag

SEQ ID NO: 23987 - DNA, 1779 bp, Artificial Sequence
  Description of Artificial Sequence: Synthetic coding sequence
atggatcctaattcaatccttttaagtccccagccacagatctgttctcatctagcggaagcgtgcaccgagggtgagagaagtagctctccaccagagctggatagggactcacccttcccgtggtctcaggttccctcctcatcccccacggatcctgagtggttcggcgatgaacatattcaagccaaacgcgctcgagtcgaaacgatcgttcggggtatgtgcctgtccccaaaccccctcgtacccggtaatgcgcaagctggagtcagtcccagatgtcctaaaaaggctagagagcggaagcgaaaacagaacctgcccaccccacaggggctgctgatgcccgctcctgcctgggatcaaggaaaccggaaggggggtccacgcgtccgcgagcagcttcatctgctcaaacagcagctgcgccatctgcaggagcacattctccaggctgctaagccccgagatactgcccagggtcccggaggttgcggaacagggaaagggcctctctccgccaagcagggtaacggctgcgggccacgcccttgggtggtggatggggaccaccaacaggggacatctaaggacctctccggcgcagaaaaacatcaggagtccgaaaagccaagttttctgcctagcggggcaccagccagcctggaaattctgagaaaggagttgactcgggctgtctcgcaggctgtagactcagtcctccagaaagttctgcttgatccgcctggacacctgactcagcttggtagaagcttccaaggccaggtcgccgaaggccgaagcgagccctcaccacccgtgggcggtgcctgtaaggaccccctggctctcgctgcactgcctagacgtgtccagctgcaggcaggggttccagtcgggaacctaagcctcgccaaacgactagatagccccaggtaccccattccacctcggatgactccaaaaccctgccaggacccacccgcaaacttcccacttactgccccttcacatattcaggaaaatcaaatactctctcagctgctggggcatcggtataacaacggccactggagctcttctccaccccaggattcttcaagtcagcgacatccaagttctgagcccgctctgcggccttggagaactaccaaacctcagcccctggtgcttagccagcagcagtgccccctgcccttcacttcagcacacctcgaatctctcccactgctgccatccgtgaagatggaacaacggggactgcacgcagtaatggaagcactccccttctctctggtgcacatcagcgagggattaaatcctgggcatctgaagaaagcaaagctgatgttcttcttcacaagatatccctccagcaacctcctgaaagtgtactttcccgacgtgcagtttaatcgctgcatcacctctcagatgatcaaatggttctctaactttagggaattttactatatccagatggagaaatcagctcggcaggccattagtgacggcgttactaatcccaaaatgttggtcgtcttgagaaattcagagctctttcaagctcttaacatgcattataacaagggtaacgatttcgaggtgcctgactgcttcctcgagattgctagcctgactctgcaagagtttttcagggccgtctccgcaggtcgcgattcagatcccagttggaaaaaaccgatttacaaaatcattagtaaacttgatagtgatatcccggagatatttaaaagcagtagctacccacagtag

SEQ ID NO: 23988 - DNA, 1779 bp, Artificial Sequence
  Description of Artificial Sequence: Synthetic coding sequence
atggacccgaactctatactgctctcccctcaaccccaaatctgctcccacctggcggaggcctgtacagagggagagagatccagcagcccccctgaattagatcgcgactcaccattcccttggtcacaagtaccgagctcctcacctacagatcccgagtggttcggtgatgagcatatccaggcaaaaagggcgagggtcgaaaccattgtgcgaggcatgtgtctaagtcccaatcccttggtgcccggaaacgcccaggcgggtgtctcacctaggtgccctaagaaggcaagagagagaaagaggaagcaaaatctgcctacaccccaggggttactgatgccagcaccagcgtgggaccagggaaaccgcaagggcggtccaagagttcgggagcagctccacctcctgaagcagcagctgagacatctgcaagaacatatcctccaggctgctaagcctcgcgatacagcgcagggtccgggaggctgtgggactggcaaaggccctctctctgccaagcaagggaacggatgcggacctaggccatgggtggtagacggagatcaccagcagggaaccagcaaagacctgtcgggtgccgaaaaacatcaagagtcggagaagccgtcatttctgccatcaggcgcaccagcatcactggagattctacggaaagagttaacgagagcagtctcacaggctgtagacagtgtcctgcagaaagtgctcctggatccacctggtcatctgacccagctcggaagaagtttccaggggcaagtggccgaggggaggtccgagccttcccctccagtcggcggagcctgcaaagacccattagccctagcagctttacctcgcagagtgcagttacaggcaggcgtgcccgttggcaacctatcactggccaaaaggctcgacagtcctcgatatcctattcccccacgcatgacgcccaagccctgccaggaccctcccgcaaattttccactgactgcgccatcacacattcaagagaaccagatactttcacagctcctgggacatagatacaataatggacactggtcttcatcacctcctcaggatagttcatcacagcgccatccgtctagtgaaccggctttacggccatggaggacaacaaaaccacagccactcgtacttagtcagcaacagtgcccactacctttcacctctgcgcatttggagtccctgcctctgctgccctcggtgaagatggaacagagagggctgcatgctgtgatggaagcactccctttcagcctactgcacattcaagagggactcaatcctggacaccttaagaaggccaagctgatgtttttcttcacccgctatccgtcatccaacctcctcaaagtgtattttccggatgtacagtttaaccggtgcattacgtctcaaatgattaagtggttctccaactttcgcgagttctactacatccagatggagaaaagtgccaggcaggctatctcagatggcgtaactaaccccaaaatgctggtggtacttcggaattccgagctttttcaggctctgaatatgcattataacaagggaaacgattttgaggtcccggactgcttcttggagattgccagtttgacactgcaagaattttttcgcgctgtcagtgccggaagagatagtgacccatcgtggaaaaaacccatctacaaaatcatttcaaagctagacagtgatatccctgaaatctttaaaagcagcagctatccccagtag

SEQ ID NO: 23989 - DNA, 1779 bp, Artificial Sequence
  Description of Artificial Sequence: Synthetic coding sequence
atggacccgaacagcatcctcttgagtccacagccccaaatatgctctcacttggccgaagcatgcactgagggcgaacgctccagctcccctcctgagctggaccgggactccccgttcccatggtcacaggtaccctccagctcgcccacggaccccgaatggtttggggatgagcacatacaagccaaaagagcgagagtggaaaccattgtccggggtatgtgcctgtctcccaatccactcgttccaggcaatgcccaggcaggtgtgtcccctagatgccctaaaaaggctcgggaacgaaaacggaagcaaaatctccccacgccccaaggactgcttatgccagcgcctgcctgggatcagggaaatcggaagggcggacctcgagtcagggagcagctccacctgctgaagcaacagctgcgccatcttcaggaacatattctgcaggccgctaagcctagggacaccgctcagggtcctggaggctgtgggaccgggaagggcccattaagcgcaaaacagggaaacggttgtgggcctaggccatgggtggttgacggcgatcaccagcaaggaacatccaaagacctgtcaggggctgagaagcaccaggagtcggaaaagccaagtttcttgccttcgggcgcacctgcctctttggaaatcctgcggaaggaattgactagggccgtgtcgcaggcagtggacagcgtcctccagaaagttcttctggatcccccaggtcacctgacccagctcgggcgttccttccaagggcaggtggctgagggcagatcagagccatctccacctgtcggcggtgcctgcaaagatccccttgccttggccgctctgcccagaagggttcagctgcaggccggtgttcccgtagggaacctgtctttagccaagagactcgactccccaaggtatcccatcccacctcggatgacacctaagccatgtcaggatccacccgctaactttccattgactgccccatctcacattcaggagaatcaaatccttagccagctcctcggacaccggtataacaacggacactggtcttcttctcccccacaggactccagcagccagaggcacccttcatccgaacccgcacttcgaccctggagaacaacgaagccccagccactggtgctcagccagcaacaatgtccgttgccctttaccagtgctcatttggaatctctgcctctcttaccttctgtcaagatggagcagcggggtctgcacgcagtgatggaagcactgcctttcagcctggttcacatccaggagggcctcaaccctgggcatttaaaaaaagcgaagctcatgttttttttcacacggtatccaagcagcaacctcctaaaggtctattttcccgacgtgcaattcaatcggtgtataaccagtcaaatgattaagtggttttctaacttccgtgagttctactacattcaaatggaaaagagcgcccgtcaggcaatatcagacggggtcacaaacccaaagatgctggtcgttttgcgcaattctgagttattccaggctctgaacatgcactataataaggggaacgactttgaggtcccagattgcttcctggagatcgccagcctcacattgcaggaattcttccgcgctgtttctgctgggagggactcagacccctcctggaagaagcccatctacaaaattatctcaaagctggactccgatatcccagaaatcttcaagtcttcctcttaccctcaatag

SEQ ID NO: 23990 - DNA, 174 bp, Artificial Sequence
  Description of Artificial Sequence: Synthetic coding sequence
atgctgtgtgcccactttagtgatcaggggcctgctcacttaaccacctccaaatcagcctttctgtccaacaagaagacaagcaccctcaaacacctgctgggggaaaccaggagcgatgggagtgcctgcaattccggaatttctgggggaaggggtcgcaaaataccgtag

SEQ ID NO: 23991 - DNA, 5439 bp, Artificial Sequence
  Description of Artificial Sequence: Synthetic coding sequence
atggctgttgacagcgctatggagctcctctttttggacacctttaagcacccatccgcagagcagagcagccacattgacgtcgttcgatttccctgcgtcgtctacatcaatgaggtcagagtaataccgcctggtgtaagggcccacagtagtctgccggataatcgggcttacggggagacctcacctcacactttccagctggatttattcttcaataacgtgagtaaaccttctgcccctgtgttcgatcgactggggtcactggagtatgatgagaatacctctataatttttcgcccaaatagtaaggtcaacaccgacgggctcgtactcagaggctggtataactgccttactctggcaatctacggctcagttgacagggttatttcccacgatcgcgacagccctccaccccctcccccaccaccgcctccgcctcagcctcagcctagcctaaaaaggaatcctaagcacgcagatggcgagaaggaggaccagttcaatggctccccacccagacctcagccacgagggccaaggacccccccaggaccacctccacccgacgatgacgaagacgatcctgtacctctgccggtttcaggcgataaagaggaggacgcaccccaccgtgaggactactttgagccaattagccccgatcggaactctgtgccacaagagggccagtattcggatgaaggagaggtggaagaggaacaacaggaggagggcgaagaggacgaggatgatgtggatgtcgaagaagaggaagatgaggacgaagatgatcgcaggactgtagattcgattccggaggaggaggaagaggacgaagaggaggaaggcgaagaggacgaggagggggaaggtgacgacgggtatgagcagatctcttccgatgaggacggtattgctgatctcgaaagagaaaccttcaagtatccaaacttcgatgttgagtacaccgccgaagacctcgcgtctgtgccgccaatgacctacgacccctatgatcgggagctggtccccctgctctacttttcatgcccttataagacgacatttgagatcgagatcagccgcatgaaggatcaggggcctgacaaggagaactcaggggctatcgaagcttccgttaagcttacagaactactcgacttgtacagggaggatcgtggtgctaagtgggtgactgctttggaagagatcccgtcgctaattattaaaggtctgagctacctacagctgaagaatactaaacaggactctcttggccagctggtggactggacaatgcaggccctcaatctgcaggtggctctgcgccaacccatcgctctaaatgtaagacagctgaaggcaggaacaaagcttgtgagttcgctggccgaatgtggcgcacaaggcgtcacaggtctgttgcaggctggagtgatctccggcctgtttgagttactttttgccgaccacgtgtcttctagtctcaagctgaatgcattcaaggctttggactcagtgatctctatgaccgagggcatggaagcatttctgaggggcagacagaacgaaaagtccgggtatcagaagctgctggaactgattcttttggaccaaaccgttcgggtagtcactgccggttccgctattctccagaagtgccacttttatgaggtgctgtccgaaataaagaggctgggagaccatctcgccgaaaaaaccagctccctgcccaaccattcagaacctgatcatgacactgatgccggactcgaaaggacaaatcccgaatatgagaatgaagtggaggcctctatggatatggacttgctggagagctcaaatattagtgagggagaaatcgagagacttatcaaccttttggaggaggtgtttcatctgatggaaacagcccctcatactatgattcaacagcccgttaagtcatttccgaccatggctagaattacagggccaccagagcgcgatgatccatatccagtgctgttccgctatctccactcacaccacttcctggaattggtaacccttctcctgtcaattccggtgacgtctgctcatcccggagtgctacaggccactaaggacgtgctaaagttcttggcacagagtcagaaggggctgctcttctttatgtccgagtacgaggctactaacttgttgatacgggctctgtgccatttttacgaccaggacgaggaggaagggttgcagagcgatggagtgattgacgacgcttttgccctatggctgcaagatagcactcagaccctacagtgtatcactgagctcttcagtcactttcagagatgtaccgctagcgaggagactgaccactcggacctgttggggaccctccacaacctgtatctgattacattcaacccagtgggccgatccgctgtggggcacgttttcagtctggaaaagaatctgcaatctctgattacgctgatggaatactattccaaagaggccttaggggatagcaaaagcaaaaagtctgtcgcttataactatgcatgcatcctcatactcgtggtggtccaatccagttctgatgtgcagatgttagaacaacatgccgctagtttgctgaagctgtgtaaggccgacgaaaataatgccaagctccaggaactcgggaagtggctggaaccactcaaaaatctgaggttcgagatcaactgcatacccaacttgatagagtatgttaagcagaatatagacaacttgatgacaccggaaggcgtgggattgacgactgcactgcgcgtgctctgcaatgtggcctgtccccctcccccagttgagggtcagcaaaaggatctgaagtggaatcttgcggtcatccaattgttttctgctgaggggatggacaccttcataagggtgttacaaaaactgaattctattctaacccagccgtggcggctgcatgtcaacatgggtactacgctccatagagtgacaaccatctccatggccaggtgtaccttgacactattgaagactatgttaactgagctactgcgcggtgggtcctttgaatttaaagacatgagagtcccctctgccctggttactttacacatgctgctctgttctatccctctttctggcagattggacagcgacgaacaaaaaattcagaatgacatcattgacatcctgttgacctttacacaaggagtaaacgaaaagttgaccataagcgaagagactctcgcaaacaatacctggagcttgatgctgaaggaggtgctgtcctctattctgaaagtgcctgaaggcttctttagcgggttaatcctgctctccgagttactccccctgcccttaccgatgcagacaacccaggtaatcgagcctcatgacatttccgttgctctgaacacaagaaaactgtggagtatgcacttgcacgtgcaagcaaagcttcttcaggagattgtccgatccttctcgggaacaacatgccaacccatacagcacatgctcaggcgtatatgcgtgcagctctgcgacctagctagccccactgcactgctgatcatgaggacggtgctagacctaatcgtggaagacttgcagagcacttcagaagataaagagaagcagtacacaagtcaaaccaccagattgctggctctgcttgacgctctcgcttcccacaaggcctgcaaactagccatcctccaccttatcaacggtacaatcaagggtgacgaaaggtatgccgagatcttccaggatcttcttgccctggttagatctcctggtgactctgtaattaggcagcagtgtgtagagtacgttacatccatactgcagtccctctgtgaccaggatatcgctctcatcttgcctagctcatctgaaggttcaatttcagagctcgaacagcttagcaactcgcttccaaataaggagctgatgacgtcaatctgcgattgtctactggcgacactggcaaattctgagagcagttacaactgtctcctcacgtgtgtaagaacaatgatgttcctcgctgagcacgattatggcttgtttcacctgaaatcaagcctgaggaagaattcttctgcgcttcacagcctactgaagagagtggtctccacttttagtaaagacactggggagctcgccagttccttccttgagttcatgaggcaaatcctgaatagcgacaccattggatgctgcggggatgacaacggcctcatggaggtggaaggagcgcatactagccgaacaatgtctatcaacgctgctgaattgaaacagttattgcaatcgaaggaagagtccccagagaacctgtttctggagcttgaaaagctcgtgttggaacattccaaggacgatgacaatcttgatagtttgctggattcagtggtgggtctgaaacagatgctggagagtagcggtgatccgctgcccctgagtgatcaggatgtagaaccagtactctctgctcctgaaagccttcagaatctgttcaacaaccgcactgcctatgtgctggcggacgtgatggacgatcagctcaagagcatgtggttcacacccttccaggccgaagagattgatactgacttggacctagtgaaggtggaccttatcgagctgtcagaaaaatgctgcagcgattttgaccttcattccgaattggagagatcctttttgtctgagccgtcaagtcccggtaggactaagacaacgaaggggttcaagcttgggaaacacaagcatgaaaccttcatcactagctccggcaaatccgaatacatcgaaccggctaaacgcgctcatgttgtccccccacctaggggcaggggcagggggggatttggacagggcattagaccgcacgatatcttccgacagcgcaaacagaatacatcccgacccccaagtatgcacgtagacgatttcgtagccgctgaaagcaaagaggttgtgccacaggacggaatcccgcctccaaagaggccacttaaagtatcacaaaagatcagttcccgaggtggctttagcggcaatcggggaggcagaggcgcatttcattcccagaataggtttttcacaccaccagcaagcaaggggaactacagccggcgagaaggtaccagaggatcctcgtggagtgcacagaacacgcctaggggcaactacaacgagagccggggtggccagtccaactttaatcggggacccttacccccactccgccctctaagctccacagggtacagaccttcgcctagagatagagcatctcgagggaggggaggcctgggaccatcctgggctagtgccaattccggaagcggagggtcgagaggtaaatttgtctctgggggttccggccgtgggagacatgtccggagcttcacccgatag

SEQ ID NO: 23992 - DNA, 1038 bp, Artificial Sequence
  Description of Artificial Sequence: Synthetic coding sequence
atgaaacagttaaagcggaagcgaaagagcaacttttccgtccaggagactcagactctgcttaaagagattactaagcggaaagaagtaattttttcaaagcagctgaacacaacaatcaacgttatgaagcgaatggcatgggaagaaatcgcgcaatgcgtgaacgctgttggcgagggagaacagaggacaggaaccgaagtgaaacgtaggtatctcgattggcgtgccctaatgaaacgaaaaagaatgaaggccaacattaaactggtggggtcaggcttcccccttccctcttccgacctggatgatagccttaccgaagagattgacgaaaaaattggattccgcaatgacgccaattttgattggcagaacgtggccgatttccgggatgccggaggaagtcttactgaggtcaaagtggaggaagaggagagggacccacagtcacctgaatttgagatcgaagaagaggaggagatgctgtcatccgtgatcccagattcccgacgagaaaacgaactgcccgatttcccccatattgacgaattctttacactcaattctactccaagtcggtctgcttacgacgaaccccaccttttggtgaatatcgaaaaacagaagctagaattagaaaagagaagacttgacatagaagcagagagactgcaagtggagaaagaacgattacagatcgaaaaggaaaggttgcggcaccttgacatggaacacgaacgcctgcagttagagaaggaacgactgcagatcgagcgcgagaaactgaggctgcagatagtcaatagtgaaaaaccctccctcgaaaacgagctggggcaaggggagaagtccatgttgcagccacaggacattgaaactgaaaagctcaagctggagcgcgaaagactgcagctggagaaggacaggctgcagttcttgaagttcgaatctgagaaactgcaaatcgaaaaggaaaggttacaggtcgaaaaggaccgcctgaggatccaaaaggaagggcacctgcagtag

SEQ ID NO: 23993 - DNA, 6737 bp, Artificial Sequence
  Description of Artificial Sequence: Synthetic coding sequence
atgcctgagatgaccgaaaatgaaaccccaactaaaaaacaacaccgcaaaaagaatcgagagacgcacaatgccgttgaacgtcatcggaaaaagaagattaacgcagggatcaacaggatcggcgagcttattccgtgttctccagcgttgaaacaatctaaaaatatgattctggatcaggctttcaaatatatcacagagttgaaacggcagaacgacgaactgctcttgaatggaggtaataatgaacaggcggaggagattaagaaactgcgcaagcaactcgaagagatccagaaagaaaatggacggtacatagaactgctcaaagctaatgacatctgcttgtatgatgaccctaccatccattggaagggcaacctcaagaattccaaggtgtcagtggtgataccttcagaccaggtgcagaagaaaattattgtctacagtaatggcaatcagcctggcggaaatagtcagggaaccgcggtacagggaatcactttcaacgtgtctcacaaccttcagaaacagaccgctaacgttgtgcccgtccagcgcacatgcaacctcgtcactccagtcagtatcagcggcgtgtatccttccgagaacaaaccctggcatcagacaaccgtcccagcgttagccaccaaccaaccagtgcccttgtgtctccccgcagccatctctgctcaatcaatcttggagttaccaacatctgaatctgagagcaatgtgcttggagctacctccggcagtctcattgccgtcagcattgagagcgagccccatcagcaccattcactccacacctgtctgaatgatcagaatagttcggagaataaaaacggccaggagaatcctaaggttctgaaaaagatgacaccttgcgtgacgaatattcctcacagctcctctgctacagccacaaaggtacatcatgggaacaagtcatgtctgtcgatccaggactttcgaggagacttccaaaacaccttcgttgtctctgtaactacaactgtatgcagtcagcccccacggactgctggagactcttctccgatgtcaatctccaaatcagctgatctgaccagcacagccaccgttgtcgctagctcggcgccaggcgtgggaaaggcgacaattccgatttccacactcagtgggaatcctttggataatgggtggaccctttcttgctctctgccatcaagctccgtctctactagcgatcttaaaaatatcaactcactgactagaatctcctcagccggaaatacccagacgacttggaccactctgcagctggctggaaacactatacaacctctgagccagacacctagctctgcagtgacaccagttttgaatgaatcaggcacatccccgacgacctccaatcactcacgatacgtggctacggatatcaatcttaacaactcatttcccgctgacggacagcctgtggaacaagtggtcgtgaccctgccatcctgcccgagcttacctatgcagcctctcattgcgcagccacaggtgaaatcacagcctccgaaaaacatcctgcccctgaactccgcaatgcaggtgattcaaatggcccagccagttggcagcgccgtgaactccgccccaactaatcagaatgtaattattttacaacccccaagtacaacaccatgccctaccgtgatgagggcagaagtgtcaaaccagaccgtgggccagcaaatagtgatcatccaagcagccaaccagaatccactgcccctgctgcctgcaccaccaccgggatccgttcgcctgccaattaatggggcaaataccgtcatagggtctaacaactccgtccagaacgtacctactccacagaccttcggcggtaagcatctggtgcacatcttaccgcgaccaagctcactttctgcaagtaactcaactcagactttcagcgttactatgagcaatcaacaaccacaaacgattagcttgaacgggcaattgttcgctttgcagcccgtcatgtcttcttccggaactacgaatcagacacccatgcagatcattcagcctacaacctccgaggaccctaacactaacgtcgccctgaacacgtttggcgcactggcttctttgaaccagagtataagccagatggcaggtcagagttgcgtgcagttgagcatcagccagcctgcaaattcacagaccgctgcaaattcccaaaccacgactgccaactgtgtgagcctcactaccaccgccgctcctcctgttaccaccgacagctcagccacactcgctagcacctataatctggtgtcaacaagctctatgaatacagtcgcctgcctgccaaacatgaagtctaagaggctgaataaaaaaccaggcggacgcaaacacctggcggcaaataagtccgcttgccccctaaattcggtgcgggacgtgtcaaaacttgattgccccaacactgagggcagtgctgagcctccctgcaatgatggccttttggagtcatttccggcagtgcttccgtccgtctccgtcagccaggctaattctgtgtctgtctccgcatcacattcactcggcgttttgagcagcgaatctttgatcccggaaagcgtctccaaatccaagtcggcagagaagtcctccccccctagccaggaatccgtgacttcagagcatttcgccatggccgctgccaagagcaaggactctaccccaaatctacagcaggagaccagtcaggacaaaccgccttcctccctcgcactgagcgacgctgctaagccatgcgcttctgccaacgtgctgattccttcaccctccgatcctcacattctcgtgagccaggtaccaggtttgtctagcacgacatccactacatcaaccgactgtgtgtccgaggtagagattatagccgagccttgccgcgtggaacaagattccagcgataccatgcagacgaccgggctgctaaaaggccaagggctgaccaccctgctgtccgatttagctaagaaaaaaaacccacagaagagctctctttccgaccaaatggatcatcccgacttttcaagcgaaaatccaaaaatcgttgacagttccgtgaatcttcatcccaaacaggagctgctgctgatgaacaacgacgacagggatcccccacaacatcactcttgtctgcctgaccaagaagtgatcaacggctctctgattaacggcaggcaagccgacagcccaatgagtacctcaagtggcagctcaaggtcattttcagtggcttctatgttacccgaaacaaccagagaggatgtgacatcgaacgccaccaccaacacctgcgactcatgtacgttcgtggagcagaccgacattgtggccctagcagcccgagccatcttcgaccaggaaaatctggaaaagggcagagtgggtctgcaggccgatatacgcgaagtggctagcaagccctccgaagcttcccttctggagggagacccgcctttcaagtcccagattccgaaagagtccggtacgggacaggcagaagctacgcccaacgagtttaactcccaaggatctatcgaggccaccatggaaagacccttagagaaaccaagttgttctctgggaatcaaaacctctaatgcaagcctgcaggacagcacgtcacagccacctagtattacgtcgctaagtgtgaacaatctgatccaccagtcctccatttctcatcccttggcttcctgtgccggactctctcctacttcagagcaaaccaccgttcctgctacagttaacctgacggtgtcttctagttcttatggctctcaacctccgggaccctcactcatgaccgaatactcccaagagcagctgaacacaatgactagcaccattcccaactctcagatacaagagcccctgctgaagccgtcccatgagagtcggaaggactccgcaaagcgggctgttcaggacgatttgctgctgtcctccgcaaaacgccagaaacactgccaacctgcgccactgagactcgaatcaatgagtctcatgagccggacgcctgatacgatcagcgaccagacgcaaatgatggtcagtcagattccacctaattcttccaactctgtggtgcctgtgtccaatcctgcccatggggacggcctaactcgactcttccccccatccaataacttcgtcacaccagccctgagacagacagaggtgcaatgcggttcacagccctcagtggctgaacagcagcagactcaagcttcacagcacctgcaagctctgcagcagcatgtccccgcacaaggggtcagccatctccattccaatcatctctatattaagcaacaacagcagcagcagcagcagcagcagcagcagcaacaacaacaacaagctggacagctgcgcgagaggcaccacctgtatcagatgcagcaccacgtgccacacgcggaatcctccgtgcattcccagccacacaacgtgcatcaacagagaaccttacagcaggaagtgcagatgcagaagaagaggaatctcgttcaaggcacccagacctcccagctaagtctgcaaccgaagcatcatggaactgaccagtcacgttccaagacgggacagcctcaccctcaccatcaacagatgcagcagcagatgcagcagcactttggcagcagccagaccgagaagtcttgtgaaaatcctagcacctcacggaatcaccacaaccaccctcaaaaccatctgaaccaagacatcatgcatcagcagcaggacgtggggagcagacagcaagggtccggggtgagttccgaacatgtgagtggacacaatccaatgcaacggctgctgaccagtcgaggcttggagcagcagatggtgagtcagccttctatcgtgacaagaagttctgatatgacttgcactccgcataggcctgaaagaaaccgggttagtagctacagtgccgaggccctcattggcaagacctccagcaattctgagcaaagaatgggaataagcatccaaggtagcagagttagcgaccaactcgagatgagatcttacttagacgtccctcggaataaaagcctagccatccataatatgcaggggagagttgaccataccgtggcatccgacattcgcctgagtgactgccagacattcaagccctccggggcttcccaacagccgcagtctaattttgaggtgcaaagctcgcgcaacaatgagatcggtaacccagtgagtagcctcaggtccatgcaaagccaagccttccgaatttcacaaaatactggaccccctccgatcgaccgccagaagaggctaagctatccaccagtgcagagtattcctactggcaatggcatcccatctagagattccgagaacacatgccatcaaagctttatgcaaagtctgctggcccctcacctgtccgatcaggtcatcggatcgcaacggtcgcttagtgaacatcagcggaacacccagtgtgggccatccagtgccatcgagtataactgcccgcctacccacgagaacgtgcacatccggagagagtctgaatcacagaaccgtgaatcttgtgatatgtccctcggcgctattaatactcgaaacagcactctgaatattccattcagttcgtcatcctcttcaggtgatatacagggacgcaacacctcacccaatgtctccgttcaaaaatctaaccccatgaggatcaccgaaagccacgccactaagggtcatatgaacccgccagtgactactaatatgcatggagtcgccaggcccgcactcccacacccttccgtgagccacgggaacggcgaccagggccctgcagttcggcaagccaactcctccgtgccccaacgctcaagacatcccctgcaggacagctcagggtccaaaattcgccagccggagcggaaccggtcaggcaaccagagacagagcacggtctttgatccttccctccctcacttgcctctatcaactggtgggtctatgatactcggacggcagcaaccggcaaccgaaaaaagaggttccattgtgcggttcatgcctgacagcccccaggtgcctaatgacaattctggccctgaccagcacaccctgagccagaatttcggattctcctttatcccggagggcggaatgaatcctcccatcaacgccaatgcatctttcatacctcaagttacccagccaagcgcaacaaggaccccggctctgattcctgtggacccccagaataccctgccaagtttctatcctccgtattctccagctcaccccaccctgtctaatgatatcagtatcccctatttcccaaatcagatgttctcaaacccaagtacagagaaggtgaactctgggagcctcaacaatcggtttggttccatcctgagcccccctcgcccagtgggttttgctcagcccagttttcctctactgccggacatgccaccaatgcacatgaccaattctcatctgtccaacttcaatatgacatccctctttccggagatcgcaacagtgttgccagacggaagtgccatgtcgcctcttctgaccatcgcaaatagctctgcgtccgacagctcaaagcagtccagcaaccggccagcccacaatatatcacatattcttggtcatgattgctcctctgcagtgta

SEQ ID NO: 23994 - DNA, 3444 bp, Artificial Sequence
  Description of Artificial Sequence: Synthetic coding sequence
atggcagtagattccgctatggaactcctgtttttggataccttcaagcacccgtccgccgaacaaagttctcacattgacgtcgtacgttttccatgcgtggtctacattaacgaggtgcgtgtgattcctcccggtgtgagggcacacagcagtttgcctgacaaccgcgcttacggagaaacctccccccataccttccagcttgacctctttttcaacaacgtgtccaagccaagcgcacccgtgttcgataggctaggcagcttggagtacgatgagaatacaagtattattttcagaccgaattcaaaggtgaacaccgacggtttggttctgagaggatggtataattgcttgaccctggctatttacgggtctgtcgatagggtgatatcccatgatcgagattcccctccacccccaccacctcctcctcctcctccacaaccacagccttctctcaagcgcaaccccaagcacgctgacggggaaaaagaggatcaatttaacggatcacccccacgacctcagccccgtgggccacgcaccccccctggacctcctcccccagacgacgatgaggacgacccagtccccttgcctgtgagcggggataaggaggaagatgctcctcaccgagaagattacttcgagcccatatcacctgaccgaaattccgtgccccaggaagggcagtactcagacgagggcgaggtcgaggaggaacaacaggaagaaggagaggaggacgaagatgatgtggacgtggaggaagaggaggatgaagatgaagatgatcggcgtaccgtagatagcattcccgaggaggaggaagaagacgaggaagaggaaggcgaggaggatgaagagggggagggcgacgatggctatgaacagattagttccgatgaggacgggatcgcagatctggaacgcgagactttcaaatatccaaattttgacgtcgaatataccgcagaagatctagcgtcagtaccacccatgacatatgatccatatgaccgggagctggtgccactgctgtatttcagttgcccgtacaagacaaccttcgagatcgagatttctaggatgaaagatcaaggccctgacaaggaaaacagcggggcaattgaagcaagcgtgaagttgacagagcttttagacctatacagagaggatagaggagcaaaatgggtgaccgctctggaagagatacctagtctcattatcaagggacttagctatctacagctaaaaaacactaagcaggactccctgggacagttagtcgactggacgatgcaggccctcaatctgcaagtggccctgagacagcccatcgccctcaacgttcgccagctcaaggctgggacaaagctggtgagctccctggctgaatgcggcgcacaaggcgttaccggtttgcttcaggctggcgtcatctctgggctctttgagttactattcgctgatcacgtgtccagcagcctcaagctgaacgcttttaaggctctggatagtgtgattagcatgaccgagggaatggaggcattccttcggggaagacaaaacgaaaagtcagggtatcagaagcttctagaacttattctgttggaccagaccgttagggtcgtgactgccggaagtgccatcctacagaaatgtcacttttacgaagtgctgtcggagattaagagactgggtgaccatctggcagagaagacctcctctctgcccaatcacagtgaaccggaccacgacacagacgcaggactggagcgcaccaacccggagtacgagaatgaggtcgaagcatcaatggacatggacctgctggaaagtagtaatatatctgagggagaaatcgaaagactgatcaacctccttgaggaagtgtttcacctcatggaaactgcaccccatacaatgatccagcagcctgtgaagtcttttcctacaatggcaaggatcacgggtcctcccgagagggacgacccctatcctgtcctttttagatatttgcatagccatcactttcttgagttggtaaccctcctgctgagtattcccgtaactagtgcccatcctggcgttctccaggctactaaagatgtactcaagttcctggcacagagccagaaaggactactattttttatgagtgagtacgaggcgactaacctccttattagagccttatgccacttctatgaccaggacgaagaagaagggctgcaaagcgacggagtcattgacgacgcattcgcactctggcttcaggacagtacccagaccctgcagtgtatcacagagctcttctcacatttccaaaggtgtacagcctctgaggagactgaccactcagatctgttgggcaccctgcataacctctatctgatcacttttaacccggtgggacgcagcgccgtgggccacgtgtttagtttggaaaagaacctacagtcccttatcacactcatggaatactatagcaaggaggccctgggggacagtaagagtaagaagagcgtggcctataactatgcctgcatcctcatccttgttgtggtgcagagcagttccgacgtgcagatgctcgagcaacacgcagctagtcttttgaagctgtgcaaagctgacgaaaataacgcaaaactccaggaactgggaaagtggctggaacctctcaaaaatctcaggttcgagatcaattgcatcccaaatctcatcgaatatgttaaacagaatattgataatctgatgacgcctgaaggagtgggccttacaaccgccttgagagtcctgtgtaacgtggcttgcccccctcctcccgttgaagggcaacagaaggacctaaagtggaatttggcggtgatacagttgttttctgcagaggggatggatacttttattagagtgcttcaaaagcttaattctattctcacacaaccttggagattgcacgttaatatgggaaccacacttcatcgcgtgactaccatttctatggcacggtgcaccctaacacttctgaagacgatgttaactgagctgctgagaggtgggtcctttgaatttaaggacatgagagtgccttcagcccttgtcacactccacatgctgctgtgctccatccctttgtcgggaaggctcgactcagatgaacaaaaaattcaaaatgatattattgacatactgctgacattcactcaaggcgtgaacgagaaattaaccatctcagaagagacactggcaaacaacacctggtctctgatgctgaaggaggtcctctcctcaatcctaaaagtccctgaggggttttttagtgggttaatcttgctttctgagctgttgccgctccctttgcccatgcagaccactcaagtttctttgccgtacaacatgcacttaattaacgactgtagtaacactttttag

SEQ ID NO: 23995 - DNA, 4134 bp, Artificial Sequence
  Description of Artificial Sequence: Synthetic coding sequence
atggcagtagacagcgccatggagctcctgtttctggatacttttaagcacccttctgccgagcaaagttcacacatcgacgtagtgcgctttccctgtgtggtatatatcaacgaggttcgggtcattccgccaggcgtgagggcacatagttctttgcctgacaatcgcgcttatggagaaacttcccctcatacattccagttggacctctttttcaacaatgtgtctaaaccttcagcccctgtgttcgaccgcctgggttcccttgaatatgacgaaaatacatcgattatcttcaggcctaattctaaggtcaataccgatggcctcgtgctgagggggtggtataactgtctgaccctcgctatctatggctcagtcgatcgtgtaatttcacatgacagagactctccacctcccccaccccctcccccaccccctccacagccacagccttcattgaagaggaatccaaaacacgccgacggagaaaaagaagaccagtttaatgggtcaccacctaggccccagcctagggggccacggacaccaccagggccacccccacccgatgatgacgaagatgaccctgtaccacttccagtttcaggtgacaaagaggaagacgcaccacatagggaggactatttcgaaccaatctctcccgacaggaacagtgtgccgcaggaggggcaatatagcgacgaaggagaagtcgaagaggaacagcaggaagagggagaagaagacgaggacgacgtagatgtggaagaagaggaagacgaagatgaggatgaccggagaactgtggattccatcccagaggaagaagaggaagacgaagaagaagaaggggaggaagatgaagagggcgagggtgacgacggctacgaacagatcagctcagacgaagacgggatagccgatctggaacgggaaacctttaagtatccgaatttcgatgtggaatacaccgccgaggacctagcgagcgtccctcccatgacatacgacccatatgacagagagctggtccccctgctctatttctcatgcccatataagactacatttgagatcgaaatcagtcgaatgaaggaccagggtcctgataaagaaaattcgggagcgattgaggcatctgtcaagctaactgaactgttagacttgtatcgggaagacagaggggcaaaatgggtgaccgctcttgaggaaattccttccctgattataaagggtctgtcttatctgcaattgaaaaatactaagcaagactcccttggacaactggtagactggactatgcaggccttaaatctccaggtagccctcagacaacctattgctctgaatgtgcggcagctgaaagcgggaacgaagcttgtgtcgtccctggcggagtgtggggctcagggcgtgaccgggctgctgcaggcaggcgtcatcagcggactcttcgagctgctgttcgcagatcatgtcagcagcagcttaaaactgaacgctttcaaggccctggactctgtgatcagcatgaccgaaggaatggaggcctttctgcgtggaaggcagaacgaaaagtctgggtatcagaagttacttgagctgatcctgctggatcaaaccgtgcgcgtggtaacggccggttccgccatactgcagaagtgtcatttctacgaggtgttatctgaaatcaagagacttggcgaccacttggccgagaaaaccagctccctgccaaaccattccgaacccgaccacgatactgacgctggcctcgagagaacaaaccctgagtatgagaatgaggtggaagcaagcatggatatggaccttctcgagagtagtaatattagtgagggggaaatcgagcgccttatcaatcttttggaagaggtgttccatctcatggagaccgctcctcacaccatgattcagcagcccgtcaaaagtttcccgaccatggctcgcattacaggccctcctgaacgggatgacccctaccctgtactcttccgctatctgcactcacatcattttctggaactggtgacgttgttgctgagtatccctgtgacatccgcccacccaggagtattgcaagcaacaaaagacgtgcttaagttcttggctcagtcccagaagggcctcctgttttttatgagcgagtatgaagccaccaacttgctgatccgggctctgtgccacttttacgaccaagatgaggaggagggcctgcagagcgatggagtgattgatgatgccttcgcactgtggctacaggatagcactcagaccctccagtgcattaccgaactgtttagccattttcagagatgtacagcctcagaggagactgaccatagtgatcttcttggtaccctccataacctatacctgattacttttaaccccgttggacgtagtgctgtcggccatgtgttttcacttgaaaaaaaccttcagtcactgataacactgatggaatactacagtaaggaagctctgggcgattctaagtccaagaaatctgttgcatacaactacgcttgcatccttattctcgtagtcgtgcagagtagctcagatgtccagatgctcgagcagcatgccgcatctttgttaaaactgtgcaaggcagacgagaataatgcaaagctacaagagttgggcaagtggttggagcccctcaaaaatctgcgtttcgagatcaattgtatccccaacctcatcgaatatgtcaaacagaatatcgacaatcttatgacaccagagggtgtggggctaaccaccgcactgcgcgttctgtgtaacgtagcctgcccacctcctcctgtggaagggcagcaaaaagatctaaaatggaacctcgcggttatccagctcttcagtgctgaagggatggacacattcattcgagtgctgcaaaaactgaactccatcctgacacagccctggcggctccacgtgaacatggggacgactctgcatcgagtaaccaccatctctatggccaggtgcaccttaacactgctgaaaacaatgttaactgagctactgcgtgggggatccttcgagtttaaagacatgagggtgccctcagctcttgttacactccacatgttgctatgtagcatacccctgtcaggaagactggactctgatgagcagaagatccagaatgacattatagacatcttacttactttcacccagggggtgaacgagaaactcacaattagtgaagagacactggcgaataacacctggtctctgatgctgaaggaagtcctcagttccattctgaaagtgcctgagggctttttttctgggctgattttgttgtctgaactgttgcccctgccacttcctatgcagactacccaggttatcgagccccacgacatttctgttgccctgaatacgcgaaaactgtggagcatgcatcttcacgtgcaggccaagttactgcaggaaattgtaagatcttttagcgggacaacttgccagcctatccagcacatgctgagaagaatctgcgtgcagctctgcgacctggcatctccaaccgcactactcattatgagaacagtgctggacctcattgtggaagatctgcagtcaacatcggaggataaagaaaaacagtacacttcccaaaccactaggctcttggcattgctcgatgcccttgcctcccataaagcttgcaaactggcgatacttcacctgattaacggtaccatcaaaggagacgaaaggtacgctgaaattttccaagatttactagccctcgtgagaagccctggcgactcagttatcagacaacaatgcgtggaatatgtcacaagtatactccagtctctttgcgaccaggacattgcgctgatcctgccatcctcttctgaaggatctatcagcgaactggaacagctttctaattctttgcctaacaaggaactcatgacaagcatctgcgattgtttactggcaaccctggccaatagcgagagtagctataattgtcttctgacctgcgtgcgcactatgatgttcctcgctgagcacgactatggtctgttccacttgaaacgggatgccgtcgagatgataatggtaagctggaagtag

SEQ ID NO: 23996 - DNA, 288 bp, Artificial Sequence
  Description of Artificial Sequence: Synthetic coding sequence
atggcagatgagaaaccaaaggagggggtgaaaaccgagaataatgaccacatcaacttgaaggtggctggccaggacggaagtgtggtacagtttaaaataaaacggcacacgcccctgtccaagctgatgaaagcatactgtgagaggcagggtctctccgtacgccagattagattccgatttgatggccagccgattaatgagactgatacgccagcacagttagagatggaagacgaagataccattgatgtttttcagcagcaaacagggggagtatactag

SEQ ID NO: 23997 - DNA, 6737 bp, Artificial Sequence
  Description of Artificial Sequence: Synthetic coding sequence
atgccggaaatgacggagaatgagacacccactaaaaagcagcatcgcaaaaagaacagagagacccataacgcagtggagcggcacaggaaaaaaaagatcaatgccggaattaacaggattggcgagctgattccctgtagtcccgctctgaagcaatcaaagaatatgatactcgaccaagcctttaaatatataaccgagctgaaaagacaaaacgatgagctgctgttaaatggaggcaacaacgaacaagcagaggaaattaaaaaactgcggaagcagttggaagagattcagaaggaaaatggcagatacattgagctgctaaaagccaacgacatctgcctctacgacgacccgaccattcattggaagggcaatctgaagaactcgaaggtcagcgttgtgatcccgtctgatcaggtgcagaaaaagatcatcgtgtactccaatggtaatcagcccggtgggaactctcagggtactgcagtgcagggtattacctttaatgtatcccacaatcttcagaagcagaccgccaatgtggtgccagtccaacggacttgcaacttggttactcccgtatctatcagtggtgtctacccaagcgagaacaagccatggcaccagactacagtaccagccctggcaaccaatcagcccgtgccactgtgcctgcccgctgcaatcagcgctcaatccatcctggaacttcctaccagcgagtccgagagcaatgttctgggagcaaccagcggatccctgatcgccgtctccatcgagagcgaaccccatcaacaccacagcctgcacacctgcttaaacgatcaaaactccagtgagaacaaaaatgggcaagaaaatcccaaagtgctcaaaaaaatgacaccgtgcgtcacgaacatcccacactctagctccgctactgctaccaaagtccatcacggaaacaaaagctgtctgtcaatccaggattttcggggagactttcagaacacctttgttgtttccgtgacgacgacagtgtgcagtcagccccctcggactgccggtgatagcagcccaatgtccatttctaagtccgccgacctgacttcaacggccactgttgtagcttccagcgcgcctggcgtcggcaaggcgacaatccccatctcaactttgtccggaaacccattggataacggctggacgctctcctgttcccttcctagttctagcgtgagtacatcggaccttaaaaatataaattcactgaccaggattagcagcgccggtaacactcagacgacttggaccacattgcagctggccggaaacactatccagcccctgtcccaaacgccaagcagcgcggtaacccccgtcctgaacgagtctggaacgtctcctacaacctcaaaccactctcgctatgtcgccacagatattaacctgaataacagcttccccgcagacggacagcccgtggaacaggttgtggtgacgcttcccagttgtccaagcctgccaatgcagccgcttatagctcagccccaggtcaaatcacaacctcccaaaaatatcttgccgttgaattcagcaatgcaggtgatccagatggctcagcccgttggctctgcagtgaactccgctccaactaaccagaacgttatcatcttgcaacccccatctactacgccctgccccacagtaatgcgcgctgaagtgtcgaatcagactgtaggccagcagatagtgatcattcaggcagccaaccagaacccccttcctctgctgccagcgccaccccctgggtccgtcagactgcctatcaacggagcaaacactgtgatcgggagcaacaactccgtgcagaatgtgcctacaccccagactttcggaggtaaacacctggtgcatattctcccaagaccttccagcctgtccgccagcaactctacgcagacattctccgtcacaatgagtaaccagcaacctcagaccatttcgctgaacggacagttgtttgctttgcaacctgtgatgtcttcgagtggcaccactaatcagactcctatgcagataatccaaccaacaacatcagaagacccaaacactaacgtggccctgaacacctttggagccttggcttctctaaatcagtccatttctcagatggcagggcaaagttgtgttcaactaagtattagtcagcccgctaactcccagactgctgctaactcccagaccacaacggccaactgcgtgtctctgactacgacagccgctcccccagttactaccgattcctcagcgaccctggcatccacttacaatctagtctcgacctcttcaatgaacaccgttgcatgtttaccaaatatgaagagcaagcgcttaaacaagaagccagggggacgaaaacaccttgccgcaaataagtccgcatgccccctgaactctgtacgagacgtcagcaagctggattgtccaaacaccgagggcagcgctgagccaccctgcaatgatggcctgctggaatccttccccgctgtcttgccaagtgtttcagtgtcccaggccaattctgtgtctgtgtcagcttctcactcactgggggtgctctcctcagaatctctgataccagagagcgtctcaaaatcaaagagcgccgaaaagagttcgcccccatctcaggaaagcgtgaccagcgagcactttgctatggccgcagcaaaatcaaaggattccacccccaatctgcagcaggagacgagccaggacaaaccaccctcatcactcgcattaagcgatgccgcaaaaccatgtgcctccgccaacgtgctaatacccagtcctagcgaccctcacatacttgtgagccaagttccagggctttcctctactacatcaactaccagcacagattgtgtatctgaggttgaaattattgcagagccctgccgggtcgagcaggactctagcgacactatgcaaaccaccggcctgctaaaaggccaggggttgactacactgttatccgacctcgccaaaaagaagaacccccagaagagctccctgtccgatcagatggatcatcccgatttctctagcgagaatccaaaaatagtggatagctccgttaatctgcaccctaaacaggagctgttgctgatgaacaacgacgatcgggacccacctcagcaccatagctgcctgccagaccaagaggtgatcaacggcagcctcatcaatgggaggcaagctgacagccccatgagtacttcatctgggtcatcccgaagcttctccgtagctagcatgctgcccgagaccacccgggaggatgtcacatcgaatgcaacaaccaacacgtgcgattcttgtacatttgtggaacaaacggatattgtagctttagcagcacgagctatatttgaccaggagaacctggagaaaggacgggtgggtcttcaagcagacattagggaggtcgcctctaagccctccgaggctagtctgctggaaggggatcctccattcaaatcacaaatcccaaaggagtctgggactggccaggcagaagcaaccccaaatgagttcaatagccagggcagcatcgaggccaccatggagcgacccctggagaaaccttcgtgcagcctcggtataaagaccagtaatgcttcactgcaggacagtaccagccagcctccctccattactagcctctcagtcaataatctcatacaccaatcctccatcagccacccgctggcgagctgcgctggcctcagccccacttccgaacagaccaccgtccctgccacagttaacttaacggtgtcttcatcgagctatgggtctcagccaccgggtccatcattgatgacggagtacagtcaagagcagttaaatactatgacaagcacaatcccgaattcacagattcaagagcctctcctaaagccttcccacgagtcacgcaaggacagcgccaaacgcgcagtgcaggatgacttgctcctgtcttccgccaagcgccagaagcactgtcagccagcacccctccgtctcgagtcaatgagcttaatgtctcgtacacccgacacaatcagcgaccagacacagatgatggtttcccagatccctcctaatagcagtaactccgtggtgcccgtgtctaaccccgctcatggtgacggtctcacacggctgtttcccccaagcaataatttcgtaactcccgctctgcggcagactgaggtgcaatgtggtagtcagccttcggtagccgaacagcaacagacccaagctagccaacatctgcaggccctccagcagcacgtgcctgctcagggagtgagccacctgcacagcaaccacctgtacattaagcaacagcagcagcagcagcagcagcagcagcagcaacagcagcagcagcaggctgggcagcttcgcgaacgccatcacctgtaccaaatgcagcaccacgttccacatgccgagagttcagttcattctcagccacataacgtgcatcagcaaagaacccttcagcaggaagtacaaatgcaaaagaaacggaatctcgtgcaaggcacacagacttcccagctctccctccaaccaaagcaccacggaaccgatcagtcaagaagcaaaaccgggcaacctcacccacatcaccagcagatgcagcagcaaatgcagcagcattttgggagtagccagacggagaagtcttgtgagaacccgagtaccagccggaaccatcacaaccacccccagaaccacctcaaccaggatataatgcaccagcagcaagatgtgggttccaggcagcagggtagtggtgtgagctcagaacatgtttctggtcacaatccaatgcagagattgctgaccagccggggactcgagcagcagatggtaagccagccatcaatcgtgacacgttcctctgatatgacatgcacccctcatcgacccgagcgtaatcgggtgtcatcttattctgctgaggcactgatcggtaagacctcatctaattctgaacagcggatgggaatctcaatccaaggatccagagtgagtgatcaacttgagatgagaagctatctggatgtcccaaggaataagtctttggctatacacaatatgcagggaagggttgaccacacagttgcatcagatattcggctgagcgactgccagactttcaagccctccggggcatcccagcaaccccagagcaattttgaagtgcagagctcaaggaacaatgagatcggaaatcctgtgagctccctgaggagcatgcagtctcaggccttcaggatttcccaaaatacagggccacccccaatcgatcgccagaagcgtctgtcatatccacccgtccagtccatcccgactggcaatggaattccaagtcgggattccgagaacacctgtcaccagtcttttatgcaaagtctgcttgcccctcaccttagcgaccaggtcatcggcagccagaggagtctcagtgaacatcagaggaacacacagtgcggtccatcttccgctattgagtataattgccccccaacacacgagaatgtgcatatacgtagagaaagtgaaagccagaatagagagtcttgtgatatgagtctgggtgcaattaacacacgtaattcaacactgaatataccgttttcttcttccagctcatcaggtgatatccagggacggaatacctctcctaacgttagcgttcagaagtcaaacccaatgcgcatcactgaaagtcatgctacaaaaggccatatgaaccccccagtcacaactaatatgcatggagtggcgagacctgctctgcctcaccctagtgtgtcccatggaaacggtgatcaaggcccagcagtaagacaggccaactcctcagtgcctcagaggtcccgccatcctctgcaggatagctccggctccaaaattcggcagcctgaaagaaatcgttctggtaatcaacgccagtctacagtgtttgacccctctctaccccatcttcccctcagcacaggtgggtctatgattctcggcaggcagcagcctgcaactgaaaaacggggatccatagttcggtttatgcctgactcaccgcaggttcctaacgacaactcgggacccgaccaacacactctctcccaaaactttggtttttcattcattcctgagggcggtatgaatcctccaattaacgctaatgctagcttcattccccaggtcactcagcccagcgctacccgtacccctgcactcatcccagtggatccccagaacaccctcccttctttctacccaccttactcccccgcacaccctacgctctctaacgatatctctatcccctattttcccaatcagatgttctctaacccctcaacagagaaagtcaacagcggtagtttgaataacagatttggttctatcctcagtccaccgaggcccgttggatttgcgcagccctccttcccattgctgcccgacatgcccccaatgcatatgaccaacagccacttgtccaacttcaatatgaccagcctgtttccagagatcgccactgtcctccccgacggttccgcgatgagtcccctgctaactatcgccaactcatcagcttcagattctagtaaacagtcaagcaaccgtcccgcacacaatatctcccacatcttggggcatgactgtagctctgcagtgta

SEQ ID NO: 23998 - DNA, 216 bp, Artificial Sequence
  Description of Artificial Sequence: Synthetic coding sequence
atgaagcaactgaagcgaaagcggaaatcaaacttctccgtacaagagacacagacgttgctcaaggaaattaccaagcgtaaagaagtgattttcagcaagcagttgaacacaaccattaatgtgatgaagcggatggcatgggaggaaatcgcgcagtgtgtgaatgccgttggagagggcgaacagcggacaggcaccgaggtgaagagatag

SEQ ID NO: 23999 - DNA, 591 bp, Artificial Sequence
  Description of Artificial Sequence: Synthetic coding sequence
atgaaacagctaaaacgcaagcgtaagagtaacttctctgtccaggaaactcagacgctgctgaaggagattacaaagcgcaaggaagtgatctttagcaagcaactaaatacaacgattaatgttatgaagcggatggcttgggaggaaattgcccagtgcgtgaatgccgtcggcgagggagagcagagaacagggaccgaagtaaaacgtcggtacttggactggcgcgcactgatgaaaagaaagcgcatgaaagcgaacattaagttggtgggatctggattcccactgcctagtagcgatctggatgattcacttactgaagagatcgacgagaagattggcttccgcaacgacgcaaactttgactggcaaaacgttgcagatttcagagatgctggtggctcgctgaccgaagttaaggtggaagaggaggaaagagatccacagtcaccggagttcgaaatcgaggaggaggaggagatgttgagtagtgttattcccgacagccggcgtgaaaacgagttacccgattttccccacattgatgagtttttcactttgaacagtacacctagcaggtcctag

SEQ ID NO: 24000 - DNA, 336 bp, Artificial Sequence
  Description of Artificial Sequence: Synthetic coding sequence
atgaaacagctcaagagaaaacggaagtcgaatttctctgttcaggagacgcagacactgctcaaggagattacaaaaagaaaggaggtaatcttttccaaacaactgaataccacaataaacgtcatgaagcgcatggcctgggaggaaatcgctcagtgtgtgaatgcagtgggtgaaggggaacagcggacaggaacggaagtgaagcggaggtacttggactggcgtgctcttatgaagaggaagaggatgaaggcaaatattaagctcgtggggtccggttttccactgccgagctcggatctggacgattctctaacagaagagatctag

SEQ ID NO: 24001 - DNA, 1158 bp, Artificial Sequence
  Description of Artificial Sequence: Synthetic coding sequence
atgcaagcatgcggagggggagccgcaggtcggagagcattcgattctatatgcccaaatagaatgctggccctgcccggtagggcgctcctctgcaagcctggaaaaccggaaagaaagtttgccccacctagaaagtttttcccagggtgcactgggggatccccagttagtgtctatgaagacccaccggatgccgaacccactgccctaccagctctgactacgatcgatctccaggatcttgcagattgcagctcgctgctagggtctgacgcacctcccggaggggatctggccgcttcacaaaaccacagtcaccagactgaggccgactttaacctgcaagatttcagagatactgttgacgatctcatatccgatagcagctcgatgatgagtccaactttagccagtggagacttcccttttagcccttgcgatatctcacctttcggcccatgcctgtctccaccgctggatcccagagcacttcagtccccaccactccgccctcccgatgtcccacccccagagcaatattggaaagaggtggccgaccagaaccagagggccctcggcgatgcgttggtggaaaacaaccagctccatgttacgctaactcaaaagcaagaggagattgcctccctgaaagaaaggaatgtgcagctgaaggagcttgcctccagaactagacaccttgcctctgtgctggataagctgatgataacccagtctcgggattgcggtgcagccgctgagcccttcctcttaaaggccaaggctaaacgcagcctggaagaactggtcagcgcagccggacaggactgtgcggaggtagatgccatcctccgagaaataagcgagcgttgtgacgaggcgctccaatccagggatccaaaaagacctagattactgcccgaaccagctaacactgacactcgccctgggaatttgcacggcgcatttcggggactgaggacggactgctctagatctgctctgaatctctcacatagtgagctggaggagggtggatctttctcaaccaggatccgaagccactcgacaattcggacccttgcctttccccaggggaatgcctttactatacgcactgccaacggtggatataagtttaggtgggttccaagttag

SEQ ID NO: 24002 - DNA, 1866 bp, Artificial Sequence
  Description of Artificial Sequence: Synthetic coding sequence
atggccgattttgaagagctgcgcaacatggtttccagtttccgggtgagcgagctgcaggtgctgttaggttttgcagggcgaaataagtcaggaaggaagcatgatctcttaatgcgcgcactgcacctgctcaaatctggatgctccccagcagtgcagatcaagatccgtgaactgtatagaagacgttacccccgaacgcttgaggggctgagtgaccttagtaccatcaaatcctctgttttcagtctggatgggggatcttctcctgtggaacccgacctggcggtcgccggaattcattctcttccaagtacatcagttaccccccactccccctcttctccagtcggctccgtcctgctgcaggacaccaaaccaaccttcgagatgcagcagccttctccacccattcctcctgtgcatcccgatgttcagctcaaaaacctaccgttttacgatgttctcgatgtgttgataaaacctacttcgttagtgcagagctccatacagaggttccaggagaaatttttcatcttcgctctgaccccacagcaggtccgcgagatttgtatatccagggattttctgccgggaggaagacgggattacactgtccaggtccaactccgactgtgcctcgccgagacctcgtgtccccaggaggataactaccctaacagtttgtgtattaaagtcaacggcaagctttttcctctacctgggtacgcccctccccctaagaacgggatcgagcaaaagcgccctggccgacctttgaatatcacctccctggtgcggctgagcagcgccgtgcctaaccagatcagcatttcctgggcctctgagatcggtaaaaattactccatgagtgtgtaccttgtcagacagcttacctcggctatgttactccagcgactaaagatgaaaggcataagaaaccctgatcactcacgtgcactcatcaaagagaaattaactgccgaccctgatagcgagattgctacaacgagccttcgagtgtctctcatgtgccctctcggtaaaatgaggttgactatcccttgtagggccgtgacctgtacccacctgcagtgttttgatgctgcactttacctccaaatgaacgagaagaaacctacatggatctgcccagtttgtgacaagaaagccgcttacgagtcactgattcttgacggactgttcatggaaatcctcaatgattgttctgacgtagatgagattaagtttcaggaagacggatcatggtgcccgatgagacctaaaaaagaggcgatgaaggtgagttcacagccttgtactaagattgagagcagctcagtcctgagcaagccttgctcagtcaccgtggcctccgaggccagcaaaaaaaaggtggacgtgattgacctcacaatcgaatcctcttctgacgaagaagaagatccacctgccaaaaggaagtgcatctttatgtctgagacacagagctctcccactaagggcgttctgatgtaccagccctcttctgtcagggtcccctccgtgacatccgtggacccggcagcaattcccccttccttgaccgattatagtgtgccgttccatcatacacccatttccagtatgtcgtccgatctgcctggactagactttctgtcccttattccagtggatccccagtactgtcctccaatgttcctggattctttgacttcccctttgactgctagctccacttcggtgaccactacgagctcacacgagagctctacacatgtgtcttcctccagctctagatcagagactggagtaattacaagtagtggcagcaacattcccgacattatctccttggactag

SEQ ID NO: 24003 - DNA, 1866 bp, Artificial Sequence
  Description of Artificial Sequence: Synthetic coding sequence
atggctaacttcgaagaaattattaacatggtgtcttcttttagagtctcagaactacaggtgcttctcggattcgccggacgcaacaaatccggccgaaagcacgacctgctgatgcgcgctctccacctgctaaagtcaggctgctcaccagctgtgcagatcaagatccgcgaactgtaccgcagacggtaccctcggacactcgaagggctgtccgaccttagtaccatcaagagttctgttttcagcctggacggcggttcatctccagtcgagcctgatctggcagttgccggtatccatagtctgccttctacgtcagtgaccccacattcgccttcgtctccagtggggtctgtgctcctgcaagataccaagccaacgtttgagatgcaacaacctagccccccaataccccctgttcacccggacgtccaacttaaaaacctgcccttttatgatgtgctggatgtgttgatcaagccaacctcactcgtgcaatcatcaattcagcggttccaagaaaagttttttatcttcgcattgacaccccagcaggtgcgggagatttgtatctctcgagacttcctccctggaggaagacgtgattacacagtccaggtgcaactcaggttgtgtttggctgaaacatcctgcccccaagaggacaattaccctaacagtctttgcatcaaggtcaatggcaagctttttcctctgcccggatacgcaccgccacctaagaacggaatcgagcaaaagcggccaggccgtcccctcaacattacgtctctggtgcgcttgtcttcagctgtcccaaaccagatctctattagttgggccagcgagataggcaagaattactccatgtctgtttatctcgtgcgccagctgacgagcgccatgctgttacaaaggctgaaaatgaaggggattcggaacccagaccattccagggcattaattaaagagaagttgaccgcagaccctgattcagagattgcaaccacctccctcagagtgtcgcttatgtgccctctgggtaagatgcggctgactataccttgccgcgcagtgacctgcacccacctccaatgttttgatgcagcgctgtaccttcagatgaacgagaagaagccgacttggatatgtcccgtgtgcgacaagaaagccgcttacgagtccctcattctggatggcctcttcatggaaatcttaaacgactgcagcgatgtagacgagattaaattccaggaggatggttcctggtgcccaatgagaccaaaaaaggaggccatgaaggtatcatcccaaccttgtacgaaaattgaaagtagttccgtgttaagtaagccatgttcagtgactgtggcctcggaggcctctaagaaaaaagtcgacgtgatcgatctcacgattgaatcaagttcagatgaggaggaggatccaccagcaaagaggaaatgcattttcatgagcgagacccagagctcccctacgaagggtgtacttatgtaccagccgtctagcgttcgggtaccgagtgtcacttcagtggaccccgctgctattccgccaagcctaactgattactccgtgccattccaccatacccccataagcagtatgagttccgacctgccagggttggattttctgagtctcatccctgttgaccctcaatattgcccgcctatgttcctggacagccttacctcgccactgaccgcatccagcacttctgtaactactaccagctcccacgagtccagtactcacgtctcatcgtcctctagcagatctgagacgggagtaataacttcctccggcagcaatatccctgatattattagtctggactag

SEQ ID NO: 24004 - DNA, 1719 bp, Artificial Sequence
  Description of Artificial Sequence: Synthetic coding sequence
atggctgatttcgaggagcttcgtaatatggtcagctcttttagagtctcggaactgcaggtactcctcggattcgcgggtcgtaacaaaagcggcagaaaacacgacctgctgatgagagctcttcacctgttgaagtctgggtgtagccctgccgttcagatcaagataagagagctatatcggcgaagatacccgcgaactctcgaaggattgtccgatctgtccactattaagtcctcggtgttttccctcgacggcggatcatctcccgttgaacctgacctggcagtggctggaatacattcattgccgtccactagcgtcaccccccatagcccttcctcccccgttgggagcgtgctactgcaggacaccaagcctacattcgagatgcagcagcccagtccaccaatccccccagttcatccagacgtgcagctcaaaaacctgcctttctacgatgttttggatgtcctgattaagcctacgtccctggtgcagagcagcatacagcgatttcaggaaaagttctttatcttcgcattgacccctcaacaggtgcgggaaatctgcatcagtagggattttctgccaggaggtagacgcgattatacagttcaggttcagctgcggctctgtctggccgagacttcctgcccacaggaagacaactatcccaattcattgtgcattaaagttaatgggaagctgtttcccctgccgggatacgctcctccaccaaagaacggaattgagcaaaagaggccaggtaggccgcttaacattacttccttagtacgactgagcagcgcggtgccaaatcagatcagtatctcttgggctagtgaaataggaaaaaattacagcatgtctgtttacctggtccgacagttaacgtcagcaatgcttctgcagagattgaaaatgaagggcattcgcaaccccgaccactcaagggccctgataaaggaaaagctgactgctgatcctgacagcgagattgcaaccacctcccttcgagtatccctgatgtgtccgttagggaaaatgcgcctaaccattccttgtcgggcagtcacgtgtactcatcttcagtgttttgatgccgcactgtatctgcagatgaatgagaaaaagcctacctggatctgccccgtctgtgacaaaaaagcagcctatgaatctctgatcctcgacggacttttcatggagatcctaaacgactgctccgatgtcgacgagatcaagtttcaggaggacgggtcatggtgtcccatgcggccaaagaaagaggccatgaaggtctcaagtcagccttgcacaaagatcgagtcgtcgtccgtcctctcaaaaccttgctctgtcaccgttgcctccgaggcctccaaaaaaaaggtggatgtgatagacctcacgatcgaaagttcgtcagatgaagaagaggacccaccagccaagcggaagtgcatcttcatgtccgaaactcagtctagccccaccaagggagtattaatgtatcaacctagcagtgtgagagttccatccgtgacctcagtagatcctgccgctatacctccttcccttacggattactctgtcccctttcaccatacccccatcagctccatgtccagtgacctgccaggagaacagaggcgtaacgatattaataatgaacttaagcttggtacctctagcgatacagttcagcagtag

SEQ ID NO: 24005 - DNA, 1191 bp, Artificial Sequence
  Description of Artificial Sequence: Synthetic coding sequence
cgaaacctcaacaatatggtgtccagtttccgagtgtcagagctgcaggtgctactgggctttgctggtcgtaataaatctgggcgtaagcacgatctgttgatgagggccctacatctgctgaaaagtggatgcagtccggctgtacaaatcaaaattagggaactttacaggcggaggtacccgaggacccttgagggcctgtccgatctgagtacgatcaaatccagtgtttttagtctagatggaggctcttccccagtggagcctgacctcgccgtcgcgggtattcattccctaccatcaacatctgttacacctcacagtccctcctcgccagtgggcagcgtgctgttgcaggacaccaaacctaccttcgaaatgcaacagcctagtccccctattcctcccgtccatcctgacgttcaactgaaaaatcttccattctacgatgtcctcgatgtgctgatcaagcctacatcattggttcagtccagcatccaacgcttccaggagaagttttttattttcgccttgacaccccagcaggtgagagaaatctgtatatcaagggactttctgcccggtgggagaagggactacactgtgcaagtgcaattacgcctatgtctggccgaaacgtcttgcccacaggaagacaactatccaaactctctgtgcatcaaagttaacgggaaacttttccccctcccagggtatgctccaccccctaaaaatggcatcgaacagaagaggcctgggcgtcccttgaacattacatctctcgtgaggctgtccagtgccgtgcccaatcagatcagtatcagctgggctagcgagattggtaaaaattacagcatgtctgtgtatttggtgaggcagctgacctcagctatgctgctgcagcggctcaaaatgaaggggattaggaatcccgaccacagcagggctctgattaaagaaaaactcacagccgacccagattctgagatcgccaccacttccctgcgcgtgtctttgatgtgcccactaggtaaaatgaggcttaccatcccgtgcagagcggtgacatgcacccatctacagtgctttgacgctgcgctgtatctccagatgaacgagaaaaagcccacctggatctgccctgtgtgcgacaagaaggcagcatatgagagtttgatacttgattag

SEQ ID NO: 24006 - DNA, 1866 bp, Artificial Sequence
  Description of Artificial Sequence: Synthetic coding sequence
atggccgattttgaggaactcagaaacatggtcagctccttcagggtgtccgagctgcaggttttgcttgggtttgcaggacgtaataaaagtggccgtaagcacgatttgctgatgcgagccctccacctgctgaagtcgggttgctcacctgcagtgcagattaagatccgcgagttgtatcgccgaaggtacccaagaaccctggaaggtctgtcagacctctcaaccatcaagagctccgtattctcactcgacggcggatctagtcccgttgagcctgaccttgccgtggcaggcattcacagcctgcctagtacttccgtaacccctcattccccaagctcaccggtcgggtctgtgctcctccaggacaccaagcctaccttcgaaatgcagcagccaagcccacctatcccaccggtacacccagacgttcagctaaaaaacctccctttctacgatgtgctagatgttctcatcaaacccacatcgcttgtgcagtcaagtatccagagattccaggagaaattcttcattttcgctctgactccgcagcaggtacgggagatatgtatctcaagagattttctgcccggaggtagaagagactatactgtccaggtgcaactccgcctgtgtctggcagaaacctcttgtccccaggaggacaattaccccaactccctttgcattaaagttaatggtaaacttttccccctccccggatacgcaccaccacccaagaatgggatcgagcagaagagacccggacgcccactcaatattacatctctagtgaggctgagctctgccgtgcctaatcagatctcaattagctgggcctccgaaattggcaagaactacagtatgtcagtatatctcgtccggcagctgacctcagccatgctgctgcagaggctcaaaatgaaagggattcgaaatcctgaccattcccgtgcacttatcaaggagaagttgactgcggatcccgattccgagatcgccacaactagccttcgggtatcattgatgtgcccactcggtaaaatgaggttaacaatcccctgtcgggcagttacctgcacacatctgcaatgctttgacgctgccctctatctacagatgaatgagaaaaaacccacgtggatctgccccgtgtgcgacaaaaaggctgcgtacgaaagtttgattctggacgggctcttcatggaaatcctgaacgactgtagcgatgttgacgagatcaagttccaggaggacggctcctggtgccccatgcgacccaagaaggaggcaatgaaagtttcgtcccaaccttgcactaaaattgagtccagcagcgttctgagtaaaccctgttctgtgaccgtggcgtccgaagccagcaaaaaaaaagtcgacgttatcgatctcactattgagtcatcctcggacgaggaagaggatcccccagcgaagaggaagtgcatcttcatgtcagagactcagagtagccccacaaagggggttctgatgtaccagcctagcagcgtaagagtgccttcagtgacttccgttgatccagccgcaataccgccaagtctgaccgattattctgttccctttcaccacacccccatctcctctatgagcagtgaccttccaggcctggactttctgagtcttatccccgtcgacccccaatactgccccccaatgtttctagactcgcttacaagcccactgaccgccagttcaactagcgtgactacaacctcctcacatgaatcttccactcacgtgtcgtcctcatcctcaagaagcgagaccggggtcattacctcaagcggcagcaacatcccagatattatttccttggactag

SEQ ID NO: 24007 - DNA, 849 bp, Artificial Sequence
  Description of Artificial Sequence: Synthetic coding sequence
atgtccgtgtatttggtccgccagcttacaagtgcaatgctgctgcagcggctgaaaatgaaaggcattagaaaccccgaccattcccgtgctctgatcaaagagaaactaacagccgatcctgattccgaaatagcaacaacatctctcagagtaagtctgatgtgtcccttgggtaagatgagactgacaatcccatgtcgcgcagtcacatgcacgcatctccagtgtttcgacgcggctctatacctgcaaatgaatgaaaagaaacctacctggatctgcccggtgtgtgacaagaaagccgcatacgagtcactaattcttgatggcctgtttatggagattctgaatgactgttctgatgtagacgaaataaaattccaggaggatggttcctggtgtccaatgagaccaaagaaggaggcgatgaaggtgtcaagccagccttgtacaaaaattgagtctagcagcgttctgtctaaaccttgttccgtgactgtggcatctgaggcctctaagaagaaggtggatgtgatcgacttgaccattgagtcgtcatccgacgaagaggaggaccccccagccaaaagaaagtgcatctttatgtctgaaacacagtcctccccgactaagggcgttctgatgtatcagccatcttcggtgagggtacccagcgtaactagcgttgatccagccgctattccaccctctctaactgattacagcgtgcctttccaccacactcccatcagttccatgtcttctgacctgcccggagagcaacggcgaaacgacatcaataatgagctcaagctcggtacatctagcgacactgtgcagcagtag

SEQ ID NO: 24008 - DNA, 1023 bp, Artificial Sequence
  Description of Artificial Sequence: Synthetic coding sequence
atggaaaccgtgatctcgtcagatagctctcctgcggtcgaaaacgagcaccctcaagaaactcctgaaagcaataatagcgtgtatacatcgtttatgaaatcgcatcgctgctacgacttaattccaacaagctcaaagttggttgtgttcgacacgtcgttgcaggtgaaaaaagcattctttgccctcgtgacgaacggcgtgagagctgctcctttgtgggacagtaagaaacagagcttcgtcgtgcttagagcgttgagttgcccgctgggtatgcttacaattactgacttcataaatatactacacagatactataagtcagctctggtgcagatctacgagcttgaagaacacaaaatagaaacttggagggaagtttacctgcaagactccttcaagccactcgtgtgcatcagccctaacgcgagcttattcgatgccgtgtccagtctgattcgcaacaagattcaccggctgccagtgattgatcccgagtccggtaacaccctgtacattctcacacacaagcgaattctgaaattccttaagctgtttataacggagtttcctaagccagaattcatgtcaaagagcttggaagagctccagatcggaacttacgctaacattgcaatggtgagaacgaccactcctgtttacgtcgcccttggaatttttgttcagcaccgcgtctcagcactgccggtggtggatgagaaaggccgtgtggtcgacatctacagtaagtttgatgttattaatcttgctgcggaaaagacctataataacctggatgtgtcagtgacaaaagctttacagcacagaagccattattttgagggtgtgctcaaatgttatctccacgagaccctcgaaacaatcatcaaccgactagtcgaagccgaggttcatcggttagtagtggtcgatgagaacgatgttgtaaagggcatcgtctcgctctctgatatcctgcaggcactggttctgaccggtggcgagaagaagccatag

SEQ ID NO: 24009 - DNA, 900 bp, Artificial Sequence
  Description of Artificial Sequence: Synthetic coding sequence
atgaaatctcacagatgttacgacctgattccaacaagtagcaaactggtggtgttcgacacaagcctgcaggtgaagaaggcattttttgcccttgtgactaacggcgtgagagccgcacccctgtgggattccaaaaagcaaagcttcgtgggcatgctgaccatcactgattttatcaatatcctccaccggtactacaaatctgcacttgtccagatatatgaactggaagagcacaagatcgaaacgtggagagaagtgtatctgcaggatagttttaagccactagtgtgcatttctcctaacgcttcattattcgatgccgtgtcgtcactgatcagaaacaagatacatcggctccccgtgattgacccggagtctgggaacaccctctatatcctgacgcacaagagaatcctcaaattcctgaagttattcatcaccgagtttccgaagcctgagtttatgtccaaaagcttggaggaactgcagataggcacctacgctaatatcgcgatggtgaggacgactactccagtgtatgttgctctgggcatcttcgtgcagcatagggtgagcgccctacccgtggttgacgaaaaggggagggtcgtcgacatttatagcaaattcgatgttataaacttggctgccgaaaaaacatacaacaacctggatgtgtctgtgacgaaagcgctccagcaccgtagccactactttgagggggtactgaaatgctacctccacgagaccctggaaaccatcatcaacaggctggtggaagcagaggtccatcgcctagtggttgtggacgagaatgatgtcgtgaaaggcattgtgagtctgtcagacatcttacaggctcttgtgctgacaggcggagagaagaaaccatag

SEQ ID NO: 24010 - DNA, 2823 bp, Artificial Sequence
  Description of Artificial Sequence: Synthetic coding sequence
atgggttctggacccattgaccccaaggagcttctgaagggcctggactcgttcctgaatcgggacggagaggtcaagagcgtggacggcatatccaaaattttttcccttatgaaagaagcaaggaaaatggtgtcgagatgtacctacctgaatattctgttgcagaccagatcccccgagatcctggtgaaatttatcgatgtggggggatacaaattattgaacaactggcttacctactctaagacaaccaacaatattcccctgctgcagcaaatcctcctcaccttgcagcacctccccctgactgttgaccacctcaaacagaataataccgcaaagctcgtcaagcagttgtccaaaagctctgaagacgaagagctcagaaagttagcctccgtgctggtgagtgactggatggccgtaattaggtcccagtcctccacgcaacccgctgaaaaagataagaagaagagaaaggacgaagggaagtctaggacaacattacccgagcgcccactgacggaggtgaaagccgagaccagggcggaggaagcacccgagaagaagcgagaaaaaccaaagagcctgaggaccacagcaccatctcatgccaaatttagaagtacgggtcttgagctcgagacgcccagccttgttccagtaaaaaagaacgcctctacagtcgtggtgtctgataagtacaatctaaagccaatcccccttaaaaggcagtcaaacgtggccgctcctggggatgccacaccccctgcagaaaaaaaatataagcccctcaacacgacacctaacgcaaccaaggaaattaaagtgaagatcattccaccccagcctatggagggtttgggcttcctcgatgccctcaacagtgctcctgtccccggaattaaaatcaaaaagaaaaaaaaggtgctaagccctacggccgctaaacccagcccctttgaaggaaaaacctcaacagagcccagcactgctaagccatcctcaccagagcctgcaccgcctagcgaggctatggatgcagatcggcctgggactccggttccccctgtcgaagtgcccgagctgatggatactgcctccttggagccaggagccttggatgcaaagccagttgagagtcccggagacccgaatcagctgactcgaaaaggtcgaaagcggaagagtgtgacatggcctgaggaaggcaaacttagggaatatttctacttcgagctcgatgaaacagaacgtgtgaatgtaaacaagattaaggattttggcgaggcagccaaaagggagatcctgagtgataggcatgcctttgagacagcacgccgactgagtcatgataacatggaggagaaagtaccttgggtttgccctcggcctctggtgctccctagcccactcgtcacaccaggaagcaattctcaagaacgctacatccaggcagagcgggaaaagggtatactccaggaattgttcctgaacaaagagagccctcacgagccggaccccgagccctacgagcccatacccccaaaactcatacccctcgacgaggaatgcagcatggacgagactccatacgtggaaaccctcgagcccggaggctccggcggtagcccagatggagctggtgggtccaaattgccacctgtgttagccaacttaatggggtccatgggggctgggaaaggacctcagggacctggtggtggcggaatcaatgttcaggaaatactgacgtccatcatgggtagccccaactctcatccatccgaggaattactgaaacagccagactacagtgataagattaaacaaatgttggtaccgcatggactgctggggccagggccaattgcgaatgggttccctcctggcggacctggcggacctaaagggatgcaacatttcccgcctggccctgggggaccgatgcctgggcctcatggaggccctggcggaccagtggggccacgattactagggcctcctccacccccaaggggtggagatccattctgggatggcccaggagaccccatgagaggcggtcctatgagagggggtcctggcccagggcctggaccttaccacaggggacgcggagggaggggcggaaatgaacccccaccaccaccaccgcctttccgcggtgctaggggaggcaggtccgggggaggacctcccaacggccgtggcggaccagggggtggcatggtgggtggtggagggcaccgaccccacgagggacccggaggaggaatgggaaactccagcggccatcggccacacgaagggcctggaggtggcatgggcagcgggcatcgcccacatgaggggccaggcggaagtatgggtggaggtgggggacaccggccacatgaaggtccgggaggcggtatctcaggaggctccggccaccgccctcatgaagggcctggcggaggaatgggagctgggggaggacatcgtccacatgagggaccaggagggtctatgggcggatccgggggtcaccgaccccacgagggacctgggcacgggggtcctcacggacacagaccacatgatgtgccagggcaccggggtcacgaccaccgcggacctcctccacacgaacaccgaggccacgacgggccaggacatggcggaggcggtcataggggccacgacggagggcattctcacggcggtgatatgagcaaccggcctgtgtgtaggcatttcatgatgaaaggcaattgccggtacgagaataactgcgctttctaccacccgggagtcaacggtccgcctctcccctag

SEQ ID NO: 24011 - DNA, 2823 bp, Artificial Sequence
  Description of Artificial Sequence: Synthetic coding sequence
atggggtccggacccatagaccccaaggagctgctgaaaggtctcgactcattcctcaacagggatggggaggtgaagagcgtcgatgggatttccaagattttctcattgatgaaagaagcgagaaaaatggtgtcaagatgtacatatttaaacatcctgcttcagactcggtcaccagagatattggtgaaatttatcgatgtcgggggatacaagcttctgaacaattggctcacatatagtaagaccactaataacatcccgttgctccaacagatccttctaaccctgcaacacttacctctgacagtggaccacctgaaacagaataacacagctaaattagtgaaacagctgagtaaatccagcgaggacgaagaattgcggaagcttgccagcgtcctcgtatcagattggatggctgtgatccgatcccagagttctacacagccagccgagaaagataagaagaagagaaaggacgaaggaaaaagtagaactactctccctgaacgcccacttactgaggttaaagccgagacacgagctgaggaggctcctgaaaagaagcgcgagaagcccaaatccttgcgcaccactgcacccagccatgccaagttccgctcaacagggttggaattggaaaccccttcactcgtgcccgtcaagaaaaacgcgtcgacagtggtggttagcgataagtataacctgaagcctattcccttgaagcgacaaagtaacgtggcagccccaggcgatgcaacccctcctgccgagaagaaatacaaaccccttaacacgaccccgaacgctacaaaggaaatcaaagtgaaaataatacctcctcagcctatggagggcctgggctttctcgatgctctgaacagcgccccagtgcctgggattaagattaaaaagaagaaaaaggttctgtctcccaccgcagctaaaccaagtccctttgaaggtaagacctccacagagcccagtaccgctaagccatcaagtccagagccggctcccccatcggaggccatggacgctgacaggccagggacacccgttccacctgtcgaagttcctgaactgatggacacagcatccctggagcccggtgccttagacgccaagccggtcgagagtccaggggatcccaatcagctaaccaggaaggggaggaagcgcaagagcgtaacttggccagaggagggtaagctgcgggagtatttctatttcgaactagatgagaccgagcgcgtcaatgtgaacaaaattaaggacttcggtgaggcagccaaaagagagatactctctgatagacacgcctttgagacagcaaggcgcctttcccacgataacatggaggagaaagtcccttgggtgtgtccgcgtcccctggtgctgccatcaccacttgtcactccgggatcgaattcccaggagcggtacatccaggccgagagagagaagggaattctccaggagctgttcttgaacaaagaatcacctcatgagcctgatcctgaaccatatgaacctattccacctaaactaattcctctcgatgaggagtgcagcatggacgagactccctacgtcgagacgctggaacccggtggaagcgggggatcacctgacggcgctggcggaagtaaactgccacctgtgctcgcgaacctgatgggatcaatgggagccggtaaaggcccacagggtccagggggtgggggaatcaatgtgcaagagatcctgacctctatcatgggctcccccaatagtcatccgtcagaggagctactcaagcaacccgactactctgacaagatcaagcagatgctcgttcctcatggactcctgggacctggccctatagccaatggctttcctcccggaggcccaggaggcccaaaggggatgcaacacttccctcccggtcccggagggccaatgcctgggccacacgggggacccggagggccagtgggccctagattactgggccctccccctccgcctcggggaggggatcctttttgggacggtcctggcgatcctatgcgaggtggcccaatgcgaggcggaccaggaccaggtcccggaccctaccataggggtcgcggagggcgtggcggaaacgagccacccccacctcccccaccatttcgcggagctagaggcggaagatcaggcggaggacctcctaacgggagaggcggacctgggggtggtatggtaggtggcggtggacaccgtccacacgaggggcctggcggtggcatggggaattccagcgggcaccggccacatgaaggcccaggtggaggcatgggatccggccaccggcctcacgagggacctggtggcagcatggggggagggggaggccaccggcctcacgagggcccagggggaggcatctctggcggaagcggacatcgaccgcatgaaggacctggcggaggcatgggggctgggggaggacataggcctcacgaaggccctggcggaagcatgggaggctcagggggacataggccccacgaggggcctggtcatggtggccctcacggccacaggccccatgacgtaccaggccaccgcggacacgaccatcgcggtcctccaccgcatgagcacagaggccacgatggtcccggacacggaggcggaggacaccgcggacatgacgggggacatagccatgggggagacatgagcaataggcctgtttgccggcacttcatgatgaagggtaactgtcgttacgaaaataattgtgccttctatcatccaggggtcaatggaccacccctgccctag

SEQ ID NO: 24012 - DNA, 2823 bp, Artificial Sequence
  Description of Artificial Sequence: Synthetic coding sequence
atgggatctggacccatcgatcccaaggagctgttgaaagggctggattcatttctaaatcgagacggggaggtgaaaagcgtggacgggatatcaaaaatcttttccttgatgaaggaggccaggaagatggtctcccgttgtacatacttaaacatcctcctacagacacgctcacctgagattctggtcaaattcatagatgtgggagggtacaaactgctcaacaactggttgacatactctaaaaccacaaataacattccgctcctccaacaaatcctgctgacgctgcaacatctgcctctaaccgtggaccacttgaaacagaataacacagccaagctggtcaagcagctgtctaagtcctcggaggatgaggagctccgcaagcttgcatcagtcctggtgtctgactggatggctgtcataagatcccaatcaagcacacagccagcagagaaagacaagaaaaaaaggaaagacgaaggaaagagccgaactacattgccagaaagacccctgaccgaggtaaaggcagagacaagagcagaggaagcacccgagaagaaacgggagaagccaaagtctctgcgaactaccgccccttctcatgcgaagttcagatccaccggactggaactggaaacacccagcctggtgcccgtcaaaaaaaatgcctctaccgtggtggtctccgataagtataatctgaaaccgattccactgaaaaggcagtccaatgtggctgcacctggagacgccacgcccccagccgagaagaagtacaagcctctgaatactacacctaacgcgacaaaggaaatcaaagtcaaaattataccaccacagccaatggagggacttggcttcctcgacgcccttaactcagcaccggttcctggaattaagatcaaaaaaaaaaaaaaggtcctaagtcccacggccgcaaagccctctccattcgagggcaaaacttctaccgaaccaagtacagctaaacctagcagtcccgagcctgctcctccttcagaagccatggatgccgatcgtccgggtacccccgtacctcctgtggaagtgcctgagctcatggacacggcaagcttggaacctggagccctggacgcaaagcctgtcgagagtcctggggaccctaaccaactaacccgaaaaggtcgcaaaaggaagtccgtgacatggccagaggaaggaaagctccgcgagtacttctattttgaactggacgaaacagaacgggttaacgtcaacaaaattaaagatttcggagaggccgctaaaagagaaattctatcggatagacacgccttcgaaactgccaggcgcctgtcacatgataacatggaagagaaagttccgtgggtgtgccccagacctctggttctaccatctcctctagtgacaccgggaagtaactctcaggaaaggtatatacaggctgagcgcgagaagggcatactacaggagctgtttctcaacaaggaaagccctcatgagcctgaccccgaaccgtacgaacccatcccaccaaagttgattcctctggacgaggagtgtagcatggatgaaacaccatacgtggaaaccctggagccaggcggatccggaggctcgcctgatggtgcaggcggaagcaagcttcccccagtgttggcaaacctcatgggcagtatgggagccggtaaaggccctcagggtccaggaggaggaggcattaacgtccaggaaattcttacctccataatggggtcaccaaatagtcaccctagcgaggagctcctgaaacagcctgactattcagataagatcaaacagatgctggttcctcacgggctcctgggccctggcccaatagccaatggatttccacccggaggacctgggggaccgaagggaatgcagcatttcccccctgggcctggcggtcccatgcccggaccacacggcggacccggtggacctgtcggaccacgtctattgggccctcctcctcccccacggggtggcgatcctttttgggatggtcctggcgaccctatgcgtggcggacctatgcggggagggcctggcccagggccaggcccatatcatcgtgggaggggtgggcgtggagggaatgagccaccaccccctcccccaccgttcaggggcgctaggggagggaggtctggcggaggcccaccaaacgggaggggcggacccggaggcggtatggtgggcggaggcggtcaccgcccacacgagggtccgggaggaggaatgggaaattcctccggtcacaggccacacgagggcccaggagggggaatgggatccggccatcggccacacgagggccctgggggaagtatgggaggcggtggagggcaccgcccacacgaaggcccaggtggtgggatatcggggggtagtggacatcggcctcatgagggtcccggtggaggcatgggcgcagggggaggtcacaggccccacgagggcccaggcggttctatgggcggaagcgggggtcacaggcctcatgagggacctggccacggcggacctcacgggcatcggcctcacgacgtgcccggacaccgcggacatgatcatagaggcccacccccacacgaacatcggggtcatgacggaccaggtcatggcggaggtgggcatcggggtcacgacggcggacactcccacggtggtgatatgagtaaccgtcctgtgtgtcgtcactttatgatgaaaggaaattgtaggtatgagaacaattgcgccttctatcatccgggagttaacggacctccactcccctag

SEQ ID NO: 24013 - DNA, 2823 bp, Artificial Sequence
  Description of Artificial Sequence: Synthetic coding sequence
atgggctctggcccaatagatcccaaagaactgttgaaggggctcgacagcttcttgaatcgggacggtgaggtcaagtcagtcgacggtattagcaagatcttttcccttatgaaagaggcccgaaagatggtgagtagatgtacttacctgaatatacttctgcagaccagatcaccagagattcttgtcaaattcatcgatgtgggcggttataaactgttaaacaattggctcacatactcaaagaccacaaacaatatcccgctattacagcagatactgctgacactgcagcatctgcctttaaccgtcgaccacctgaagcagaataataccgcgaaactcgtcaagcagcttagcaaatcatccgaggacgaggagttacgaaagctagcgtccgttctcgtctctgactggatggccgttatcagatcacagagcagtacacagcctgccgaaaaagataagaaaaaaagaaaagacgaaggcaaatcacgcacaaccctgcctgaaaggcccctaactgaagtcaaagctgagacacgtgctgaagaagcccctgagaagaagcgcgagaagcccaaatccctgcggaccacagccccttcacacgcaaagtttcgtagcactggactggaactggagacccccagcctcgtgcctgtgaagaagaatgccagcactgtcgtagtatcggacaaatacaacttaaagccgataccgttaaagcggcaatcaaatgtggcagccccaggagacgcgacacccccagccgaaaagaagtacaagccacttaatactactccaaatgctacaaaggagatcaaggtaaagataattccgcctcagcctatggaggggctaggcttcctggatgctctgaatagtgctccagtgcccggtatcaagatcaagaaaaagaaaaaggttctcagccccaccgcagccaagccttctccctttgaggggaaaacctctaccgagcccagcactgccaaaccaagctccccagaaccagctcctccttcagaggccatggacgccgacaggcccggtactcctgtgccacctgtggaagtgcccgagctgatggacacagcctccctcgagccgggagcgctcgacgccaagccagtagagagtcccggagatcctaatcagcttacccggaagggcagaaagagaaagtctgtcacttggccggaagaggggaaactgcgggagtacttctatttcgaactggatgagaccgagcgggttaacgtaaacaagattaaagacttcggcgaagctgcaaaacgcgaaatcttaagcgaccgccatgcattcgagacagctcggagactcagccatgataacatggaagaaaaggtcccttgggtctgcccgcgacctctagtactgccaagccccttggtgactcccggttcaaatagtcaggagcggtatattcaggccgagcgagaaaagggcattctgcaggagctgttccttaataaggaatctcctcacgaaccggaccctgagccatacgagccaataccccctaagctgataccgttggacgaagaatgttcaatggatgagactccgtatgtcgaaaccctggagccaggcggatcaggcggaagtcctgatggggctgggggatccaagttgcccccagtgctggctaatttgatggggtcaatgggcgcagggaaggggcctcagggcccaggagggggtggaatcaatgtccaagagattctgacatctatcatggggtccccaaactcccaccccagcgaagaactgctgaaacagccggactattcagacaagattaaacagatgttggtgccacacggcctactcggcccaggcccaatcgcaaatggattcccccctggagggcctggcggacctaaagggatgcagcactttccgccaggacccggtgggcctatgccaggccctcacggcggacccggaggtcccgttgggccacgcttgctgggacctcctcctccccctcggggtggagacccattctgggatggacctggagacccgatgagaggcggaccgatgcggggtggtcctgggcctggcccaggaccctaccatcggggaagggggggaagggggggtaacgagccgcctccacctccacctccctttcgcggagcacggggagggcgaagcgggggaggtcctcccaacggaaggggagggcctgggggtggaatggtggggggaggcggacatcgaccccatgaaggacccggagggggaatggggaactcgtctggccaccgccctcacgagggccctgggggtgggatgggctcaggtcaccgccctcacgagggacccggaggcagcatggggggtgggggaggacataggcctcatgaggggcctgggggtgggattagcggcggttctggacatcgccctcacgaaggccctggaggcggtatgggagccggaggaggccacagaccgcatgagggacctggcggttctatgggagggtctggcggacatcgccctcacgaggggcctgggcacgggggaccacatggacaccgtccgcacgacgtgccaggccaccgagggcacgaccaccgagggccaccccctcatgagcataggggccatgacggtcctggccacggtggcggtgggcaccgtggacacgatggcggacactcacacggaggtgacatgagtaataggccagtgtgcaggcattttatgatgaaaggaaattgtaggtatgaaaataactgtgcattctaccacccgggagttaacggaccgccactgccatag

SEQ ID NO: 24014 - DNA, 2823 bp, Artificial Sequence
  Description of Artificial Sequence: Synthetic coding sequence
atgggcagcggacctatcgatcccaaagagctgctgaaagggctagactctttcctgaacagagatggcgaggttaaaagcgtcgacgggatttccaaaatcttctccctgatgaaagaagcaagaaagatggtgagccggtgcacatacttaaacattctgttacagacccgttccccagaaatcctggtcaagttcatcgatgtggggggttacaagctcctaaacaactggctgacttactcaaaaacaaccaataatattccgcttctacaacagatactgctgactcttcagcacctcccactgactgtcgatcatttgaagcagaacaacaccgcgaagctggtcaaacagctttcgaagtcatccgaagatgaggagcttagaaaactggcctctgtgctcgtgtctgattggatggcagttattagaagtcagtctagcactcagcccgcagagaaggataagaagaagagaaaagacgaaggaaagtctcgaaccaccctaccggagagacctctcaccgaggtgaaggccgagaccagggctgaagaagccccagagaagaagcgtgagaagcctaagagtttgcgcacaacagccccttcccacgctaaattcaggtctaccggccttgaactggagactccaagcctcgttccagtgaagaaaaatgcttccaccgtcgtggtgagcgacaagtacaatttgaagccaatacctctgaaaagacagtctaatgtggccgctcccggtgatgctaccccaccagctgagaagaaatataagcctctcaacactactccgaatgctacgaaagaaatcaaggtaaaaattatccccccacagccaatggagggcctgggctttctggatgcacttaacagcgcgccagttcctggtattaagattaaaaaaaaaaaaaaggtcttaagtcctactgccgctaagccatcaccatttgagggtaagaccagtactgagccaagcacagcgaaaccgagcagcccggagccggcaccgccatccgaggctatggatgccgatcgacccggtaccccagttccacctgtggaagtgccggagctgatggacaccgcgtctttagagccaggggcactggatgcaaaaccggtggaatcacctggcgaccctaaccaattaaccagaaagggcagaaaaaggaagagtgtcacctggcccgaggaaggaaaattaagggaatacttctactttgagctggacgagaccgaacgtgtgaacgttaacaaaatcaaggatttcggggaggcggctaaacgcgagattctcagtgaccgtcacgcctttgaaaccgcaagaaggctgtctcacgacaatatggaagaaaaagttccgtgggtctgcccacggcctcttgtccttccctcaccactcgtcactcctggatctaatagccaggaacggtacatccaggctgagcgtgagaagggcattctgcaggagcttttcctaaacaaggaaagtccccacgagcctgatccggaaccctatgaacctattccacctaagctgattccattagatgaagagtgcagcatggatgagacaccgtatgtggagacactggagccaggtggaagcggaggaagccccgacggggctggaggaagtaagttgccacctgttctcgccaacttgatgggatccatgggcgcaggtaagggccctcagggaccagggggtggtggcattaatgttcaggagatcctgaccagtatcatgggcagtcccaattctcaccctagcgaagagctgctcaaacagcctgattactctgacaaaatcaagcagatgctcgtgcctcatggactacttggcccaggacccatagccaatggcttcccacctggtgggccaggaggcccaaagggcatgcaacattttcctcccggacccggaggacccatgcctgggccacacggagggccaggagggcctgttggacctcgcctgttaggaccaccccctccacccagaggaggtgaccccttttgggatgggcctggggatcccatgaggggtgggcctatgagaggagggcctggtccaggccctggcccataccaccggggaagagggggacgcggtggtaatgagccgccacctcctccgccaccatttagaggggcacggggaggcaggagcgggggtggccctccaaacgggcgtggaggccctggtggcggaatggtggggggaggcggacataggcctcatgaaggaccgggtggtggtatgggtaatagctccggccaccgccctcacgaggggcctggagggggaatgggctcaggacatcgcccacatgaaggtcccggaggctcgatgggaggcggaggaggacatcgaccacatgagggtcctggcggaggcatctcaggagggtctggtcaccgaccacacgagggccctgggggagggatgggagccggaggcggtcaccggccacatgagggcccaggcggttccatgggcggaagtggtggtcacagacctcacgagggtcccggacatggagggcctcacggccataggccgcatgatgtgcccggtcaccggggacacgaccacagaggcccacctcctcacgaacaccgaggacacgacggcccaggacatgggggaggaggccaccgtggacacgatggtggccactcccacggcggagatatgagtaaccggccagtctgcagacatttcatgatgaaaggcaactgtcgctacgagaataactgtgccttctatcaccctggagtgaatggaccccctttaccctag

SEQ ID NO: 24015 - DNA, 2823 bp, Artificial Sequence
  Description of Artificial Sequence: Synthetic coding sequence
atggggtccggcccaatcgatcccaaagagctgttgaaaggcttggactccttcctgaaccgcgatggagaagtgaaatccgtcgacgggatcagcaagattttttctttgatgaaagaagccagaaaaatggtcagtcgttgtacatatcttaatatcctgctgcagacgcggagtccggaaatcctcgtcaagtttattgacgtaggcggatataagttgctcaataattggctcacatatagtaagacaaccaacaacattccgctgctgcaacagatattactgaccttgcagcacctccccttaaccgtggatcaccttaaacagaataatacagcaaagcttgtgaagcagctgagcaaaagcagtgaggacgaggaactgcgaaagctggcctccgtgctggtgtcagactggatggctgtgattagatcccaatcttccacacagccagcggaaaaggataaaaagaaaaggaaggatgaaggaaaaagccgaaccactttaccagagcgcccactcaccgaagtaaaggcagaaactagggccgaagaggctcctgagaagaagcgagagaaaccaaagtcactgcgcacgaccgctcccagccacgcgaaattccgctccacaggcctggagctggaaaccccctcacttgtgccagtcaagaagaatgctagcacagtagtggtttctgataagtataacctaaaaccaattcccctgaagcgccagtcgaacgtggctgcccctggcgatgccacaccaccagcagagaaaaaatacaagccactgaataccactccaaatgcaacgaaggaaattaaggtcaaaatcattcccccacagccaatggagggcctgggctttctggatgctttaaacagtgcccctgtgcctggcatcaaaattaagaagaagaagaaagtcctttctcctaccgcagccaagccatcaccctttgagggcaaaactagcactgagccctccactgctaaaccgagcagtcccgagccagcgccaccctctgaggcgatggatgcggacagacctggcacgccagtgccccctgttgaagtgcctgagttgatggacacagcttctctcgagcctggagctctggatgccaaaccagtggaatcaccgggtgacccgaaccagctgacgcgtaaaggccgaaaacgtaaaagcgtgacctggccagaggagggtaaactccgagagtatttctacttcgagctggacgagacagaaagggtaaacgtaaataaaatcaaggacttcggggaggcagccaagcgggaaatcctatctgatcggcacgcctttgagactgcgaggagattaagccatgataacatggaagaaaaggtcccttgggtgtgtccacgacccctcgtgctgcctagtcccttagttacccccggaagcaatagccaggagcgatacatccaggccgagagagaaaaaggtattttacaggaactgttccttaacaaagagagtccacatgagcccgacccggagccctacgaacctataccacctaagctcatccccctcgatgaggagtgttcaatggatgagaccccttacgtggaaacactagagcccggaggaagtggtggctcacctgacggcgcaggtggctccaagctgccgcctgtcctcgccaacttaatgggctcaatgggggctggaaagggccctcagggcccaggcggaggcggtataaacgtgcaggagattctgacctcaattatgggatccccaaactctcacccatcagaagagttgctaaaacagccagattactctgataaaatcaaacagatgctggtccctcacggtcttctaggaccaggtcctattgccaacggcttccctccaggtggccctgggggaccgaaaggaatgcagcactttccgcctggcccaggaggacccatgcccggaccccacggaggccctggcggtccagtggggccacgtctgctgggtcctcctcccccacccagaggcggtgaccccttttgggacggaccgggtgatcctatgcgaggtggcccaatgagagggggacccggaccagggcctggaccataccaccggggacgtgggggacgcggaggcaacgagccccctcccccaccccctccatttaggggagcccgtggcggtcgctcaggtggcggtcccccaaatggaaggggcggtcccggtggaggcatggttggcggtggaggtcataggccgcacgagggaccaggaggaggcatgggcaattctagtggtcacagacctcacgaaggcccaggtggaggtatgggaagcgggcatagacctcacgaagggccaggcggttccatgggcggtggtggcggacaccggccacacgaaggtccaggtgggggtatttcaggaggctccggccacagacctcacgagggacccggagggggtatgggtgccggtggtggtcacagacctcatgagggccctgggggatcaatggggggaagcggtgggcacaggccccacgaagggccagggcacggaggcccacatgggcatcggccacacgacgtacccggacaccgcggtcatgatcacagaggtcccccacctcacgagcaccgaggtcatgatggacctggtcacggaggcggaggacaccgcggacacgatggcggacatagccatgggggagatatgtctaacaggcctgtctgccgacactttatgatgaaaggtaactgtcggtacgaaaacaattgcgccttttatcatccaggtgttaatggaccacctcttccttag

SEQ ID NO: 24016 - DNA, 2823 bp, Artificial Sequence
  Description of Artificial Sequence: Synthetic coding sequence
atggggagtggaccgatagaccccaaggagttacttaaaggcttggacagcttcctgaatagagatggagaggtcaagtccgtagacgggatctccaagattttttctctgatgaaggaagccaggaagatggtgtcccgttgcacctacttgaatatacttctgcaaactagatcccctgaaatcctggtgaaatttattgatgtaggagggtataagcttcttaataactggttgacatactccaagactaccaataatatccccctgctacaacaaatcctgctcactcttcagcacctacctctgacagtcgaccacctgaaacagaacaataccgctaagttggtgaagcagctgtcaaaaagctcggaagatgaggagctccgaaagctggctagcgtgctggtgtccgattggatggccgtgatccggagccagagctcaactcagcccgctgaaaaggacaagaaaaaacgaaaagacgaggggaaatcacggaccactctcccggagaggccacttactgaagtgaaagcagagactcgcgctgaggaagcccctgaaaaaaaacgggaaaagcccaaaagcctgcgaacaacagcccctagccatgcaaagttcaggtccactgggctcgagctagaaacgccctcgctcgtgcctgttaagaagaacgcttccactgtggtagtcagtgacaaatacaatttgaagcctattcccctcaagcggcagagcaatgtcgctgcccctggcgatgcaactccacctgctgagaaaaagtacaaacccctgaatactacacctaacgctactaaagaaatcaaggtcaaaattattccccctcaaccaatggaaggcctggggttcctcgacgcgttgaactctgcacccgtgccaggaatcaagatcaagaagaaaaagaaggtcctatctcctactgcagccaagccaagcccctttgaaggcaagacatccacagagccgtctactgctaagcccagctctccagaaccggcaccccctagcgaggcgatggatgccgatagacccggaaccccagtgccgcctgtggaggttcccgagctgatggatacagcctctctggagccgggagcattagatgcaaaacccgttgagagtccaggggatccgaaccagctgacacggaagggtcgaaaaaggaagagcgtgacgtggcctgaagaagggaagcttcgcgagtatttttattttgagctcgacgagaccgaacgcgtcaacgtcaataagatcaaagatttcggtgaggcagcgaaaagggaaattctatccgataggcacgcgtttgagaccgccaggaggctgtcgcacgacaacatggaggagaaggtgccgtgggtgtgccctcgcccactggtgttgccctcaccactggtgacacctggttctaattctcaagaacggtacattcaggccgaacgggagaagggaatcctgcaggaactgttcctgaataaggagagcccccacgaacctgatcccgaaccatatgagcccattccccctaaactgataccactagacgaggaatgctctatggatgaaaccccatatgtcgagacactcgaacccggaggctctgggggatccccggacggggcagggggatcgaaattgcctcctgtcctagctaatctgatggggagtatgggagccggaaaggggcctcagggccctggcggaggcggtattaatgtgcaggagatcctgacaagcattatgggctccccaaattcccacccgtctgaagagctcttaaaacagcccgactactctgacaaaatcaagcagatgttagtgccacacggactgctcggaccaggcccaattgcgaacgggttccctccgggtggccctggcggacccaaggggatgcagcactttccgcctggcccaggtgggccaatgcccggaccgcatggcggtccagggggacctgtcggtcctcgtctgctgggtcctccaccacctccccgaggaggagacccattttgggacggacctggagacccaatgcgaggcggtcccatgaggggtggcccaggtccagggccaggaccttatcaccggggacgagggggtagaggcggaaacgagccgccaccgcctcctcctcccttccggggtgcccgagggggtcgcagcggaggcggtccccctaatgggagaggaggtccaggcggtggaatggtgggaggcggagggcaccggcctcatgaaggacccggtgggggtatgggcaatagctccggccaccggcctcatgagggcccaggtggtgggatggggtccggacaccgccctcacgagggacccggaggatctatgggtggcggtggcggacatagaccccatgagggcccaggaggcggaatctcaggcggttcgggacatagaccacacgaagggcctggcggtgggatgggcgcaggaggcggtcaccgcccacatgaggggccagggggaagcatgggaggatctggtggacaccgaccccacgaaggtcccggtcacggagggccacatggccacaggcctcatgatgtccccggtcaccgaggccacgaccaccgaggacctcccccacacgaacaccggggacatgatggacctggccacggaggtgggggacatcgtggacatgacggcggtcattcgcacgggggtgacatgtcgaacagacctgtttgcaggcacttcatgatgaagggtaactgccgttatgaaaataattgcgctttttatcatccaggagttaatggacctcctctgccttag

SEQ ID NO: 24017 - DNA, 939 bp, Artificial Sequence
  Description of Artificial Sequence: Synthetic coding sequence
atggggtctggtccaatcgacccaaaggagctgctgaagggtctggacagttttctcaatagagatggtgaggtgaagagcgtggacggcattagtaagatcttctctttaatgaaagaggctcgcaagatggtttcccgatgtacctacctgaatatcctcctgcagacgcgtagccctgagattctcgtgaaatttattgacgtcggcggatacaagttgctcaataattggctgacatacagtaaaacgaccaacaacattcccttgcttcagcagatcttgcttactctccagcatctgccactcactgtcgatcacctgaaacaaaacaacaccgctaagcttgttaaacagctcagcaaatcctccgaggatgaggaattgagaaagctggccagcgtccttgtcagcgactggatggccgttatccggtctcagtcatctacccaacctgccgagaaggacaagaaaaagcgaaaagatgagggcaagagcagaacgaccctccctgagcggccattgactgaggttaaggccgagacccgtgccgaggaggctccggagaaaaagcgggaaaaaccgaagtctcttcgaaccacagccccaagccatgccaagtttcgcagtaccggactcgaactcgaaaccccatctctggtacccgtgaagaagaacgcctccaccgtggtggtgtcggacaaatacaacctcaagcccattccacttaagagacagagtaatgttgccgctcccggtgacgccacccctcccgctgagaaaaagtacaagcctctgaacactaccccgaatgccacgaaggagattaaagtcaaaattattccccctcagccgatggaaggacttggctttttggatgccctcaactcagcacctgtgcccggtattaagattaagaaaaaaaaaaagaagaagtag

SEQ ID NO: 24018 - DNA, 939 bp, Artificial Sequence
  Description of Artificial Sequence: Synthetic coding sequence
atgggctccggacccatcgatccaaaggagctcctgaagggtctcgatagtttcctcaacagggacggggaagtgaaatccgtggatggcatctcgaagatcttctccctcatgaaggaggccaggaaaatggtctcccgatgtacctacttgaacattcttcttcagactagaagccccgaaatactggttaagttcatagatgtgggaggatacaaactgcttaacaactggcttacatactctaagactaccaataatatcccgctgctgcagcagatcctgctcactctccagcatcttcccctcactgttgatcatctcaaacagaacaacaccgccaagttagtgaaacaactgtctaaatcgtcggaggacgaggagctccgcaagctcgcaagtgtgctcgtatccgactggatggcagtgatcagatctcagtcgagtacacagccagccgagaaagacaagaaaaagcgcaaggatgagggtaagagcaggaccactctccctgaaagaccactgaccgaagtgaaggcggagacaagagcggaggaggccccagaaaaaaagagggagaagccaaagtccctccggacaaccgcccctagtcatgcaaagttcagatctaccggcctcgagctggagacccctagtctggttcccgtgaagaagaacgcctccaccgttgtggtaagcgacaagtataacctcaagccaatccctctgaaacggcagtctaacgtcgcagcacccggagacgctacacctccagccgagaagaagtataaacctctgaacacaacacccaacgccacaaaagagatcaaggtgaagattatacccccacagccaatggaggggctcggatttctggatgcattaaactccgcgcctgttcccggaattaaaatcaaaaagaagaagaaaaaaaagtag

SEQ ID NO: 24019 - DNA, 939 bp, Artificial Sequence
  Description of Artificial Sequence: Synthetic coding sequence
atgggaagcggccctatcgatcctaaagaattgctgaaaggtctggacagttttctgaacagggatggtgaggtaaagtctgtggatgggatctctaagatcttcagcctgatgaaagaggccaggaagatggtgtcccggtgtacctacctgaacattctcctgcagaccagatcccccgagatactggttaaattcatagatgtcggcggatacaaacttttgaataattggcttacttattcaaaaacgactaataatatccctttgttgcagcagattctgctgaccctccaacacctgcccctgactgtcgatcatttgaaacagaataataccgccaagctcgttaagcaactctcaaaatcaagcgaagacgaggagctgcggaagctcgcctctgtgctcgtttctgattggatggccgtcatccgctctcaaagttccactcagcccgcagaaaaagacaagaaaaaaaggaaagacgaaggaaaaagcaggaccacgctcccggagagaccgctgaccgaagtgaaggcagaaacccgtgctgaggaggcacccgagaagaaacgggaaaagccaaagtccttgaggacaacagcgcctagtcatgccaagttcaggtccacagggttagagctggagacaccctctctggtgcccgtcaagaagaacgcatctacagtcgtcgtgtccgataagtataatctaaagccaattcccttaaaacggcagtctaacgtggctgcaccgggagatgccacccctcccgcagaaaagaagtataaaccacttaacaccacacccaacgccacaaaagaaatcaaggttaagattattccacctcagcctatggaaggattaggatttctagatgcgttgaacagcgcgcctgtccctggaatcaagatcaaaaagaaaaaaaagaagaaatag

SEQ ID NO: 24020 - DNA, 939 bp, Artificial Sequence
  Description of Artificial Sequence: Synthetic coding sequence
atgggatcaggccctatcgatccaaaggaactgttgaagggcctggattctttcctcaaccgtgacggggaagtgaagtcagtggacggcatttctaaaatctttagcttgatgaaggaggccagaaagatggtcagcaggtgcacatacttgaatatcctgctgcagactagatctccggaaattttagtcaaattcatagacgtgggtggctataaactattaaacaattggcttacctacagtaagactactaataacatcccactgctgcagcagattttgctgactctccagcacttgccgttgaccgtggaccacctcaaacagaacaatacagctaaactggtcaagcagttgagcaagtcttctgaggatgaggaacttaggaaactcgccagcgtcctggtatcagattggatggccgtcattaggtcgcaatctagtacccaacccgcagagaaagacaaaaagaaacggaaggacgagggaaagtcccgcactaccctgcctgaaagacctctgactgaagttaaagcagaaacgagagccgaggaagctcctgagaagaagagagagaaacctaagtccctgcgcacaactgcgccttctcacgcaaagttccgctcaacaggcctagaactggagaccccgagtcttgtccccgtgaaaaaaaacgcttcaaccgtagtggtgtccgataagtataatctcaaaccaattcctctgaaaaggcaatccaacgtggccgctccaggcgacgctacccctccagccgagaagaaatataagccgctgaacacaacccccaacgcaaccaaggaaatcaaggttaaaatcatccctccacagcctatggaaggactcggattcctggacgcgctgaactccgccccagtgcccggaattaagatcaagaaaaagaagaagaaaaagtag

SEQ ID NO: 24021 - DNA, 939 bp, Artificial Sequence
  Description of Artificial Sequence: Synthetic coding sequence
atgggaagcggtcccattgatcctaaggagctcctgaagggacttgactcttttctaaaccgcgatggcgaagtgaagtctgtggacgggatttccaagatattctctctcatgaaagaagctcgcaaaatggtcagccgctgtacctacttgaatatactgctgcaaacaaggtcgccagaaatcttagtgaaattcatcgacgtgggcggatataagctgctaaacaattggctgacgtactcaaagaccacaaacaatattccactcctccaacagattctgcttactttgcagcaccttccccttaccgtagaccacctgaagcagaataacactgctaagttggttaagcaactgtctaaatcttctgaagacgaagagcttcggaagcttgcgtctgttttagtaagcgactggatggccgtaatcaggagccaaagctcaactcagcccgctgagaaggacaagaaaaaaagaaaagacgaagggaaatctcggaccactcttcctgagcgccctctaactgaggtgaaagcagaaacacgggcagaggaagcccctgaaaagaaacgtgagaaacccaagagcctcagaaccactgctccgtcccatgctaaattccgctcaacagggctcgagcttgagaccccaagcttagtgcctgtgaaaaagaacgcttccactgtagttgtgtctgataagtacaacctgaagccgataccattgaagagacaatccaatgtggccgcacccggagatgcaacacctcccgcagagaagaagtataagccattgaacacaactcccaacgctacgaaagagatcaaggtgaaaatcataccacctcagcccatggaaggactaggcttcctcgacgctttgaattcagctcccgtgcccggtatcaaaattaagaagaagaagaagaaaaagtag

SEQ ID NO: 24022 - DNA, 939 bp, Artificial Sequence
  Description of Artificial Sequence: Synthetic coding sequence
atgggctccggacctattgaccccaaggaactgcttaaggggctggacagttttctgaatagagatggagaggttaagagcgttgatggaatcagcaagatttttagtctcatgaaagaggccaggaagatggtgtctcgctgcacataccttaacatccttctgcagacaagaagcccagagatactggtgaagtttattgacgtggggggttacaaactcctgaataattggctcacctattctaaaaccacaaacaacataccattgctgcagcagatactgttaaccctgcagcatttgccactgactgtcgatcacctgaaacaaaataatactgcgaaattggtcaaacagttatccaagagttcagaggacgaagaactgaggaagctggcttctgtgctggtctctgattggatggcggttatccggagtcagagctcaacacagcctgccgagaaggacaaaaaaaaacgcaaggacgaaggtaagagccggacaaccttgccagagcgcccacttacagaggtgaaagccgagactcgtgcagaagaagcccctgaaaaaaaacgagagaagcccaaatctctgagaactacagcaccttctcatgcaaagtttcgcagcaccggccttgaacttgaaactcctagtcttgtccccgtaaagaagaacgcatcaaccgtggtggtctctgacaagtacaatctgaagcccataccactgaaaaggcagagcaacgtggccgcaccaggggatgctactccacccgcagagaagaaatataaacccctgaacacaacacctaacgccactaaagaaatcaaagtgaagataatacccccacaaccgatggagggattgggatttttggatgccctcaatagcgcccctgtgccgggtatcaagatcaagaaaaaaaaaaaaaagaagtag

SEQ ID NO: 24023 - DNA, 939 bp, Artificial Sequence
  Description of Artificial Sequence: Synthetic coding sequence
atggggagtggacccatcgaccccaaagagctgctgaaagggttggattccttcctgaaccgggacggcgaggtgaaaagtgtcgacggcatttcaaaaattttttccctgatgaaggaagccaggaaaatggtcagtagatgtacctacctgaacatactcctccagaccagatctcctgagattcttgtcaagtttatcgatgtcggcggatacaaactgctcaacaactggctgacctactcaaaaactactaataacatccctctcctgcagcagattctactgactctccagcatctgccactgacagtagaccacctgaagcagaataacacagctaagcttgttaagcagctttctaaatcctccgaggacgaggagctacgcaaactggccagtgtcctggtgtccgattggatggccgtcatcagaagtcaatcatccacccaacccgctgagaaggacaaaaagaagcggaaggatgaagggaaaagccgtacaacattacctgaacgaccgctcaccgaggtgaaggccgagacccgggctgaagaagcccctgagaagaagcgagagaagcccaaatctctcaggaccactgccccatctcatgcaaagtttcgaagcacagggctggagctggagacaccctcactagttccagttaaaaagaatgcctccaccgtcgttgtttccgacaagtacaacctcaagcctattcccctcaaaagacagagcaatgtggccgctccaggagacgccaccccccctgcagagaaaaagtacaaacctcttaacaccaccccgaacgctactaaagaaataaaggtgaaaattatccctccacagcccatggagggactcgggtttctggacgcccttaatagcgctccagtccccggtatcaagatcaaaaagaaaaaaaaaaagaaatag

SEQ ID NO: 24024 - DNA, 3630 bp, Artificial Sequence
  Description of Artificial Sequence: Synthetic coding sequence
atgttcttgatgaatgcaagcccagtagtggcactgcagagcaagtgggaggcattcggtccgcctggttcttgccgatttcctagatgtttttccgaagcggatgaaggagtggagagcgcttctgtgagcgcaagagttcagatgctgatatccaccctgcagcgggacggcgctgctaggggcacttcagatgaacgagcagcccagaggggacacagagccgaaggatgccatgatgcacggccagccgctaaacctaccgtgcataaagaacctccggctctggcagtgtgtggactggttgctgactttgacccgatgggtgaagaagagactaccgattttggcccactggtgctcgacagcgattctgacgactctgtggaccgagatatagaggaggcaattcaagagtatctgaaggctaaaagcggggcagcacagcctggggctgggggtgcacagccgggagctgcccaaccatccagagctgctgggggtggatcacgatgcaagccggagccggctcacggctcggcgccaactgccttgtgccctccaaaactagtgcctggatcaggcggaggcccagggtcccaagtgggctcatctaaggatcaagggagtgccagccctgtgagcgtgagctccgatgactctttcgaacagtcaatacgcgctgagatcgagcagtttctgaatgaaaagcggcagcatgaaacacagaaatgtgatggcagtgttgagaaaaagcccgacacgaatgaaaatagtgctaagtctctcttgaagagccaccaggaacccccaacaaaggtcgttcaccggcagggtctgttgggggttcaaaaagaatttgcatttagaaagccacctcggctggccaagatgaacgtgcagcccaggagccttaggtccaaagttaccacaacacaggaaaatgagggatcaacgaaaccagccaccccatgcaggccaagcgaagctgcacagaataaagggggaattaaacgctccgcttctgctgctcgccgaggaaagcgcgtgatgtcagccgctcaggcctccgaggcgtcggattcaagcagcgatgacggcatcgaagaggcaatccagctgtaccaactgcagaaaaccagaaaggaggcagacggtgacctgcctcagcgggtgcagttgcgggaggagagggcaccagatccgcctgcccacagtaccagctccgcaacaaagtccgcactgcccgaaacccatcgtaagacaccttctaagaagaagctggtggccaccaagacaatggaccctggtcccggaggactggatactgaccacgcccctaagcttctaaaggaaactaaggcaccccctcctgcgagccctgctagcaggtctgagttcgtcgagcggtcctcctgccgggctgatacaagcgccgagttgatgtgcgcagaggctatcctggatatatccaagaccattcttcccgcacctgtggaaggatccgacggctccctgtccgccagccccctcttctattctccaaatgtacccagccgttctgatggggactcctcctccgtggattccgacgattcgatcgaacaggagattaggacattcctcgctttgaaggcacagtctggcagtctgctggctaggggtgaaagctgcccccaggcagcccaaggtcccctcttgcccccaggattaaatagccagaccggcggacacaagactccccttagcaaaactccagacccactgctgggatgcaagaggaagcgccgtgggggaggccacgtccgtcccagtacccccaagaaaatgcaggaggtcgtaaaagacgggtcacaagacgccgaccactctcaagggagagctgagcccggacacgagaggcgggatctgcctattcagggtaaggcctccgaggctctgggaggcgaaggaactgcccgaggccctggcgacacgagaatgtctcagggccaaggcaaaaccgacgaagcgaggcgcctggacgaaaaagagtccagcgaagataaaagctctagtttagattccgatgaggacctggacaccgccatcaaggacctcctgcgatccaagagaaaactcaagaagcgatgcagggagccccgagcagcgtgtaggaaaaaagttcgattcagtacagcccagacccattttctggaacagctgggcggactacggagagactggaaagaccgtggtcccccagtgctgaagagttgcctctctaagtccaaacgtgacagcggtgagggccctgggaagaaaccacccagcgtgttcggatcaaccgccgagcgaatgcgccaagaaggagccgcatcccaggatgctgcgcttgccttcagagttcgacggccagctagcgcgtctgcttccgagggcaatcccttccctagggaatcccagggcccagctccctccccaggaagcttatcggatgatagttctagtgttgatagcaacgatagcattgaactcgaaatccgaaagtttttggctgagaaagccaaagaaagtgtgagttcttcagaggtacaagccgaggggcctacagccctgggcaccggcggaccagctcgcccagaagttctatgccgcaaggaaccagcccctccccctggagtgtgtactcgttcccagagggcccgaggagttccccatctcgcagaaggcttaagagggactgagagtgccggtgcccagggaaccgccggattattctcacaaggtggaaaagggctccccgcagctcctgctaggggggatccagtcccaccgcgttctacctctgggggtgtgagcgccaaagggctgagtgtgagccgcaggaacgtgtacgtgcataaagaccagtcaccgcgtggagccgaaccagcagccaagtcggcctttggacaactgccgtcatgcgcaacggcgggtactgaggctgggggtgcaagagggacgttccacatggggtgcggaagtccctcttttttgacaccatccccaggggcagagagagatgcaggcgctcaggctgacaggaccccaccttggagcgatttcgcacaccaatccaggttgcctagcccgtgggttttgagaagtgaggggagggacgcggtatggcggggaggtgtcgggtcagaaagagacaaaggaagcgagggccctgctcgcggattgccgtctctgcccctggccggttttagtcccttgctcagcacccaactcttccacttcggtaaaggggtatcctggggcggtcgccaggccggactttttagccctcacctgggtctgccactgcaaggtccctccttctcagctttccgagaagcccaagccggtccttccccagtcttcggatccccgcacctgctagccaagaaggacggcggaccttggcctacacggaaggcccaggcagggctcagccttcatgatcgacggagcagcggaagcgaagaatccatcctggatttgaggtatcgcaggagggttaatcgggatgatcaggagcaggacgctctgggctcagacgcatccgattttagtgacacttctactgaggatagcggcggaagtagtgttgtgaaggtttag

SEQ ID NO: 24025 - DNA, 327 bp, Artificial Sequence
  Description of Artificial Sequence: Synthetic coding sequence
atgtttctgatgaacgcttcacccgtagttgctctgcagagcaagtgggaagcattcgggcctccgggatcatgccgttttcccagatgctttagcgaggcggacgaaggcgttgaatccgccagcgttagcgcacgcgtgcaaatgttaattagcacattgcaacgcgacggcgctgccaggggcaccagcgatgaacgggctgctcagagggggcatagggccgagggctgtcacgacgctcggccagcggctaagcccactgtgcacaaagagccgcctgccttggccgtttgcgggttggtggcggattttgaccctatgtag

SEQ ID NO: 24026 - DNA, 1728 bp, Artificial Sequence
  Description of Artificial Sequence: Synthetic coding sequence
atgccccctggaaaggtactccagccagtgctgaagatgaaggtcgacgaactgtttttgtactggctctccgaagcctccactcagaggatgctccaggattgtctgcgacgaatcaaagctcccggtagagaccagcccaccccaggcgacggcgagcagccaggagcctggcccacggccccactggctgctcccagacccagcgggttggagccacctggaaccccaggaccaggtccggcactgcctctgggggcagcatcatctcccagaaatgccccacacgtcaggggcacgcgcagatcagccggaactcgcgtggtccagactagaaaggaagaaccgttgcctcctgccacaagccagagcatcccgactttttatttccctcgagggaggcctcaggattctgttaacgtggacgctgtgattagcaaaatcgaatccacttttgcaaggttcccacacgagagagccacaatggatgatatgggcttagttgccaaggcatgcgggtgtcccctgtactggaaaggacctcttttctacggcgcagggggagagaggacagggagcgtctcagtgcataagttcgtcgcaatgtggcgcaaaattctgcagaattgtcatgacgatgctgcaaagtttgttcaccttctcatgagcccaggctgtaactacctggttcaggaggacttcgtccctttcttgcaagacgtcgtcaatacgcaccctggcctgagctttctcaaagaagcctccgaatttcactcccgttatatcactacggtcattcagcgaatcttctatgctgtcaaccgttcttggagtgggcgtatcacatgtgctgagctccggaggagctctttccttcaaaatgtggctctcttggaagaggaggcggacataaaccaactgaccgaatttttctcctacgaacatttttatgtcatctattgcaaattttgggagctagataccgaccacgatctgctgatcgacgctgacgatctggcaaggcacaatgatcacgccctctcgactaagatgatcgaccgcatttttagtggggctgtgacaaggggtagaaaagtccagaaggagggcaagatttcctacgcggatttcgtgtggttcctgatttccgaggaagataagaagacaccgacctccatcgagtattggttcagatgtatggacctggatggtgacggtgctttgagcatgttcgagctagaatatttctatgaagagcagtgtcggcgactggactctatggcgattgaagctctgccattccaggattgtctttgtcagatgctcgacctggtaaagccacgaacggagggaaaaatcaccctgcaggacctgaaacgctgcaaactggccaacgttttttttgacaccttcttcaacatcgagaagtacctggatcacgaacagaaagagcaaatcagcttactacgagatggagatagcggcggtccagagttgtccgattgggagaaatacgctgctgaagaatacgacatcttggtggcagaggagaccgctggagagccctgggaagatggcttcgaggccgaattatccccagtggaacagaagctctccgccctacggtcccccttagctcagaggccgtttttcgaagccccttctccactgggagccgtcgacttatacgagtacgcttgcggcgatgaggacctggaacccctgtag

SEQ ID NO: 24027 - DNA, 2286 bp, Artificial Sequence
  Description of Artificial Sequence: Synthetic coding sequence
atgccgaatttttgcgccgctcccaattgtaccagaaagtccactcagagcgatctggccttcttcagatttccccgtgatccagcccgttgtcagaagtgggtggagaactgccgaagagcggatctggaggacaaaaccccagatcagcttaataaacactatagactctgtgcaaaacatttcgagacttctatgatctgtcggacatccccctacaggaccgtcctaagggacaacgccatcccgacaatttttgatctcaccagtcacctgaacaatccccactctcgacatcgaaaaaggattaaggaactttcggaggacgagatccgtacccttaaacagaaaaagatcgatgagacatctgaacaggaacagaaacacaaagagaccaataactctaacgcacagaacccttccgaggaagaaggagaagggcaagatgaagacatactccccttgaccctcgaagagaaagagaacaaagaatatctgaaatcactgtttgaaattctgattctcatgggaaagcaaaatattccgctggacggtcatgaggctgatgagatccccgaaggcttgttcactcccgacaactttcaggctctcctcgagtgccgaattaacagcggcgaggaggtgctgcgcaagaggttcgagactacagccgtgaacactctgttctgctccaagacccagcaaaggcagatgctggaaatttgtgagagctgtattcgcgaggaaacactccgtgaagtgagggacagtcactttttctccatcatcacagatgatgtcgtagatattgctggagaagagcacctacctgtcctagttaggtttgtagacgaatcccacaatttgcgtgaagaatttatcggctttttgccctacgaagcggatgccgagattctcgctgtgaagttccacactatgataactgaaaagtggggcctgaacatggagtactgccggggacaggcctacatagtaagctctggattttcctctaagatgaaagtagtggcatcacggctgctggagaagtaccctcaggctatctacaccctgtgtagtagctgcgcgttgaatatgtggctcgcaaagagcgtgcctgtgatgggggtgtcggtggccctcggaactattgaggaagtttgcagcttcttccataggagcccccagctgcttctcgagctggacaacgtgatcagcgtgctattccagaattccaaagaaaggggcaaagaattgaaagaaatttgccatagtcagtggaccggacggcacgatgccttcgaaatacttgtggagctgctacaggccctggtgctgtgcctcgacgggatcaatagtgataccaacatcaggtggaataactacatcgcgggtcgtgccttcgttctttgttcagccgtttccgactttgacttcattgtcaccatcgtggttcttaagaacgtcctatcctttacccgcgcttttggaaaaaacctgcaaggacaaaccagcgatgtcttcttcgcagccggatcccttaccgcagtgctgcatagtttaaacgaagtcatggagaacattgaggtatatcatgaattttggttcgaagaagccactaacttggctaccaaactggatattcagatgaagctccctggcaagttccggcgtgcgcaccaaggcaaccttgagtcccagctcacaagcgagagttactacaaggagaccctgtctgtgccaaccgtagaacacatcatccaggagcttaaggacatcttttctgagcaacatctgaaggctttgaaatgcctgtctcttgtaccgagcgttatgggtcagctcaagttcaacacatcagaggagcatcacgcagacatgtataggtctgatctgccaaatcctgataccctttctgctgagctccattgctggagaattaagtggaaacaccggggaaaagatattgagctgcccagtacaatatacgaagcactgcatttgccagatatcaagttttttccaaacgtctacgcccttctcaaggtgttatgtattctgcccgtaatgaaggtggagaatgagcgctatgaaaatggtcgcaagaggctgaaagcttaccttcgaaacaccctcacagatcagagatctagcaacctggcgctcttgaatattaactttgacattaagcacgatcttgatttaatggttgacacctatataaagctatatacgtctaagtctgaactccccactgacaactcagagacagtggagaatacctag

SEQ ID NO: 24028 - DNA, 1761 bp, Artificial Sequence
  Description of Artificial Sequence: Synthetic coding sequence
atgggcaaacaaaatatcccacttgacggtcatgaagccgatgaaattcctgagggactctttacccctgataattttcaggcattgctggagtgccgtatcaattctggggaggaggtgttgagaaaacgcttcgagactacagcagtaaacacgctgttttgctctaaaacccagcagagacagatgctggagatctgtgagagttgcattagagaggagaccctacgcgaagtgagagacagccacttcttttctatcataaccgacgatgtggtggacatagccggagaggagcacctaccagtgttggtacggtttgtggacgagtctcataatttgagggaggagtttatcgggtttctcccctatgaagctgacgcagagattttagccgtgaaatttcatactatgattacggagaagtggggactgaacatggagtactgtcggggtcaggcttacattgtaagtagcgggttctcctctaagatgaaggtcgtggcatcccggctgctcgagaaataccctcaagccatctacaccctgtgttcttcctgtgctctgaatatgtggctggctaaaagtgttcccgttatgggagtgtctgtggcattgggcaccatagaggaggtttgcagttttttccacaggtccccccagctgctgctggaactggacaatgtaatctcggtgctattccagaattctaaggagcgaggaaaggagttaaaagagatttgtcactcacaatggaccggaagacatgatgccttcgagatcctagtagaactgttacaggccctcgtgctttgcctggacggaatcaatagcgatacgaacatcagatggaacaattatattgcaggcagggctttcgtcctctgcagtgcagtttcagactttgatttcattgtcacaattgtggtgctcaaaaatgtgttgtccttcacacgagcctttgggaagaaccttcagggacagacttcagacgtttttttcgctgccggtagcctaacagcagtgctacactcccttaatgaggtaatggagaatatcgaagtgtaccatgaattttggttcgaggaggctaccaatctggctactaaacttgatatccaaatgaaattgccgggtaagttccgaagggcacaccaggggaatctcgaaagccagttaacatctgaatcttactacaaggagaccttgtctgtgcccactgtcgaacatattatacaggagttgaaggacattttttctgaacaacacttaaaggcattaaagtgtctgtccttagtcccatctgtgatgggccagctcaaattcaacacttccgaggagcaccatgccgacatgtatcggagcgatctcccaaaccctgacacactttctgccgaattgcattgctggaggattaaatggaaacatagaggcaaggatatagagctgccttccaccatttatgaggccttgcacttacctgatataaaatttttccccaacgtttatgccttgctgaaggttctttgtatcctgccagtgatgaaggtcgaaaacgagaggtacgagaatggccgaaaaaggctcaaagcctacctcaggaacactctgaccgaccaacgcagctcaaatctggccctgttgaacatcaactttgatattaaacacgatctggaccttatggtggatacctacatcaaactgtacacgagcaaaagcgagctgccgacggacaactcggagactgtggaaaacacatag

SEQ ID NO: 24029 - DNA, 939 bp, Artificial Sequence
  Description of Artificial Sequence: Synthetic coding sequence
atggcgaaccgtacagtgaaggacgcacactctatccacgggaccaacccacagtatctcgtggaaaaaatcatcagaacacgcatttacgagtcaaagtactggaaagaagaatgctttggcctcaccgcagagctggtggtggataaagctatggaactgcggttcgtgggcggtgtctacggtgggaatattaagccgaccccttttctgtgccttacacttaaaatgctgcaaatccagcctgaaaaagatatcatcgtggaattcattaagaatgaagactttaagtatgtgcggatgttgggtgcactctacatgaggctgactggaacagctattgactgctataaatacctggagcccctgtataacgattatagaaaaattaaatcccagaataggaacggggaattcgaattgatgcatgtagacgaatttattgatgaattgttgcactctgagcgggtgtgcgacattatcttacccaggctgcagaagcgatatgtgttggaagaagctgaacaactggagcctagggttagtgcactggaagaagatatggatgacgtcgagagttcagaagaggaagaggaagaggatgaaaagctcgaacgcgtgccaagccctgaccacaggcgcaggagttatcgcgacctcgacaaacctcggaggtcgccaaccctacggtaccgcagatctcggagcagaagtcccaggcgtcgcagtcgctcgcccaaacgacgctctccctcaccccgtcgggagcgccaccggagtaagtctccccgacgccatcgctcccggagcagggaccggagacaccgctcccgatcgaagtccccaggtcaccaccgctcgcacaggcaccgatcccactcgaaaagccccgagaggagcaagaaatcacataaaaagagcaggcggggtaacgagtag

SEQ ID NO: 24030 - DNA, 1308 bp, Artificial Sequence
  Description of Artificial Sequence: Synthetic coding sequence
atgtgcggcggtgttagaggcgttggcactggagggattgtgagtacggctttctgtctcttatacaagctgtttacccttaagctcacgcggaagcaagttatgggactgatcacacacactgatagtccatatatccgagctctcggcttcatgtacatcagatatactcagccccctacagacctgtgggactggttcgaaagctttttagatgacgaggaagacctggacgtcaaggctggagggggatgcgtgatgacaatcggcgaaatgctccgatcatttctgactaagctcgaatggttctctactctgtttcctcgcatccccgtcccagttcagaagaatattgaccagcagataaaaactcggccacgaaagatcaaaaaggatgggaaggagggggcagaggaaattgataggcacgtcgagcgcagaagaagccgttcccctaggagatctttgagtcctagaagatctccacgacgctcaagatcacggagccaccatagggagggccatggaagtagctctttcgacagagagcttgaaagagagaaagagaggcagcgacttgagagagaagctaaggagagggaaaaggagcggaggaggagtagatcaatagatcggggacttgagcgtcgccgatcccggtcacgcgaaaggcatcgatcccggtcccgttctcgagacaggaaaggggaccgaagagatcgagatagagagcgggagaaggagaatgaaaggggcagaaggcgcgacagggactatgacaaggaacgtgggaacgagagagagaaggaacgcgagagatctagggagaggtcaaaggaacagagatcccggggagaggtagaggagaagaagcataaggaggacaaggacgaccggaggcaccgggacgacaaacgcgacagtaaaaaggagaaaaaacactctcgctcaaggtcccgggaacgaaaacacaggagtagatcaaggtcccgaaatgctggcaaacgttctaggtcacgcagcaaggaaaaatcgtcgaagcacaagaatgagtccaaagagaaatccaacaaacgttcccggtctgggtcccagggaagaaccgactctgtggaaaagtccaagaagcgagaacatagcccatctaaagagaagtccagaaaacggagtcggtcgaaagagagaagccacaaaagagaccacagtgacagcaaggatcaatccgacaaacacgatcgaaggcgctctcagtctattgagcaggagtcccaggaaaagcaacataaaaacaaagacgaaaccgtatag

SEQ ID NO: 24031 - DNA, 573 bp, Artificial Sequence
  Description of Artificial Sequence: Synthetic coding sequence
atggcaaataactcccctgcactcacaggcaactctcagcctcagcatcaggcagccgctgccgcagcacagcaacagcagcaatgcggcggaggcggagccactaaacctgccgtctccggaaagcaaggaaacgtccttcctttgtgggggaatgagaagaccatgaacctcaatcctatgatcctgaccaacatcctgtcctccccttacttcaaagttcagctgtatgagctgaaaacctaccatgaggtggttgacgagatctattttaaagtcacccacgtggaaccttgggagaagggcagccggaagacagcgggtcaaaccggaatgtgtgggggagtgagaggcgtgggcaccgggggaattgtgagcaccgcattttgtctgctgtacaagttgttcacactgaagctgacccgcaagcaggtcatgggtctcattactcataccgacagcccgtatatccgtgccctggggttcatgtacattagatatacacagccccctactgacctctgggattggttcgaatccttcctggacgatgaggagtttttcaccctatag

SEQ ID NO: 24032 - DNA, 1641 bp, Artificial Sequence
  Description of Artificial Sequence: Synthetic coding sequence
atggcaaacaatagccccgcactgaccggtaacagccaaccccagcaccaggcagctgccgctgctgcccagcagcaacagcagtgtgggggaggaggggcaacaaagcccgcagtgtcagggaagcaaggcaatgttctccccttatgggggaacgagaaaaccatgaatctgaatcccatgatcctgacgaatatcctatcaagcccctactttaaggtgcagctttatgagctaaaaacgtatcatgaagttgttgacgagatttacttcaaagttacccacgtggaaccatgggaaaaggggtcacgcaaaacagctggacagactgggatgtgcggtggagttcgaggcgtggggacagggggaattgttagcaccgctttttgccttctgtacaaattgtttaccctcaagttgacccggaaacaagtgatgggtctgattactcacactgacagcccttatattcgtgccctgggtttcatgtatatacgatacactcagcctccaacagacctgtgggattggttcgagagctttctcgatgatgaggaagatctggacgttaaagcaggaggcggatgtgtcatgactataggcgaaatgctaaggagttttcttaccaaactggagtggtttagtacactgttccccaggatcccagtcccggtccagaaaaatatcgatcagcagattaagactagaccaagaaagatcaagaaagatggcaaagagggggcagaggagatcgatagacatgtcgaaaggaggagatctcgcagccctcgtcgcagtctctccccgagacgaagtccaaggaggagccgttcccgcagtcaccatcgcgaaggacatggatcatcttctttcgaccgggagctcgagcgcgagaaagaacgccagcgcttggagcgcgaagccaaagaaagagaaaaagaaagaaggcggtccagaagtatcgaccgcggactagagcggcgtcgctcgcgatctcgcgagagacaccgaagtagatcacgctcaagagaccggaagggtgaccggagggatagggatcgcgagcgcgagaaggagaatgagaggggtagaagacgggatcgcgactacgacaaggagagagggaatgagagagagaaagagcgggagcggtctcgggaaagatccaaggagcagcgatctcgcggagaggttgaagaaaagaagcacaaggaagataaggacgacaggcggcaccgggacgataagagggattccaagaaggaaaagaagcactcgcggtctcgaagccgtgagagaaaacacaggagccgcagtcggagccggaacgccggtaagcgatctcgctccaggtcaaaggaaaaaagttcaaagcacaaaaacgagtccaaagaaaagtctaataaaaggtctaggtccggcagccagggacgtaccgacagcgttgagaagtctaaaaagcgtgaacactccccctcaaaggaaaagtcacggaagagatcacgttctaaagagagatcacacaagcgggatcactccgatagcaaagaccagtcagacaaacatgaccggagacgctctcagtcgatcgagcaagagtcacaggagaagcagcacaaaaataaggacgagaccgtgtag

SEQ ID NO: 24033 - DNA, 2010 bp, Artificial Sequence
  Description of Artificial Sequence: Synthetic coding sequence
atgcagaatagtcacatggatgagtaccgcaactcatctaatggcagcaccgggaattcatctgaggtggttgttgagcaccccaccgacttcagcacagaaataatgaatgtcactgaaatggagcagagtcccgacgacagccccaacgtaaatgcctccaccgaagaaaccgaaatggcctctgcagtggatctccccgttacactaacagagaccgaggccaatttcccacctgagtacgagaaattttggaagaccgttgagaacaacccccaagacttcacaggatgggtatacctgctgcaatacgtggagcaagagaatcacctgatggcagcacgaaaggcattcgatcgcttttttattcactatccctactgctatggttattggaaaaaatacgccgacctggaaaagaggcacgacaatatcaaaccctccgatgaagtgtatcggagaggattacaggcaataccgctctccgtggatttgtggattcactacatcaatttcttaaaggagaccctagatccgggtgatcctgaaactaacaatactattcgcggaacgtttgagcacgccgttttggctgccggaactgacttcaggagcgatcgcctttgggagatgtacatcaattgggagaacgagcaggggaacctgagagaagtgactgcaatttatgacaggatcctgggaatcccaactcaactttacagtcaccactttcagcgttttaaggaacatgtacagaacaatctgccacgcgacctgcttaccggggagcagttcatccaactccgacgcgaactggcgtcagtgaacgggcacagcggtgatgacggcccacccggagatgatctgccttctggtatagaggatattactgatccggcaaagctgatcaccgagatcgagaatatgcgacacaggatcattgagattcatcaggaaatgttcaactataacgagcatgaagtctctaagcgttggacttttgaggagggcatcaaaaggccttactttcatgttaagcctctggagaaggcccagctgaagaactggaaggaatatctggagttcgagatagaaaatggaacccatgagagagtggtggtgctttttgagaggtgtgttatctcatgcgctctgtatgaggaattctggataaaatatgcgaagtacatggaaaatcactctattgaaggggtgagacacgtcttcagcagggcgtgtacaattcacctgcccaagaagcccatggtacatatgctgtgggccgcttttgaggaacagcaaggcaacattaacgaggcacgtaatattctgaagacgtttgaggagtgtgttcttggactagccatggtgcgcctgaggcgggtctccttagagcgccgtcatggaaatctcgaggaagcagagcacctattgcaggacgcgataaaaaatgctaagtccaacaacgaatcatcattttatgcagtgaaacttgctagacacttatttaagatccagaagaatctgcccaaaagcagaaaagtgctgctggaggccatcgaaagagacaaggaaaacaccaaactttacctgaatctgttagaaatggagtatagcggcgaccttaagcaaaacgaagagaatatcctgaactgctttgacaaagccgttcatggatcactgcctattaaaatgagaataaccttttcacagaggaaggtagaatttctagaagacttcggttctgacgtaaataaattactgaatgcctacgatgagcaccagacgctgctgaaagagcaggattccctgaaacgtaaggcggaaaatggatccgaggaaccggaggagaaaaaggctcatacagaagacactacctccagctcaacgcagatgatagatggcgatctgcaggccaatcaggccgtgtacaattactctgcttggtaccagtataactaccagaatccttggaattatggccagtactatccacctcccccaacatag

SEQ ID NO: 24034 - DNA, 723 bp, Artificial Sequence
  Description of Artificial Sequence: Synthetic coding sequence
atgcagggcctgttaagatttgaggatcaggactccgctcgcggagaccaaaatattgcaatgttctatccaacttccacccaaatggtttacagacgcggactgcaggctatccccctgagcgtcgacctttggattcattacatcaactttttaaaggagactttagacccaggggatcctgaaacaaataatacaatcagaggaactttcgaacatgccgtcctggctgccggtaccgattttaggagtgaccgtctttgggaaatgtacatcaattgggagaatgagcagggcaatctcagggaggttactgcaatatacgataggatcctcggcattcccacacaactttacagccaccacttccagcgctttaaggagcacgtccagaataacctgccccgtgacctccttaccggagagcagtttatccagctgcgaagggaactggcttctgtcaatggccactcaggtgacgatggcccacctggcgatgacctgccatcaggcattgaggatattacggacccagctaagctgattaccgagattgagaacatgagacacagaattattgaaattcaccaggagatgtttaactataatgagcacgaggtaagtaagcgctggactttcgaagaagggattaaaaggccttatttccatgttaaacccctggagaaagcacagaagaagttagaacgtatattgcggatctag

SEQ ID NO: 24035 - DNA, 2577 bp, Artificial Sequence
  Description of Artificial Sequence: Synthetic coding sequence
atgccccctccaggcattcctcccccttttcctcccatggggctgccacccatgtcacagaggccccctgcgataccccctatgccccctggaattttgccgccaatgctgcccccaatgggcgctccgccaccacttacacagataccagggatggtgccgccaatgatgccgggtatgctcatgccagctgtcccagttacagccgctacggcccctggagcagataccgcctcctcagccgtggccggaacagggccaccaagagctctgtggtcggaacatgtcgctcctgatgggaggatttactattacaacgctgatgacaaacaatccgtgtgggagaaaccttccgtgctgaagagcaaagctgagctcctactgtcacagtgtccttggaaagagtataagtccgacaccggcaaaccttactattataataaccaatctaaggagtcgaggtggaccaggcccaaagacctcgacgacctggaagtgcttgtgaagcaggaagccgctggaaaacaacaacagcagctcccccaaacactgcagccacagccgccacagccccagcctgatccgcctccagtaccccctggcccaacaccagtgccaaccggcctgctggagccagagcccggaggcagcgaggattgcgacgtgttggaggcaacccagcccctggagcaggggttcctccagcagcttgaggaaggaccgtcatcctcaggccagcaccagccgcagcaggaggaggaggaatctaagcccgagcctgagaggtccggcctaagttggtccaaccgggaaaaggccaagcaggccttcaaagaactgctgcgtgacaaggcggtgccttccaatgcctcctgggaacaggccatgaagatggtagtgaccgatcctagatacagcgctttgccaaagttgtccgaaaagaagcaggccttcaacgcatacaaggcccagagggagaaagaggaaaaagaagaagccaggcttcgggctaaagaagcaaagcagaccctgcagcattttctagaacagcatgaacgaatgacatcaacaacacgctatcgaagagctgaacaaacattcggcgagctcgaggtgtgggccgtggtgcccgagagagaccgaaaagaggtgtatgatgacgtgttgttcttcttagccaaaaaggaaaaggaacaggccaagcagctgcggagacggaatattcaggcattgaaatccattctggacgggatgagcagcgtgaacttccagaccacctggtcccaggcacaacagtatttgatggataatcctagttttgcccaggaccaccagctgcagaacatggataaagaggacgctctgatctgctttgaagagcacatcagagccctggaaagagaggaagaggaagaacgggagcgcgcacgcttgcgcgagcgtaggcagcagaggaaaaatagagaagccttccaaacatttctggacgaactgcatgagaccggccaacttcatagcatgtcaacatggatggaactgtatccagcagtgagcacggatgtacgctttgccaacatgctgggtcagcctggtagtactcccttggacctgtttaaattttacgtggaagagctgaaagctcgtttccacgatgagaagaaaatcatcaaggatatcctaaaagtaaacactgccttcgaggacttcgctcacgtgattagcttcgacaaacgggcagctgcccttgacgcgggaaatatcaagcttacattcaactccttgctggaaaaggccgaagccagagaacgagagagggaaaaggaagaggccagacgcatgagacgcagggaggctgcatttaggagtatgcttagacaagcggtgccggctctggagctcggaaccgcttgggaggaggttcgcgagcgcttcgtatgtgactcagctttcgagcagatcactctcgaatctgagcgcataagactgtttcgcgagttcttacaggtgctcgagcagaccgaatgccagcatctgcataccaagggccgaaaacacggcaggaaaggaaagaagcaccatcataagcgctcgcacagtccatctggatcagagtccgaggaggaagagctccctcccccatcgctccggcctccaaaaagaagaaggagaaatccgtctgagagcggatctgagcccagtagctcactggactcagtggagtccggcggagccgcacttgggggacggggatccccctcctctcatctgttaggggcagaccacgggttgcggaaagcaaaaaaaccaaaaaagaaaacaaagaagcgcagacacaaatcaaattcacctgagagcgagacagaccctgaagaaaaagctggcaaagagtccgacgaaaaggaacaggagcaggacaaggatcgggaacttcagcaggcagaactgcctaaccggtctcccggttttgggattaagaaggagaaaactgggtgggatacatccgagagcgaactcagtgaaggtgaactcgaacggaggcggagaacactcctacagcagctggacgatcatcagtag

SEQ ID NO: 24036 - DNA, 2616 bp, Artificial Sequence
  Description of Artificial Sequence: Synthetic coding sequence
atgatgccccctcccttcatgccacctcctggtattccgcctcctttcccccctatggggctgccccctatgtcgcaaaggccccctgcaataccccctatgccgcctggaatcctccctcctatgctccccccaatgggtgcacctccaccgctgacacagataccgggaatggttcctcccatgatgcccggaatgctgatgcccgcagtgccggtcacagcagcgacagcccctggcgcagacacagcttcaagcgccgtagccggtacaggacctcccagagcgctgtggagtgagcatgtggcaccagatgggagaatttattactataatgccgatgataaacaatccgtgtgggagaagcccagcgtcctcaaaagtaaagcagaacttttactctcccagtgtccctggaaagagtacaaatctgatactggtaagccctattattacaataatcagtctaaagagagccggtggacaaggcccaaagacctggacgatctggaggtactggtaaaacaggaagccgcaggtaagcagcagcagcaacttccccagaccctgcaaccacagcctcctcaaccccaacccgatccacccccagttcctccgggacccacccctgtgcctaccgggttgttggagccagaacctggtggcagtgaggactgtgacgtccttgaggctacgcagcctctggagcaggggtttctccaacagctggaggagggcccaagttccagcggccaacaccaaccccagcaggaagaagaagagtccaagccagagccagagcgctctggactctcttggagcaatcgcgagaaagccaaacaagcatttaaggagctcctgagagacaaggcagtgccgagtaacgcaagttgggaacaggccatgaagatggtcgtcactgatcccagatacagtgccttgcctaagctcagcgagaaaaagcaggcctttaatgcctacaaagcgcagagagaaaaggaggagaaagaggaagccaggctaagggccaaagaagccaaacagaccttgcagcattttctcgagcagcatgaacggatgacttcaactacaaggtatagacgtgctgagcaaacattcggcgagctggaagtgtgggccgttgtgcccgagcgggataggaaggaagtgtatgacgacgtgctgttttttcttgctaaaaaggagaaggagcaggctaaacagcttcgcaggcgcaacattcaggctctgaaaagcattctggacggtatgtcctccgtgaacttccagacaacctggtcccaagcacaacagtatcttatggacaatccttccttcgcacaggatcaccaactgcagaacatggacaaggaggatgcgctgatatgctttgaagaacatatccgcgcactggaacgcgaggaagaagaggagagggagagagccaggctccgtgaacgcagacagcagaggaaaaacagagaggcctttcagaccttcctggacgagttacatgagaccggccaactgcattctatgtcaacatggatggagctctatcctgcggtgagtaccgacgttagatttgccaacatgctcggccaacccggttccactcccctagatctttttaagttttacgtcgaggagctgaaggctagattccacgatgaaaaaaaaataattaaggacattttaaaggatcgcggattttgcgtcgaagttaatacagccttcgaggatttcgcccacgtcatcagctttgacaaacgcgctgccgctctggacgctggaaatatcaaactgacattcaacagcctgcttgagaaagcggaggccagggagcgcgagagagagaaagaggaagcgaggagaatgagaagacgagaagccgcatttaggagcatgttgcggcaggccgttcctgccctggagctgggaaccgcctgggaggaagttagagagagatttgtatgcgattcggccttcgaacagattaccttagaaagcgaaaggatcaggctctttagggagtttctccaagtgctggagcagacggagtgccagcacttacacactaaggggcgaaagcacggcagaaaaggaaagaaacaccatcacaagaggtcacattcaccgagcggcagcgagagcgaggaggaggaactccccccaccctccctgaggccacccaaaagacggaggcgtaacccaagcgagtccggatctgagccgtcctcaagcctggattccgtcgagagtgggggagctgctctcgggggaagaggctctccatcctctcaccttctgggtgcagaccacgggctccggaaggctaaaaaaccaaaaaagaaaactaaaaagagaagacataaatcaaacagcccggagtccgaaacggatcctgaagagaaagctggtaaggagtctgacgagaaggagcaggaacaggacaaggacagagagctacagcaggccgagttaccgaataggtccccgggattcggtataaagaaggaaaagactgggtgggacaccagtgagtccgagctgagtgaaggtgaactggagaggcggagacgtaccttactgcagcagcttgatgaccaccagtag

SEQ ID NO: 24037 - DNA, 21 bp, Artificial Sequence
  Description of Artificial Sequence: Synthetic coding sequence
atgatgccccctccattttag

SEQ ID NO: 24038 - DNA, 1791 bp, Artificial Sequence
  Description of Artificial Sequence: Synthetic coding sequence
atggaagcagaaccaccattatatcccatggcaggcgctgctggccctcagggtgatgaagacctgttaggagtacccgacggtcctgaggctcccctcgacgaactggtgggagcttacccgaactacaacgaagaggaggaggaaaggcgttattatcggaggaagcggcttggcgtgctgaagaatgtgttagctgctagcgcaggcggaatgctgacatacggtgtgtacctaggactgctgcagatgcagctgatcttacattatgatgagacatacagggaagtgaagtatggcaatatggggctgccagacatcgatagcaaaatgttgatggggatcaatgtgactccgattgctgccctgctctacacccccgtcctcataagatttttcggaactaagtggatgatgttccttgctgtgggtatttatgccctctttgttagcaccaactactgggaacgctactacacgctggtgcccagcgcagtagccctgggcatggcaatcgttcctctgtgggcctcaatgggtaattatataactaggatggcccagaagtatcacgagtattcccattataaggaacaggatgggcagggcatgaagcagcgaccccctcgcggatcccatgccccttatcttctggtgtttcaagctatcttttattctttcttccatctgtctttcgcctgcgcccagctgcctatgatttattttctgaaccactatttgtatgaccttaaccacacactgtataatgtccaatcatgtggaaccaactctcacggaatccttagtggttttaataaaacagtactgaggactcttcccagaagcgggaacctgatcgtggttgaatccgtgctgatggctgtgttcttggccatgttactggttcttggactgtgtggcgctgcctatcgaccaacagaggaaattgacctgcggtctgtcgggtggggaaacatcttccagcttcctttcaaacacgtgagagactaccgactcagacacctggtcccgtttttcatctactcaggatttgaggtgctcttcgcttgtacgggaattgccctagggtatggagtatgtagtgttggattggagagactggcttaccttctggtcgcctattctctgggcgcttccgcagcttcattgttaggtttactggggttatggctgccccgacctgttccgctcgtggccggtgccggagtccatctactgttaacatttattctattcttttgggctcccgtgcccagagttcttcaacatagctggatcctgtacgtcgcagctgccttatggggcgttggaagcgcactaaacaaaactggtctctccacactgctggggattctttacgaggataaggagagacaagactttatttttaccatctaccactggtggcaggcagtcgcaatctttaccgtgtacttgggatctagtcttcacatgaaagctaagctggccgtcctgttggtcactctcgtcgccgctgccgtctcttaccttaggatggaacagaaactgcgacgaggtgtcgctcctagacagccacggattccaagacctcaacacaaggtgagggggtatcgatacctcgaagaagacaactctgacgaatcggatgctgaaggcgaacacggcgacggtgctgaggaggaggcaccgcctgcagggcctaggcctggcccagaacctgctgggttagggagaaggccctgcccttatgagcaagctcagggtggagatggcccagaggagcaatag

SEQ ID NO: 24039 - DNA, 1446 bp, Artificial Sequence
  Description of Artificial Sequence: Synthetic coding sequence
atggcgtataacgacacagaccgtaaccaaactgagaagctcctaaaacgcgtgcgagagctcgaacaggaggtacaacggctcaagaaggagcaagcaaaaaataaagaagattccaatatccgcgaaaactctgccggtgctggaaagacaaagcgcgcatttgacttcagcgcccatgggaggaggcacgtcgcgcttagaatcgcctatatgggatggggttaccagggctttgcctcccaggagaatactaataacaccatcgaagaaaagttattcgaggccctgacaaaaactagactggtcgaatctcggcagactagtaactaccaccgctgcggtcgaaccgataagggagtgtcagccttcggacaggtcatctctttggaccttcggtcccaattcccccgaggtagggactctgaggactttaatgtgaaagaggaggctaatgccgctgccgaggagatccgatatacacacatactaaaccgcgttctaccacctgacattcgaatattggcttgggccccagtggagccgtctttctccgcgaggttctcgtgtcttgagagaacctacagatatttttttcccagggctgatttagatatcgtcactatggactatgctgcgcagaagtacgtcgggacccatgattttcgaaatctttgtaaaatggatgtggctaacggcgtgattaatttccagcgaactatcctgtctgctcaagtccaattggtgggccagtccccgggtgaaggcagatggcaggagccattccaactctgtcagtttgaggtcacagggcaggctttcttgtaccaccaagtgcgatgcatgatggcaattctgtttctcatcggtcaggggatggagaaacctgaaatcatcgacgaactgttgaatattgaaaagaatccacagaaaccacagtattccatggctgtcgagttcccactggtcctctatgactgcaaattcgaaaatgtaaagtggatttacgaccaggaggctcaagagtttaatataactcacctgcagcagctctgggccaaccatgctgtgaaaactcatatgttgtattctatgttacaggggttagataccgtcccagttccctgtggcattggcccaaaaatggacgggatgaccgagtggggcaatgtgaagccctccgtgattaaacagacctctgcctttgtcgagggtgtgaagatgagaacatataagcccctcatggatagacctaagtgccagggactcgagtcccggattcaacactttgtgaggagagggaggattgaacacccccacctgttccatgaggaagagacgaaggctaagcgagactgtaacgacaccctggaggaggaaaataccaatctggagactcctaccaagcgcgtgtgcgtggacaccgagatcaaatctataatctag

SEQ ID NO: 24040 - DNA, 939 bp, Artificial Sequence
  Description of Artificial Sequence: Synthetic coding sequence
atggccgatggcgactccggatccgagagggggggagggggtggaccctgcggcttccaaccggcaagccggggaggcggagagcaagaaactcaggaacttgcctccaagaggctagatatccagaataaacgcttctacctcgatgtaaagcagaatgccaagggtcggtttctgaaaattgcggaggtcggagccggaggatctaaaagtagactgacgctgagcatggctgtcgccgcagaatttcgggatagcctgggtgattttatcgagcactacgcacagctgggccctagctcacccgaacaattagcagcaggagctgaggagggcggaggaccacgcagggcccttaagagcgagttcctcgtgcgtgagaatcgcaaatattacctcgacctgaaagagaaccaacgcggaaggttcctgagaattcgccagactgttaacaggggcggaggtgggttcggagccggacccggtccaggtgggctacagagcgggcagactatcgctctgcccgcacaaggccttatcgaattccgtgacgccttggccaaattgatcgatgattatggcggtgaagatgatgagctcgccggaggtccgggtggaggcgcagggggtcccggtggagggctgtacggtgagcttcccgaggggactagcatcacggtcgatagcaagaggtttttttttgatgtgggctgtaataagtatggtgtgtttcttcgggtcagtgaggtcaagcctagctataggaatgccatcactgtgccttttaaggcctggggcaaattcgggggagccttttgtcgatacgcagacgagatgaaagagatacaggagaggcagcgcgacaaactctacgagcgacggggtggcggatccggcggtggggaggaaagcgaaggagaagaagtggatgaagattag

SEQ ID NO: 24041 - DNA, 969 bp, Artificial Sequence
  Description of Artificial Sequence: Synthetic coding sequence
atggaaagagcgcgacgaagagggggtggaggagggaggggaagaggaggtaagaacgtgggtggatcaggtctcagcaaaagccgactctacccccaggcacagcactctcactatccacattatgccgctagcgccacacccaaccaggccggaggagccgcagagattcaagagttagcgtctaaaagggtggatatccagaagaagaggttctatctcgacgtcaaacaatcgtctagagggaggtttctgaagatagcggaggtgtggatcggaaggggacggcaagacaatatcagaaagtctaagctcactctatcacttagcgtggccgctgaactcaaggattgtctgggagatttcatcgagcattacgcccatctgggtttgaaggggcaccggcaggagcacggccatagcaaggaacaggggagtcgccgtcgacaaaagcatagcgcaccaagcccacctgtgagtgtcggctctgaggagcaccctcactcagtgttgaagacagactacattgaaagggataatcgaaaatattatttggatctcaaggaaaatcaacgaggccgatttttgcgcattcggcagactatgatgcgaggcacagggatgattgggtattttggccattcgctggggcaggagcagacgatcgtcctgccagcacaaggaatgattgaattccgcgacgcattagtgcaactgatcgaagactatggagagggcgatattgaggagaggcggggaggcgatgatgaccctctggagctgcccgagggcactagttttcgggttgacaataagaggttttacttcgatgtcggctccaataagtacggaatcttcctgaagcttaccaactacccgaaatcacgggaaaacatcaacctgtttcattgttgccaaatcaaacacaaggaacagccccatgatacgactaagactgtagaagagtag

SEQ ID NO: 24042 - DNA, 1044 bp, Artificial Sequence
  Description of Artificial Sequence: Synthetic coding sequence
atggagcgggctcggcgtaggggtggcggaggaggtcgtggacgaggcggaaaaaatgtcggcggatccggcctgtccaagtcaaggctgtatcctcaggcccaacattcccactatccccactatgccgcttcagcgacacctaatcaggcaggcggtgccgctgaaattcaagaacttgccagtaagcgcgttgacattcaaaaaaaaagattctacctggatgtgaagcagtctagccgaggtcgatttctgaaaatcgcggaggtctggattggcagggggagacaggataacatcaggaagagcaagctcaccctctctctgtccgtcgcggctgaattaaaagactgcctcggagacttcattgaacactacgcgcacttggggctaaagggccatagacaggaacacggccactctaaggagcagggatccagacgcagacagaagcattccgcaccgtccccgccagtgtcagtggggagcgaagaacatccacacagcgtgctgaaaacagattatattgagcgagacaaccgaaaatattatcttgatttgaaagagaatcaacggggaagatttctcaggatccgtcagactatgatgcggggaacaggtatgataggatatttcgggcacagtctaggacaggaacaaacaattgtattgcctgcccaaggtatgatcgaattcagggacgctttggtgcagctgatcgaagattacggcgaaggtgacatcgaggagcgaaggggcggtgacgatgaccccttggagctcccggagggcaccagcttccgggtggataataagcggttctatttcgatgttgggtctaataagtacggaattttcctcaaagtgtcagaagtgaggcctccctaccgcaacacaatcacagtcccatttaaggcatggactcgattcggggaaaacttcatcaaatacgaggaagagatgcgcaaaatctgtaattcccataaagagaagagaatggacggacggaaagcgtcaggtgaggagcaagaatgtctcgactag

SEQ ID NO: 24043 - DNA, 429 bp, Artificial Sequence
  Description of Artificial Sequence: Synthetic coding sequence
atggccccagtgaagatcagccacgtggtgagcttttcctcacaggatcccaaatatccagtggaaaatttgcttaaccccgactcacctcggagaccctggctgggatgtccccaggacaaaagcgggcagctaaaggttgaattgcagctggaaagggctgttcctactggatatattgatgttggcaactgcggatgcgcctttctgcaaatcgatgtgggccacagcagttggcctctcgatcgaccattcatcaccctcttacctgccactaccctaatgtcactcactgattcaaagcaaggaaagaacagatcgggcgtgaggatgttcaaggacggcaaagaaggcaagtcccggaaggatggaggaggcctgtacgagaaacagaggtgcagcaccaaggaagactgcgaatgctactag

SEQ ID NO: 24044 - DNA, 1506 bp, Artificial Sequence
  Description of Artificial Sequence: Synthetic coding sequence
atgaataggagtagacaggtcacatgtgtcgcctgggtccggtgcggggtggcaaaggaaacacctgataaagtggaactgtcaaaggaagaagtgaaacggctgattgcagaggccaaggaaaagctccaggaggaggggggaggctccgacgaggaagagaccgggtcaccatctgaagacgggatgcagagtgcccgtacacaggctaggccgcgtgagccactggaggacggggaccctgaagacgatcggaccctggacgatgatgaattagcagagtacgacttggataaatacgacgaggaaggagaccctgacgcggagacgttaggagagagtcttctcggcctgacagtgtacggctcaaatgatcaggacccctacgttacgctgaaagacactgagcagtacgagcgggaggattttttgattaagcccagcgataatcttattgtgtgcggtagagcggagcaggaccagtgtaacttggaggtgcacgtgtataaccaggaagaagattctttctatgtgcatcacgacatactgctgtcggcatatccactttctgtggagtggttaaactttgatccaagtcccgatgactccacgggcaactacattgcagtggggaatatgacgcccgtgatagaagtctgggatctggacatcgtagactccctcgaacccgttttcaccctggggagcaaattatcaaaaaaaaaaaagaagaagggaaaaaagtcttcatcggccgaaggccataccgacgccgttcttgatctgtcgtggaacaagctaatccgcaatgttctggccagcgcttccgccgataacacagtaatcctttgggacatgtcactcgggaaacccgcagctagcctcgccgttcatactgataaagtacaaacactccaatttcatcccttcgaggcgcaaacactgatttcaggaagttacgataagagcgtagccctctatgactgtagaagtccggatgagtcacatagaatgtggcgcttcagtggacagatcgaacgggttacatggaaccactttagtccctgtcacttcctcgcgagtaccgacgatggatttgtgtacaacctcgatgccagatcagacaaacccatattcacgctgaatgctcacaatgacgagatcagcggcctggatttgtcaagtcagatcaaagggtgtcttgtgaccgccagtgctgacaagtacgtcaagatttgggacattctgggtgacaggccatcccttgtccactctcgtgacatgaagatgggggtcctgttctgttccagctgttgccctgacctcccgttcatttatgcttttggaggccagaaagaagggcttagggtgtgggacatctccactgtaagttcagtgaatgaggccttcgggagaagggaacgcctggttctaggttctgcccgtaattcctctatcagcggtccgtttggttctaggagcagcgacacaccgatggagtcctag

SEQ ID NO: 24045 - DNA, 762 bp, Artificial Sequence
  Description of Artificial Sequence: Synthetic coding sequence
atgaatcgctctcggcaggtgacttgcgtggcatgggtgcggtgcggggtggccaaggagacacctgacaaggttgagctgtcgaaagaggaagtgaagaggctgatcgcagaggcaaaagagaagctgcaggaagagggtggtgggtccgacgaagaggagacaggctcaccctcagaggacggtatgcaatctgccaggacccaggctcggccacgagaacctctggaggacggcgatccggaggacgatcgaaccttagacgacgacgaattggccgagtacgatctagacaaatatgatgaagaaggagaccccgacgccgagacactgggtgagtccctacttggtttgaccgtctatggttctaatgaccaggatccctacgtgaccctgaaggacacagagcagtacgaaagggaagattttcttataaagccaagtgacaatctcatcgtgtgcgggagagccgaacaggaccagtgcaaccttgaagttcatgtttataatcaggaagaggactctttttatgtccaccatgatattttactgtctgcttaccccttatccgttgagtggcttaactttgacccatctcccgacgatagtacaggcaactacatcgctgtggggaacatgacgcccgtaattgaagtgtgggacctggacattgtggattcgctggagcctgtcttcactctcggtagcaagttaagtaagaaaaagaagaaaaaaggaaagaaagtgaagaagaagaggtag

SEQ ID NO: 24046 - DNA, 750 bp, Artificial Sequence
  Description of Artificial Sequence: Synthetic coding sequence
atgaacagatccaggcaggtaacgtgcgtcgcctgggtgaggtgcggcgtggcaaaggagacccccgacaaagtagagttgagcaaagaggaggtgaaacgacttatagccgaggctaaggaaaagctgcaggaagaaggagggggatcagatgaagaggagacgggaagccccagtgaagatggtatgcagtcagcgaggacccaagctagaccgagagagcctctcgaagacggagacccggaggacgaccgaactctggatgatgacgaactggccgagtacgacctcgataaatacgatgaagaaggagacccagacgcagagacactgggtgagagcttattagggctgacagtctatgggtctaacgaccaggatccgtacgttaccctgaaggacacagaacagtatgaacgagaagactttctcatcaagccaagcgacaatctcatcgtctgcggacgggcagaacaggaccagtgtaacctggaggtgcacgtttataatcaggaagaggatagcttttacgtgcaccacgatatcctcttgtctgcctaccccctctccgtggaatggctgaattttgatccaagtcctgacgatagcactggcaactatatcgcagtagggaacatgaccccagtgatcgaggtatgggacctggatatcgtcgactctctggagccggtcttcacgttagggtcaaagctgagcaagaagaagaaaaagaaaggtaagaaaaagtag

SEQ ID NO: 24047 - DNA, 297 bp, Artificial Sequence
  Description of Artificial Sequence: Synthetic coding sequence
atgcagagcgccaggacccaggcccgacctagggaaccactggaagatggagatcctgaggatgacagaaccctggatgacgacgagctagctgagtacgatttggataaatacgacgaggaaggtgacccggacgctgagacgcttggggaatcacttctggggcttactgtatacgggtctaatgaccaggatccttacgtgactttaaaagatacagagcagtacgagcgtgaggattttcttattaaaccatccgacaaccttatcgtatgtggaagagccgagcaagactag

SEQ ID NO: 24048 - DNA, 1260 bp, Artificial Sequence
  Description of Artificial Sequence: Synthetic coding sequence
atgcccgcagaaaattctccagcccctgcatacaaggtgagcagccatgggggagacagtggtctcgacggcttggggggtccaggcgtccaactgggcagccccgacaaaaagaagcgcaaggcaaatacccagggtccttcatttcctcccctgtcagaatacgcgccacccccaaaccccaatagtgaccacttagtggccgcaaacccctttgacgacaattacaacactatcagttacaagccactgccttcgtcaaatccatatctgggccctgggtacccaggttttggtggctattctaccttcaggatgcctccgcacgtacccccacgcatgtcctctccctattgtggtccttactcgttgaggaaccaaccgcatccttttcctcaaaacccacttggcatgggcttcaataggccccacgccttcaattttggaccccatgataactctagcttcgggaatccaagctataacaatgccttatcacagaacgtcaatatgcccaatcaacatttcaggcagaatcctgctgagaacttcagtcagattccgcctcagaatgcttcacaggtgagtaatcctgatctcgcttccaactttgtgcccggaaacaattctaacttcacaagtccgctcgagtccaatcacagctttatccccccacctaacactttcggccaggcaaaggctcctccaccaaagcaagatttcacacagggcgcaactaaaaacacaaaccagaacagttctgcccaccctccccatttgaatatggatgatacagtgaatcagtccaatattgagctgaagaatgtgaatagaaacaatgcagtcaaccaggaaaactcaaggtcttcttcgactgaagcgacgaataataacccagcaaacggaacccagaacaagcccagacaacccagaggcgcagctgatgcatgtacaaccgagaagtcaaataagtcgtctcttcacccgaacaggcacggacacagctccagtgaccctgtctacccatgtggtatctgtaccaatgaagtgaacgacgaccaggacgccatcctgtgcgaggcttcttgtcagaagtggttccacagaatttgcaccggcatgacagaaactgcatatggtctgctcaccgctgaagctagtgcagtctggggatgtgacacttgtatggccgacaaagatgttcagcttatgcggacacgggagactttcggaccttccgccgtggggtctgatgcctag

SEQ ID NO: 24049 - DNA, 1260 bp, Artificial Sequence
  Description of Artificial Sequence: Synthetic coding sequence
atgagtgccgaacaggaaaaggaccccatcagcctaaaacgggtgagggggggagactcaggattggacggcctgggcggtcctggcgtgcagctgggttctcccgataaaaaaaaaagaaaggccaacacacagggcccaagtttcccgccactgagcgagtatgcacctccacctaacccaaattcagaccatctcgtggccgcaaacccctttgacgacaactataatactatcagttataagccgttgcccagttcaaacccctaccttggaccgggttacccaggttttggcggttacagtacattccggatgcccccacatgtcccacctcggatgagctccccgtactgcgggccatatagtctcaggaatcagccgcaccccttcccccagaaccctttgggcatggggttcaatcgtccacatgctttcaattttgggccacacgacaactcaagtttcggaaacccgagctataacaacgcactgtcacagaacgtaaatatgccgaaccagcattttcggcagaatcccgctgaaaattttagccagattcccccacagaacgcaagtcaggtgagcaaccccgacttagcctccaattttgtccccggaaataattccaattttacgtcaccactggaatcaaaccactctttcattccaccaccaaacactttcggtcaggcgaaggcccctcctcctaagcaggactttacacagggcgcaacgaagaacactaatcagaactcctccgctcatccaccccatcttaatatggacgatactgtgaaccagtcgaatattgagttgaagaacgtgaatcgcaacaatgctgttaaccaggaaaattcgcgttcatcatcaactgaagccacaaacaacaaccccgcaaacgggactcagaataagcctcgacagccgaggggggcagcagatgcatgtaccactgagaagagtaacaaatcttcacttcaccctaatcgacatggccattccagctctgatccagtgtacccctgcggaatttgcactaatgaagtgaatgatgaccaggacgcgattctgtgtgaagcatcttgtcagaagtggtttcaccgtatttgcaccggtatgaccgaaactgcatatggcttgctgacggccgaagcctcggccgtctggggctgtgacacttgcatggcggacaaggatgtgcagctcatgcgtacccgggagaccttcggaccatcagcagtcgggagcgatgcttag

SEQ ID NO: 24050 - DNA, 2931 bp, Artificial Sequence
  Description of Artificial Sequence: Synthetic coding sequence
atgagcaactctaatacaactcaggagactttggagattatgaaagagagcgagaagaagctggttgaggagtctgttaataagaacaaatttatctcaaagacacctagcaaggaggaaatcgaaaaggaatgcgaagatactagccttaggcaagagacgcagcggcgtacgtcaaatcatggccatgccagaaagcgcgcaaaatcgaattctaaactaaagttggttcggagcctggcagtgtgcgaagagagctcgaccccgttcgctgacgggcctctggagacccaggacattatccagcttcacatcagttgcccgtcagacaaggaagaagaaaaaagtaccaaagatgtgtccgagaaggaggataaggataagaacaaagagaagattccccgtaaaatgttgtcacgcgattcatcgcaggagtacaccgactctacggggatagacctccatgagttccttgtcaacacactgaagaagaatccaagggaccggatgatgctgctaaagcttgagcaagagatcctcgaattcattaacgataacaacaaccagttcaagaagttcccccagatgacatcctatcaccgaatgttactgcatcgcgtggcagcctattttggcatggaccacaatgtcgatcaaaccggtaaagccgtcataattaacaaaacatcaaacacccggattcctgagcagaggtttagcgaacacataaaagacgaaaaaaacactgagtttcagcaaaggtttatcctcaagcgagatgacgccagtatggacagagatgataatcagaccgggcagaatgggtatcttaatgacattcgactttctaaggaagccttcagttccagctcccataagaggcgtcaaatttttcgcggaaaccgggaaggcttgagccgcacgagtagctccagacagtcctccactgattctgagctgaagagcctggaaccacgaccctggtcctctacggacagcgacgggtctgtgaggtctatgaggccccctgtaaccaaggcttctagcttcagcggaattagcatcctcacaagaggagactctatcggaagctcgaaggggggaagcgccggacgaatatcccgccctggtatggcgcttggcgcaccggaggtgtgtaaccaggtcacatcatcccagtccgtgagaggcttgctgccttgtaccgcccaacaacaacagcagcagcagcagcagcagctccccgctctccctccgaccccacaacagcagcccccactcaataatcacatgatcagtcaagccgacgacctgtctaaccctttcggacagatgtcactgtctcgccagggtagcaccgaggcagccgacccaagcgccgcactgttccagacccccctgatatcacagcacccacagcagaccagttttatcatggcttcaaccggacaacctttgcccacctcaaattacagcacgagttcccacgctccacctacacagcaagtactgccgcctcagggttatatgcagccacctcagcagatccaggtcagttattaccctcctgggcagtaccctaactcaaaccagcaatatagaccgcttagccacccagtcgcttattctcctcagcgcggacagcagctcccacagccatctcagcagcctggactgcagcctatgatgccaaaccaacagcaggctgcctatcagggaatgatcggagtgcagcagccacagaatcagggattactgtcgagtcagcgaagctccatggggggacagatgcaggggctcgtcgtacagtatacccctctcccctcttaccaggtgcctgtgggctctgactcccagaacgtggtccagcctccctttcagcaacctatgcttgtgccagtgagccagtctgtgcaaggcggtcttccagctgctggcgtccccgtgtattattcaatgattccccctgctcaacaaaatggtacttcaccgtccgtgggattcctgcaacctcctggctctgaacagtaccagatgccccaaagccctagcccttgttcaccacctcaaatgccccagcagtattccggcgtatccccatccggacctggagtggtggtgatgcagttgaatgttccaaatggtcctcagcccccacagaatccctcaatggtgcagtggtctcactgtaagtattactcaatggaccagcggggtcaaaaacctggcgatttgtattctcccgattcttctccccaggcaaacacccagatgtcgtctagcccagtgacaagccctacacagagtccggctccatctcctgtaacgagtcttagtagcgtttgtacaggactgtctccgctcccggtcctcacccaattcccgagacccggtggccctgcccagggagacggaagatactcactgctggggcaacctttgcagtataatctgtccatttgccccccactgctccacggtcagagtacctacaccgtacaccaagggcaatcgggtctcaagcacgggaatagaggcaagcgacaggcgctgaaatctgcaagcactgatctcggcactgccgatgtcgtgttgggaagagtcttggaggtcaccgatttgccagaggggatcacaaggacagaagccgacaagcttttcactcagttggccatgtctggcgctaagattcagtggcttaaggatgcccaaggactgcctggcggaggcggtggtgataactctgggactgccgagaacggcaggcatagtgacctcgccgctttgtacacgatagtcgctgtgttcccctctccattggcagctcagaatgccagtctacggttaaataactctgtgagccgcttcaagctccgcatggcgaagaaaaattacgacctcaggatactggagagagcctcatctcaatag

SEQ ID NO: 24051 - DNA, 2931 bp, Artificial Sequence
  Description of Artificial Sequence: Synthetic coding sequence
atgtcgaattcaaatacaacacaagagacgctcgagatcatgaaggaatcggaaaagaagctggtcgaggaatctgtgaacaagaataaatttattagcaagacccccagcaaagaagagatcgaaaaagagtgtgaggacacgtcgctgcggcaggaaacacagaggcggacatcaaatcacggccacgccaggaagcgggctaagtcaaactcaaaactcaaactggttcggagtctggcagtgtgcgaggaaagcagcacgccctttgcagacggcccattggagacgcaggacattatccagctccacatatcatgcccatcagataaggaggaagagaagtcaaccaaagacgtgtccgagaaggaggataaggataagaacaaagaaaagattcctagaaagatgctgtctagggacagttcgcaggagtatactgacagcaccggtattgatctgcacgaattcctcgtgaacactcttaaaaaaaatccccgtgacaggatgatgcttttgaaactggagcaggaaatcttggagttcatcaatgacaacaacaatcagttcaaaaagtttccacaaatgaccagctatcatagaatgttactccatagagtagccgcttacttcggcatggaccataatgtcgatcagaccgggaaagcggttataattaacaaaacttctaacactcggattccagagcagcgcttttccgaacatatcaaagatgagaagaacacagaattccagcagcgcttcattctgaaaagagatgacgcgagtatggaccgggacgataatcagacagggcagaatggctacttgaacgatattagactgagcaaagaagcattctcctccagctcacacaagcgacggcagattttcagagggaaccgcgaaggcctgtccagaacaagctcttccaggcaatcctcaacagacagtgaactcaagtccctggagcccaggccgtggagctctaccgattctgacggatctgttaggtcgatgagaccccctgtcactaaggccagcagcttttccggcatcagcatccttacaaggggagatagtataggatcttctaagggcggttcagccggaagaatcagccggccaggcatggcgctgggtgccccagaggtctgcaatcaggtaacatcctctcagagtgtgcgcggattgctcccttgtacggcccaacaacaacaacagcagcagcagcagcagcttcctgccctgccaccaacacctcagcagcagccgcctctcaataatcatatgataagccaggcagatgacctctcgaaccccttcggacagatgagcctcagtcgtcagggtagtactgaagcggctgacccaagcgcagccttatttcagaccccgctcattagccagcacccccagcagacatccttcatcatggcgagcaccgggcagcctctgcccaccagtaattactccacctcctctcatgctcctccaacccagcaggtcctaccaccacagggttatatgcaaccacctcagcagatccaggtgtcctactatcctccgggacagtatccaaacagcaatcaacaatacaggcctctgtcgcaccccgtggcgtacagtcctcagcgcggtcaacaactgccccagccatcccagcagccagggctgcagcctatgatgcccaaccagcaacaggccgcttatcaggggatgataggagtgcagcagccacagaaccagggcctgctgagtagccagaggtcatctatgggcggacagatgcaaggattagttgtccaatatactccactgccttcgtatcaagtccctgtgggaagtgattcccaaaatgttgtgcagccgcctttccagcagcctatgctcgtgcccgtttctcagtccgtacaggggggactgcccgctgctggcgtccccgtgtactatagcatgattcctcccgcacagcagaacggtacaagcccgtccgtgggtttcctacagccaccaggctctgagcagtaccagatgccccagtcacctagcccttgctctcccccacaaatgcctcagcaatattctggagtaagccccagcggtccaggggtagttgttatgcaactgaacgtgcctaacggaccccagcccccacagaaccccagcatggttcagtggtcacactgcaaatattatagcatggatcaacggggacagaagccaggtgatctctatagccccgacagcagcccacaggccaatacacagatgtctagctcacccgtcacttcacccacccagagcccggcacctagccctgtgacctctctgtctagtgtgtgcactggcctctcccccctacctgtgttgacccagtttcctcgcccaggaggccctgcccaaggggatgggaggtacagcttgctgggtcagccccttcagtacaatttgtcaatatgcccccctctgctacacggccagagtacctacaccgtgcaccagggacagagtggactaaagcatggaaaccgcggaaagcggcaagcactcaagtctgcatcaactgatctggggaccgcagacgtggtattggggcgagttctcgaggtgaccgatttacccgagggcatcacacggactgaggccgacaagttattcactcagctggcaatgagtggggctaagatccagtggctgaaggacgctcaaggcctgcccggtggtggtggtggcgacaactcaggcacagcagaaaacggcagacactcagatctagctgcactgtatacgatcgttgctgtgtttccgtccccactggcagcgcaaaatgcctcactaagacttaacaacagcgtctcgaggttcaagctgaggatggctaagaagaattatgatttgaggattttggaaagagcgtcaagccagtag

SEQ ID NO: 24052 - DNA, 2112 bp, Artificial Sequence
  Description of Artificial Sequence: Synthetic coding sequence
atgaggaggatccagaattttaaccgcggtagtttctcacgcgagatgatgcccgtatggacggaaatgattactcggggtaaccgggaagggctttcaaggacatcgtcctcccgacagtcttcaacggactctgagctcaaatctttagagcccaggccatggtcttccaccgatagcgatggtagcgttcgctccatgcgaccccctgtgacaaaggcttcttctttttcaggcatctcaattctcacacgcggagactctatcggcagttctaagggaggcagtgcaggaagaatctctcgccctggcatggctctgggagctccagaggtgtgcaaccaggttactagctcccagtctgtaaggggattgctcccctgcactgcccaacagcagcagcagcagcaacaacaacagctgccagctctccctccgacgccacagcagcagccccctctgaacaaccacatgatcagccaggcggatgacctgagcaatccttttggccagatgagtctgagtcggcagggctccacggaagcagccgatcctagcgctgcactgtttcagacacctctgatctctcaacacccccagcagactagttttattatggccagtactggacagccgcttcccacgtccaactattccacatccagtcacgcacccccaacccagcaggtccttcctcctcagggatacatgcagccgcctcaacagatccaggtctcatactatccacctgggcaataccctaacagtaaccaacaatacagacccctgtcgcaccccgttgcgtacagtccccagagaggacagcagctgccgcagccgtcccagcaaccgggactgcagccaatgatgcctaaccagcagcaggcagcctatcagggcatgataggcgttcagcagccgcagaatcagggattactctcctcacaacggagtagtatgggcggtcagatgcagggtttagtagtccaatacactcccttgccaagctaccaggtacctgtcggtagcgactcccaaaatgtggtccagccccctttccagcagcctatgctcgtcccagtgtctcagtcagtgcagggagggctgcccgctgcaggcgtgcccgtctactacagcatgatcccccctgcccaacagaatgggacctcaccaagtgttgggttcctgcaaccacctggcagcgagcagtaccagatgccccagtctccgtccccctgcagcccacctcaaatgcctcaacaatactccggcgtttctccatctggcccaggggtcgtggttatgcagctgaatgtgcctaacggaccacagccaccccagaatcctagtatggtgcagtggtcccattgcaagtattattccatggaccagcggggtcagaagccaggagatctctattcccccgattccagcccccaggccaatacccagatgagctcttctcctgtgacctcacccacacagtctcccgctccaagtccagtgacgtcgctgagcagtgtttgcactggactttcaccactgccagtgctgacgcagtttccccgacctggcggacccgcacagggagacggcagatatagcctcttgggccagcccctccagtacaacctgagtatttgccccccactgcttcatggccagtctacctacaccgtgcaccagggtcaatccggcctgaagcacggaaaccgagggaaaagacaggccctaaagtccgcctccaccgatctcggcacggcggacgtggtgctcggcagagtccttgaggtgaccgatctcccagaagggattacgcgaaccgaggctgacaaactgtttactcagctggccatgtcaggagcaaaaatccaatggctgaaggacgcccagggactgcccggaggtgggggaggagacaactcaggcactgcagagaacggacgccacagcgacctggccgcactttacacaattgtggcggtctttcccagccccctcgccgctcagaatgcatcattgcggttaaataattctgtaagtcggtttaagctgagaatggctaaaaagaactatgacctacggattctggaacgggcatctagtcagtag

SEQ ID NO: 24053 - DNA, 1791 bp, Artificial Sequence
  Description of Artificial Sequence: Synthetic coding sequence
atgagacggattcagaatttcaacaggggctcgttctcccgagagatgatgcctgtctggacagagatgataacacgaggtaatcgcgagggcttgtcacgcacgagttcgtcccggcaaagctcaaccgactccgagctgaagtctctagagcccagaccctggtctagtaccgatagtgatggatcagtacgcagcatgcgtcctcctgtgacaaaggcctcctctttctcaggaataagtatactgactagaggcgactcaatcgggtctagcaagggagggtcggctggacgcattagtcgcccaggaatggctctgggcgcacctgaggtctgcaatcaggtgacctccagccagtccgtccgaggactgctgccctgtaccgctcagcaacagcagcaacagcagcagcaacagttgccagccctccctccgacgccccaacaacagccccctctcaataaccatatgatctcacaggccgatgacctcagcaatcctttcggacaaatgtcactttcacgccaaggctccacagaggccgctgacccctccgccgctctattccagacacctctgatctcacagcatcctcagcaaacctcttttattatggcttccaccggacagcccctgccaacaagcaactatagtaccagcagccacgccccacctactcaacaggtcttgcctccgcagggatatatgcagccccctcagcagatccaggtatcttactaccccccaggacagtacccaaatagtaaccagcagtatcgcccactgagccatcctgtggcctacagccctcagcgcggacagcaactccctcagccttcccagcagcccggactgcaaccgatgatgcccaatcagcagcaggccgcataccagggaatgatcggggtgcagcagccccaaaatcagggactgctctctagccagagaagttccatgggcggacagatgcaaggcctggtggtgcagtatactcccttaccttcgtaccaggtcccagtgggatccgatagtcaaaatgtcgtacaacccccattccagcagcctatgctggtccccgtcagtcagtccgtccaaggtggactccccgctgccggtgtcccagtttactatagcatgattcccccagctcagcagaatggaaccagtccttcagtgggctttttacaacccccagggtctgagcagtatcagatgcctcagtcaccctctccctgttccccgcctcagatgccacagcagtactcaggcgtgagtccctctggccctggcgtcgtggtaatgcaactgaacgtaccgaacggtccacagccccctcagaacccgagcatggtgcaatggagccactgcaaatactactcaatggatcaacggggacagaagccaggggatttgtattctcctgattctagcccccaagctaacacacaaatgtcctcctctcctgtcacctctccaacccagtcccccgcacccagtcctgtgaccagtttgagcagcgtatgcaccggcctaagtcccttgccagtacttacgcagttcccccgtcccggaggaccagcacagggcgatggtcgctattccctattgggccagcctctgcagtataatctcagtatctgtccccctctgctccatggacaaagcacgtatacggtgcatcagggccagtcggggctgaaacatggaaaccgtgggaaaagacaggccctcaagtctgctagcactgatctgggtactgcagacgtggccctttcattccagccatag

SEQ ID NO: 24054 - DNA, 2016 bp, Artificial Sequence
  Description of Artificial Sequence: Synthetic coding sequence
atgaggccgccagttacaaaagcaagcagcttttctggcatcagcattctcacacgtggagacagcatagggtccagtaagggaggctctgctgggaggatctctagaccaggcatggccctgggagctccagaagtctgcaaccaagtgacgtcaagtcaatccgtccgcggattactgccatgcactgcccagcagcaacagcaacagcagcagcaacaattgcccgctcttccacctacacctcaacagcagccccctctcaataatcatatgatctctcagcctgtgcctgccctgcagccctcgccacaacctgtgcaattttcaccatccagctgccctcaggtcctactgcccgtcagtccaccccagcagtacaatatggccgacgatctctccaacccatttggccaaatgagcttgtcacggcaaggcagtacggaggctgctgatcctagcgccgcacttttccagacccctctgatctcacagcatccacaacagacctcttttatcatggcctctaccggccagcctctgccaacctccaactactctacatcatcccacgcaccgccaactcagcaagttctgcccccacagggatacatgcagccaccccagcagatccaagtgtcttattatcctcctgggcaatatcccaattcaaaccaacagtatcggccactctctcaccctgtggcctactctccccagcgcggtcagcagctgccacagccaagccagcagccgggtctacaaccgatgatgcctaatcagcagcaagctgcataccagggtatgataggcgtccagcagccccagaatcaaggactacttagtagtcagcgatccagcatgggtgggcagatgcaaggtttggtagtgcagtacactcctcttcccagctatcaagtgccggtaggttctgactcccagaatgtagtgcaacctccttttcaacaaccaatgttagtgcctgtgtcccagtcagtgcaagggggactccccgctgctggagtccctgtgtactactcaatgatcccgcctgctcagcaaaacggcacgtctccttctgtgggcttccttcagccccctgggtccgaacaataccaaatgccacagtctccctcaccctgttctcctccacaaatgccacaacagtatagtggggtgagcccatcagggccaggtgttgtggttatgcagctgaacgttccaaatggccctcaaccccctcagaatccaagtatggtacagtggtctcattgcaaatattactctatggaccagagggggcaaaaacctggggatctgtactccccggacagctcaccacaggctaacacccagatgtcgtcatctccagtcaccagtcctactcagtcccctgcaccttctcctgtcacctccttgtcaagcgtgtgcacaggactgtcacccctacctgtattaactcagtttcccagacccggtggtcctgcccagggggatgggaggtattcactgctcgggcagccccttcaatacaaccttagcatatgcccgccactccttcatggccagagtacctatacggttcaccagggtcagtctgggctcaagcacggcaatcgcggaaagcgccaggcgctcaaatcagcctccaccgatttggggactgcagacgttgtgcttggcagggttctggaggttactgaccttcctgaggggatcaccagaacagaagcagataaactgttcacgcagcttgctatgagcggtgctaagattcagtggctcaaggacgcacaaggcctacctgggggtggtggcggagataacagcggcactgccgagaatggcagacacagcgaccttgctgccttatatacgatagttgccgttttcccttccccacttgcagctcagaacgcaagtcttcggctgaacaattcagtgtcaagattcaaactgaggatggctaagaagaattacgacctgcgtattctcgagcgggcatcttcccagtag

SEQ ID NO: 24055 - DNA, 90 bp, Artificial Sequence
  Description of Artificial Sequence: Synthetic coding sequence
atgagtaattcaaacactacccaggagaccttagagatcatgaaggaaagcgaaaagaagttagtggaggaatctgttaacaagaactag

SEQ ID NO: 24056 - DNA, 198 bp, Artificial Sequence
  Description of Artificial Sequence: Synthetic coding sequence
atgttctatactcacgttttgatgtccaaacgcggtcccttggcaaagatctggctggctgcacactgggagaagaaactgacaaaggctcacgtatttgaatgtaaccttgagatcacgatcgagaagatcctgagccccaaagtgaagatagcattgcggacttctggtcatctcctgttaggcgtagtcagatag

SEQ ID NO: 24057 - DNA, 1566 bp, Artificial Sequence
  Description of Artificial Sequence: Synthetic coding sequence
atgttttatacacacgtcctcatgagcaagagaggtcccctagcgaaaatctggcttgcagcccactgggagaaaaaacttaccaaggcccatgtcttcgagtgtaatttggaaattactatcgagaagatcctcagtccgaaggtgaagatcgctctgagaacctcagggcacctcctcctgggagtggtgcgaatctacaatcgcaaggccaagtatctcctagccgactgtagcgaggcgtttctcaaaatgaagatgactttctgccccggactagttgaccttcctaaggagaacttcgaggccagctataacgccatcaccctccccgaagagtttcacgattttgacactcagaacatgaatgccattgacgtcagtgaacactttacacagaaccagtcccgcccagaggaaatcaccctccgggagaacttcgacaacgatctgatttttcaggcagaaagcttcggagaggagagcgaaatccttagacgccactccttcttcgacgacaacatccttctgaattcctctggaccactgatcgagcacagttccggatctctcactggagagaggtccctcttttacgacagcggcgatggattcggcgacgagggggcagcaggcgaaatgatcgacaaccttctccaggatgatcaaaatatcttactggaagatatgcatctgaatcgagagataagcttacccagcgagcctcctaattcactggccgtggagccggataactcagagtgtatctgtgtgcccgagaatgaaaaaatgaatgagacaattctattgagtaccgaggaagaaggctttaccctggaccccattgatatatccgatattgcagagaagagaaaaggtaagaaaagaagactgctgatagaccctattaaagagctatcctcaaaggtgatccataaacagttgacctcttttgctgatacccttatggtgctggagttagcccctcctacccagcgactcatgatgtggaagaagagaggaggcgtacacaccctccttagcacagccgctcaggacctcatccatgccgagctgaaaatgcttttcaccaaatgcttcctgtcttcaggattcaagctgggcagaaaaatgattcagaaggagtccgtccgggaagaggtgggaaaccagaacatcgtggagacctccatgatgcaggagcctaactaccaacaagaattaagtaagccgcaaacttggaaagacgttattggcggtagtcaacactcttctcatgaagacaccaacaagaatatcaacagtgaagagtcactgagcaacgaggagaatatcgaaacagaaaggtggaacggacgcatactacaaatgttgaataggctgagagtcgccgaccagggacaggccgctgcggcagcaacagctgaggctctgcgccaggctggcccagaatggtgcgagccagcaggacttcgtcgcgctagcggactatcgccgagggacacggcccatcccacgccatactctgatcctcaacctcacggacacgtacctgccaggaaatag

SEQ ID NO: 24058 - DNA, 1566 bp, Artificial Sequence
  Description of Artificial Sequence: Synthetic coding sequence
atgttttacacgcatgtgctgatgtctaaacgcggtccgctcgccaagatatggctggccgctcactgggagaagaaattgacaaaagctcacgtgttcgaatgcaaccttgaaattaccatagaaaagatactgagcccaaaggttaaaatagctttacgcacctccggccatctgcttctgggcgtggttcgaatttacaatagaaaggccaagtacctactagctgattgttcagaagcttttcttaaaatgaaaatgacattttgcccgggactggtagacctcccaaaggaaaatttcgaggccagctacaatgcgatcacccttcccgaggagtttcacgacttcgatactcagaatatgaacgccattgacgtgtccgaacactttacccaaaatcagtcaaggccagaggagatcactctgagggagaatttcgacaacgatttgatttttcaagcagaatcttttggagaagaatctgagattctgcggagacatagcttcttcgacgataatatcctgctcaactcttccggcccactgatcgaacatagtagcggctccctgaccggagaacgtagcctattctacgattcaggcgacggtttcggcgatgagggagccgctggagaaatgattgacaatctgctccaggacgatcagaacatcctcctcgaggacatgcatcttaaccgtgaaatctcattgccatccgagccgcctaacagcctggctgttgagcccgataattctgagtgcatttgtgtccccgaaaacgaaaaaatgaacgaaactatacttctgagtaccgaggaggagggatttaccttagaccccatagatatatctgacattgccgagaaacggaaggggaagaagaggcggctattaattgatcccatcaaggaattgtcctccaaagtgattcacaagcagttgacttcctttgccgacacactcatggtactcgagctagcgccacccacgcagaggctgatgatgtggaagaagagaggcggtgttcatactctgctgagtacagcagcgcaggacctgatccacgccgagcttaagatgctgttcacaaagtgcttcctcagctcgggcttcaaacttgggaggaaaatgatacagaaggagtcagtgcgggaggaagttggaaatcaaaatatagttgagacctccatgatgcaagagcctaattatcagcaggagctgagcaaaccgcagacatggaaagacgtaattgggggtagtcagcattccagccacgaggacaccaacaaaaatatcaactccgaggaatcgttgtctaatgaagagaatatagaaacagagcggtggaatggaaggatccttcagatgctgaataggctgcgggtggctgaccagggccaggcagcagctgccgcaaccgccgaggcactcagacaggccggacctgagtggtgtgagcctgccggacttaggcgcgcaagcggtctttcaccacgagacacagctcaccctaccccatattccgatcctcagccccatgggcatgtgcctgccaggaagtag

SEQ ID NO: 24059 - DNA, 1671 bp, Artificial Sequence
  Description of Artificial Sequence: Synthetic coding sequence
atgttttacactcacgtacttatgtctaaaagaggccctttggcaaagatttggctggcagcgcattgggagaagaagctcacgaaggctcacgtgttcgagtgtaatctcgagatcacaattgagaaaattctgtctcctaaggtgaaaatcgccctgaggacatccgggcacctgctactgggggtggtccgcatttacaaccgcaaggccaagtatttgttggccgactgcagcgaagcattcctcaagatgaagatgacgttctgtccaggcctggtggacttgccaaaggaaaactttgaggctagctacaacgctatcactctcccagaagagttccatgatttcgatactcagaacatgaacgcaattgacgtgagtgagcacttcacacagaaccagagcaggcctgaggagattactttaagagagaacttcgacaacgatctgatcttccaagcggagagctttggcgaggaaagtgaaatcttaaggaggcactccttttttgatgacaacatcctgctgaactcatctggccctctgattgaacacagttccggctctctgaccggtgagcgttctctgttttatgattccggcgatgggtttggtgacgagggggctgccggagagatgatcgataatcttctgcaggacgaccaaaatattctgctcgaggacatgcacctgaaccgagagatttccttgccctcagagccgcctaactcgctggcagtggagcccgacaattcggagtgcatatgcgttccagaaaacgagaagatgaatgagacaattctgctgtccacggaggaagaaggattcacgctggacccaattgatatctctgacattgccgagaagcgcaaagggaaaaagcggcgactccttattgatcccatcaaggagttgtcttcaaaggtgattcataaacagctgacgtcctttgcagacacactgatggtactcgagctggccccacccacacagcggctcatgatgtggaagaaaagaggtggagtccataccctcctgtcaacggctgcacaggatctgatccacgctgagttaaagatgctcttcactaagtgtttcctctcctcaggctttaaacttggtcgcaaaatgatacagaaagagtccgtcagagaagaggtaggaaatcaaaacatagtagaaacttccatgatgcaggagcccaactaccaacaggaacttagtaagcctcaaacctggaaggatgtgatcgggggatcacagcattcctcccacgaggatacaaataagaatatcaactctgagcaggatatagttgaaatggtctctctggctgccgaggagagctctctgatgaacgacctcttcgcgcaggaaattgaatacagccctgttgaactggaatcactctccaacgaggagaacatagagacggaacgttggaacgggaggatcctacagatgctgaatcgtctcagagagtcaaacaaaatggggatgcagtccttttcactgatgaaattatgcagaaactccgacagaaagcaagccgctgccaaattctactctttcctcgtgctcaaaaaacaactggcaatcgagctctctcaatctgccccatacgctgacatcatcgctacaatgggaccaatgttttacaatatttag

SEQ ID NO: 24060 - DNA, 3486 bp, Artificial Sequence
  Description of Artificial Sequence: Synthetic coding sequence
atgggactcggcaagaccctgcaggtgataagctttatcgatgtcttgttccgtcacacccctgctaaaactgtcctcgctattgttccggtgaacaccctgcagaattggctcgccgaattcaatatgtggctgccccctccagaggcactgccggctgataataagcctgaagaagtgcagccccgttttttcaaagtgcatattctcaacgacgagcacaaaacaatggctagtcgcgctaaagtgatggcagattgggtctctgaagggggagttctccttatgggatacgagatgtatagactgctgactctgaaaaagtcctttgctacggggaggcccaaaaagacaaagaaacgcagtcacccagtgataattgatttggatgaagaagaccgccagcaagagttcagacgtgaattcgaaaaagccttatgtcgccctggcccagacgtcgtcatatgtgacgaaggtcatcgaattaaaaactgtcaggcctcgacaagccaagcccttaaaaatatacggtccagacgcagagtggtcctgacaggctatccattgcaaaacaatctgatcgaatattggtgcatggttgacttcgtgagaccagatttcctgggcactcgccaggaattttcaaatatgttcgaacgcccaatcctcaacggccagtgtattgacagcacaccacaggacgtcaggctgatgcgatatcgaagccacgtactgcattctctcctggaaggatttgtacagcggaggggacacaccgtactaaaaattcaccttccggcaaaggaggagaatgtcatcctcgtccggttaagcaaaatccagcgggacctttacacccagtttatggaccggttcagggactgcgggtcttcagggtggttaggacttaatccgctcaaagccttttgtgtttgctgcaagatctggaatcaccctgacgtgctttatgaggcccttcagaaggagagcctggccaatgagcaggatctggacgttgaggagttgggaagcgcaggcacatctgccaggtgccctccccaaggcacaaaaggcaagggcgaagatagtactctggcatccagcatgggagaggccaccaactcaaaattcctgcagggtgtgggcttcaacccgttccaggaacggggaaataacatagtgacctacgagtgggcgaaagacttacttaccaactatcagaccggcgtgctcgagaactcacctaaaatggtacttctgttccatctaatagaagagtctgtcaagctcggagacaagattctggtattttcccagtccctgagcaccctggccctaatagaggagtttctagggaaaagggaagttccttgtccccctggcacagaaggacagggcgctcaaaagtgggtcagaaatatctcttactttagactggacggaagtacccctgcattcgaacgggagagactgatcaatcagtttaatgacccgtccaatctcacaacttggctgttcctgctgagtacacgggcaggatgcctcggggtgaacctgattggcgctaaccgagtggtggtgtttgacgcctcctggaacccctgccacgatgcacaggccgtgtgcagggtgtaccggtacggacagaaaaagccctgctatatttatcgactagtcgccgactacaccctcgagaagaaaatctatgacagacagatttccaaacagggaatgagcgatagggtagttgacgatcttaacccaatgttgaattttaccaggaaggaggtggaaaacctccttcactttgtggagaaggagccggctccccaagtatccttgaacgtgaagggaatcaaggagtcagtgctgcagctggcttgtttaaagtatcctcatctgattacaaaggagccgtttgaacacgaatccttgcttctgaacagaaaagaccataagttaacaaaggcagaaaagaaggccgctaaaaagagttacgaggaggacaaaagaacaagtgtgccatatacaaggccatcctatgctcagtactatcctgcatccgaccaaagcctgacttccatccccgcttttagccaacggaattggcaacccaccctgaagggagatgagaaaccggtggcctccgtaagacctgttcaatcaactccaatcccaatgatgccaaggcacgtgcctttgggaggctcagtctcttccgccagctcgacaaaccccagcatgaatttcccaatcaattacttacaaagagctggggtgctcgttcagaaggtcgtgacgaccaccgacattgtgattcccggactgaactcttctaccgacgtccaggccaggatcaacgccggagagtcaatccatatcatcagagggaccaagggcacatacattaggacctctgacgggagaatcttcgctgtgagggctaccggcaagcccaaggtgcctgaggatggtcggatggccgcaagtggctctcagggaccaagctgcgagtcaacctctaacggcagacattccgcaagcagccccaaagcaccagatcccgaggggttagctagacctgtgagccctgactcccccgaaattatttctgagttgcaacagtacgccgatgtggcagcagcccgagagagtaggcagtcctccccaagcaccaatgcagcccttcctggaccaccggctcagctgatggactcctcggctgtgccaggcaccgcattaggaaccgaaccaaggctgggcggacattgtctgaactcctctctgctggtgactggccagccctgtggagacagacatcccgtcctagacctgcgcggacacaaacggaaacttgcgacacctcctgcagctcaggagtctagtcgtagaaggtccaggaagggacacctccccgctccggtgcagccttatgagcatggctaccccgtcagtgggggatttgctatgcctcctgtgagtctgaatcataacctcacgactccctttacatctcaggcaggagagaactccctattcatgggatctaccccatcttattatcaactgagtaacctgctggcagacgcccgactggtctttccagttaccaccgaccccctcgtaccggcagggccagttagctcatcctcaaccgccacatctgtcacagcttcaaatccttcatttatgttgaatccaagcgtcccaggcatcctgccatcctacagtttaccttttagccaacccttactgtctgagcccagaatgtttgccccatttccgagtcccgttttgccctctaacttgagccggggaatgtcaatctatcccggttatatgagcccgcacgctggatacccggctggtggcctgctccggtcccaggttccgccttttgatagtcatgaagtggctgaggtcggtttttcctcaaacgatgacgaggacaaagacgatgatgtcatcgaggtgacaggtaagtag

SEQ ID NO: 24061 - DNA, 4404 bp, Artificial Sequence
  Description of Artificial Sequence: Synthetic coding sequence
atgtctgacgaatccgccagcgggtcagaccccgatctggaccccgacgtcgagctcgaggatgccgaagaagaggaagaagaagaagaggtggcagttgaagagtgcgatagagacgacgaagaggacctcctcgatgatccatccttagagggaatgtgcggaactgaacacgctcagttaggcgaggacggtcagcagccaccacgctgcacatcaaccacttctagccaatccgaacctagtgagcagttgcgcaggcaccagggtaaaaacctggcgagcgaagaccccaaaaagaagcgcgcacagaagcccagtcacatgcggagaaacatccgtaaattgctgcgggaggatcaacttgaacccgttaccaaggccgctcagcaggaagaattggaacgaaggaagcgcttggagcagcagcggaaagattacgccgctccaattcccaccgtgccactagaatttctgcctgaagaaattgctctgcgcgcatctgacggtcctcagttgccaccgcgagtgctggctcaggaagtaatctgcctcgattcttctagcggcagtgaggacgagaaaagctcaagggatgaggtgattgagttatcctccggggaggaggataccctgcacattgtagactcctccgaatctgtgtccgaagatgacgaagaagaggagaagggaggtacccatgtcaacgacgtcctgaaccaaagggatgcactagggagagtcttggtgaatctgaatcatccgccagaagaggagaacgtgtttttggcccctcagctcgccagggccgtgaaaccgcaccaaattgggggtatcaggtttttgtacgacaatctggtggaatctctggagcggttcaaaaccagctccggattcggctgcatactggctcactccatgggcctgggtaagacgctgcaggtgatcagtttcatcgatgtacttttcaggcacacccccgctaaaaccgtgctcgccatcgttcctgtgaacactctgcagaactggctggccgaatttaacatgtggctgcccccacccgaagcactccccgcagacaacaagcccgaggaggttcaacccagattctttaaagtgcatattctgaacgatgagcataaaaccatggccagccgcgcaaaggttatggctgactgggtatccgaaggcggagtgctgttgatgggatatgagatgtacagattactcaccctgaagaagtccttcgctaccggaagacccaagaaaacgaagaaacgatcccatcctgtgatcatagatctcgatgaggaagataggcagcaagaattcaggagagagttcgagaaggccctttgccgcccaggtccagatgtggtcatctgtgacgaaggccatagaattaaaaactgccaggcatcaacctcccaggcattaaaaaacattaggagtaggagaagggtggttctcactgggtaccccctgcagaacaatctgattgagtattggtgcatggtagacttcgtgcgcccagatttcctgggaacgcggcaggaattctctaatatgttcgagcgcccaatcttgaacggtcagtgcattgatagtacccctcaggatgtgcgactgatgcgttatcggagtcacgttctacacagtctgctggagggcttcgttcaaagaagaggacacacagtgctgaagattcacctgccagccaaagaggagaatgttatactggtgagattaagcaaaatacagcgagacctgtacacgcagtttatggacaggtttcgggactgcgggagttcagggtggctgggactcaatccactcaaggctttctgtgtctgttgtaaaatttggaatcatcctgatgttctgtatgaggccttacagaaggagagtcttgccaacgagcaggatttggatgtggaggaactgggaagcgcgggaaccagcgccagatgtcctccacaaggaactaaggggaaaggtgaggattctacccttgccagctctatgggcgaggccaccaactccaagttcttgcagggcgttgggttcaacccctttcaggagcggggtaacaacatcgtcacgtatgagtgggcaaaggacctgctcacaaactatcaaacgggagtgctcgaaaattctccgaagatggtgctgctgtttcacttaatagaggagtccgtgaagttgggcgacaaaatcctggtcttctctcagtcactctcaactctggctctaattgaagaattcttgggcaagcgggaagttccatgcccacccggtactgagggccagggcgctcagaaatgggtgcggaatattagctacttccggctcgatggcagcaccccagcctttgagcgtgaacgccttattaaccaatttaacgacccctctaacctcaccacctggctttttttgctcagcacccgtgccggatgcctgggtgtcaatctgatcggtgcaaatagggtcgtggtgttcgatgcttcatggaacccatgtcacgatgcgcaggctgtgtgccgcgtgtatcgctacggccagaaaaagccttgttatatttatcgtctagtggcggactacaccctcgagaagaaaatttatgacagacaaataagcaaacaggggatgagtgaccgagttgtggacgacctgaatccgatgctgaactttactcgcaaggaggttgagaatctcctacacttcgtggaaaaggaaccagctccgcaagtgagcctgaacgttaagggaatcaaagagtcagtcctgcagctcgcttgtttgaagtatccacatctgatcacaaaagagcccttcgagcatgaatccctattgcttaacagaaaagaccacaagcttacgaaggccgagaagaaagccgctaagaagagctatgaagaagacaaaaggacttcggtcccatacacccgtccatcttatgctcagtattacccagcatcggatcagtccctgaccagcatccctgccttctcccagaggaactggcagcccacactgaaaggagatgaaaaacccgtggcaagtgttcgtcccgtgcaatccacacccattccgatgatgccaaggcacgtcccactagggggatcagttagcagtgcaagttctaccaaccctagcatgaacttccctatcaactatctgcagcgagccggagttttggtgcagaaggtagtcaccacaactgacatcgttattccaggacttaactccagcacggatgtgcaggctagaatcaacgccggagaatctatccacattatacgcggtacaaaaggcacttacattaggactagcgatggacgcatttttgccgtccgtgctacgggtaagccaaaagtgcccgaagacggacgaatggctgccagcggatcacagggtccctcttgtgagagtacctctaatgggagacacagcgcgtcaagccccaaagcacccgatccagaaggattggcccgacctgtgtcgccggactccccagagatcatatctgagctacagcagtatgcagacgtcgccgcagccagggagagcagacagagctctccgagtaccaacgctgcattgccgggacccccagcacagttaatggactcatccgcagtcccaggcactgccctaggaactgaacctaggctgggaggccattgtttgaattctagtctcctcgtgaccggtcagccctgtggcgacaggcatcccgttctcgatctacgcggacataaaagaaagctcgctactcctccggcagcacaagagagttctcgcagacgaagtagaaaaggtcacctccccgctccagtccaaccatatgaacatggatacccggtttccggtggatttgctatgcccccagtgtctctgaatcacaacttgaccacgccgttcacatcccaggcaggggagaactcactcttcatgggctcaacaccctcctattaccagttatctaacctcttagccgatgctcgactcgtctttcccgtgaccacggatccattggttcctgctggcccagtcagcagcagtagcaccgctaccagcgtgactgccagtaacccgagttttatgctgaatcctagcgttcctggaatcctgccaagctacagcttgccctttagtcagcctttactttccgagccaagaatgtttgccccattcccttccccagtgctgcccagcaacctgagtagggggatgtcaatctatcctggttatatgagccctcacgccggataccctgctggaggtctgcttagaagtcaggtaccaccctttgattcgcatgaggtggcggaagtcggcttctctagtaatgacgatgaggacaaggatgatgatgtaatcgaggtgaccgggaagtag

SEQ ID NO: 24062 - DNA, 675 bp, Artificial Sequence
  Description of Artificial Sequence: Synthetic coding sequence
atgccccctagaaagaagcgtagacaaccctcccaaaaagcacccctcttgtttcaccaacaacccttggaggggccaaagcactcttgtgcaagtacacagcttccaattacgcacactcgccaggtatcgccagacttcgataccgccgctggctcgctctttcccgcttaccagaagcatcaaaacagagccaggcacagttcccggaagccaacaacttcaaaattcccccacctgacattcgagtcccctcagtcaagtagctctgaaaccctgggcatccccctgatcagagagtgcccaagcgagtccgaaaaagatgttagccgcagacccttggttccagtgctgtctcctcagtcctgcggaaacatgtccgtgcaggcgctgcaatctctgccgtacgtgttcattcccccagatatacagacaccagagagctcatcagtcaaggaggaactgatacctcaggaccagaaggaaaactccctcctgtcctgtacgctgcataccggcacccccaattcacccgaacctggcccagttctggtcaaggatactcctgaagacaaatacggtatcaaggttacctggcggaggagacagcacctgctggcatacctccgcgagagaggaaaactgtccaggtcccagtttctggtcaagtcttag

SEQ ID NO: 24063 - DNA, 1335 bp, Artificial Sequence
  Description of Artificial Sequence: Synthetic coding sequence
atggggagctccagacttagagttttcgatccacacttagaacgcaaggattcagcagccgcactgagcgatagggagttgccactgcctacattcgatgttccatatttcaaatatatcgatgaggaggatgaagacgacgaatggtcctcacgttcacagtcaagcactgaggacgattccgttgattccctgctcagcgatcgatacgtggtggtttctggcactcccgagaagattctggagcatttgctcaatgatctgcacctggaggaagtccaagacaaggaaacagaaacgttattagatgacttccttctgacttacacagtgtttatgacaaccgatgacctctgccaggcactgcttcggatctattcagctaagaaataccagggcaaagaagaaaatagcgatgttccacgacggaagcgcaaggtgctgcatcttgtgagccagtggattgccctatacaaagactggcttccagaggatgaacacagcaagatgtttctcaagactatttatagaaatgtgcttgacgatgtgtatgaatatccgatcctggaaaaggagctaaaagagtttcaaaaaatcctggggatgcaccgacgacatacagtggatgaatactcgccacagaagaaaaacaaagctttgttccaccagttttctctgaaggagaactggctccagcatagggggacggtgactgagacagaggaaatattttgccatgtctacatcaccgaacacagttatgtctccgtgaaagccaaggtgtcgagcattgctcaggagattctgctgtgttcacaactcgggaagcgcgtccagctggtgaagaagtttataaaaatagccgcacactgtaaggcgcagcgaaatctgaattctttctttgctatcgtgatggggttgaacacggctagcgtttcgaggctgtcgcagacgtgggagaagattcccggaaagtttaagaagctgttttccgagctggagtctttaaccgatccaagcctaaatcacaaggcttaccgggatgcatttaagaagatgaaacccccaaaaatcccttttatgcccttgctattaaaagacgtgacatttatccacgaaggcaacaagacattcttagataatctggttaatttcgaaaagcttcatatgattgccgataccgtgagaaccctgagacactgccggacaaaccagtttggcgatttatcacctaaagagcatcaggagctgaaatcttacgtgaatcacctgtatgtcattgatagtcagcaagcgctatttgagctgagccaccgaattgagccgcgtgtctag

SEQ ID NO: 24064 - DNA, 2193 bp, Artificial Sequence
  Description of Artificial Sequence: Synthetic coding sequence
atggccataggggtctggcagctgttattagatatgggaataatgctcagcgtagaccagcatctatactttcaggacacatatgttttctatcagttctcctctgatgagtgcagctatttatactgtgagttcgagcgcgaagaagaatggcagaacggggtgaaactgctgctgcagctcgtgcccttaatacctgcccgaggcggaatctgcgagctgtcccaccagaaaatcgaggactctgaagagagcagcgatgagatcctggtgcggctaactagcgcggtccagcgcgaattagccgcagtcatcgctctcaaggccagaaaatctgccatcgaacaggatgaggagaacaatgacaaacacgtggctgtcactgaagctgaatccgttcctgattctcaggccggagtcatgtgtaaattgcaagagagagacgaaattggacgcattgagctcgtgcagaagttggccaaggagaactatcagtttctgcaaactgacaaaaaggaacaggagaaatcggagcaccaagatgacgaagtcactactgtccaggtcaaggagcaggatcagtccgtcctggtcctgaaaaaagtgcagtgttgtgggccagccccaactgctggcagcgcggagagccattggagatatgtggtagtgtctggcactcctgaaaagattttggaacatctactgaacgatctgcacctagaggaggtccaggataaagagacagaaacactgctagacgacttcttgctgacatacactgtgttcatgacaaccgatgacctgtgccaggctctcctacggcattatagcgccaagaagtaccagggcaaggaggagaacagcgacgtgcctcgcagaaagcgtaaagttctgcatcttgtgtcacagtggattgctctctacaaggactggttgcccgaagacgagcactccaaaatgtttctgaaaacaatttaccggaacgtgctggacgatgtgtatgagtatccaatactggagaaggagctaaaggaattccagaagattctgggcatgcaccgcaggcataccgtggacgaatacagcccccaaaaaaagaacaaggctctatttcaccagtttagccttaaagagaattggctccaacaccggggtacagtgactgagactgaagaaattttctgccatgtgtatatcacagagcacagttacgtctcagtcaaggccaaggtcagctctatcgcccaagagatacttaaagtcgtagccgaaaaaatccagtatgccgaagaagacctggctctggtcgccattaccttcagcggcgaaaagcacgagctacaacccaatgacctggtgatctccaagtccctggaggccagcggtcgcatttatgtgtaccgcaaggacttagctgacaccctgaatccttttgcggagaacgaggagtcccagcagcgtagcatgcggatattggggatgaacacatgggacttggctctggaactgatgaatttcgattggtcgttgttcaatagcatccacgaacaggaattgatttatttcactttctcaaggcaggggtccggcgaacacaccgccaacctgagccttctcctacagaggtgcaatgaggtacagctatgggtggctaccgagattctactatgcagccagctgggcaaaagggtacagctggtaaagaaattcataaagattgctgcccactgtaaggctcagaggaacctgaactctttctttgccatagtcatgggactcaataccgcgtcggtgagtcggctttcccagacttgggagaagattcctggcaaattcaagaagttgttcagcgagttagagtcacttaccgatccctcgttgaatcataaagcctatagggacgcctttaaaaagatgaagcctccaaaaataccttttatgcctttgttgctcaaagacgtgacttttatccatgagggtaataagacatttctggacaacctagtaaacttcgagaaactgcacatgattgcagacaccgtccggaccctccggcactgtcgaacgaatcagtttggcgacctaagtcctaaagagcaccaggagctgaaatcttatgtgaaccacctgtacgtcattgatagccagcaagcattgttcgagctgagccataggattgaacctagggtgtag

SEQ ID NO: 24065 - DNA, 1743 bp, Artificial Sequence
  Description of Artificial Sequence: Synthetic coding sequence
atgggctcttcccggctgcgcgtgtttgacccccatctggaacgcaaggatagtgctgctgcactttccgatcgcgaactacccctgcccacattcgatgttccatactttaagtacatcgatgaagaggatgaggatgacgaatggtcaagtcggagccagagttctacggaagatgactcagtggacagcctgctgtctgaccgttacgtcgtggtgagtggcactcccgagaagattctcgaacaccttctgaacgacttgcacctcgaggaagtgcaggataaggaaaccgagacgctgctggatgattttctcctcacgtataccgtgttcatgactacagatgacctatgccaggccctcctgagacactacagcgccaaaaagtaccaaggcaaagaggaaaacagtgatgttccgaggcgcaaaaggaaggttttgcatctcgtgagccagtggatagcactgtacaaggattggctgccagaggatgaacactcgaaaatgtttctgaaaactatctaccggaatgttctagacgacgtgtatgagtaccctatcctcgagaaggagctgaaggaattccaaaagattttgggcatgcacagacgccacacagtggatgagtatagtccgcaaaagaagaacaaggccctatttcatcagtttagcctgaaagagaactggctgcagcaccggggaacagtgactgaaactgaagagatattttgccacgtgtatataaccgagcacagttacgtgtcagttaaggctaaagtgtcctctatcgcgcaggagatcctgaaggtggttgctgaaaaaatccagtatgccgaggaggatctggcactggtggccatcaccttttctggtgaaaagcacgaactccagcccaacgaccttgtcataagcaagtccctggaagctagcgggagaatctacgtatatagaaaagacttagctgacactctgaatccatttgcagaaaatgaagaatcccagcagaggagcatgcgcatattgggaatgaacacgtgggatctggccctggagctgatgaacttcgactggagtttgtttaacagcattcatgaacaggagctcatctacttcactttcagcagacagggcagtggggagcataccgctaatttgtcactacttttacagcgctgcaatgaagtacagttgtgggtcgcaaccgagatcctcctgtgcagccagctaggaaaaagggtgcagctcgttaagaaattcattaagatagcagcccattgcaaagcccagagaaacctgaactccttttttgcaatcgtgatgggattaaataccgcatccgtcagcagactgtcccagacctgggaaaagataccaggtaaatttaagaagctgttttccgagctcgaatctttaacagatccctccctgaaccataaggcataccgggatgctttcaagaagatgaagcctcctaaaatccccttcatgcccctcctgcttaaggacgttacattcattcacgagggtaataagaccttcctagataaccttgtgaatttcgaaaagctgcatatgattgccgatacagtaagaaccctgaggcactgccgtacaaaccagttcggcgacctttcgcctaaggagcatcaggaactgaagtcatatgtgaaccacctgtacgtgatcgacagtcagcaggcactgtttgaactctctcacaggatcgagcccagggtgtag

SEQ ID NO: 24066 - DNA, 1749 bp, Artificial Sequence
  Description of Artificial Sequence: Synthetic coding sequence
atgggttcttctcgcctgagagttttcgacccccatttagagagaaaggacagtgcagccgctctgtctgaccgcgagcttcctctgcccacctttgacgtgccatactttaaatacatcgatgaagaagatgaagatgacgaatggtcgagcagaagccagagctctacagaagacgactcagtggactctctcctttccgatcgttacgtggtggtctccggcacccctgaaaagattttagaacatctgttaaacgatttacatctggaggaagtccaagataaggagacagagacactgcttgatgatttcttgctcacatatacagtctttatgactacagacgatctttgccaagcactgttaaggatttattctgctaagaaatatcaaggaaaagaggaaaactccgatgtgcctcgccgaaaaagaaaggtgctccatcttgtcagtcaatggatcgccctgtataaagactggctgccagaagacgaacactccaagatgttcttgaaaaccatatacaggaacgtgctggacgatgtttacgagtatccgatcctggagaaagaattgaaagagttccaaaagatactggggatgcaccggagacacactgtggatgaatatagcccacagaaaaaaaacaaggcactcttccaccagttttctttaaaagagaattggttacagcatcggggaactgtaacagagacagaagaaatcttttgccatgtgtacattaccgagcactcttatgtgtctgtcaaggcaaaagtgtcttctattgctcaggaaatcctgaaagtggtcgccgagaagatccagtacgccgaggaagatctggcgttagtggccataaccttctctggagacaaagaaaaacacgagctgcagcccaacgacctcgtgatttcaaagagcttggaagcttcaggcagaatatacgtgtatcggaaagacctcgccgacacactcaatcccttcgccgaaaacgaagagtcgcagcagaggtcgatgcggatattggggatgaatacctgggatctcgcgttggagctgatgaacttcgactggagtcttttcaacagcatccatgaacaggaattgatctatttcacattctctagacaaggctctggagaacataccgctaacctgagcttattattgcaacggtgcaatgaagtgcagctgtgggtagcaacagagatcctgctgtgttctcaactgggcaaacgggtccagttggttaagaagtttataaaaatcgcggctcactgcaaagcgcagagaaatctcaactcgttctttgcaatagtcatgggactcaacaccgcaagtgtgagcaggctctctcaaacatgggagaagattcctggtaagtttaaaaaactgtttagcgagcttgagtcactgacagacccatcactgaatcacaaggcataccgcgacgccttcaagaagatgaaaccaccaaaaattccattcatgccgcttttgctcaaagacgtaacattcatccatgagggcaataaaacattcctggacaatctcgtgaattttgagaagctacatatgattgcggacacagtaagaacactgcgccattgtcgcacaaatcaatttggagacctttctcctaaagagcaccaggagttaaagtcttacgtcaatcacttgtatgtaattgattcacagcaggcgctgtttgagttgtcacacagaatcgaacccagagtctag

SEQ ID NO: 24067 - DNA, 1122 bp, Artificial Sequence
  Description of Artificial Sequence: Synthetic coding sequence
atgctgttggggcttgctgccatggaacttaaggtatgggtggacggcattcagagggtggtttgcggtgtgtctgagcaaacaacttgtcaagaagtggtcatcgcactggcccaagctattgggcagactggacgattcgtgctggtgcagcggctgagagagaaagagcgtcaactcttgcctcaagagtgccccgtgggtgcacaagctacttgcggccagtttgcctcagatgtgcagttcgtcttaagacggactgggccttcactggccggaagaccatcttctgatagctgccctcctcctgagcgatgtttgatcagagcatccttgccggtgaaacccagggccgcattggggtgcgaaccacgcaaaacattaaccccagaacccgctcccagtctttcccgcccaggtccggctgccccagtaacgccaacacctgggtgctgcaccgacttaagggggcttgagctgcgcgtccagagaaacgctgaagaactgggtcacgaggccttctgggagcaggagttgcggagggaacaggccagagagcgcgaggggcaggcacggcttcaggccctctccgctgcaacagcagagcacgccgcaagactgcaggcactggatgcacaggctcgagccctcgaggccgagctccagctggctgctgaagctcccggacccccttcaccaatggcgtccgctaccgaaagactgcaccaggacctggccgtccaggaacgtcaaagcgctgaagtgcagggttcgctggcacttgtgagccgggctcttgaagccgctgaaagggccttgcaggcgcaggcacaggagctcgaagaactgaaccgcgaattgcggcagtgtaatttacaacagtttattcaacagaccggcgcagctctgccgcctccacctagacccgataggggacctcccggaacccaggggccactcccacctgccagggaggagagtcttttgggagctcctagcgagtcccacgctggagcccagcccaggcccagggggggtccgcacgatgctgagttactggaggtcgccgctgccccagcccctgaatggtgtccactggctgcccagccccaggctctatag

SEQ ID NO: 24068 - DNA, 1014 bp, Artificial Sequence
  Description of Artificial Sequence: Synthetic coding sequence
atgctcttgggactcgctgccatggagttgaaagtttgggtggacggaatccagcgcgtcgtctgtggtgtctcagagcagaccacatgtcaggaggtggtcatagccttggctcaggctatcgggcagaccgggagattcgtgctggtgcaaagactaagggaaaaggagcggcagcttttgccgcaggaatgccctgtgggggcacaagccacctgcggtcaattcgcctctgacgtgcagtttgtgctgcgtcgtactggaccctcattagctgggcgaccatcttccgactcctgccctccacctgaaagatgcctgattagagcttcactaccggtgaagccaagggccgcactgggatgcgagcctcgtaaaactctaacacctgaacctgccccaagcctgagccgcccaggcccagccgcacccgtgacacccacgcctgggtgctgtacagacctgaggggattagaacttagagtgcagaggaacgccgaagagctgggtcacgaggccttctgggaacaggaactccgccgtgagcaggcaagggaaagagaaggtcaggccaggctccaggccctcagcgccgctactgccgagcacgccgcacgcctacaggcccttgatgcccaggcccgtgctctggaggcagagctgcagcttgcagccgaggctccgggaccaccttcccccatggcttccgctacagaacggttgcaccaggacctcgcagtgcaggagagacagagcgcagaggttcagggttccctcgctctcgtctcaagggctctcgaggccgctgaacgagctttacaagcccaggcccaagaactggaagaactgaaccgcgaactgcgccagtgcaacctccaacaattcatccaacagacaggggcagcgctgccaccccctccgcgtcccgacagaggaccccctggaacgcaagtcggcgttgtgctcggagggggttgggaagtgcggacatggccgagtccaacgccgagctag

SEQ ID NO: 24069 - DNA, 1122 bp, Artificial Sequence
  Description of Artificial Sequence: Synthetic coding sequence
atgctgctaggacttgccgctatggagctgaaggtatgggtggacggaatccagcgcgtagtctgcggcgtttctgagcagaccacatgccaggaagtggtcatcgcgttggctcaggctattggccagactggacgtttcgtgcttgtgcagaggctcagagaaaaggaacgccaattgctgccccaggagtgccccgtcggagctcaagctacatgcgggcagtttgcaagcgacgtgcagttcgtgttgagaaggaccggtccctcgctggctggcagaccaagcagcgactcatgccctccgcctgagcgctgtctgattcgggcaagcctcccagttaagcctcgcgctgccctgggatgtgagcccaggaaaacactgactcccgagccggctccctccctctcccgacctggccctgccgctccagtcacccctacaccgggttgctgcactgacctgaggggcctggaactgagagtgcagaggaacgcagaggagctgggacatgaagctttctgggaacaggaacttagaagggagcaagcccgagaaagggagggacaggccagactgcaggccctgtcagctgccacagcagagcacgctgccaggctccaagctttggatgcccaagccagggctctcgaggcggagttgcagctggccgctgaggcccctgggccacctagccctatggcctccgcaaccgaacggctgcaccaggatctagcagtccaggaacgacaatctgcggaagtccagggatccctggcattggtatcccgcgctttggaagcggctgaacgggctctccaggcccaggctcaggagttggaggaactaaatagggaactaagacagtgtaatctgcagcagttcattcagcaaaccggcgcagctcttccgccaccgccacggcctgaccgtggcccacccggtacgcagggtcccctgccccctgcaagggaggaaagtctgctcggcgcaccgtcagaatcccatgccggagcacagccacgacccagggggggtccccatgatgctgagttgctagaggtagccgcagctcccgctccagagtggtgccctcttgccgcacagccgcaggctctctag

SEQ ID NO: 24070 - DNA, 1014 bp, Artificial Sequence
  Description of Artificial Sequence: Synthetic coding sequence
atgctgctggggctggccgcaatggaattgaaagtgtgggtagacgggattcagcgcgtggtttgcggcgtgagcgaacagacaacctgccaggaagtggtgattgccctagcacaggccattggccaaaccggacggtttgtgctggtgcagcgcctccgcgagaaggaacggcagctattaccccaggaatgcccggtgggggcacaggccacttgtgggcagtttgcgtccgatgtgcaattcgtgctaaggcgaactgggccaagccttgcagggaggccctcctctgatagctgtcccccacccgaaaggtgtttaattcgagcgagtctcccagtaaagccacgggctgccctgggatgcgaacctcggaaaaccctgactcccgagcccgctccaagcctctcgcggcctggcccagccgctccagtgacaccaactccaggttgctgtaccgacctgagagggcttgagctgcgcgtgcaaaggaatgctgaggaactgggacacgaggcattctgggaacaggagctgagacgggagcaggcacgggaacgggagggccaggcccgactccaagctttaagcgcggctactgcggaacacgctgccagactccaggcactcgacgcccaagcgcgagccttggaggcggagctgcagttagccgcagaagcacccggtcccccttcccctatggcaagcgccacagagaggctccaccaggatctggctgtgcaagagcgacagtcagctgaggttcagggctcactggcgcttgttagtcgagccctggaggccgctgagcgcgctttgcaggcacaggctcaggagttggaggagttgaaccgcgaactgagacaatgtaacctccagcagtttatccaacagaccggagctgcgcttccgccacccccacgcccagatagggggcctcctggcactcaggttggtgtcgttttgggaggcggatgggaagtgcgtacctggccatcaccgacccccagctag

SEQ ID NO: 24071 - DNA, 963 bp, Artificial Sequence
  Description of Artificial Sequence: Synthetic coding sequence
atgttgctaggcttggccgcaatggagctcaaagtgtgggtggatggaattcaacgagtcgtgtgtggcgtatccgaacagaccacatgccaagaagtcgtgattgccctcgcacaggctattggtcaaacaggtcgcttcgtgttagtgcaacggttaagggagaaggaacgtcagcttctgccccaggaatgtcctgtgggcgcacaggccacctgtgggcagtttgcttctgatgttcagtttgtgctacggaggacaggacccagtcttgcaggtagaccctcgtctgattcatgcccccctcccgagcggtgtttgattcgcgctagcctgcccgtcaagcctcgggctgcacttggttgcgagcctcgtaagacattgactcctgagcctgctccatctcttagtcgacctggtcccgctgctcccgtaactcccacccctgggtgctgtacggacctgcgtggcctggagttgcgggttcaaagaaacgcggaagagctcgggcacgaggcgttttgggagcaggaactccgtcgagagcaggccagggaaagagaagggcaagctagattgcaggcattatcggcggcaaccgcggagcatgccgctcggctccaagcccttgacgcacaggcccgagcgttggaggctgagttacagttagcagctgaggctccgggacctccaagtcccatggcttctgctaccgagcgccttcaccaggacctggccgtccaggaacgtcagtctgccgaggtgcaagggtctctggcacttgtgtcaagggccttagaggcagcagaacgagctttacaggcccaggcccaggagctggaggagctcaatcgcgaactccgccagtgcaatcttcagcagttcatacagcagacaggcgcagccttgccccctcctcctaggcccgatcggggacccccaggcactcagtggccaccgtag

SEQ ID NO: 24072 - DNA, 255 bp, Artificial Sequence
  Description of Artificial Sequence: Synthetic coding sequence
atgttgctcggcctggctgctatggagctcaaagtttgggtggacggaattcagagagtggtgtgtggggtttctgagcagaccacgtgccaggaagtcgtcatcgctctggcccaggccatcggtcagaccgggagatttgttctagtccagcggttgagggagaaggaaaggcagttgcttccacaagagtgcccagtaggcgcacaggctacatgtgggcagttcgcctctgatgtgcaattcgttctgtag

SEQ ID NO: 24073 - DNA, 2145 bp, Artificial Sequence
  Description of Artificial Sequence: Synthetic coding sequence
atgaatactctgcagggacccgtgagtttcaaggacgtcgcagtcgattttacccaagaggagtggcagcaactggaccccgatgaaaaaattacgtatagagatgtcatgcttgagaattactcccatttggtgtcagttggctacgacacgaccaagccaaacgtcatcataaagctggaacagggagaagagccttggattatgggtggagagtttccctgtcagcatagccccgaagcgtggcgcgtcgacgaccttattgagcggatacaggagaacgaagataaacactcccggcaggcagcctgcatcaactcaaagacactcactgaggagaaagagaacacattctcccagatttacatggaaacttcccttgttccatcttccatcattgcgcacaattgtgtctcttgtggcaagaacctggagtcaatttctcagctcatctccagtgacggtagctacgctcgcaccaaaccggatgagtgtaatgagtgcggcaagacttatcatggagagaaaatgtgcgaatttaaccagaatggagatacatattcacacaacgaggagaacatcctgcagaaaatctcgatattagaaaaaccatttgaatataacgagtgtatggaagctctggacaacgaggcagtttttattgctcataaacgcgcatatataggggagaagccttatgaatggaacgacagtggacctgactttattcaaatgagcaattttaatgcctatcagcgcagccagatggagatgaagccgtttgagtgttccgaatgtgggaaatcattctgtaagaagtccaagtttattattcaccagcgcgctcacacgggggaaaaaccctacgaatgtaatgtgtgcggcaagagcttcagtcaaaaaggcactctcacagttcataggaggagccatctcgaggaaaagccttataagtgcaacgaatgtgggaaaactttctgccagaaattacatctgacccagcacttgagaacccattcaggcgagaaaccatacgagtgttccgaatgtgggaagaccttctgtcagaaaacccatctgactttgcatcagcgcaatcatagtggcgaacgcccttacccatgcaatgagtgcggcaagtctttcagtaggaagagtgccctgtccgaccaccaacggacccataccggagagaagctgtataaatgtaatgagtgcgggaaaagctactatcgcaaatctacattaatcacgcaccagcggacgcacactggcgaaaaaccctaccagtgctccgaatgtggtaaatttttttcaagggtctcctacctgacaatccactatcgttcccaccttgaagagaaaccgtacgaatgtaatgagtgcgggaagaccttcaatctgaactccgcattcatcaggcatcgcaaagtgcacactgaagagaagtctcacgaatgctcagagtgcggtaaattttcacagctttacctaacagatcatcataccgcacacctggaagagaagccttacgaatgcaacgagtgcggtaagacattcctggttaacagcgcttttgacgggcaccagccattgcctaagggagagaagagttacgagtgcaacgtgtgcggaaagctattcaacgagttgagttactacaccgagcactataggtcacactccgaagagaagccgtacggatgtagcgagtgcggcaaaactttcagtcacaactcctctctcttccgccatcagagagtacataccggcgagaagccttacgagtgttatgaatgcgggaaattcttttcccaaaaaagttacctgaccattcaccaccggatccactccggagagaagccttatgaatgtagcaagtgcgggaaagtatttagcagaatgtcgaatctgactgttcattacagatcccatagcggcgaaaagccttatgagtgcaacgagtgcggaaaggtattttctcagaagtcttacctaaccgtccactatcgcacacactcaggagaaaagccctacgaatgtaacgagtgcggcaagaaatttcatcatagatctgcatttaactcacaccagagaatccatagaaggggaaatatgaacgttctcgacgtggagaacctgtag

SEQ ID NO: 24074 - DNA, 2145 bp, Artificial Sequence
  Description of Artificial Sequence: Synthetic coding sequence
atgaacacattgcagggcccagtttcttttaaagacgtggccgtcgatttcactcaggaagaatggcagcagcttgatcccgacgagaaaattacttatagggatgttatgcttgaaaattatagccatctggtttcggtgggctacgatactacaaagcccaacgttatcatcaaactcgagcagggagaagagccatggattatgggcggagagttcccttgccagcatagccccgaggcctggagagtggacgaccttattgaacgaattcaagagaacgaggacaagcattcacggcaggcggcttgcatcaattccaaaacactgactgaagagaaggagaacacgtttagccaaatttatatggaaaccagcctagtgccttcgtctattattgctcacaactgtgtctcatgcggaaagaatctggagtccatctcacagctcatcagcagcgatggaagctatgctcggaccaagcccgacgagtgtaacgaatgtggcaaaacttaccatggagaaaagatgtgcgagttcaatcagaacggagacacctacagccataacgaggaaaatatactccagaagatttcaattctcgaaaaaccttttgagtacaacgaatgcatggaggcgttagacaatgaagcagtctttatcgctcacaagcgtgcgtatatcggagagaagccatatgaatggaacgactctgggcctgacttcattcagatgagcaattttaacgcttaccagcgctcacagatggaaatgaagccgtttgagtgttcagagtgcgggaagagcttctgtaaaaagtccaaatttattattcaccaacgggcacacactggcgaaaagccgtatgagtgcaacgtctgcggtaaatctttcagccagaaagggactctaactgtgcatcgcaggagtcatcttgaggaaaagccttacaaatgcaacgaatgtggaaaaaccttttgtcagaagctgcacctcacccagcacctgcggactcactcaggcgagaaaccttatgagtgctctgagtgtgggaagaccttctgccagaaaacccacctgaccctccatcaacggaaccattctggtgagcgaccttatccatgcaatgagtgcggaaagagcttcagtcgtaagagcgccctcagcgatcaccagaggacccatactggagaaaaactgtacaaatgcaacgagtgtggaaagagctactatcggaagtcaaccttgattacccaccagcggacccacaccggcgagaagccttaccagtgttcagagtgcggcaagtttttcagtagggtctcgtatctcaccatccattacaggtcacacttagaggagaaaccatatgaatgtaatgagtgcggcaaaacctttaatctcaactctgccttcattcgacacaggaaagttcatactgaggaaaagagccacgagtgtagcgaatgtggcaagttctcgcagctttatctcacggatcaccacacagcacacttggaagagaaaccctatgagtgcaatgagtgcggcaagacgtttttggtgaattctgcctttgatgggcaccagcccctgcccaaaggtgaaaagagctatgagtgcaatgtttgcggtaaactcttcaacgaactgtcatattacactgaacactaccgtagtcactctgaggaaaagccttatggctgcagtgagtgcggcaagacattttctcataacagcagtcttttcaggcaccaacgtgtccatacaggcgaaaagccttatgagtgctacgaatgcgggaagttcttttctcagaaatcctaccttaccatccaccacaggatccacagtggtgagaaaccttacgaatgttcaaagtgcggcaaggtctttagtcgcatgtccaatctgactgtgcactatagatcccactctggagaaaaaccttatgagtgcaatgagtgtgggaaggtgttttcgcagaaatcatatctgaccgtccattacaggacccactccggtgaaaagccctacgagtgtaacgaatgcggtaaaaaattccaccatagatctgcgttcaactcccatcagagaattcacaggagagggaatatgaatgttttagacgtcgaaaatctgtag

SEQ ID NO: 24075 - DNA, 732 bp, Artificial Sequence
  Description of Artificial Sequence: Synthetic coding sequence
atgaatacccttcagggcccagtgtctttcaaggatgtggccgtcgactttacacaagaggagtggcagcagctggacccggacgaaaaaattacctatagggacgtaatgctggagaattacagtcatctcgtctctgtggggtatgatacaactaagccgaacgtaattatcaagctcgaacagggggaagaaccgtggattatggggggagaatttccttgccaacattccccagaggcctggcgtgtagatgatctcatagaaaggatccaggaaaatgaggataaacatagcagcaggccagccagaagaccatgcggccctagatgctgttgttgctgttgttgctctaggcccccaaggagtcccccacccaagcccctccccacacggatgctgacacctaggaaggcttttcgcacatgttccaaggagtccggtctggccgagaccgaatcatgcggccagacacacacatggccacgtgccctggctgttctcatgggcctttggtggcccagggaccagaaggcgggagaggaggacctgcggttcagagagaggagaccaggtttacaggcgacggcgaccggaagcggagaacacggagctttcccagtgcacagccagggcgtttgggcgtctacccattggcaggggactgccgtgtgtccacttcagactccaccccctgacgctttcattaggaataacaaggttctgagttag

SEQ ID NO: 24076 - DNA, 342 bp, Artificial Sequence
  Description of Artificial Sequence: Synthetic coding sequence
atgaacacactgcagggtccagtaagcttcaaggatgtggcagtagattttactcaggaggaatggcaacagctggacccagacgagaagatcacctaccgtgacgttatgttagaaaattacagtcatttagtgagtgttggctacgacacaaccaagcccaacgttatcatcaagctggagcaaggcgaggaaccttggattatgggcggtgagttcccttgccagcatagcccagcagccttacccgcaggtcatgtcgccccagcagtggccgctgcagctgccgctccaggaaggcccggtccccaccggcaatcccggtcaccacctggctgctag

SEQ ID NO: 24077 - DNA, 1554 bp, Artificial Sequence
  Description of Artificial Sequence: Synthetic coding sequence
atggacccagctggggctgcagaccctagtgttccccctaatcccttgacacacctaagcctacaggacagaagcgagatgcaactgcagagcgaggcggataggcggtctttgccaggaacttggactcggagctcccccgagcacactaccatattgcgagggggtgttaggcgctgtctccagcagcagtgcgagcaaactgtgcgtatcctacacgccaaggtggctcagaagagctatgggaacgagaagaggttcttctgccctcctccttgtgtctacctgtctgggcctggctggagggtgaagcccggacaggatcaggcacatcaggcaggagaaacaggacctaccgtgtgcggttacatgggactcgattctgcctcaggctccgcaaccgaaacacagaagttgaatttcgaacagcagccagattctagggagtttggatgcgccaagaccctgtacatctcagatgccgacaagcgcaagcacttcagactagttctaagactggtactgcgtggaggaagggagttaggaaccttccatagcagattgataaaggtaatcagcaaaccttcccagaaaaagcagtctcttaaaaacaccgacctgtgcatctcatcaggctcaaaagtgagcttgtttaatagacttagatcccagactgtgtctacgcggtatcttagcgtcgaggacggcgctttcgtggccagcgctcgacagtgggcagcattcacactgcatctcgccgacggacactcagcccagggtgactttccacctagagaggggtacgtaaggtatgggtcattggtgcagttggtgtgtactgtgacaggaattacactgcccccaatgatcatccggaaggtggccaaacagtgcgctctgcttgacgtagatgaaccaataagtcaacttcataaatgtgcctttcagtttcccggtagcccacccggaggcggaggcacatacctctgcttggcaaccgaaaaggtcgtacagttccaggcgtctccttgtccaaaagaagcaaatagagccctactcaacgacagctcttgctggactattataggaacggagagtgtcgagttcagcttctctacctccctggcttgcacactggaacctgtgactccagttcctcttatttccacgttggagctgtctggaggcggagacgtggctactctggaattgcatggcgaaaattttcatgctggccttaaagtgtggttcggcgacgtggaagctgagaccatgtacagatccccaaggagtttggtctgcgttgtccctgatgtggcagctttctgttctgactggcggtggttgcgcgcacccattaccatccctatgtctctggtgagggctgacggcctgttttatccgagtgcattttcctttacctacacccccgagtattccgtcagaccaggccatcctggcgtccccgagccagccacggacgcagacgcactgctggagtctatccatcaagagttcactcggacgaactttcacctgtttatccagacatag

SEQ ID NO: 24078 - DNA, 1416 bp, Artificial Sequence
  Description of Artificial Sequence: Synthetic coding sequence
atggatccagcaggggcagccgatccaagcgtccctcccaatccattgacacacctcagcctgcaggacagatccgaaatgcagttgcagtcagaagccgatcgacgctcactacccggaacctggaccagatccagtccggaacacaccactattcttcggggaggggttcgtcggtgtctgcaacagcagtgcgagcagactgtgaggatcctgcatgctaaggtcgcccaaaaatcgtacggaaacgagaagcggttcttctgcccccctccttgcgtttacctgagcggccctggatggcgagtgaagcccggacaggatcaagcccaccaggccggagagactggccctaccgtctgcggatacatgggccttgacagcgcttctggaagtgcgactgagacgcagaagttgaattttgaacaacaaccagattctagagaatttggatgtgctaaaacgctgtatatctcagacgccgataagcggaagcatttccgattggtgctcagacttgtcctgcgtggtgggagagaacttggcactttccactctaggcttatcaaggtgattagcaaaccaagtcaaaaaaagcagtcattgaagaacacagatctatgtatcagctcagggtcaaaggtgtcattgttcaaccgacttagatcccaaacagtgtctacacgttacctgtccgtcgaggacggcgcttttgtggcatcagcaagacagtgggccgcattcactctacacctcgctgacggacatagcgctcagggagacttccctcctcgtgaggggtatgtccgctatggaagtcttgtgcagctggtttgtacggtgacaggtattacattaccgcctatgataattagaaaggtggccaagcagtgtgccctgcttgatgtcgacgagccaatttcccagttacataagtgcgctttccagtttcctgggtcccctcctggcggtgggggaacatatctctgtcttgctacggaaaaggtggtacagttccaagcctcgccctgcccaaaggaagccaatagagccctgttaaatgacagttcctgctggaccatcatcggcacagagagcgtcgagtttagtttctcgacttccctggcttgtacactggaacctgtgacccccgtcccactaatatccaccctggaactgagcgggggaggcgacgtggccacgttggagcttcacggagaaaacttccacgctgggctgaaggtctggttcggtgacgtggaggccgagacaatgtacaggtatggcgtagagcctgccgttcctggggtcagaggggcaggcagaggaggactgctccaacggttggcactagccgcacgttcccatcataacccacatgaacccggagcccgaaggcgggctctgttgccatag

SEQ ID NO: 24079 - DNA, 1551 bp, Artificial Sequence
  Description of Artificial Sequence: Synthetic coding sequence
atggatccagcgggagccgctgaccccagtgtgcctcccaacccgctgacccacctttcgttacaagaccgatccgaaatgcagctgcaaagtgaagccgacaggaggagtctcccgggaacctggacacggtcttcgcctgagcacacaacaatcctgcggggaggggttaggcggtgtttgcaacagcagtgcgagcagactgtgaggattcttcatgcaaaggttgctcaaaaaagctatgggaatgagaaaaggtttttttgtccgccaccctgtgtgtacctgagtggccctgggtggcgcgtgaaaccgggacaagaccaggcccatcaggctggcgaaactgggcctactgtgtgtggctacatgggcttggatagcgctagtgggtccgccaccgaaactcagaaattaaactttgagcagcagcccgactcacgagagttcggctgcgctaaaactctttacatcagcgatgccgacaaacgcaaacacttcagactggtgcttagactggtcctgcgcggaggccgtgaactgggaacctttcactcaagattgattaaggtcatttctaaaccctcccagaagaaacagtcactgaagaacacagatctctgcatctcctccggatcgaaagtgagtctgttcaacagattgcggtcccaaaccgtgagtactcgctaccttagtgtagaggacggagcctttgtcgcttcagcacgccagtgggcagccttcaccttacacctggccgacggccactctgcgcagggcgactttccccctcgggaaggctatgtacggtacgggtcgcttgtgcagttggtgtgtacggtaacagggatcaccctcccacccatgattatacggaaagttgctaaacaatgcgcattactggatgtggatgaacccatatctcaactgcataagtgcgccttccaattccccggatccccacctgggggaggcggtacttacttgtgcctcgcgaccgagaaagtcgtccagtttcaggcctccccctgccccaaggaggcgaacagggccctgttgaacgattcttcgtgctggaccattattgggacagaatcagtggagttctctttcagtaccagtctcgcctgcaccttggagcctgtgactcccgtaccactcatttccactctggaattgagtggcggaggcgacgtcgccacactcgaactgcacggagaaaactttcatgctggactaaaggtgtggttcggagacgtcgaggccgagacaatgtattctccccgttctctggtgtgtgtggtgcccgatgtcgcggcattttgttccgactggcgatggctgcgggctccaatcacaattcccatgtcccttgtgcgggctgacggcctcttctatccttccgctttctcattcacatataccccagagtactccgtgaggccaggccaccccggagtgccagagccggcaactgacgctgacgccctcctcgagagcatccaccaggagttcacccgcaccaactttcacctattcatccagacgtag

SEQ ID NO: 24080 - DNA, 2124 bp, Artificial Sequence
  Description of Artificial Sequence: Synthetic coding sequence
atgcagacatcagaaactgggtctgacaccggatctaccgtgacccttcaaacctcagtcgctagccaagcggcagttcctactcaagtggttcagcaggtgccagtgcagcaacaggtccagcaggtccagaccgtgcaacaagtgcagcacgtctatcccgctcaagttcaatatgtggagggctccgacacagtgtacaccaacggcgcaatcagaaccacaacatatccctacaccgaaactcagatgtacagccagaacaccgggggtaattatttcgatactcagggatcctctgcccaggtgacaaccgtggtctcatcccatagcatggtgggcacagggggtatccagatgggggttacgggaggacagctaatcagtagtagcggtggcacgtatctcatcggaaattccatggaaaattctggccatagcgtgactcataccacacgcgcttctcccgcaacaattgagatggctattgaaaccctgcagaagtccgacgggttgagcactcaccgcagtagtctcctcaattcccacctacagtggctcctggacaattatgagaccgccgagggagtgagtctcccaagatctacgctctataaccattaccttaggcactgtcaggaacacaaactagaccccgttaatgccgcatcattcggcaagttgatacggagcatctttatgggactgcgcaccaggagactagggactagaggtaattccaagtaccactactatggtatccgcgtgaagccagattcccctctcaatcgtctgcaggaggatatgcagtatatggcgatgcgccaacaacctatgcaacagaaacaacgttacaagccaatgcagaaagtcgatggggtggccgacggattcacgggatccggacaacagaccggcaccagtgtggagcaaacagtcatcgcccagagccagcatcaccagcaattcttggatgcgtcccgggctttgccggagtttggagaagttgagattagctcactgcctgacggaacaacatttgaagatatcaagagcttgcaatcgctgtacagggagcattgtgaggctatcttagacgtggtggtgaatttgcaattctccctcattgaaaagctatggcaaacgttctggaggtacagtcccagtacccctacagatggaaccaccataacagagagcagcaacctgtctgagatcgagagcagactcccgaaagctaagttgataactctgtgtaagcatgaatcaatcctcaaatggatgtgtaactgcgaccatggaatgtaccaggccctcgttgagattctgattccagacgtgctacggcctatcccatccgcacttactcaggcaattagaaactttgccaagtctctggagggttggctgagtaacgccatgaataacatcccacagcgcatgatacagactaaggtcgccgctgtctctgcctttgctcagaccttgcgtaggtacacctcgctcaaccacctggctcaggccgctcgagcggtgctgcaaaatacatcccagattaaccagatgctgtcggaccttaatagagttgatttcgctaacgtgcaggagcaagcctcatgggtgtgtcagtgtgatgacaatatggtgcagcgattggaaactgacttcaaaatgactttacaacagcagagcactctggagcaatgggccgcatggcttgataatgtgatgatgcaggccctgaagccatacgaaggaaggccttcatttccaaaggctgccagacagtttctgcttaagtggtccttctattctagcatggtgatcagggatctgacgctgcggtccgcagcttccttcgggtccttccacttaataagactgctgtacgatgagtacatgttttaccttgtagagcatagggtggcccaggcgaccggcgagacccccatagctgtgatgggggaggtcagagaggctgaacgagcggtgacacattgggtgattaaaaataagcccgagctgcatttctctctcaataccctgctgattaaaaccatggtccccaatcaagtcagcctccgtgcaagacgcgattgtggcgtgatcgcccgtgtgccatag

SEQ ID NO: 24081 - DNA, 2124 bp, Artificial Sequence
  Description of Artificial Sequence: Synthetic coding sequence
atgcagacatcagagaccggctcagatactggctctacagttacgttgcagacctctgtggcgagtcaggccgcagtccctacacaggtggtgcagcaggtgcctgtgcagcagcaggtccagcaagttcagaccgtgcaacaggttcagcacgtgtaccccgctcaagtgcagtatgtggagggatcagatacggtttataccaatggggcaatccgcacaaccacttacccctataccgaaacccagatgtacagccagaacactggagggaactatttcgatacacaaggaagttcagcccaggtgacaaccgtggtgtcgtcccacagtatggtcggcactggtggcattcaaatgggggtaaccggaggccagctgatatccagctcagggggaacatatctcataggtaacagtatggaaaactccggacactctgtgacacataccacgagggccagccccgctaccatagaaatggccattgaaactctgcaaaagagtgatggactgagcacgcataggtcaagcctactcaacagtcaccttcagtggctgttggacaattacgagactgcagagggggtgagcctgccaaggagcactctctataaccattacctcagacactgccaggagcacaagcttgatccagtgaatgcggcatcatttggtaaactgattcgctctatcttcatgggacttaggacccgacggctcggaaccaggggcaattccaaataccactattacgggatacgggtcaaacccgactctcccctcaatcgtcttcaggaggacatgcagtacatggccatgcgtcaacagccaatgcaacagaagcagcggtacaaacccatgcaaaaggtagatggggtggctgatgggtttaccggcagcggccagcagactggcactagcgttgaacagaccgtgattgcccaaagccagcaccaccagcaattcctggatgcctctagagctttgccagaattcggcgaggtcgaaatcagttcgcttcctgacggaacaacttttgaagacattaaaagcctccagtccctgtaccgcgagcactgtgaagctattctggacgtggtggtgaacctacagttttccttaatcgaaaagctctggcagaccttctggcgctattctcccagtactcccactgatggcacgacaattaccgaaagctctaacctgagtgagatcgagtccagactgcccaaggctaagctaatcactttatgtaaacatgagagcatactgaagtggatgtgcaattgcgaccatggcatgtatcaggctttggtggagatcctgattcctgacgttctgagaccaatcccaagtgccctgacccaagcaatcagaaacttcgctaagagcctggagggatggctgtcaaacgcaatgaacaacatcccccaacggatgattcaaacaaaagttgccgcagtgtcagctttcgctcaaactctgcgtcggtatacctctctaaatcatctcgctcaggctgcccgtgctgtgttacagaatacttcccaaatcaatcagatgctctccgatttgaacagagtggacttcgcaaatgtccaagaacaggcttcatgggtgtgtcagtgtgacgacaacatggtccagaggctcgagacagattttaagatgactctccagcagcaatctacactcgaacagtgggctgcctggctggacaatgttatgatgcaggccctgaagccctacgagggccgaccctcatttcccaaggccgctcgccagtttctccttaaatggtctttttattctagtatggtcatacgggatctaactttgagaagtgctgcgagcttcgggtccttccatttaatcaggttgctctatgatgaatacatgttctatctagtggagcaccgagtcgcacaggcaactggggaaactcccatcgccgtgatgggggaggtgcgggaggcggagcgggctgtgacccactgggtcatcaagaataagcccgagctacatttcagcttaaacacactgctgattaagacaatggttccaaaccaggtctccctgcgcgctagacgggactgtggcgtgattgcacgtgttccttag

SEQ ID NO: 24082 - DNA, 258 bp, Artificial Sequence
  Description of Artificial Sequence: Synthetic coding sequence
atgcaaacttcggaaaccgggtccgatactggaagcacagtgacactccaaactagtgtcgcctctcaggctgccgtcccaactcaggttgtgcaacaggtgcctgtgcaacagcaggtgcagcaggtgcagactgtgcagcaggttcagcatgtgtacccggctcaggtacagtacgtggagggcagcgataccgtgtacaccaacggggcaatgtcccgtgctccatggtccatgattttagagtcttccccgtag

SEQ ID NO: 24083 - DNA, 588 bp, Artificial Sequence
  Description of Artificial Sequence: Synthetic coding sequence
atgcagactagcgaaacggggtcagacaccggctccactgtgacgctccagacaagcgtggcctcccaggcggctgtacccacacaagtggtgcagcaggtgcctgtacagcagcaagttcagcaagtgcagaccgttcagcaggtacagcacgtgtaccccgctcaggtgcagtatgtcgagggcagtgataccgtctacactaacggggcaattcggacaactacctacccatatacagagacacaaatgtacagccagaataccggtgggaattattttgatacccaagggtcgtcagcccaagttaccaccgttgtgtccagccacagtatggtcggaacgggcggaatccagatgggcgtgactgggggacagcttattagttcgtctggaggaacctacctgatcggaaacagtatggaaaatagtggacacagcgtaacacatacaacccgcgcatccccagccacagctaactccgttccagaaatgaagctgctaagacagattacgatgaaccgactcttcccaacattgaatcataaactaactgaaggctctggcccacacttccaatcaatttag

SEQ ID NO: 24084 - DNA, 417 bp, Artificial Sequence
  Description of Artificial Sequence: Synthetic coding sequence
atgttatctgacttaaatagagtggactttgccaatgtacaggagcaagccagctgggtatgccaatgtgatgataatatggttcagcgattagagaccgactttaagatgaccctacagcagcagtctactttagagcagtgggccgcttggctggacaacgtcatgatgcaagccctgaaaccctatgagggcagacccagcttccccaaggctgccagacagtttcttctgaaatggtccttttacagtagcatggtgatacgggatttgaccctgcggagtgctgcctcttttggcagctttcatctcatcagactcctgtacgacgagtatatgttctacctggtggagcaccgcgtggctcaggccacaggcgaaacgcccatcgcagtgatgggagaagtgccaatgtag

SEQ ID NO: 24085 - DNA, 651 bp, Artificial Sequence
  Description of Artificial Sequence: Synthetic coding sequence
atgcagacaagcgagacaggcagcgacacaggcagcactgtcaccctccagacctctgtggccagccaagctgccgttcctacgcaggtcgtgcagcaggttcccgtgcaacagcaagtgcagcaagtgcagactgtgcagcaggttcagcacgtctatccagcccaggtgcagtacgtcgaaggatctgataccgtgtatactaacggagcaatacggacgaccacgtacccttacaccgagacacagatgtattcccagaacaccgggggaaattacttcgatacccaagggtcaagcgcgcaggtgaccactgtggtgtccagccatagcatggtgggcactggcggaatccagatgggcgtgaccgggggacagctgatctccagcagtggcggtacctatttgatcggtaactcgatggagaactctggacatagcgtcacccataccacccgtgcttctcccgctaccttacaatggttgttagataactatgaaacagctgagggtgtttctctccctaggtccacactatataatcattatttgaggcattgtcaagagcacaaacttgatcctgtgaatgcggctagctttggcaaattaatcagatccatttttatggggttacggactcggagattgtag

SEQ ID NO: 24086 - DNA, 2250 bp, Artificial Sequence
  Description of Artificial Sequence: Synthetic coding sequence
atgcagaccagtgaaacgggtagcgacacgggatccacagtgacgttgcagacttccgtcgcttctcaagctgccgttcccacgcaggttgttcagcaggttcccgtgcaacaacaagttcagcaggtgcagacagtccaacaggttcaacatgtgtaccctgcccaggtgcaatacgtggagggcagcgatacagtgtacacaaatggggctatccggaccactacctacccatacaccgagacccaaatgtattcccaaaataccggtgggaactattttgatacacaaggctcctctgcacaggtgaccaccgtagtgtctagccattccatggttggaacaggcggtattcagatgggcgtcaccgggggacagcttatcagctccagcggagggacctaccttatcggcaatagcatggaaaatagcggacattctgtgactcacaccaccagagcaagccccgcaaccatcgaaatggctatagagaccctccagaagtctgatggcttgagcactcacagatcttcactgctgaattcccatttgcaatggctgctggataactacgagactgcggagggggtatcgttgcctaggagcacattatataaccattacctcagacactgtcaggagcataaactcgaccccgtgaacgcagcaagcttcggaaaattaatacggagcatattcatggggctgcggactaggcgcttaggcacaagaggcaactctaaataccactactatggtatccgggtcaaaccagattcgccgctgaatcgcctgcaggaagacatgcagtacatggccatgcgtcagcagccaatgcaacaaaagcagcgttataagccaatgcaaaaggttgacggcgttgccgacggcttcactggctccgggcaacaaacagggaccagcgtggaacagacagtgatcgcccagagtcagcaccaccagcaattcttggacgcctctcgcgcactgcctgagttcggcgaggtcgagatcagctcactccctgacggtaccactttcgaggatatcaaatccctccagagcctgtatcgggaacattgcgaagctattttggatgtcgtggtgaacttacagttttccctcattgaaaagctgtggcagacgttctggagatactcccctagcacccccactgatggcacaaccatcacagaatccagtaacctgagcgaaattgaaagtcgtctgcctaaggctaagctgatcacactatgtaaacacgagagtatcctcaagtggatgtgtaactgcgatcatgggatgtaccaggcactggtagaaatactgatcccggatgtgctaaggcccatccctagcgctctaacgcaagcaattcgtaatttcgcaaagagcttggagggatggcttagtaatgcgatgaacaacatcccacagaggatgatccaaaccaaagtggccgcagtgagcgcgtttgcacaaaccctgcgacggtacacgtccctgaaccatttggcccaagctgcaagggcagtgctgcaaaatacctctcagataaatcagatgctttccgatctaaaccgcgttgactttgcgaacgtccaagaacaagctagttgggtgtgtcagtgcgatgataacatggtgcagcgtctggagaccgatttcaagatgaccttacagcagcagagcacgttggaacagtgggcagcttggctggacaatgttatgatgcaggccctaaagccgtacgaagggaggccctccttccctaaggctgcgagacagtttctactgaagtggtcgttttatagcagcatggtgatccgcgatctgacattgcgctcagcggcaagcttcggatcttttcaccttataagactcttgtatgacgaatatatgttttacctcgtcgagcacagggtggcccaagccaccggcgaaacccccatcgccgtgatgggcgaattcggggacctcaacgcggtttccccgggtaacctggataaagacgaggggagcgaagttgagtcagagatggacgaagagcttgacgactcatctgaaccccaggccaaacgcgaaaaaacagagttatcccaggcttttcccgtcggctgcatgcaacccgtactcgagaccggcgtgcaaccttccctcctgaatccaatccactccgaacatatcgtgaccagcactcagactattagacagtgctctgccacagggaacacatatacagcagtatag

SEQ ID NO: 24087 - DNA, 471 bp, Artificial Sequence
  Description of Artificial Sequence: Synthetic coding sequence
gtacagcaggtgcagacggtgcaacaagtgcagcatgtgtaccccgcacaggtacagtatgttgaaggcagcgacacggtatataccaacggagcaataagaactacgacctacccatacaccgagacgcagatgtattcccagaatactggagggaactatttcgacacccagggttcaagtgcacaggtgactaccgtggtgagctctcatagtatggttggaactggcggaattcaaatgggcgttactgggggtcaattaatatcaagttcaggaggcacctatctgatcggcaattccatggagaattctgggcactctgtgacccatactacaagggcctctcctgccactgctaatagcgtaccagaaatgaaactgctgcgccagattactatgaatcggctgttcccgacactgaaccacaaactcacagaggggagcgggccacacttccagtctatctag

SEQ ID NO: 24088 - DNA, 408 bp, Artificial Sequence
  Description of Artificial Sequence: Synthetic coding sequence
gtgcagcaggtgcaaaccgttcagcaagttcagcatgtgtacccagcccaggtccaatacgtggaggggagcgacactgtgtatactaatggggctatcagaacaacgacatacccatacaccgaaactcagatgtactcccagaataccggtggcaattattttgacacccaggggtctagcgcccaggtgaccacagtggtatcttcacacagcatggtgggaacgggagggattcaaatgggcgtgacagggggacagctcatttcttcctccggcggtacctacctgattgggaacagtatggagaactcagggcacagcgtaacacatacgacccgagcctccccagcaacactgtttctcttcagctgtgtccccttttccctgggccagctctccccgtag

SEQ ID NO: 24089 - DNA, 417 bp, Artificial Sequence
  Description of Artificial Sequence: Synthetic coding sequence
atgcagacatctgaaacaggttctgatacaggtagcacagtgacgttgcagacctccgtggcctcccaagcagcagtccctacccaggtggtgcaacaggtgcctgtgcagcagcaagtacagcaggtgcagaccgtgcaacaagtccagcacgtttacccagcccaggtccagtatgtcgagggttcagacacagtatacaccaatggtgccatacggacaaccacatatccatatacagaaacccagatgtattcacaaaatacaggcggtaattactttgacacccaggggtcctcagctcaggtcacgacggtggtatcaagccattctatggtcggcactggtggcatccagatgggagtaacaggtggccagctcatctcctcttctggtggcacgtatctcatcggttag

SEQ ID NO: 24090 - DNA, 375 bp, Artificial Sequence
  Description of Artificial Sequence: Synthetic coding sequence
gagcaggcatcctgggtttgccaatgtgacgacaatatggtacagcggttggagactgattttaaaatgaccctgcaacagcagagtaccctggagcaatgggctgcgtggctggataatgtgatgatgcaggcattgaagccctacgaaggcaggccctccttcccaaaagctgctcggcagttccttcttaagtggagtttttactcctctatggtcattcgtgatctaacactgcgctctgccgcttcattcggaagtttccatctgattaggctgctgtacgatgagtacatgttttatctagtggagcatcgggtcgctcaagccaccggtgagacccccatcgctgtcatgggggaagttcctatgtag

SEQ ID NO: 24091 - DNA, 555 bp, Artificial Sequence
  Description of Artificial Sequence: Synthetic coding sequence
atgcagacgagcgagactgggtctgacacaggatccaccgtgacactccagacatctgtcgcctcccaggctgcggtgcctactcaggtggtgcagcaggtaccagtgcaacagcaggtacagcaggttcagaccgtgcagcaagtgcagcacgtgtaccccgctcaggtgcagtatgtggagggctctgatactgtgtacacgaatggggcaatacgaaccacaacttacccctacactgagacccagatgtactcccaaaatacaggaggcaattatttcgacacacagggctcatccgcacaggtgaccaccgtcgtgtcatcacactctatggtcggcaccgggggaatccagatgggagtcacggggggacaactgatctctagtagtgggggtacgtacttgatcggaaattctatggagaatagcggccacagcgtgacccacaccactagggcttctcctgccactatcgaaatggctatagagacgctgcagaagtccgatggcctgtccacacaccggtcgtccctgcttaactcccacgtctag

SEQ ID NO: 24092 - DNA, 651 bp, Artificial Sequence
  Description of Artificial Sequence: Synthetic coding sequence
atgcagacaagtgagactggtagcgacacaggctctactgttactctgcagacctctgtagcctctcaggccgctgtgcctacacaggttgtgcagcaggtgccagtccagcagcaagtccagcaggtccagacagtgcaacaagtgcagcacgtttatcccgcacaggtccagtacgtggagggaagtgacaccgtgtacacaaacggagccattcgcacaactacctacccttatacagaaacacaaatgtactcgcagaatacaggtggtaactattttgacacccagggctccagcgcacaagtcactaccgtcgtcagcagccatagcatggtcggcactggcggtattcagatgggcgtcacgggcggtcagttaattagtagttcaggcggaacctacctgatcggaaatagtatggagaactctgggcatagcgtgacccacaccacgagggcgagccccgctaccctccaatggcttcttgacaattatgaaacggctgagggggttagcctgccaaggtccacgctctataaccattatctgcggcactgccaggaacataaactcgaccctgtgaacgcggcttctttcggaaagttgatccgttctattttcatgggattgaggacgcgcaggctgtag

SEQ ID NO: 24093 - DNA, 525 bp, Artificial Sequence
  Description of Artificial Sequence: Synthetic coding sequence
atgtgtaattgtgaccatggaatgtaccaagctctcgtcgaaatcctgattcctgacgtattaagacccatcccatccgcccttactcaggccatccggaactttgccaaatctctcgaaggttggctcagtaacgcgatgaataatatccctcagcgaatgattcagactaaagttgccgcagtgtctgccttcgctcaaaccctgagaagatacacctctctaaaccacctggcacaggcggctagggccgtactgcagaatacatctcagataaatcaaatgctgtctgatttaaacagggtggacttcgctaatgtgcaagagcaggccagctgggtgtgccagtgtgacgacaatatggttcagagactggagactgattttaagatgacgctacagcagcaaagcactctggaacagtgggctgcctggctcgacaatgtgatgatgcaggctctcaagccttacgagggacgaccctcgtttccaaaagctgcaaggcagttcctgctcaaatggtag

SEQ ID NO: 24094 - DNA, 330 bp, Artificial Sequence
  Description of Artificial Sequence: Synthetic coding sequence
atggctgtggtgggagtttcgagcgtgagccgtctgttagggaggtcccgccctcagctcggcaggccaatgtcaagcggcgcacatggtgaagaaggctcggccagaatgtggaaaaccctgaccttttttgttgcccttcctggggtggcagtgtctatgctgaatgtttacctgaagagccaccatggcgagcacgaacgccctgagtttattgcatatcctcacttacggatccggaccaaacccttcccctggggcgatggaaatcacaccctattccataacccccatgtgaatccactgccaaccggatacgaagatgagtag

SEQ ID NO: 24095 - DNA, 2235 bp, Artificial Sequence
  Description of Artificial Sequence: Synthetic coding sequence
atgattaaacgtagagcacatccgggtgcagggggtgacaggacccggccacgacgtagacgctccaccgagtcctggatagaacggtgtctgaatgaatccgaaaataagaggtattcaagtcatacgtccttaggcaatgtgagtaatgatgaaaacgaggagaaggaaaataaccgagcctctaaaccacactccactcctgctacactccaatggctggaggagaattacgagatcgccgaaggggtgtgcatcccccgttcagctctctacatgcactatctcgacttttgtgagaagaacgacacccagcccgtgaacgctgcttccttcggaaaaataatccgtcagcagtttccacaactgacaacccgacggctcggcacacgcggtcagtcaaagtatcattactatgggatcgctgtgaaagagtcctctcagtattacgacgtcatgtactcaaaaaagggcgctgcgtgggtgtccgaaaccggcaaaaaggaggtcagtaaacagacggtggcttacagtcctcgcagcaagcttgggacgttgttacccgaattccctaatgtgaaggatctgaatctgccggcatctctaccagaggaaaaggtgtctacctttataatgatgtacaggactcactgccagcgcatcctggacacagttattcgagcaaactttgacgaggtccagtcattcctgctgcacttctggcagggtatgcctccccacatgctgcccgtcttggggagctcgactgtggtcaacattgttggtgtatgcgactccattctttacaaagctataagcggtgtcctgatgcctactgtcttacaagccctgcctgattctctgacacaggttatccgaaagttcgccaagcagctggatgagtggcttaaggtggcgcttcacgacttgccggaaaaccttcgcaatatcaaattcgagctgtccaggcgcttctctcaaatccttcgcaggcaaacttcacttaaccacctctgccaggcttcaagaacagtcatccactccgcagacatcacatttcagatgctagaggattggcgtaacgtcgatctcaacagtattacaaaacagaccttatataccatggaagactctagggacgagcataggaagttgatcacccagctgtatcaggagtttgaccatctgctagaagagcagtctccaattgagagctatatagagtggctggacaccatggtagatcggtgtgtcgtaaaggttgccgcaaagcgacagggttctctcaaaaaagtggcccaacagtttctgcttatgtggagttgcttcgggactagagttatccgtgacatgacattacattcggcacccagttttggttcattccaccttatccatctgatgtttgacgactacgtgctctatctcctcgaatcgctgcactgccaggaacgagcgaacgagctgatgcgcgcaatgaagggcgagggttctacggccgaggtcagagaagagataattctgaccgaggctgccgcacctacacccagcccagtgccctcattcagtccggctaagtcagctaccagtgtggaagttcccccacctagttcccccgtgtccaatcccagtccagagtatactgggctgtccactactggagctatgcaatcttacacctggtccttgacgtacactgtaacaaccgcggctggtagcccagctgaaaactctcaacagttaccttgcatgcggaatacccatgtcccgtcctcaagtgtgacacaccggatccccgtctatccacatcgggaagagcatggctacactgggtcttataactatgggtcttatgggaaccagcaccctcaccccatgcaaagccagtatccagcactgcctcacgacaccgcaatcagtgggccactgcattatgctccttaccataggagtagcgcccagtacccgtttaactcacccacatcccgaatggagccatgtctgatgtcctccactcctagattgcatcccacccccgtcacaccgagatggccggaagtgcctagcgcaaacacttgctatacaagcccttcagtgcacagcgcccgatacgggaactccagcgatatgtacacaccacttaccacgcgaaggaattccgaatatgaacatatgcagcatttcccgggtttcgcttacatcaatggcgaggccagcacaggctgggccaaatag

SEQ ID NO: 24096 - DNA, 2208 bp, Artificial Sequence
  Description of Artificial Sequence: Synthetic coding sequence
atgcattgcggcctgctggaggaaccggacatggattctaccgagtcctggatagagcgttgcctaaacgagagtgaaaataaacgttactcaagtcatacctccctgggaaacgtgagtaatgatgaaaatgaggaaaaggaaaacaaccgcgcaagtaagccgcattcaactccggcaacgcttcagtggctggaagagaactatgagatagccgagggtgtgtgcattcctagaagtgctctatatatgcactatcttgacttttgtgagaagaacgacacccagccggtaaatgctgcaagctttggcaaaatcatccggcagcagttccctcaactaaccactcggaggctgggtacacgtgggcagtctaaatatcattattatggaattgcggtaaaggaatcttcgcagtattacgacgtgatgtactccaagaagggagccgcttgggtttccgaaacgggtaaaaaagaagtttccaaacagactgtggcatactctccaaggtcaaaactcggaactttgttgccagaatttccaaacgtgaaggacctgaatctccctgccagcctgcccgaagagaaggtgtctaccttcatcatgatgtatcgcactcattgtcagcgtatcctggacaccgtgataagggccaactttgacgaagtacagtccttccttctacacttttggcagggtatgcccccacacatgctacccgtgctgggcagctcaacggtggtgaacattgtaggcgtgtgtgactctattctatataaagcgatcagcggggtgcttatgcctactgtactccaggccctgcccgattccctgacgcaggtcatccgcaaatttgctaaacaattggatgagtggcttaaggttgcgctgcacgacctgcctgaaaatctgcgcaatattaagtttgagctttctcgacggttcagccagatccttaggagacagacttcgctcaaccacctgtgtcaggccagtcgtacagtgatccattcagcggatattacttttcaaatgctggaggactggaggaatgtggatcttaattctattacaaaacagacactctacacaatggaggatagtcgggatgagcacaggaaactcattactcagctgtatcaggagttcgaccacttactcgaagagcagagcccaatagaatcatacatagagtggttagacacgatggtagacaggtgtgtggttaaggtggccgctaagagacaaggcagtctgaagaaagttgcacagcagtttctcctgatgtggtcctgctttgggacaagggtaatcagggacatgacactgcatagcgccccatcttttggtagttttcacctgattcacctgatgtttgatgactacgtactctacctactggagtccctgcactgtcaggaaagggcaaacgagcttatgcgcgcaatgaaaggcgaaggaagtacagctgaagtgcgcgaagaaatcattcttaccgaggctgccgctcctaccccgagccctgtgccctccttcagccccgctaagtcagcgaccagcgtcgaggtcccgcctccaagctctcctgtgagcaacccctcaccagagtataccggcctgagtacgaccggtgccatgcaatcatacacatggtctctgacctacacggtcacaacagctgcaggttcacctgccgaaaactctcagcagctgccctgtatgcgaaacactcacgttcccagtagttcagtcacccacagaattcccgtctatccgcacagagaggagcacgggtatacagggtcttataactacggttcttatggaaaccagcatccacatcccatgcagtcccaatatcctgcactcccacatgacacagccattagcggcccattgcattacgcaccgtaccatagatccagcgctcagtatccatttaatagtcccacctcccgcatggagccttgcctcatgagtagtacccccagactgcaccctactcccgtaaccccccgatggccagaggtcccatccgccaatacctgctacacttccccctccgtgcactctgcaaggtacgggaattccagcgacatgtatacccccctcactactaggcggaacagcgagtacgaacatatgcaacactttccgggtttcgcctatatcaatggtgaagcttcaacgggctgggcgaaatag

SEQ ID NO: 24097 - DNA, 1761 bp, Artificial Sequence
  Description of Artificial Sequence: Synthetic coding sequence
atggccgagggggtacccgcttccccatctagtggagagggttctcgcggtccccactctggagtaattcagtggctggtggataacttctgcatatgcgaagagtgttcggtgcctaggtgtctgatgtacgagatatacgttgagacatgcggccagaacaccgagaatcaagtgaacccagccactttcggaaaactggtccggttagtgttccctgaccttggcacgcgaaggttaggtacaaggggtagtgcgagataccactatgacggaatatgtattaagaagtccagttttttctatgcccaatactgttacctaatcggagaaaagcgatatcactcaggcgacgcgatcgccttcgaaaagtccacaaattataattccattattcagcaagaagctacctgtgaagatcacagtcccatgaagacagacccggtgggctcacctttgagcgagttcagacgctgtcctttcttagagcaggagcaagccaaaaagtatagttgcaacatgatggcttttctggcggacgagtactgcaactattgccgcgatatcttacgcaacgttgaggaccttttgacctcattctggaagagtttgcagcaggacacagtgatgctgatgagcctgcccgatgtctgccagctctttaagtgctatgatgtgcagttgtacaaggggattgaagacgtattactgcacgacttcctggaagatgtttccatccagtatctgaagtccgtccagctgttctccaaaaaatttaagctttggctcctgaacgccttggagggggtgcccgcacttcttcagatcagcaagcttaaggaagttactctgtttgtgaagcggctcaggcggaagacttatctgagtaacatggccaagaccatgcgcatggtgctgaaaagtaagagacgggtgtccgtgctcaagagcgacctgcaggcaattatcaaccagggtacccttgctacaagcaagaaggccctggcgagcgacaggagtggcgctgatgagttggagaataatcctgagatgaagtgcctgcgaaacctgatctcactactggggacctccactgatctcagagtgtttctcagctgtctctcatcacacctgcaagcattcgtttttcagacctcgagatctaaggaggagtttaccaaactcgctgcctcttttcaactgaggtggaacctcctgttgactgccgtctctaaggccatgaccctttgtcatagggactccttcggctcctggcacctgtttcatctgctcctgctcgagtacatgattcacattctccagtcttgcctcgaggaggaggaggaggaagaagacatgggcactgttaaggaaatgttgccagacgacccgacacttggtcagcccgaccaggccctgtttcactcccttaactcctccttgtcccaagcctgcgcctcaccctctatggagccgttgggggtcatgcctacgcatatgggacaaggaagatacccagtaggtgtatcaaacatggtgctgagaattctgggctttcttgttgacacagccatgggtaacaaattgatacaggttctgttagaagatgagacaactgagtcagcggttaaactgtccctgcctatgggccaggaggccctcattacattaaaggatggccaacaattcgtgatacaaatcagcgacgtgccgcagtcgtccgaagacatctactttagagagaataatgcgaacgtgtag

SEQ ID NO: 24098 - DNA, 1422 bp, Artificial Sequence
  Description of Artificial Sequence: Synthetic coding sequence
atgtatgagatctacgtggaaacgtgtggccaaaacactgagaaccaggtgaaccctgcaacttttggcaaatgcgaagaccattcccctatgaagaccgaccctgtgggctccccgctctctgaattcagaagatgtccatttcttgagcaggaacaggccaaaaagtattcctgtaacatgatggccttcctcgcagacgaatactgtaattattgtagggacattctgaggaacgtcgaagacctactgacgtctttctggaagtccttgcagcaggatacagtgatgctaatgagcttaccagacgtctgccagctctttaagtgttacgacgtgcagctttacaagggtattgaagacgtgttactgcacgattttcttgaagacgtatctatccagtacctcaagtcagtccagttgtttagcaagaaattcaagctctggctgctgaatgccctcgaaggtgttccagctctacttcagatatctaaactcaaagaggtcacactgtttgtcaagcggttgcgccgaaaaacatacttgagtaacatggcaaagaccatgcgcatggtgttaaagagcaagagacgcgtgagcgttctgaaatcggatttgcaggcaatcataaaccaaggcactctggccacatcgaaaaaagctttggccagtgaccgcagcggagcggatgagctcgagaacaaccctgagatgaagtgcctgagaaatctgatctcgttactgggcactagcacagatcttcgggtcttcctgagctgtttgagctcacacctgcaagccttcgttttccaaacttctcggtctaaggaagagttcacaaagctggctgcctccttccagctccggtggaacctattactcaccgccgtcagcaaggcaatgacgttgtgtcatagagacagttttgggagctggcatctttttcatttgttactgctggaatacatgattcatattttgcagtcctgcttggaggaggaggaggaagaggaggatatggggactgtaaaggaaatgcttccagacgacccaaccctgggacagcccgaccaagctctcttccactctttgaatagttctctgtctcaagcatgcgcatcccctagtatggagcctctcggcgtcatgcctacgcatatggggcagggtcgctatcccgtgggtgtcagcaacatggtgctacgcatcctgggctttctcgtcgacactgccatgggtaacaaactgatccaggtcctcctggaagatgagaccaccgagagtgccgtcaagctttctctcccgatgggccaggaagccctgattacactcaaggacggccaacaattcgtcatacagatctccgatgttccacagtccagtgaggatatctacttcagagagaacaatgcgaacgtgtag

SEQ ID NO: 24099 - DNA, 138 bp, Artificial Sequence
  Description of Artificial Sequence: Synthetic coding sequence
atgtacgagatttatgtagagacttgcggccagaatacggaaaatcaggtgaaccccgcaacctttggcaaaatggccttcctggccgacgagtattgtaattattgtagggatatactccggaatgttaggaactag

SEQ ID NO: 24100 - DNA, 1704 bp, Artificial Sequence
  Description of Artificial Sequence: Synthetic coding sequence
atgctggaaagacggtgccgcggtcccctggccatggggctggcacagccgagacttttgagcggcccatcccaggagtcgccacagactctgggcaaagagtccaggggattgagacagcagggcacatccgtggctcaaagtggggcacaggctccgggaagggcgcaccgctgtgcccattgccgcagacattttcccggatgggttgccctgtggctacacacccgaaggtgtcaggctcgcctgccactgccgtgccctgagtgtgggagacgattccggcatgcccctttccttgcgctgcatagacaagtccacgcagcggcaacacccgacttgggttttgcttgccatctttgtggacagagcttcagggggtgggtggccttggtgctacacctgcgtgctcactccgctgctaagcgcccaatcgcctgccccaagtgcgaaaggcggttttggcgaaggaagcaattaagagcccatcttaggcggtgtcacccacctgctccagaggctcgcccatttatatgtggcaactgcgggagaagctttgcccagtgggatcagttggtggcccacaagagagtacatgtggctgaggctctggaagaggcagcggctaaagccctcggcccacggccacgcggacggcctgccgtgaccgcaccacgcccagggggagatgcagtggaccggccatttcaatgcgcttgctgcggcaagaggttccggcataaacctaatttgattgcccaccgaagggtgcacacaggggaaaggcctcaccagtgcccagaatgtggtaagcggtttaccaataagccatatctgacttcacacagacggatccacactggggaaaaaccgtacccctgcaaagaatgtggtcggcgattccgccataaacctaatctcctttctcacagcaaaatccacaagcgatccgaggggagcgcccaagcagctcccggtccagggtctccacagctgccagcaggaccacaagaatccgccgctgagcccaccccagccgtgccactaaaacctgcacaggaacctcctcctggcgctccacccgagcaccctcaggaccctatcgaggctcctccttctttgtattcatgcgacgattgtgggaggtcgttcagactggagaggtttctgagagcacatcagcggcagcacacgggggaacgacctttcacttgtgccgagtgtggtaaaaactttggcaagaaaacgcatctagtggctcactctcgggtgcactccggtgaacgacccttcgcttgcgaggagtgcggaagacgcttttcacaaggctcacacttggccgctcaccgccgagaccacgcacctgacaggccttttgtctgtcctgactgtggcaaagccttcaggcataaaccatacctcgcagcacatcgacggattcacactggcgagaaaccctatgtctgcccggactgtggaaaagccttctcccagaaatctaatttagtgtcccatcggcgtatccatacgggtgaacggccatatgcctgccccgactgtgataggagcttcagccaaaaatctaatttaatcacccaccggaaaagccacatcagggacggggctttctgctgcgctatatgcggtcaaacttttgatgatgaggagcgtcttctggctcaccaaaaaaagcacgacgtgtag

SEQ ID NO: 24101 - DNA, 1704 bp, Artificial Sequence
  Description of Artificial Sequence: Synthetic coding sequence
atgttagagcgacgttgtaggggcccactggcaatgggactggcccagcccagactgctatcagggccaagccaggagtctccccagaccctgggtaaggagtcccggggactgcgccaacagggcactagcgttgcccagagcggggcacaagcaccaggacgggctcaccgttgcgcgcactgccggagacacttccctggatgggtggcactctggctccatacgcgaagatgccaagcgcgactgcctctcccctgcccagaatgtggcaggaggttccggcacgcgccttttctggcgttgcaccgccaagttcacgctgctgccaccccagatctgggttttgcctgtcatctatgtggccagtcctttaggggttgggtggctctggtgctgcacctccgggctcactccgctgcaaaaaggcctattgcttgcccaaagtgcgaacgtagattttggagaaggaagcagttgagggctcatctcagacgatgtcatccccctgccccagaagccaggccctttatctgcggaaactgcggccgttcttttgctcagtgggatcaactcgttgcccacaagcgggtgcacgtcgcagaggcacttgaagaggctgcagctaaggcgctcgggcctcgtccccgtgggaggcctgccgtcacagcaccacggccaggtggagatgctgttgacagaccattccagtgcgcctgctgtgggaagcggttcaggcataagcctaatctgattgcccacaggcgcgtgcataccggtgaacggccacaccagtgtcccgagtgcgggaagaggtttacgaataaaccttatcttacttcacaccgacggatccacaccggagaaaagccttacccttgtaaagagtgtggacgtcgttttagacataaacccaatctcctcagtcattccaaaatccataaacgcagcgaaggcagcgctcaggcggcaccgggacctggttctccccagctccccgctgggccacaggagagcgcagctgaacctactccggcagtgcctttgaagcccgctcaggaaccccctccaggggctcccccagaacatcctcaggatccaattgaggctcccccttccctgtactcctgtgacgattgtggtagatcatttcgtctggagagatttctcagggctcaccagcggcaacacacaggggaacgtccatttacatgtgccgagtgcggaaaaaatttcggaaagaaaacccacctggtggctcacagcagggtccactctggcgagcgtccttttgcctgcgaagaatgtggtcgcaggttctctcaggggagccacctcgctgcccataggagagatcacgcccctgacagacccttcgtatgcccggattgtggcaaagcattccgtcacaaaccttacctagccgcacaccgccgaatccacactggggaaaaaccctacgtctgtccagattgtgggaaggccttttctcagaaatccaacctggtctcccatcgacggattcatactggagaacgcccatatgcatgtccggattgcgatcgctccttttcccaaaagagtaacctgatcacccatcggaagagccacattagggatggggcattttgttgtgccatttgtggccagaccttcgacgacgaggagaggttgctggcccaccaaaagaagcacgacgtgtag

SEQ ID NO: 24102 - DNA, 1704 bp, Artificial Sequence
  Description of Artificial Sequence: Synthetic coding sequence
atgctcgaaagacgttgtcggggaccactggccatgggactggctcaacccaggctcttgagtggcccaagtcaagaaagccctcagactctggggaaggaatcacgtgggctgaggcagcaagggacttcggtggcccagagcggcgctcaggcccctggtcgagcccacaggtgcgctcattgccgtagacattttccaggttgggtggccctctggctgcatactcgaaggtgccaggctcggctcccactgccctgtccagagtgtggtcggagatttagacacgcaccgttccttgcactacacaggcaggtccacgctgccgctacccccgacctggggttcgcctgtcatttatgcggccagtcttttcgcggttgggtcgcgctggtgcttcacctgagagcacattctgccgctaaacggccaatcgcgtgccctaagtgcgagcgaaggttttggcggcgtaagcagctgagagcccacttacggcgatgccatcctcccgctcccgaagccaggccattcatctgcggaaactgcggtcgctctttcgcccagtgggaccagctggtggcccataagagagtacatgtggcggaggctctggaagaggccgctgcaaaggcccttgggcctaggcctagagggaggcctgccgtgactgccccacggccaggaggagacgctgtagataggccatttcaatgcgcctgctgcgggaagcggttcagacacaagcccaatcttattgcacatcgcagagtccacaccggtgaacggccacaccagtgtccagagtgtggtaaaagattcactaataagccctatctgacctctcacagacgtatacacaccggggagaagccctatccatgtaaagagtgtggcaggcggttcagacacaaacccaatctgctgagccactcaaaaattcacaagcggtctgagggcagtgctcaggctgctcctggcccaggttcaccccagctcccagctgggccacaggaaagtgccgcagagcctacccccgctgttcctctaaagcccgcacaggagccccctcctggtgctcctcctgagcacccccaggacccaatcgaggctcccccatcactgtactcatgcgatgattgtggaaggtccttccgcttagagcgcttcctgcgcgcacaccaaaggcagcacactggcgaacggcctttcacttgcgccgagtgcgggaaaaactttggaaaaaaaactcacctcgttgcccattctcgggtccactcaggtgagaggccatttgcttgtgaagagtgtggcaggagatttagccagggctctcaccttgcagcgcatcgcagagatcacgcacccgaccgcccttttgtctgccctgattgcgggaaagccttccgccataagccgtacctggcggcacatcgccgtatccacactggcgaaaaaccctatgtgtgtcccgactgtggcaaggcctttagccaaaaaagtaatttggtgagtcaccggagaattcacaccggagaaaggccatatgcttgcccagactgcgataggagtttctctcaaaaaagtaacctcataacccaccgcaagagccacattagagatggtgcattttgttgtgctatttgtgggcagacttttgatgacgaagaacgtcttctggcacaccagaaaaagcacgacgtttag

SEQ ID NO: 24103 - DNA, 615 bp, Artificial Sequence
  Description of Artificial Sequence: Synthetic coding sequence
atgggtataggcgtctcactgctcctgcaattcagtctgactcctggcggttacagatccgtggggcgatctcggaggtgtagccggggaagtatccctcggaacattccaaagaggagttggaaaaaacctcatccacagctctgttcgctgcaggcggaagaggaacccatgctcgaacgtcgatgcaggggccctttagctatgggtctcgctcagccccgactgctctctggaccgtctcaggaaagtccgcagacgcttggcaaagaatctagaggcctgcgacagcagggcacctctgttgcccagtctggcgcacaagcccctggcagagcacatagatgcgctcactgccgcaggcacttcccaggttgggtcgctctatggctgcacaccaggagatgccaggctagactcccactcccctgtcctgagtgcggcagaagattccgtcacgcacccttcctagccttgcatcggcaggttcacgcagccgctacacccgatctggggttcgcctgccacctctgtggccaaagctttcggggttgggtggcactggtgctgcatctacgcgctcacagcgcggctaaaagacccattgcgtgctag

SEQ ID NO: 24104 - DNA, 1875 bp, Artificial Sequence
  Description of Artificial Sequence: Synthetic coding sequence
atgggcatcggggtgtcacttttgctccagtttagcctgacaccaggaggttaccgatcagtgggtcgatctaggcgttgcagtcgcggatctattccccgtaatattcccaagaggagctggaagaagccgcaccctcagctgtgttccctgcaggcagaagaggagccaatgctggagcgacggtgcagaggaccattggccatgggcctcgcccaaccaaggctcctctccggaccatctcaagaaagccctcaaactctcggaaaggaatctcgtgggctgaggcagcaagggacatccgtcgcgcagtccggtgcgcaggctcccggaagggcacacaggtgtgcccactgtcgaagacactttcctggatgggtcgcactgtggctgcacactcgtcgctgtcaggcacgtcttcccctgccctgtccagagtgtggccgtcggtttcgccacgccccattcttggctcttcataggcaggtccacgccgctgctacacccgatttaggcttcgcctgccatctgtgcgggcaatcatttagagggtgggtggccctggtgttgcatctccgggcacactccgccgcaaaaaggcccattgcatgtcctaagtgtgagaggcggttctggcgcagaaaacagctccgcgcacatcttcgcagatgtcacccgccagcgccagaagctcgaccttttatttgcggcaactgcggaaggtccttcgcccagtgggatcaactggtggcacataagagggttcatgtagccgaagccctggaggaagccgctgcgaaagctctgggaccacgaccacgcggtcggcctgcagttacagcacctagacccggaggcgacgccgttgatcgaccatttcaatgtgcatgttgtggaaagagatttcggcacaaacccaatctgatcgcgcatcgtcgggtgcacactggtgaaagacctcaccaatgcccggagtgcggcaaacggttcaccaacaagccttacctaacctcacatagacggatccacacaggcgagaaaccctacccttgcaaagagtgtgggagacgctttcgacacaaacccaacttgctcagccattccaagattcacaaacgctcagaaggctccgcacaggcagcccctggacctgggagtccacagctcccggcaggtcctcaggaaagcgccgctgaacctactccagcagtgcctctaaagcctgctcaggagccaccacctggcgcaccccctgagcacccacaggatcccatcgaggctcccccttcgctgtacagctgtgatgattgcggcaggagctttagactcgagcgattcttgcgagctcaccagcggcagcatactggggagagaccatttacatgcgctgagtgcgggaagaacttcggcaaaaaaacgcacctggttgcccacagccgggttcactctggagaacgacccttcgcttgcgaggagtgcggtcggaggttcagccagggtagtcatctcgccgcacaccgccgagatcatgcacctgaccgcccttttgtttgtcctgattgcggcaaagcgttccgacataaaccatatttggccgcacaccgcagaatccacacaggcgagaagccctatgtctgccccgattgcgggaaggcgttttcacagaagtccaacttggtgagccacagaaggattcacaccggcgaaaggccctatgcctgtcctgactgcgataggtcatttagccagaagtccaacctgattacacaccgcaaatcccacattagagacggcgctttttgctgtgccatttgtggtcaaacattcgacgacgaagaaaggctcctggctcaccaaaaaaaacacgacgtctag

SEQ ID NO: 24105 - DNA, 441 bp, Artificial Sequence
  Description of Artificial Sequence: Synthetic coding sequence
atgcttgaaaggagatgccggggtcctcttgccatgggtctggcccagcctaggctgctgagcggtcctagccaggaatcccctcagacactgggaaaggagtccagaggcctgaggcagcagggcaccagcgttgcacaaagtggagcccaagctcctggtcgcgctcaccgatgcgctcactgtagaagacactttccgggttgggtggcactttggctccacactaggcgctgtcaggccagactacccttgccttgcccagaatgtggacgccgatttaggcatgccccattcctggctctccaccgacaggtccacgcagccgcaacacctgatttaggttttgcctgccacctgtgtggacaatcttttagagggtgggtcgctctcgtcctgcacctgagagcacactctgcagcaaaaaggcccattgcctag

SEQ ID NO: 24106 - DNA, 1704 bp, Artificial Sequence
  Description of Artificial Sequence: Synthetic coding sequence
atgttggaacgcagatgtcggggtcccctggcaatgggcctcgctcaacccagattgctgtccggaccgtcccaggagtctcctcagactctcggtaaagaatcgagagggctccgccagcaggggacctccgtggctcagtctggcgctcaggcccctgggagggcccatcggtgtgctcattgcagaaggcactttcccggatgggtagccctgtggctccacacaagaaggtgccaggctcgtcttcctctaccttgcccggagtgcggcagacggtttcggcacgcgccattcctggcattacatcgccaggtacacgcagcagctacccccgatttagggtttgcctgccacttatgtggccaaagctttagagggtgggtggccctggttctgcatctgcgggcacactccgctgcaaaaagacctattgcttgccccaaatgtgagagacgtttctggcgcaggaaacagcttagggctcatctcagaagatgtcaccctcctgccccagaggcccgacctttcatttgtgggaactgcggacggtcattcgctcagtgggaccagctggtggcccataagcgagtccacgtggccgaagcccttgaggaagcggctgccaaggctctggggcctaggcctagaggccgaccagctgtgaccgctccacgccctggtggcgacgctgttgataggccttttcagtgtgcttgctgcggcaaacgctttcgccacaagcccaacctgattgcccaccggcgagttcacacaggcgaacgtccgcaccagtgtcctgaatgtggtaagagattcacaaataagccttacttgacttcacatcggaggattcatacaggagagaagccgtatccatgcaaggagtgcgggaggcggttcaggcataagcccaatctgttgagccatagtaagatccataagcgcagcgagggaagcgcccaagctgccccaggtccgggatctcctcagttgcccgctggtccacaggaatctgccgctgagcctacaccagccgtgcctttgaagccagcccaagaacctccaccaggggctcccccagagcacccccaagatcctattgaggcacccccatccttatactcatgtgacgattgcggccgatcctttcgcctcgagcgcttcctgcgtgcacaccagcggcagcatactggagaacgaccttttacatgcgccgagtgcggtaaaaacttcgggaaaaaaacacacctggtggcacactctagagtgcacagtggagagcgaccatttgcatgtgaggaatgcggcagacgcttcagccagggatctcacctggcagctcaccggagggaccatgcccctgataggccattcgtgtgtcctgattgtggcaaagccttcagacacaagccttacttagccgctcacagacggatccatactggagagaagccctatgtttgtcccgattgcgggaaggccttctctcagaagtcaaacctggtgagccacaggcgaattcataccggcgagcgcccatatgcatgcccggattgcgatcggtctttctcacagaaatcaaatttaatcacacatcggaagtcccatatcagagacggtgctttttgctgcgccatctgtggacaaacattcgatgacgaagaacgcctgctggcacaccagaagaaacatgatgtgtag

SEQ ID NO: 24107 - DNA, 1449 bp, Artificial Sequence
  Description of Artificial Sequence: Synthetic coding sequence
atggtggagaagggacccgaggtgagcggcaaacgtcggggacggaacaatgctgccgctagtgcctctgccgcagccgctagtgctgcagcgtccgccgcttgtgcgagtccagccgcaacagcggcaagtggtgccgctgcctcaagcgcctctgctgcagctgcaagcgcagccgcagcaccgaacaatggtcagaacaagagcctagcagctgccgcaccaaacggcaactccagttctaacagctgggaggagggatcatccggaagctcgagcgatgaagagcacggcggaggcggtatgcgcgtcgggcctcaataccaggccgtcgttcctgattttgaccctgccaagctcgccaggaggtcacaagaaagggacaacctgggcatgctggtgtggagcccaaatcagaatttgagcgaagctaagttggacgagtacattgctattgccaaggaaaagcacggctacaacatggagcaggcgttgggaatgctgttctggcacaaacacaatattgagaagagcctggccgatctgccaaattttactccctttcctgatgaatggacggttgaggacaaagtgttatttgaacaagctttctcctttcacggcaagacatttcaccgtattcagcaaatgctgccagacaaatccattgcctccctcgttaagttttattactcatggaagaagactcggaccaaaactagtgtcatggacagacatgcacgaaagcaaaagcgtgagagagaagaaagcgaggatgagctggaggaagctaatgggaataatccaattgacatcgaagttgaccagaacaaggaatctaagaaggaggtaccccctacggagacggtgcctcaggtcaagaaggagaagcatagcactcaggcgaagaatagggcgaaacgaaagccgcctaaaggcatgtttctgtcacaggaggacgtagaggccgtgagcgcgaatgcgaccgcggctacaactgtcctgagacaacttgatatggagttggtatccgtgaagcggcagatccagaatattaagcagaccaattccgcactcaaagagaagctggacgggggaattgagccctatagactgcccgaggtgatccagaaatgcaacgctagatggaccactgaagagcaactcttggctgtgcaagccatccggaaatatgggcgagactttcaggccatctccgacgttatagggaataaatccgttgtgcaggtaaagaatttttttgtgaattacaggaggcggtttaacatcgatgaggtgctgcaggaatgggaggccgaacatggcaaagaggaaaccaatggcccaagtaatcagaagcctgtgaagagtcccgataattctattaagatgcctgaggaggaagatgaggccccagtgctggatgttcgatatgcaagtgcctcctag

SEQ ID NO: 24108 - DNA, 1449 bp, Artificial Sequence
  Description of Artificial Sequence: Synthetic coding sequence
atggtggaaaaaggtccagaggtttctggcaagcggagaggtcgcaataatgctgccgcttccgcgtctgctgccgctgcgtccgcggcagcctcagcagcctgcgccagtcccgcagccaccgctgcctccggagccgcagcctcttctgcatccgccgcagccgcatctgcagcggctgcaccaaacaacggacaaaataagtctttagctgccgcagcgccaaacggaaacagcagctcaaactcgtgggaggaaggcagtagtggcagttcgtcagacgaggagcatggtggaggtggaatgcgagtgggcccacagtaccaggctgtggtgccagatttcgacccggctaaactggctaggcgaagccaagagagggataacctaggcatgctggtgtggagccccaaccaaaatctgagcgaggcgaagttggatgaatacatagcaattgcaaaggagaagcatggttacaacatggagcaggcgctcgggatgctgttctggcacaagcacaatattgagaagagtctggctgacttgcctaatttcacaccattccccgatgaatggaccgtagaggacaaggttctgtttgagcaggcgttctctttccacggcaaaacatttcacagaattcaacagatgctccccgataaaagcattgcgagtctggtcaagttctactactcttggaagaagaccaggacaaagaccagtgtgatggatagacatgcccgtaaacagaaaagagagcgcgaagagagcgaagacgagctggaggaggcaaatggcaacaaccctattgatatcgaggtggaccaaaataaagagtccaagaaagaagtgccacctacggagacagttccccaagtgaaaaaagaaaaacactctacccaagcaaaaaacagggctaaacgaaagcccccaaaggggatgttcttgtctcaggaagacgtggaagcagtgtcagcaaacgctaccgctgccaccaccgtgctgcgacaacttgacatggaactggttagtgtgaagcggcagatacagaacattaagcagactaattccgccctgaaagagaagctcgatgggggtattgaaccttacagactgcctgaggtgatccagaaatgtaacgcgagatggaccacagaagagcaattgctcgcggtgcaggctatcagaaaatacggcagagactttcaggcaatcagcgacgtaatcggaaataaaagcgtggtacaggtcaagaatttcttcgtaaattacaggagaagattcaacatcgatgaagtgcttcaggaatgggaggccgagcacgggaaggaggaaaccaacgggccttctaatcagaagccggtcaaatctccagacaacagcattaaaatgcccgaagaggaggacgaggccccagtgctggacgtgaggtatgctagtgcttcttag

SEQ ID NO: 24109 - DNA, 1572 bp, Artificial Sequence
  Description of Artificial Sequence: Synthetic coding sequence
atgccttctgtcatggagaaaccttctgccggatccggtatcctgtctcggtctcgcgctaagactgtaccgaacggtggccaacctcattctgaggacgatagttcagaggaggaacacagccacgactctatgattagggtcggtacaaattaccaggcggtcataccggaatgcaagccagaatctcctgcaaggtactccaataaagagttgaagggaatgctcgtctggtcgcctaaccactgcgtgtctgacgccaaactggataaatacatcgccatggccaaagagaaacacgggtacaacattgaacaagccctggggatgctactgtggcacaagcatgacgtggagaaatccctggccgacctggccaacttcacccctttccccgacgaatggaccgtggaggacaaagttctgttcgaacaggcatttggtttccatggcaagtgtttccaacggatacaacagatgctcccagacaaactgatcccctcacttgtcaaatattattatagttggaaaaaaacccgttcgcgcacatcagtcatggaccggcaggcccgtcgcctgggaggtcgcaaagacaaggaggactcggatgagctcgaggaggggagaggaggcgtgtcagaaggtgaacccgatccggctgacccaaagcgagaaccattgccaagccgacctcttaacgccagacccggacctggcaaaaaagaggtgcaagtctctcagtaccgtcaccatcctctcagaacacggcgacggcctccgaagggaatgtacctctcgccggagggactcactgcagtgtcgggatccccagatctcgccaatctgacccttagaggtctcgattcacagctcatttccctgaagcgccaggtgcaaagtatgaaacaaacaaacagcagcttaagacaggcattagaaggaggtatagatcccctgagaccgccagaggctaacactaagtttaattcccgctggactacagatgagcagctgctggctgtccaggccattcggcgttacgggaaggactttggcgcaatcgcagaagtcataggtaataagaccctgacacaggtgaaaaccttctttgtcagctaccgtcggagattcaacctggaggaggtgctccaggaatgggaggcagaacaggatggggctcccggtgcccctgttccaatggaggaggctcgtcggggagcgccactgcccgctcctgccctggaggaggacgatgaagtccagatcacttcggtgtctacgtccgtaccgagaagcgtgccacccgctcctccacccccaccacccccaacgtccctgtctcaacctcccccattactgagacccccactgccaacggctcctacactcctgcggcagccccctccgctacaacaggggagattcctgcaacctcgactggctcccaatcagcctcctccgcctctgatccggcctgcacttgctgcccctagacattccgctcgccctggtccacagccaccacccactctgatcggtacccccctagagccacctgctcctagtctgtag

SEQ ID NO: 24110 - DNA, 1488 bp, Artificial Sequence
  Description of Artificial Sequence: Synthetic coding sequence
atgagagtaggagccgaatatcaagccaggattcccgagtttgatcccggtgcaactaagtataccgataaagacaacggagggatgctcgtttggtcaccatatcactcgatccctgatgctaagcttgatgagtacattgctattgctaaggagaagcacggctataatgtggagcaagcccttggaatgttgttctggcataaacacaatatcgagaaatccctggctgacttgcccaacttcaccccctttcctgacgaatggacggtggaagacaaagtgctgttcgaacaggctttctccttccacgggaagtcctttcatcggatccagcagatgctaccagataaaacaatcgcctcactggtgaaatactactattcgtggaaaaaaactaggagccgaacatccttgatggaccggcaggctcggaaacttgcaaatcgacacaatcagggcgattccgatgatgatgttgaggagactcatcccatggatggaaatgacagcgactatgatccaaaaaaagaagctaagaaagaaggaaacaccgaacaaccagtacagacatccaaaatagggctgggccgacgggaatatcagtccctgcagcataggcaccattcacagagaagcaagtgccgaccaccaaaaggtatgtacctcactcaagaagacgtcgtagctgtttcgtgtagtcctaatgccgcaaacactatcctgcgccagctggatatggaactcatttccctaaagcggcaggtgcagaatgcaaagcaggtgaacagcgcactcaagcagaagatggagggcggaattgaggagttcaagcccccagaaagcaaccagaagatcaatgccagatggaccactgaggaacagctgttggccgtgcaaggcgtgcgcaagtacgggaaagactttcaggcaatcgccgacgtgattgggaacaaaactgtgggacaggtgaaaaatttcttcgtgaattatcgtcggcgtttcaaccttgaagaggtcctgcaggagtgggaagcagaacaagggacccaagcatccaacggggacgcctctacactgggcgaggaaactaagtccgcctcaaatgttccgagtggaaagtcaacagacgaagaagaagaagcacagaccccccaggcacccaggactctgggccctagtcctccggctccctcttcaacgcccacacctaccgcccctatcgccactttgaatcagcctccaccactgctcagacccacgcttcccgctgcacctgcactccatagacagcccccaccactacagcaacaagcaaggtttattcaacccaggccaaccctgaatcagccccctccccctttgattaggccagcaaactctatgccacccaggctgaaccccagaccggtgctgagtacagtaggcggtcagcagccaccttcattaattggcatacagacagattctcagagctcacttcattag

SEQ ID NO: 24111 - DNA, 1311 bp, Artificial Sequence
  Description of Artificial Sequence: Synthetic coding sequence
atgccgggaatgatggaaaagggccctgagctgctgggcaagaatcgctccgccaacggttctgcaaaaagcccggctggaggcggaggatctggggcttctagtaccaatggaggactgcactactctgagccagaatccggatgttcctctgacgatgagcacgacgtcggcatgcgggtgggcgctgaataccaggccaggattcctgagttcgatcccggagctacaaagtatactgacaaagacaatggtggtatgctggtttggagcccttaccactcaataccggacgctaagctggatgaatacattgccatcgctaaagaaaaacacggatataacgtggagcaggctttggggatgctattctggcacaaacacaatattgaaaaatctttagcagacctgcctaacttcacaccattcccagacgaatggacagtggaggataaggtcctattcgagcaggctttttcctttcacggcaaatcattccaccggatccagcagatgctcccagataaaaccatcgcttcactggtaaagtactattactcatggaagaaaacacgctcccggacatcactgatggaccggcaggcccgaaaactggcaaatagacacaaccaaggcgattccgacgacgatgtcgaagagacccacccaatggatggaaatgatagcgattatgatcctaaaaaggaagcaaaaaaggaggggaataccgaacagcccgtacagacctccaaaatcggactcgggaggagagagtatcagtctctccagcaccgccaccatagtcagcgctcaaagtgcagacctcccaagggcatgtacttgacacaggaagatgtggtggccgtgtcttgttctccaaacgccgctaatacaattctccgccagcttgacatggagctgatcagcctgaaaaggcaggttcagaatgcgaagcaggtaaattcagctctgaaacagaagatggaaggaggcatcgaggagttcaaaccccctgagtccaatcagaagatcaacgcacgctggaccactgaagagcagttgcttgccgtgcaaggtaccgatcctaccggctctagtgacaccggtagtattaccagctgtcctatcattcactctaacacaaacagcccctattgccactcggagcccgcttctaccacatcttcatctaacacagcctgctgccccggatccagccctgccgcttctagcactccggcagcaggcagcgtgcatcccgcacctgccaattttaaatcagcatctaccacttcatacagtccatgttag

SEQ ID NO: 24112 - DNA, 1662 bp, Artificial Sequence
  Description of Artificial Sequence: Synthetic coding sequence
atgcctggcatgatggaaaaagggccagaactgctcggcaaaaataggtctgcaaatgggagcgccaaatctcccgctggaggaggtgggtccggcgctagctccacaaacggtgggctgcattattcggaaccagagtcaggctgtagctcggacgatgagcacgacgtcgggatgcgtgtgggcgcagaatatcaggccagaatccccgagttcgacccaggagccacaaagtacactgataaggataatggaggcatgcttgtgtggtcgccctaccactcaatccctgatgcaaaactcgatgaatatattgctattgccaaggaaaagcatggttacaatgtcgaacaagccttgggaatgctgttctggcacaagcataacatcgaaaaatccctggctgacctgccaaattttacaccatttcccgacgaatggaccgtggaagacaaggtcctcttcgaacaagcattttctttccacggcaaaagtttccaccgcatccaacaaatgctcccagataaaacgatcgcttctctggtaaagtactattactcttggaagaaaactcggagtcgcaccagcctaatggataggcaggccagaaagctagccaataggcataaccagggcgattcagacgacgatgtggaagagactcatccgatggatggcaacgactccgactacgacccaaagaaggaagctaaaaaggaaggcaatacagagcaacccgttcagacctcaaaaatcggccttggcaggcgggaatatcaaagcttgcagcaccggcatcactcccaacgatccaaatgcagaccccctaaagggatgtatcttacccaagaggacgtggtggccgtgtcctgctcacctaatgcggctaacaccattctgcgccagctcgatatggagctgatcagcctgaagaggcaggttcagaatgcaaagcaggtgaattcggcgctgaaacagaagatggagggaggaatcgaggagttcaagccaccagagagcaatcaaaagattaatgccaggtggactaccgaggagcagcttctggcggtgcagggcgtgaggaaatacggcaaggattttcaggcaatcgccgacgttatcgggaataagaccgtgggacaggtcaagaatttttttgtcaattacaggcggagattcaatcttgaggaagtcctgcaggagtgggaagcagaacagggtacccaggcttctaacggagatgctagcaccctgggtgaggaaacaaagagtgctagtaacgtcccgagtggtaaatccaccgatgaagaggaagaggctcagactccacaggcccctcgtacccttggaccctcaccacctgccccaagctccactcccaccccaacggcaccaatcgctacattgaaccagccacccccactgctgcgccctacactcccagctgcccctgctctccacagacaacctccacctctgcagcagcaagccaggtttattcagccacgtccaacactgaaccagccgccaccgccactgattcgccctgctaactccatgccacccagactcaatccaagaccagtgctgtccaccgtgggaggtcagcagcctccaagcttgatcgggatccagacagactcccaaagctcgcttcactag

SEQ ID NO: 24113 - DNA, 1350 bp, Artificial Sequence
  Description of Artificial Sequence: Synthetic coding sequence
atgcctggtatgatggagaagggacccgaactcttggggaagaatcggagcgcaaacggttcagctaaaagcccagctggcggtggtggctcaggtgcaagttcgacaaacggtggcctgcattactctgagccagagtccggatgctctagcgacgacgaacacgatgttggcatgagagtcggcgcagaataccaggctcgaattccagaattcgatcccggtgcaactaagtacaccgacaaggacaacggagggatgctcgtttggtccccctaccactctattccagacgctaaactggacgaatatattgcgatcgccaaagagaaacacgggtacaatgtcgagcaggcgttaggcatgctgttctggcataagcacaacattgagaagtccctcgctgatcttccgaactttactccctttcccgacgagtggaccgtggaggacaaggtcctatttgaacaggccttcagctttcatggaaaatctttccatcggatacagcagatgttgccagacaaaacgattgcgagcttagtgaagtactattattcttggaagaaaactcgctctaggacaagcctgatggatcgccaggctcgcaaactggcaaaccgccataatcagggcgattctgatgacgatgtggaagaaactcaccccatggatggaaacgattccgattatgatccaaagaaggaggctaaaaaggaaggtaacacagagcagccagttcaaacctcaaagatcggcctcggccgacgggagtatcagtcactgcagcacaggcaccacagtcagcgttccaaatgccggcctcctaaggggatgtacctgacccaggaagacgtcgtggccgtgtcttgctcccctaacgccgcaaacacaatccttagacaactggacatggagttaatcagcttgaagcggcaggtgcaaaacgccaaacaggtcaactctgccctcaaacagaaaatggagggcggtatagaagaatttaaacctcccgagagtaatcagaagataaatgcacgctggacaacagaagagcagctgctcgctgttcaaggcgtgaggaaatacggcaaggactttcaggcgattgctgatgtcattgggaataagaccgtgggacaagtgaagaactttttcgtgaactatcgaaggagatttaatctcgaggaagtcctgcaggagtgggaggcagaacagggcactcaggcgtcaaacggagacgctagtaccctgggagaggaaacgaaaagtgcctccaacgtcccctccggcaagtcaaccgacgaggaagaagaggtgtgtttgtgtatggaattcgagctgatttag

SEQ ID NO: 24114 - DNA, 450 bp, Artificial Sequence
  Description of Artificial Sequence: Synthetic coding sequence
atgcgggtgggagcagagtaccaggctagaatccctgaatttgatcccggagcgacaaaatacactgacaaggacaatggagggatgctcgtctggtctccctaccactcaattcccgatgccaaattggacgaatacatcgcaatcgccaaagaaaaacacggttataatgtcgagcaggccctgggtatgctgttctggcataaacataatatcgaaaagtcgttggcagaccttccgaattttacgccctttcccgacgagtggacggtggaggacaaggttctgttcgagcaagccttttcctttcatggcaaatcatttcaccggattcaacaaatgttaccggacaaaacgatcgcgtctctggtcaagtactactactcctggaagaaaacccggagcaggaccagcctgatggataggcaggccaggaaactggcgaattag

SEQ ID NO: 24115 - DNA, 261 bp, Artificial Sequence
  Description of Artificial Sequence: Synthetic coding sequence
atgcgagttggtgcagaataccaggcacgaataccagagttcgatcctggcgctacaaagtatacggataaagacaacggcggtatgctggtgtggtccccatatcattcaattcccgacgccaaactggacgagtacatcgctattgccaaggaaaagcacggctacaatgtggaacaggccctggggatgctgttttggcataaacacaatatcgagaagtccctggcagatctgccgaactttacgcccttcccatag

SEQ ID NO: 24116 - DNA, 555 bp, Artificial Sequence
  Description of Artificial Sequence: Synthetic coding sequence
atgttcctgtccccaggggaggggcctgctacggaggggggaggactcgggccaggggaggaagcaccaaaaaaaaagcaccggagaaatcggactacctttactacgtaccagctgcaccagttggaacgcgctttcgaggcaagccattatcccgatgtgtacagccgggaggagttggcagctaaggtgcaccttccagaggtgagagtacaggtttggtttcagaaccggagggcaaaatggcgtcgccaggaacgcctggagagcgggtcgggcgcagtcgctgcccctagacttcctgaggcacccgctctgccatttgcaagaccaccagctatgtccttgccattagagccatggctaggtcctggccctcccgcagtgccaggccttccgcgactcctgggccctggaccaggtttacaagcttctttcggaccccatgccttcgctcccactttcgctgatggcttcgctcttgaagaagcctccctgaggctcttggccaaggaacatgcacaggcccttgaccgagcgtggccgcctgcttag

SEQ ID NO: 24117 - DNA, 693 bp, Artificial Sequence
  Description of Artificial Sequence: Synthetic coding sequence
atgccagcaccagtggaaggcaccgactttcccggagccggaagacaagcctggggttctcctgcactcagcctccctgtcgcccctccagccgtgtcaccgcctagtgtcccactgccgtctcatcaggtcggcgctatgtttttgagtcctggagaaggtcccgcaacagagggcggaggactgggacctggcgaagaggcacccaaaaaaaaacataggagaaaccgtacaactttcacgacttatcaattgcaccaattggaaagagcgttcgaagcctcacattacccagacgtctactccagggaagagttggccgctaaggtacaccttccagaagtccgtgtgcaggtgtggttccagaatcggagagcaaagtggaggagacaagaacgattagagtctggctcaggggcagttgctgctccccgtctgcctgaggctcccgcactgccattcgccagaccccctgccatgagtctcccccttgaaccttggctgggcccaggaccgccagctgtcccagggctgccaagactgttggggccaggcccaggcctgcaggcttcttttgggcctcatgcctttgcccctaccttcgcggatggcttcgcactagaggaggcctcccttaggctcctggctaaggagcacgcccaggcactggacagggcatggccaccagcctag

SEQ ID NO: 24118 - DNA, 615 bp, Artificial Sequence
  Description of Artificial Sequence: Synthetic coding sequence
taggctggagccggtgttccgtggaaatcaaccgagggcctcccttgggccgtgggagccatgttcttgtcgcctggggaaggccctgcaaccgaggggggagggttgggccctggagaggaagcccctaaaaaaaaacatagacggaatagaaccaccttcacaacataccagctgcatcagctcgagagggcattcgaggcttcgcactaccctgacgtttattcgcgggaggagttggcagctaaagtccacctccccgaagtgcgggtgcaggtctggttccagaataggcgggctaagtggaggcgccaagaaagactggaaagtgggagtggtgctgttgccgctccccgtctgcctgaggcacctgccctaccatttgcacggccacctgcgatgtctcttcctcttgagccctggctgggccctgggccaccagccgtgccgggtctgccaagactgctgggtccaggaccgggacttcaagcatcattcggcccacatgccttcgccccaacgttcgccgacgggtttgccctcgaggaggcgtccttacgcttgctggctaaagagcatgctcaggcactggacagagcatggcctcccgcttag

SEQ ID NO: 24119 - DNA, 1278 bp, Artificial Sequence
  Description of Artificial Sequence: Synthetic coding sequence
atggcggacaaggaagccgctttcgatgatgcagtggaagagcgcgttattaacgaagaatacaagatatggaaaaaaaatacgccattcttatatgacctggttatgacccacgctctggagtggcccagcctcaccgctcagtggttgcccgatgtgacacgccctgaggggaaagattttagcatacaccggctggtgttgggcactcacacatccgatgagcagaaccacctcgtcattgcctccgtgcagttacctaacgacgatgctcagtttgatgcgtcacattacgattccgaaaaaggcgagttcgggggattcggttcagtatccgggaagatagagatcgagattaagatcaatcacgaaggggaggtaaatagggccaggtacatgccccagaatccgtgtataatcgctactaaaacaccatcttccgacgtgctagtgttcgattatacaaagcaccccagcaagcccgatcctagcggtgagtgtaatcccgacctccgactgagggggcatcagaaggaagggtacgggctctcttggaatcctaacttgtctgggcaccttctgtcagcaagcgatgatcatacaatctgcctctgggacatctcagccgtcccgaaagaggggaaggtcgtggatgccaagacaatttttacggggcataccgccgtggtcgaagatgtctcatggcaccttttgcacgagtctctctttgggtccgtggccgacgatcaaaaacttatgatttgggacacacgctccaataatacgtctaagccctctcattccgtggacgcgcacacagcagaagtaaattgcctgagttttaacccgtacagcgagttcatcctggcaactggatctgctgacaagaccgtggcactctgggacctccgaaatcttaagctgaaactgcattcttttgaatcccacaaggatgaaatctttcaggtccagtggtccccacacaatgaaacaatcctggcctcatctggcacagaccgacggttgaatgtctgggacctgtcaaagattggggaagaacagtccccggaagatgccgaggacgggccaccggaacttctctttattcatggcggacacactgccaaaatttctgattttagctggaacccgaacgaaccatgggtcatttgtagtgtgtccgaggacaacatcatgcaagtgtggcaaatggctgagaacatctacaatgacgaggatccggaaggctctgtcgaccccgaggggcagggttcttag

SEQ ID NO: 24120 - DNA, 1275 bp, Artificial Sequence
  Description of Artificial Sequence: Synthetic coding sequence
atggccgacaaggaggcgttcgacgacgccgtggaggaacgtgtcattaatgaggagtacaagatctggaaaaaaaacactccgtttttgtatgatctggtgatgactcacgcactcgaatggccgtcactaaccgcccagtggttgccagacgtgacccgcccagaaggaaaagatttttctatacacaggctggtcctgggcacccacactagcgatgagcagaaccatttagtcatcgcatccgtacaactccctaatgatgacgctcagttcgatgctagccactacgattccgaaaaaggagagttcggcggattcggaagcgtgtcaggaaagatcgagattgaaatcaagattaaccatgaaggagaggtgaacagggctcgctatatgccccaaaatccatgtatcatagcaacaaagactccatcgtcagatgttctggtatttgattatacgaaacatccttcgaaacctgatccgtcgggggagtgcaacccagacctgcggctcagagggcaccagaaagagggatacgggcttagctggaaccctaacttgagcggccacctgctgagcgccagcgatgatcataccatatgcctgtgggacatttctgccgttccgaaggagggcaaagttgtggacgcaaaaaccatattcaccggacacaccgccgttgtggaggatgtgtcctggcaccttcttcacgaatctctcttcggcagcgtcgcggatgaccagaagcttatgatctgggacacaaggagcaacaatacctctaagccaagtcattccgtcgacgcacatacggccgaggtcaattgcctgtcctttaatccatactcagaatttatccttgcaaccggctctgccgataaaaccgtcgccctgtgggatcttcgaaacttgaagctgaaattacacagttttgagagccataaagacgagatctttcaggtgcaatggtccccccacaatgaaacaatcctggctagcagcggcactgaccggcgactgaacgtttgggacctgtctaagatcggagaagagcagagccccgaggatgccgaggatgggccacccgagctgctcttcattcatggcggacacacagccaagatatctgactttagttggaaccctaatgaaccctgggtgatctgtagcgtgagcgaagacaatatcatgcaggtttggcaaatggccgaaaacatatataatgatgaggacccagagggcagtgtggaccctgaaggccagggaagttag

SEQ ID NO: 24121 - DNA, 264 bp, Artificial Sequence
  Description of Artificial Sequence: Synthetic coding sequence
atgactcacgccctggagtggcccagcttgacggctcagtggctgccagatgtaacccggccagaaggcaaagatttctctattcatcgtctcgtccttggaactcacacaagcgatgagcaaaatcaccttgtgatcgcctcagtgcagctccccaacgacgacgcacaatttgacgcatctcactacgattcggaaaaaggtgagtttgggggtttcggctctgtcagcggtaagattgagattgaaataaagataaattag

SEQ ID NO: 24122 - DNA, 1173 bp, Artificial Sequence
  Description of Artificial Sequence: Synthetic coding sequence
atgactcatgctcttgaatggccgtcactgacagctcagtggctcccagacgtaacccggcctgaaggcaaggatttcagtatacacagacttgttctcgggacacacacatcggatgagcaaaaccatctggtaatcgccagtgtccaattgcccaatgatgatgcacagttcgacgcatcccattacgattctgagaagggggaattcgggggtttcggaagtgtcagcggcaagattgagattgagatcaaaattaaccatgaaggagaggttaaccgcgcacgctacatgccgcagaacccttgcattattgctactaagacaccttcatctgatgttctggtcttcgactatacaaagcatccttccaagcccgatccaagtggcgagtgtaatcccgatcttcggctacggggtcaccagaaggaagggtatggactctcttggaatcctaatttaagcgggcacctcctgagcgcctcagatgaccacaccatctgcctgtgggatatctctgctgtgccaaaagaggggaaggtggttgatgcaaaaaccatttttactggacacaccgctgtagtggaagacgtgtcttggcatctgctacacgagagcctttttggcagcgtcgccgatgaccagaagctcatgatctgggacacacgtagtaataacacatcaaagccatcccattctgttgacgcccatacagcagaagtaaactgtctctcctttaacccgtactccgagttcatcctcgccaccggatctgctgataaaactgtggccctgtgggacttgaggaacctgaaattgaagctgcactcttttgaatcccataaagacgaaatattccaggttcagtggtctcctcacaacgaaaccatcttggccagctccgggactgataggcgcctcaacgtttgggatctctccaagattggcgaggagcagtctcctgaggacgccgaggacggacctcccgagttgctgttcatccacggagggcataccgccaaaatcagtgatttttcttggaacccgaatgaaccctgggtcatctgctcagtcagcgaggataacatcatgcaggtttggcagatggctgagaacatctataatgacgaagacccagaagggtccgtggatcccgaagggcaggggtcctag

SEQ ID NO: 24123 - DNA, 543 bp, Artificial Sequence
  Description of Artificial Sequence: Synthetic coding sequence
gtggctgacgaccagaagctcatgatctgggatacaagatcaaacaacacctccaaaccctcccattccgtagacgctcatactgccgaggtgaattgtctaagtttcaacccctactctgagtttattctggcgacggggtctgcagacaagaccgtggcactgtgggacctgcgaaatctcaaactgaagctccattcattcgagtcacacaaggacgaaatttttcaggtccagtggagtccccataacgaaaccatcctcgccagtagcggaacagacagacgccttaacgtctgggacctgtcgaaaatcggcgaggaacagtcccccgaggatgccgaggatggcccacccgaacttcttttcattcatggcggtcatactgccaaaatctctgatttctcgtggaatccaaatgaaccttgggtgatttgttcagtgagtgaggacaatatcatgcaagtgtggcagatggccgagaatatctacaacgatgaggatcccgaaggaagtgttgaccctgagggccagggtagttag

SEQ ID NO: 24124 - DNA, 207 bp, Artificial Sequence
  Description of Artificial Sequence: Synthetic coding sequence
atgactcacgccctagagtggccatcattgaccgcgcagtggctcccagacgttacccggcctgaaggtaaagactttagtatccatcgactggtcctgggaactcacacctccgatgagcagaaccatctagttattgcctcagtgcagctacctaacgatgacgcacagttcgacgcaagccactacgattctgaaaaaggctag

SEQ ID NO: 24125 - DNA, 522 bp, Artificial Sequence
  Description of Artificial Sequence: Synthetic coding sequence
atgatatgggacacgcggtccaacaacacaagcaagccctctcattcagtggacgcacacacagctgaagtgaattgtctgagctttaatccatacagcgagtttatcctggccacgggatcagccgataaaactgttgccctttgggacctaagaaacttgaaacttaaactgcattcttttgagagtcataaggacgagatcttccaggttcagtggtccccccacaacgagaccatacttgctagttctgggactgacaggagattgaatgtttgggatctgagcaaaattggggaagagcagtcacctgaagacgcagaggacgggcctcctgaactgctatttatccacggcggtcacacagccaaaattagtgatttctcatggaatcctaacgagccctgggtcatctgtagcgtgagtgaggacaacatcatgcaggtgtggcagatggcagagaacatctacaatgacgaggaccctgaagggagcgttgatccggagggacagggaagctag

SEQ ID NO: 24126 - DNA, 588 bp, Artificial Sequence
  Description of Artificial Sequence: Synthetic coding sequence
atggccgctgaggatgtggtcgcaaccggagctgatccaagcgatcttgagtcagggggacttctgcacgaaattttcacatcccctctaaaccttctgctgctgggtttgtgcattttcctgctgtacaagattgtgcgcggagaccagccggcagcctcaggagattccgatgatgatgaaccgcctcccttacctcgattaaagcggcgagattttacgccagccgaactcagacgatttgacggcgtacaggacccccgaatattgatggctataaacggcaaagtttttgacgttacaaaaggacgcaaattctacggcccagaaggcccatatggcgtgttcgctggaagggacgcttcccgaggcctcgccacattctgtctggacaaggaagctctgaaagatgaatacgatgacctttccgacctcaccgctgcacagcaggagaccctctcagactgggagtcccagttcacattcaagtaccaccacgtaggaaaattacttaaggaaggggaggagccaacagtatactcagacgaggaggagccaaaagatgagtctgccagaaagaacgactag

SEQ ID NO: 24127 - DNA, 867 bp, Artificial Sequence
  Description of Artificial Sequence: Synthetic coding sequence
atggagccccctgaccagtgttctcagtatatgactagtctgctgtcccccgctgtggatgatgaaaaagaattgcaggatatgaatgccatggtcctgagcctcaccgaggaagtgaaggaagaagaggaagacgcccagccagaaccagagcagggtacggcggctggtgagaaactcaaatcggccggagctcaggggggtgaggaaaaggacggaggcggagaagaaaaggatggcggaggcgcaggggtgcccggacacctctgggagggggacctggaaggcacctctgggagtgatgggaacgtcgaagattccgatcaatccgagaaagagcccggtcagcagtactcgcgaccgcagggcgctgtgggagggctcgaacccggaaacgctcagcaaccaaacgttcacgcctttacacctctccagctgcaggagttagaacgaatctttcagagagaacagttccctagcgaatttctgagacgaaggttggcccgtagcatgaatgtaaccgagctggccgttcagatttggtttgagaaccgtagggctaagtggcgtaggcatcaaagagccctgatggcccgtaacatgctaccctttatggccgtcggccagcctgttatggtcacagcagctgaggctattacggctcccctgtttataagcggcatgcgggacgactacttttgggatcactcacactcttcgtctttgtgcttcccaatgcccccatttcctcctcctagcctgccactgccgctcatgttgctgccccctatgccgccagccggacaggcagagtttggtccctttcccttcgtgattgttccatctttcacgtttcctaacgtctag

SEQ ID NO: 24128 - DNA, 867 bp, Artificial Sequence
  Description of Artificial Sequence: Synthetic coding sequence
atggaaccaccagaccaatgctcacagtatatgaccagtctgcttagtcccgcagtggacgacgagaaggaactgcaagacatgaacgctatggtgctgtcattgacagaggaagtaaaggaggaagaggaagacgctcagccagaaccagaacagggcaccgccgcaggcgagaaactgaagtcagccggagcgcagggaggagaggagaaggatggcggaggagaggaaaaggacggcggtggggctggcgttcctggtcacttgtgggaggggaatcttgaaggcacttccggatctgatgggaatgtcgaggacagtgatcagtccgaaaaggagccaggccaacagtactcaagaccccaaggcgctgtgggtggccttgaacctgggaacgcacagcagcccaatgtgcatgccttcacgccgctgcagctccaggaacttgagtgtatcttccagagagagcagtttccctccgagttccttcgcaggcgacttgctcggtctatgaatgtcacagaactagctgtccaaatttggtttgagaacaggcgcgcaaagtggcggcgtcatcaaagagctctcatggcacggaatatgcttccctttatggcggtcgggcagcccgtgatggtgaccgcagccgaagccattaccgctccgctatttatctctggtatgcgcgatgattacttttgggatcactcacattcctcttctctttgcttccccatgcccccattccccccaccatcattacctctgccattgatgttgctgcctcccatgcccccagccggtcaagcggaattcggaccctttccattcgttatagtaccttcctttaccttccctaacgtttag

SEQ ID NO: 24129 - DNA, 375 bp, Artificial Sequence
  Description of Artificial Sequence: Synthetic coding sequence
atgcccgctcccgctgcaacttacgaacgtgtagtgtacaagaacccttcagaataccattatatgaaagtctgcctagaatttcaggattgcggtgtcggcctcaatgccgcacagtttaagcagttgctgatatccgcggttaaggatctgttcggggaagtcgacgccgctttgccacttgacatactcacatacgaggagaaaacactatcagctatcctccgaatttgctccagtggcctagtgaaactgtggtccagtcttacgctgcttggaagctataaagggaagaaatgtgcgttccgcgttatccaagtcagcccattcttattggctctgtcaggaaattctagggagctggtgctagactag

SEQ ID NO: 24130 - DNA, 375 bp, Artificial Sequence
  Description of Artificial Sequence: Synthetic coding sequence
atgcctgctcccgcagccacttacgagagggtggtgtacaagaacccttcggaataccactatatgaaagtatgtctggagtttcaggactgcggggtcggcctcaatgccgcacagttcaagcagcttctaatatcggcagtcaaagatttattcggggaggtggatgctgcactgcctctggatatcctgacatatgaagaaaagaccttgagtgcgattttgaggatctgtagctcaggcctagttaagctgtggtccagtctgaccctgctcggaagctacaagggcaagaagtgtgccttcagagtcattcaagtctccccattcctgttggccctgagcggcaactcacgggagctggtgctggattag

SEQ ID NO: 24131 - DNA, 375 bp, Artificial Sequence
  Description of Artificial Sequence: Synthetic coding sequence
atgcctgcccctgccgcaacgtacgaaagggtggtgtataagaacccaagtgaatatcactacatgaaggtctgcctggaattccaggattgtggagtcggcctgaacgccgcacagttcaaacagctcctcatcagtgcagtgaaagacttgttcggcgaggtggacgccgctttacctcttgacattctgacctacgaggaaaagactctttcggcaatcttgcgaatttgctctagcggactggtaaagctgtggtcgtctctgaccctgctagggtcctacaaggggaagaaatgcgccttccgggtaatccaagtcagcccatttttgctagcccttagcgggaatagccgcgaacttgtcctcgattag

SEQ ID NO: 24132 - DNA, 600 bp, Artificial Sequence
  Description of Artificial Sequence: Synthetic coding sequence
atggagaacttccggaaagtgaggtccgaggaagccccagctggatgtggcgctgaaggcggtggaccaggttctggcccatttgccgatttggctcccggagcagtacatatgagagttaaagagggtagcaagatccgtaacctcatggccttcgcgaccgcttcaatggctcagccggcaacacgggcaattgttttttctgggtgtgggagggcaaccacaaaaaccgtaacgtgtgcggaaattctgaagcgcaggctggctgggctccaccaggtgacacgtctaagatataggtctgtaagagaagtgtggcagagcttgcccccaggtccgacccaaggacagacacccggtgaacccgctgctagtttgtcagtgctaaaaaacgttcctggcctcgcaatcttgctgagcaaagacgccttggatccacgtcagccaggctatcagccacctaatcctcatcctggcccatcaagtccgcctgccgcaccagcttcaaagagatcgctcggcgaacctgccgcaggtgagggatccgcgaaaaggagccaacctgaaccgggagtggcagatgaggaccaaactgcctag

SEQ ID NO: 24133 - DNA, 600 bp, Artificial Sequence
  Description of Artificial Sequence: Synthetic coding sequence
atggagaatttcaggaaagtccgctccgaggaagccccagcaggttgtggtgccgaaggcggaggtcccggtagcggcccttttgcggatttggcacccggagctgtgcatatgagggtaaaagaggggagtaaaatccggaatttaatggcctttgccaccgcaagcatggcccagccagccacacgggctatcgtgttcagcggctgtggtcgcgctactactaagactgttacgtgtgctgaaatcctaaagagaagactggctggtctgcatcaggttacccgactcagataccgctccgtgcgggaggtatggcagagcctgccgcctgggcctacccaaggacagacacccggtgaaccagcggcttccctgtctgtgctgaagaatgtccctggactcgctatcctgctaagcaaggatgccttggacccgcgacagccaggataccaacctcccaatcctcaccctggtccaagcagtcccccagctgccccagcgagcaaaaggagcctgggggaacccgcagctggcgaaggtagcgctaaacgctcccagccagaacccggagtggccgacgaggatcaaacggcttag

SEQ ID NO: 24134 - DNA, 1386 bp, Artificial Sequence
  Description of Artificial Sequence: Synthetic coding sequence
atggtatctcgggtccagcttccaccagagattcagctagcacagcgtctggctgggaacgaacaggtgacacgcgacagagccgtgcgaaagttgcgaaagtatatcgtcgccaggactcagcgggctgccggaggattcacccacgatgagttattgaaagtgtggaaggggttgttttactgtatgtggatgcaggacaagcctctcctgcaggaagagctgggcagaactatcagtcagctggtgcacgcatttcaaaccacggaagcccagcacctgttcctacaggcattttggcagacgatgaatagagagtggacagggatcgatcgacttcggctcgacaaattctatatgctgatgcggatggtgctgaacgaaagtctcaaagtgctgaaaatgcaggggtgggaggaacggcagattgaggaacttcttgaactgctgatgactgagatactacatcccagctcgcaggctccgaacggggttaagagccactttattgagatatttcttgaagagctcaccaaagtcggcgctgaagaactgacggctgatcagaatctaaagtttatcgacccattttgccgcatcgccgctagaaccaaggactctcttgttctcaataatatcaccagggggatcttcgagactattgtcgaacaggccccattggctatagaagatctacttaatgagttagacacgcaggatgaggaagtcgcttcagactcagatgagagtagtgagggaggcgagcggggtgacgcactgtctcaaaaacgcagcgaaaagccaccagcaggatctatttgccgcgcagagcctgaagccggagaggaacaggctggggatgatcgcgattccggaggccctgtcctgcagttcgactacgaggctgtggcaaaccgccttttcgaaatggcctctaggcagtccactccttcgcagaataggaagcgactgtataaggtaatccgaaagctgctgccctggttctcgggcattttccctgaggacgagataccagaaaaggcctgccgcagactgctggagggcagacgacaaaaaaaaaccaagaagcagaaacggttgttgaggctccagcaagaacgcggaaagggcgaaaaggagccaccctcacccggtatggaaagaaagcgcagccggagaagaggtgttggggctgatcccgaagctagggccgaagcgggagagcagccaggcacagcagaacgagccctgctcagagaccagccccgtggcagaggccaaaggggcgctcggcaaaggcgcagaacacccaggccactgacaagcgccagagcgaaagccgctaatgtacaagaacctgagaagaagaaaaagagacgggagtag

SEQ ID NO: 24135 - DNA, 1386 bp, Artificial Sequence
  Description of Artificial Sequence: Synthetic coding sequence
atggtgtcccgcgtgcaactgccaccagagatccaactagcccagaggctggccggaaacgagcaggtgactcgcgatcgggctgttcgaaagctccggaaatacatagtagctagaacccagagggccgctgggggatttactcacgacgaactgctaaaagtgtggaagggccttttttactgcatgtggatgcaggacaagcccctactacaggaggagctgggacgcaccatcagtcagcttgtccacgcctttcagacaactgaggcgcagcatctgttcctccaagctttttggcaaactatgaatcgtgagtggacaggcatagataggctccgtctggataagttctacatgctaatgagaatggtgctcaatgaatcgctgaaggtcctcaagatgcagggctgggaggagcgacagattgaggagctgctagagctgcttatgactgaaatcttacacccctcctcgcaggcccctaatggtgtgaaatctcatttcatcgaaatctttcttgaggagctgacaaaggtcggggctgaggaactcaccgctgaccagaaccttaaatttattgatcccttctgccgcatagcagcacgaaccaaagactccttggtgctgaacaatattacacgaggtatattcgaaaccatcgtcgaacaggcacccctcgcgatcgaggatctgttgaacgaactggacacacaggacgaagaggtcgccagcgactccgacgagtctagcgaaggaggagagagaggcgacgcgttgtctcagaagaggtctgaaaagccacccgctggctctatctgtagggcagaacccgaggctggggaggaacaggccggagacgacagagatagcgggggaccagtactgcagttcgattacgaagccgtggccaaccgtctcttcgagatggcctctcgccagagcaccccttcacagaaccgcaagaggttgtataaggtgattcgcaaactacaggacctagccggaggcatatttcctgaagacgaaatcccggagaaggcttgccgtcggctccttgagggcagaaggcaaaagaaaactaagaagcaaaagagactcttgaggttgcagcaggagaggggaaaaggggaaaaggagccacctagccctggtatggagcgtaagcggagccgtcggaggggcgtaggggcagatccagaagcccgtgccgaggctggcgaacaacccggaactgcagagagagccctgttgcgcgaccaacccaggggtcgcggacagcgaggagccagacagcgaagacggacccccagaccactgacatctgcccgagccaaggccgctaacgttcaagagccagaaaagaaaaagaagaggcgcgagtag

SEQ ID NO: 24136 - DNA, 1371 bp, Artificial Sequence
  Description of Artificial Sequence: Synthetic coding sequence
atgtttgaagagcccgagtgggccgaagccgctcctgtcgcagctgggctcggtcctgtaatctccaggcctccgccagccgcttcttcacagaataaaggctcaaagcggcgacagctcctggcgaccttgcgcgcattggaggctgcgagcctgagccagcacccacctagtctgtgcatttcagattctgaggaagaggaggaagaacggaaaaaaaaatgtcctaaaaaggccagtttcgcctctgcttccgccgaagtgggcaagaaaggcaaaaagaagtgtcaaaaacaagggcctccttgttcagattccgaagaagaggttgaacggaagaaaaagtgccacaagcaggctctggtaggctcagactcagctgaggatgaaaagcgaaaaagaaaatgccaaaaacatgccccaattaatagtgcccaacatttggacaatgtcgaccagacaggtcccaaagcttggaaaggctcgacgacaaatgaccctcccaagcagtcccccggttccacatccccaaaaccccctcacaccctttctcgcaaacaatggcgtaaccgtcagaagaacaagcgcagatgcaagaataaatttcagcctccccaggtgcccgaccaggcacctgctgaagccccaaccgaaaaaacggaggtgtcccctgtacccagaaccgatagccatgaggctagagcgggagcactcagggctaggatggcacagcggctggacggagctagattccgttatctgaacgaacagctttactccgggccatcatccgccgctcagagactgttccaagaggaccccgaagcgtttctgctctatcacaggggtttccagtctcaggtgaagaagtggccactccagccggttgacagaattgctcgagacctgaggcagcgtcccgcttccctggttgtggctgactttgggtgtggggattgtcggctcgccagcagcattaggaaccccgtacattgctttgatctggccagcctcgacccaagagtgactgtgtgcgatatggctcaggtcccgctggaggatgaatccgtggacgtcgctgtgttctgcttgtcactgatggggaccaacatcagagactttctggaagaagccaaccgcgtgttgaagcccggagggttgctgaaagtggcagaggtctcgtcaaggttcgaggacgtgcggacattcctcagggccgttactaagctgggcttcaagatagtgagtaaggatttaactaactcccactttttcctgttcgatttccagaagaccgggcctccactggtggggccaaaggcccagctttccggattgcaactccagccttgcctttataaacgcaggtag

SEQ ID NO: 24137 - DNA, 1017 bp, Artificial Sequence
  Description of Artificial Sequence: Synthetic coding sequence
atggagctgtggggcaggatgttgtgggccctcttatcaggcccaggcaggaggggctcaacacgaggttgggcattttcttcatggcagccccaaccgcctcttgccggactatctagcgctatcgagctagtgagccactggacaggggtattcgagaaaagagggatcccggaggccagagagtcctctgaatatatcgtggcccacgtcctgggcgcaaagactttccagtccttgcggcctgcactgtggacccagccccttacaagccagcagttgcagtgcatcagagaactcagtagcagacgactgcagagaatgcccgtccagtatattctgggtgaatgggacttccagggactgagcctgcggatggtcccacccgttttcattcctcgcccagagacagaggagctggtagaatgggtgttggaagaggtagcacagcgaagccatgcagttggatccccaggatcaccgcttatcctggaggtgggatgcgggtcgggcgctatatccttgtcactgctcagtcaattgccacagtcacgggtcattgccgtcgataagagagaggctgctatttctctgacccatgagaatgcacagagactccgactgcaagatcgcatctggattatccaccttgatatgacttccgaaaggagctggacgcatcttccctgggggcctatggacctgattgtctccaatccaccttatgtttttcaccaggacatggaacagctcgctccagagatccgaagctatgaggaccccgctgctttagacggcggtgaagaaggtatggacattatcacccacattctggccctggctccgaggctgctgaaggatagcggatccatatttcttgaagttgacccacggcatcccgagcttgtctcctcctggctacaatcccggcctgacctctacttgaacttggttgctgtcagacgtgatttttgtgggagaccgagattccttcacatacggcgaagcgggccatag

SEQ ID NO: 24138 - DNA, 1050 bp, Artificial Sequence
  Description of Artificial Sequence: Synthetic coding sequence
atggcaaaggccggtgataaatcttcatcctcaggcaaaaagtcgctcaaaaggaaagcagcggcagaggaactccaggaggctgccggagcaggggacggggctacggagaacggggtccagccaccaaaagctgccgcattcccccctggcttctcgatctcggaaataaagaacaaacaaaggcgacacctgatgttcacccgctggaagcaacagcaacgcaaggagaaattagcagccaaaaaaaaactaaagaaggagagagaggcactcggggataaggcgccacctaagcccgtgccaaagactatcgacaatcagcgagtttatgatgagaccactgttgacccgaacgacgaggaagtagcttatgacgaagcgaccgatgaatttgcctcgtacttcaacaagcaaacctcaccaaaaatattgatcacgaccagcgaccggcctcatggcagaacagttcggctgtgtgagcagctgtcaaccgtaatccccaacagtcacgtgtactaccgccgtggactggcgctcaagaagatcatcccacagtgtatagccagggacttcacagatctcattgtgatcaacgaagacagaaaaacaccgaacgggcttattctgagtcatctgcctaacggtccgacagcccatttcaagatgtcttctgttcgtctgaggaaggagattaaacggagggggaaggatcccactgagcatatccccgagattatcctcaataatttcacgactaggctcgggcattccatcggcaggatgtttgcctcgcttttcccacataatcctcagttcatcggtcggcaagtcgccacttttcataatcaacgcgactatatcttttttcgtttccatcggtatatctttaggtcagaaaagaaggtgggtatccaggaacttggccctcggtttaccttaaaactgcggagtttgcagaagggaacctttgattctaagtacggggagtatgagtgggtgcacaagccgagagaaatggacactagtcgcagaaagttccacctgtag

SEQ ID NO: 24139 - DNA, 390 bp, Artificial Sequence
  Description of Artificial Sequence: Synthetic coding sequence
atggcaaaggctggcgacaaaagttcttccagcggcaaaaagagtctcaaacggaaagcagcggctgaagaattgcaggaagctgcgggagccggagacggggctacagagaacggggtgcagcctcccaaagcagctgctttccccccaggattcagcatttctgaaatcaaaaacaagcagcgcagacatcttatgtttacacgatggaagcagcaacagagaaaggaaaaactcgcggctaaaaagaaacttaagaaagagagggaggcattgggcgataaggcccctccaaaacctgtgcctaaaacaattgataaccagcgggtgtatgatgaaacaaccgtcgacccaaacgacgaggaggtcatgctagaagttctcaattag

SEQ ID NO: 24140 - DNA, 627 bp, Artificial Sequence
  Description of Artificial Sequence: Synthetic coding sequence
atgtgtttcgtcctgaaggccattaactttgtgttacaatatgccctgaagaaaccctacggagtgctgtataaaaaaaagaacataaccaggcctttcgaagatcaaacatcccttgagtttttcagcaagaaaagcgattgctccctcttcatgttcggttctcataataagaaacgccctaataaccttgtgattggtaggatgtacgattatcacgtgctggatatgatcgagcttggcattgaaaactttgtgtctcttaaagacatcaagaactcaaaatgtccggaaggcactaagcctatgctaatctttgctggggacgacttcgacgtcacagaagactaccgtaggctgaaaagcctgctaatcgattttttcaggggccctaccgtctctaacatcagactggcgggactggagtacgtgctgcattttaccgccctgaatgggaaaatttactttagaagctacaaactccttctgaaaaagtcaggatgtcggacgccccgaattgaacttgaggagatggggcctagtcttgacctggtgctccggaggacacaccttgcatctgatgacctgtacaagctttctatgaagatgcctaaagcactgaagtag

SEQ ID NO: 24141 - DNA, 645 bp, Artificial Sequence
  Description of Artificial Sequence: Synthetic coding sequence
atgcttatcaaaggaggaaacgcaaacgccactgtaaccaaagttctgaaggacgtgtatgccctgaaaaagccttatggcgtgctatacaagaaaaaaaacattacccgtccctttgaagatcagacctctctcgaattcttctcaaagaagtctgactgcagtctgttcatgtttggatctcacaacaaaaaacggcctaataatttggtgatcgggaggatgtacgactaccacgtccttgacatgatcgagctgggaattgaaaactttgtctccctgaaagacatcaagaactccaaatgccccgaagggacaaaaccaatgcttatattcgccggtgacgacttcgatgtcaccgaggactaccgtagacttaaaagcttattgatcgatttcttcagaggcccaaccgtgtccaacatccgactcgcgggtttggagtatgtcttgcactttaccgctttaaacggcaaaatatacttccgatcttacaagctgctgcttaaaaaatctgggtgccgtacacccagaattgagctcgaagaaatggggccttctctggatctggtcctgcggaggacccatctggcgagtgacgacctttataaactgtctatgaagatgccaaaagctctaaagtag

SEQ ID NO: 24142 - DNA, 921 bp, Artificial Sequence
  Description of Artificial Sequence: Synthetic coding sequence
atggacacgcttgacagagtggttaaacctaaaaccaagcgggcaaagcggtttctggaaaagagagagccgaagcttaacgaaaatatcaagaacgcgatgcttataaaagggggtaatgctaatgctaccgtcacaaaggtgctaaaggacgtgtatgccttgaagaaaccatatggcgtcttgtataagaaaaaaaatatcacgagaccgtttgaagaccagacatcactcgagttcttttccaagaagagcgactgtagtctatttatgtttggatcccataacaaaaaaagaccaaacaatctagttattggacggatgtatgactatcatgtgctcgatatgatagaattaggcattgagaattttgtttcgctcaaggacatcaagaatagtaagtgcccagaggggaccaaaccaatgctgatcttcgctggcgacgacttcgacgtaacggaggactacagaaggctgaaaagtcttctcattgactttttcagggggccaaccgttagcaacattcgtttggccggtttggagtatgtactccactttactgcccttaatggaaagatttattttagatcatacaaattactccttaaaaaatcagggtgccgcacccccagaattgaactggaggaaatgggcccatcgttggacttggtgctccgacgcactcatctcgcaagtgacgatctttataaactgtcaatgaaaatgcccaaagccttgaagccgaagaagaagaagaacatttcacatgatacatttgggactacctacggtcgcattcatatgcagaagcaggatcttagtaagctacagacacgcaagatgaaggggctcaagaagcggcctgccgagagaatcaccgaggaccacgaaaagaagagcaagaggatcaagaagaattag

SEQ ID NO: 24143 - DNA, 546 bp, Artificial Sequence
  Description of Artificial Sequence: Synthetic coding sequence
atgagcgggattgggaataaaagagccgctggcgaacccggaaccagcatgccacccgagaagaaggctgctgttgaagactctgggaccaccgtggaaaccatcaagctcggaggtgttagcagcactgaagaactggatattaggaccctgcaaactaagaatagaaaactggctgaaatgctggaccagcggcaggccattgaggatgaactgcgcgaacatatagagaagctcgagcgacgtcaggccacggatgacgcctctctgttgattgtgaaccgctactggagccagttcgacgaaaacatcagaatcattctcaaacgttacgacttggagcaggggctgggcgacctgctcacagaaaggaaagctctggtggtgcctgaacccgagccggacagcgactcgaatcaggagcgaaaggatgacagggaaagaggcgaggggcaggagcccgctttctcatttttagctaccctggcgagttcttcaagtgaagaaatggaaagccagctccaggagagggttgagagttcatag

SEQ ID NO: 24144 - DNA, 2928 bp, Artificial Sequence
  Description of Artificial Sequence: Synthetic coding sequence
atgtcaggaatagggaacaagcgcgctgcaggagagcccggaacatcaatgccacctgagaaaaaagccgctgtggaagactcagggactaccgtggaaacaatcaaactgggtggggtgagtagtaccgaggaattagacatacgcaccctgcaaacaaagaatcgcaaacttgcagagatgcttgaccaaaggcaggccattgaggacgagctcagagaacacatcgaaaagctggagcgccgacaggctacagatgatgctagtctgctcatcgtgaataggtattggtcgcagtttgatgaaaacatcagaattatactgaaaaggtacgatctcgagcaaggccttggcgatttgctgacagagcgcaaagctctggtcgtgccagagcctgaacctgatagcgattcgaaccaggagagaaaagacgatcgcgagcgcggagagggccaggagcccgcatttagctttcttgccacactcgcaagtagtagcagtgaagagatggagtcgcagctgcaggagagggtagaaagctcacgacgagctgttagccagattgtaacagtctacgacaaacttcaagaaaaggtcgagcttctgagtaggaagcttaacagcggggacaacctgattgttgaagaggcagtgcaggaactgaatagtttcttggctcaggagaacatgaggctccaagagctaaccgacttgctgcaggaaaagcataggaccatgagtcaggagtttagcaaactgcaatcaaaggtggaaactgctgaaagccgagtcagcgtcctggagtctatgattgacgacctgcaatgggatattgacaaaatccggaagcgtgagcagagactgaacagacacctcgctgaagtgctggagagagttaactcaaagggatacaaggtatacggtgctggatcatcgctctacggcggaacgatcacaattaacgcaagaaagtttgaagagatgaacgccgaactggaggagaataaggagctcgcgcagaatcgcctttgtgagctggagaaactcaggcaagatttcgaagaggtcaccacacaaaatgaaaagctgaaggtagagttgagaagtgctgtggagcaggtcgtcaaagaaacccctgagtaccgctgcatgcaaagccagtttagcgtgttatacaacgagtccctgcagctcaaagcacatctggacgaggccaggacactgcttcacgggacacgtgggacccaccaacaccaagtggagctcattgagcgagatgaggtgtcccttcataagaaattacggacagaggtgattcagctggaggacaccctagcacaggtgcgcaaagagtatgaaatgctccgcatagaattcgaacagacactggctgccaacgaacaggctggcccaatcaatcgcgagatgcgacacctgattagcagcctccagaaccacaaccatcaattgaagggggaggtgctccgctacaaacgaaagcttagagaggcacaaagcgatctcaacaagactaggcttcgctccggaagcgcccttctgcagtcccaaagctccaccgaggacccaaaggacgaacctgccgagctgaagcccgacagtgaggacctttcaagtcagtcaagtgcttccaaggcatctcaggaagatgccaacgaaattaaaagcaagcgggacgaggaagaaagagaaagagagaggagagagaaggagagggagagagagagggagagagaaaaagagaaggagagagagagggaaaaacagaagttgaaagaatcagagaaggaaagggactctgctaaagataaggagaaaggaaaacacgatgatggcagaaaaaaggaagctgagataatcaaacaactgaagatcgaactaaagaaggctcaagaatcacagaaggaaatgaaattgctcctggacatgtataggagcgccccaaaagagcaacgagacaaggtacagctgatggccgctgagaagaagtctaaagctgaacttgaagatttacgccagcgattaaaagacctcgaggacaaagaaaagaaagagaataaaaagatggccgatgaagacgcactccggaagattagggccgttgaagaacagatcgaatatcttcaaaagaagctggcaatggccaaacaggaggaagaggctctcctgtcagagatggacgtgacaggccaggcatttgaggatatgcaggagcagaacattcgactgatgcagcagctcagagaaaaagatgatgcgaattttaagctcatgtctgagagaattaaatcaaatcagatacacaagctgctgaaggaagagaaagaggagctggccgaccaggtcttaaccctaaagacacaggtcgatgcccagttacaggtggtgcgcaagctggaagaaaaagagcacctcctgcaatctaacattggcactggagaaaaggagctcgggctgcgcactcaagcactggagatgaacaagagaaaggccatggaggcagctcaattagccgacgacttaaaggcccagctcgaactcgcgcagaaaaaactgcacgattttcaggacgagatcgtggagaattccgtgaccaaggaaaaagatatgttcaatttcaagcgtgcccaggaggatatttcgcggctcagacggaagcttgagactactaaaaaacccgataatgttcctaagtgtgacgagatcttgatggaggagatcaaagactataaggcacgtctgacatgtccttgttgcaacatgaggaagaaggacgcggttctgacaaaatgttttcatgtgttttgtttcgaatgcgtcaagactcgctatgacacaaggcagcggaaatgccccaagtgcaatgccgcatttggcgcaaatgattttcatcgaatttacattgggtag

SEQ ID NO: 24145 - DNA, 438 bp, Artificial Sequence
  Description of Artificial Sequence: Synthetic coding sequence
atgtctgggataggcaacaaaagagcagcaggtgaacctggtactagcatgccacccgaaaagaaagcggcagtcgaagatagcggaactactgtggaaacaatcaaactgggtggggtatcatctaccgaggagttagatatccgcacccttcagactaaaaaccggaaactggctgaaatgcttgaccaacgacaggccatagaagacgaacttagagagcatatcgagaagttggagcgcaggcaagcaaccgatgacgcctccctgttaatcgtcaaccggtattggtcccagttcgacgagaacatcagaattatcctgaagcgctatgacctagagcaggggcttggggacctcctgactgagcgtaaagccctggtggttcccgaacccgagccagatagtgattccaatcaggaaaggaaggatgattag

SEQ ID NO: 24146 - DNA, 300 bp, Artificial Sequence
  Description of Artificial Sequence: Synthetic coding sequence
atgtcaggcatcggcaataagagagccgcaggggaaccgggaacctcaatgcccccagaaaaaaaagctgcagtcgaagactctggtactaccgtggaaacaatcaagctgggcggtgtgtcttctactgaggaactggatatcagaaccctgcagacgaaaaaccggaagctggccgagatgctcgaccaaagacaggcaatcgaagatgagctacgtgaacatattgaaaagttggaacggaggcaagcaacggacgacgcctcattactgatagtgaaccggtactggagccagtag

SEQ ID NO: 24147 - DNA, 1878 bp, Artificial Sequence
  Description of Artificial Sequence: Synthetic coding sequence
atgaatgtgacttccatcgctctgcgagccgaaacctggctgctcgcagcatggcatgtgaaggtgcccccaatgtggctggaggcctgtatcaactggattcaggaggaaaataacaatgtgaatctcagccaggcccaaatgaacaaacaggtgtttgagcagtggctcttgaccgatcttcgcgatctggagcatcctttactgcccgacggaatcctcgaaattccaaagggcgagctcaacggtttctacgccctgcagattaacagtctcgtggacgttagccagcccgcttacagtcagatacaaaagctgcgtggtaaaaacaccactaacgatctggtgaccgcggaggcacaggtgactcctaagccatgggaagcaaaaccctctcggatgcttatgcttcaactcacagatggcattgttcaaattcagggcatggagtatcagcccatccctatccttcactcagacctgcctcctgggactaaaatcttgatttatggaaatattagctttaggcttggggtgctcctgctgaaacccgagaacgttaaggtgcttggcggagaggtggatgctctcctagaggaatacgcacaagaaaaggtccttgccagattaatcggggaaccagacctggtggtgagtgtgattccaaacaactcaaacgaaaatatacctagggttacagacgtcctggatccagccctgggaccttctgatgaggagttactcgcctcactggacgaaaatgacgagcttacagcaaacaacgacacctccagtgagcggtgttttacgactggctcaagctctaatactatcccaacccggcagtcctcttttgagcccgagtttgtgattagcccaagaccgaaggaggagccctctaacctgagcattcacgttatggacggtgaattggatgattttagtcttgaggaagcactgctcctggaggaaaccgtgcagaaggagcagatggagactaaggagcttcagcctctaacattcaacaggaacgcagaccgctccatcgagcggttcagccataaccctaataccaccaacaacttctccctcacatgcaagaatggcaacaacaattggtccgagaaaaatgtctcggaacagatgacgaatgaggataaaagttttggatgtccgagtgttcgagaccaaaaccgttccattttctcagtacattgtaacgtccccctggcacacgactttacaaacaaagaaaaaaatctcgaaactgataacaagataaaacagacatcctcatccgattcacactcactgaacaataagatcctcaacagagaggtcgttaattacgtccagaaacggaacagccagatttccaatgaaaacgattgtaatttgcagtcctgttccctcaggagtagtgagaattctattaacctgagcatcgccatggacttgtacagtccaccgttcgtttatctgagcgttctgatggcctccaaacctaaagaagtgaccaccgtaaaggtcaaggccttcatcgtgacccttaccgggaacctgtcatcttccggtggcatttggagtatcaccgcaaaagttagtgacggcactgcttacctcgatgttgactttgtggacgagattttgacatccttgatcggattttccgtgcccgaaatgaagcagagcaagaaggatcccttgcaataccagaagtttctggagggtctgcagaagtgtcagcgtgatctgatagacctgtgctgtctcatgacaatctccttcaatcccagcctaagcaaggcaatggtgctggcactccaagatgttaatatggaacacctggagaatcttaaaaaaaggctgaacaaatag

SEQ ID NO: 24148 - DNA, 2196 bp, Artificial Sequence
  Description of Artificial Sequence: Synthetic coding sequence
atgcctagcataccacccattcccgttccgcctccggtgcccacacttcctcccgtgcctcctgtgccacccatcccccctgtgccctccgttccacccatgaccccacttccccctatgagtggcatgcctcctctgaatccaccccctgtggccccactgcccgctgggatgaacggaagcggcgctcctatgaacctcaacaacaaccttaacccgatgttcttgggccctctgaaccccgtgaatccaattcagatgaatagccagagctccgtcaagcccctaccgatcaaccctgacgatttgtacgtctctgtgcatggtatgcccttctctgcaatggagaatgatgttagggacttctttcatggcctccgggtggacgctgtccatctgcttaaggaccatgttgggaggaataatggaaacggccttgtgaagtttctgagcccacaagacacttttgaagccctaaagagaaatcggatgcttatgattcagagatatgtggaggtgagtcccgcaacagagcgtcagtgggttgccgcaggaggtcacatcacgtttaaacagaacatgggtccttccgggcagacacaccctccccctcagacactgccacggtccaagtcacctagtggacagaagcgatcccggagtcgatcccctcatgaggccggattttgtgtgtacctgaagggcttgcccttcgaagctgagaataaacacgtaatcgacttctttaaaaagcttgatattgtggaggattctatctacattgcctatggtcctaacggcaaggccacaggcgaaggtttcgttgagtttcggaatgaagctgattacaaggctgcactgtgtaggcacaaacagtacatggggaataggtttatccaggttcatcccatcaccaagaaggggatgctggagaaaatcgatatgattcggaagcgtctccagaatttttcttacgaccagagggaaatgatactaaacccggagggagacgttaactcggccaaagtttgcgcacacattaccaacattcctttctctatcaccaagatggacgtgctgcagtttctggaaggaatcccagtggacgaaaacgccgtgcacgtcctggtggacaataacggacaggggctagggcaggccctggtccagttcaaaaatgaggatgacgcccgaaaatccgagagactgcatcgtaagaaactcaacggtagggaagcttttgtgcatgtcgtaacattagaggacatgagggagatcgagaaaaacccccctgcccagggcaagaaggggctgaaaatgcctgtccctggtaacccagccgtgcccggaatgccgaacgcaggccttccgggagttggtctgccctctgccggacttccaggtgccggtcttcccagtacaggtctcccgggttccgcaatcaccagcgcaggtttgccaggtgcaggcatgccctcagcgggtataccttcagcaggcggagaagagcatgcatttctcaccgtgggatccaaagaggcaaataatggtcccccattcaatttccctgggaactttgggggaagcaacgcatttggccctccaattcccccacccggtctcggcggaggggcttttggagacgctcgccctggtatgccttcggtgggcaatagtggcctgcccggtctgggcctggatgtgcccggttttggaggaggacctaacaatttaagcggcccttccgggttcggaggtggcccacaaaattttggcaatgggcctggctcactgggcggtccgccaggcttcggaagcggacctcctgggttgggttccgccccagggcacctgggcggaccccctgcctttggccctggtcccggtcctggacctggccctgggcctatccatataggcggaccccctggtttcgctagctctagcggtaaacccggaccaaccgtcataaaagttcagaacatgcccttcaccgtttccattgacgaaatcctggattttttctatggataccaggtgatccccggatcagtgtgtctcaaatataatgagaaaggaatgcctactggagaagccatggtagcctttgagtcaagggatgaggctacagctgctgtgatcgatttgaacgatcggccaattgggtcgaggaaggttaaactggtcctgggatag

SEQ ID NO: 24149 - DNA, 2799 bp, Artificial Sequence
  Description of Artificial Sequence: Synthetic coding sequence
atggctgtggtgatcagactgcagggcctgccaatcgtagcaggcacaatggacatcaggcatttcttttctggactgacgatacccgacgggggtgtacacattgtaggaggggagctcggcgaagcatttatagtctttgctactgacgaagacgcaagactaggaatgatgcggaccgggggtaccatcaaaggtagcaaagttactctcttgctgagttccaaaacagaaatgcagaatatgatcgagctgagtaggaggcggttcgaaacggcgaatctggatataccacctgccaacgcttccaggtcgggcccacctccctcttccgggatgagcagtcgggtaaatctgcctacgacagtttcgaatttcaacaatccatcccctagcgtcgtcactgcaacgacctctgtccacgagagtaacaagaacattcagactttcagcacagccagtgtcggaactgcccctccaaacatgggtgctagcttcggcagccctacattctcctcaactgtgcctagcacagcttcacctatgaatacagtgcctccaccgcctatccctccaatcccagcaatgcctagcctgccacctatgccatctattcccccaatccctgttccacctcccgtcccgaccctgccacctgtgccccctgttcctccaattcctcctgtgccatccgtccctcccatgactcctctacctccaatgtcagggatgccacccctgaatcctcccccagtggcgcctctgcccgctgggatgaatggttctggggctccgatgaacttgaataataacctaaaccctatgttccttggtcccctgaacccagtgaatcccattcaaatgaactcacagtcttcggtcaagcccctgcccattaaccccgacgacctatatgttagcgttcacggaatgcctttttctgccatggaaaacgatgtaagagattttttccacggactgagggttgacgccgttcatctcttgaaggaccatgtaggtaggaataacgggaatggcttagtgaagtttctctctccgcaggacactttcgaggcactgaaacgaaacagaatgctgatgatccagaggtacgtcgaagtgtccccagccacagagaggcagtgggtcgccgctggtggacatattacgttcaagcagaatatggggcctagcggccagactcatccacctccacaaacattgcccaggtctaaatcaccctctggccagaaacgttccaggagtagaagcccccacgaagctggattctgcgtgtatctgaagggattacccttcgaagctgagaacaagcatgtaattgatttttttaagaagctcgatatcgtggaagattcgatttatattgcatacgggccaaacggcaaggctactggggagggtttcgtggagttccgaaatgaggccgactacaaggccgctctctgccgccacaaacagtacatgggcaatcgattcattcaggtgcacccgatcacgaaaaaggggatgctggagaagatcgacatgattcggaagagactccaaaattttagctacgaccagagagagatgatactgaatccggagggcgacgtaaacagcgcaaaagtttgcgcccatatcactaatatcccatttagcatcactaagatggatgttctgcagttcttggaggggatcccagtggatgagaatgccgtgcacgttctggtcgacaacaacggtcagggcttgggccaggccctagtccagttcaagaacgaagatgacgcgaggaagtcagaacggttgcacagaaagaagttaaacgggagagaagcctttgtacacgtggtcactctggaggacatgcgggagattgaaaagaatcccccagcccaggggaagaagggactaaagatgcccgtacccggaaatcccgctgtgccagggatgcccaacgcagggctcccaggcgtcgggctccccagtgcgggactaccaggtgcaggcctcccctcaaccggactccccggatcagcgattactagtgctggcctaccgggtgccggtatgccaagtgccggaatcccatctgccggaggggaagaacacgcatttttgaccgtggggagtaaggaggccaataatggacccccattcaatttcccgggaaacttcgggggatcgaacgcgtttggaccacccatccccccacccggactcggagggggtgctttcggagacgcgcgtcccggaatgccctctgtaggaaattcagggctgccgggactgggtctggacgtccccggattcggaggcggaccaaataacctgtctgggccttccggctttggtggtggccctcagaattttggcaatggccctgggagtctcggcggacccccaggatttggctccggccctccaggtctgggatctgcgccaggacatctggggggaccacccgctttcggccctggacctggcccaggtccagggccaggacccattcatattggcggaccccctgggttcgcatcctccagcggtaaaccgggacctaccgtgatcaaagtgcagaatatgccgttcactgtgagtatagatgagatcctggattttttttacggatatcaagttattcccggatcagtgtgccttaaatacaatgaaaagggcatgcctaccggcgaagccatggtggcgttcgaatctagagacgaggctactgccgctgtgatagacctgaacgacaggcccattggctcacggaaggtgaagttggtcctcggatag

SEQ ID NO: 24150 - DNA, 2799 bp, Artificial Sequence
  Description of Artificial Sequence: Synthetic coding sequence
atggctgtggtgatccgtctgcaaggtctgcctatcgtggccggtacaatggatatcagacactttttcagcgggctgaccattccagatggcggagttcacatcgtggggggagagctgggggaggctttcatcgtttttgctactgatgaggatgcccgtctgggcatgatgagaacaggcggtaccatcaagggaagcaaagtgaccctgctcctttccagcaaaactgagatgcaaaacatgattgaattatcacgccgtcgatttgaaacagctaatctggacatcccacctgcaaacgcatcccgctctgggccaccaccatcaagcgggatgtcaagccgcgtgaatctcccgacaaccgtctcaaatttcaataacccgagcccgtccgtagttacagctacaactagtgtgcatgagagtaacaaaaacatccaaactttcagtacagcgtcagtgggcacagctccacctaatatgggggcttccttcgggagccctacatttagtagcacggttcccagcaccgcttcaccaatgaatacggtgccccctcctccgatcccccctatcccagccatgccctctctgccaccaatgccttccattcctcccatccccgtgcctccacccgtccctactctgcctccagtgcctccagttccacctatcccccctgtgccttctgtgccaccaatgactccactccctcctatgagtggcatgccaccccttaacccacctccagtggcccctttgcccgcaggcatgaatgggtcaggcgcaccaatgaacctgaacaacaacctgaacccaatgtttttaggcccactgaatcctgtaaatccaattcagatgaacagtcagtctagtgttaagcctctccctataaatccagacgacctctatgtctccgttcatggtatgccattctctgccatggagaatgatgtcagagacttttttcacgggctgcgagtagacgccgttcatcttttgaaggatcacgtgggcaggaataacgggaacggattagtgaaatttctgtcgccgcaggacacctttgaagctcttaaacgcaatcgcatgctcatgattcagagatacgtagaagtctcccccgctacagaacgccagtgggtggcggcaggaggccatattacattcaagcagaacatgggcccatccggacaaacccatccccctccacagaccctgccaaggagtaagagcccatctgggcagaagcggagtaggtcccgaagcccccacgaggctggcttctgcgtgtaccttaaaggacttccctttgaagctgaaaacaagcacgtgatagactttttcaagaaactggatattgtagaagactctatttacatcgcttacggccctaacggcaaggccaccggtgaagggttcgttgaattcaggaatgaggccgactataaggccgctttgtgcagacataagcaatacatggggaatcggtttatacaagtgcatcccatcaccaagaagggcatgttggagaaaatagacatgatcagaaaaaggcttcagaatttttcttacgaccagagggagatgattcttaatccagagggggacgtcaactccgccaaagtctgcgcccatattactaatatacccttctccatcacaaagatggatgtgttgcagttcctcgaaggaatcccagtggatgagaacgccgtccatgtcctcgtggataataacggccagggattaggccaagcgctggtgcagtttaagaacgaagatgacgccagaaaatcagaacgtttacaccgtaaaaagttgaatggtcgagaagccttcgtccacgtggtaacactggaagacatgagagagatagagaaaaatccaccggctcaggggaaaaaggggctcaagatgccagtccctggcaaccccgcagtgcccggaatgccgaacgcaggtctacctggcgtgggtctcccctccgccggacttccaggcgcaggtctgccgtccactggcctcccaggctccgccattaccagcgcgggtttgccgggtgcaggtatgccaagcgctggcattccctcagccggaggagaggaacacgcgttcctcaccgtggggagcaaagaggccaataatggcccacctttcaacttccctggcaacttcggtggctccaacgccttcgggccaccgataccacctccagggttaggcggtggcgcattcggagatgccagacccggaatgccctctgtcggtaatagcggtctgcctgggcttggtctggatgtgcctggtttcggaggaggaccgaataacttgtctggccctagtggctttggcggtggacctcagaactttggaaatggacctggcagtttaggagggcctccgggatttgggagtggcccacctggcctgggaagcgccccaggacatctggggggaccaccagcattcgggcctgggcctggccctgggcctggccctggaccaatccacataggtggccctcccggattcgctagcagctctggtaaaccaggacctacagtaatcaaagtccagaacatgccatttactgtgtctatcgacgagattctggacttcttctatggataccaagtcattccgggatccgtttgtctgaaatataacgaaaaagggatgcctaccggagaagcaatggttgcatttgaatcaagagatgaagctaccgcagcggtcattgatttaaatgaccgcccaatcggttctcgaaaggtgaagctcgtgctggggtag

SEQ ID NO: 24151 - DNA, 2799 bp, Artificial Sequence
  Description of Artificial Sequence: Synthetic coding sequence
atggcagtggtgattagattgcaagggctcccaatcgtggccggaaccatggatattagacacttcttcagtggactaacaattcctgatggtggcgttcacattgtgggtggggaactcggcgaggcgtttattgtctttgcaacagacgaggacgccaggctgggcatgatgcgcaccggcggtaccatcaaagggtccaaagtcacactgcttttaagctctaaaaccgaaatgcagaatatgatagaattgtctcggaggcgctttgagaccgcaaacctggatatccctccggcaaacgcaagcaggtcggggcctccaccttccagcggtatgagcagcagagtgaatctacccacgacagtctccaactttaataacccttcacctagtgttgtgaccgctaccacgagcgtgcacgagagtaacaagaacatccagacctttagcacagcgtcagtgggtacggcgccacccaatatgggtgcaagcttcggctccccaaccttctcgtccactgttccctcaacagcttcccccatgaacacagtgcctccccctcctatcccccctattccagccatgccatctctgccaccaatgccttctatcccaccaatcccagtgcctccacctgtgcctactttgccccctgtgccaccagtccccccaattccgcctgtaccttcagtgccacccatgacaccactgccacccatgtccggtatgcctccgcttaatccaccccctgttgctccacttcctgccggaatgaacggttctggcgctccaatgaacctcaacaacaacctcaatcctatgttcctcggaccactgaatcccgtgaacccgatacagatgaactctcagagctcggtcaagccactccccattaatccagacgacctttacgtctcagtgcacggcatgcctttttctgccatggagaacgacgttcgagatttcttccatggtttgcgtgtggatgccgtccacctgttgaaagatcacgttggaaggaacaatggtaacgggctcgtgaagttccttagcccacaagacacgtttgaagctctgaaacgcaatagaatgctgatgatacagcgatatgtcgaggtgagtcccgcaactgaaaggcaatgggtggccgctggagggcacattacttttaaacagaatatgggaccatctggtcaaacgcacccccctccccagactctccccagaagcaagagccctagtggccaaaaacgttcaagatcgagatccccgcacgaggccggtttctgtgtctacctcaagggcctgccctttgaggcagagaacaagcatgtgatcgacttctttaagaaactggacatcgtggaagatagtatatatattgcctatggcccaaatggcaaagccacaggcgagggctttgtggagttccgtaacgaagccgactataaagcagcactctgtcggcataaacagtacatgggtaataggtttattcaggtacatcccattactaagaagggaatgctagagaagatagatatgatcaggaagcggttgcagaatttttcatacgaccagcgggaaatgattcttaatcctgagggggacgtaaactctgctaaggtttgcgcccatattaccaatattccattcagcatcacaaagatggatgtcctccaatttttggaggggatcccagtagacgaaaacgcagtgcatgtcctagtggacaacaatgggcagggcctagggcaggccctcgtgcagtttaagaatgaagacgatgcacgcaagtccgaacgactacaccgaaaaaaactgaacggaagagaggcctttgtgcacgtcgtgacactagaagatatgcgggagatcgagaaaaacccaccggctcaaggtaaaaaagggctgaagatgccggtccctggcaaccccgctgtccccggaatgcctaacgctggattgcccggtgtgggcctcccaagtgccggactccctggggctggcttgcccagcactggcctgcctggatctgccattacgagtgctggactgcctggggcaggaatgccctccgcgggaattcctagtgctgggggagaagagcacgcattcctgaccgtcggaagcaaggaggccaacaatgggcctccatttaatttccccggtaactttggtggttcgaacgccttcggaccccctatccccccacctggcctcgggggtggtgcttttggagacgcgagaccgggaatgccaagtgtcgggaactctggactacctgggttgggactggacgtaccaggtttcggcggaggccctaacaatttgagcggtccatccggcttcggcggtggccctcagaattttggaaacgggccaggatccctggggggaccccctggctttgggtccggccctccgggtctgggctccgcccctggacacctaggaggaccccctgcctttggcccagggcctgggccaggtccagggccaggcccaattcacatcggtggccctcctgggttcgcttcaagctccggcaagcccggtcctaccgttattaaggtccaaaacatgccctttaccgtatccattgacgagatattggattttttctacgggtatcaagtgatcccgggaagcgtgtgcctgaagtacaacgaaaaaggcatgcccacaggcgaagcaatggtggccttcgagtctcgggacgaggcaactgctgctgtgattgatttgaacgaccgcccaataggtagccggaaggtcaagctggtgctgggctag

SEQ ID NO: 24152 - DNA, 876 bp, Artificial Sequence
  Description of Artificial Sequence: Synthetic coding sequence
atggctgtagtcatacgcctacagggcctgcctatcgtggcaggtaccatggatattcggcatttcttcagtggcttgaccattcccgatgggggtgtgcatatagtgggaggggaactgggggaggcttttatcgtcttcgccaccgacgaagatgctcgcctgggcatgatgcgaacaggagggacaatcaagggctcgaaagttacactgcttctcagctccaagacagaaatgcagaacatgatcgaactttctcgcagacgattcgagaccgcgaatctggacatcccgcctgccaacgcatcccgatcaggccctcctccttcatccggaatgtcttccagggtgaacctcccaacaacagtctcaaacttcaacaatccttcaccctctgtggtgacagccaccacatccgtacacgagtcaaacaaaaacatacagaccttctcaaccgcatccgttggcacggccccaccaaatatgggcgctagttttggatcacctaccttttcctcaactgtaccatccacagcctcacccatgaatactgtccccccaccaccaatccctccaattccagctatgcccagcttgccccctatgcccagcattccccctattcctgtacctcctcccgtaccgacgctgccccctgtgccaccggtgccgcctattccaccagtcccatcagtgccgcctatgacacctctcccgccaatgagtggcatgccacccttaaacccccctcccgttgcacccctgcctgcaggaatgaacggctctggggctcccatgaacttaaataacaatctcaacccaatgttcctcggcccactgaatccagtgaacccaatccagatgaatagccagtag

SEQ ID NO: 24153 - DNA, 432 bp, Artificial Sequence
  Description of Artificial Sequence: Synthetic coding sequence
atggccgtggtgattaggctgcaggggctgcccatcgtcgcaggaactatggacatcaggcatttcttctccgggctcacaatacccgacgggggtgtccacattgtgggaggggagttaggtgaagcatttattgtttttgccaccgacgaggacgcgaggctggggatgatgcgcacagggggtactattaagggaagtaaagttacactgttgctgtcgtccaaaacggagatgcagaatatgatcgagctgtctcgccgaaggttcgagaccgccaacctggatatcccccctgccaacgcatcacgaagtggtcccccacctagctcaggtatgagctctagagtcaatctccctaccaccgtctcgaacttcaataacccttctccatccgtcgttacagccaccactagtgttcacgaatcctag

SEQ ID NO: 24154 - DNA, 405 bp, Artificial Sequence
  Description of Artificial Sequence: Synthetic coding sequence
atggcagtcgtgatcaggctgcaaggtttaccgattgtggcgggaactatggacattcggcattttttttccggccttacaatcccagacggcggagtgcacatcgtgggtggcgagctgggcgaagcctttattgtgttcgccacagacgaagatgctcggctaggcatgatgcgcaccggcggtacaattaaggggtctaaggttacactgttgctctcgtccaaaactgagatgcagaacatgatcgaattgtcccgccgaagattcgaaacagccaatctggatattcctcctgcaaacgcgagccgatctggaccaccgccatcctcaggcatgagcagtcgggtgaatctgcccactacagtgagcaacttcaacaacccgtctccctccgtggtctag

SEQ ID NO: 24155 - DNA, 1251 bp, Artificial Sequence
  Description of Artificial Sequence: Synthetic coding sequence
atgtccaataagggaaaaaagctcaagcgcatcattctcgccattccgcctgccgctccagctacggtggcgatgagaccagtcgaggccgcaccctcaggaagacaggctaggcggagaggtgtgggggctattatcaaagccggtattgagtccgccgttgtcgtggaaatcggaataggaatcgatggcgaaatcgtgggcgcagaagtccaagtcggaagtgtggttcggagtaggtcctgggaccgcagacacggttctgagtcacgttccagggaccatcgcagagaggatcgggtgcattaccgttccccacccctagccaccgggtacaggtacggccactccaaatctccacacttccgagagaaatcccccgtgagagagcctgttgataacttgagccccgaggaacgcgatgccagaacagtgttttgtatgcagctcgctgcgaggatccggcctagagatctcgaggacttcttctcagccgtgggtaaggttagagacgttcgtatcatcagtgatcggaactctagacgcagcaaaggaattgcatacgtcgaattctgcgagatccagagtgtgccattggccattggcctgacgggccaacgcctgctgggcgttcccatcatcgttcaggcctcacaggcagagaagaaccgactagcagctatggcaaacaatctgcagaaggggaacgggggacctatgagactttatgttggttccctgcacttcaacatcacagaggacatgctcaggggcattttcgagccttttgggaagatcgataatatcgtattaatgaaggatagtgatactgggaggtctaaaggttatggattcatcaccttcagtgactccgagtgcgctcgcagagctctcgaacagctgaacggattcgagcttgccggacgacccatgagggttggacatgtgactgagcgactcgacggtggaacagacatcacttttcctgatggcgaccaagagcttgatttaggctccgcaggtggaaggttccaactgatggcgaagctggctgaaggagcagggattcagctcccatccactgctgcggctgctgccgcagcagctgcccaggccgcagctttgcagctgaatggagctgttcctttgggagccctgaatccagccgcattaacagcattgtcccccgcattgaatttggccagccagtgctttcagttgagctctttgtttacaccacagaccatgtag

SEQ ID NO: 24156 - DNA, 1218 bp, Artificial Sequence
  Description of Artificial Sequence: Synthetic coding sequence
atggcctctgatgactttgatattgtgatcgaagcaatgctggaggctccgtacaagaaggaggaggatgaacagcagaggaaggaggtcaagaaggattacccaagcaacactacttcctctactagcaattcagggaatgagacctccggatcttcgacaattggcgagactagtaatagatcaagggatagagacaggtatcgccgtcgcaactccaggagtcgttccccaggaaggcagtgtcggcaccggagcagaagctgggatcggagacatggctccgagagcagaagtcgcgatcacagaagggaggatcgtgttcactatcggtctcctccacttgccacaggcgaaccagtagataatttaagccccgaggaacgtgacgcgaggaccgtcttctgtatgcagctggctgctcgaattcggcctcgcgacctggaagacttcttcagcgctgtcggaaaggtgcgcgatgtgcgaatcatctcagatcgaaacagccgccgatcgaaaggaattgcttacgttgagttctgtgagattcagagcgtgccgctggcaatcggtttaactggacagcgcctactgggagttccaattattgtgcaggccagccaggcagaaaagaatcgcctggctgccatggccaacaatttgcagaagggaaatggtggaccaatgcgcctctacgtcggctcgttacacttcaacatcacggaagacatgctgcgcggaatctttgaacctttcggaaaaattgataatatagtgttgatgaaagattctgatacaggccgatcaaagggctacggcttcattacgtttagcgactcggaatgcgctagacgcgctctggagcagcttaacggctttgagctggccggtaggcccatgcgggtgggccatgtcaccgagcgactcgacgggggaaccgacatcacctttcccgatggtgaccaggagctggatctgggtagcgcaggcggacggtttcagctaatggccaaactcgctgagggtgctggaatacagcttcctagcacagccgcagcggctgcagctgccgctgcccaagccgcagccctgcagctgaacggcgctgtccccttaggtgcccttaatcccgcagcattgacagcacttagcccggctctaaacctggcctcccagtgctttcagcttagttctctatttaccccacagacaatgtag

SEQ ID NO: 24157 - DNA, 1320 bp, Artificial Sequence
  Description of Artificial Sequence: Synthetic coding sequence
atggccagcgatgacttcgatattgtcattgaggctatgcttgaggcaccgtacaaaaaggaagaggatgaacagcaacggaaggaggttaaaaaagactaccccagtaacaccacttcttcaaccagtaattcggggaatgagaccagcgggtcttccaccatcggcgagacttccaagaaaaaaaggagcagaagtcacaacaagagccgggatcgtaagaggagcaggtcccgggatcgtgaccggtataggagaagaaacagccggtctcgctcacccggtaggcagtgtcggcacaggtccagatcatgggatagacgccatgggtccgaaagtcgcagccgcgatcaccggagagaagatagggtccattaccgatccccacctctggctacaggatacagatatggacactcaaagtctcctcattttcgggagaaatctcctgtgagagagcccgttgataacttgtcacccgaggaaagggatgcacgcacagtgttttgcatgcagctggctgccagaataagaccgagagatttggaggatttttttagcgctgtgggaaaagttagggatgtacgtataatatccgatcgtaacagtcgcaggagcaagggcatcgcttacgtcgagttttgcgagatccaatcagtgccccttgctatcggactgactgggcagcgtctgttgggcgtgcccattattgtgcaggccagccaggccgagaagaaccgactggccgcaatggcaaataatctccagaagggcaacggtgggcctatgcgattgtacgtgggctcacttcacttcaacattactgaggatatgctccggggaattttcgaacccttcggcaaaattgacaatatagtacttatgaaagattctgacacagggaggagcaaggggtacggctttatcacattttccgactccgagtgtgcgagacgcgcactggagcagctcaacggatttgagctggctggcagaccaatgcgcgtaggacatgtgacagagcgactggacgggggtaccgatattacattccctgatggagatcaggagctcgatctcggtagcgccggaggccgtttccaactaatggcaaagctggccgagggcgctggaatccaacttccgagtacagctgctgccgctgccgctgccgctgcccaggcagcggctctccaactcaacggcgcagtgcctcttggtgccctaaaccccgctgctttgacagccctgtcgcctgctttgaacctcgcatcccagtgctttcaacttagcagcttgtttactcctcagaccatgtag

SEQ ID NO: 24158 - DNA, 1272 bp, Artificial Sequence
  Description of Artificial Sequence: Synthetic coding sequence
atggcctcggacgattttgacattgtgatcgaggccatgttagaggccccttataagaaagaggaggacgagcagcagaggaaggaggtgaagaaagactatcccagtaatacaactagctcgacatcgaattccggaaacgaaacttctggctcttccacgattggagaaacatccaaccggtcgagagatcgggataggtatagacgaaggaattctagaagtcgctcccccggacggcagtgccgtcacaggtcacgtagctgggatcggagacacggaagtgagtctcgatcacgagaccaccgacgcgaagaccgcgttcattaccggtcccctccccttgccaccggataccgctacggacatagcaagtccccacactttcgagagaagagccctgtgagagagcccgtggacaatctgagcccagaggaaagagacgccagaacagttttttgcatgcagctcgccgctagaattcgaccccgagacctggaggactttttcagtgcagtgggaaaggttcgcgacgtcagaattatctccgacagaaatagccgtcgctcaaagggaatcgcctacgtagaattttgtgagatccagagcgttccattagctattggtctaacaggccaaagactccttggcgtgccaataatcgtgcaggcgtctcaggcagaaaagaatcggttggctgccatggccaacaatttgcagaaaggcaatggtggccctatgagactgtatgtcggttctttgcacttcaatattacagaagacatgctcagggggatttttgagccattcgggaaaatcgacaacatcgttctgatgaaagatagtgacacgggacgcagtaaggggtacggttttattactttctcagacagcgaatgtgctcgaagggctcttgagcagctcaatggctttgagctggccggaaggcccatgcgggtcggccacgtgaccgagcgtctggacggaggcactgacatcactttccctgacggtgatcaagagcttgacttgggcagcgctgggggtagattccagctaatggccaagcttgccgaaggagctggaattcagctgccttcgactgccgcagccgctgctgcagcagctgcccaggctgcagcacttcagctcaatggtgccgtgcctctgggcgctctgaatccagccgctctgacagccctctctccagcactcaaccttgccagccagtgtttccagctgagctcactgtttacccctcagaccatgtag

SEQ ID NO: 24159 - DNA, 183 bp, Artificial Sequence
  Description of Artificial Sequence: Synthetic coding sequence
atggcctctgacgatttcgacatagtgattgaagcgatgctggaagccccttataagaaggaagaggacgagcagcagcgaaaggaagtgaaaaaggactacccatcaaataccacctccagcacttctaactccggcaacgagacatctggtagcagcaccattggcgaaacgagcaaatag

SEQ ID NO: 24160 - DNA, 435 bp, Artificial Sequence
  Description of Artificial Sequence: Synthetic coding sequence
atggctagtgatgatttcgatattgtgatcgaagccatgcttgaggcaccatacaaaaaagaagaggacgagcaacaacgaaaggaggtgaagaaggactacccatcaaatactacatcttccacatccaatagtggaaacgaaacaagtggctcctccaccatcggagagacctcaaaaaaaaagaggagtaggtctcataataagagcagagaccggaagagatcccggtccagggatagggaccgatataggcgcaggaatagccggagcaggagtccaggcaggcagtgccgacacaggtcacgctcctgggaccgcagacatggcagtgaaagtcgcagcagggatcatagacgagaagatcgggtacactatcggagccctcctctagcaactggcgagcctgtggataacctctcaccagaggagtag

SEQ ID NO: 24161 - DNA, 228 bp, Artificial Sequence
  Description of Artificial Sequence: Synthetic coding sequence
atggcttcagacgattttgatatcgttattgaggcaatgctggaggcaccgtataaaaaagaggaggatgaacagcagcgaaaggaagtcaagaaagactaccccagcaacacaacaagttctacctcgaattctgggaacgagacttccggtagctccacaatcggagaaacctccaaaaaaaaaaggagcagaagtcacaataagtcgcgggacagaaaacggtag

SEQ ID NO: 24162 - DNA, 303 bp, Artificial Sequence
  Description of Artificial Sequence: Synthetic coding sequence
atggccagtgatgatttcgacatcgtgattgaggccatgctggaggccccttacaaaaaggaagaggatgaacagcaaaggaaagaggtcaaaaaagactatccgtccaacaccacctcctctacctccaactccggaaatgaaacatccgggtcttccacaatcggcgagacaagtaatagaagtagggatcgggatagatataggaggaggaatagtcggagtcgctctcctgggcgacagtgccgccatcgatctcgatcctgggatagacggcacggatccgagagtaggtctagatag

SEQ ID NO: 24163 - DNA, 174 bp, Artificial Sequence
  Description of Artificial Sequence: Synthetic coding sequence
atggcaagtgatgattttgacatcgtgattgaagccatgcttgaggctccttataagaaggaggaagacgagcagcaacggaaggaagtaaagaaagattacccctcaaatactaccagctcgactagtaattccgggaatgagacctcaggatccagcaccattggggaatag

SEQ ID NO: 24164 - DNA, 279 bp, Artificial Sequence
  Description of Artificial Sequence: Synthetic coding sequence
atggctagtgatgactttgacattgtaatcgaggccatgctggaggccccttacaagaaggaggaggacgagcagcaacggaaagaggtaaaaaaggactacccatccaacactacaagcagtacatcaaacagcgggaacgagactagcggctcctcaaccattggagagacctccaagaagaaacgaagcaggtcccacaataagtcaagggacagaaagagaagcaggtctagggatcgcgaccggtaccgcagacggaactccaggtccaggtag

SEQ ID NO: 24165 - DNA, 201 bp, Artificial Sequence
  Description of Artificial Sequence: Synthetic coding sequence
atggcaagtgatgactttgacattgtgatcgaggccatgctggaggcgccttataaaaaggaggaggatgaacagcaacggaaggaggtgaagaaggattacccctcaaacaccacttcttctacatctaattctggcaacgaaacaagcgggagcagtactattggagagacttcaaaccgctctcgggacagagactag

SEQ ID NO: 24166 - DNA, 306 bp, Artificial Sequence
  Description of Artificial Sequence: Synthetic coding sequence
atggcgtctgatgacttcgatatcgttattgaggccatgctcgaggccccatataaaaaggaggaggatgagcaacagcggaaggaggtcaagaaggactacccatcaaacacaacttcatctacttcgaactccggaaatgaaacaagtggctcctccaccatcggagagacaagtaatcgatctagggacagggatcgataccggaggcggaactctcggagcagatccccagggagacaatgcagacacagatccagaagttgggacagacgccatggctctgagtcaaggagtagagattag

SEQ ID NO: 24167 - DNA, 276 bp, Artificial Sequence
  Description of Artificial Sequence: Synthetic coding sequence
atggcttcagacgactttgacatcgtaattgaagcaatgctcgaagcaccctataagaaagaggaagatgagcagcagcgcaaggaggttaaaaaggactatccttcaaacacgactagctcgacctccaactctggcaacgagacctccgggtcatcgacaattggtgagacgagcaataggtctagggatagagacaggtatcggaggaggaatagtcggtctcgctcgcctggccgacagtgtcgccatcgtagtcgtagttgggacagatag

SEQ ID NO: 24168 - DNA, 636 bp, Artificial Sequence
  Description of Artificial Sequence: Synthetic coding sequence
atggctttggaggggatgtctaagcgcaaacgcaaaaggtccgtacaggagggcgagaatcccgatgacggcgttagaggctctccccctgaggactacaggctcggacaggtggcctcctcgctgttcaggggagaacaccatagcaggggaggaacaggacgtttggcctccctatttagctctctagagccccagatacagcccgtatacgtccctgttcccaaacagacaatcaagaagactaagagaaacgaggaggaagaatctacatcgcagattgaacgcccactgtcccaggaacccgctaagaaagtaaaagctaaaaaaaagcatacgaatgcagagaagaaattggcagatagcagcccttttcggctgatgctccgcccttgcttgtcgatttctagcaacacactctactgcatttaccgctttactatctatttttgggaaagcgctcttgcctctgctgatcttgaggaagagatccaccagaagcaggggcagaagagaaagaacagtcaacccggagtaaaggtggccgatcgcaaaattctcgacgacaccgaggacaccgtggtgtcccagcgcaaaaagatccagataaaccaggaagaggaacggcttaagtag

SEQ ID NO: 24169 - DNA, 1293 bp, Artificial Sequence
  Description of Artificial Sequence: Synthetic coding sequence
atggcccttgaggggatgagtaagcggaaaaggaaaagaagcgtccaggagggggagaaccctgatgacggagttaggggtagtccgccagaagattacaggctgggccaggtcgcctcttcgctctttcgtggggaacatcacagccgcggaggcaccggaagacttgcaagcctgttttcaagcttggagccacagatccaacccgtctacgtgccagtccccaagcagactatcaaaaagacaaaaagaaacgaggaggaggagagcacgtctcagatcgagcgtccactgagtcaggagcccgctaagaaagttaaagcaaaaaagaaacatactaacgccgaaaagaaattagccgatcgtgagagcgccctggctagtgctgatctggaggaggaaatacaccagaaacagggacagaaacggaaaaactctcagccaggtgtcaaagtggctgaccggaaaatcctggatgacacagaagacacagtcgtgagccagaggaaaaagatccagatcaatcaagaagaggagcgcttgaagaatgagagaacagtgttcgtgggaaatctgcccgtcacttgtaacaagaagaagctcaaaagcttctttaaagaatatggtcagatcgagagcgttcggtttaggagtctgatccctgcagagggtactctcagtaaaaaactcgccgctattaagcgcaagatccatcccgaccagaagaatatcaatgcttatgtagtgtttaaagaagaatccgccgcaacccaggctttgaaacgtaatggggcacagatcgcagatgggtttaggattagggtcgatctggccagcgagacctcatcacgtgataagcgaagcgtgtttgtcggaaatttgccttacaaggttgaggagagcgccatcgaaaaacacttcctggactgtggatccataatggctgtgaggattgtccgggacaagatgaccgggattggtaaaggcttcgggtatgtcctgtttgaaaatacagactccgtgcacttagcactgaaattgaacaattccgagctaatgggcaggaagcttagggtgatgcgctctgttaacaaagagaagttcaagcagcagaattccaacccgagattaaagaatgtctctaaacccaaacagggacttaattttacttcgaaaaccgccgaggggcaccctaagtcactctttattggcgaaaaggcagtcctcctcaaaaccaaaaagaaggggcagaaaaagtcaggacggcctaagaaacagcgcaagcagaagtag

SEQ ID NO: 24170 - DNA, 636 bp, Artificial Sequence
  Description of Artificial Sequence: Synthetic coding sequence
atggccctggagggaatgagcaagcgaaaacgcaagcggtccgtccaggaaggcgagaatccagatgatggcgtgagaggatcccccccagaggactatcggctggggcaggttgctagcagtttattcaggggcgagcatcactcaagaggtggtacaggaaggttagcaagtctattttcatccctggagcctcaaatccaaccggtgtatgttcctgtgccaaagcaaactataaagaaaactaaacgcaacgaggaggaggaatcaacttctcagattgaacgtccacttagccaggaaccagctaagaaggtcaaggctaaaaagaagcacaccaatgccgagaagaagctggccgactcctctccctttcgccttatgcttaggccctgcctgtccatctctagtaatactctgtactgcatctacaggtttaccatctacttctgggaatccgcactagcctctgccgacctcgaggaggagatccaccaaaaacaggggcagaaacggaaaaacagccagcccggagtgaaggtggccgaccggaagattttggatgatacggaagatacagtggtgagtcagcgcaagaaaatacaaatcaaccaggaggaagagagacttaagtag

SEQ ID NO: 24171 - DNA, 1074 bp, Artificial Sequence
  Description of Artificial Sequence: Synthetic coding sequence
atggcaagcgtcctcaatgtgaaagagtccaaggcgccagagcgaaccgtcgtcgtcgctggcctgccggtggatttgttcagtgaccagctgcttgccgttctagtgaaatcccattttcaggatattaagaacgagggaggggacgtggaggacgtgatctatccaacacgtactaagggggtcgcatatgtgatcttcaaagagaaaaaagtagcagagaatgtgatccggcaaaagaagcactggttagcacggaagacgcggcacgccgagttgaccgtcagtctgcgagtatcccatttcggagacaaaatcttctcttcggtcaacgcaatactggacctgtctgtgttcggtaaggaggtgaccctcgaaactctggttaaggatttgaagaagaagatcccaagcctcagcttttcgcccctgaagcctaacggcaggatcagtgtggaaggaagctttctggccgtaaaacggctccgagagagcctgctggctcgagcctgcagcctgcttgaaaaagaccgaaacttcacctccgaagaaaggaaatggaacaggcaaaaccctcaacggaatctccagagatctaacaactctctcgcttccgtcaggactctggttcccgaaacagcacgttcaggggagatgttagtactcgacactgatgtcttcctataccttaagcacaagtgcggaagctacgagtcaactctcaaaaaattccatattctgagtcaggagaaagtggatggagagataactactatttgtctgaagagcatccaggttggttctcagcctaataatgctaagcatgtgaaagagttgattgaggagtggagtcacgccctgtaccttaaactgagaaaagagactttcattttggaaggtaaggaaaacagagagaagcggatgatcaaacgggcatgtgagcagcttagcagcaggtacctcgaagtgctcatcaacctgtacaggacacacattgacatcataggcagctccagtgacacatatctgtttaaaaagggcgtaatgaagctcataggacagaaggtatcctag

SEQ ID NO: 24172 - DNA, 1782 bp, Artificial Sequence
  Description of Artificial Sequence: Synthetic coding sequence
atgacggctgaggatagcaccgctgccatgtcaagtgatagtgccgctggaagttcagctaaggtgcccgaaggtgtggctggggcaccgaacgaagccgctctgctggctttgatggagcggactgggtactccatggtgcaggaaaacggccagcgaaagtacggcggaccgcctcccggttgggaagggcctcaccctcagagagggtgtgaggtttttgtagggaagatacccagagacgtgtatgaggacgaactggttcccgtcttcgaagccgtgggcaggatctatgagctcagactaatgatggatttcgacggaaagaatcggggttacgccttcgtgatgtattgtcataagcacgaagcaaagcgagctgtccgagagttgaacaactatgagattagacccggacgactgcttggcgtttgctgctctgtggacaactgtcgcctatttataggtgggattccaaaaatgaaaaaacgcgaggaaatcttggaggaaattgctaaggtcaccgagggcgtactcgatgttattgtttacgcatcggcagccgataagatgaagaatcgcggtttcgcctttgtcgagtacgagtctcatcgcgcagccgctatggcgcgtcggaaacttatgcccggtcgcattcaactgtggggtcaccagatcgcagtcgattgggcagaacccgagatcgacgtcgacgaggacgttatggaaaccgttaagatcctgtacgttagaaatctgatgatcgaaactactgaagacactatcaaaaagtcatttggccaatttaatcccggatgtgtagaacgagtaaagaagatccgcgactacgcatttgttcactttacctcgagagaggatgcagtgcatgccatgaacaacctgaatgggactgaactggaaggtagctgcctggaggttacactggcgaagcctgtggacaaagaacagtatagtcggtaccagaaggccgcacggggtgggggagccgctgaagctgcccaacagccctcttatgtatactcctgcgatccctatactctagcttattacgggtacccttacaatgcccttatcggcccaaacagagactattttgtcaaagccggatccatacgcggacgaggccgaggcgcagcaggcaatagggcccctggtccccgaggttcctatctgggtggatatagtgccggaagaggtatctactccagataccatgaaggtaaggggaaacagcaagaaaaaggctatgagctggtgccgaacctggaaatcccgacggtgaatccggtggcaattaagcctgggaccgttgccatccctgctatcggagctcagtattcaatgttcccagctgccccagctccgaagatgatcgaggatggaaaaatacacacagtggaacatatgatttcccctattgcagtgcagcccgaccctgctagcgccgcagccgcagccgcagcggcagcggcagccgctgcagcagtaattcccaccgtcagcaccccacctccctttcaaggtcgccctattacccctgtctacacggtcgcacccaatgttcagcgtattccaacagctggaatttatggagcaagctatgtcccgtttgcggctccagccaccgccacaatcgccacactgcagaagaatgctgctgcagccgcagccatgtacgggggttacgcaggctacattccacaggccttccctgcagcagctatccaggtgcctatccccgatgtctaccagacctactag

SEQ ID NO: 24173 - DNA, 1575 bp, Artificial Sequence
  Description of Artificial Sequence: Synthetic coding sequence
atgactgctgaggactccacagccgctatgagctctgacagtgctgccggatcgtctgccaaagttcctgaaggagttgcgggtgcacccaatgaggccgctctattagccctgatggaacgcactgggtactctatggttcaagagaatggccagcggaaatatgggggacctccgccaggatgggagggcccacaccctcagagggggtgcgaggttttcgtagggaagatacctcgtgacgtgtacgaagacgaattagtgccagtattcgaagctgtaggaaggatttacgaacttcgtctgatgatggatttcgacggaaagaaccgcggatacgcgtttgtaatgtattgccacaaacacgaagccaaacgagccgtcagagagctgaacaactacgagatacgaccgggtagactgctgggagtatgctgcagcgtggacaactgccggctctttatcgggggtatccccaagatgaaaaagagggaggaaatcttggaagagattgctaaggtgaccgaaggagtgcttgatgtgatcgtgtacgcctccgccgctgataagatgaagaacaggggattcgcgttcgtcgagtacgaatcccacagggctgccgctatggccagaaggaaactgatgcctggtaggatccagctctggggccatcagatcgctgtggattgggcagaacctgaaatagacgtcgacgaggatgtaatggagacagtgaagatcttgtacgtgcgtaatctgatgattgaaactacagaagatacaattaagaagtctttcggccagtttaatcccggatgcgtcgaaagagttaagaagataagggattatgctttcgtgcattttacaagccgggaggacgcggtccacgcaatgaacaacctgaatgggaccgagttggaaggttcctgtctagaggtcacacttgccaagcctgtggacaaggagcagtacagccggtaccagaaagccgcaagaggaggaggagccgcagaggctgcccagcaaccctcgtacgtgtatagctgcgacccctacaccttggcctactacggctacccttacaatgcactgatcgggccaaacagagactactttgttaaggtggcaattcccgcaattggagctcaatatagtatgtttccagccgcacccgcaccaaaaatgatagaggacggtaaaatccacactgtcgaacacatgatcagtcccattgccgtccaaccagacccagcaagtgcagctgccgctgcagcggctgcagccgcagctgcagcagccgtaatccctacggtgtcaacgccccctcccttccagggaaggccaataacccctgtctacacggtggccccaaatgttcagaggatccccaccgcgggaatctatggggctagctatgtgccttttgctgccccagcaacagccacaatagcaaccctccagaagaacgcagccgctgcagcggcaatgtacgggggatacgccggatacatcccacaggccttccccgcagctgcaatccaggtgcccattcccgatgtataccagacctattag

SEQ ID NO: 24174 - DNA, 1782 bp, Artificial Sequence
  Description of Artificial Sequence: Synthetic coding sequence
atgacagcagaagattcaaccgccgctatgagcagtgattccgctgctgggagctcagcgaaggtcccagagggagtggctggagcacctaatgaagcggcattactagcattgatggagcggacaggatacagcatggtgcaagagaacggtcagagaaaatatgggggaccaccccctggatgggagggacctcaccctcagcgaggctgcgaggtctttgtaggcaagatcccgcgtgatgtgtacgaagacgagttggttccagtgtttgaggccgttggtcgcatctacgagttaaggctgatgatggacttcgacgggaagaaccgcggatacgcctttgtgatgtactgtcacaagcacgaagccaagcgggcagtgagggaattgaataactacgagattcggccaggcagacttctgggagtgtgctgttccgtcgacaattgcagattgttcattggcggaatccccaaaatgaagaagagggaggagatcctcgaagagatcgctaaggtgacagagggagtgctggatgtgatcgtgtacgcaagcgctgcagacaagatgaagaaccgcggattcgctttcgttgagtatgagagccatcgcgcagctgctatggctcgcagaaagctgatgcctggtcggattcaactctggggccaccagattgccgtagactgggccgaaccagagatcgatgtcgacgaagacgttatggagaccgtgaagatcctatacgtgcggaacctgatgatcgagaccaccgaggatacgatcaagaagagcttcgggcagtttaatcctggatgtgtcgaacgtgtgaagaagattcgggactatgcattcgtgcacttcacgagccgggaagacgcagttcacgctatgaacaacctaaacggcacggaattagaagggtcctgtttagaagtcactttggctaaacctgtggataaagaacagtattcccgataccagaaggccgcacggggagggggagcagccgaagccgctcagcagccaagctatgtctactcttgtgatccctatacattagcctactacgggtatccgtacaatgccctgatagggccaaacagggactactttgttaaagctggctcaatccgcggaagaggcaggggcgctgcaggcaacagagcaccaggccctaggggatcgtatctggggggatatagtgccggaagaggaatctattcgaggtatcatgaaggtaagggcaaacagcaggaaaaagggtatgaactcgtacctaacctggaaatcccaaccgtgaatcctgtcgccataaaaccaggaacggttgctataccggcaatcggagcccagtattccatgttccccgctgcgccagcccctaagatgatcgaggacggtaagatccacacagtggaacatatgatcagccccatcgccgttcagcccgacccagcttcagcagccgctgctgcggctgccgcagcggctgcggcagccgctgtgattcccacagtcagcaccccacctccatttcagggccgaccaattacgcctgtttatactgtggctccaaatgtccagcggattcctactgcgggaatatacggcgcatcgtacgtaccatttgcagcgccagccacagccacgattgctactttgcagaagaatgccgcagcagctgcagccatgtacggcggatatgccggttatattccgcaggcctttcccgcagctgccatccaggtgccaatcccggacgtatatcagacctactag

SEQ ID NO: 24175 - DNA, 1575 bp, Artificial Sequence
  Description of Artificial Sequence: Synthetic coding sequence
atgactgctgaggactctaccgctgccatgagtagcgactccgcagccggatccagcgcaaaggtacccgagggcgtagccggagcccctaatgaggccgcactcttggccctgatggaacgcaccggttactctatggtccaggagaacgggcaacgaaagtacggaggcccacctcccggatgggagggcccacacccacagaggggctgcgaagtgtttgtaggaaaaatccccagggacgtttatgaggacgagcttgttcctgtctttgaggcagtaggacgtatatacgaactgcggcttatgatggatttcgatggtaagaaccgcggatacgcgtttgttatgtactgccacaaacacgaggcaaagcgcgcagttagagagctgaacaattacgaaatacgtcctggccgtctgctcggcgtctgctgcagtgtggataactgccggctgttcatcggcggtatcccgaagatgaagaagagggaagagatattggaggagatagctaaggtgactgaaggtgtgttggacgttatcgtctacgcctcagctgcagacaagatgaaaaaccgcggattcgccttcgttgaatacgagagtcacagagcagccgctatggctaggaggaagctgatgccaggacgcatccagctttgggggcatcagattgctgtcgactgggccgagcctgagattgacgtggacgaggatgtgatggaaactgttaaaattttgtacgtcaggaatctgatgattgaaaccactgaggatacaatcaaaaagtcttttggacaatttaaccccggatgtgtggagcgggtaaagaaaattcgcgattatgcattcgtccattttactagcagagaagacgccgtgcacgccatgaataacctcaacggtacagagctggagggaagttgcctcgaggtcaccctcgccaagcctgtagacaaagagcagtattcaaggtatcagaaggcggctcgagggggaggagcagccgaggccgctcagcagccatcctacgtctacagctgtgacccgtataccctggcttactatgggtacccatacaacgctctgattggacccaacagagattattttgtgaaggtcgccattcctgctatcggtgcccaatactctatgtttccagccgcacccgcacccaaaatgatagaggacgggaagatccacaccgtggagcatatgatatcaccgatagcagtccaacctgatcccgcatccgccgcagctgccgcagccgcagccgcagcagcggctgctgccgtaattcctacagtcagcaccccaccccctttccaagggaggccaattaccccagtgtacaccgtggctcccaatgtgcagagaatacctactgcaggaatttacggggcttcttacgtcccttttgctgccccagcgacagctacaatagctacactccagaaaaatgccgctgcagccgctgccatgtatggcggatatgccggatacatcccccaagccttccccgctgcagccattcaggtacctattccagacgtgtatcagacatactag

SEQ ID NO: 24176 - DNA, 180 bp, Artificial Sequence
  Description of Artificial Sequence: Synthetic coding sequence
atgaccgctgaagattcgaccgccgctatgtcttccgacagcgccgcaggaagttccgccaaggtccccgagggggtggccggagcccctaatgaggccgcactgctcgcactaatggagagaactgggtacagcatggtacaggaaaacggccagagaaaatacgggggtccaccctag

SEQ ID NO: 24177 - DNA, 480 bp, Artificial Sequence
  Description of Artificial Sequence: Synthetic coding sequence
atgacggccgaagatagcactgccgcaatgagctctgatagtgccgctggatcctcggccaaagtgccagagggagttgctggagcgccaaatgaggctgcactgctggcactgatggaaaggactggctattctatggtgcaggagaacgggcagcggaagtacgggggtcctccacctgggtgggagggcccacacccccaacggggatgcgaagtatttgttgggaaaatcccccgtgatgtgtacgaagacgaactcgtgcccgtattcgaggccgtgggtcgcatatacgagcttcgtttgatgatggacttcgacggaaagaaccgaggctacgcttttgttatgtactgtcataaacacgaagctaagagagccgtgagagagctgaataactatgagataaggccagggagactcctgggtgtttgctgctccgtggacaactgcaggctgtttattggtgggatcccctag

SEQ ID NO: 24178 - DNA, 375 bp, Artificial Sequence
  Description of Artificial Sequence: Synthetic coding sequence
atgacagctgaggatagcaccgccgctatgagctctgactccgccgcagggagcagtgccaaggtgcccgagggcgtcgccggagcccctaatgaagctgccttgctcgcactaatggagaggaccggctattccatggtgcaggagaacgggcagcgcaagtacggcggaccacctccaggatgggaaggcccacacccacagagaggctgcgaagtctttgtgggaaagatccccagggatgtttacgaggatgaactcgttcccgtgttcgaggctgttggtagaatctacgagctcagactgatgatggactttgacggcaaaaaccgtggctacgcattcgtgatgtattgccataaacatgaggcctag

SEQ ID NO: 24179 - DNA, 345 bp, Artificial Sequence
  Description of Artificial Sequence: Synthetic coding sequence
atgacggcggaggattctaccgcagccatgagcagcgatagtgctgctggatcttccgcaaaggtgccagagggtgtcgccggagcccctaatgaagcggcactgctcgctctgatggaaaggacaggatactctatggtacaggagaacggccagcgcaagtatggtggacccccacctggatgggaagggccacacccacagaggggatgtgaagtcttcgtgggcaagatccctagggatgtctatgaagatgagctcgtgccagtgttcgaggccgtcgggagaatttacgaattgagactcatgatggacttcgatggaaagaatcgcggatatgcctag

SEQ ID NO: 24180 - DNA, 180 bp, Artificial Sequence
  Description of Artificial Sequence: Synthetic coding sequence
atgacggctgaggattcaaccgcagccatgtcatcagattccgcagctggttccagcgctaaggtccctgaaggagtagccggtgctcctaatgaagccgcacttctggccctgatggaacggaccggatactccatggtgcaagagaatgggcaaaggaagtacgggggacctccttag

SEQ ID NO: 24181 - DNA, 582 bp, Artificial Sequence
  Description of Artificial Sequence: Synthetic coding sequence
atgacagcagaggactctacagcagccatgtcaagcgactcagcagcgggaagtagcgcaaaggtgccagaaggcgtggccggtgctcccaatgaagcggctctcttggcactgatggaaaggacgggatactccatggttcaggagaacggtcagcggaagtacggaggcccaccacccggatgggagggtccgcatccacagaggggctgcgaagtgtttgtagggaaaatcccaagagatgtttacgaagacgaattggtgcccgttttcgaagccgtgggccgtatttacgaactccgcctgatgatggactttgacgggaaaaatcgcggttatgcttttgtaatgtactgtcacaagcacgaggcaaagagggctgtgcgtgagttgaacaattacgagatccgccctggcaggctgttgggcgtgtgctgttctgtagataactgcaggctgttcattgggggtataccgaagatgaaaaagcgggaggagattctcgaagagatcgccaaagtcacagagggggttctggatgtgattgtgtatgcttctgctgccgacaagatgaagaactag

SEQ ID NO: 24182 - DNA, 414 bp, Artificial Sequence
  Description of Artificial Sequence: Synthetic coding sequence
atgacagctgaggacagtacagctgctatgagtagcgattctgccgcagggagctccgcaaaagtgccagagggcgtggctggggctcctaacgaagccgctttgctggcattaatggaaagaacggggtactcaatggttcaggaaaacggccagcggaagtatggaggaccgcctcctgggtgggaggggcctcacccccaaagaggatgcgaggtgttcgtcggaaagataccccgagacgtttacgaagatgagttagtgcctgtgtttgaggcagttggcagaatttacgagctgaggctcatgatggattttgatggcaaaaaccgtggatatgcatttgttatgtactgccacaaacacgaagccaaaagagccgttagagaactcaacaactatgagattcgttag

SEQ ID NO: 24183 - DNA, 654 bp, Artificial Sequence
  Description of Artificial Sequence: Synthetic coding sequence
atgacagccgaggactctaccgccgcaatgagctccgactcagctgccggatcgtcagcaaaggtcccggaaggtgtggctggagcgcctaatgaggccgcattgctggcactcatggaacgcaccggctatagcatggtacaagaaaatggccaacgcaaatatgggggtcctcccccaggctgggaggggcctcatccccagagaggatgtgaggttttcgttgggaaaatccccagggacgtatatgaggacgagcttgtgcctgtattcgaagcggtgggtcggatatacgaacttcgattaatgatggatttcgatggaaagaacagagggtatgcattcgtcatgtactgtcacaagcatgaagctaagcgcgctgtccgcgaactgaataattacgagatccgccctggtcgacttctaggggtttgttgtagcgtagataattgcaggctttttataggtggaatccctaagatgaagaaacgggaagagattctggaagagatagccaaggtaactgaaggcgtactcgatgtaatcgtttatgccagcgccgcagacaagatgaaaaaccgcggtttcgcctttgtggagtacgaatcccaccgcgctgctgcaatggctcgaagaaaattgatgcccggttag

SEQ ID NO: 24184 - DNA, 1080 bp, Artificial Sequence
  Description of Artificial Sequence: Synthetic coding sequence
atggtcaagctattcatcggtaacctgcccagggaggccaccgagcaggagatcaggtccctgttcgagcagtacggcaaggtgctagagtgcgatatcatcaaaaattacggcttcgttcacatagaagacaagacggctgcagaggacgccataaggaacttgcaccactacaagctgcacggggttaacattaatgtcgaggcttccaagaacaagtcaaaagcctcgacaaagctgcacgtgggaaatatcagccctacgtgtaccaaccaagagttaagggctaagttcgaggagtacggacctgtaatagagtgtgacattgtgaaggactacgcctttgtgcatatggaacgggctgaggatgcagtggaggccatcaggggtctggataacactgagttccagggaaaacgaatgcacgtccagctgagcacctcacgcttgaggacggcaccaggtatgggggatcaaagtgggtgctacagatgcggcaaggaggggcactggtcaaaggagtgcccagttgacaggaccggcagggtggccgattttacagaacagtacaatgaacagtatggtgctgtccgcaccccgtacactatgggctatggagagtccatgtactacaatgacgcctacggcgctttggactattacaagcgataccgggtgagatcttacgaggctgtggctgcagccgcagccgcatcggcctacaactatgcagaacagactatgtctcatctcccccaagtacagtctaccacagtcacatcccatctgaactcaaccagcgttgatccgtatgacagacacctgttgcctaacagcggagcagccgctacaagcgccgctatggccgcagctgccgctacaacatccagttactatggacgggaccgatccccacttaggagagccgctgcaatgcttcctacagttggggagggatacggatatggccctgaatccgagctctctcaagcgagtgccgctacacgtaactctctctatgacatggcgcgttatgaaagagagcagtacgttgaccgggcacggtattctgccttctag

SEQ ID NO: 24185 - DNA, 1080 bp, Artificial Sequence
  Description of Artificial Sequence: Synthetic coding sequence
atggtgaagctattcattggaaatctgccaagagaggcaactgagcaggagattaggagcctgttcgagcagtacggcaaagtgctggagtgtgatatcatcaaaaattatggcttcgtccatatcgaagataaaaccgccgctgaggatgcgatcagaaacctccaccactataaacttcatggggtcaatatcaatgtcgaagcttctaagaataaaagcaaagcctcaacaaaactgcacgtgggtaacattagccccacctgtaccaaccaagagttgagggcaaaatttgaagagtacggcccagtgatcgaatgcgacattgtcaaagactatgcctttgtacatatggagagagctgaggacgccgtcgaggccatcagagggttggataatacagagtttcagggcaaacggatgcacgttcaactctccacctcccgcctgcgaaccgctcctggtatgggggaccagtctggatgctacagatgcgggaaagaaggccactggtcaaaagagtgccctgtcgaccggacaggacgcgttgctgatttcaccgagcagtacaatgagcagtatggagctgtgcgtactccctacactatgggttacggggagagtatgtattacaacgatgcctatggcgcattggattattacaagaggtatcgagtgaggtcatacgaggccgtcgccgctgctgcagcggctagcgcctacaattatgctgagcaaaccatgtcccatctcccccaggtacagagtactactgtgacaagtcatcttaactcgaccagtgtcgacccatacgatagacacttgctccccaattctggcgctgccgcaaccagcgcagccatggcagccgcagctgccacgacatcatcctactacggcagagatcgctctccactgcgcagagccgctgccatgcttcccacagttggagagggctacggatacggacccgagagcgaattaagccaggcctcggcagcaactaggaactcactatatgacatggctcggtatgaacgcgagcagtacgtggaccgggctagatattctgcattttag

SEQ ID NO: 24186 - DNA, 2448 bp, Artificial Sequence
  Description of Artificial Sequence: Synthetic coding sequence
atggggtccgacaaacgggtcagccgtactgaaaggtctggtcggtacggttctatcatagatcgggatgatagagatgaacgggagagccggtcacgacggcgagacagcgactacaaacgctcttctgatgacagaaggggcgaccgctacgatgactaccgagattatgactcccctgagagagaaagagagcgcagaaactccgatcggtctgaggacggatatcactccgatggcgattacggagagcacgattacaggcacgacattagtgacgaacgggagtccaagactattatgcttcgcggactccctatcacaatcacagagtccgacatacgggaaatgatggaatcctttgagggtcctcagccagctgacgtgaggctaatgaagcgcaaaaccggcgtctctagaggatttgcttttgtggaattctatcacctccaggatgccactagctggatggaggccaaccagaaaaagctagtcattcaaggcaaacatatagctatgcattactccaatccaagaccaaagtttgaggactggttgtgcaataaatgctgccttaacaactttaggaaacgcctaaagtgctttcgttgcggcgcagataagtttgatagtgagcaagaggtcccgcctggaacaaccgagtccgtgcaatccgtggactattattgcgacaccattatcctcagaaatattgcacctcatactgtcgtcgattcaatcatgactgcgctcagcccgtacgccagcctcgccgtgaacaatatcagactgatcaaagataaacagacgcagcagaaccgcggttttgcattcgtgcagttatcatccgcaatggatgcatcccagttattacagattcttcagagtcttcatcctcccctgaagatcgacgggaaaaccattggcgtggacttcgccaaatctgcccgtaaggatttggttttgagtgacggaaaccgtgttagcgcctttagcgtagcgtccaccgcaattgccgcagcccagtggagcagcacccagagtcagtccggtgagggaggttccgtcgattactcatatctccaacccggacaggatgggtatgcccagtatgctcaatactcccaagattatcagcaattctaccagcagcaggccggtggtctagagagtgatgcctcttcagcctccgggaccgccgtaaccacgacctcagctgcagtcgtgagccagagcccccagctctacaatcaaacctccaatccgcctgggtcccctacggaggaggcacagccttcaacctctacctctacgcaggctccggcagcttccccaaccggggtggtccccggaactaagtacgcagtcccagatacaagcacataccaatatgacgaatcatctggctactactatgacccaactactggtctgtattatgaccccaattcccagtattattacaattcactcacccaacagtacctctattgggacggggagaaggagacttacgtgcccgctgctgaaagttcctcccaccagcagtccggacttcctccagccaaggaggggaaagaaaagaaagagaagccaaaatctaagacagctcagcagatcgccaaggacatggaaaggtgggcgaaaagcctgaataaacagaaagagaacttcaagaatagcttccagccagtgaattctctgcgggaggaagagcggagagaaagtgctgctgcagatgccggtttcgccttgtttgagaaaaagggagcactcgccgaacggcagcagcttattccggagctcgtgaggaatggcgatgaggagaacccactcaaacgagggttggtcgcggcttattctggggatagtgataatgaggaggaactggtcgagcgactggaatcagaagaggagaaactcgccgattggaagaaaatggcttgcttgctctgccgtaggcagttcccaaataaggacgctctggtgaggcaccaacagttgtctgacttacacaaacagaacatggacatctatcggaggtctagactttccgagcaggagcttgaggccctcgagctgagggagcgtgaaatgaagtatagggaccgcgcagctgagagaagagagaagtacgggatccccgaaccgcctgagcccaagagaaagaagcagttcgacgccggaactgtgaactacgaacagcccactaaagatggtatcgaccatagcaacattggtaataagatgctgcaggccatggggtggagagaaggctcaggactgggacggaaatgtcagggcattacagccccaatcgaggcccaggtgcggttgaagggcgcagggcttggtgcaaagggatccgcctatggactctctggagcagacagctataaggacgccgtgagaaaggccatgttcgcacggttcaccgagatggaatag

SEQ ID NO: 24187 - DNA, 363 bp, Artificial Sequence
  Description of Artificial Sequence: Synthetic coding sequence
atgggaagcgataaacgagttagcagaacagagcgtagcggcaggtacggctccataattgacagagacgaccgtgatgaacgagaatctaggtcacggaggagggattctgactataagcggagctctgatgacaggaggggagataggtatgacgattaccgcgattatgacagccctgaacgtgaacgcgagcgcaggaacagcgatcgatccgaggacggctaccatagcgacggtgactacggagagcacgactacaggcacgacatctcggatgaaagggagagcaagacgattatgctgcgaggcttacctattacaataaccgagagtgatatccgtgagatgatggagagctag

SEQ ID NO: 24188 - DNA, 318 bp, Artificial Sequence
  Description of Artificial Sequence: Synthetic coding sequence
atgggctcagacaagagagtttccaggacagaaaggagtgggaggtacggctctatcatcgacagggacgacagagacgaaagggagagccgatcgcgcagacgggacagcgactacaaaagatctagtgacgacaggcgcggtgataggtatgacgattatagagattacgacagccccgagagggaaagggaaaggagaaactccgaccgaagtgaggacgggtaccactccgatggtgattatggtgaacatgattataggcacgatattagcgacgagcgcgagtcgaagaccattatgctccgcggtctgtag

SEQ ID NO: 24189 - DNA, 414 bp, Artificial Sequence
  Description of Artificial Sequence: Synthetic coding sequence
atggggtctgataagagagtgagccggaccgaacgcagtggacgatacgggtctatcattgatagggacgacagggatgagagagagagcagatctcgtagaagagactccgattataagcgttcctcggatgatcgcagaggagaccgctatgatgattatagggactatgacagccccgaacgagagagagagcgccgaaatagcgatcggtcagaggatggttaccacagtgacggtgattacggtgagcatgactaccggcacgatatttcagacgaaagggagtcaaaaactattatgctaagaggcctgcctatcacaattactgaaagcgacataagggaaatgatggaaagctttgagggaccccaacccgctgacgtccggcttatgaagcgcaagactggctag

SEQ ID NO: 24190 - DNA, 432 bp, Artificial Sequence
  Description of Artificial Sequence: Synthetic coding sequence
atgggctccgataaaagggtcagccgaacagagcgcagtggcagatacggctcaattatcgaccgcgatgaccgagacgaacgggagtcccgcagcaggaggcgggactccgactacaagaggtcgtccgacgatcgcagaggggatagatatgatgactatcgcgattacgattctcctgaaagagaaagagagcgcaggaattcagatagatccgaggatgggtatcatagcgatggggactacggcgagcacgactaccgccacgacatcagtgacgagcgcgaatctaaaacaataatgctcaggggtttgcctatcacaattactgaatcggatatacgagagatgatggaatcattcgaagggccacaacccgctgacgtgcgactcatgaagcgcaaaactggcgaaagtctgctatcgtcctag

SEQ ID NO: 24191 - DNA, 381 bp, Artificial Sequence
  Description of Artificial Sequence: Synthetic coding sequence
atgggatccgacaagagggtgtctcgcacagaaaggagtggacggtacggatcaatcatcgaccgggatgacagagacgaaagagaaagccgatccagaaggagggatagcgattataaacgcagctccgacgatcgtaggggagaccggtacgacgactacagggattatgactctccagagaacgacaagtacagccgaaacgacggggtgctgaggaggccaagcgcttgtgggtgcgaggcggacgaggaggaaaatcgctgcaagccgtggttcagactccgaggagttctttccttggcccgatgttaccagcttgacggctcacagagcgagaaagtgggcgactcccggaaagcccactgtaacgccctgtag

SEQ ID NO: 24192 - DNA, 450 bp, Artificial Sequence
  Description of Artificial Sequence: Synthetic coding sequence
gggacaaagtgcagagtgtctcgtactgagcgcagtggtaggtacggttctataattgatagagacgatagagatgaacgcgaatcacggagccgacgaagggactccgactataagaggtcctctgatgatcgtaggggtgacaggtacgacgactatcgtgactatgattcacccgagcgagaacgggagcgtcgcaatagtgatagaagtgaagacggatatcacagtgatggagactacggggaacatgactacaggcatgacatctccgatgagcgagagtccaagaccataatgttaaggggcctgccgataaccatcaccgaatctgatatccgagagatgatggaaagcttcgaaggaccacagccagccgatgtgcgactgatgaaaagaaagacggaaaaagtaggggactcgcgcaaggcccactgtaatgccctctag

SEQ ID NO: 24193 - DNA, 2445 bp, Artificial Sequence
  Description of Artificial Sequence: Synthetic coding sequence
ggtactaaatgcagagtcagtagaacggaacgctccggtcgatatgggtcaatcatagaccgtgatgatcgagatgagcgggaatccaggagtagaagaagagactccgattacaagagatcgagcgatgacaggaggggtgatcggtatgatgactaccgggactacgatagccctgagagggagcgggagagacgcaactccgatcggagcgaggatggatatcactccgatggagattatggtgagcacgactaccgtcatgacatctctgatgagagagagagcaagacaatcatgctgcgcggtctgcctatcacaatcactgagtccgatatccgcgagatgatggagagctttgaaggtcctcagcccgctgacgtccgtctcatgaagcggaaaacaggagtgtcacggggattcgcgttcgtagaattttaccatctacaagatgctactagttggatggaggcaaaccagaaaaaattggtgatccaagggaagcatatcgccatgcattactccaatccacgacctaagttcgaggactggctgtgtaacaaatgctgtctgaacaacttccggaagcggctcaaatgtttccggtgcggagccgataaattcgactcggagcaggaagtgcctccaggcactacagagagcgtgcaaagcgttgattattattgtgatacgatcatactgcgtaatatcgcccctcacaccgtcgtcgattctatcatgaccgctctcagtccctatgcttcgcttgctgtcaacaacattcgactcatcaaggacaagcagacacagcagaataggggatttgcctttgtacaactgtcaagcgccatggatgcaagccaattattacaaatccttcagagcctccatccgcctctgaagatcgatggaaagacaatcggggtggatttcgctaagtcagctcgtaaagacttggttttgtcagacggcaatcgggtgtcggccttcagcgttgccagtaccgctattgccgcagctcagtggtcctctactcagtcacaaagtggggagggaggatcggtcgactattcatatttgcagccgggtcaagatggctacgcacaatacgcccaatactcacaggattaccaacagttctaccagcagcaagcaggcggtctcgagtcagacgcctcatctgccagtggaacagccgtcacaactacctcagccgcagtggtgtcacagagtcctcagttatacaaccagaccagtaacccaccagggtctccaacagaagaggcccagccctccacgagtacgtctacacaagccccagccgcatccccaactggcgttgtcccgggaacaaagtatgcggtgcccgataccagcacataccaatacgacgaaagtagcggatactactatgatccgacaaccggactgtactatgatccaaatagtcagtactactacaacagtctcacgcagcaatacctgtattgggatggagagaaggaaacatatgtgccggctgcagagtcaagtagtcaccagcagagcggtctgccccctgccaaggaaggtaaggagaagaaggagaaaccgaagtccaagacagcacagcagatcgctaaagatatggagcggtgggcgaaaagcctgaacaaacagaaggaaaactttaagaacagttttcagccagtcaactctctgagagaggaggaaagacgcgaatctgccgcagccgacgcaggctttgcacttttcgaaaaaaaaggcgctttggcagagcgccaacaactcattcccgaactggtgaggaacggcgacgaggaaaatccactgaagaggggcctggtggccgcatactccggggacagtgataatgaggaagagctcgtggagaggctggagtccgaggaagagaagctcgccgactggaaaaaaatggcctgcttgctatgcagaaggcagtttcccaacaaggacgccttggtcagacatcagcagttgtccgacttgcacaaacagaacatggacatataccggaggagccgcctaagcgagcaggagctcgaggctctagaactcagggagcgggaaatgaaatacagggaccgagccgctgaacgaagagagaaatatggaatccctgaacctccagagcccaaaagaaaaaagcagtttgatgccggaacagtcaattatgagcaacctactaaagatggcattgatcactccaatattggcaataaaatgctacaggctatgggttggagggaaggatccggattggggagaaagtgccagggcatcaccgctccaattgaagcacaggtgcgcttgaaaggagctgggctgggagcgaagggttccgcatacggactctcgggtgcggattcctacaaagatgctgttcgcaaagccatgtttgcccgttttacagaaatggagtag

SEQ ID NO: 24194 - DNA, 1518 bp, Artificial Sequence
  Description of Artificial Sequence: Synthetic coding sequence
aacgggttccgtagcggagagagggatctagtgctctcggatggaaaccgcgtatccgcgtttagtgtggcgtctactgccattgccgctgcccagtggtcttcaacccagtcacagtccggagaaggtggcagtgtcgattacagttatctccaacctgggcaagatggctatgcacagtatgcgcagtactctcaagattaccagcagttctatcagcagcaagctggtgggctggagtctgacgcaagcagcgcgtcaggcacagcggtcacaacgacaagtgccgcagtggtcagccagagcccacagctttataaccagaccagcaatccccctggctcaccaacagaagaagctcaaccaagcacaagcacctccacacaggccccagccgctagcccaactggagtggtgccagggactaagtacgcagtccctgacacctccacctaccagtacgatgagtcttccggatattactatgatcctacaacagggctgtattatgatcctaattcccaatattattataacagcctgactcaacagtacctgtactgggatggggaaaaagagacatacgtccccgctgcggagtcgtcttcacatcagcagtctggattaccacccgcaaaggaagggaaagagaagaaagaaaaacccaagtcaaagacagcccagcagatagcaaaggacatggaacgctgggctaaaagccttaataaacagaaggaaaacttcaagaatagttttcaacccgtaaactcgcttcgggaggaagaacgcagggaaagtgcggctgctgatgcaggatttgccctgttcgagaagaaaggggctttggccgaaagacagcagctcatcccagagctggtacgcaacggggacgaagagaatcccctgaaacgcggattagttgccgcatactctggcgacagcgataacgaggaggagcttgtggaaagattggaatcagaagaagagaagctggccgattggaagaagatggcttgcctactgtgtcggcgtcaatttcctaataaggacgctttagtccgtcaccaacagctgtccgacctacacaagcagaacatggacatatatcggcgaagtcgcctttccgaacaagagctcgaagctttggaactcagagagcgcgagatgaaatatagagaccgcgctgccgaacgtagagagaaatatggtatcccagagccccctgaaccaaaaagaaagaaacagttcgacgccggaacggttaattacgaacagcccacaaaggatggaatcgaccattccaatattggcaacaagatgctccaggcaatgggatggagagaggggtctgggctcggtaggaagtgtcaagggatcaccgctccaattgaggcccaggtgaggctgaaaggggctggtttaggagcaaagggttctgcatacgggctgtcaggagccgatagttataaggatgctgtaagaaaagcgatgttcgcgcgttttacggaaatggagtag

SEQ ID NO: 24195 - DNA, 3372 bp, Artificial Sequence
  Description of Artificial Sequence: Synthetic coding sequence
atgtggggggacagccgcccagcgaatcgtactgggccattccgcggtagccaagaagagcgcttcgccccagggtggaatcgggactacccacctcccccactcaagtcgcacgcccaggagagacatagcggaaattttccaggcagagactcgctaccctttgacttccaaggacattccggaccaccgttcgccaacgtggaagagcattcgttctcctacggcgctcgcgatggaccccatggggactacaggggcggagagggcccaggacacgacttcagaggcggtgatttcagctcttcagacttccagtctagggactcatctcagctggacttcagagggagagatattcatagcggcgattttagggatcgggagggtcccccaatggactatcgcggaggagacggcacatcgatggactatcggggaagggaggctccccatatgaattatcgggatcgggatgcccatgcagttgatttccggggtcgtgacgccccacctagtgacttccgtggccgtggaacctatgatctagacttcagggggagagatgggtcacacgctgactttcgtggcagggacctgagcgacttggatttccgagcacgggagcagtctcggagcgatttcagaaatcgcgatgtaagcgaccttgattttcgggacaaagacggcacgcaggtagactttcgagggagaggatctggaaccacagacctggattttcgggatagggacacgccacattctgactttcgcggacggcaccgctcaagaaccgatcaagactttcgaggacgggagatgggcagctgtatggagtttaaggaccgcgaaatgccccctgttgatcccaacatcctcgattatatccaaccatctacccaggatcgggagcatagcggaatgaacgtcaataggagggaagagtcaacgcacgaccacaccatagagaggcccgcattcggaatccagaaaggcgagtttgagcacagcgagacacgggaaggagagacacagggcgtggccttcgaacacgaatccccagctgacttccagaacagccaatctcccgtgcaggatcaagataagtcacagttgtctggacgcgaagagcagagctctgatgcagggctgtttaaagaagaaggcggacttgatttcttggggagacaagataccgattacagatccatggaatacagagatgtggatcacagactccccggatcccagatgtttggatacggacaaagcaagtccttccccgagggcaaaaccgctagagatgctcaacgcgacttgcaggatcaggactaccgcacaggccctagcgaagaaaagccttccaggctgatcagactatccggcgtgcctgaagacgcaaccaaggaagagatcctcaatgctttcagaacccctgacggcatgcctgtgaagaacctgcaactgaaggagtacaatactggatacgattacggctacgtctgcgtggagtttagtcttttagaggacgccatagggtgcatggaggccaaccaggggacccttatgattcaggataaggaagttaccctcgaatacgtgtcttccctggatttttggtattgcaagcgatgcaaggccaacatcggaggccatcgctctagttgttcattctgcaagaaccctagagaggtaaccgaagccaagcaggagctcatcacctacccacagccgcaaaagactagcatccccgctcctttagagaagcagccaaatcagcccctcagacctgcggacaaagagcctgaaccaagaaagagagaggaaggccaagagtccagactgggtcaccagaaacgggaagctgagcgttacctgccgcctagccggcgtgaggggcctacctttcggcgtgaccgggaacgcgagagctggagtggagagaccagacaagacggagagagcaaaacaattatgctgaagaggatataccggtcgactcccccagaggtgatcgttgaggtgttagagccatacgttcgtctaacaaccgccaacgtgaggattatcaagaaccgtaccgggccaatggggcacacatatggctttatcgatctggacagtcatgctgaagccttgcgggtggtgaagattctgcaaaatctggacccaccgttctccatcgacggaaaaatggtggctgtcaatctcgccaccggaaaaagacggaatgatagcggcgaccacagcgaccacatgcattactaccagggcaaaaagtattttcgcgatcggcgtggcggtggcaggaatagcgactggagctccgacaccaacagacagggccaacagtctagtagtgattgttacatctatgacagcgccacgggttactactatgatcccctggccggaacatactacgaccctaatacccagcaggaagtgtatgtgccgcaggacccagggttgcccgaagaggaggagataaaagaaaaaaaaccaacaagccagggcaaatcaagttccaagaaagagatgagtaagcgagacggtaaggagaaaaaggaccgaggggttactcggtttcaggaaaacgcttccgagggaaaggcccctgccgaggacgttttcaagaaacctctgccccctacggtgaaaaaggaagaaagccctcctccccctaaggtcgtaaatcctttaataggcctgcttggagagtatgggggagactcagactatgaggaagaggaagaggaggagcaaaccccacccccacaaccccgaactgctcagccacagaagcgggaggagcaaacaaaaaaggagaacgaggaggacaagctgacagattggaacaagctcgcatgcctgctctgccgacgtcagtttcccaataaggaggtactgatcaaacaccagcaactctcagacctacacaaacagaatcttgaaatccatcgcaagatcaagcagtccgagcaagagctggcatacttggagagaagagagcgtgaggggaaatttaagggcagagggaatgaccgaagggagaaactccagagcttcgactccccggagaggaaaaggatcaagtattctagagaaaccgacagcgaccgtaaattagtcgacaaagaagacatcgatactagttcgaagggaggatgcgtacaacaggcaacaggttggcgcaaggggaccggcttgggatatggccatcccggtttagcaagcagtgaggaagccgagggtaggatgagggggcctagtgtcggagcttctggcagaacaagcaaaaggcaaagcaacgagacttaccgtgacgccgtgcgcagagtgatgtttgctcggtacaaagaactggactag

SEQ ID NO: 24196 - DNA, 429 bp, Artificial Sequence
  Description of Artificial Sequence: Synthetic coding sequence
atgtggggcgactcaaggcccgctaacaggactggcccttttcgtggcagtcaggaggaacggtttgctccgggttggaatcgggactaccctccccctccacttaagtctcacgcgcaggaaagacatagcggaaacttccccggacgtgatagtctgccctttgactttcaaggccacagcggcccaccattcgcaaacgtggaagaacattcattcagctacggcgcacgcgacgggccacacggcgattacagaggcggtgaaggcccaggacatgacttccggggtggggatttcagtagcagcgacttccagagtagggactctagccagcttgatttccgaggaagggatatccacagtggggactttagagacagagagggtcctccaatggactaccggggaggggacggtaccagctag

SEQ ID NO: 24197 - DNA, 1806 bp, Artificial Sequence
  Description of Artificial Sequence: Synthetic coding sequence
atgatccaggacaaagaggtgactttggaatacgtcagcagtctggacttttggtactgcaagcggtgtaaagcaaatattggtggccatagatctagctgctctttttgtaaaaatccacgcgaagtgacggaggccaagcaggaattgatcacgtatccacagccccagaagacaagtatcccagcgccactggaaaagcagcctaaccaacctttaaggcccgctgataaagagcctgagcctagaaaacgtgaggaaggtcaggagtcacgcctcggccaccaaaagagggaggcagagcgttacctgcctccctcccggagagaaggcccaactttccgtcgggatcgggagcgtgagagctggagtggagaaacacgtcaagacggggagagtaagactatcatgctcaaaaggatctaccggagtacaccaccggaggttattgtcgaagtgctagagccatatgtcagactcacaaccgcaaatgtccggattatcaaaaaccggacaggccctatgggccacacctatggtttcattgacctggattcacacgccgaggccctccgtgtcgtgaagatactgcagaatttggaccctccctttagtattgatggcaagatggttgctgtgaatcttgctactggaaaacgcaggaatgactccggcgaccacagtgaccacatgcactactaccagggaaaaaagtatttccgagataggaggggcggaggcagaaacagtgattggtcttccgataccaatcggcaagggcagcagagttcctcagattgttatatctatgactctgcaacgggctactactatgatccactggctggaacatactacgaccctaacacgcagcaggaagtttatgtgccacaggatcccggacttccggaagaagaagaaatcaaggagaaaaagccaacttcacaaggaaaaagctccagtaagaaggaaatgagcaaaagggacgggaaggaaaaaaaggacagaggcgtgacgaggtttcaggagaacgcttcagaagggaaggctcccgcagaagatgtcttcaaaaagcccctgccacctacagtaaaaaaagaagagagcccaccgcctcctaaagtcgtaaatcccctgattgggctgttaggcgaatacgggggtgattccgactatgaggaggaggaggaggaagagcagacgcccccaccacagcccagaactgcccagccgcaaaagcgggaggagcagaccaaaaaggagaacgaggaagataaacttacagattggaacaagctggcttgcttattatgtcgacgtcagttcccgaacaaggaagtgctcataaaacaccaacagttatccgatcttcataagcagaatcttgagatacacagaaagatcaagcagagtgaacaggaattggcttacttggagcgtcgggaaagggaaggcaagttcaaggggaggggcaacgacagacgcgaaaagttacagagtttcgactcccctgaaagaaagaggatcaaatactccagagagacagacagtgacagaaagttggtggataaagaggacatcgacacctcttcaaagggaggatgcgtacagcaagcaacagggtggagaaagggcaccggtcttgggtatggccatcctggcctggcttccagcgaggaagccgagggtcgcatgcgcggaccatccgtgggtgctagcggacggacatctaaaagacaaagcaatgaaacataccgcgatgccgtcagacgtgtgatgttcgccagatataaggagcttgattag

SEQ ID NO: 24198 - DNA, 1563 bp, Artificial Sequence
  Description of Artificial Sequence: Synthetic coding sequence
atgtggggggatagtcgtcccgctaaccgtacgggtcctttccgaggcagtcaggaggaacgctttgccccagggtggaaccgagactaccccccacccccactcaaatctcacgcccaggagaggcactctgggaactttcctggtcgggattcactcccatttgatttccaggggcactcagggccacctttcgcgaacgtcgaagagcattctttcagctacggcgctcgtgacggccctcacggtgattatcggggaggcgagggacccggacacgacttcaggggcggtgacttctccagcagcgacttccagagccgtgactcttcccaactggatttcagggggagagatatccattccggggacttcagggatcgggaaggcccaccaatggactatcgaggaggggatgggacctctatggactatcgcggtcgggaagcccctcatatgaattatagggatagagatgcccacgctgttgatttcaggggtagggatgccccaccgtctgacttcaggggaagagggacctatgatctggatttcaggggacgcgacgggtcgcacgccgacttccgaggacgagatctgagcgacctggatttcagagccagagaacagagccggagcgattttcgcaacagggatgtgagtgaccttgattttcgagacaaggacggcacccaagtagacttcagaggcagaggaagcgggaccaccgatttggacttcagggacagagacacaccccacagcgacttccggggacgacacagatctcgaactgatcaggatttcagaggtagagagatgggttcttgcatggaattcaaagatcgagagatgccccctgtggaccccaatattctggattacatccaaccatctacccaggaccgggagcatagcggaatgaatgtcaaccgccgagaagaatccacacatgaccatacaatagagagacccgcatttggcatccagaagggtgaatttgagcatagcgaaaccagagagggagaaacacaaggtgtggcttttgaacatgagtccccggctgattttcagaattctcaatcccccgtgcaggatcaggacaaatctcaactgtccggcagggaggaacaatcttccgatgctggcctgttcaaggaagagggcggtctggactttctcgggaggcaggatacagattatcgatctatggagtatcgagatgttgatcacagactgcccggttcgcagatgtttggttatggccagtctaagagctttccggagggtaagacggccagagatgctcagcgagacctgcaagatcaagactatagaaccgggccatccgaggaaaagcctagccgactgataaggctttcgggcgtccccgaggatgctaccaaggaggagatcctgaacgcctttcgcacacctgatggcatgccagtcaagaacctgcaactgaaggaatataacacaggtaactcgaacgaccccggtcaacggtcatatccgggtgtgtgtatcaaacccggattcctggttctccagactatgtag

SEQ ID NO: 24199 - DNA, 231 bp, Artificial Sequence
  Description of Artificial Sequence: Synthetic coding sequence
atgtggggagactctcggccagcgaatcgtactggaccatttcggggatctcaggaggaacgttttgccccaggatggaaccgagactaccccccacccccacttaagtcacacgctcaggaacgacattccggcaatttccctggcagggattcactgccattcgatttccagggacactcaggacccccatttgccaacgtcgaggagcattcttttagctatggctag

SEQ ID NO: 24200 - DNA, 1806 bp, Artificial Sequence
  Description of Artificial Sequence: Synthetic coding sequence
atgattcaggacaaagaagtgaccctcgaatacgtcagcagcctcgacttttggtattgtaaaagatgcaaagctaacatcggtgggcaccggtcctcctgctctttctgtaagaatcccagggaagtgaccgaggcgaagcaggaattaattacctatccacagcctcagaagacctcaatacctgcacccctggagaagcagccaaatcaacctctacgtcctgccgacaaagagcctgagccgagaaagcgggaagagggtcaggaatctcgcctaggacaccagaaacgcgaagctgaaaggtaccttcccccaagcagacgggaagggcctacattccgccgagaccgggagcgcgaaagctggtccggagagaccaggcaggatggcgagagcaagactataatgctgaaaaggatttacaggagtacacccccagaagtgatcgtcgaagtgctggagccatatgtgcggctgacaaccgcaaatgttaggatcatcaagaatcgcactggtccgatgggccacacttatggattcattgacttggacagccatgcggaagctctgcgcgtggtcaaaatcttacagaacctggaccccccatttagtattgacggaaagatggttgcagtcaatctagccacaggcaagagacgaaatgacagcggcgaccactctgaccacatgcactattatcagggcaagaaatactttcgcgatagacgcggtgggggacgaaactccgactggagctcagatacaaaccgccaggggcaacagagcagcagcgactgctatatctacgactccgccaccgggtactattacgacccactggctggtacatactacgaccccaatacccaacaagaagtgtacgtcccacaggatcccggactgccagaggaggaagaaatcaaagaaaagaagcccacttcacaagggaaatcttcgtccaagaaagagatgtccaagagagatggcaaggagaaaaaagacagaggcgttacacggtttcaagagaacgcctccgagggcaaggccccagccgaagacgtctttaagaagccattacctccaactgtcaaaaaagaagaatcccccccaccacctaaggtggtgaacccactgattgggttattgggagagtacggaggtgattctgattatgaggaagaagaagaagaggaacagactcccccaccccagccacgcacagcacagccccagaagcgtgaggaacagaccaagaaggaaaatgaggaagacaaactcactgattggaacaaattggcttgtctgttgtgcagacggcagttcccaaataaagaggtactcataaaacaccaacaactgtcagatctgcataagcagaatctggagattcaccggaaaattaaacaatctgaacaggagttagcttacttggagagacgcgagcgtgaaggcaagttcaagggccgtggcaacgaccggagagagaagctgcagagttttgactcccctgaacggaagcgcattaagtattctagggagacggacagcgaccggaagctggttgataaggaagacatcgacacttcgagcaagggcggttgtgtccagcaggcgacagggtggcgcaaaggcaccggccttggatacggccacccaggtttggccagtagtgaggaggccgagggcagaatgcggggacccagcgtcggcgcatcaggcaggacttccaagcgacaatctaacgaaacctacagagatgccgtacgccgtgtcatgtttgccaggtacaaagagctcgactag

SEQ ID NO: 24201 - DNA, 2976 bp, Artificial Sequence
  Description of Artificial Sequence: Synthetic coding sequence
atggattaccgaggtggcgatggtacgagtatggactaccgcggaagagaggctccgcatatgaactaccgggatagagacgcccacgccgtggatttccgaggacgagatgccccaccatctgattttcgagggagagggacatacgatctcgatttccggggacgcgacgggtcacatgcggacttcaggggacgagatctgtcagatctggacttcagggcccgtgagcagagccgatccgactttcgtaatagagacgtgtcggacttggattttagggataaggatggtactcaagtagacttccgcggaagggggtcagggacaaccgatctagattttcgggatcgggacacaccccactcagacttcagagggcgtcatcgatcacggaccgatcaggactttcggggtagagagatgggctcctgcatggaattcaaagatcgtgagatgccccctgtggaccccaatattctggattacatacaaccttcaacccaggaccgggagcactccggaatgaacgttaaccgacgcgaagaatctacacatgatcatacaatcgaaaggcccgctttcggtatccagaagggggaatttgagcactccgaaactcgcgaaggagaaactcaaggtgtagcttttgagcacgagagtcctgccgacttccagaactcacagtcaccagttcaagaccaggacaaatcccaattatccggtagagaagaacaatctagtgacgcagggctcttcaaagaagagggcggtttggacttcttgggacggcaggacaccgattatagaagcatggagtatagagatgtggatcatagactccctggctctcagatgtttggctatggccaaagcaagagcttcccagagggaaagacagctagagacgcccagcgggacttgcaggaccaggactatcggacgggaccttcagaagagaagcccagcaggctaatccgcctgagcggggtgccggaagacgctacaaaagaagagatactcaacgcattcagaaccccagacggtatgccagttaaaaacttgcagttgaaggaatataacactgggtatgattacggctacgtttgtgtggagttctctctccttgaggacgcaataggttgtatggaggcaaatcagggtactctgatgatccaggacaaggaggtgacgcttgagtatgtgtcctcgctcgatttctggtattgtaaaaggtgcaaagccaatatcgggggacaccgttcatcttgctcattctgtaaaaatccacgagaggtaaccgaagccaagcaggagctgatcacataccctcaaccacaaaaaacatctatccccgctcctctggagaaacaacccaatcagcctctgcgtccagcagataaagaacctgagccacggaaaagggaagaaggtcaagagtctcgcctggggcatcagaaacgggaggccgagcggtacctacctccttccaggcgcgaaggaccaacattcagaagggaccgtgaacgcgaaagctggagcggggaaaccagacaagatggggaatctaaaaccatcatgctgaaacggatttatagaagcactcccccagaagtgatcgtggaggtgctagagccttatgtgcgtctcactacagcaaatgtacgtattattaagaatcgcaccggaccgatgggccatacatatggttttattgacctggactcccatgccgaggccctccgcgtggtgaagattctacagaacctggacccaccctttagcatcgatgggaagatggtggccgtaaacttggccaccggcaaaagacgcaatgactccggggatcattccgatcacatgcactactaccagggaaaaaagtacttccgtgataggcgaggcggtggaagaaacagcgattggtctagcgacaccaacagacagggtcaacagagcagctctgactgttatatttacgactctgcgactggatactattatgatcctctagcaggcacatactacgatcctaatacacagcaggaggtatacgtcccacaggatcccggactgcctgaggaggaggaaatcaaagaaaagaagccaaccagtcagggcaagtccagtagtaagaaggaaatgagcaagagggacggcaaagagaagaaggaccgtggagtgacccggttccaggagaacgctagcgagggcaaggctccggctgaggatgtttttaagaagcctctccctccaactgtcaagaaagaagaatctccacctccaccaaaggtcgtgaaccctcttatcggcctcttgggagagtacgggggagactcagattacgaagaggaggaggaggaagagcagactcctcccccacaaccccgaactgcccaaccccagaagagagaggaacagaccaagaaagaaaacgaggaggacaagttgaccgattggaacaaattggcctgcctcctgtgcagaaggcagtttcccaataaggaggtgctgattaagcaccagcagctcagtgaccttcataagcaaaatctggaaatccataggaaaattaagcagtcagagcaggagctggcctatctggaacgcagggagcgggagggtaagtttaaaggtcgcggtaatgatagacgtgaaaagcttcagagcttcgactccccagaaagaaagagaatcaaatacagccgcgagacagactctgaccgaaaattagtggacaaagaggatatcgataccagtagtaagggtggttgtgtgcagcaggccacaggatggagaaagggcacgggcctgggatacggccatcccggactggctagttcagaagaggctgagggacgcatgagagggccatcagtcggcgctagcggacggacgagcaaacggcagtcaaatgagacgtaccgcgacgccgtgcgaagagttatgtttgcgcgatataaggaactggattag

SEQ ID NO: 24202 - DNA, 1398 bp, Artificial Sequence
  Description of Artificial Sequence: Synthetic coding sequence
atgctgaaaagaatatacagaagcaccccacccgaggtaattgtcgaagttttggagccctacgtgcgactgactacagctaacgttaggattattaagaatcgcaccgggcctatgggccacacatacggatttatcgacctggattctcacgctgaagccctcagggttgtaaaaatattacagaatctggatccccctttttccattgacgggaaaatggtggctgttaacctggccactggcaagaggcgtaatgactcgggcgatcacagcgatcacatgcactactaccagggcaagaaatattttagggaccgtcgaggcggagggcgtaactcagattggtcctccgataccaaccgacagggccagcagagcagtagcgattgttatatttacgactctgccaccgggtattattacgatccgctcgctggtacttattatgaccccaacacccagcaggaagtgtacgtgccccaggatccagggttgcctgaagaggaggaaatcaaagagaaaaagccaacaagccaagggaagtcctcttctaagaaggagatgtccaaacgggatggcaaagaaaagaaggatcgcggagttacacgctttcaggagaacgcctcagaaggcaaggctccagctgaggacgtgttcaaaaagccgcttccccctacagtaaaaaaggaagaatccccccctccccctaaggtagttaaccctctgatcggcttgcttggcgagtatggaggcgatagcgattacgaggaggaggaggaggaggagcagacacccccaccacagcctaggactgcccagccacagaaacgggaggagcagactaagaaagaaaacgaagaagataagctcactgattggaacaagctagcctgcctgctctgccggagacagtttcccaacaaagaagtgctgatcaagcaccagcaactgtccgatctccacaagcagaatctggagatccatcggaaaatcaagcagtctgagcaggaattagcttacttagaacggcgagagagggagggaaagtttaagggacggggaaacgacaggagggagaagctgcaatctttcgacagtccagaacgaaaaagaatcaagtactcccgcgaaaccgactcagacagaaagctggtcgacaaggaagatatcgatacctcaagcaaaggcggttgcgtgcagcaggccaccggctggaggaaaggcaccggacttggatacggccatcccggtcttgctagctccgaggaagcggaggggagaatgagaggcccatcagtgggagcatccggtcgaacttccaaaaggcagtccaatgagacctatagagacgcagtgagacgggtaatgtttgccagatataaagagctggattag

SEQ ID NO: 24203 - DNA, 1173 bp, Artificial Sequence
  Description of Artificial Sequence: Synthetic coding sequence
atggttgaggcagatcgccctggaaagctgttcatcggcggactgaataccgaaaccaatgagaaggcattggagactgtgtttgggaagtacggcagaattgttgaagttttgctgataaaggatagggagacgaacaagtcccggggattcgcctttgtgacctttgaaagtcccgcagacgccaaggatgctgctagggatatgaatgggaaatctctggatgggaaggcgatcaaagtcgagcaggcgaccaagcctagtttcgagaggggcagacatggccctccccctccccctagatccagaggaccaccaaggggttttggtgccggaagaggcggaagcggtgggacccgaggacccccttcaagaggaggacacatggacgatggtggatattctatgaattttaacatgagttcgagtcgaggacctttaccagttaagcgcggacccccacctaggtctggaggccctagtcctaaacgaagcgctccttccggcctggtgcgctcctcatcaggcatgggcggaagggcccctctgtctcggggaagagactcctatgggggtccgccacgtagggagcctctgccctcaagacgcgacgtgtatctgtccccccgtgacgacggatatagcacaaaagattcatacagctctagggactacccaagcagccgcgacacaagagattacgcacctcctccgagggattacacatatcgtgattacgggcatagttcttcacgtgacgattatccttcccggggatacggggaccgggacggctatggacgagaccgggactacagcgaccacccttctggaggctcctaccgggattcctacgagagctacggaaactcacgctcagctccactcacgcgcggacccccaccgagctatgggggatcgtcaagatatgacgattattcctccagcagggatggctacgggggttctagagactcttactcatcctccaggagtgatctctactcctcctgcgaccgggtcgggagacaggagagagggctccccccttccgtggagagggggtatcctagctcgcgggactcatatagcagctcgtcccggggagccccacgtggcgcaggcccaggtggcagtcggtctgatagagggggtggtagaagtaggtattag

SEQ ID NO: 24204 - DNA, 1173 bp, Artificial Sequence
  Description of Artificial Sequence: Synthetic coding sequence
atggtggaggccgacaggcctgggaagctctttattgggggtctgaacacggagaccaatgagaaggccttggagaccgtcttcggcaagtacggacgaattgtcgaggttcttctcataaaggacagggaaaccaataagagcagaggcttcgctttcgtcacttttgagagccccgctgatgccaaggacgctgcacgggatatgaacgggaaatcgctagatggaaaagctattaaggtggaacaagctacaaagccttccttcgagaggggccgacatggcccaccccctccaccgaggagccggggacccccaagggggtttggggctggacgcggagggtcagggggaacgagaggtcctcctagccgcggtggacatatggatgatggaggctacagcatgaattttaatatgagcagtagccggggtcccttgccggttaagagaggcccaccccctagatcagggggacctagtccaaagagatctgcacctagcgggttggtcagatcctcctccggtatgggcggacgtgctcccctctcacggggtagagactcctacggagggccaccacgacgggaacccctgccatctcgccgtgatgtgtatctgtcgccacgggatgatggctatagcacaaaggacagttattcaagcagagattacccgagttctagagatactcgcgactatgcaccacccccaagagattacacttaccgtgactacggacacagctccagcagagatgactatccaagtaggggctatggcgatagggatggttacgggagggatcgcgattatagcgatcacccgagcgggggttcctatcgcgactcttacgaaagttatgggaattctaggtccgcaccactgacgcggggacctcctccgtcttatggcggaagcagccgttatgatgactattccagcagtcgtgatggctacgggggatcgcgggacagctatagctcgagccgttccgacctgtattcttcctgtgaccgggtcggcagacaggaaaggggattacccccttcagtggagcgcggttatccctcatccagagactcctactctagttcctcccgtggagcaccaaggggggctgggccaggcggatcccggagcgatcgtggtgggggtaggtcacggtattag

SEQ ID NO: 24205 - DNA, 1491 bp, Artificial Sequence
  Description of Artificial Sequence: Synthetic coding sequence
atggtggaagcagatcaccccggtaaactgttcatcgggggattgaatcgcgagactaacgaaaaaatgttaaaagcggtgttcggaaaacatggacctatctctgaagtcctactgattaaggatcggacaagtaaatcacgcggatttgcgttcatcacgtttgagaacccagctgacgcgaagaacgctgccaaagacatgaatgggacatccctgcatggaaaagctatcaaggttgaacaggccaagaagccgtcttttcagagcgggggaaggaggaggcccccagcgtcatcacgcaaccggtctcctagcggatcactccgctctgccagaggtagctccggtgggacacgcggatggctgccaagtcatgaaggccacctggatgatggcggatacactcccgatttgaagatgtcatactccagaggcctgatccctgtgaaacgcggaccatcctccaggtcagggggaccccctcctaagaagagcgctcccagcgccgtggctagatccaactcatggatgggctcccaagggcctatgagccaacggagagaaaattacggcgttcccccaagaagagctacaatctcgagctggcggaacgatcgaatgtctacccgccatgatggttatgccaccaacgacggaaaccatccctcttgtcaggagactcgagattacgcccctccatccagaggctacgcctaccgggataatggacacagtaacagagatgagcactcatcccggggataccgcaaccacagatcctcccgagaaacgcgggattacgctccccctagccgaggccacgcgtacagagattacggacacagcaggagggatgagagttactctcgtggatatcgaaaccaccggtcctctagagaaactagagagtacgcacccccaagccgcggtcatgggtacagagactatggacatagccgtagacatgagtcatactctcgtggttaccgcaatcacccttcctctcgagagacgagagattacgcccctccccatagagattacgcgtatagggattacggccatagctcctgggacgaacacagctctcgtggatattcgtatcacgatggttatggtgaggccttgggcagagaccacagcgagcatctgtcagggtcttcataccgcgacgcactgcagcgttatggcacgtcccatggcgctcctccagctcgtggcccacggatgtcctatgggggatccacatgtcacgcctactcaaatacccgagatcgctacggacggtcctgggaaagctacagctcctgtggagatttccactattgcgaccgtgagcatgtatgcaggaaagatcagcggaatccgccttccctcggcagagttttgccggatccacgcgaggcttatggcagcagctcttatgtggccagcatcgtggatggcggagaaagccgatctgaaaagggcgactcgtcaagatattag

SEQ ID NO: 24206 - DNA, 1380 bp, Artificial Sequence
  Description of Artificial Sequence: Synthetic coding sequence
atggtggaggcggaccatcccggaaagttgttcatcggaggtctgaacagggaaaccaatgaaaaaatgctgaaagccgtcttcggaaagcacggaccaatctcagaggttttgttgatcaaggatcggaccagcaagagcaggggcttcgctttcataacattcgaaaaccctgccgacgccaagaatgccgctaaggatatgaacgggacctccttacacggaaaagctatcaaagttgaacaagccaagaagccatctttccaatctgggggacgcaggagacctccagcatctagtagaaatcgtagccccagcggttcgctcagatcagcacgaggatcctccgggggtactagaggatggctgcctagccacgagggtcaccttgacgatgggggatatacccctgacctcaagatgtcctactcccgaggactgatccccgtcaagcggggtccttcatcgagatcaggtggtcctcctcccaagaaatccgctccatctgccgtagcccgaagcaactcttggatgggaagtcagggccctatgagccagaggcgtgaaaattacggcgtccccccaagacgtgcaaccatttcatcttggagaaacgaccgtatgagcacgaggcatgacggatatgcgacaaatgatgggaaccatccatcttgtcaggagactcgagactacgcccctccttctagaggctacgcatatagggacaacggacactctaacagagacgagcactcatcccgcggatataggaatcacagatctagtcgagagaccagggactatgcaccaccaagtcgtggacacgcctatcgtgattacggccattctaggcgggacgaatcttactcgaggggttatagaaatcacagatccagtcgagaaacacgtgaatacgccccaccgagtagagggcacggataccgggactatggccactccagacgacacgagtcttatagtagaggatattcttaccacgatggctacggagaagcattgggaagagaccactcagaacacttgagcggctctagttatcgagatgccctgcagagatacggcaccagccacggggcacctcctgccagagggcctcgcatgtcatatggcggatcaacatgtcacgcttattcaaacacccgggaccgatacggtcggagttgggaatcctactcaagctgcggcgacttccactattgtgacagggagcatgtttgtagaaaagatcagagaaacccccctagcctggggagagtgttacccgatccgcgagaggcctacgggtccagcagctacgtggccagcatcgtggacgggggagagagccgctctgagaagggcgattctagccggtattag

SEQ ID NO: 24207 - DNA, 1491 bp, Artificial Sequence
  Description of Artificial Sequence: Synthetic coding sequence
atggtggaagcagatcatcctggcaagctgttcattggtggccttaacagggaaactaacgagaaaatgctcaaggcagtgttcggaaaacatgggccaatttccgaggtgctcctcataaaggatcgcacaagcaaaagcaggggcttcgcctttatcaccttcgagaaccctgccgatgccaaaaacgcggctaaggacatgaacggaacaagtctccacgggaaggcaatcaaagtcgaacaggctaagaagccttctttccagtctgggggaagacgcaggccacccgcttcctcgcggaatcgcagccctagcgggtcactgcgatccgccagaggcagcagcgggggaacacggggttggctgccttcccacgaagggcacctcgatgatggtggctatactccagatcttaaaatgagttattctcggggactgattcctgtgaagagagggccttctagtcggagcggaggaccacctcctaagaaatcagcaccctcagccgtcgctcgcagcaattcttggatggggagccaggggccaatgagccaacggcgtgagaactatggcgtacctccacgcagagcaactatatcttcatggaggaacgatagaatgtccactagacatgacgggtatgctacaaatgatggcaaccaccctagttgccaggagactcgtgattacgcgcctccctccagaggctatgcgtaccgagacaatggacatagcaacagagacgagcacagttctagaggctatcgtaatcaccgatcctcccgcgagacaagagactacgcaccgccatctcggggtcacgcttatagggactacggccattcgaggcgcgacgagtcttacagccgcggatatcgcaaccaccggtcaagccgggagactcgcgaatatgccccacccagccgcggtcacggctatcgggactatgggcatagccggagacatgagtcttactcaagaggataccggaaccatccctccagccgcgaaacacgggactacgcacctccccatcgagactacgcctatcgggactacggccatagttcttgggacgaacattccagcaggggctacagttaccacgacggatacggagaggcacttgggcgagatcattccgaacacctgtccggtagctcatatcgcgacgcactgcagcgctacgggacatcgcacggtgcccctcctgcaagaggtccccgtatgtcctatggcggtagtacatgccatgcatatagtaatacccgtgatagatatggtcgctcttgggaatcttactcctcatgcggcgactttcactactgtgaccgagaacacgtgtgtcgcaaagaccagaggaaccccccttcgttggggcgagtgcttccagaccccagggaagcatatggtagtagtagttacgtcgcgagcattgtggacgggggagagtccaggtccgagaagggagactcatctcgatattag

SEQ ID NO: 24208 - DNA, 1491 bp, Artificial Sequence
  Description of Artificial Sequence: Synthetic coding sequence
atggtcgaggccgatcaccctggcaagttattcataggtgggctgaatagggagacaaatgaaaaaatgctgaaagccgttttcggaaaacatggacctattagtgaggtcctattaatcaaggaccgaacctcgaagtcgcgcggattcgcatttattacatttgaaaatcccgcagacgcgaaaaatgctgctaaagatatgaatggcacctcactgcacggcaaagccatcaaggtcgagcaagctaaaaagccgtccttccagagcggtggccgacgcagaccacctgccagttcccggaaccggtctccctcagggtctctacgttccgcgaggggcagctcggggggaacccgtggctggctgccctcacatgagggtcacctggacgatggaggatacacacccgatctgaaaatgtcatacagccggggattaattcccgtcaaaaggggtccaagctctcgcagcggaggaccaccaccaaagaagagcgccccttcagcggtagccaggtcgaactcttggatggggagccagggtccaatgagtcaaagacgcgaaaactatggcgtgccccctcgccgtgctacgatatcaagctggaggaacgataggatgtctaccaggcacgacggatatgctacaaacgatgggaatcatccttcctgtcaggagacacgtgactatgcacctcctagccgcggttatgcctatagggataacggccatagcaacagggacgaacacagttctcggggataccggaaccatagatcttctcgagaaacccgcgactatgctccacccagccgaggtcatgcatatcgcgactatggccactcacggcgagacgaatcttactccaggggctaccggaaccatcgttcaagcagggagacgcgggaatatgcccctcctagcaggggccatggttatcgtgactacgggcatagccgcagacatgaatcttattcaagaggctatcggaaccatccctcgtcacgcgagactcgggattacgcaccaccacatagagattacgcctacagggactatggtcactcgagttgggacgaacacagctcaaggggctatagctaccacgacggatacggcgaggcgcttggccgagaccattcagagcatctgtctggctctagttatcgcgatgccctgcaaagatatgggacatcacacggggctccgccagccaggggcccaagaatgtcatacggaggatcaacttgccacgcatactcaaatacccgcgacagatatggtaggtcctgggagtcctactccagctgcggggactttcactattgcgatcgcgaacacgtgtgcaggaaagaccagcgtaatccaccctctcttggacgagtgctgcctgacccacgggaagcttatggatccagttcgtatgtggcatcgattgtagacggaggagagtcacggtccgagaaaggtgactctagtagatactag

SEQ ID NO: 24209 - DNA, 1380 bp, Artificial Sequence
  Description of Artificial Sequence: Synthetic coding sequence
atggtcgaagcagatcatccgggtaaactctttatcggtggactgaatagagagacaaacgagaaaatgctcaaagccgttttcggaaaacatggaccgatctcggaggtgctgctgatcaaggacagaacgtctaagtccaggggctttgctttcataacattcgagaaccctgccgatgcaaagaacgccgctaaggacatgaacggaacttcgctgcacggtaaggccatcaaggtggaacaggcaaaaaagcccagctttcaatccgggggtaggaggcgccctcctgcctcttctagaaacaggtctccctccggaagcctgagaagcgccaggggaagcagtggcggaactcgcggatggttgccgtcacatgaagggcacttggacgatggtggatacactccagacctgaagatgtcatattcacgaggcttgattccggtgaaacggggaccgtcatccagaagtggaggaccccctccaaaaaaaagcgctccctctgcagttgcaagaagtaattcatggatgggcagtcagggtccaatgagtcagcggagagagaattacggcgtgcctcctcgacgtgcgactatcagctcatggcggaatgataggatgtctacccggcacgatggttacgcaaccaacgacgggaatcatcccagctgtcaggagactcgcgactatgcgcctcctagcagagggtacgcatatcgggacaatgggcacagtaatagggacgaacatagctcccgcggatatcgcaaccaccgctcttccagagagactcgtgattatgcccctccctcgcgaggccacgcttacagagactacggtcactctcgtcgcgacgaaagctacagtagaggctacagaaaccacaggtcaagccgcgaaacaagggaatacgcaccgccttcccgcggacatgggtacagggattatggccactctcgccgtcatgagtcctattcacgtgggtactcctatcatgatggctacggagaggcactcggcagggaccattccgagcacctatcgggttcttcttatcgggacgctttacagagatatggcactagccatggagcccctcccgctcgtggccctaggatgtcttatggcggaagtacatgccatgcttactctaacaccagagatcgctacggacggagttgggagtcttacagctcctgcggcgattttcattattgcgacagggaacatgtgtgcagaaaagatcaaagaaaccctccctctctcggcagggtgctgcctgatcctcgggaggcatacggatcaagcagctatgttgccagcatagtggatgggggagagtcacgttccgagaagggtgattcttcacgatattag

SEQ ID NO: 24210 - DNA, 1221 bp, Artificial Sequence
  Description of Artificial Sequence: Synthetic coding sequence
atgggcaaggtatggaaacagcagatgtatccccaatacgctacctactattacccccagtacctgcaggctaagcagagtctcgtcccagcccatcccatggcccctccatcccctagcactacctccagtaacaacaatagcagtagtagcagcaacagtggatgggatcaactgtccaagaccaatctgtacatccgagggcttccaccgcacacgacagaccaagatctggttaaactctgccagccatacggtaagattgtatcaacaaaagccatcctcgataagaccacaaacaagtgtaagggctatggattcgtagacttcgactcccctgcggcagctcaaaaggcagtgagtgccctgaaggctagcggcgtccaagcccagatggctaagcagcaggagcaggatccaactaatttgtacatcagcaatcttcccctgtccatggatgagcaagaactcgaaaatatgctcaagcccttcgggcaagtgattagtactagaatccttcgcgacagctccggaacatcccgtggagtgggctttgcaaggatggagtctaccgagaagtgcgaagctgtgattggtcatttcaacggaaagttcataaaaaccccccctggagtttcagcccctaccgaacccctgctatgtaagttcgcagatggagggcagaaaaagcggcagaaccccaataagtacataccaaatggcaggccctggcatcgtgaaggcgaggttcggctggcaggcatgactctcacatacgaccctaccactgctgctatccagaacgggttctaccccagcccctactccatcgccacgaatcggatgatcacacagactagcattactccgtacatcgctagccccgtcagcgcctaccaggtgcagagtcccagttggatgcaaccccagccttacatcttgcagcaccccggagctgtgctcactcccagcatggagcacacaatgagcctgcaaccagcaagcatgatttcacctctggcccaacagatgagtcatctgagtctggggagcaccggaacctatatgcccgctacctctgcgatgcagggtgcttatctacctcagtacgcacacatgcaaaccacggcagtgcccgtcgaagaggcttccggccagcagcaggtggcagttgaaaccagcaacgatcatagtccctacactttccaaccaaataagtag

SEQ ID NO: 24211 - DNA, 1260 bp, Artificial Sequence
  Description of Artificial Sequence: Synthetic coding sequence
atgggtaaggtttggaaacagcagatgtaccctcagtacgctacatattattaccctcagtatctgcaggcgaagcaatcactggtccctgctcatcctatggcaccaccctcaccttcaactacaagctctaataataacagcagtagttcctctaattcagggtgggatcaactgagcaaaacgaacctgtatatccgaggcctaccgcctcacaccaccgatcaggaccttgtcaaactgtgtcaaccctacggaaagatcgtgtcaactaaggctatcttagataaaaccaccaataagtgcaaagggtatggcttcgtggatttcgattctccggctgctgctcagaaggctgtcagtgcattgaaggccagcggcgtccaggctcagatggccaagcagcaggaacaggacccaacaaatctttatatcagcaatctgcctctatccatggatgaacaggagctggagaatatgctgaaacctttcggccaggtcatcagcacacgtatccttagagattcaagcgggactagtaggggggtgggtttcgccaggatggagtccacagaaaagtgcgaggccgtgatcggacacttcaatggaaaattcatcaagactcccccaggagtgtcggccccaactgagcccttgctttgcaaattcgctgacggagggcagaaaaaaaggcagaatcctaacaaatatatccctaacggtcgcccatggcacagggaaggcgaggccggtatgacacttacctacgatccgaccacagccgctatccagaatggattctatcctagcccctactctatcgcaaccaatcggatgattacccaaacctctatcaccccctacatcgcttcccccgtttcagcttaccaagttgcaaaagagactcgggagaacaaatataggggcagcgccatcaaggttcagtccccatcctggatgcaaccacagccatacattctgcagcatcccggtgccgtactgacgcctagtatggagcatacgatgagcctgcagcccgcatcgatgatctcccctcttgctcagcagatgagtcatttgagcctcgggtcgactggaacctatatgccggcaaccagcgctatgcagggggcttatttaccgcagtatgctcatatgcagactacagcggtccccgtggaagaggcctctgggcaacagcaagtggccgttgagacaagtaacgatcatagtccttatactttccagcccaacaagtag

SEQ ID NO: 24212 - DNA, 1113 bp, Artificial Sequence
  Description of Artificial Sequence: Synthetic coding sequence
atggcacctccttcaccaagcacaaccagttccaataacaattctagttccagttctaactcaggctgggatcagctgtctaagactaacctctacatccgcggtcttccaccgcatactaccgatcaggacttagtgaagctctgccagccttacggaaagattgtttccactaaagccatattggacaagacaaccaataagtgtaagggatatggtttcgtagacttcgattcacccgcagccgctcagaaagccgtctctgcactgaaggcaagcggggtgcaagcgcaaatggctaagcagcaggagcaggaccccactaacctgtacatttctaatctgcccttatccatggacgagcaggagttagagaacatgctgaagccctttggacaggtcatctccaccagaatcttgagagatagcagcggtacttccaggggcgtgggtttcgctaggatggagagtaccgaaaaatgcgaagcggtaattgggcattttaatgggaagttcattaaaacgcctcccggagtaagtgcacccacggaaccgctcctctgcaagttcgcagatgggggacagaagaaaagacagaatcccaataagtacatcccaaatggcagaccatggcacagagaaggggaagctggcatgaccttgacatacgatccgacgactgctgctatacagaacggcttttatccgtctccctactctatcgcaacaaatcgcatgatcacccagacatctataaccccgtatatcgcttctcccgtctcagcctatcaggtgcagagtccctcctggatgcagccacagccgtacattctccaacaccctggggcagtgcttaccccgagcatggaacacacaatgtccttgcagccagcctctatgatctccccattggcccagcagatgagtcacctgtccctgggctctactggtacctacatgcccgcaactagcgccatgcagggggcttatctgccacagtacgcccacatgcagactactgctgtacctgtagaggaagcttcaggccaacagcaagttgctgtagagaccagtaatgaccactctccatataccttccaacctaataaatag

SEQ ID NO: 24213 - DNA, 1113 bp, Artificial Sequence
  Description of Artificial Sequence: Synthetic coding sequence
atggcccctccttctccatctaccaccagctcaaacaataattcctctagctccagcaactcaggatgggaccagctgtcaaagactaacctgtatatcagagggctcccaccccacaccaccgatcaggaccttgttaagctctgtcaaccttacggtaagatagtctccaccaaggcaatcctcgacaagacgaccaacaagtgtaagggatacggttttgtggactttgacagtccagctgccgcacaaaaagctgttagcgccctgaaggccagcggagtgcaagcgcagatggccaaacagcaggagcaggaccctaccaacctgtatatctcaaacctcccactcagtatggatgagcaggaactcgagaatatgcttaaaccattcggacaggtgatctctacacgtatcttgcgagattcgtctggaacatctagaggagtgggtttcgcacggatggagtctaccgagaaatgcgaggctgtgataggtcattttaatgggaaatttattaagaccccacctggcgtcagcgctcctaccgaacctctgctttgcaagtttgccgacggcggacagaagaagcgacaaaatcctaacaaatatataccaaacggcaggccctggcaccgagagggcgaggcgggaatgaccttgacctatgaccctaccaccgccgcaatccagaacggcttttatcccagtccctactctatcgctacgaatcgaatgattactcaaaccagtattacaccgtacatagcctcaccagtgtccgcctaccaggtgcaatcgccttcttggatgcagccacagccctatattctgcaacaccccggagcggttctgaccccctcaatggagcacaccatgagtcttcagccagcttctatgatcagcccgcttgctcagcagatgagccatctgagccttggcagtacgggaacctacatgccagcaacttctgctatgcagggagcttatttgccccagtatgcccacatgcagacaacagcggtcccggtggaggaagcttccggacagcagcaagtcgccgtggaaacaagcaacgaccattccccgtacacattccaaccaaacaaatag

SEQ ID NO: 24214 - DNA, 1113 bp, Artificial Sequence
  Description of Artificial Sequence: Synthetic coding sequence
atggcccctccatctccatccaccaccagcagcaataacaatagtagctctagttctaactctggttgggaccaactatccaaaactaatctgtacatccgcggtcttccgccacacaccactgatcaggacttggtcaagctgtgccagccatacggtaaaattgtgtccactaaagcaattttggacaaaactaccaacaagtgcaagggctacggttttgtggactttgacagtccggctgccgcacagaaagccgtctcggccctaaaagcatcaggtgtccaggctcagatggccaagcagcaggagcaggatcccaccaatctctacatctccaacctaccacttagtatggatgaacaggagctcgaaaacatgctcaagccgtttggccaggtaatcagtactcgaatcctgcgagattcttccggaacttcaagaggtgtgggctttgctaggatggagtccacggagaagtgtgaagccgtgataggccatttcaacggtaagttcatcaagactccaccaggtgtctcagctcccacagagcccctgctgtgcaaattcgctgacggcggacaaaaaaagaggcagaatcccaacaagtacatcccaaacggtaggccctggcaccgggaaggggaggccggtatgacacttacttacgaccctaccacggctgctattcaaaacggtttctacccctctccatatagtattgcaaccaataggatgatcactcaaaccagtataacaccttacatcgcatcccctgtttccgcatatcaagtccagtccccttcttggatgcagccccagccttacattctgcagcacccaggcgctgtcctgacacctagtatggagcacaccatgtccctgcaaccggctagcatgatatctccactggctcaacagatgagtcaccttagcctcggcagcaccggtacatacatgccggctacctcagccatgcaaggcgcatacttaccccagtacgcacatatgcaaaccactgctgtccctgtggaggaagccagtgggcagcagcaggtggctgttgagaccagcaatgatcactcaccctacaccttccagcccaataaatag

SEQ ID NO: 24215 - DNA, 387 bp, Artificial Sequence
  Description of Artificial Sequence: Synthetic coding sequence
atggctcccccttctcctagcacaacctcttcgaacaataatagctcatcctcctctaatagcggctgggatcaactgagcaaaacaaatttatatattcgcggactgcctccccataccactgaccaggacctggtcaagctgtgccagccttatggcaaaatagtttctaccaaggccatcctcgacaaaacaacaaacaaatgcaaaggatacggctttgtggacttcgattctcccgctgcagctcagaaggcggtctccgctctaaaggccagcggggttcaggctcagatggctaaacagcaggagcaggaccccacaaacctgtacatatccaacctgcctttatcaatggacgagcaggaactggagaatatgctttag

SEQ ID NO: 24216 - DNA, 1224 bp, Artificial Sequence
  Description of Artificial Sequence: Synthetic coding sequence
atgctattgtcagtgaccagccgccctggcatctccacctttggatataacaggaataacaaaaagccttatgtctccctagcgcagcagatggcaccccctagtccttccaattctacacccaatagttcctctggaagcaatggaaacgaccaactgtctaagaccaacctatacattaggggccttcagccaggcaccacagatcaggatctggtgaaactctgccagccctatggaaagattgtgagcacaaaggctattctagataagaccactaataagtgtaagggttacggcttcgtggatttcgactccccttcggcagcccagaaggccgtcacagcactgaaggcctctggagtgcaggcacagatggccaagcagcaggaacaggaccccaccaatctgtatatcagcaacctgccactgtccatggacgagcaagagctcgaggggatgctgaagccttttggacaggtgatatccacgaggatcctgcgggatacatctggtactagtagaggagttgggttcgctcggatggagtccaccgagaagtgtgaagcaatcatcacccactttaatggcaaatacatcaagactccacctggggtgcccgctccatcagatcctctgctgtgtaagtttgcagatggaggcccaaagaaaagacagaaccagggaaagttcgtgcagaacgggagggcctggcccagaaacgccgatatgggagtaatggccttgacatatgaccctaccaccgcccttcagaatgggttttacccggcaccttacaacattactcctaatcgcatgctggctcagtccgccctaagcccttacctctcatcccccgtctcatcctaccagcgagtgacccagactagtcccctccaggttcctaacccttcttggatgcaccatcacagttacctaatgcagccaagcggctcagtgcttacacccggaatggaccatcctatctctcttcagcctgcttccatgatggggcctctgacgcagcagcttgggcacctctctctttctagtacgggaacctacatgcctacagccgcagcaatgcagggcgcatacataagtcagtacacaccagtaccttcatcttccgtgagcgtcgaggaaagttcagggcagcaaaaccaggtggccgtagatgcgccaagcgagcacggggtatacagcttccaattcaacaaatag

SEQ ID NO: 24217 - DNA, 921 bp, Artificial Sequence
  Description of Artificial Sequence: Synthetic coding sequence
atgagtctaaaattacaggcatcaaatgtaaccaataaaaacgacccgaagagcattaacagcagggtgtttatcggaaatctcaatactgctctcgtgaaaaaatcagatgtagagacaatttttagcaagtatggcagagtggctgggtgtagcgtgcacaagggttacgccttcgtgcagtacagcaatgaacgacatgctcgcgctgctgttctaggagagaacgggagggttctggcaggacagactctggatattaacatggccggagagccaaagccggataggccaaaagggcttaagcgggctgccagtgcaatatacagcgggtacatattcgattatgactattaccgcgatgacttctacgacagactcttcgattaccggggaagactgtcaccagtcccggtgccgagagccgttcccgtgaaaaggccgagagtgactgtgcctttggtcaggagagtgaaaaccaatgttcccgtgaagctcttcgcacgatccacagccgtcactacttcaagcgctaaaatcaaactaaagagctcagagctgcaggctattaagactgaactgacgcagatcaaatcaaatattgacgcgttgctttctagattagaacagatagccgctgagcagaaggccaatccagacgggaagaaaaagggggatggagggggagctggcggaggcggaggagggggaggatctggcggtgggggtagcggtggcggaggcggtgggggatcctcccgccctcctgcccctcaggaaaacaccacctctgaggcagggctgccgcagggggaggcacgcacaagagatgacggcgatgaagagggcctcctgactcactcagaggaggaattggagcacagccaggacacagatgccgacgacggtgccctgcagtag

SEQ ID NO: 24218 - DNA, 873 bp, Artificial Sequence
  Description of Artificial Sequence: Synthetic coding sequence
atgagcttaaaactgcaggcgtctaacgtgacgaacaaaaatgatcccaagtctattaactcgcgggtgttcatcggcaacttaaatacagctctagttaaaaaatccgatgtcgagaccatcttttccaagtatggcagagttgccggttgctctgtccacaaagggtacgcctttgttcagtattctaatgaacggcatgctagagcagccgtactaggcgaaaacggcagagtgttagcagggcagaccctggatatcaatatggctggggagcctaaacctgaccgcccaaagggcttgaagcgagcagcgagtgcaatctacaggctttttgattatcgcggacggctctcccccgttcccgtgccacgagctgttcctgtgaaacgacctagggtgaccgttccactggtgaggcgagtaaaaactaatgtccccgtaaagctgtttgctcgaagtaccgcggtgactacatccagtgccaaaattaaactgaaatcatccgaacttcaggcaatcaaaacagagttgacccaaatcaagtccaatattgacgcgctattgtctcgtttagagcagattgcggctgaacagaaagcgaacccagatggaaaaaaaaagggggacggtggaggtgccggtggtggcggtggaggaggcggatctggtggcggagggtccggcggaggaggagggggtggaagctctagaccaccagctccacaggaaaacaccacatctgaggccggattgccgcaaggggaggccaggactcgggacgacggtgacgaggaaggtttattgacacactcggaagaggaactggagcatagtcaggataccgacgctgacgatggggctctgcaatag

SEQ ID NO: 24219 - DNA, 270 bp, Artificial Sequence
  Description of Artificial Sequence: Synthetic coding sequence
atgtcactgaaattacaggcgtccaacgtgacaaacaaaaatgaccctaaaagcattaattcccgcgttttcattggtaatctgaacacggcactcgttaagaaaagcgacgtggaaaccatcttctcgaagtacgggagggtggcgggatgctctgtgcataaggggtatgcgttcgtccagtactcaaacgagaggcacgcaagagccgctgtgctgggtgagaatggaagagtgctcgctggccagacccttgacatcaacatgtag

SEQ ID NO: 24220 - DNA, 714 bp, Artificial Sequence
  Description of Artificial Sequence: Synthetic coding sequence
atgagcctcaagctgcaggctagcaatgtcacaaacaagaatgatcccaaatcaatcaattccagagtgtttatcggaaaccttaacacagcactcgtaaaaaagtcagacgttgaaactatcttttccaaatacggtagagtggcaggatgtagcgttcacaaaggttacgccttcgtccagtacagcaacgaacgccatgctcgagccgcagttctaggggaaaacggtagagtcctcgcaggtcagactttggacataaatatggccggtgagccgaaacccgaccgacccaagggtttgaagcgcgcagcttcagcaatttataggctgttcgactatagaggtagattgtcacccgtccccgtccccagagccgtaccggtcaagcggcctagggtcaccgtgcctctcgtgaggagggtcaagacgaatgtacctgtcaagttgtttgctaggtccacagcagttacaacctcttccgccaaaataaagctcaagtcttctgagctgcaggctatcaaaaccgaactgacccagatcaaatctaatatcgatgcgctgctgtctagactggaacagattgccgcagaacaaaaggctaatcctgacgggaagaagaagggtgatggcggaggggcagggggaggcggtggcggtggcggatccggaggagggggatcagggggtgggggaggaggtggatctagctag

SEQ ID NO: 24221 - DNA, 546 bp, Artificial Sequence
  Description of Artificial Sequence: Synthetic coding sequence
atgtccctcaagctccaggcgagtaacgttactaataaaaacgaccccaagtctatcaactctcgagttttcatagggaacttgaacaccgccctggtgaaaaaatctgacgttgaaacaatctttagcaagtacgggcgtgtggccggatgctcagtgcataaaggatacgcctttgtgcagtatagcaacgaaaggcacgcacgcgcagccgtcctgggcgagaatggcagggtgcttgccggacagacactcgatattaatatggctggggagccaaagcccgaccgtccaaaagggctgaagagagccgcatccgccatctattccggttatatttttgattatgattattacagagacgacttttatgaccgtctctttgattatcgcggacgtctctcacccgtcccagtcccaagggctgtacctgtgaagcgccctcgcgtgaccgtccctctggtgcgtcgcgtcaagactaatgtgccagtcaaactcttcgcacgcagcacagcagtgactacctctagtgccaagataaaatag

SEQ ID NO: 24222 - DNA, 564 bp, Artificial Sequence
  Description of Artificial Sequence: Synthetic coding sequence
atgaccagcctgactccagggtgtaggtactccgttagagtgtcacctcagatggccaatcgaattgtcgattccgccaggtctatcctgaataagtttatcccagatatttacatctacacagaccatatgaagggagtgaactctggcaaatcacccggattcggcctgagtctggtggcagaaactacttcaggcacttttctctcggctgaactggcttccaatccacagggccagggggcagctgttctccccgaagatctgggacggaattgtgcgaggctgctgctggaggagatttatagagggggatgtgtggacagtacaaaccagtctcttgcacttctactcatgacacttgggcagcaggacgtcagtaaggtgctactcggacccctatctccctataccatcgaatttctgagacacttgaaaagcttttttcagataatgttcaaaattgagacaaagccctgtggcgaggagctcaagggtggcgataaggtgctgatgacctgcgtcggcatcggattctccaatttgtccaagacccttaaatag

SEQ ID NO: 24223 - DNA, 564 bp, Artificial Sequence
  Description of Artificial Sequence: Synthetic coding sequence
atgacctccctgacacccggttgcaggtactccgtgcgggtcagcccccaaatggctaatcgcatcgtcgactcagcgaggtccatactcaacaaatttatccccgacatctatatctataccgatcacatgaagggcgttaacagcgggaaatcaccaggttttggactgagcctagtggcagagaccacatccggaacgtttctttccgccgagttggcctcgaacccccaggggcagggggcagctgtattgcccgaggatcttggcaggaattgcgctcgactacttctcgaagaaatatataggggcggatgcgtggacagcacgaaccagagcctagccctgttgctgatgactttggggcagcaagatgtcagtaaagtcctgctgggcccactgtccccctacactatcgagtttctaaggcacctgaaatctttctttcagatcatgttcaaaatagaaactaagccatgcggggaagagctaaagggtggagataaggtgttgatgacttgtgtgggaatcggctttagtaacttaagcaaaactctgaaatag

SEQ ID NO: 24224 - DNA, 528 bp, Artificial Sequence
  Description of Artificial Sequence: Synthetic coding sequence
atggcaacacaggctcattcactgtcttatgctggctgtaacttcctcaggcaacggctggtgctgtcaactctaagtggacgcccagtgaaaatacgaaagataagggctcgggacgacaacccaggtttaagagattttgaggcttcgttcattcgccttctggacaagattacaaacgggagccgaatcgagataaaccagacaggtaccaccctgtattatcagccgggtctcctgtatgggggaagtgtggagcacgattgctctgtgctgcgtggaattggctattacttggagagcttgctctgcctcgccccattcatgaagcacccgctcaagattgtcctgcgcggagtgacaaacgaccaagtcgatccaagcgtgtctattgagaataagccctggtgtggattttgtttcgtttcttgccacaacccaacctgcgaaaagaaagtgccatataaggcccagttttactataagtgcattttactcttgctcttcacgctccggtttcggggatag

SEQ ID NO: 24225 - DNA, 1122 bp, Artificial Sequence
  Description of Artificial Sequence: Synthetic coding sequence
atggctacacaggcccattcactatcatatgctgggtgtaacttcctacgccagaggttggtgttaagtacattgagcggccgacctgttaagataaggaaaattcgggcaagggacgacaaccccggtttgcgtgatttcgaagcttcattcatccgattgcttgataaaataactaacggctcgaggattgagattaaccaaactggcaccacactctactaccagccagggcttctttatggaggcagtgtggagcatgattgtagcgtgctgcggggaattggctactatctggagagcctcctctgtttggctcctttcatgaaacatcctctcaaaatcgtgttacgaggggtgacaaacgatcaagtcgacccctctgtggacgttcttaaggcaactgccctgcccctgctgaagcagttcggaatcgatggcgagtcatttgaactgaagatcgtacggaggggaatgccaccgggaggtggtggcgaggtggtgtttagctgccccgtgcgcaaggtgctcaagcctatccaactgaccgacccaggcaagatcaaaaggattagaggcatggcatactccgtgcgtgtgagcccccagatggccaatcgcattgtagattccgctaggagcattctaaacaagttcataccagacatctatatatatactgaccacatgaagggggtgaattctgggaagtcccccggttttggcctgagcttagtagctgagaccacatcaggaacattcctgtctgcagagctggcatctaatccacagggccaaggagcggctgtcctacctgaggatttagggagaaattgtgcacgcctgctgctggaggaaatataccgtggcggatgcgtggattccacgaaccagtctcttgcgctgctgctaatgacccttggtcagcaggacgtgtcgaaagtgctgcttggtcccctgagcccatacacgattgagttcctcagacacctgaaaagtttctttcagatcatgttcaagatagaaacaaaaccctgcggtgaagagttgaagggcggagataaagtgctgatgacatgcgtagggattggattttcaaatctctccaaaacgctgaagtag

SEQ ID NO: 24226 - DNA, 417 bp, Artificial Sequence
  Description of Artificial Sequence: Synthetic coding sequence
atgacctcattgactcctgggtgccgatactctgtcagagtgagcccacaaatggcaaaccggatcgtggactcagcccgatccatacttaacaagttcataccagatatctacatttataccgaccacatgaagggtgttaactcagggaagtcgcccggtttcgggctcagcctggtggccgaaaccacaagcggaacattcttgtctgcagagcttgcttcaaatccccaggggcaaggggctgcggtgctgcccgaagatctgggtcgcaactgtgcaagactgcttttagaagagatttatagggggggatgtgtggattctacaaaccaaagccttgcactgcttctgatgaccctgggacagcaggacgtgtccaaagtgctactgggtcccctgtcaccttatacatag

SEQ ID NO: 24227 - DNA, 549 bp, Artificial Sequence
  Description of Artificial Sequence: Synthetic coding sequence
atgcctcccggtggcggtggagaggttgttttctcctgtccggtgcgaaaagtactgaagcccatccaactgacagaccctggaaagattaaacgtatccgcggtatggcatacagcgtgcgcgtgtcccctcagatggccaaccgcatcgtggatagcgcgcgtagtattttaaataagttcatcccggacatctacatttacaccgatcacatgaagggagtaaacagtggaaagagtcccggattcggcctttcgttagtggccgagacaacatctgggactttcctcagtgctgagctcgcgagtaatccccagggccagggtgccgctgtgcttccagaggatttgggccgtaattgtgcaaggctgcttctcgaggaaatctaccgcggaggatgtgtcgatagtacgaaccagagcctcgccttgcttttaatgactctcggacagcaagacgtctctaaggtccttctcggacccctgagtccttatacaatcgagttcctccggcatctgaaatcattcttccagattatgtttaaatag

SEQ ID NO: 24228 - DNA, 564 bp, Artificial Sequence
  Description of Artificial Sequence: Synthetic coding sequence
atgacaagcctcacccccggttgcaggtattccgtcagggtcagtccccaaatggcgaatagaatagtggacagtgccagatctattcttaataaattcattcctgatatctatatctatactgaccatatgaagggggtgaacagtggcaagagcccagggtttgggctgagtcttgtggccgagaccaccagcggtaccttcctcagcgccgagctggcatcgaaccctcagggccagggggctgcggtgctaccagaagacctggggaggaactgtgcgagactcctgcttgaagagatctacagagggggttgtgtggattctaccaaccaaagtcttgccctactgttgatgactcttgggcaacaagacgtgagtaaagtgctcctaggacctctatccccatacaccatcgaattcctgaggcacctgaagtccttttttcagatcatgttcaaaatcgagactaagccatgtggagaagaactcaagggcggagacaaggtgctgatgacttgcgtaggtatcgggttttctaacctgtccaagacactcaagtag

SEQ ID NO: 24229 - DNA, 1554 bp, Artificial Sequence
  Description of Artificial Sequence: Synthetic coding sequence
atggccgcacctgagcaaccactggcgattagcagaggttgcactagtagctcttccctttcccctccgaggggagatcggacactcctcgtcagacatctgccagctgaactgacagccgaggagaaagaggaccttttgaagtatttcggtgctcagtccgtacgcgtcctgtctgacaaaggaaggctcaaacataccgcttttgcaacttttcctaacgagaaagctgcaatcaaggctctcacacgtttgcaccagctgaagctcttgggtcacacgctggtggtggagttcgctaaggaacaggatcgagttcatagtccctgccctaccagcggttcagagaaaaaaaagagatcagatgaccctgtggaggatgacaaggaaaaaaaggagctagggtacttaacggtggaaaatggaattgctcccaatcacgggctgacctttcccttgaatagttgtcttaaatatatgtaccctccacccagtagcaccatcttagcaaatattgttaatgccctggcatctgtgcccaaattttacgtgcaagtgctacatctcatgaataaaatgaatctaccaaccccattcgggccaattacagcccgtccccctatgtacgaagattacatgcctcttcacgcaccattgcccccaacaagcccccaacccccagaggagcccccattacccgatgaggacgaggagctctcatccgaggagagtgagtacgaatctactgacgatgaagatcgccagcggatgaataaacttatggaactcgccaacctccagcccaaaagacccaagactattaagcagagacacgttcggaagaagaggaagattaaagatatgctgaatacccccctatgccccagccactcgtctctgcatcccgtgttattacccagcgatgtgttcgatcagccacagcctgtgggaaataagcggatcgaattccacatctctaccgatatgcctgccgctttcaagaaggatctcgagaaagagcaaaattgtgaagagaagaaccacgatctgccagccactgaggtggacgcttctaacatcggttttggaaagatctttccaaaacctaatctcgacattactgaggagattaaagaggattccgatgagatgccctccgagtgcatttcacgacgagagctggagaaaggtcggataagcagagaggaaatggagactctgagcgttttccgcagttacgagcccggagaacccaattgtagaatctacgtcaagaatctggcgaaacatgtgcaggagaaggacctaaagtacatcttcgggcgttatgttgatttttccagcgagacacagcggatcatgtttgacattagactgatgaaggaggggcgaatgaagggccaggcatttatcggcctgccaaacgagaaggcagccgctaaggcattgaaggaggccaatgggtatgtgctttttggaaaaccaatggtggtccaattcgcgcgtagcgccaggcctaaacaagatcctaaggaaggcaagcgcaaatgttag

SEQ ID NO: 24230 - DNA, 387 bp, Artificial Sequence
  Description of Artificial Sequence: Synthetic coding sequence
taacgacgggagcttgaaaaggggagaatatctagagaagagatggaaaccctcagcgtgttccggtcatatgagcctggagaaccgaactgtcggatctacgttaagaatctcgctaagcacgtgcaggagaaagacctgaagtatatctttggaagatacgtcgatttttcatctgaaacccagagaataatgttcgatattcgccttatgaaggagggaagaatgaagggacaggcgtttattgggttgcctaatgaaaaggcggctgctaaagctttaaaggaagccaacgggtatgtgctgtttggaaagccaatggtagtgcaattcgcaagatctgcacgaccaaaacaggatccgaaggaagggaaacgcaagtgctag

SEQ ID NO: 24231 - DNA, 558 bp, Artificial Sequence
  Description of Artificial Sequence: Synthetic coding sequence
atggccgctcccgagcagccgcttgctatttctagaggctgtacctcttcatcatctctgagcccccctcggggagataggaccctcctggtgagacacctaccagccgaactcaccgctgaggagaaggaagaccttttgaaatatttcggcgctcagagcgtgcgggtgctatctgacaaaggacgcctgaagcacacagcttttgctaccttcccaaatgagaaggccgctattaaagccctcacacgcttgcatcagttgaaactgcttggccatacgcttgtggtggagttcgcgaaagaacaagaccgggtgcacagcccatgtcccacctctggctccgagaagaaaaagcggtctgacgatccagtggaagatgataaggaaaaaaaggagctcgggtatctgactgtggaaaacggcattgctcctaatcatggtctcacattccctctgaattcctgcctgaagtacatgtatcccccaccctcgagcactatactggcaaatattgtaaatgcgctggcttccgttcctaagttttatgttcagtag

SEQ ID NO: 24232 - DNA, 1554 bp, Artificial Sequence
  Description of Artificial Sequence: Synthetic coding sequence
atggcagcccctgagcagcctctcgccatcagcagaggctgtacttcctcgtcctccctgagtcctcctaggggcgatcgaacactgctagtgcgtcacctgcccgcagaacttactgcggaagagaaggaggatctgttaaagtactttggggctcaatctgtgcgggtgctttcagacaaaggcaggctgaaacacactgctttcgcaacatttcccaatgaaaaagctgccattaaagcactgactaggcttcatcagttgaaacttctcggccacacactggtggtggagtttgccaaggagcaggaccgtgtacacagcccctgccctaccagcggaagcgaaaagaaaaaaaggagcgacgaccctgttgaggatgacaaagagaagaaggagctgggatacctcactgttgaaaacggaattgcgcctaatcatgggctcaccttccccctgaatagctgtctgaagtacatgtatcctccgccatcctccacgatcctggccaatattgtcaacgcgctcgcatcagtccccaagttctatgttcaggtcctccatctgatgaacaaaatgaaccttcctacccctttcggacctatcaccgccaggccacccatgtacgaagattatatgccgcttcatgcaccgctgcctccaacatctccacagcccccagaagaacctcctctgccagatgaagatgaggaactgtcaagcgaggaaagcgagtacgaatccaccgacgatgaagatcgccagcggatgaacaagctcatggaactggcaaatctgcagccgaagaggccgaaaactattaaacagaggcacgtgcgaaaaaagcggaagataaaagacatgcttaacacaccattatgcccgtctcactcatccctgcatccagtcctgctcccaagcgacgtctttgatcagccccaacccgtaggcaataagcgaatcgaatttcacatttcaactgatatgcccgcagcattcaaaaaggacctggaaaaagagcagaactgcgaggagaagaaccacgatctcccagcaaccgaagtagatgcaagcaatattggttttgggaaaattttccctaaacccaaccttgacatcaccgaagagatcaaagaagacagtgatgaaatgccatcagaatgcattagtcgtagagaactggagaaggggaggattagccgagaggagatggaaactttaagcgtatttaggtcatacgaaccaggggaacccaattgccggatatacgtgaaaaatctggcgaaacatgtgcaggagaaagacttgaaatatattttcggacgatacgtagatttcagctcagagacacagcggatcatgtttgatattcgcctgatgaaggagggccgaatgaaaggacaggctttcatcggcctgccgaatgagaaagccgctgcaaaagccctgaaggaggcgaacggatacgtattattcgggaaacccatggtggtacagttcgcacgatctgctcggcctaaacaggaccctaaggaggggaaaaggaaatgttag

SEQ ID NO: 24233 - DNA, 2409 bp, Artificial Sequence
  Description of Artificial Sequence: Synthetic coding sequence
atgttcatcagtggtagaagaacagcagacaagtggagagcagaagaaaggctgcagtgccctgccggatctgcccgtgctgcactggcccgttgcgcagacggaggagctgtggggccattcaaatgtgtcttcgtgggtgaaatggccgctcaggtaggagccgtgagggtggttagggccgtcgcagctcaggaggaaccggataaggaaggcaaagaaaaaccgcacgcaggtgtctcccctaggggggtgaagagacagcgcagaagttccagcggtgggtctcaagaaaaacgcggacgaccaagccaagaaccacctttagcaccgccacatcggaggcgcagatccaggcagcatccaggcccattacctcccacaaatgccgctcccactgtgcccggacccgtggagcccctgttgctccctccgcctccgcctccctccctcgcaccagctgggcctgctgttgcagctccattgccagctccctccaccagtgccttgtttacatttagtcctttaaccgtttccgccgctggccctaaacataagggccataaagagcgccacaagcatcaccatcatagaggacctgatggcgaccccagctcatgtggcacagacttgaaacataaagataaacaagagaacggtgagaggactggcggtgtaccattgattaaagcacccaaaagagagacaccagatgagaatggaaaaacccagcgagctgatgacttcgtactgaagaaaataaagaaaaaaaaaaagaagaagcacagagaggatatgcgcggtcggaggctgaagatgtacaacaaagaggttcagacagtatgtgctggccttacccgtatctcaaaagaaatcctgactcagggccaaatcaatagtactagcgggctgaacaaagagtcgttccggtacctgaaggacgaacaactttgccggttgaacctgggcatgcaggaatatagggttccccagggcgtccagaccccatttatgactcatcaagagcattcaatcagaaggaatttccttaagactgggacaaagttcagtaactttatccacgaggagcaccaatctaacgggggagctctggtgctccatgcctatatggacgagctgagcttcctgtccccaatggaaatggaacgcttctcggaggagtttctggccctgactttttctgaaaacgagaagaacgccgcatactatgctctggctattgtgcacggcgcagctgcttatctgccggattttctggactacttcgctttcaatttcccaaacaccccagtgaaaatggaaatcctggggaaaaaagatattgagacgacgactatctccaacttccatactcaagttaatagaacctactgctgcggaacttatcgggcagggccaatgagacaaatatcattggtaggtgcagtggacgaggaagttggagattactttccagagtttttggatatgttagaagagtctccttttctcaagatgacactaccctggggaacactgtcaagtctgcgattgcaatgtcgtagtcagagcgacgatggaccaattatgtgggtccgtccgggtgaacagatgatcccaaccgctgatatgcctaagagcccctttaaacggagacgctccatgaacgagatcaagaatctacaatatttgccacgaaccagcgagcctagagaggtgttgtttgaagaccggactcgtgcccatgcggatcacgtcggccagggattcgattggcagagcaccgctgccgtcggggttttgaaagccgtccagttcggggagtggtctgatcaaccccgaatcacaaaggatgttatatgcttccacgccgaagattttaccgacgtcgtacagcgtttgcagctcgacttacatgagccacctgtgtctcagtgcgtgcaatgggtggacgaggcaaagctgaatcaaatgcgccgtgagggaatccggtatgcacgcatccagctgtgtgacaacgatatctattttattcccaggaacgttattcatcagtttaaaaccgttagtgccgtttgctccctggcctggcatattcgcctcaaacagtatcacccagtagtcgaggcgactcagaacacagagagcaacagcaacatggattgcggactgactgggaaacgggaattggaggtcgactcccagtgcgtcagaatcaagacggagagcgaggaggcttgcactgagatccagcttctgaccaccgcttctagcagcttcccccctgcctccgagttgaacctgcaacaggatcaaaaaacccagcctatcccagtactgaaggtggaaagccgccttgattcggaccaacaacataatttacaggagcactcaaccacatctgtctag

SEQ ID NO: 24234 - DNA, 2541 bp, Artificial Sequence
  Description of Artificial Sequence: Synthetic coding sequence
atggctgagcctccctcccctgtgcattgtgtggccgcagcagcacctaccgccacagtgtcggagaaagaaccgttcggaaaattacagctcagttcacgcgatcccccagggtctctcagcgcgaagaaagtgcggactgaggagaaaaaagccccacggagggtgaacggcgaaggcggatcagggggtaattccagacagttgcagcccccagcggcaccttccccccagtcctatggctcacccgcaagttggtcttttgcaccattgtcagctgccccttcaccatctagctcacggtccagctttagctttagtgcgggaactgctgtcccatcctcagcatctgctagtctttcccagccagtgccgcgaaaactgttggtccctccgacgcttctacatgctcagccacatcacctgctcctccccgcagcagcagccgcagcgagtgccaatgcaaagagtcgcagacctaaagaaaagagggagaaagagcgccgacgtcatgggctggggggtgctagagaagccggaggggcatccagggaagaaaacggagaggtgaaaccattgcccagagacaaaatcaaggataaaataaaggaaagagacaaggagaaggaaagagagaagaagaagcataaggtcatgaacgagattaagaaagaaaacggagaagtgaagatcctgttgaaatccggcaaagaaaaaccaaagacgaatattgaggacctgcagataaagaaggtgaagaaaaagaagaaaaaaaagcacaaggagaacgaaaaaaggaagcgaccaaagatgtactccaaatccattcaaaccatttgtagcggtctcctgactgacgtggaggaccaggcggctaagggaattctcaatgataacatcaaagattatgtgggtaagaaccttgatactaaaaactacgacagcaaaatccccgagaatagtgagtttcctttcgtgtccttgaaagagcccagagtgcagaataatttgaagagactggacacgctggaattcaagcaattaattcacattgagcaccagcctaatggcggtgcatctgtcattcacgcttattcaaacgaactgagtcacttgagccctatggagatggagagatttgctgaagaattcgtgggtctggtgttcagcgaaaacgagaattcagcagccttctatgtgatgggcatcgttcatggggctgccacctatcttccggatttcctggactactttagctttaactttcctaactctcccgtgaaaatggagattttgggcaagaaggacattgagacaaccacaatgagcaattttcacgctcaggtgaagcgcacctactcgcacggcacttacagagccggacctatgaggcagatctccctggtcggtgcagtcgatgaggaagtgggcgattattttcctgagttcctcgacatgctggaggaaagcccttttctcaagtgcacacttccatggggtacactgtcctctttaaaactgcaatcacgcaaagacagcgatgatggtcctatcatgtgggtgaggccaggagaacaaatgattccagttgctgacatgccaaagagtccatttaagaggaagagaaccacaaacgagatcaaaaacctccaatatctaccacggacatctgagccacgggagatgctgtttgaagaccgtacccgcgctcatgccgatcatattggccagggctttgaacgccagactactgccgctgtgggagtgctgaaagccgtgcactgcggcgagtggcctgaccagccaaggatcacgaaggacgtgatttgttttcacgcagaggattttctggaagttgtccagcgcatgcagctggatctccacgagccaccattaagtcagtgtgttcagtgggtcgacgacgcaaagttaaaccagttacgccgagagggtattaggtatgcaagaattcagctgtatgacaacgacatttacttcattccacgaaacgtcgtccatcaattcaaaactgtcagcgctgtgtgctcactggcatggcatattagactcaagctctatcactctgaggaggacacctcacagaataccgccacccacgaaacgggtacctcatcagatagcaccagctcggttctgggaccacatactgataacatgatttgcgctgtcagtaaggcaagccttgactctgtgttcagcgacaagctgcacagcaagtacgagttacagcagattaagcatgagccaattgctagcgtgcgaattaaggaggaacccgtaaacgtaaacatcccagagaagactacggcactgaataacatggatggaaaaaatgtaaaggcaaagctggaccacgttcaattcgctgagttcaaaatcgacatggacagcaagttcgagaacagcaataaagatttgaaggaggagctgtgtcctggtaatctgagcttagtagatacacgacagcattcatcggcccactcaaaccaggataaaaaggatgatgatatcctgtgttag

SEQ ID NO: 24235 - DNA, 1731 bp, Artificial Sequence
  Description of Artificial Sequence: Synthetic coding sequence
atgtactccaagagtatccaaactatctgcagtggtctccttactgatgtggaggatcaggcagccaaaggaattttgaacgataacattaaggactatgtggggaaaaacctcgacaccaagaactatgatagcaagattcctgaaaacagcgaattcccatttgttagtctcaaagagcccagagttcagaataacctcaaaaggctggatacactggagttcaagcagctcatacacatcgagcaccaaccaaatggcggtgcctccgttatccacgcatacagtaacgaattgtcccacctgagtcctatggaaatggagaggtttgcagaggaattcgtaggtctcgtgttctccgagaatgagaattccgccgctttctatgtcatggggatcgtgcatggcgcagctacttatctgccggattttctggattatttctctttcaattttcccaattctccagtcaagatggagatacttggtaaaaaggatatcgagacaacgacgatgtccaatttccatgcgcaggttaagagaacatacagtcacggtacataccgcgcagggcctatgaggcagattagcctggtgggagccgtggacgaggaagtgggggattactttccagagttcctggacatgctggaggagagcccctttctgaagtgtacactgccttggggcacactctcttctctaaagcttcagtcccgaaaggacagcgatgacggtccaatcatgtgggtgcgcccaggggagcaaatgataccagtggctgatatgccaaaaagcccatttaagaggaaaagaacaacgaatgagataaagaatttacaatatttgcctcggacatccgagcccagagaaatgctgtttgaagacaggactagagcacacgccgatcacataggccaaggttttgagcgccagaccacggcggcagtgggggtgctgaaggccgtgcactgcggggagtggcccgatcagccccgaatcaccaaggacgtgatttgcttccacgctgaggactttctggaggtggttcagcgaatgcagctcgatcttcacgaaccacctctatcacagtgcgtgcaatgggtcgatgacgccaagctcaaccaactccggcgtgagggcatcaggtacgcacgaatccagctgtatgacaatgacatttactttatccccaggaatgttgtacatcagtttaagactgtctccgccgtgtgttctctcgcctggcacataaggctaaaactgtatcatagtgaagaagacacctctcagaataccgccactcatgagacagggactagcagcgacagcacgtcctctgtcctgggaccacacactgacaatatgatctgcgccgtgtccaaagcctccttggattcagtgttttccgataagctgcattccaagtatgaattgcaacagatcaagcacgagccaatagcctccgtgcggatcaaggaggaacccgtgaatgtaaacatacctgaaaaaactaccgcgcttaataatatggatggcaagaacgtcaaagccaaactagatcatgtacagttcgccgagttcaagatagacatggatagcaaattcgagaatagtaataaggatctgaaggaggagctctgtcccggaaatttatcacttgtcgacaccaggcagcactctagcgctcatagcaatcaagacaaaaaagatgatgatattctgtgttag

SEQ ID NO: 24236 - DNA, 1815 bp, Artificial Sequence
  Description of Artificial Sequence: Synthetic coding sequence
atgataagtgtgaagcggaatacctggcgggcactgtcactggttattggggactgccgaaaaaaaggaaattttgagtattgtcaagataggactgaaaaacatagtactatgccggattcccccgtagatgtgaaaacacagagccgccttacaccacccaccatgccccctcctcccaccacacagggggcacctagaacctcttcctttactccgacgaccctgacaaacggcacctcacattccccgacggccctgaacggtgccccatctcctccaaacggctttagtaacgggccatcctcttctagctcttcctccctggcaaaccaacagctgcccccagcttgcggcgcacgccagctgagcaaactgaaacggttcctgactaccctgcaacagtttggcaatgacattagcccagagattggagaaagagtgcggaccttggtgctgggactagtgaactccaccctcactattgaggaatttcattccaaactacaggaagccaccaatttcccccttcggcctttcgttatccccttccttaaggcgaatctgcctctgttgcagagagaacttctgcattgtgctcgtctggcaaagcaaaacccggctcagtacctggcccagcacgagcagctgctgcttgacgccagtaccacatctccggtggactcgagcgaactgctgttagacgtaaatgaaaatggaaagcggcgaacacctgacaggacgaaagagaatgggtttgaccgggagccgctccactcagaacatccatctaaacgcccatgcactatttcccctggtcagcgctattctcccaataatggcctttcttatcagcctaacggtctcccgcaccccactcctccccctccacaacattaccgcctggacgacatggctatcgcgcatcattacagggactcctacaggcacccttcccatcgggatctaagagaccgtaacaggccaatgggcctccatggaactaggcaggaggagatgattgatcatagattaactgatcgtgaatgggccgaagagtggaagcaccttgaccatttgctgaactgcattatggacatggtagaaaaaactagacggtccctgaccgttctgcggaggtgccaagaagccgacagagaggaacttaactattggatacggagatactcggacgctgaagacttgaaaaaagggggaggcagtagctctagccatagcaggcagcagtccccagtgaatccagaccccgtggcacttgacgcccaccgggaattcctgcacaggcctgcttctggctatgtcccggaagagatctggaagaaggcagaggaagcagtgaacgaggtaaaaagacaagcaatgacggagctccagaaggcggtttcagaagcagagcggaaggcacacgatatgattactacagaacgggctaagatggagcggaccgtggctgaagccaaacggcaagctgccgaggacgctctggccgtcatcaaccagcaagaggacagcagcgagtcctgctggaattgcgggcgaaaggcatctgaaacgtgttcaggctgtaatacggcccgatactgcggctcattttgccagcacaaagactgggaaaaacatcaccacatatgcggccagaccctgcaggcgcaacaacaaggcgacacacccgctgtaagctcatcagtcaccccaaattctggggcaggatccccgatggatacgccccctgcagccacacccaggtcaactactccgggtactccgagcacgatcgagacgacccccaggtag

SEQ ID NO: 24237 - DNA, 1704 bp, Artificial Sequence
  Description of Artificial Sequence: Synthetic coding sequence
atgcccgattcacccgtggacgtcaagactcagtctagattaaccccacctacaatgccaccgcctcctaccacgcagggggcaccaagaacatccagttttaccccaaccaccctgacgaacgggacctctcacagtccaacagctcttaatggagctccttcccctcccaatggattctccaatggaccttctagctctagcagcagctcccttgcaaaccagcagctcccgcctgcatgtggtgctcggcagctgtctaagctgaaacgctttcttactacccttcagcagttcggcaatgatatctctcctgagatcggcgagcgcgtgcggacactggtcctcggattggtcaattctaccctgactatagaagagtttcactccaagttacaagaagctactaactttcccctgaggccgttcgtgattccatttctgaaggccaacctgcctctgttacagagagagttgttgcattgtgcacggttggccaagcagaaccctgcccagtaccttgcccaacacgagcagttactcctcgacgcttctactacgtctccggtggatagcagtgaactcttgctggacgtgaacgagaatgggaagagaagaacacctgatcggaccaaagagaacggtttcgatagagagccgttacatagtgagcaccccagcaagcggccatgtacaatcagccctggccagcgctacagccctaataatgggttatcataccagcccaacggcctcccacatccaacgcccccaccacctcaacactaccggctagatgatatggctatcgctcaccactatcgggattcctaccgacatccatcacaccgagatctaagagacagaaatcggccaatgggactgcatgggaccaggcaggaggaaatgattgatcacagactcacagatcgtgaatgggcagaagaatggaaacacttagatcacctactgaattgtatcatggatatggtcgagaagacgcgcaggagcctaacagtgcttcgtcgatgtcaggaggccgaccgtgaggagctcaactattggattagaaggtattctgatgctgaggatctgaaaaaaggagggggatccagctcatcacactctcgtcagcagtcacctgtcaacccagatcctgtggctcttgatgcccacagggagttcttgcaccgacctgcctctggttatgtccccgaagaaatctggaagaaggccgaggaggcggttaacgaagttaaacggcaggccatgacagagctgcagaaagccgttagtgaggcggaacgtaaagcccatgacatgatcacgactgaacgcgctaaaatggagcgcacagtcgccgaggccaagcggcaggcagccgaggacgcgctggcggtcatcaaccaacaggaagacagttccgagtcgtgttggaattgcggcaggaaagcttcagagacctgttcgggttgtaataccgcccgttattgcgggagtttttgtcagcacaaggattgggaaaagcaccaccacatttgtggacagacacttcaggcccagcagcagggcgacacccctgcagtctctagcagcgtgaccccaaattccggagctggatccccaatggacactccaccggctgcgactccacgctcaacgactccaggcacaccctctactattgagaccacgcccaggtag

SEQ ID NO: 24238 - DNA, 1734 bp, Artificial Sequence
  Description of Artificial Sequence: Synthetic coding sequence
atgcctgataggaccgaaaaacactcaacaatgccagacagcccggtcgatgtgaagacccagagccggctgacccccccaactatgccccctcctcctacgactcagggagcccctcggacttccagtttcactcccaccacccttaccaatggaacctcccattcaccaaccgccctaaacggcgctcccagcccccctaatggcttctccaatggacctagcagtagctcttccagttctctcgctaatcagcagctgccacccgcttgtggggctcgacagctttccaaactgaagcggtttctgaccaccctccagcaattcggcaatgacattagccccgaaatcggagagcgcgtcagaaccctggtcctggggttagtgaatagcaccctgaccattgaagagttccactctaaacttcaggaagccactaactttcccctccggccattcgtcattccgtttttgaaagccaaccttcccctgcttcaacgggagctgcttcactgtgcaaggcttgcaaagcaaaatcctgctcagtacctggcccagcacgaacagctgttgcttgatgcttccacaacctctcccgttgactcatctgagctgttgctcgacgtgaacgaaaacggtaaacgccgtaccccagatcggaccaaagaaaacggcttcgacagagaacctctgcactctgagcaccccagtaagcggccttgcactatcagcccgggtcagcggtattctcctaacaatggcctgtcttatcaaccaaatggactgccgcatcccacaccccctcctccccaacactaccggctcgatgatatggcaattgcacaccactatcgcgacagttacagacatcccagccacagagaccttcgcgacagaaaccgacccatgggtttacacgggacccgccaagaggagatgatcgatcataggcttaccgacagagaatgggccgaggaatggaagcacctggatcaccttttgaattgtatcatggacatggttgaaaagaccaggagatccctgacggtccttcgcagatgtcaagaggctgacagagaagaactaaattattggattcggcgatattcggatgctgaagacttaaagaaagggggtgggagcagttcctcccatagtagacagcagtcacccgtgaatcctgaccctgtcgccctggatgcccaccgagagtttctgcaccgccctgcaagtggatacgttcctgaagaaatctggaaaaaggccgaggaggccgtgaacgaggtgaagcgacaggctatgacagagctacaaaaagccgtgtccgaagccgaaagaaaagcacacgacatgatcaccaccgagcgcgctaagatggaaagaacagtagctgaggcaaaaaggcaggctgcagaagatgcgctggctgttatcaaccaacaggaggattcgtctgaatcgtgctggaattgtggcagaaaggcttctgagacttgtagcggctgtaacaccgcacgttactgtggatctttctgccagcacaaggattgggagaaacaccaccatatttgcggacaaacgctgcaggcccaacagcagggagatacccccgcagttagctcatctgtaacacctaattcaggagctggatctcccatggacaccccccctgcggcaaccccccgaagcacaacccccggtacaccctcaacaattgagaccacccctcgctag

SEQ ID NO: 24239 - DNA, 1704 bp, Artificial Sequence
  Description of Artificial Sequence: Synthetic coding sequence
atgcctgactctcccgtcgatgtcaaaacccagtcacgacttactcccccaacaatgccccctccacctaccacacagggtgccccaagaaccagttcatttacccctactactctaaccaacggtacctcacattccccaactgcgctaaatggagccccaagccctcctaatggattttccaatggaccatcttcttcaagcagttctagcctggctaaccagcagctgccgcctgcctgcggggcaaggcagctatctaagctgaaacgctttctcactactctgcagcaattcggtaacgacatttctccggaaataggggagcgggtgcgcacattagttctcggcctggttaattctacattaacaattgaggaattccactcaaagcttcaagaggctacaaatttcccattgagacccttcgtgattcctttcctcaaggccaacctgccgctgctacagagagagcttctgcattgcgcgagactggcaaaacagaatcctgctcagtacctcgctcagcacgagcagctgctgttggacgcatcgacaacgtcccctgttgattcctctgaattactcctagatgtaaatgagaacggcaagcgccgtacgccagatagaaccaaggaaaacggcttcgatagagaaccattacactccgagcatcccagcaaacgcccatgcaccatctctcctgggcagaggtacagtccgaataacgggttgtcctatcaaccaaatggcttgccccatccaactcctccgccaccccagcactaccgactcgatgatatggcgatagcacaccattatagagatagctaccggcacccaagccacagagatctgcgagataggaatcgtcccatgggcttacatggaacacgccaggaggaaatgattgaccatcgccttacagatcgcgagtgggcagaggagtggaagcatctggaccacctgctgaactgcatcatggatatggtagagaagacacgcagaagcctcacagtactgcggaggtgccaggaggccgacagggaggaactgaactactggattaggaggtattctgacgcagaggaccttaagaaggggggaggaagctctagctcccattcacgccagcagtcacccgtcaatcccgatcccgtcgcactcgacgctcaccgcgagtttctgcaccgaccagcatctgggtacgtgccagaagagatttggaagaaggccgaagaagctgtaaacgaagtcaagcgccaggcaatgacagagctacagaaggcagtcagcgaggccgagaggaaggcccatgacatgattacaaccgaacgtgccaaaatggaaagaaccgtggccgaagcaaagcgccaagctgcggaggacgctctggcagtcataaatcagcaagaggattcttccgagtcctgttggaattgcggacgcaaagcctcagaaacctgttcaggctgcaacacagccagatactgcggctctttttgccaacataaagactgggagaaacatcaccatatctgcggccaaaccctgcaggcacagcagcagggagacacccctgccgtcagtagcagtgtcacccctaatagtggcgcaggtagcccaatggatacacctcctgctgcgacccctaggtctaccactccagggactccctccaccattgaaaccacaccgagatag

SEQ ID NO: 24240 - DNA, 1848 bp, Artificial Sequence
  Description of Artificial Sequence: Synthetic coding sequence
atgtgtcatcccgacaaggcctttacatccgataagctgcaatgtgtgttcaacgagtataaggccgctgtgtgggtgccaccccgaccaaggccattgtcccgggctccactccctgaggatagaaccgaaaagcactcaacgatgcccgatagtcctgtcgacgtgaagactcagagccgactgacacccccaactatgccacctcctccgaccacacagggcgctcctcgcacgtcctctttcacccccaccaccctgacgaatggaacatcccattcccccactgccctaaatggagccccttcccctccaaacggattttccaacggacccagcagtagctcatcctcatcgctagccaaccagcagcttcctcccgcttgcggggcacgtcaactgtcaaaattgaaaagatttctcactactctgcaacagttcggtaacgatataagtcctgagatcggggaaagggtgagaacactagtactgggcttggtcaattcgacactgaccattgaagagttccattccaaactgcaggaggctacaaacttccccttgagacctttcgtgattcccttcctgaaggccaatttgccgctgctccaacgggagttgctgcattgtgctagacttgcaaagcagaatccggcacaatacctcgcccagcacgaacaactgctgttggatgccagtacaacttctccggtggattccagcgaactgttgctggacgtcaacgaaaatggaaaaagaaggacccccgatcgcacaaaggaaaatggcttcgatcgggagcctctgcactccgaacaccctagcaagagaccctgcaccatatctccgggtcagcgctattcaccgaacaacgggttgtcctaccaacccaacggactgcctcaccccacgccgccacctccccagcactataggctggacgacatggctatagctcatcattatagggattcttaccggcaccccagtcatcgggacctcagagacagaaaccggccaatgggactgcatggcaccagacaggaggaaatgatagatcatcgactaacagacagagagtgggctgaggagtggaaacacctagatcacctgctgaactgtattatggatatggtcgagaagactcgcagatcactgactgtgcttcgcagatgtcaggaggctgaccgcgaggagcttaactactggatcagacgatactctgatgcagaggacctcaagaaaggcggtgggagttcctcctcacattctcgacagcagagccctgtgaacccggacccagttgcactcgatgcgcacagagagtttctgcacagacccgcttccggatatgtccccgaggagatctggaaaaaagcggaggaggctgtgaatgaagttaagcggcaggccatgactgaacttcagaaggctgtgtctgaggcagagagaaaagcgcacgatatgattaccaccgaacgcgctaagatggagcgcacagttgccgaggcaaagcgacaggctgctgaagatgcattggccgtcattaatcagcaagaggattctagtgaatcctgttggaactgcggtagaaaagcttcagagacatgcagtggctgcaacactgctcgctattgtggaagtttctgccagcacaaggactgggaaaagcatcatcacatctgtggacagacgttgcaagcccagcagcagggagacactcctgccgtgtcctcctcagttacccctaacagtggggcagggtcaccaatggatacccctccagctgccacccctcgcagcacaaccccaggaacaccatctacaatagagaccactccgagatag

SEQ ID NO: 24241 - DNA, 363 bp, Artificial Sequence
  Description of Artificial Sequence: Synthetic coding sequence
atgccagatagccctgtggatgtgaaaacacagtcccgactgactccgcctaccatgcccccacccccaacaacccaaggggcaccacggaccagctcttttacccccactaccctgacaaacggtactagccattcaccgacggctctgaacggggcaccaagtccacccaacgggttctccaatggccctagcagttccagctcctcctcactggcaaaccagcagctccctcccgcatgtggagcacggcagctcagcaagctgaagagattcctcaccactttgcagcagtttggcaacgacatctctcccgagattggggaacgggtgaggaccttggtgttgggtcttgtgaattag

SEQ ID NO: 24242 - DNA, 408 bp, Artificial Sequence
  Description of Artificial Sequence: Synthetic coding sequence
atgatttccgtgaagcggaacacatggcgtgctctctcgcttgtgatcggagattgccggaagaaagggaactttgaatactgccaggatcggaccgaaaagcactctactatgcctgattcccctgtggacgtcaagacccagtcccgactcaccccacccacaatgccgcctccacctacaactcaaggagcacccagaaccagttcttttacaccaacaactttgaccaacggaacctctcactctccaaccgccctgaatggtgcgcctagcccacccaacgggttcagcaatggaccaagctcttcttcttcaagcagcctcgcaaatcaacagcttccacccgcatgtggtgcgaggcagttgtcaaagcttaaacgatttctgacaacactgcaacagtag

SEQ ID NO: 24243 - DNA, 210 bp, Artificial Sequence
  Description of Artificial Sequence: Synthetic coding sequence
atgcctgatagaacagagaagcatagcactatgccagactccccagttgacgtgaagacgcagtcccggttaaccccaccaacaatgcctccacccccaaccacacaaggcgctccgagaacctcaagttttactccgacaacccttaccaatggcacctcccattcgcccacagctcttaatggcgctcctagcccccctaacgggtag

SEQ ID NO: 24244 - DNA, 177 bp, Artificial Sequence
  Description of Artificial Sequence: Synthetic coding sequence
atgatcagcgtgaagcggaacacatggcgcgctttgtcactggtcataggtgactgtagaaagaaggggaacttcgaatattgtcagggggcaagggcacagcaccccgcatctggggacgctgcgccagcccctctgatggctttactgtccgctgcaacacactcacgtacatag

SEQ ID NO: 24245 - DNA, 240 bp, Artificial Sequence
  Description of Artificial Sequence: Synthetic coding sequence
atgcccgacagaaccgaaaaacatagcacgatgccagattcccctgtggatgttaaaacgcaatcgaggttaacgcctcctacaatgcccccaccccctacaacccaaggagcgccacggacttcctccttcacacccacgactctgacaaatggtaccagtcactctcctacagctctgaatggtgctcccagccctcccaatggcttttccaacggtccctctagctcttcctcctag

SEQ ID NO: 24246 - DNA, 141 bp, Artificial Sequence
  Description of Artificial Sequence: Synthetic coding sequence
atgccggattcacctgtcgatgttaagacacagtctcggctgactccaccgactatgccacccccacctaccacccaaggtgcccctcggacatcctcctttacccccactactctgactaacggcacaagccacagctag

SEQ ID NO: 24247 - DNA, 1734 bp, Artificial Sequence
  Description of Artificial Sequence: Synthetic coding sequence
atgcctgaccgtaccgagaagcactcaaccatgcctgattcacccgtggacgtgaagacacagagcagacttactcctcccacaatgccccctccccctactacccaaggcgcacctcgcacgtcatcctttacccctacaaccctgacgaatggaacgtcccactctccaactgcacttaatggcgctccaagccctcctaacggcttctccaatggtcccagctcttcctcgagcagctctctggcaaatcagcaattgccccctgcttgcggggcacgccaactgagcaagctgaaaaggttccttacaacgttgcagcagttcggaaatgacatatcccccgagattggtgagcgggttaggacgctggtcctcgggttggtgaacagcacactgactatcgaggagtttcactccaagctacaggaggccacaaatttcccactccggccatttgtgatccctttccttaaggctaatctgcctctacttcagcgcgagttacttcactgcgccaggttggctaaacaaaatccagctcagtacctggcccagcacgagcaactgctgcttgacgccagcaccactagtcccgtcgattcctccgaacttctgctggacgtgaatgaaaatggaaagaggcgtacccctgacaggaccaaggagaatggcttcgatcgcgaaccactccactctgagcacccgtctaagcgaccttgcactatttctccgggacagcgctactccccaaataatggactgtcataccagcccaacggcctgccacacccaactcctcctccaccacagcactataggttggatgatatggctattgcgcatcactatcgagattcttaccgacatccatcccacagggatctgcgtgacaggaatcggccaatggggttacacgggaccaggcaagaggaaatgatcgatcaccggctcaccgatcgtgaatgggcggaggaatggaaacacctggatcacttgctaaactgcataatggatatggtggaaaaaacacgtcgctcgcttacagtcttgaggcgctgccaggaagcagacagggaagagcttaattactggattcggcgatatagcgacgccgaggacttaaagaagggcggaggttcaagctcgagccactctagacagcagagtccggtaaatccagaccccgtagctctcgatgcccatcgagaattcctccataggcctgcctctggatatgttcctgaagaaatctggaaaaaggccgaggaagcggtgaacgaggtaaagaggcaagccatgaccgaacttcagaaagctgtctcagaagcggaaagaaaggcccatgacatgattactacagagagagccaagatggagagaaccgtggcagaagcaaaacgccaggctgcagaggatgccttagcggtcataaaccagcaggaggactcctcggagagttgctggaattgcgggagaaaagcctctgagacgtgtagtggctgtaacaccgctagatactgtgggtcgttttgccagcacaaggactgggagaagcaccaccacatttgtggccagacgttacaggctcaacagcagggtgatactccagcagtcagtagctcagtgacacctaacagtggggctggctctccaatggacactccacccgcagccacgcccagatcaacgactcccggaacaccaagtacaatagaaacaacacctaggtag

SEQ ID NO: 24248 - DNA, 165 bp, Artificial Sequence
  Description of Artificial Sequence: Synthetic coding sequence
atgattagcgttaagcggaacacatggagagcactgtctttagttattggggactgccgcaagaaagggaattttgagtactgccaagacaggaccgaaaaacattctactatgccagactcccctgtggacgtcaagacgcagagccgcctgacgcccccatag

SEQ ID NO: 24249 - DNA, 690 bp, Artificial Sequence
  Description of Artificial Sequence: Synthetic coding sequence
atgattagcgtgaagcgaaatacttggagagcactgtccctggtgattggcgactgccggaagaaggggaacttcgagtactgtcaggacagaaccgaaaaacatagcaccatgccggattccccggtggacgtgaaaactcaaagtaggctgaccccacctacgatgccgccacctcccaccacccagggggcaccccgaacaagcagcttcacccccacaacgctcaccaacgggactagtcattctcccaccgccctgaacggggctcctagccctcctaatggattttcaaatggccctagctcgagtagctcctcttcattggccaatcagcagctgccccctgcatgtggggctagacaactttccaagcttaagcggttcctcacgaccctgcagcagtttggcaacgatatctcccctgagatcggggagcgcgtacgcacactggtcctggggctggttaacagtacgctaactatagaggagtttcattctaaactgcaagaagccacgaatttccctttgcgcccttttgtgataccttttctcaaggctaatttgcctctgctccagagagagctgctgcattgtgcccgacttgctaagcagaacccggcacagtatctggctcagcatgagcagttgttgctcgatgctagtaccacatccccggtggatagctag

SEQ ID NO: 24250 - DNA, 81 bp, Artificial Sequence
  Description of Artificial Sequence: Synthetic coding sequence
atgcccgaccgtactgaaaagcactctacaatgcccgattcgccagtcgacgtcaaaacacagtccaggttgacgccatag

SEQ ID NO: 24251 - DNA, 510 bp, Artificial Sequence
  Description of Artificial Sequence: Synthetic coding sequence
atgatctcagtcaagagaaacacgtggcgcgcactgagcctcgtcattggagactgccggaagaaaggaaacttcgaatactgccaagacagaactgaaaagcattcaaccatgccagattcccccgtggacgtgaaaacacaatcaagactaactcctccgacaatgcctcctccacctacaacacaaggtgccccacgcacatcaagctttacacccaccacacttaccaatggaaccagccactctccaaccgctctgaacggagctccctctccccctaacggatttagcaatggaccatcttccagttcttccagtagcctggcaaatcagcagctgcccccagcgtgtggggctcgccagctgagtaaactgaagcggtttctgacaactcttcaacagtttggaaatgacattagtcccgagatcggggaacgggtccgaactcttgtgctgggactggtgaacagcacgttaaccatagaggaatttcacagcaagctctag

SEQ ID NO: 24252 - DNA, 147 bp, Artificial Sequence
  Description of Artificial Sequence: Synthetic coding sequence
atgatcagtgtgaagcgcaacacttggcgtgctcttagcctcgtcatcggtgattgtcggaaaaaaggaaacttcgagtattgtcaggatcgcactgagaagcacagcactatgccagactctcccgttgatgtgaagacccagtag

SEQ ID NO: 24253 - DNA, 276 bp, Artificial Sequence
  Description of Artificial Sequence: Synthetic coding sequence
atgcccgactccccggtggacgtgaagacacagtccaggctaacgccgcctactatgccaccacccccaaccacccaaggcgcacctaggacttcaagcttcacacccaccacgcttacaaacggtacctctcattcaccgactgctctgaacggtgcacccagccctccaaacgggttctccaacggaccgtcaagttccagctcaagttcgctcgccaatcaacagctccctccagcctgtggagcacgacagttaagtaaattgaagaggtag

SEQ ID NO: 24254 - DNA, 363 bp, Artificial Sequence
  Description of Artificial Sequence: Synthetic coding sequence
atgataagcgtgaagaggaacacgtggcgagcgctcagccttgtcataggagactgtaggaagaagggcaattttgaatactgccaggataggaccgagaaacactcaactatgcctgactcccctgtggatgttaaaacccaatctaggctgactccgccaaccatgcctccgcctcctactactcaaggagccccacgaacaagtagctttactcccaccaccctgaccaacggtactagtcactcacccaccgccctgaacggggctccttcccctccgaatggtttttctaatgggccatcgtcctctagcagctcctcgcttgcaaatcagcaactcccacccgcttgtggcgcttag

SEQ ID NO: 24255 - DNA, 1704 bp, Artificial Sequence
  Description of Artificial Sequence: Synthetic coding sequence
atgcctgacagtccggtggacgttaaaacccagtcccgattgacacctcccaccatgccccctccacctacaacccagggtgccccaagaacaagctctttcacgcctaccaccttgacaaacggaacctcccattctccaacagccttgaacggggctcctagtccacctaacgggttctctaacgggccatcgtcctcttcgtcctcaagcctagctaaccagcagctcccacccgcttgcggggcaagacagctgtccaagctaaagagattcctgacgacactacagcaattcggcaatgatatcagccccgaaatcggcgaacgcgtgaggactcttgtgttagggctggtcaacagcaccctgactatcgaagagtttcactccaagctgcaggaggcaaccaactttcctttgcgaccctttgtgatcccatttttgaaagccaacctccctttactccagagagaactgcttcactgcgctcgacttgcaaagcagaacccagcccagtacttagctcaacacgaacagttacttctcgacgccagcactacttcaccagtcgacagcagcgagctcctgctagatgtgaacgagaatggcaagcggaggacaccagataggacaaaagagaacggctttgaccgcgagcccctccattctgaacatcctagtaaacgcccatgtactatatcccccggacaaaggtacagccccaacaacgggctgtcctaccagcccaacgggctacctcatccaacccctccacctcctcagcattaccggctggacgatatggctattgcgcatcactatcgagactcttaccgacacccgtcccatagagatcttagagatcggaatcggcctatgggcctgcatggtacccgacaggaggagatgatcgaccaccgattaacagatagagaatgggctgaggagtggaagcatctagaccatcttcttaactgcattatggatatggtagaaaagaccagacggtctttaactgtgctgaggagatgccaggaggccgatcgggaggaactgaactactggatccgacgatatagtgacgcagaggacctcaagaagggaggcggatcctccagctcccactcacgccagcaaagccccgtgaatccagacccggtggccctcgatgctcaccgggagttcctccataggcctgccagtgggtatgttcccgaggagatatggaagaaggccgaagaggctgtgaacgaagttaaacggcaggccatgactgaattgcaaaaagcagtgtctgaggctgagagaaaagctcatgatatgataaccaccgagcgagccaaaatggagcgcaccgtcgccgaagctaaacgtcaggcagccgaagatgcactggctgtgatcaaccagcaggaggatagttcagaatcctgctggaattgcggtcgtaaggcgtcagagacatgctccggatgtaacacagcacggtactgcggttccttctgtcagcataaagactgggaaaagcaccaccacatctgcggacagacactgcaggcccaacagcaaggcgatactcccgcagtgtcatcgagcgtgacccccaattctggggcaggaagtccaatggatacccccccagcggcaacacccagatcaaccacaccaggtaccccaagtactattgagactacgccccgatag

SEQ ID NO: 24256 - DNA, 258 bp, Artificial Sequence
  Description of Artificial Sequence: Synthetic coding sequence
atgatttctgtgaaacggaatacatggagagccctttcactggtgatcggtgattgcagaaaaaaaggtaacttcgaatactgccaggacagaacggagaagcattcaacaatgcccgacagccccgtggatgtgaaaacccaatcccgcctaactccgccaacaatgccaccacccccaactacgcagggcgctccccgaacatctagctttacgcctaccactttgaccaatggtacgtctcatagccccacatag

SEQ ID NO: 24257 - DNA, 516 bp, Artificial Sequence
  Description of Artificial Sequence: Synthetic coding sequence
atgcccgactcccccgtggatgtgaaaacccaatcacgcctaacaccccctaccatgccacctcctcccacaactcagggagctccccgtaccagcagctttactcctactactctcactaatggcacgtcccattctccaacagccctaaacggagctccttcacctcctaatgggttttccaatggcccaagcagtagctctagctcaagcctagccaatcagcaactaccgccagcctgtggagctagacagctgtccaagcttaagaggttcttgaccacattgcagcagtttggcaatgacatttcccctgaaataggggagagagtgcgcaccctagtcctggggctggtgaatagtacccttactatcgaggagttccatagtaagctgcaggaggctacgaacttccccttaagacctttcgtgataccatttctgaaggctaacctccctctgcttcagagggagctgctgcattgcgctagactggcaaagcaaaaccccgcatag

SEQ ID NO: 24258 - DNA, 270 bp, Artificial Sequence
  Description of Artificial Sequence: Synthetic coding sequence
atgcccgatagcccagtggacgttaagacccaatcccgcctcaccccacccaccatgcccccaccacctacgacacagggcgctcctcgcacctcttccttcacaccaaccaccctgaccaatggaaccagtcactcccctactgccctgaatggggcacctagccctcccaacggattctcaaacgggcctagttcttcatcaagtagttcactggccaaccagcagctgcccccagcatgtggcgcaaggcagctgtccaagctgtag

SEQ ID NO: 24259 - DNA, 285 bp, Artificial Sequence
  Description of Artificial Sequence: Synthetic coding sequence
atgatcagtgtaaagcggaacacctggcgagctctttccctcgttatcggggactgtagaaagaagggcaatttcgaatattgccaggatagaaccgagaaacacagtacaatgccagattcccctgtcgatgtcaaaacccaaagcagactgacccctcctacaatgcctccccctcctaccacacagggcgcaccaaggacatccagtttcaccccaactaccctgactaacggtacgagccattctccgacagcactgaatggtgcgccatcccctccatag

SEQ ID NO: 24260 - DNA, 306 bp, Artificial Sequence
  Description of Artificial Sequence: Synthetic coding sequence
atgccagacaggaccgaaaagcacagcacaatgcctgactcccccgtcgatgttaaaacccagagtcgcttgacaccccctaccatgcctccccctccaactacccagggcgctccaagaacatcatctttcacaccgacgacactcaccaacggtacaagccattccccaacggctctaaatggtgcgccttcccctcctaatggtttcagtaacgggcctagtagcagttcctcttcctcactggctaaccagcaactgccccctgcgtgtggcgcacgtcagctttccaaattgaaacggtag

SEQ ID NO: 24261 - DNA, 471 bp, Artificial Sequence
  Description of Artificial Sequence: Synthetic coding sequence
atgattagcgtcaaacgcaacacttggagggcactgtcccttgtcataggggactgtagaaagaagggaaacttcgaatattgccaagacagaacagagaagcacagcacaatgccagattctccggtggatgtcaaaacccagagccggctgaccccccctactatgccacccccacccactacccaaggagcacctaggacctcctctttcacccccactacattaactaacggaacgtctcattccccaacagccttaaacggagctccgtcacctcccaacggctttagtaatgggcctagcagttcttctagctcatccttagccaatcagcagttacccccagcatgtggcgctaggcaactgagcaagctgaaacgttttttgaccaccttgcagcagtttggaaatgacatttcacccgaaatcggagaacgcgtgaggaccttggtccttggccttgtatag

SEQ ID NO: 24262 - DNA, 363 bp, Artificial Sequence
  Description of Artificial Sequence: Synthetic coding sequence
atgatctcggtcaaacgtaatacatggagggcactttctctcgtgattggggactgccgcaagaaaggaaattttgaatattgccaggataggactgagaagcatagcaccatgccagactcccctgtggacgtcaaaacacagagtaggctcacgccacccaccatgcccccacctccaactactcagggtgcccctaggacatccagctttacccccactactcttacaaacggcacaagtcatagccctaccgccttgaacggagccccatctccacccaatggtttctcaaatggcccaagttcttcaagcagctcttccctggcgaaccagcagctacctcccgcatgcggagcttag

SEQ ID NO: 24263 - DNA, 1815 bp, Artificial Sequence
  Description of Artificial Sequence: Synthetic coding sequence
atgatcagcgtcaaacggaacacttggcgggctctttcactcgttattggagactgccgtaaaaaaggaaacttcgagtattgccaggaccggacggaaaagcactccaccatgcctgattcccccgtggacgtaaaaacccagtccagactgaccccgcctaccatgccaccgcctccaactacccagggagcgccacggactagctccttcacgccaacgaccctgacgaacggaacctcgcactcacccacagccctcaatggagctccttctccacccaacggattttcgaacggtccttcctccagctcctcttcgtcgctggcaaatcagcagctgcctccagcctgcggcgctcggcagctctctaaacttaaacgctttctcaccaccctgcagcagtttggtaatgatatcagccccgagatcggtgagcgggtgcgtaccttagtgctggggctggtcaactctaccctgaccatcgaggaatttcacagcaagcttcaagaagctacaaattttccgctgcgcccttttgtgatcccttttttgaaagccaatctccccctcctgcagcgtgaattgttacattgcgcaaggctggctaaacaaaatccggcacaatacctggcacagcatgaacagttattgttggatgcttctactactagcccagtggactcaagtgagcttctgttggatgtcaacgaaaacgggaagagacggacaccagacagaaccaaggagaatggcttcgatcgggagccacttcactcggaacacccctctaagaggccctgcactatttcaccaggtcagagatactctcctaataacggactcagttaccagcccaacggactcccacacccaacgcctcctcctccgcagcactaccgtttggatgatatggccatcgcacatcattacagagatagctataggcatccgagccaccgagacctgagagaccggaatagacccatgggattgcatggaactagacaggaggagatgatcgaccacaggttaaccgatagagagtgggcagaggagtggaagcacctcgatcacctgttgaactgtattatggacatggtggagaagacacgaagatcactaacagtgctgaggcgttgccaggaggctgatagggaggagctcaattactggatccgccgttacagcgatgctgaggacctgaagaaaggtggaggaagtagctcgtcacacagtcgacagcagtccccggttaatcccgatcctgtggcgctcgacgcccaccgggagtttctgcatagaccagctagtggttacgtcccagaggagatttggaagaaagcagaggaagccgtgaatgaggttaaacgccaggcaatgacagaactgcagaaagctgtgtctgaggctgagcgtaaagcccacgacatgataactacggagagggcgaagatggagcgcacagtggccgaagcaaagcgccaggcagcggaagacgccctggccgtcattaatcagcaagaagattccagcgagagttgctggaattgcggacgcaaagcgagcgaaacctgctccggctgtaatacagcccgatactgcggttccttttgccagcacaaggattgggagaaacaccatcacatttgcggccagacactgcaggctcagcaacaaggcgatacacccgctgtgtcctcgtctgttactcctaatagtggagcgggatctcctatggacaccccaccagccgcaactccgagatcaacaactcctggcaccccatccacaatagagactactcctcggtag

SEQ ID NO: 24264 - DNA, 3105 bp, Artificial Sequence
  Description of Artificial Sequence: Synthetic coding sequence
atggctgctgccacaggagcggtcgccgcaagcgcagcttcgggccaggcagaaggtaaaaagatcactgaccttcgcgtgattgatctaaagagtgagcttaagcgcagaaacctggatataactggagtgaaaacggtgcttatttctaggttgaagcaggcgattgaagaggaagggggtgaccccgacaacattgaattaacggtttccactgatactccaaataaaaagcccacaaaaggcaaaggtaagaaacatgaggcagacgaattgtccggtgatgcctccgtggaagacgacgcgttcatcaaagattgcgaactggaaaaccaggaggcccacgagcaagacggcaatgatgagctgaaggatagcgaggaattcggggaaaacgaagaggaaaacgtgcactccaaagaattgctttctgcagaggaaaataaacgggcacatgagctgattgaggcagagggtatcgaggacattgagaaagaagatattgagagccaggaaatcgaggctcaggagggagaggatgatacatttctgactgcccaagatggagaagaggaggagaatgagaaagacatagccggatcaggggacgggactcaagaggtcagcaagcctctcccgagcgaggggtctctagctgaggcagaccatactgcacatgaggaaatggaagcccacacaacagtaaaagaggctgaggatgataacatttcagtcactatccaagcggaagatgctatcacactagattttgacggagacgaccttttagaaacagggaaaaacgtgaagatcacagactccgaggcttccaaacccaaggacggccaggatgcgatcgcacaatcaccagagaaggaatctaaggactacgaaatgaatgccaaccataaagacggtaaaaaggaggactgtgtgaaaggcgatcccgtggaaaaagaggctcgcgagtcttcaaagaaagcagaatccggggataaggaaaaagatactttgaagaaaggtccgagttccaccggtgcctcggggcaagccaagtccagctcgaaagagagtaaggattcaaaaacctccagcaaggatgacaaagggagtacttcctccacctctggatcaagtggaagcagtaccaagaatatctgggtctcagggttaagctccaataccaaggccgctgatttgaaaaacttattcgggaaatatggcaaagtcttgtctgccaaggttgtgacgaacgcaaggtcacctggagctaaatgttatggcatcgtcacgatgtcctcgagcactgaggtgagccggtgcatcgcccacctgcacaggactgaactgcatggccagctgatttccgttgagaaggttaagggcgatccctcgaagaaggaaatgaagaaggagaatgatgagaaatcctcttccaggtctagtggcgacaaaaagaatacgtctgacagatcatccaagacccaagcctccgtgaaaaaggaagagaagaggagtagtgagaagtctgagaagaaagagtcaaaggacaccaagaaaattgaagggaaagatgagaagaatgataacggcgcttcaggtcagacttccgagtctatcaagaaatctgaggaaaaaaagaggatctcctccaagtcaccagggcacatggtgatcctcgatcagactaagggggatcattgcaggcctagcagacggggacgctacgagaagatacatggaagaagtaaggaaaaggagcgagcatccctagacaagaagagggacaaagattatagacggaaagaaattctgccttttgagaagatgaaagagcagcgcctgagggagcatctcgttcggttcgaacgattgcgtcgcgcaatggaactccgccgtagacgagagattgccgagcgagaaagacgcgagcgcgagaggattaggatcatcagagagagggaagagagggaacgcctgcagcgcgagcgcgaacgattggagatagagcggcagaaattggagagggagaggatggagcgagagcgactggagagggagcgtatccggatcgaacaagagagaagaaaggaagccgaacgaatagccagggaacgtgaggaactgcggagacagcagcaacaactccgttacgagcaggaaaagcggaatagtctgaagagacctcgcgacgtggaccataggagggacgacccttactggagcgagaataagaaactttccctggacactgacgcgagattcggccacgggagcgactattctcgtcaacaaaaccgctttaacgatttcgaccatagagagcgaggcagatttcctgaatcatctgccgtccaatcttcttctttcgaacgtagggatcggtttgtcggacagtcagaagggaaaaaagctcgacccacagcaagaagagaagaccctagcttcgagaggtaccccaagaacttctcagatagccggaggaacgaacctccgcctccaagaaacgagttacgtgagagtgaccggagggaagtgaggggggagagggacgagcggaggactgtaattatccacgatagaccagacatcacacatcccaggcatccgagggaagccggaccgaatccctcgcgacccacttcctggaagtcagaagggagcatgtccaccgacaaaagggagacgcgggtagagcggccagaaaggagcggtagagaagtttccggacacagtgtgcggggtgcccctcccggtaataggtcatccgcttcgggctatggaagtagagagggcgacagaggagttatcaccgatcggggtggcggatctcagcactatccagaggagaggcatgtggtcgagcgacatggtcgcgacacctccggcccacggaaagaatggcacggcccaccttctcagggaccgtcttaccacgatactagacgaatgggcgacggcagagctggcgcaggaatgatcacgcagcattcctcaaacgcttccccgattaatcgtattgtccagatttctgggaactccatgccaagaggttctgggtctggctttaaaccatttaaagggggtccacctcgaagattttag

SEQ ID NO: 24265 - DNA, 1812 bp, Artificial Sequence
  Description of Artificial Sequence: Synthetic coding sequence
atgagttcatcaaccgaggtgtcaagatgcatcgcacatctgcatcgcaccgagctgcacggccagttgatctccgtcgagaaggtcaaaggcgatccttctaagaaagaaatgaaaaaagagaatgacgagaaaagctctagcagaagcagcggcgacaagaagaacacttctgacagatccagcaagacccaggcgtccgtgaaaaaagaggagaagcgcagctcagagaaaagcgaaaaaaaggaaagtaaggacacgaaaaaaatcgaaggtaaagacgagaagaacgataatggcgcaagcgggcagactagcgagtccatcaaaaagtctgaagagaagaaacggatatcatcaaaaagtccaggtcacatggttattctggatcagaccaagggcgatcactgtagacccagtagaagagggcgatatgagaagatccacggcaggagcaaggagaaagaaagggcgagcctggataagaagagagataaagattacaggcgaaaggaaattcttccattcgagaaaatgaaagagcagcgactccgcgagcacctggtgagattcgaacggctcagaagagctatggagctgaggagacggagagagatcgctgagagggaaagaagggaacgcgagaggatccgcattattagagaacgggaagagagggaaaggctccagcgagaaagggagagactcgaaatcgagcgacagaaactggagcgcgagaggatggagcgggaaagactggaacgcgaacgcatccgaatagagcaggagaggagaaaggaagctgagcgtatcgcaagggaacgagaagagcttcgtcggcagcagcagcagttgaggtatgaacaggagaagaggaatagcctaaagaggccacgggatgtggaccatagaagggatgatccgtattggtcagagaacaagaaacttagcctggacaccgacgctagatttgggcatggtagtgattatagccgacagcaaaaccgttttaacgacttcgaccatagggagagaggcagattccctgagtcgagcgcagtccagtccagcagcttcgaacgccgagataggttcgtgggacagagtgaagggaagaaagccagacctacggccagacgcgaggaccctagctttgaacgctacccgaagaacttttctgattctaggaggaacgagcctcctcctccaagaaatgaactgagggaatccgaccggcgagaagtgcggggagagcgagatgaaaggcgcacggtgatcattcatgatcgtccggacattacacacccaagacaccccagggaggcagggccaaacccctcccgtcccacctcctggaagtcggagggttctatgagcacagacaaacgagagactagggttgagcggccagagagatcaggaagggaagtatctggacactcagttaggggggctcccccaggcaacagatctagcgctagtggatacgggtcgagagagggggacagaggagttatcaccgacagggggggaggatcacagcattatcccgaggagcgtcacgtggtggaaagacatgggagggatacttcggggcctagaaaggagtggcacggacctcccagtcaaggcccatcgtatcacgacacgagaagaatgggcgatggccgagcgggtgcaggaatgatcacccagcactcaagcaatgcctctcccatcaaccgcatcgtccagatttccgggaactcaatgcctcgagggagcggctctggcttcaaacccttcaagggaggacctccacgcaggttttag

SEQ ID NO: 24266 - DNA, 303 bp, Artificial Sequence
  Description of Artificial Sequence: Synthetic coding sequence
ggtgtgatcaccgacaggggtgggggttctcaacactatcccgaggagcgacacgttgtggaacggcacggccgagatacctctggaccaaggaaagaatggcacggcccacccagccaggggccatcctatcatgacacccggagaatgggcgacgggcgagccggagccggaatgatcacccaacattcatctaacgcttctcctattaatcggatagttcaaatttctggcaattctatgcctcggggaagcgggtctgggttcaagccattcaagggaggccctcctagaaggttttag

SEQ ID NO: 24267 - DNA, 552 bp, Artificial Sequence
  Description of Artificial Sequence: Synthetic coding sequence
atgaacggattcagtaccgaagaagacagcagagagggtccgccagccgctcctgccgctgccgctcccggatatggccagagctgctgcctgatcgaagatggcgaaagatgcgtccgtcccgcaggcaacgcctcctttagcaagagagttcagaaaagcatcagccagaagaagctgaagctcgacatcgataaatccgtaagacatctgtacatctgtgattttcataagaacttcattcaatccgttaggaacaagaggaaacgaaaaaccagtgacgacggcggtgactctcccgagcatgacacagacattccagaggttgaccttttccagctccaggtgaataccttgcgccgatataaaaggcattacaagcttcagacacgccctgggttcaacaaggcccagctggcagagaccgtctcacgccacttcagaaacattcctgtgaatgagaaggagacgctcgcatactttatctatatggtaaaaagcaataaaagtcgattggatcagaagtccgaaggcggaaagcaacttgaatag

SEQ ID NO: 24268 - DNA, 414 bp, Artificial Sequence
  Description of Artificial Sequence: Synthetic coding sequence
atgaacgggttttcaaccgaagaggatagtcgagagggtcccccagccgcacccgctgctgccgcacccggatacggtcagagctgttgtctcatagaagatggcgaaaggtgtgtgcggcctgctggcaatgcaagcttcagcaaaagggtccagaaatcaatcagtcagaagaaactgaagctggacatcgataaaagcttacaggttaacaccctgcgtcgctataagagacactacaagctgcagaccagaccaggctttaataaagctcaacttgccgaaacagtttcacgacacttccgaaacattcctgtgaatgagaaggagacactagcctactttatctacatggtgaaatccaataagtctaggttggaccagaagtcagaaggcggtaaacagctggaatag

SEQ ID NO: 24269 - DNA, 429 bp, Artificial Sequence
  Description of Artificial Sequence: Synthetic coding sequence
atgaatggattcagcacagaagaggattcccgagagggccctcctgccgctcctgctgcggctgcccctggatacggacagagttgctgcctcatagaagacggagaacggtgcgtgagacccgctggcaacgctagcttttccaaaagggtacaaaaaagcatctctcaaaaaaagctgaaactggatattgacaaaagcgtagacctgtttcagctgcaagtcaatacactgagaagatacaaacgccattataaacttcagactcggccagggttcaacaaagcgcaactggcagaaacagttagccgccatttcaggaacattcctgttaatgagaaagaaaccctggcttactttatatatatggtgaagtctaacaaaagtcggcttgaccagaagagcgaaggagggaaacagctggagtag

SEQ ID NO: 24270 - DNA, 540 bp, Artificial Sequence
  Description of Artificial Sequence: Synthetic coding sequence
atggcggctaccgagccaattttggcagcgactggtagtcccgcagcggtgccgccagaaaagctcgaaggagccggaagtagctctgccccagaaagaaactgcgtgggctcgtctttacctgaggccagccctccagctcctgaaccatccagcccgaatgccgctgtccccgaagcaatccccacccccagagctgctgcttcagccgcactggagctgcctctgggacctgcaccggtgtcagtggcccctcaggctgaagctgaagcacgcagcacaccaggccctgccggtagcagactgggtcccgagacctttcggcagaggtttaggcagtttcgttaccaggatgctgctggcccacgcgaagcctttcggcagctgagagagctgagccggcaatggctccgccctgatattcgtaccaaggagcaaattgttgagatgctcgttcaggaacagttgttggcaatcctgcctgaggctgcccgtgcgcgaagaatcaggaggcggactgacgtaagaatcacagggtag

SEQ ID NO: 24271 - DNA, 540 bp, Artificial Sequence
  Description of Artificial Sequence: Synthetic coding sequence
atggccgctaccgagcctattctcgctgcaacaggtagcccagcagcagtgccacccgaaaagcttgagggcgctggttccagttctgcccctgagcggaactgcgtcggcagctccctgccagaagcgagcccccctgctccggaaccatcatcccccaacgctgccgtgccagaggctataccaacgcccagagccgcagcctcagccgctctggagttaccactgggaccagcacctgtgagcgtcgcaccacaagcggaggccgaggccaggtcaacacctggccctgcgggtagcaggctgggaccggaaactttcaggcagcggtttagacagtttcggtaccaagatgctgccggtcccagagaagccttccggcaactgcgggagctctctcgtcagtggctgaggcctgatattaggactaaagaacagatcgtcgaaatgctggtccaggagcaactgctggccattctcccagaggcagccagagctcgaagaattcgcaggcgcactgatgtcaggattacagggtag

SEQ ID NO: 24272 - DNA, 3978 bp, Artificial Sequence
  Description of Artificial Sequence: Synthetic coding sequence
atggaggcagtctccagagtgttcccagccctcgcgggacaagctcctgaagagcagggtgagattattaaggtcaaggtgaaggaggaggatcacacctgggatcaggagtccgccctgcgacgcaacctcagctatactagggaactgtcacgtcaaagattccgacagttctgctaccaggagactcccggaccacgcgaagccctctcacaactgagagaactctgtagacagtggttgaatccagaaattcacaccaaagagcagattctggagttattggtgctggagcagtttcttactatcctgccggaagaacttcagtcttgggttcgtgagcataaccccgagtccggggaggaagtggtaacacttctagaagatttagagcgggagctggacgaacccaggcaacaggttagtcagggaacttatggacaggaagtctccatggaggaaatgattcccctggactccgccaaggaatcattgggaacccagctccagtctatggaagatcgtatggaatgtgagtcaccagagcctcatcctctccaggacaatggaagcttcctctggtttagtatgatgtcacagagcatgggcggtgataatctctcatccctagatacaaacgaagccgagatcgaacccgaaaatatgagagagaagttcttccggagcctggcacgcctcctagaaaataagagcaataacactaagatattctccaaagcaaagtactgccagcttattaaagaagtgaaggaggccaaggcaaaggcaaagaaagaaagcgttgactaccggagactggctcgattcgacgtgatcctcgtacagggcaatgagaaactcatcgaagctgtcaatggcgaaaccgacaagatcaggtattaccttcattccgaggatctgttcgacatcctgcataacacccatctgagtattggacatggagggcgtacgcgtatggagaaagagttacaggcaaaatacaaaaatattactaaagaggtgatcatgctctacttgacgctttgtaagccctgtcaacagaagaacagcaaattgaagaaggtattgacctccaaaagtatcaaagaggtctcttcccgatgccaagttgatctcatcgatatgcagctgaatcccgatggagaatatcgctttatccttcactaccaggacctttgcaccaaactcacatttcttagaagcctcaagtccaaacggcctactgaggttgcccacgccctactggacatctttacaatcattggcgcaccctctgtgttgcagtccgacaacggtagagaattcagctcccaggtggtgtcagaactttccaacatctggccagagttgaaaatcgtgcatgggaagtcccagacctgccagtcgcagagcagcgctgagcaaaccgaggacatacgaaaacgtatattctcctggatgcagacaaataattcaagccattggaccgagtttttgtggtttatccagatgtcccagaatcaaccttatcaccgatccatgcagcaaacaccttgtgagtctgctttctcttccgaggccaagctcggcctgtctcacagtcagttaacggaggaactggtggcctccctacataccgagaacgagctcgatcaggccgataaggaactggagaacacactcagagctcaatacgaggaaaatattgagaccgggacggattcaagcgatatcgaggaaaatctgagtgtgacaccaaaagtggctgagaaaagccctccagaatcccggcttcgatttctctcctgcgtggtatgcgaaaaagagtgtacgggtgtgaattcatgtatctcctgcgacggaaacattcatgcaatctgcggggtcccgtcccagcatggaacagaggggtgtggaagacagatcacatgctctctgtgctatgagaccagcaccatgaagaggaaacacgatgagatccagagatctctgcccgtgaagccatcgaagatgctgaaacccagtgggacaccctttagcccagataaggtcggcgattggatggccaagcaagccagtctcgacttctttgtcaaaaagagacatgcattctcagaacacagctcctctaataaacggaacgttaacaaccggtcttaccctgaagaaggaaagacaaagcgagtgcatgcttccttcacccgaaaatatgaccccagctatatcgagttcggcttcgtggccgttatcgacggggaggttttaaagccccagtgtattatttgcggagacgtgctggctaatgaggcaatgaagccaagtaagctgaagcgccacttatatagtaagcacaaggagatcagtagtcagccgaaggaattctttgaacgcaagtcatcagagttaaaaagtcagcccaaacaggtcttcaatgtgtcccacataaacatctcagctcttagagcctcctacaaggtggctctgccagtggctaaaagcaagacaccttatactattgccgaaacgctggtcaaggattgcattaaggaagtgtgtcttgagatgctgggagaatctgccgcaaagaaagtggcacaggtccccctgtccaacgacactatcgccagacgcattcaggagttggctaacgacatggaggatcaactcatcgaacagataaagctggccaaatacttcagcctgcaactggacgagtgtcgggatattgcgaatatgattattctgctggtatacgtgcgctttgagcatgacgatgacattaaagaggagttcttcttcagcgctagcctgcccacaaataccacctcctcagagctatatgaggccgtcaaaaattatattgtaaataagtgtggtctggagttcaaattctgtgtaggggtgtgttctgatggggcagctagcatgaccggaaaacactcagaggtagtgacccagattaaagagctcgcgccagagtgcaaaacaacccactgctttatccatagagagtctctcgccatgaagaagattagcgcagagctcaactcagttctgaatgacatcgtaaaaattgtgaactatattaagagtaacagcctcaattcgagactgttcagcctcctctgtgataacatggaagcggatcacaaacagctgctcctgcacgcggagattcggtggctgagtagggggaaggtgctgtcgcgcatgtttgaaatcagaaacgaattgctcgtgttcctgcaaggtaagaagcctatgtggagtcagctttttaaggacgtcaactggaccgccaggcttgcctacctctccgatattttttccatatttaacgaccttaatgcgtctatgcagggcaagaatgcgacctatttcagcatggcagataaggtggagggacagaaacaaaaactggaggcctggaagaataggatttctactgactgttatgatatgttccataaccttacaacgatcatcaacgaagttgggaacgatctggacattgctcacttgcgcaaggtaatcagcgagcacctaactaacctgctagaatgcttcgagttctattttccctccaaggaggacccgaggataggaaatttatggatacagaaccccttcctgagttcaaaagataaccttaacctcacagtgacgttgcaggacaagctcctgaaactcgccacagacgagggcttgaagatctctttcgaaaacacagccagcctcccgtccttttggattaaagcaaagaacgattacccagagctcgccgagatagccttgaagctcttgctgctctttccaagcacgtacttatgcgagaccggcttttcaacactaagtgttattaaaaccaaacatagaaactctctcaacatacactaccctttgagggtcgctttatcaagtattcagccgagactggacaaactgacgagcaaaaaacaagcacacctttcccattag

SEQ ID NO: 24273 - DNA, 2706 bp, Artificial Sequence
  Description of Artificial Sequence: Synthetic coding sequence
atggaggccaatcagtgccccttggtcgttgagccaagctatccggatctggtcattaacgtcggcgaggtgactctaggcgaggaaaacaggaagaaactgcagaaaatccagagggatcaggaaaaggagcgagtaatgagagctgcgtgtgctctgctgaactcgggtggaggcgtgatcagaatggccaagaaagtggagcaccctgtggagatgggcctggacttggaacagagtctgcgtgaactgattcagagcagcgatctccaggcgtttttcgagacaaaacagcagggacgttgcttttatattttcgtgaagtcatggtctagcggtccttttcctgaggatcgctcagttaaaccacgtctgtgctccctctcgtcgagtctttacaggaggagtgagacaagcgtgaggtctatggactcccgtgaggctttctgctttctgaagaccaagcggaagcccaaaatactcgaggagggccctttccataagatccataagggcgtgtaccaggaattgcccaattctgaccccgctgatcccaactctgacccggctgacctaatcttccagaaagactacctggagtacggagagatactgccttttcctgaaagtcagctggttgagtttaaacagttctcaaccaagcacttccaggagtacgtgaaacggacgatccccgaatacgtgccagcttttgcaaatacaggagggggttacctctttatcggggtcgacgacaaatccagggaggtgctcggatgtgcgaaggaaaacgttgacccagacagcctgcgaagaaaaattgagcaagcaatctataagcttccctgtgtgcacttttgccagccacagagacctattacattcacactaaagatcgttaatgtgctaaaaaggggagagctgtacggttacgcatgcatgatcagggtaaacccattttgttgtgccgttttctctgaagcacctaactcttggattgtggaggataagtacgtgtgctctttgacgaccgaaaaatgggtgggaatgatgaccgacactgatcctgatctgcttcagctaagcgaagatttcgagtgtcagttgagcctcagctctggcccaccactgagtaggccggtgtattccaaaaaaggcttagagcataaaaaggaactccagcagcttttgttctcagtgccgcctggatatctgcgatacacacccgagagcctttggcgtgacctgatttccgagcaccgcggtcttgaggagctgataaacaagcaaatgcagcctttttttaggggcatactgatcttcagccggagctgggccgtcgacttgaatctgcaagagaagccaggtgtcatttgtgacgctttgctgatagcccagaacagcactccaatactgtatacaatccttagggagcaggacgcagaggggcaagattattgcactcgaacagcctttacattaaagcaaaaactggtgaatatgggcggatacacaggcaaagtttgcgtacgagccaaagtgctctgtctgtcacctgaatcttccgccgaggctctggaagctgccgtgagccccatggactatccagcatcctacagcttggccggtacacaacatatggaggccttgcttcagagccttgtcatcgtgcttctgggcttcagatcattgctttctgaccagctgggttgcgaagtgctgaacttactcacagcccagcagtacgagattttcagcaggtcactacggaagaatcgagagctttttgttcacgggctccccggaagcgggaagacaattatggctatgaaaatcatggaaaagatcaggaacgtcttccactgtgaggcacacaggatactgtatgtatgtgagaaccagcctctgcgcaatttcattagcgaccggaatatatgccgtgctgagacccgtaagacctttcttagagaaaacttcgaacatatacagcacatcgtgatcgacgaagcccagaacttcagaacagaggacggcgactggtatgggaaggcaaagtccatcacccgcagagctaaagggggtcctggcattctgtggatttttttggactactttcagacttcacacctcgactgtagcgggctaccgccattgagcgatcagtaccccagagaagaactcacacgtattgtcaggaacgccgaccctattgcaaagtacctgcagaaggagatgcaggtgattcggtcaaatccgtcttttaacatacccacagggtgtctggaggtcttcccggaggctgaatggagtcagggcgtccagggtactctgagaattaaaaaatatcttaccgtggagcagataatgacctgtgttgccgatacatgcaggcggttcttcgaccggggttatagcccaaaagacgtagccgtcctggtgtccactgccaaggaggtcgagcattacaagtatgaattgttgaaggccatgaggaaaaagagggtggttcagctctctgatgcctgtgacatgctgggagatcatatcgtactagattccgttagacggttttcagggctggagcgatcaatcgttttcggtattcacccgcgtacagcagatccagccatcctgccaaacgttctgatttgtctggcgtctagagcaaagcaacacctttatatatttccatggggaggtcattag

SEQ ID NO: 24274 - DNA, 2706 bp, Artificial Sequence
  Description of Artificial Sequence: Synthetic coding sequence
atggaggccaatcaatgcccacttgtggtcgaaccaagctaccccgatttagtgattaatgttggagaagtaacgttgggagaggaaaatagaaagaagcttcagaagatccagcgagaccaagaaaaggagcgggtgatgcgagctgcatgtgcccttctgaattccggaggtggagtgatcaggatggctaaaaaagtcgagcatcccgttgaaatgggactggaccttgagcaaagtttgagagaactcattcaatcttcggatttgcaggcattctttgagacaaaacaacaaggcaggtgcttctatattttcgtgaaatcatggagtagtggcccatttccggaggaccgcagcgtgaagcccagactttgtagtctgagtagctcactgtaccgtcggagtgaaacgtccgttcgcagtatggactcgcgcgaggccttctgtttcctgaagaccaagaggaagccaaagatcctggaggaagggccattccacaagatccacaaaggggtataccaagagctgcctaattcagaccccgctgacccaaattcagatccagccgaccttatctttcagaaagattacctggagtatggcgaaatcctgccgttccctgaaagtcagctggtggagtttaagcagtttagcactaaacacttccaggagtacgtaaaaaggacaatccccgaatacgtgcctgctttcgccaacactggcggtgggtacttattcatcggagtcgacgacaaatcaagggaagtgcttggatgcgctaaggagaatgtggaccctgattccttgcgccgaaaaattgagcaggctatttataagctgccttgtgtgcatttttgccagccgcaaagacccatcactttcaccctcaagatcgtgaatgttctgaagaggggcgaactctacgggtatgcctgtatgattagggtgaatcccttctgttgtgcagtcttcagcgaagctcctaattcctggattgtggaggataaatacgtgtgctctctcacaactgagaagtgggtgggcatgatgacagatactgaccccgatcttctgcagctgagtgaagattttgagtgtcagctgagcttatcctcaggtccacccctgtcaaggccagtctactcgaaaaaaggactcgagcacaagaaggaactgcagcagctcttgttttctgtcccacccggatatctgaggtatacgccggagtcactgtggagggatttgatcagtgagcacaggggtctcgaagaacttatcaacaaacaaatgcagcccttctttcggggaattcttatcttcagccgttcttgggctgtggacctgaatttgcaggagaagcccggagtcatttgtgatgcgcttcttatcgcccagaattccacgccaatcctgtacacaatccttcgggagcaggacgccgaaggacaggactactgtacccggactgcctttacgttaaaacagaaactggtgaatatgggcggatacacaggaaaagtctgtgtgcgggcaaaggtgctgtgcctgagccccgagtccagtgcggaggccctcgaagcagcagtgtcccccatggattacccagccagttactccctagcaggaacccaacacatggaggctctgcttcagtcactggttatagtactgcttgggttccggtcgcttctgtctgaccaattgggctgtgaagtgcttaacctcttaacagcccagcagtacgagattttctccagatcacttaggaagaaccgggagctcttcgtccatggcttacccggaagcggcaaaacaatcatggccatgaagatcatggaaaagatacggaatgtatttcattgtgaggcacaccgaatcctgtacgtatgtgagaatcagcccctgagaaattttatcagtgatcgcaatatctgccgagctgagacccgcaagacttttttgcgggaaaactttgagcatatccaacatattgtgatagacgaagcccagaactttagaacagaggatggagattggtacggcaaggcgaaaagcatcacccgccgtgccaaaggaggcccaggaatactgtggatcttcctcgactacttccagacaagccaccttgactgtagtggccttcccccacttagcgaccagtatccgagagaggagctgacccgcattgtacgcaacgccgatccaatcgcaaagtatcttcagaaggagatgcaggtgataaggtcgaatccatcttttaacattcccaccggatgtctcgaagtgttccccgaagccgaatggtcccagggtgtgcaggggaccctgcggattaagaaatatctaactgtggaacaaataatgacctgtgtcgcagacacgtgtagacgtttttttgatcgcggttatagccctaaagatgtagctgtgctggtgtcaaccgccaaggaagtggaacattataagtatgagctccttaaagcaatgagaaaaaagcgcgtggttcaactgagcgacgcctgcgacatgctgggcgaccatattgtcctcgactccgtgcgcagattctcggggctcgaacggtcgattgtatttggcatacatccccgaactgctgatcctgctatcctcccgaacgtgctcatatgtctggcatcccgcgctaagcagcatttatacattttcccatggggcggacattag

SEQ ID NO: 24275 - DNA, 273 bp, Artificial Sequence
  Description of Artificial Sequence: Synthetic coding sequence
atggaggctaaccaatgcccactggtggtggaaccctcttacccagacctcgtaattaacgtgggcgaagtgacactcggagaagagaatcggaaaaaactgcaaaagatccagagggatcaggagaaggagagagtgatgagggcggcttgtgcccttcttaattccgggggaggggttattcgaatggctaaaaaggtggaacacccagtcgaaatgggactagacctcgagcagtctttaagagagctgatccagtcttccgacctgtag

SEQ ID NO: 24276 - DNA, 273 bp, Artificial Sequence
  Description of Artificial Sequence: Synthetic coding sequence
atggaggccaatcagtgccccctcgttgtggagccttcctatccggatcttgtcatcaacgtgggggaagtgaccctgggagaggagaacaggaaaaagctgcaaaagatccagagagaccaggagaaagaacgggtgatgcgagcagcatgcgcactactgaattccggcggaggcgtgattcgaatggctaagaaggttgagcaccccgtggaaatgggtctggacctggaacaatccctccgcgaactgattcaatcttcagacctctag

SEQ ID NO: 24277 - DNA, 273 bp, Artificial Sequence
  Description of Artificial Sequence: Synthetic coding sequence
atggaagccaaccaatgccccctggtggttgagccgagctacccagatttggtaatcaatgtaggcgaggtgactttaggggaggagaacagaaaaaaactccagaagattcagagagaccaagaaaaggagcgggttatgagggccgcatgtgcactgttgaatagtggtgggggagttataaggatggccaagaaagtagaacaccctgtggagatggggctcgatcttgagcagtctctgagggagctgattcaaagctcagacttgtag

SEQ ID NO: 24278 - DNA, 606 bp, Artificial Sequence
  Description of Artificial Sequence: Synthetic coding sequence
atgagtttcgcaacgctgaggcctgcccctcccggacggtacttataccctgaagtgagtccgttgagcgaggacgaagataggggctcagactcctccggctcagatgagaaaccctgccgcgtccacgccgcaagatgtggattgcaaggtgcacgcaggcgcgcaggtggacgcagagccggaggcggtggccctgggggtagaccgggacgggagccacgtcagagacatacggctaacgctagggagcgggacaggacgaattccgtgaataccgcctttacagctttgaggacactgatccctaccgagcccgctgatcgaaagctctccaagattgagactcttcgcctggctagtagttacatctctcacttgggaaacgtgctacttgccggagaagcatgcggagatggtcagccctgtcatagcggcccagccttttttcacgccgctagagcgggatccccacctccgcctccaccgcctccgccagctagagatggcgaaaatacccagccaaagcagatttgtactttctgcctctccaaccaacgaaaattgtccaaggaccgcgaccggaaaaccgccatccggtcttag

SEQ ID NO: 24279 - DNA, 2472 bp, Artificial Sequence
  Description of Artificial Sequence: Synthetic coding sequence
atgaacggtgaacagcagctggatgccgatgcaggcagtggaatggaggaggttgaactgagctgggaggattacttggaggagaccgggtcgacggcagttccatatgggtccttcaagcacgttgatactcggctgcagaacggatttgctcctggaatgaaactcgaggttgccgtgcgaacagacccagaaacgtactgggttgccaccgtgataaccacgtgcgaacagttgctgctattgcggtacgacggctatggagaggatcgtagagctgacttttggtgtgacattagaaaagccgatctttatcccatcggatggtgtgaacagaataaaaaaaccctggaggccccagagggtattagagataaagtctccgattgggacgagtttttgcgtcagacacttatcggagcctgctcccctccagtcccactactggaaggcttacgaaacggaagaaatcccctcgacctgatagccccaggttcaagactggagtgccaagcttttcaggactctctgtccacttggattgttactgttgtggagaacattgggggtcgcctgaaactgcggtatgagggcctggagagctccgataactatgaacactggctctattacctggacccatttctgcaccacgttggatgggccgcacagcagggctacgagttacagcctccttccgccatccggcacctgaagaatgaggcagagtggcaggaaatattggctaaggttaaggaggaggaagaggagcctttaccctcttacctcttcaaggacaaacaagttatcggcattcacacattttccgtaaacatgaaactggaagctgtcgacccctggtcacccttcggcatcagtcctgccacagtggttaaagtatttgatgagaagtactttctggtcgaaatggacgaccttagacccgaaaaccacgctcggaggtccttcgtctgccatgccgattcacccggaatcttccccgttcaatggtcgcttaagaatggtctgcacatatcacccccaccgggatatccctcccaggacttcgactgggctgactacctcaaacaatgtggggcagaggccgcaccgcagaggtgctttccaccactcatctcagaacatgagttcaaggagaatatgaaacttgaggccgtgaaccctattctgcctgaggaagtctgtgtggccacaatcacagcagtgaggggaagctacctgtggcttcagctggagggctctaaaaagcctattcccgagtgtatcgtgtctgtggagagcatggacatttttcctcttggttggtgcgagacaaatggtcatcccttgtctacccccagaagagcccgtgtgtataaacaacgtaagatagccgtggttcaaccagaaaagcaggtcccttcatctagaaccgtgcacgaaggacttcgcaatcaagaactcaactcaacagaaagtgtgatgataaacggaaagtattgttgtcccaagatatactttaaccatcgttgtttctccggaccatatctgaataaagggaggattgccgagcttccccaatgcgtgggtcctggtaactgtgtcctggtgctccgggaagtgctcacgctgttgattaatgccgcttataaaccctccagggtattaagagaattgcagcttgataaggactccgtgtggcacggctgcggtgaggttctgaaagccaagtacaaaggaaagtcctaccgtgccaccgtcgagattgtgaagactgccgatagagttactgagttctgccgccaaacttgcatcaagctggagtgctgcccaaatctctttggccctcgaatggtgttggataagtgttctgagaactgcagtgtactcacgaagactaagtacacacattattacggcaaaaaaaagaacaaacggataggacgacccccaggagggcacagcaacctggcctgcgcactcaagaaggctagtaaaagacgcaaacgcagaaagaacgtattcgttcacaagaagaagcggtcttcagctagcgtagataacacccccgcagggtccccccaagggagtggaggtgaagatgaggatgacccagatgagggtgacgatgattcactctccgaaggatcgacctccgagcaacaagatgagctgcaagaggaatccgagatgtctgaaaagaaatcgtgctcctcctcaccaacccagtccgagatcagcacgtccctacctcctgatcgccaaagacgcaagcgagagctacggacattttccttttcggatgacgagaacaaacctccctctccaaaagaaatcgacggacaagccttactgctgctgaccttacccaccgttcaggaatgcatggacctcaaattgggcccagctatcaagctttgccaccacattgaaagaatcaaattcgcattctacgagcagttcgcaaattag

SEQ ID NO: 24280 - DNA, 2601 bp, Artificial Sequence
  Description of Artificial Sequence: Synthetic coding sequence
atgaacggcgaacaacaactggatgctgatgctggtagcggtatggaagaggtggagctatcctgggaggactacctggaggagacaggctctacggctgttccatacggcagctttaaacatgtagacaccagactccaaaacggcttcgcgccaggcatgaagcttgaggtggccgttaggacagatcccgagacatattgggtcgccaccgtcattaccacgtgtgagcaactactattgctgcgttacgacggctacggagaagaccgacgtgcagatttttggtgcgacattaggaaggcagatctttacccaatcgggtggtgtgagcaaaacaaaaagacactggaggctcctgaaggcattagggacaaagtttccgactgggatgagtttctcagacagaccctgataggcgcatgcagcccaccagtgccccttctggagggcctgaggaatggccgtaatcctcttgacctcatcgcacctggcagccgccttgagtgccaagcttttcaagatagcctaagcacgtggatcgtcacagtcgtcgagaatattggcggaaggttgaagctacgctacgagggactggaatctagcgataactatgagcattggctgtattaccttgaccccttcttacatcatgtcgggtgggcagctcagcagggctatgagctgcagcctccatcagctatcagacatctcaagaacgaagcggagtggcaggagatcttggcaaaggtcaaggaagaggaggaggagccactgccctcatacctctttaaagacaagcaggtcatcggtatccacacttttagtgtgaatatgaaactggaggcagtcgacccatggtccccgttcgggatttctcctgccaccgtggtaaaagtattcgatgaaaagtattttctcgtagagatggacgatttgagacccgagaaccacgctcggagaagctttgtctgccacgctgactctccaggaatcttccccgtgcagtggagcttgaaaaatggtttgcatatttcacctcccccagggtacccttctcaggattttgattgggctgattaccttaagcagtgcggggctgaggcagcccctcaacgatgctttcccccactgatctctgagcacgagttcaaggagaacatgaagctggaggcagttaatcccatcctccctgaagaggtttgtgtggccaccataaccgccgttcgcggaagttatctgtggctacaactggaagggagtaagaaacccatcccagagtgcattgtgagtgttgaatccatggacatctttccgttagggtggtgcgaaactaatgggcacccgctctcaacccctagacgcgcacgggtgtataaacaacgcaagatcgcagtggtgcagcctgaaaaacaggttcctagtagtcggaccgtgcacgagggcctccgcaatcaggagctgaatagtaccgagagtgttatgattaacggaaaatattgttgtcctaaaatttatttcaatcaccgctgttttagcggcccatatctcaacaagggaagaattgctgaactgccacagtgtgtcggcccaggcaattgcgtacttgtgcttcgggaggtgttgactcttctgattaatgccgcatataagccttcccgagtgttgcgagaactccagctcgacaaggatagcgtatggcatgggtgcggggaggtcctgaaggccaaatacaaaggcaaatcttatagggcaactgttgagatcgtcaaaaccgccgatagagtgacagagttctgccggcagacttgcattaaactcgagtgctgccccaacctattcggacccagaatggtgctcgataagtgcagcgagaattgttctgttctcacaaaaactaaatacacacactactacgggaaaaagaaaaacaagcgaattggtagaccaccagggggtcacagcaatctggcatgcgcgcttaagaaagcctccaaacggcgtaagcgccgtaaaaacgtgtttgtgcataagaaaaaaaggtccagtgctagtgtagataatacccccgcaggttcccctcagggaagtggtggtgaagatgaggatgacccggatgagggagacgacgatagcttatctgaggggtcaactagtgagcagcaggatgaattgcaggaagaatccgagatgtctgagaagaaatcttgttcatctagtcctacacaaagcgaaatatccaccagcctcccgccagacagacagcgacgcaaaagggagctgcggaccttcagcttcagcgacgacgaaaacaagcctccgtcgcccaaggagatccggatcgaagtggcagagcgtctgcatctggattcgaacccactcaagtggagcgtcgccgatgtggtgcgcttcatccgttcaactgactgcgccccattagctaggatattccttgatcaggaaatcgatggacaggccttgctgctcctgactttgccgaccgtgcaggagtgcatggacctgaagcttggcccagctatcaagctatgtcaccacatcgaacgcatcaagtttgctttctacgagcaattcgcaaattag

SEQ ID NO: 24281 - DNA, 2601 bp, Artificial Sequence
  Description of Artificial Sequence: Synthetic coding sequence
atgaatggagaacagcagctggacgcggatgctgggtccggcatggaagaggtggaactgtcatgggaagattacctagaagaaaccggctccaccgctgttccctatggatctttcaaacacgttgatacccgactacagaacggattcgcccctgggatgaaactggaagtcgcagttcggaccgacccagaaacctattgggtggccactgtgataacgacttgcgagcagctgcttctgctgagatacgacggttacggagaggacagaagggcggatttctggtgtgatatacggaaggctgatctgtacccaatcgggtggtgcgagcagaataagaagacccttgaggcccctgagggcatccgtgataaggttagtgattgggacgaattcttacgccaaacactgattggcgcatgcagtccgccagtcccgttgttggaaggtctccggaacggacgtaatcccttggaccttattgctcccggatcacggctagagtgccaggctttccaggactcccttagcacatggatcgtcaccgtcgtggagaacatcggcggtcggctgaaactccgatatgaaggcctcgagagttccgacaactatgagcactggctgtactatctcgacccttttctgcaccacgtaggctgggccgcacagcaagggtacgaacttcaacccccatccgccatccgccatttgaaaaacgaagccgagtggcaagaaatcttggccaaggtgaaggaggaggaagaagaaccactgccaagctatctctttaaagataagcaagttataggaatccatacattctctgtaaacatgaagctggaagcggtggacccctggtcaccattcggtatatctcctgccaccgtggtgaaagtctttgatgagaaatactttctggtggaaatggatgacctgaggcctgagaatcacgcgaggcgctcgttcgtgtgccacgcagactccccaggcatcttccctgttcagtggagcctgaaaaatggacttcatatctccccccctccgggataccctagccaggatttcgactgggccgactacctgaaacagtgtggagcggaagctgccccacagcgctgtttccccccactgatatctgaacatgaatttaaggagaacatgaagctcgaagccgtaaacccaatcttgcctgaggaggtctgcgtagctaccatcacagcggttaggggaagttatctgtggctacagcttgagggatctaaaaaacccattcccgagtgcatagtcagtgttgagtccatggatatcttccctttgggatggtgcgagaccaacggacaccccctaagcaccccgaggcgggcaagagtctataaacagcggaagattgccgtagtgcagcctgagaaacaggtcccatctagcaggacagtgcacgaaggcctccgcaaccaggaactcaatagcacagaatccgtcatgataaacggcaaatactgctgcccaaagatctattttaaccaccgctgcttttctggcccttatctcaataaggggcgtattgctgaactcccacagtgtgtcgggcctggaaactgtgtgttggttttgcgagaggtactgaccctcttgatcaatgcagcatacaaaccaagtagggtcttgcgagagctgcagctggacaaggattccgtgtggcatgggtgcggggaagtcctgaaagccaaatacaagggaaagtcctaccgggctaccgtggagatcgtgaagacggcagaccgggtgacagaattttgtaggcagacttgtataaaattggagtgctgtcctaatctctttgggcctaggatggttctcgataagtgtagcgagaattgtagcgtattgacaaaaacgaaatatacccactactacggcaaaaaaaagaacaaacggatcggtcggccaccagggggacattccaatctggcatgcgctttaaaaaaggcctccaagcgacgcaaaaggagaaaaaacgtgttcgtgcataaaaagaagcggagcagcgcctctgttgataatacaccagctggcagtccacagggctcgggcggagaagatgaagatgatcccgacgagggcgacgacgattcgctgtccgaggggagcactagtgaacagcaggacgagttgcaggaagagagcgagatgagcgaaaaaaaaagctgcagctctagtcccacccagtctgaaatcagcacttccctgcctcctgatagacagcgacggaagcgggaactgaggacattctctttttccgatgacgagaacaagcctcccagcccaaaagagattaggatcgaggttgctgaaagacttcacctggatagcaatccgctgaaatggagtgtcgccgacgtggtgcgcttcatcaggagcaccgattgcgcccctcttgctcgcatctttttagaccaggagattgatgggcaggcactgctcctgctcaccctccccactgtgcaggaatgcatggatttaaaactgggtcccgctatcaaactctgtcatcatattgagcgcattaaatttgcgttttatgaacagttcgccaattag

SEQ ID NO: 24282 - DNA, 2601 bp, Artificial Sequence
  Description of Artificial Sequence: Synthetic coding sequence
atgaatggggaacagcagctggacgcagacgcaggctccggcatggaggaggttgaactgtcttgggaggactatttggaagagaccggctcaactgcagtgccctatggatcatttaaacacgtcgacacacggttgcagaacggttttgccccaggtatgaagctcgaagtagccgtccgcacagaccccgagacatactgggtggcaaccgtcatcactacatgtgaacagctgctgctgctccgctatgacggatatggagaggatcggcgagctgacttctggtgtgacattagaaaagcagatctgtacccgattggatggtgcgagcagaacaagaagactctagaagctcccgaggggatcagggacaaggtgtccgattgggatgaatttcttagacagacgcttataggagcgtgcagcccaccggtcccgctcctggaaggcctcaggaatgggagaaatcccctagacttgattgctccgggatctaggttggagtgtcaggccttccaggacagcctcagcacttggatagttaccgtggtagaaaatattgggggaaggcttaaactgagatacgagggcttggagagttccgacaactacgaacactggctgtattacctggatcctttcctccaccatgttggctgggccgctcagcagggctacgagctgcagcccccttccgccataaggcacctgaaaaatgaagcagaatggcaagagatactggccaaagttaaagaagaagaggaggagccactacctagctatcttttcaaggataagcaagtcatcgggattcataccttctctgtgaatatgaaactggaggcagtggatccctggtcaccgtttgggatcagccccgcaaccgtggttaaggttttcgatgaaaagtacttcctagtggaaatggatgacctccgccctgagaatcatgcacgacggagtttcgtgtgtcacgctgattcccccggaatattcccagtccagtggtctctaaagaacgggttacacatcagccccccaccgggatatcccagtcaggacttcgactgggcggattatctgaagcagtgtggagccgaggccgctccccagaggtgcttccctcctctgatcagtgaacacgaattcaaggaaaatatgaaactggaggctgtgaatcccattctccctgaagaggtttgtgtggctaccatcactgccgtgaggggcagttacctgtggttgcaattggaaggtagcaagaaacccattcctgagtgcatcgtctctgtggaaagtatggatattttccccctgggatggtgcgaaacaaatggccacccactgtccactccgagacgagcgagggtatataagcaacgtaaaatagcagtagtgcagcccgagaagcaggtgccaagcagcaggaccgttcacgagggcctcagaaaccaagaattaaacagtactgagtctgtcatgataaatgggaaatactgctgtccaaaaatctactttaaccaccgctgtttttcaggaccatatctgaataaaggaaggatcgcggagctgcctcagtgcgtcgggccaggcaactgcgtcttggtcctgagggaagtgctgactttgctgattaacgcggcttataagccgtcacgtgttctgcgtgaactccagctcgataaggatagcgtatggcacggatgtggcgaggtactgaaagcgaaatataagggaaaatcctatcgggcaaccgtagaaattgtgaagactgcggaccgggtcacagaattctgtagacagacatgcattaaactcgaatgctgccctaatttgtttggcccacgaatggttctggataaatgttccgagaattgctctgttctgaccaagaccaagtacacccactactatggcaaaaagaaaaacaagcgtattggtcgccctcccggtgggcacagcaatctggcttgcgctctcaagaaagcatcaaagagacgtaagagacgcaagaatgtgttcgtgcataagaagaaacgttcttctgcctctgtggacaatactccagctggctctccacagggctccggaggagaggacgaggatgaccccgacgagggcgatgacgattctctttctgagggtagtacgtccgagcagcaggatgaactccaggaagaatctgagatgtcggaaaagaaatcctgctcatcatctccgacacagagcgagatttcaacttcccttcctcctgacaggcagcgaagaaagagagagctgcggaccttttctttctccgacgatgaaaataagccgccatctcctaaagagattcgcatagaggtagcggagcgcttgcatctggactctaacccactgaagtggtctgtggcggacgtggtgcgttttattcgaagcaccgactgcgcccctttggcgcgaatctttttggatcaggaaatagatgggcaggccctgcttttgctgacactccccaccgttcaagagtgtatggacctcaagcttggcccagcaataaaactgtgccatcatatcgaaagaattaagttcgccttctatgagcaatttgctaactag

SEQ ID NO: 24283 - DNA, 366 bp, Artificial Sequence
  Description of Artificial Sequence: Synthetic coding sequence
atgaacggggaacagcagctcgatgcggatgcgggatccggcatggaagaggttgagctgtcctgggaggactacctcgaagaaacggggtcgaccgccgttccctacggcagcttcaaacacgtggacactaggctgcagaatggttttgccccagggatgaagctcgaagtggccgtccgtactgatcccgagacatactgggtggctacagttatcacaacgtgcgagcagctgctcctgcttcgatacgacgggtatggagaagacagaagggcggatttttggtgtgacattcgaaaggcagatctctaccctattggctggtgcgagcaaaataaaaagaccctcgaggcccctgagtag

SEQ ID NO: 24284 - DNA, 285 bp, Artificial Sequence
  Description of Artificial Sequence: Synthetic coding sequence
atgaacggggaacaacagttagatgccgatgcaggatctggaatggaggaagtcgaactgagctgggaggattacctggaggaaactggaagcaccgccgtaccctatggaagtttcaagcacgttgatacaagattacagaacggattcgctcccggaatgaaacttgaggtggccgtgagaactgacccagaaacatactgggttgccaccgtgatcacaacctgcgagcaactcttgctactgcggtatgatgggtatggcgaggatcgcagggcggattag

SEQ ID NO: 24285 - DNA, 153 bp, Artificial Sequence
  Description of Artificial Sequence: Synthetic coding sequence
atgaatggggagcaacaattagacgctgatgccggaagcggcatggaggaggtggagctgtcttgggaggactacctcgaagagactggctcgacagccgtgccgtatgggagtttcaagcatgtggacacacgattacagaacggattctag

SEQ ID NO: 24286 - DNA, 2685 bp, Artificial Sequence
  Description of Artificial Sequence: Synthetic coding sequence
atggagtccacactgagcgccagcaatatgcaggacccttccagctcccctctggagaaatgtctcggatccgcaaacggtaacggggatctcgacagtgaggagggcagcagtctggaagagaccggcttcaactggggcgagtatctggaagaaaccggtgcctctgccgctccgcatacaagtttcaagcatgttgaaatctctatccagtctaattttcaacctggcatgaaactggaagttgcgaataagaataacccagacacttactgggtggccacaattattaccacctgtggccagttactactcttaaggtactgtggctacggagaagacagacgcgcagacttttggtgcgatgtcgtgatcgcagatctgcaccccgtgggttggtgcacacagaacaacaaggtgttgatgcctccggacgcgatcaaggaaaagtacaccgattggaccgaattcctgatccgggatctgaccggctccagaacagcacccgctaatctcctggagggtccactgcggggtaaagggccaatcgatctgattacagtgggctctttaatcgaactccaggattcccagaatccatttcaatactggatcgtttccgtcattgagaatgtgggagggagacttcggctgagatatgtcggtctggaagacaccgaaagctacgatcagtggcttttctaccttgactaccgcctgcgcccagttggatggtgccaagaaaacaagtatcgtatggaccctccctcagagatatatccattgaagatggcatcagagtggaagtgcacactggaaaagtcactgatcgacgccgctaagttccccctcccaatggaggtgtttaaggaccatgccgatttgcggagccactttttcaccgtgggaatgaagctggagacagtcaatatgtgcgaacccttctacatatctcctgcttcagtcacaaaagtgtttaacaaccacttctttcaggtgactattgacgatcttcgtcctgaaccctctaagttgtcaatgctctgccacgcggacagtctgggcatactacctgtgcagtggtgtctgaagaacggcgtgtcactgacccccccaaaaggatactctgggcaagattttgattgggctgactaccacaaacagcatggagctcaggaagccccacccttttgtttccgaaacactagtttcagcagggggttcaccaagaacatgaagctcgaagcagtcaatcccagaaaccctggagaactatgtgtagctagcgtcgtgtccgtgaaaggaagattgatgtggctgcacctagagggactgcagacaccagttcctgaagtgatcgtggacgtagagagcatggatatcttccctgtgggatggtgtgaggccaacagttaccctttgacagcccctcataagacggtttcccagaaaaagcggaagatagccgtggtccagccagaaaaacagctcccaccgacggtgcccgtgaaaaagatcccccatgatctctgcttatttcctcacctcgatacaaccggtaccgtgaatggcaagtattgttgccctcaactatttattaatcacaggtgttttagcggcccatatttaaacaaaggccgtattgcggaattgccccagtctgtgggaccagggaaatgtgtgctggtcctgaaggaggtgctgtcgatgataatcaacgcagcatataaacctggccgtgttctccgcgaactacagctggtagaagacccccattggaactttcaggaggagacactgaaggctaagtacagggggaaaacctatagggcagtcgtgaagattgtcagaacatcagaccaagtggccaatttctgtagacgggtatgcgccaagttggagtgctgccccaacctattcagtcccgttctcatttccgaaaattgccccgagaactgttccattcatactaagacaaagtatacctactactacgggaagcggaaaaaaatcagtaaaccacccatcggcgaatcgaatcccgatagcggccatccaaagcccgctaggcggaggaaaagaaggaaatcaatctttgttcagaaaaagcgcaggagctcggccgtcgacttcaccgccggttccggtgaagaatcagaggaggaagacgcagatgcaatggatgacgacactgcgtccgaagagacaggctccgaacttagggatgaccaaaccgatacgtcgtccgcagaggtgccgtccgccaggcctcgcagagctgtgaccctgcgatccggctccgaaccggtgaggcgccctcctccggagaggacccgccgaggacgcggagccccagcagccagctccgcagaggagggcgaaaaatgccctccaacgaagccagaaggaacagaggatactaagcaggaagaggaagaacgattagtgctggagtctaatcccctggagtggacagtcaccgatgtggtgcgttttatcaagttaacagactgtgcccctctcgccaaaattttccaggaacaggacattgacggtcaggcccttctactgttaaccctgcctactgttcaagaatgcatggaactaaagctgggaccagccatcaaactctgtcatcagattgagagagtgaaagtcgccttttacgcccagtacgccaattag

SEQ ID NO: 24287 - DNA, 483 bp, Artificial Sequence
  Description of Artificial Sequence: Synthetic coding sequence
atggagagcaccctgtccgcttcgaacatgcaagacccttcatcttctcccctggagaaatgcctgggcagcgcaaacggaaacggagacctggacagtgaggagggctccagcttagaagagaccgggttcaattggggagagtacttggaggaaaccggagcctctgcagcccctcacacctctttcaagcacgtcgagatcagcatccagtcaaattttcagcctggaatgaagttggaagtggcgaacaaaaacaaccctgacacgtactgggtcgcgactattattactacttgtggacagctgctgctgctgcgatactgcggttatggcgaggacagaagggccgacttttggtgtgatgtggtgattgccgatcttcacccagtaggctggtgcacccagaataataaggtcctaatgcctccggacgtggagtcagacgtgaaaccttctgccagtgtccaacacattagttag

SEQ ID NO: 24288 - DNA, 561 bp, Artificial Sequence
  Description of Artificial Sequence: Synthetic coding sequence
atggaatcaacactgtccgcatctaacatgcaggatccttcctcctctccactggagaagtgtctagggtccgcgaatggaaatggtgacctggactcagaggagggaagttccctcgaagagactggctttaattggggggagtaccttgaagagaccggagcctctgctgctcctcacacttcatttaagcatgttgagattagtatccaatctaacttccagcccggaatgaagctggaggtcgcgaacaaaaataacccggacacctactgggttgcaacaataattactacatgcggccaattgttgcttcttcgttactgcgggtacggcgaagatcgcagagcagatttctggtgtgatgttgtcatcgccgacctccatcccgtcgggtggtgtactcagaataacaaggtgctgatgccacccgacgctattaaagaaaagtacacagactggacagaatttttaatcagggatttgactggatcgcgcaccgctcctgccaatctgttagaaggtgtgtgtatagttgttatccatttgatgtacctgtag

SEQ ID NO: 24289 - DNA, 483 bp, Artificial Sequence
  Description of Artificial Sequence: Synthetic coding sequence
atggagtccaccttgtctgcttccaacatgcaggatccaagctcgagtcctctcgagaagtgcctcggctccgctaatggaaatggagacctggactctgaagaggggagctctctggaagagacaggcttcaactggggcgagtacctagaagagaccggcgcaagcgccgcaccacacacctctttcaagcatgtggagatcagcattcaaagcaacttccaacctggcatgaaattggaggtggcaaacaagaataaccccgacacctattgggttgccaccatcattacaacctgtggccagctgctacttctgaggtactgcggttacggggaggatcgtagagcagatttctggtgtgatgtggtcattgccgacctgcaccccgtgggatggtgcacacagaacaataaggtgcttatgccgccagacgtggagtcagatgtcaagcccagcgcgtccgtgcagcacatctcctag

SEQ ID NO: 24290 - DNA, 2685 bp, Artificial Sequence
  Description of Artificial Sequence: Synthetic coding sequence
atggagagtaccttaagcgcaagcaatatgcaggacccctctagcagcccactggaaaaatgtcttgggtctgcaaatgggaacggagatctggattcagaggaaggaagttccttagaagagaccgggtttaattggggagagtacctggaggaaaccggcgcttcagctgcccctcatacaagctttaaacacgtggagatctctatccagagtaatttccagcccggaatgaagttagaggtggccaataagaataacccggatacttattgggtggctactattattacgacctgcgggcagctactgctgctgcggtactgtggatatggggaagacaggagagccgatttttggtgtgatgtcgtgatcgcggatctgcatccagttggttggtgcactcagaacaataaggtgctcatgccaccagatgccattaaggagaagtacacagattggactgagttccttattagagatctgaccggcagccggacggctcccgcaaacttgctggagggcccactccgagggaaagggcctattgaccttatcactgtgggctctctgattgaacttcaagatagtcaaaacccgtttcagtattggatagtttccgttatagagaacgtgggtggcagactgcgacttaggtatgtcggtctggaggatactgagagttacgaccagtggctcttttacttggactaccgactccgccctgtcggctggtgtcaggaaaataaataccgcatggatccaccttctgagatctacccgttgaaaatggcctctgaatggaagtgcactctcgagaagtcactgatagatgccgcaaaatttccgctccccatggaggttttcaaggaccacgctgacctgcgcagtcactttttcacagtcggaatgaagttagagactgtcaacatgtgcgaacccttctacatttccccagcgagtgtcaccaaggttttcaataaccacttcttccaggtgaccatcgacgatcttaggcccgagccgtcaaagctgagtatgttatgtcacgctgacagtcttggcatcctgcccgttcagtggtgtcttaaaaatggtgtctctctaacacctcctaaaggatattccggtcaggatttcgactgggccgattaccacaagcaacatggagcccaggaagctccccctttctgttttagaaatacaagcttttcgcgcggttttacaaagaatatgaaactggaagccgtcaatccaaggaaccctggagagctatgcgtcgcctcagtcgtatccgttaaggggaggctgatgtggctgcacctggaggggttacagactccagtgccggaagtgatcgttgacgttgagagtatggatattttcccggtaggatggtgcgaagcaaactcctacccactgaccgctccccacaaaaccgtgtctcagaagaagagaaaaatcgcagttgtgcagccagaaaaacagttacctcccacggtgccagtgaagaaaatcccccacgacctgtgcttgtttccacacttagacaccaccggtactgtcaatggcaagtactgctgtccacagttattcatcaaccacagatgtttctccggaccctacctcaacaaaggaaggatcgccgaacttccccagagtgtggggcctggaaagtgcgtacttgtcctgaaggaggtcctgtctatgattattaacgccgcttacaaacccggacgtgtgttgcgcgagctgcaactggtggaggaccctcactggaactttcaggaagaaactttaaaggcaaaatatagggggaaaacttaccgagccgtcgtcaagatcgtgagaacaagcgaccaggttgccaatttttgcaggcgggtgtgtgctaagctcgaatgctgtccaaatctcttcagcccagttcttatttccgagaattgccccgagaattgcagtatacataccaagactaaatatacgtattattacgggaaaagaaagaaaataagcaagccccctataggcgaatcaaacccggactccggccatcctaagcctgcacgccgtcgcaaacggaggaaatcaatcttcgtgcagaagaagagacgcagctcggcagtggacttcacagctggctcaggagaggaatccgaagaagaggacgcagatgccatggatgatgacaccgcctccgaagagaccgggagtgaactccgggacgatcagacggatacatcgtccgccgaagtgcccagcgctagacctcgcagagccgtaaccttacggtcgggttcagagccagtccggaggccaccacccgaacgcacaaggcggggtagaggggctcctgccgctagctccgcggaagaaggtgagaagtgtcctcccacaaaacctgaggggacagaggataccaagcaggaggaggaagaacgactggtcctggaaagtaatcctttagagtggacagtcacggacgtggtccgctttattaagttgactgattgcgcccctctcgccaagatcttccaagagcaggatatcgatggacaggctctgctcctccttaccctgccaaccgtgcaagagtgtatggagttaaagttgggcccagctattaaactgtgtcaccaaatagaaagagtgaaggttgccttctatgctcagtacgccaactag

SEQ ID NO: 24291 - DNA, 924 bp, Artificial Sequence
  Description of Artificial Sequence: Synthetic coding sequence
atgccgaggtcgttcctagtaaagaaaatcaagggagatggcttccagtgctccggagttcccgctcctacatatcaccccctggaaaccgcatacgtgcttccaggagcgaggggccctcctggagataacggctatgcgcctcatcgcctcccacctagtagttacgacgccgaccagaagccgggattagaattggccccagccgagcccgcttaccctcccgctgctccagaagagtactctgatccagagagtccacagtcgagtctctccgccagatatttcagaggcgaggctgctgttacggactcctattcaatggatgccttctttatatccgatggcaggtcccggcgacgccgagggggaggaggcggagacgctggtggcagtggcgacgccggaggagccggaggccgagccggacgcgctggcgctcaggcaggtggtggccacagacatgcatgtgcagagtgcggcaagacctacgctacttcttcgaatctgtcacgacataagcagacacataggagtctggattcccagttggccagaaagtgccccacctgcggaaaagcctacgtgtctatgcctgcactcgctatgcatctgctcacgcacaacctaagacataagtgcggcgtttgcgggaaggcattctcccgcccatggctgctgcagggccatatgaggagccacaccggcgagaaacctttcggttgcgcacattgtggaaaggctttcgctgacagatcaaatctcagagctcacatgcagacccactctgcatttaagcactaccgctgcaggcagtgtgataaaagcttcgcgcttaaaagctatcttcacaagcactgcgaggccgcttgcgctaaggctgccgagccaccccctccaactccagctggaccggctagttag

SEQ ID NO: 24292 - DNA, 2064 bp, Artificial Sequence
  Description of Artificial Sequence: Synthetic coding sequence
atgtcgaaccgcaataataacaagctgccatcaaacctccctcaactccagaacctgataaagagggacccgcctgcttacatagaggaattcctgcaacagtacaaccactacaagtcaaacgtggagatctttaagctacagcccaacaaaccaagcaaggagctagcagaactggtcatgttcatggctcagattagccactgctaccctgagtacctgagtaacttcccccaggaagtcaaggacctgctaagctgtaatcatactgtgctcgacccagatctacggatgacattctgtaaggctctaattctattgcgaaataaaaacctcataaatccgtcatctctgcttgagctcttcttcgaactatttcgctgtcacgacaagctcctccggaaaacgttatacacacacattgttactgatattaagaatatcaatgccaaacacaagaataataaggtaaacgtggttcttcagaacttcatgtacaccatgctacgtgattctaacgcaacagcagcaaaaatgtctctggacgtgatgatcgagctataccgcagaaacatttggaatgacgcaaaaacggtcaacgtcatcacaactgcatgtttctccaaggtgaccaaaattctggtggctgctctgacattctttttagggaaggatgaagacgaaaaacaagatagtgacagtgagagtgaagatgatggtcctactgctcgagatttactcgtgcaatatgcaacgggcaaaaaaagctccaaaaataaaaaaaagctggaaaaggcgatgaaggtcttgaaaaagcagaagaagaagaaaaagcccgaggtgtttaatttctccgcaatccacctgatccacgatccacaagactttgccgaaaagctactcaagcaactggaatgttgtaaggagcgtttcgaagtgaaaatgatgttgatgaatttgatcagccgcctcgtcggtatccacgagcttttcttgttcaacttttatccttttttgcaacgatttcttcaacctcatcagcgggaggtaaccaaaatcttacttttcgccgctcaggcttcccatcatctggtacctcctgaaataattcagtcactcttaatgaccgttgctaataatttcgttaccgacaaaaattctggagaggttatgacagtcggcatcaatgccatcaaggaaataacagccaggtgcccgctagctatgaccgaggagttgttgcaagatctcgcccaatacaaaacccacaaggacaagaatgtaatgatgagtgcccgaacactgatccatctgttcagaacgcttaatccccagatgctccagaagaagttcaggggcaagccaacagaagcctccatagaagcccgtgtgcaggagtacggggaactggacgctaaagattatatccctggggctgaggtgctggaggttgagaaggaggagaatgctgaaaacgacgaggatggatgggagtccaccagtctgtctgaggaggaagacgctgacggggagtggattgacgtgcaacacagttctgacgaggaacagcaggagatctcgaagaagttgaatagcatgccgatggaggaaaggaaagctaaggccgctgccatctctacttctagggtactaacacaggaggacttccagaagattcgaatggcccagatgaggaaggagttagacgcagcaccgggaaagagccagaaaaggaaatacatagaaatcgactcggacgaagaacctcggggagagcttctgtcactgcgggacatcgagagactccataagaagcccaaaagtgacaaggagacccggttggccaccgcaatggctggaaaaaccgaccggaaagagtttgtgcgcaaaaagaccaaaacaaatccttttagctcatcgaccaataaagagaagaagaagcagaagaactttatgatgatgcggtatagccagaatgtcagatcaaagaataaacggtccttccgggagaaacagctcgcgttaagggatgccctgctcaaaaagagaaagcggatgaaatag

SEQ ID NO: 24293 - DNA, 786 bp, Artificial Sequence
  Description of Artificial Sequence: Synthetic coding sequence
atgagtcggtatacaaggccccctaacacctctttgttcattcgtaacgtggcagacgccacccgccctgaggatctgcggagggaatttggaagatacggccctatcgtggacgtctatattcctctggacttttatacgaggcggcctcgtgggtttgcctacgtacagtttgaagatgtgcgggatgctgaggatgcattatataatctaaaccggaagtgggtctgtggtagacaaatcgagatccaattcgcgcagggcgacaggaagacaccgggtcagatgaaaagtaaagagaggcatccctgctcaccttctgatcatcgacggtctcgatctccctctcagcgcaggaccaggtccagatcatccagctggggtagaaatcgacggaggtccgatagtctgaaggagagccggcatcgccgtttttcttatagccagagtaagtcgaggtccaagagtcttcccagaagatctacatcggcccgacagagcagaactccgagaaggaatttcggtagccgcggtaggagtcgatctaaatcactgcagaaaaggtctaagagtatagggaaaagccagagtagtagtcctcagaaacagaccagttcaggaaccaagtctcgcagtcatggcagacattcagacagtatcgccagatcaccatgcaagtccccaaaagggtacactaactctgaaacaaaagtacagacagctaaacacagtcacttccggtctcattcaaggtcaaggagctatcgccataagaattcctggtag

SEQ ID NO: 24294 - DNA, 1245 bp, Artificial Sequence
  Description of Artificial Sequence: Synthetic coding sequence
atgattcccctggagaagcccggatcgggcggttcaagcccgggagcgacgtccggatccggtcgtgctggaaggggtctgtcgggcccttgtcgcccacccccaccgccacaggctagggggcttctcactgagatcagagccgtggtgcggactgagccctttcaggatgggtattctctgtgccctggccgagagctgggcagaggaaagtttgccgtagttaggaagtgtattaaaaaggacagcggaaaggagttcgcagctaaattcatgcgaaagcgccgaaaagggcaagactgccggatggagatcatccacgagatcgccgtgttagagctggcacaagacaacccttgggtcatcaacctacatgaagtgtacgagacagcttctgaaatgattctggtgctcgagtatgccgcaggcggagaaatctttgaccagtgcgtggccgaccgtgaagaagccttcaaggaaaaggacgtgcagcggctgatgcgccagatactcgaaggcgtgcacttcttgcataccagggacgtcgtgcatctggacctgaaaccacaaaacatcctgcttacgtcggagagcccactcggcgacatcaagattgtggactttggtctttctcggattctgaaaaactcagaagaattgagagaaatcatgggaacgcctgaatacgtggcccctgaaatactgtcatacgaccctatctcaatggctacagatatgtggtctataggagtgctcacctacgtgatgctgaccggaatctccccattcctaggcaatgacaagcaggagaccttcctgaatatctcacagatgaatcttagctatagcgaggaggaattcgatgtgctttccgagtcagctgtcgacttcatcagaaccctgctagttaagaagccagaggatagagccacagcagaggaatgcctcaaacacccctggttaacccaaagctctattcaagagccttccttccggatggagaaagccttagaagaggccaacgcgctccaggagggacacagcgtgccggaaatcaatagtgacaccgataaatccgaaaccaaagaatctattgtaaccgaggagctaatcgttgttacatcttataccctgggccaatgccggcagtccgagaaagagaaaatggagcagaaggctatctccaaacgcttcaagtttgaggagccactgctgcaggagattcccggtgagtttatctactag

SEQ ID NO: 24295 - DNA, 1062 bp, Artificial Sequence
  Description of Artificial Sequence: Synthetic coding sequence
atgtccttgcacacccagtacctggagagtttcctaagaagccagttctacatgcttcgaatggacggcccactgcctcttccctatcggcactacattgctatcatgaaattggtgaaaacaggcgagaacaactggagcctgcctgaactggtgcatgccgtagtattgctcgcacattaccatgcattagctagctttgtgtttggcagcgggattaatcccgagcgtgaccccgaaattagtaacggcttccgcctcattagcgtgaataatttttgcgtctgcgatttagccaacgacaataacatcgaaaatgcctcattatcaggcagcaatttcggaattgtcgacagtctcagtgagctagaggccctcatggaaagaatgaagagactgcaggaggaaagggaggatgaggaggccagccaggaagaaatgtcaacgagatttgagaaggagaagaaagaatctctgttcgtggtgtccggggacacttttcattcctttccccatagtgacttcgaagacgacatgattattacaagcgacgtgtctagatacatcgaggatcctggtttcggatacgaggacttcgcgcgaagaggcgaggagcacctgcctacattccgggctcaggattacacatgggagaaccatggattcagcctggtgaaccgcctctattctgatattggccacttgctggacgagaagtttcgaatggtctataacttgacttataacacgatggctacccacgaagatgtggatacaacaatgctgcgcagagcgctgtttaattatgtacactgtatgtttgggattcgctatgatgactacgattatggcgaggtgaaccagctgttggagcggtctctgaaggtgtacatcaaaactgtgacctgttatccggaacggaccaccaagagaatgtacgacagctattggaggcaatttaaacacagcgagaaggttcacgtcaatcttttgctcatggaagcaagaatgcaggcagagctgttgtatgctctccgcgctattacaagacacctcacgtag

SEQ ID NO: 24296 - DNA, 954 bp, Artificial Sequence
  Description of Artificial Sequence: Synthetic coding sequence
atgaatcggggaggcggtagcccttcggccgctgccaattacctgctgtgtacaaactgcaggaaggtgcttcggaaggacaagaggattagagtctcccagcctttgacaaggggaccctcagcctttatccctgaaaaggaagtcgtgcaggcaaatacagtggacgaaaggacaaacttcttggtcgaggagtattccacctcaggcaggctcgacaacattacccaggtgatgtctctgcacacacaatatctggaatcctttctgagatcccagttctacatgctgcggatggatgggccactgcctttgccgtatagacattacatcgctatcatggcagcagctcggcatcagtgcagttacctcataaacatgcacgtagacgaattcctcaagaccgggggtatagctgagtggcttaacgggctggaatatgtaccccagagactgaaaaacctgaacgaaattaacaagttactggctcaccggccatggctcatcacaaaagagcacattcagaagctggtgaaaactggcgaaaacaactggtcccttcctgagcttgtccatgcggtagtgctcctggctcactatcatgccctcgcatcatttgtctttggaagtggaattaatccagagagagaccccgaaatctctaatggttttagacttattagtgtgaacaacttttgtgtttgcgacttagcaaacgataacaatattgagaacgcctcgctttcaggatccaattttggcatagtggattccctgtccgagctggaagccctgatggaacgaatgaagcgcctgcaggaagagcgagaagacgaagaggcatctcaggaggagatgagcacacggttcgagaaggagaaaaaggaatcattgtttgtggtgagcggagacacattccatagtttcccacacagtggtcttctcaaatattag

SEQ ID NO: 24297 - DNA, 966 bp, Artificial Sequence
  Description of Artificial Sequence: Synthetic coding sequence
atgaacaggggcggtggttcaccttctgccgcagcaaattatcttctctgcacaaactgccgcaaggtcctgagaaaagacaagcgtattagggtcagccaaccattgaccaggggcccatccgcattcatacccgagaaggaggtcgtccaggctaacaccgtggatgagagaaccaatttcctggtcgaagagtactccacaagcggtcgactagacaacatcacgcaggttatgagcctccacactcagtacctggagtctttcctgcgctcccagttctatatgctgcggatggatgggccactgccattaccctatagacattacattgcgattatggccgcagccagacaccagtgctcctatctgattaacatgcacgtggacgaatttctaaagactggcggaattgctgagtggctcaatggcctcgaatatgtgcctcaacgtctgaagaacctaaatgagataaataaactcctggcccaccgcccttggctgattaccaaagagcacatccagaaattagtgaagacgggagaaaacaattggtctcttccagaactggtccacgcagtcgttctccttgcccactatcatgctttagcatcattcgtgtttgggagcggaataaaccccgagcgtgatcccgaaataagtaatgggttccgactaatttcagtgaacaacttctgcgtctgcgacctggccaatgacaacaacattgagaacgccagcctctcgggtagcaattttggtatcgttgacagcctgtccgaactagaggcactcatggagcggatgaagcgtctgcaagaagagagggaggacgaagaagcctcccaggaagagatgtctactagattcgaaaaggagaagaaggagtctctgtttgttgtaagtggggatacattccacagctttccccactctggcgcttttctgcactttttcgctttttag

SEQ ID NO: 24298 - DNA, 1479 bp, Artificial Sequence
  Description of Artificial Sequence: Synthetic coding sequence
atgaatcggggaggaggttcaccctctgcggcagcaaactacctgctgtgtactaattgcaggaaagtcctccgcaaagataaaaggattagggtgagtcagccccttacccgagggccttctgcatttatccctgaaaaggaagttgtgcaggccaacacagtggatgagaggaccaattttctagtcgaagagtacagtacatctggaagattagacaacattacccaggtgatgtctctacatacccaatacctggaatcctttctaagatcccagttctacatgttgaggatggacggccctctcccgctgccctatcggcactatatcgcaatcatggcagccgcacgacatcagtgcagttacttaatcaatatgcatgtcgacgaatttctaaaaacgggcggaattgctgaatggctgaacgggctcgaatacgtcccacagcggttaaaaaacctgaacgagataaacaagcttcttgctcaccggccatggctcataaccaaagaacacattcagaaactcgtcaaaactggagaaaacaactggagcctccccgagctcgtccatgccgtagtactcttggcccactaccatgcgctggcatcatttgtgttcggcagcggcatcaatccagaacgggaccctgagatttccaacgggttccggctgatttctgtgaataatttctgtgtgtgcgatctggcaaatgacaataatatagaaaacgcctctctttctgggagtaacttcgggatcgtcgactctttgagtgagctggaggcactgatggagcgaatgaaacggcttcaggaggaacgggaggatgaagaggccagccaggaggagatgagcacacggtttgaaaaggaaaaaaaggagagtctgttcgtggtgtccggcgacaccttccattcatttcctcactcagatttcgaggacgatatgataataacttcggacgtatcccgttatattgaggaccccggatttggttacgaagattttgctcggcgtggcgaagagcacttaccaacgtttagagcgcaggattacacatgggaaaaccatggcttctccttagtcaacaggctgtattcggatatcggccacctactggacgagaagtttcgcatggtttataatctgacttataataccatggccacgcatgaggacgtcgacactacaatgctgagacgcgctctgttcaactatgtacattgtatgttcggtatccgttatgatgattatgactacggagaagttaaccaattgctggaacgcagcttgaaagtctatattaaaactgtgacctgctacccagagagaaccacaaagcggatgtacgactcctattggcgacaatttaaacattctgagaaggtgcatgtgaacctgttactgatggaggccagaatgcaggctgagctcctgtatgcccttcgcgctattacacggcacctgacctag

SEQ ID NO: 24299 - DNA, 891 bp, Artificial Sequence
  Description of Artificial Sequence: Synthetic coding sequence
atgggcaagaagtcccgcgtgaagacacaaaaaagtggaacaggcgcaaccgccactgtcagcccaaaggaaattttaaacctgactagcgaattactccagaaatgtagtagtccagcccctgggcctggaaaggaatgggaagagtacgtccagatacgaacactggtggagaaaattaggaagaaacagaaagggctgagcgtgaccttcgacggaaaacgcgaggactacttcccggacttaatgaaatgggcatccgaaaacggcgcatcagttgaaggattcgaaatggtgaacttcaaagaagagggctttgggcttagggccacacgggatatcaaggccgaggaactgttcctgtgggtgcctcgcaaattgcttatgaccgtggaatcagccaagaatagcgttcttggccctctgtactcccaggaccgaatactgcaggcaatggggaacatcgcgctggccttccacctgctgtgcgagagagccagtcctaacagtttttggcagccctacatacaaacactgccaagcgaatacgacactcctctgtactttgaggaagacgaggtcaggtatctccagtccacccaggccatccatgacgtgttctctcagtataagaatactgcgaggcagtatgcttacttttataaagtcattcagactcatccccacgccaacaagcttcctttgaaggactcttttacctatgaagattatcgctgggccgtgtccagtgtgatgactcgccagaaccaaatcccaacagaggacggatccagggtgaccctcgcattgataccgctttgggacatgtgtaatcataccaacggcctgacaccagaggatagcttcgctctcgctgtggcaagcgcctag

SEQ ID NO: 24300 - DNA, 1785 bp, Artificial Sequence
  Description of Artificial Sequence: Synthetic coding sequence
atggggaagaaatccagggtaaaaacccagaagtcaggcacaggagccacagcaaccgtatcacccaaggaaatactcaaccttacttccgaacttctgcaaaaatgtagtagtccagcacctggccctggcaaggagtgggaagaatatgttcagattcggacccttgtagaaaaaatacggaaaaagcagaaagggctcagtgtgacgtttgatggaaaacgggaggactatttccctgaccttatgaaatgggcctctgagaacggcgctagtgttgaaggatttgagatggtgaatttcaaggaagaaggattcggcctgcgagccacacgggacatcaaagccgaagaactattcctatgggtccccagaaagctgctgatgactgttgagagtgccaagaattctgtgctgggaccactgtacagccaggatcgcatcttgcaggcaatgggcaatatcgcattggccttccacttgctgtgtgaaagagcttcccctaattctttttggcagccttacattcagaccctgccctccgaatacgatacacctctgtacttcgaagaagatgaagtgcgctatttacaatctacccaggctatccatgatgtgttcagtcagtacaagaacaccgcgaggcagtatgcctatttttacaaagtcatccagacccacccccacgccaataagttgcccttgaaagattcttttacatacgaggattaccgctgggctgtcagttctgtgatgacccgtcagaaccaaatacccaccgaggacggctcgcgcgtgacactggctctgatacctctttgggatatgtgcaaccacacaaacggcctgattaccactgggtataacctggaggacgaccgctgcgagtgtgtggcccttcaggatttcagagccggagagcagatttacattttctatggtactcgctccaacgcggagttcgtgatccatagcggattcttcttcgacaataattcacatgatagggtcaagatcaaattgggtgtgagcaaatctgatagactttatgccatgaaagcagaggttttggcaagagctggtattcccaccagttctgtctttgccctccacttcactgaacctccgatttccgcccagcttttggcttttcttagagtgttttgtatgaccgaggaagaactgaaggagcacttactgggggactctgccattgatcggatttttacactgggcaactctgagttcccggtctcttgggacaacgaagttaaattatggacattcctggaggacagggcatccttgctgcttaagacctataaaactacaattgaggaggacaaatccgtgttgaaaaatcacgatttgtctgtgcgtgctaagatggccatcaagcttaggctgggcgaaaaggagattctggagaaagccgtgaagtcagctgcggttaaccgagaatactacagacaacagatggaagaaaaggcgccactgccgaaatatgaagaatcaaatctgggactactcgagtcaagcgtcggagattcccgtctccctctggtgctgagaaacctcgaggaagaggccggtgtccaggatgccctgaatatccgcgaggctatctctaaggccaaggccaccgaaaacggtctagtgaatggcgaaaacagtatccccaacggcactagatctgagaacgaatccctgaatcaagagtccaagcgggcagttgaagacgccaaggggtcgagtagcgatagcaccgccggagtcaaggagtag

SEQ ID NO: 24301 - DNA, 975 bp, Artificial Sequence
  Description of Artificial Sequence: Synthetic coding sequence
atgcctgagttagcggtgcagaaagttgtcgtgcatccactcgtcctgctaagtgtcgtcgatcatttcaaccggatcggcaaggttggcaaccagaagagggtcgtgggggttctgctcggttcatggcaaaaaaaagtgcttgatgtctctaacagcttcgccgtgccattcgacgaggatgataaagatgactctgtgtggtttctggaccacgactatctcgagaatatgtatgggatgtttaaaaaggtcaatgccagagaaagaattgtaggctggtaccatactgggcctaagctgcataagaatgacattgccattaacgaactgatgaagcgctactgccctaactctgtcctggttatcatcgatgtgaaacctaaagatcttggtctccctacagaggcttatatatcggtggaggaggttcatgacgatgggactccaacttccaagacttttgagcacgtcacatctgaaatcggcgctgaggaggctgaagaggtcggcgtcgagcacctgctgcgagatataaaggatacaactgtgggaacactgtctcagcgtatcaccaatcaggtacacggcctgaagggactgaatagcaaactgctggatattcggagctacctcgagaaagtggcgaccggtaaactcccgattaatcaccagataatctaccaattgcaggacgtgtttaacttgcttccggacgtgtcactgcaggaatttgtcaaagctttctatcttaagaccaacgaccagatggtggtggtctacctggcctctctcatccgcagcgtggtcgctttacataacctgatcaacaataagatcgccaatagagatgccgagaaaaaagaagggcaggagaaagaagagtccaagaaggacagaaaggaggacaaggagaaggataaggataaagagaagagcgacgtcaagaaggaggaaaaaaaggaaaagaaatag

SEQ ID NO: 24302 - DNA, 1350 bp, Artificial Sequence
  Description of Artificial Sequence: Synthetic coding sequence
atggcaactcaggccaagaggccacgagtagctggcccagtggatggcggtgacctggatcctgtggcctgttttcttagctggtgtcgccgagttggcctggaactctccccaaaggtcgcggtctctaggcagggaactgtagcaggctatgggatggtagctagagagagcgtacaggccggagagctgctcttcgtggtgccacgggcagccttactgtcacagcacacatgctccatcggagggctccttgaaagggagcgcgtcgccctccagagtcaaagcgggtgggtccccctgctgctcgccctcctgcacgagcttcaggcacccgctagccgttggcggccttactttgccttatggccggaacttggacggctggagcatccgatgttttggccagaggaggaacgcagatgcctcctgcaggggacaggcgtgcctgaggccgttgagaaggatctcgccaacattaggagcgaataccaatcaatcgtacttcccttcatggaggcgcatccagaccttttttcccttagagttaggagcttggaactctaccaccagttggttgcgctggtgatggcgtattccttccaggagcccttagaagaagaagaggacgagaaagagccaaactcccctgtgatggtgcctgccgctgatattctgaatcacctggctaatcacaacgctaatctcgagtacagtgccaactgtttgcggatggtggctacccagcctatcccgaaaggacatgagatttttaatacatatgggcaaatggccaactggcagctaatccatatgtatggatttgttgagccatacccagacaacaccgacgatacagcagatattcagatggtgacagttcgagaggcagccttgcaaggaacaaagacagaagcggaaaggcacctagtgtacgagcggtgggatttcctatgtaaattggaaatggtcggggaggagggcgcttttgtaattggcagggaggaggttttgacggaggaggaattaaccacaaccctcaaggtcttgtgcatgcccgctgaggaattcagggaactcaaggaccaggatggaggcggagacgataaaagggaggaggggagcctcaccatcacaaatatcccaaaattgaaggcctcctggcgccaactgctgcaaaactctgtgttactcaccctgcaaacctacgccacagacctcaagaccgaccagggcctcctctctaacaaagaggtgtacgcaaagctatcttggcgagaacaacaggcattgcaagtgagatatggacagaagatgatcctccatcagctgctggagttgacgagttag

SEQ ID NO: 24303 - DNA, 372 bp, Artificial Sequence
  Description of Artificial Sequence: Synthetic coding sequence
atggcgacccaggccaaacggcctcgggtagctgggcctgtggacggcggtgatctggatcccgtcgcttgcttcctaagctggtgtagaagggtgggccttgaactcagtcccaaagtgtctgaacgggctgcgggtcgagctccagttgctgcacatcttttgcatcgaaggcccgctggggctagggcctcttgcgccgctgagcctgtgggtttgggtgcaacagcagcgggtgcagcacctagggccgcagggcctggcctcacactcgaggccttgctctgcgcgctggctcgcgcaggccctctgggagccccagacgtcttggtccgtgcgttaggcggagttggggaaagactacatagatag

SEQ ID NO: 24304 - DNA, 810 bp, Artificial Sequence
  Description of Artificial Sequence: Synthetic coding sequence
atgctatttttcacccagtgctttggagccgtactggatctcattcacctgcggttccaacactataaagccaagcgggtgttttctgccgctggccaactggtgtgcgtggtcaatcctacacacaacctgaagtacgtctccagcaggagagctgtgacgcagtcagctccagaacagggatcgtttcacccacaccatctctcccaccaccactgtcaccaccggcatcaccaccacctgcggcaccacgcgcatccacatcacctacaccaccaggaagcaggcctccacgctaatcctgtgaccccctgcctgtgtatgtgcccgttgttttcttgccagtgggaggggaggctggaagtggttgtccctcatcttcggcagatccacagggtggatatcttacagggcgctgagattgtgttccttgccacggatatgcacctgcctgctcctgccgattggatcataatgcatagttgcttgggacaccactttctgctggttctgagaaaacaagagcgtcatgaaggccatccccaattttttgcaaccatgatgctcataggcacaccaacccaagcagattgtttcacataccgccttgagctgaacagaaaccatagaagactcaaatgggaggccactcctaggtctgtcctggaatgtgtcgactcagttatcactgatggcgattgtcttgtgctaaacacttccctggcccagctgtttagcgataatggcagcttagccattggcattgcgatcaccgcaaccgaggtgctaccatctgaggccgaaatgtag

SEQ ID NO: 24305 - DNA, 1983 bp, Artificial Sequence
  Description of Artificial Sequence: Synthetic coding sequence
atgctggtatgctatagtgtcctggcatgcgaaattctgtgggatctgccctgctccattatgggcagcccactgggccactttacctgggacaagtacctgaaggagacctgcagcgttcccgctcccgttcattgttttaaacagagctataccccccctagtaacgagtttaagatttctatgaaactggaggcccaggatcccaggaataccacatctacctgcattgccacagtggtgggtctaactggagccagactgcgtctaaggctagacggcagtgacaacaagaatgacttttggagactcgtggactccgccgagattcagccaatcggtaactgcgaaaagaatggtggaatgttacaacctccactcgggttccggctcaacgcctcttcatggcccatgtttcttctgaagaccctgaacggggctgagatggctccaattaggatcttccataaggaacctccatcccccagccacaatttttttaagatgggaatgaagctggaggccgtcgaccggaagaatcctcacttcatctgtccagcgactattggggaagtcagggggagcgaggtcctggtgaccttcgatggttggcggggtgccttcgactactggtgcaggtttgacagtagagatatcttcccagtcggttggtgttcattgactggggataacctgcaaccccctgggactaaggtagtcattcctaaaaacccttaccctgcttctgatgttaatacagaaaagccttcaatccattcctctactaagaccgtgctggaacaccagcctgggcaacgagggaggaagccaggtaagaagagaggcagaaccccaaagacgcttatcagccaccccatcagcgccccttctaaaaccgccgaaccgcttaaattccccaagaagcgtggcccaaagcctggatctaaaagaaagccccgaactctgctcaatcctccccctgccagtcccacaacttccaccccagagcccgataccagcaccgttccacaggacgccgctacaattccttcatccgcaatgcaggcgccaactgtgtgtatctatctcaataagaatggctccacagggcctcatctggacaagaaaaaggttcagcagttgcccgatcatttcggacccgctcgtgcgagtgttgtgcttcagcaagccgtccaggcttgtatagattgcgcataccatcagaagaccgttttctcttttctgaaacagggtcatgggggagaggtaatttctgccgtgttcgaccgggagcaacatacccttaatcttcctgccgttaatagtattacctatgtcctcaggttccttgagaaattgtgccataacctccgaagcgacaatctattcggaaaccaacccttcactcagacccacctgagcttaactgccattgagtacagccattctcatgatcggtacctgccaggtgaaaccttcgtgctggggaattctctggccagatctctagagcctcactccgatagtatggattctgcatcgaatcctacaaatctcgtgtccaccagccagcgtcatagacctctcctgtctagttgcgggctgcctccctccacggccagtgctgttcggaggctctgcagccggggagttttaaaggggtctaacgaaagacgagatatggaatcattctggaagctgaatagatcaccaggctccgatcggtatctggaatctcgagacgcttctcgcttgtcagggcgagacccctctagctggaccgtggaggatgtaatgcagtttgtgagagaggcagatccacaactgggcccacacgccgacctctttcggaaacatgagatcgacggaaaggccctgctattgctgcggtctgatatgatgatgaagtacatggggctgaaactgggtcctgcattgaagttgtcataccatatcgaccgacttaagcaggggaagttctag

SEQ ID NO: 24306 - DNA, 1947 bp, Artificial Sequence
  Description of Artificial Sequence: Synthetic coding sequence
atgcagcccaatgtcattgattggagcgatgttcgcaagcataagtacggccacctaagcgagtccgcatcccagtatcaggaagccgctgacatccttgatttagggcatttcacctgggacaagtacttaaaggaaacctgcagcgtccctgctccggtccattgctttaaacagtcctatacccccccatccaatgaattcaagatctccatgaagctagaggcacaagatcctcgcaacaccacgtcgacctgcattgcgaccgtggttgggttgactggcgctaggctccgcctccgactcgatggtagtgataacaagaacgacttttggagattggtcgactccgcagaaattcagccaattgggaactgtgagaagaatggcggaatgttgcaaccaccactagggttccgcctgaatgcatcctcatggccaatgttcctgctgaagaccttgaatggagctgagatggcgcctataaggatattccataaagaacctccctcaccttctcataacttcttcaaaatggggatgaagctcgaggccgtcgatcgcaagaacccgcactttatctgcccagccacaattggcgaagtgcggggaagtgaggttcttgttacatttgacggatggaggggtgccttcgattactggtgcaggttcgacagtcgcgatattttccccgtcggatggtgctctctcactggagataacctgcaacctccaggcactaaagtggttatccccaaaaatccctacccggcatcagatgtgaatactgagaagcctagcatccactccagcacaaaaactgtccttgagcatcaaccaggccagcgcggtcggaagcctggaaagaagagggggaggacaccaaaaacactcatctcacatccaatctctgccccatctaaaactgccgagccccttaagtttcctaagaagcggggacctaagccgggaagcaaacgaaagccgcgaacgttgttgaaccccccacccgcatcgccgactaccagcactcctgaaccagatacatctaccgtgccacaagatgcagcgaccatcccctcctctgccatgcaggcacccactgtctgcatatatctcaacaaaaacgggtccaccggccctcatcttgacaaaaaaaaggtgcagcagcttcctgaccatttcggccctgctagagcctcagtcgtgctccaacaagctgtccaggcctgcattgattgcgcttatcatcaaaagacagtctttagcttcctaaaacagggacatgggggagaagtgatttctgccgtgtttgatcgcgaacaacacactctgaacttgccagcggtcaactccattacttatgtgctgcgatttctagagaagctttgccataatctgcggagcgataatttgtttgggaaccagcctttcacccaaacccatctttccctgacagctattgagtacagccacagccacgatcgatatcttcccggagagacttttgtcctaggtaatagcttggctcggagtctggagcctcacagtgattctatggatagcgcctcgaatcccaccaacctggttagcacttcccagaggcaccggccactactgagctcatgcggactgcccccatccactgcctcagccgttaggcgcctctgctctcgtggaagcgaccgatatttggaatccagggatgcatctcggctctctggtcgcgacccgtcctcttggactgtggaggacgtgatgcaattcgtcagagaagccgacccacagctgggcccacacgccgatcttttccgcaagcatgaaatcgatggcaaggcactgctactgttacgctcagacatgatgatgaagtacatgggacttaagctgggaccagcattaaagctgtcatatcacatcgataggctgaagcagggaaagttctag

SEQ ID NO: 24307 - DNA, 1734 bp, Artificial Sequence
  Description of Artificial Sequence: Synthetic coding sequence
atgaagctcgaggcacaggacccgaggaataccacttccacttgtatagcaacggtcgtcggtctcacaggagctcggctgaggttgcgtctcgacggaagcgataataaaaacgacttctggcgccttgtcgacagcgctgagatccagcctatcggaaactgcgagaagaatggagggatgctgcagccccctcttggatttcgactgaatgccagctcatggccaatgtttttgctgaaaactcttaatggagccgaaatggcaccgatcaggatctttcacaaggagccaccctcccccagccacaatttcttcaagatgggcatgaaattggaggctgtcgatcgtaagaatcctcactttatttgtcctgcaacaatcggcgaagtgagaggttcagaggtgcttgtgaccttcgacggttggcgcggtgctttcgactactggtgtagatttgactctcgcgacatcttccccgtcgggtggtgttcacttacgggcgataatcttcagccgccaggaacgaaggtcgtgattcccaaaaatccctatccggcatcagatgtgaacaccgaaaaaccctcaattcatagcagcacgaaaacggtgcttgagcatcagccgggacagcgcggacgaaagccaggtaagaagcgcggaaggacacctaaaacattgatctcgcatcccatctcagctccctccaaaacagcggaacctctgaaattcccaaagaagaggggcccaaagcctggctctaagcgcaagccgaggaccctcttaaatccacctcccgctagcccaactacatccactcctgaacccgacacgtccacagtccctcaggacgcagctacaatcccatcatccgctatgcaagcgcctacagtgtgcatttacctgaataaaaacggttcaaccggccctcacctggacaagaagaaggtgcaacagcttccagatcactttgggcctgctagagcgtctgtggtgctgcagcaggccgtccaagcgtgcatcgattgcgcataccatcagaagactgtgttctctttcctgaagcaggggcacggcggagaggtcattagtgccgtctttgatagagagcagcacaccctgaacttgcccgctgtgaacagcatcacatatgtactacggtttcttgagaaactgtgtcataatcttcggagcgacaacttgttcgggaatcagccattcactcaaacccacctctctctaaccgccatagagtacagccacagccacgacaggtacctgcctggtgaaactttcgtcttgggcaattcacttgctcgctcgctcgaaccccactctgactcaatggatagtgcctcaaatccgacaaatctggtttccacctcccagcggcacagaccactactgtcatcatgtggtctaccgccatctacggcatctgctgtgaggcggctctgttcaagggggtcagataggtacctagagagccgcgacgcaagcagactgtcaggccgagacccatctagttggactgtggaagacgtcatgcagtttgtgagggaggcagatccccagctagggcctcacgccgacttatttagaaaacatgaaattgatggcaaagccctgctcctgctaaggagcgatatgatgatgaagtacatgggtcttaagctgggacccgctcttaaattgtcctatcatatcgaccgcctgaagcagggcaagttctag

SEQ ID NO: 24308 - DNA, 1776 bp, Artificial Sequence
  Description of Artificial Sequence: Synthetic coding sequence
atgcagagttatacacctccaagcaatgagtttaagatctcgatgaaattagaggcccaagatcccaggaacaccaccagcacctgtattgcaaccgttgtcgggctgacaggggctcggctgcgtctcaggctagacggcagcgacaacaaaaatgacttctggaggctggtcgactccgctgagattcagcctataggaaactgtgaaaagaacggtgggatgttgcagcctccactggggtttaggcttaatgctagttcatggcctatgtttctgcttaagactctgaacggtgctgagatggcgcctatccggatatttcacaaggaacctccgtcgccaagccacaatttttttaagatggggatgaagcttgaagctgttgaccggaaaaaccctcactttatatgtcctgccacaatcggtgaggttcgcggtagcgaggtactcgtcacatttgatggttggcggggagccttcgattactggtgcagatttgattcaagagacatttttcctgtcggctggtgcagcctcacaggcgacaatttacaaccacccggtactaaggtcgttatccccaaaaatccataccccgcttcagacgtgaataccgagaagcctagcattcactccagtactaagacagttctggagcatcagccaggtcagaggggcagaaagcctgggaagaaaaggggtagaacccctaaaacgttgatctcacaccctatctcagcaccctctaaaactgcggagcccctgaagtttccaaaaaagcggggacccaaacctgggtctaaacgaaagcctaggacattactcaatccccctcctgcatcccctactacgagcacaccagagcccgatacgagcaccgtgcctcaggatgcagccaccatcccatcatctgccatgcaagctccaacagtgtgcatttatcttaacaaaaacggttccactgggccacacttggacaaaaagaaagtgcagcagctgccagatcacttcggcccagcccgagctagtgtggtcctccagcaagcggtgcaggcatgtatcgactgcgcataccatcagaagacagtgttttctttcctgaagcagggccacgggggagaggtgattagtgccgtgtttgatcgggagcaacacaccttaaacctgcctgcagttaattccattacttacgtactcaggttcctcgaaaaactgtgccacaacctgagaagcgacaacctgtttggaaaccagccatttacccagacgcacttatccctaaccgcgattgaatactcgcactcccacgatcgataccttcccggtgagacttttgtccttggaaactccctcgctaggtctctggaacctcattctgactccatggactccgcaagcaatcccacaaatttagtaagcacaagtcaacggcaccggcctcttctgtcaagctgtggccttcccccatccacagcgagcgccgtgagaagactgtgttccagaggatctgacagatatctcgaaagtcgggacgcctcaaggctgtccggtagagatccttccagttggaccgtggaggatgtgatgcagttcgtacgagaggccgatcctcagctgggcccacatgcagacctgtttaggaagcatgagatagacggcaaggccctgctgctgttgcgaagtgatatgatgatgaaatacatgggtctcaagttggggcctgcccttaagcttagttatcacattgatcgtttaaagcagggcaaattttag

SEQ ID NO: 24309 - DNA, 1800 bp, Artificial Sequence
  Description of Artificial Sequence: Synthetic coding sequence
atgaaactggaggctcaggacccaagaaataccacttctacttgcatcgctaccgtggtgggcttaacaggagcgaggttgagactgaggctcgacggctctgacaacaaaaatgacttctggcgtctcgtcgattccgcagagatacagcccattggaaactgcgagaagaacgggggtatgttgcaacctccgctgggattcagacttaacgcctcctcctggcccatgttcttactaaagactcttaacggcgcagaaatggctcctatccggatctttcacaaagagcccccaagcccgtcacataatttttttaagatgggcatgaagctggaagctgtcgaccggaaaaacccacacttcatttgtccagctacaatcggcgaggtgaggggatctgaagttttagtaacattcgacggctggcggggagccttcgattactggtgtcgtttcgactcgcgagacatctttcctgtaggatggtgctccctgactggagataatcttcagccgccaggcaccaaggttgtgattcctaagaatccttacccggcaagtgatgtgaacacggagaaaccatctatccactcatctacgaaaacagttctcgaacaccagcccggacaaagagggagaaagccgggaaagaaacgaggcagaacccctaaaaccttgatctctcaccccatttccgctccctctaaaaccgcagagccccttaagttccccaaaaagcgcggacccaagcctggctccaaacgcaaaccaagaaccctcttgaaccccccaccagcctctccgaccacgtcgaccccagagcctgacacatctaccgtgcctcaggacgctgctacaatcccttcctctgcaatgcaggctccgactgtctgcatttatctgaacaaaaacggatctactggtccgcacttggataaaaagaaggtgcagcagctgcccgatcattttgggccagcgagggccagtgtcgtgctgcagcaagctgtgcaggcctgcatcgactgtgcgtatcaccagaagaccgtattcagcttccttaagcaaggccatggcggagaagtgatctcagccgtttttgaccgggagcagcatactctgaatctgcctgcagttaattctattacttacgtgttgcgtttcctagaaaagctctgccacaacctcaggagtgataacctcttcggaaaccaacccttcacccagacccacctctcactgaccgccatcgagtacagtcattcacacgatagatatttacctggggaaacatttgtcctaggaaatagtttagcccgttcgctcgagccgcactcagactccatggatagtgccagcaacccaaccaatctggtgtcaacgtcgcagcgtcaccgacctctcctgtcaagttgcgggctccccccttctactgctagcgctgtccggagactctgttctcggggagtgttaaagggaagtaacgagagacgcgacatggagtcattctggaaactcaatagatctccaggtagcgaccgttacctagaaagccgggatgcttcccgtctgagtgggcgtgaccccagctcatggaccgtcgaggacgtgatgcagtttgtgcgcgaggcggatccccagcttggccctcacgcagacctcttccgaaagcatgaaatagatggcaaggccctgctgctgctgagaagtgacatgatgatgaaatacatgggcctgaagttagggccagctcttaagcttagctaccatatcgatcgcttgaagcaaggaaaattctag

SEQ ID NO: 24310 - DNA, 1734 bp, Artificial Sequence
  Description of Artificial Sequence: Synthetic coding sequence
atgaaactcgaggcccaggatccgagaaacaccacctctacatgcatcgcgactgtggtgggtctcactggagccagacttagattgagactggacggctcagataataaaaatgatttctggcgattagtggatagcgccgagattcaaccaataggcaattgtgagaagaatgggggtatgttacagccacccctgggatttcggctgaacgcttcatcctggcccatgtttctccttaagacattgaatggcgctgaaatggccccaatccgtattttccataaagaaccccctagtcctagccacaacttttttaagatgggtatgaagctggaggcggtcgataggaagaacccgcatttcatatgcccagccacaataggcgaggtgaggggttccgaagtgcttgtgactttcgatgggtggcgaggtgcttttgactactggtgccgctttgatagtagggatattttcccagttgggtggtgtagcctcaccggagacaacctgcagcctcctggtactaaagtggtaatcccaaaaaatccctacccagcaagtgacgtaaataccgaaaaaccttcaattcactcttcgaccaaaacagttctcgagcaccagcccggtcaaaggggcagaaaaccgggtaagaagcggggtcggactccaaaaactcttataagccatcccattagcgccccttccaagacagccgagcccctgaaatttccaaagaagcgagggcctaagcccggttcaaaacgaaaaccacggaccctgctgaatcccccacccgctagtcctacaacgtcgactcccgagccagatacaagtaccgtaccccaggatgccgcaaccatcccgtcatccgcgatgcaagcccctacagtgtgtatctacctgaataagaatgggagcaccggaccacatctggataagaaaaaagtccagcagctacctgaccattttggtcccgcaagggcctccgtggtattacagcaggccgttcaggcctgtatcgattgcgcttaccaccagaagacagttttctcttttctgaaacagggccacgggggagaggtgatcagcgccgtgtttgaccgcgaacagcacacgctgaacctgccagctgtgaactcaattacctatgtacttagatttctcgaaaagctgtgccacaatctgcgctcggacaatctgtttggcaaccagccctttacacagactcatctgtcgcttaccgctattgagtacagccattcccatgacaggtacctgcccggagagactttcgtgttaggcaattcacttgcccgatccctggaaccccattcggatagcatggactcagccagtaatccgacaaacttggtgtcaacctcacagagacatcgtcccctcctgtcttcctgtggactccccccaagtacagccagcgccgtgcgcagactgtgtagtcgtggctctgaccgttaccttgagtcccgcgatgcatcaaggttgtcagggagggatcccagcagctggaccgtggaagacgttatgcagtttgtgagggaggcggatccccagttgggtcctcacgcagacctctttagaaaacacgaaatcgatggcaaagccctcctactactgcgcagtgatatgatgatgaagtatatgggtctcaagctgggtcccgcattgaagctgagttatcacattgatcgccttaaacagggtaaattctag

SEQ ID NO: 24311 - DNA, 1776 bp, Artificial Sequence
  Description of Artificial Sequence: Synthetic coding sequence
atgcagtcctatacacccccttccaacgaattcaagatctccatgaagttggaggcgcaggatccaagaaacacgacaagtacttgcattgccactgttgtcgggctgaccggcgcaaggctgagacttcgcctggatggtagcgacaataagaacgatttttggcgcttggtcgattcagcagagatccagcctatcggcaactgtgagaagaatggtgggatgctccaaccgcctctggggttcagactgaatgcatccagctggcccatgtttctactcaagactctgaacggcgcagagatggcacccatcagaatatttcacaaagaaccgccaagcccttcacacaatttttttaagatgggtatgaagttggaggccgtggatagaaagaaccctcacttcatttgcccagcaacgatcggggaagtcagaggttccgaggttctagttacattcgatggttggcgtggtgctttcgactattggtgccgcttcgattctcgggatattttccctgttgggtggtgcagtctaactggggacaacctgcagccaccaggcacaaaggtggttatccctaagaacccttacccggcttcagatgtaaacaccgagaagccaagtatccattcatccaccaagacagtgctggagcatcaacctgggcaacgtggccgtaaacccggaaaaaaaagaggacgaacacccaaaactttaatttcacatccgatcagtgcaccgtctaagacagcggaaccgctgaagtttccaaagaaacgcggacccaagccgggatcgaagaggaagccgagaaccctcctgaatccgccacccgcatccccgaccacatcaacccctgagcctgacacctccactgtgccccaggatgccgcaaccatcccgtcatccgcaatgcaggccccaacagtgtgtatttatctgaataagaatggaagcacaggaccccacctggacaaaaaaaaggttcagcagctccctgaccactttgggcctgcaagagctagtgtcgtgctgcagcaagccgttcaggcttgcattgactgcgcttaccaccagaagactgtgttctcattcctgaaacaaggtcacggaggagaagttatcagcgctgtgtttgaccgcgagcagcacacactaaatctacccgctgtaaattccataacttacgtactgcgattcttggaaaaattgtgtcacaaccttcggtccgacaacctgttcgggaaccagccatttactcagacgcacctgagcctaaccgccatcgagtactctcactctcatgatagatacctgcctggcgagacttttgttctgggaaatagtctggcgagatcgcttgagccacactctgatagcatggactcggcgtccaaccccaccaatcttgtgagcacatctcagcggcaccggccactgctgtcttcatgtggactaccaccgtctaccgcctcagcagtccggcgtctttgcagtcgcggttctgaccggtatcttgagtcacgcgatgcaagcagactgagcggtcgagacccaagttcttggaccgtcgaggacgtcatgcaatttgtcagggaagcggatccccagctaggaccccacgcagacttgtttcgaaagcatgaaattgacggtaaagctcttctgctgttaagaagtgatatgatgatgaaatacatgggacttaaactcgggccagcgctgaagctttcctaccacatagatagactaaagcagggcaagttctag

SEQ ID NO: 24312 - DNA, 1734 bp, Artificial Sequence
  Description of Artificial Sequence: Synthetic coding sequence
atgaagctggaggctcaggacccaaggaatacaacttctacctgtatcgcgactgtagtggggctcacaggggcacggctcagacttaggctggacgggtcagataataaaaatgacttctggcgcttggttgatagtgccgagattcagcccatcgggaattgcgagaagaacggcggaatgctgcagcctcccttaggctttcggctgaatgcttccagctggccgatgttcctgctaaagaccctcaatggagccgaaatggcccctattcgcattttccacaaggaacctccatccccatcccacaacttctttaagatgggaatgaagcttgaggccgtcgacaggaagaacccacactttatttgtcctgccacaattggtgaggtgaggggttcagaggtgctggtgacatttgacgggtggagaggcgcttttgattactggtgtaggtttgactctcgggacatttttcctgtgggctggtgttctctgacaggcgacaatctccagcctcctggtaccaaggtggtaatccccaaaaatccttaccctgcctctgatgtgaacaccgagaaaccctccatacactccagtactaagaccgttcttgaacaccaaccaggacagcgaggcaggaagcccggaaaaaaaagagggcgtacgcctaaaactttgatatcccatccaatttctgcccctagcaaaaccgcagaacccctgaaatttccgaagaaacgcggtccaaaacccggaagtaaacgaaagcctcgcactctgcttaatcctcctcccgcatcaccaacaacctctacccccgagcccgatacctctacagtgccccaggacgcagctacgatcccttcatcagctatgcaagcacccacagtctgtatttatctcaataagaatgggagcaccggcccacacctagataaaaaaaaagtacagcagctaccagatcattttgggcctgcgagagccagtgtggtgctgcaacaggccgtacaggcatgtatcgattgcgcttaccaccagaagaccgttttcagcttcctgaagcaggggcatggaggggaagtcatctctgctgtcttcgatagagaacagcatacattaaatttacctgcagtgaacagcatcacatacgttctacgattcctggagaagctctgccataatctcaggagcgataatctcttcggtaaccagcccttcacacaaacacatcttagcttgaccgctattgaatatagccactcgcatgaccgctacctgccaggcgagacctttgtgctcgggaattccttagcacggtccctggagccacattcggactctatggattccgctagtaacccaactaatcttgtcagtacctcacaaagacacagacccctgctatcatcttgcggcctgcccccttcaaccgcttcagctgtgaggagactgtgcagcaggggctcagatcgctacttggaaagtcgcgatgcctctcggctcagtggtcgagacccttcttcttggaccgtggaagacgtgatgcaatttgtgcgagaggcagatccccagttaggtcctcatgctgacctgtttagaaagcacgagatagacggaaaagcactgctgctgctacgttcagatatgatgatgaagtacatgggtctgaaacttggccctgctctcaaactttcttaccatattgacaggctgaaacagggaaagttttag

SEQ ID NO: 24313 - DNA, 1857 bp, Artificial Sequence
  Description of Artificial Sequence: Synthetic coding sequence
atggggtccccattaggccacttcacttgggataagtacctcaaagagacatgttcggtgccggctcctgtccattgtttcaagcaatcctacacgccaccgtccaatgaatttaagatcagtatgaagttggaagcccaagaccctcgtaacaccacaagtacgtgtattgccaccgtggtcggcctgacaggagcaaggctgaggctgaggttggatggctccgacaataagaatgacttttggcggctcgtggattccgccgagattcaaccaatcggtaactgtgagaagaatggcggaatgctgcaaccaccactgggttttcggctgaacgccagctcctggcccatgtttctgctaaaaactcttaacggggctgaaatggcaccaattcgcattttccataaggagccaccctcgcctagtcacaacttttttaagatggggatgaagctggaggcagtggatcggaagaatccacattttatctgcccagcaactatcggcgaagtacggggtagcgaggtgctggtgactttcgacggatggcgtggagcctttgattactggtgtaggttcgactcaagagatatttttccagtcgggtggtgtagcctgactggcgacaacttgcagccccctggcacgaaagtcgttatcccaaaaaacccctatccagccagtgacgtcaacaccgagaagcccagtatccacagttctacaaagacagtgctggagcaccagcccggacagcggggaagaaagcccggaaagaagagggggcgaaccccgaagacgctgatctcacacccaataagcgccccttctaaaacagccgaacccctgaagtttcctaaaaaaagggggccaaagcccggatcaaagcggaagccacgcacattactgaaccccccaccggcatctcccacgacctctacacctgagcctgatacctcgactgtgccacaggacgccgctactatcccgagctcggccatgcaggccccaaccgtgtgcatctacttaaataagaacggctccacaggccctcatctggacaagaagaaggtgcaacagctgccggaccattttggacctgccagagcttccgtggtgctgcagcaggcagtgcaggcctgcattgactgcgcgtatcaccagaaaactgtgttttcgtttcttaagcagggccacggtggagaagtgatctctgccgtcttcgacagggaacagcatactctgaatctgcccgcagtgaactccattacgtatgttcttaggtttcttgagaaactttgtcacaatctacggagcgacaacttgttcggaaatcagccattcacgcaaacccacctttcactgaccgctattgagtactctcactcgcacgatcgctacctcccgggagaaacctttgtgctcggcaacagcctggccaggtctctagagccgcattctgacagcatggacagcgccagtaatccgacaaacctcgtttctacgagccagcgccacaggcccctgttgagttcctgtggtctacctccatccacagcgagcgctgtaaggcgtctctgcagtaggggatctgacagatatttggagagtagagatgcatccagactctctggacgggatccctcaagttggacagtggaggatgtgatgcaatttgtccgggaggcagacccacaactgggccctcacgctgatcttttcagaaaacatgaaatagacggtaaggctctcctgttgctaaggtcagacatgatgatgaaatatatgggcttaaaactggggcctgccttgaaactgtcatatcacatagacaggctcaagcagggcaagttttag

SEQ ID NO: 24314 - DNA, 1983 bp, Artificial Sequence
  Description of Artificial Sequence: Synthetic coding sequence
atgctggtttgttatagcgtgttagcatgcgagatcctatgggacctcccatgttcaattatgggctcccccctgggccacttcacctgggacaaatacttgaaggagacatgttccgtccccgctccagtgcattgtttcaaacagtcttataccccgccaagtaacgaatttaaaatttctatgaaactcgaggcccaagacccgagaaatactacaagcacttgtattgccacagtcgtaggactgacaggtgccagactgcgtctgagactggacggctccgacaacaaaaacgacttttggaggctggtagattccgccgaaatccagcctattgggaactgcgagaagaatggcggaatgctgcagccgccactgggcttcaggttgaatgcatcctcatggcccatgttcttgctgaaaacactcaatggcgcagaaatggcgccaattaggattttccataaggaacccccatcaccttcccacaacttttttaaaatggggatgaaactcgaagccgtggatcggaagaatccccatttcatctgtccagctactatcggagaggtgcggggaagcgaggttctcgttacattcgacgggtggcgaggcgcatttgattattggtgccgattcgactccagagacatcttcccagtggggtggtgttctctcactggggataacctccaacctcccggaactaaggtcgttatcccgaagaatccttatcccgctagcgatgttaatacggagaagccctctatccactctagcacaaagactgttctagagcaccagcctggccaaagagggcgtaagcccggaaagaaacggggaagaacacccaagaccctgatctcccatccaatcagtgcaccaagcaagacagctgagcccttaaaatttcctaaaaagcgaggacctaagccaggaagcaagcgaaagccgaggacactgctcaatccccctccagccagccccactacgagcacacctgaaccagacacaagcacggttccccaagacgcagctaccatccctagctcagctatgcaggctcccaccgtttgtatttacctgaacaagaatgggtccactggaccccacctagacaagaaaaaggtgcagcaactgccggaccattttggcccagccagagcatcggttgtcctacagcaggcggtgcaggcttgtattgactgtgcttatcatcagaagaccgtgttcagcttcttgaagcagggccacggcggtgaggttatctctgcagtgttcgatagagagcagcataccctgaatctgcccgctgttaactccattacgtacgtgctcagatttcttgagaaactctgtcataaccttcgctccgataacctctttggaaaccagcccttcacccagactcatctctcactgacggcaatcgagtactcccactcacacgaccggtatctgccaggggagacttttgttctgggcaattcacttgccaggagcctggaaccccattccgactctatggattcagcctcaaaccctaccaatctggtctccacgtcccaaaggcaccgtccactgctgagctcatgtggtctaccaccttcgacagccagcgcagtgagacggctgtgctctcgcggtgtgctcaagggatcaaacgagcgccgtgacatggaaagtttctggaagttaaaccgcagcccaggatccgaccgatatttagaatcgagagacgcatcgagactttcaggcagagatccctcgagctggaccgtggaagacgtgatgcagttcgtaagggaagcagatccacagcttggccctcacgcagatttgtttcgcaagcacgagatcgacggtaaggccctgctcctactgaggtctgacatgatgatgaagtacatgggcctgaagctgggtcctgcgctgaaactctcctatcacattgatcggctgaaacaaggcaaattctag

SEQ ID NO: 24315 - DNA, 1443 bp, Artificial Sequence
  Description of Artificial Sequence: Synthetic coding sequence
atgcagtcttatactcccccaagcaatgaatttaagattagcatgaaacttgaagcacaagatcccaggaacaccacttcgacttgcatagccactgtggttggcttgactggtgccagactccggctcaggctggatggttcagacaataagaatgatttttggagacttgttgactcagctgagatccaacccattggcaattgcgagaagaatggcggtatgttacagcctcccttggtggtcatccctaaaaacccgtacccagctagcgatgtcaacaccgaaaagccgtctatccacagctccaccaagaccgtgctggaacaccagccgggacagcgcggtcggaaacccggaaagaagcgaggacggacgcccaagactctgatcagtcatcctatctctgctcccagcaagacagctgaaccattaaagttccctaagaaaagaggtcctaagcccggaagcaaacgaaagccccgtaccttattgaacccccctcccgcttccccaacaacatccactcccgaacccgatacaagtaccgtcccccaagatgcagctacaattcctagcagcgccatgcaggctccaacagtgtgtatatatctgaacaagaacggctccactgggcctcatttagataagaaaaaggtgcagcagctgccagaccattttggacccgctagggctagcgtcgtgctccagcaggccgtccaggcttgtatcgactgtgcttatcaccagaaaaccgtgttctcttttctcaaacaaggccacggaggggaggtaatctccgctgttttcgaccgtgaacaacataccttgaatcttccagcggtcaattccataacatacgttttaaggtttttggagaagctttgtcacaatctgcgcagtgacaacctgtttggaaaccagccctttactcagacacacctctctctgactgcgatagagtattcacactctcatgaccggtacctgccgggagagacatttgtgctgggaaatagcttggcccgaagtctcgagccacactctgactcgatggactcagcctcaaacccgaccaatctagtaagcacttctcagcgtcatcgccctttgctgagcagctgtggcctgcccccatctaccgcatccgctgtgagaagattgtgctcccgcggatcagaccgatacctcgagagtcgcgatgctagccgcctcagcggaagggatccttcttcctggacagttgaagatgtgatgcagttcgtgagagaagcagatccgcagctgggacctcatgccgacctatttaggaagcacgagatagatggcaaggctcttctgttgctgaggagcgacatgatgatgaagtacatgggcttgaaactggggccagccctgaaactgagttatcacattgaccgcttaaaacaagggaagttctag

SEQ ID NO: 24316 - DNA, 1245 bp, Artificial Sequence
  Description of Artificial Sequence: Synthetic coding sequence
atgcaaagccagaggatccctggcagaaaaaggggtcggccaagcctccactcaacaccaatgaaaatggctgtccacaacctttactctgcgtcggccggaagcttacccgcagttaaaataccgaaaaagcggggacgaaagccgggttataagatcaaaagtcgcgtgctgatgactcctcttgcgttgtccccaccacgatcaaccccagagcccgacctatcatccatcccccaagatgccgctacggtccccagcctggctgctccacaagccctcacagtttgcctgtacattaacaagcaggcgaatgccggtccctatctcgaaagaaagaaggtccagcagctgcccgagcacttcgggccagagaggccgtcagctgtgctgcaacaggcggtacaggcatgtatcgattgcgcacatcagcagaagctcgtcttctctttggtgaagcaaggctacggcggagaaatggtctccgtttctgcctctttcgatggtaaacagcaccttagaagcttgcccgtcgtcaattctataggctacgtcctccgcttcctggccaagttatgccggtcactcctgtgcgacgatctgttctctcatcagccctttcctcggggatgttccgcatccgaaaaggtgcaggaaaaagaagaggggcgaatggagtctgttaagacagtcacaactgaagaatatctggtgaatccggtcgggatgaatcgatacagcgtcgatacttctgcgtctacgtttaaccaccggggtagtctgcatccctcaagctcactatactgcaaaaggcagaattctggtgattcccacctcggagggggaccagcagccacagccggaggacccagaaccagccctatgtcttctggaggaccgtcagccccaggactgcgtccccctgcgtctagcccaaagcgaaacaccacaagtttggaggggaatcgttgcgctagctctccctcacaggacgctcaggatgccaggaggcccagaagccggaatccttctgcttggacagtggaggacgtcgtttggttcgtgaaggacgctgacccccaggcgctaggccctcatgtcgaactgtttcggaaacacgagatagatgggaacgccctactgctgctcaagagtgatatggtcatgaaatatctcgggctgaaactgggaccggctttaaagctctgttaccacattgacaaattaaagcaggcaaaattctag

SEQ ID NO: 24317 - DNA, 918 bp, Artificial Sequence
  Description of Artificial Sequence: Synthetic coding sequence
atgccatgccagcggactgcctggatcggctgtgatagacagaggacacctccattccactggagagagatcaaatccagggtgttgatgacgcccttggcactctcacctccgagaagtacacccgaacccgacctgtcaagtattccacaggatgccgcaacagtaccctcgctggcggcaccccaggctctgaccgtgtgcctttatatcaataaacaggcaaacgcaggtccttacttggaacggaaaaaagtgcagcagttacctgagcattttggtccagagcggcctagcgcggtactgcaacaggccgtccaggcttgcatcgattgcgcacatcagcagaaattagttttctcgctggtaaaacaaggatacggcggagagatggtaagtgtatcggctagcttcgacggcaagcagcacttacggtcactgccggtcgtgaactcaatcggctatgtcctccggttcctggctaagctgtgtaggtcattgctgtgtgacgatctgttttcacaccagcctttccccagaggctgctctgcctcagagaaagtgcaagagaaagaagaagggagaatggaaagtgtcaagacagttacaaccgaggagtatctcgtgaaccccgtgggaatgaatcggtacagtgtcgacaccagtgcatccacatttaatcatcgcggtagtttgcatccttcttcctcactgtactgcaagaggcagaacagcggggattcccacctggggggaggccctgccgcaacggctggtggcccaaggacatcccccatgtctagcgggggaccgtctgcccctgggttgaggccgccagccagctcgcctaagcgaaatacaacttcactggaaggaaacaggtgcggcaacgtgatgcatgcatccgcttcccactag

SEQ ID NO: 24318 - DNA, 324 bp, Artificial Sequence
  Description of Artificial Sequence: Synthetic coding sequence
atggtaatccgggtatttatcgctagtagctctgggttcgtcgctattaaaaaaaagcagcaggacgtggtgcgctttttggaagctaataagatcgagtttgaggaagtggacattacaatgtctgaagagcagcggcaatggatgtacaaaaatgtgccccctgaaaaaaaacccacccagggcaacccgttgcccccacagatctttaacggcgaccggtactgtggtgactatgacagctttttcgagagcaaggagtcaaacactgtgttctcatttctcgggcttaaaccacgcttagcttctaaagctgagccatag

SEQ ID NO: 24319 - DNA, 960 bp, Artificial Sequence
  Description of Artificial Sequence: Synthetic coding sequence
atggaggaattaacagcttttgtgtctaagagtttcgaccagaaagtcaaagaaaaaaaggaggcaatcacctacagggaggttcttgaaagcggcccacttaggggcgcaaaggagccaacaggatgcacagaggcaggcagagatgatagatcttcccctgctgtgcgggcagccggaggagggggaggaggcggtgggggaggcggtggaggcggtggcggtggcggtgtggggggagggggtgccggtggaggagctggcggaggccgtagccccgtaagggagttggacatgggcgcagctgaaagatctagagagcctgggtctcccagattaacagaggtctccccggaactaaaagatcgaaaggaagacgccaaaggtatggaagacgagggccaaacaaaaatcaaacaaaggaggagtcgcaccaacttcacattggagcagttgaacgaactggaaagactgtttgatgagactcattatcccgacgccttcatgcgtgaagaacttagccagcgcttgggtctcagcgaagcacgggtccaagtgtggttccagaaccgacgcgcaaaatgccgcaagcaagaaaaccaactgcacaaaggagtactaatcggagcagctagccagttcgaggcctgtagggtggcaccatacgtgaacgtgggggcactgcgcatgcctttccaacaagtgcaggcccaactccagctagactctgccgttgcccatgctcaccatcacttacatccgcaccttgctgcccatgcaccctacatgatgtttcctgcccctccgttcgggttgcctcttgcgacgttagctgccgactcagctagtgcagcatctgtcgtcgctgctgcagccgctgcgaagactaccagcaagaacagcagcatcgctgacctgcgcctgaaagccaagaaacacgcagctgccctagggctgtag

SEQ ID NO: 24320 - DNA, 663 bp, Artificial Sequence
  Description of Artificial Sequence: Synthetic coding sequence
atgaacgggtttaccccagacgaaatgtcccggggaggagacgccgcagcagcagtagcagcagtggttgcggctgcagcagctgctgcctcggccggaaacggaactggggcagggactggtgccgaagttcctggtgcgggtgccgtcagcgccgctggccctccaggggctgctggacccggacccggtcagctgtgctgcctccgggaagatggggagaggtgtggtcgggctgctggcaacgcttcattctctaagaggattcagaagtcaatctcgcaaaaaaaggttaagatcgaattagataagagcgccaggcacctgtatatatgcgactatcacaaaaatctaatacaatctgtgaggaaccgcaggaaaaggaaaggaagcgacgacgacgggggtgactcgcccgttcaggacatcgacactccagaggtggacctgtatcagcttcaggtgaatacgctgcgtcggtacaaacggcacttcaagctgccgactagaccagggctaaataaggctcaactggtggaaatcgtcgggtgccatttcagatcgattccggtgaacgagaaggatacactgacatatttcatctattccgtgaagaacgataagaacaagtctgacctcaaggtagacagcggtgtccactag

SEQ ID NO: 24321 - DNA, 828 bp, Artificial Sequence
  Description of Artificial Sequence: Synthetic coding sequence
atgggaccagccggagtggcggcacgacccggtcggttcttcggagtgtacttactgtattgcctgaaccctaggtaccgaggacgagtgtacgttggctttactgtaaacacagctcgacgagtgcaacagcataatgggggaagaaaaaagggcggagcctggcggactagcggccgaggaccatgggagatggttttggtcgtacacggattcccaagttcagtggcagccttacgcttcgagtgggcatggcagcacccacacgcctctagacggctggcgcatgttggtcccagactgagaggtgaaactgcgttcgcatttcaccttcgggtactggcacatatgttgagagcacccccttgggccaggctaccactcacactgcgatgggtacgtcctgacctccgccaggacctctgcctgcccccaccaccccacgtgccattagcattcggtcccccaccaccccaggcccctgcaccgagacgtagagccggtccattcgatgacgccgagcccgaaccagaccagggtgaccccggtgcttgctgctcactctgtgcacagactattcaggacgaggaaggtcctttgtgttgtccacacccaggttgtttgctacgcgctcatgttatctgccttgccgaggaattcctgcaagaggagccgggacagctcctgccattggagggtcagtgcccatgttgtgagaagtccttgttgtggggcgacctgatatggctgtgccagatggataccgagaaggaggtagaggactccgaattggaggaagcacattggactgatctgcttgagacatag

SEQ ID NO: 24322 - DNA, 486 bp, Artificial Sequence
  Description of Artificial Sequence: Synthetic coding sequence
atgggacctgccggagtggcagcaagacccggacggttcttcggggtgtacttgctttactgtctcaaccccaggtacaggggcagagtctacgtgggatttactgtaaacactgccagacgggtacagcagcacaatgggggacggaaaaagggaggcgcatggagaacctctgggagaggcccttgggaaatggttttggtggtccacggctttcccagtagtgttgctgcactgagggacgaggaggggcctctgtgttgtccccaccctgggtgcctgttaagggcccatgtgatctgtttagcagaagaattcctccaagaagagcccggacaacttttacccctggaaggccaatgtccatgttgcgagaaaagtttgctctggggtgatctgatctggctatgtcaaatggatacagaaaaggaagtggaggatagtgagctggaagaggcgcattggaccgatctactggagacctag

SEQ ID NO: 24323 - DNA, 765 bp, Artificial Sequence
  Description of Artificial Sequence: Synthetic coding sequence
atgggccctgccggagttgcagccagacctggtcgcttttttggtgtgtacctgctctattgtctgaatccgaggtataggggcagagtgtatgtgggatttaccgttaacaccgctcggagagtacagcagcataacggtgggagaaaaaaaggcggagcttggagaacatcaggccgaggcccatgggagatggtcctggtcgttcacggcttcccgtcctccgtggctgcactgcgcttcgagtgggcctggcagcacccccatgcctcaagaagactggctcatgtagggccaaggttacggggtgaaaccgcctttgctttccatctgcgggtccttgctcacatgctgagagcacccccatgggcaaggctccccctcactctcagatgggtccggccagacctaaggcaggatctctgcctaccacctccgcctcacgtccctctcgcctttgggcctccaccccctcaggcgccagcccctagaaggagggctggtcccttcgacgacgccgaaccggagcctgaccagggcgatcccggtgcatgctgtagcctgtgtgcccagaccatccaggacgaagaaggaccgctttgctgtccacatcctggttgtctgttgagggctcacgtgatttgcctcgccgaggaattcctgcaggaggagcctgggcagttacttcctcttgaagggcagtgcccctgctgcgagaagtccgcactgggacgtccagacctggcagtgccagatgggcactag

SEQ ID NO: 24324 - DNA, 828 bp, Artificial Sequence
  Description of Artificial Sequence: Synthetic coding sequence
atggggccagcaggggtcgcggcaagacccggacgcttcttcggagtgtatctgttatactgtctcaatcccagatacagggggagggtctacgtgggcttcaccgtgaacacagcacggagagtgcagcagcataatggagggcgtaaaaaagggggtgcctggcgaacatcagggagaggcccatgggagatggtactggtggttcacggatttccctcttctgttgccgctctgcggttcgaatgggcttggcagcacccgcacgcaagtcgcaggcttgcgcacgtcgggcctcggctgaggggcgaaactgcttttgcctttcacttaagagtcctggcacacatgcttcgcgctccgccttgggccaggctgccactgaccctccgctgggttcggccagacctgcgtcaagacttatgtctgcccccacctccacacgtgccattagccttcggccctcctcccccacaggcgcctgccccacgcagaagagcagggccattcgatgatgcagaacctgagcccgatcaaggggaccccggtgcatgttgttccctctgcgcacagactatccaagacgaggaagggccattgtgttgcccccaccctgggtgcctgctgagagcgcatgtgatttgcctggcagaagagtttctgcaggaagagcctggacagctactgcctttggagggccagtgtccctgttgcgagaagagcctactgtggggagatttgatctggttgtgtcaaatggacacagagaaggaagtggaagacagtgagcttgaagaggcccattggacagatctgctggaaacctag

SEQ ID NO: 24325 - DNA, 486 bp, Artificial Sequence
  Description of Artificial Sequence: Synthetic coding sequence
atgggaccagccggagtggccgcacgtccaggccgtttttttggggtctatttgctgtattgtctgaacccacgataccggggtagagtatacgtgggttttacagtcaatacagccaggcgcgtacagcaacataacggaggaaggaagaagggcggagcctggcgtacctctgggagaggaccctgggagatggtcctggtggtgcacgggttcccatcctcagttgccgctttgcgggatgaggagggaccactgtgctgtccgcaccccggttgtcttttgagagctcacgtcatctgcctggcagaagaatttctgcaggaagagccgggacaattgctacccctcgagggacagtgcccatgttgcgaaaaaagtttgctctggggcgacttgatttggctatgtcagatggatacagaaaaggaagtggaagattctgaactcgaagaagcacattggacagacctgctcgaaacctag

SEQ ID NO: 24326 - DNA, 765 bp, Artificial Sequence
  Description of Artificial Sequence: Synthetic coding sequence
atggggcctgccggtgtggccgctaggccaggcaggttcttcggcgtctatttgctgtactgcctgaaccccaggtatcgcggtcgtgtgtacgttggattcacagtaaacacagcgcgacgcgttcagcagcacaacggcggtcgcaaaaaaggcggagcgtggaggactagcggcaggggaccatgggagatggtccttgtcgtgcatggcttccccagcagtgtcgccgctctgagatttgaatgggcatggcagcacccccacgcatcacgtaggcttgcgcacgtcggcccaagacttcgtggagagacggcattcgcatttcacctgcgtgtacttgctcacatgcttcgggctccaccctgggctaggctaccacttactttgcgctgggtcagacctgatcttagacaggacctgtgccttccccctccaccccatgtgcctctggccttcggcccaccaccaccccaagctccggcacctcgtcggagagccggaccgttcgatgacgcagagcccgagcccgatcagggcgaccctggggcatgttgttctctctgcgcacagactattcaggacgaggaaggcccactttgctgtcctcaccccggatgcctcttgagagcgcatgtgatctgcctggccgaagaatttttgcaggaagagcctggtcagctgcttcctttagaaggtcaatgcccttgttgtgaaaagtcagccctgggtagacctgacttggctgttccggacggacattag

SEQ ID NO: 24327 - DNA, 372 bp, Artificial Sequence
  Description of Artificial Sequence: Synthetic coding sequence
atggtggtgcaggatccattactgtgcgacctgcccatccaggttactttggaagaggtgaacagtcaaatagccctggagtatggacaggccatgaccgtgcgggtctgcaaaatggacggggaggtcatgcccgtcgtcgtcgttcaatccgcgactgtcctggatttaaaaaaagctatccagaggtatgtgcagcttaagcaagaacgcgagggcggaatccagcacatttcatggagttacgtctggcggacctatcacctgactagtgctggagagaaacttacagaggaccggaagaagcttcgcgactatggcatcagaaatcgcgatgaggtgtcctttatcaaaaagctcagacagaagtag

SEQ ID NO: 24328 - DNA, 399 bp, Artificial Sequence
  Description of Artificial Sequence: Synthetic coding sequence
atggatgtgttccaggagggactagccatggtcgtacaggatcccctgctgtgcgatctgccaatccaagtgacattagaagaggtgaacagtcagatcgcccttgagtatggacaagcgatgaccgttagggtttgcaaaatggatggagaagtcatgccagtagtggttgtccaaagtgccaccgtgctggacctcaagaaggccattcagaggtatgtgcagctgaagcaggagcgagagggtggaatacagcacattagctggtcttacgtctggagaacgtaccatctgacttccgccggagagaagctgacggaagaccgtaaaaagctgagagactatgggattcgcaatcgcgacgaagtatcattcattaaaaagcttagacagaaatag

SEQ ID NO: 24329 - DNA, 468 bp, Artificial Sequence
  Description of Artificial Sequence: Synthetic coding sequence
atgggccgaagtcgcagtcgcagcccacgaagagaacggaggcggtccaggtccacttcccgtgaacgggagagacgaaggcgagagaggtctagaagtagggagagggacaggcggcgtagcaggtctaggtccccccatcggcgaagaagccgtagccccagacgtcatcgctctacctcaccatcaccctctaggctgaaggagagaagggacgaagaaaagaaagagactaaagagactaagtctaaggagaggcaaatcaccgaggaggacctagaaggcaagactgaggaggagatcgaaatgatgaagttaatgggtttcgcatccttcgacagtacgaagggcaaaaaggtggatggttcagtgaacgcttatgctatcaacgtatctcaaaaacggaagtaccggcaatatatgaatagaaagggcggattcaatagaccactggattttatcgcctag

SEQ ID NO: 24330 - DNA, 468 bp, Artificial Sequence
  Description of Artificial Sequence: Synthetic coding sequence
atgggcaggtcacggtcaagatctccaagaagggaacggcgacgttccagaagcacgagcagagagagagaacgccgaaggcgggaacgttctcggtccagagaacgtgaccgccgacggtcgcgctctcgctccccccacagaaggagaagccgaagtcctaggaggcatcggtcaacaagtccttccccaagtagactgaaggagcggcgtgatgaggaaaagaaagaaacaaaagaaacaaagagcaaagagaggcaaattaccgaggaagacctggaaggaaaaacagaggaggaaattgagatgatgaaactgatggggtttgcttcattcgattccaccaaaggcaagaaggtggatggatccgtaaatgcctatgcaattaacgtttcccagaagcggaaatatcgccaatacatgaacagaaaaggtggcttcaaccgtcccctagatttcattgcatag

SEQ ID NO: 24331 - DNA, 741 bp, Artificial Sequence
  Description of Artificial Sequence: Synthetic coding sequence
atgaatgactggatgcctatcgccaaggagtacgacccacttaaggctggatctatcgacgggacagacgaggatccgcatgatcgtgcagtttggagggccatgttggcccgatacgtaccgaataaaggggtaattggggatcctttgttgactttgtttgtggcgagactcaacctccaaacaaaagaagataaactaaaagaggtcttttcccggtacggggacattagaaggctgaggctcgttcgagatcttgtgacgggattctccaagggatatgcctttatcgagtataaagaggaacgtgccgtcattaaggcgtatcgcgacgccgacggcttggtgatagatcaacatgaaatcttcgtggactacgagttggagagaaccttgaaaggatggattccccgtcgcttaggaggaggcctcggcggaaagaaagaaagtggtcagctgaggtttgggggacgggaccgccctttccggaagccgattaatctcccagtcgtgaagaatgacctctaccgggaaggcaaacgggaaaggcgggaacggtcccgttcgcgtgagcgacactgggatagcaggactagggatcgcgaccatgatcggggtagggaaaagaggtggcaggaacgtgaacccacgagggtatggccagacaacgattgggaacgggaacgggacttccgagacgacaggattaagggcagggaaaaaaaggagcgtggtaaatag

SEQ ID NO: 24332 - DNA, 756 bp, Artificial Sequence
  Description of Artificial Sequence: Synthetic coding sequence
atgaagccggcaaatatgaacgattggatgcctattgccaaggaatatgatcctcttaaggcaggcagcatcgatggaacagacgaagaccctcacgaccgggctgtgtggagagcgatgctggccaggtacgttcccaacaagggagtgatcggggaccctctgctgaccctgtttgtggctaggttgaatctgcaaactaaggaagataaactcaaagaggtatttagccgttacggtgacattcgacggctgcggctggtgcgtgatttagtgactggcttcagtaaaggctacgccttcatcgagtataaggaagaacgcgcagtgattaaggcgtaccgggatgctgatgggttggttatagaccagcacgagatttttgtcgactacgaactggaaagaaccctaaagggatggatcccaagaagactgggagggggtcttgggggaaaaaaagagagcggacagctgagatttggaggcagggatcgtccatttcgaaagccaattaatctaccagtggtcaagaatgacctttatcgcgaggggaagagagagcgacgagaacgcagtaggtctagggaacgacattgggacagccgaactcgggacagagatcacgatcgtggacgtgagaagcgctggcaagaacgggaaccgacccgcgtgtggccagataacgattgggagcgagaaagagacttcagggacgaccggattaaaggcagggagaaaaaagagagaggcaaatag

SEQ ID NO: 24333 - DNA, 741 bp, Artificial Sequence
  Description of Artificial Sequence: Synthetic coding sequence
atgaatgattggatgcctattgccaaggagtacgatccactaaaagccggatctattgatggaacagacgaggacccccatgacagagctgtgtggcgtgctatgctggccaggtacgtgcctaacaaaggcgtcattggagacccgcttcttaccctgttcgtggccagactcaaccttcagaccaaggaggataagttgaaggaagtattctcacggtacggagatattcggaggctgagactggtccgcgacttggttacaggctttagcaagggctatgcgttcattgagtataaggaggagagggcagtgatcaaggcgtaccgggacgcggatggccttgtaatagatcaacatgagatctttgtcgattacgagctcgaaagaacgttgaagggctggatacctagaaggctgggcggaggtctgggaggcaagaaagagagtggccagttacgattcgggggtcgcgaccgccctttccgaaagcccataaatctgccggtggtgaaaaacgacctgtatcgggagggaaagcgcgaaagaagagaaaggtccagatcacgcgagaggcattgggacagccggacaagagatagagaccacgatcgcggacgcgaaaagcgttggcaggaacgggaaccaacccgcgtttggcccgataacgactgggagcgagaaagggacttcagagacgacagaattaaggggagagaaaagaaggagaggggcaagtag

SEQ ID NO: 24334 - DNA, 1371 bp, Artificial Sequence
  Description of Artificial Sequence: Synthetic coding sequence
atggaacctcgatgcccaccaccatgtggttgctgtgagcgcctcgttctcaatgtagctgggctgcgattcgaaacccgcgcaaggacactcgggaggtttcccgatactctgctaggcgatcccgctcgacggggtagattctatgacgacgccaggcgcgaatactttttcgaccgccacagaccctctttcgatgctgttttatattactaccaaagtggaggccgactgaggaggccagcacatgtacctttggacgtttttctcgaagaagtagcattttatggactgggggctgcagcactggctcgactcagggaagatgagggatgccctgtacctcccgaacgcccactgccccgtagagcatttgcgcgacagctgtggctcctatttgagtttccagagagtagccaagcagctcgcgttctggctgtcgtgtcagtgctggtaatcttggtgtcgatagtagtcttttgtctcgaaacattgccagatttccgcgatgaccgcgacggaacaggactggccgcagcggctgcggctgggccattccccgctccactcaatgggtcatcacagatgcctggcaacccacctcggctgcctttcaacgatccatttttcgtggtggagaccctgtgtatctgttggtttagcttcgaactgctggtcaggctgctggtatgccctagtaaggcgatctttttcaaaaatgtcatgaacttgatagacttcgtagcaatacttccatatttcgtcgctctggggacagaacttgcacgacagcgcggtgtgggacagcaggctatgtctcttgcaattctgagggtgatacgtcttgttcgggtgtttaggattttcaaattaagccggcattctaagggcctccagattctagggcagacactgcgcgcatctatgagggaacttggactgttaatatttttcctttttatcggagtggtcctattctccagcgcagtgtacttcgctgaggttgatcgggtggatagtcactttacctccattcctgaaagcttctggtgggccgtggttaccatgactaccgtaggttatggagatatggcccctgttacagtgggtgggaagatcgtgggcagtttgtgcgccattgctggtgtgctgacaatctccttgcctgttccagtcatcgtgagtaattttagctacttttaccacagagaaacagaaggggaggaggccggaatgtttagtcacgttgatatgcaaccctgcggacccctggaggggaaagctaatgggggattggtcgatggcgaagtgccagaactgcctcctcctctgtgggcccctccgggtaagcatctggttaccgaagtctag

SEQ ID NO: 24335 - DNA, 501 bp, Artificial Sequence
  Description of Artificial Sequence: Synthetic coding sequence
atgacccagttcttaccccctaaccttctcgctttgtttgccccaagagatcctattccttatttgccacccctggaaaaactcccacacgagaaacaccataaccagccctactgtggcatcgccccttatatcagagaatttgaagatcccagagacgctccccctccgacccgtgcggagactagagaggagcggatggaacgcaagcgcagagaaaaaattgaacgcagacagcaggaggtcgaaaccgaactaaaaatgtgggacccacacaacgaccctaacgcccagggtgatgcatttaagaccctgttcgtggcgagggtgaattatgacaccactgaatccaagcttagacgagaattcgaagtgtatggcccaatcaagaggatccatatggtttacagtaaaaggtcaggcaagccgaggggatatgccttcattgagtatgagcatgaacgagatatgcatagcacaacgcagctcgcctgctcatag

SEQ ID NO: 24336 - DNA, 114 bp, Artificial Sequence
  Description of Artificial Sequence: Synthetic coding sequence
gcagccgctgccgctgccagtcttagaaccgatgcccgagcgcgacggtatgctacttggcaagacgacccagtgcctgccgcacagcccagcggacccctgtgccccccttag

SEQ ID NO: 24337 - DNA, 1026 bp, Artificial Sequence
  Description of Artificial Sequence: Synthetic coding sequence
atggagcaagccctgcatcgctttgggagggggctggtgtggctgagcgtcgcttggctctctgttgggcgagtgcgggtaagggacgatggcgataccggccgtggcttttgccgcgctggcccagtcctgacccgaggacccagcggggactcatccccccttcccttgcccaccagcgtcaccgctgcatataagcacgctgatgggaagaagattgatggcagaagagttttggtggacgtggagaggggccgaaccgtgaagggctggaggcctaggaggctcggaggcggtcttggtgggactaggagaggaggggcagatgtcaatatcagacacagcggtagagacgacacgtcccgatacgatgaacgcccaggacctagccctctcccacatcgcgaccgcgaccgcgaccgggaacgagagaggagagaaaggtctcgggaacgggataaggagagagaaaggcgcagaagcagatcaagggacagaagacgaagaagcagatccagagacaaagaggagcgacgtcgaagcagggagagatctaaagataaggaccgtgatagaaaacgtagatctagcagaagtcgcgagcgggcaaggcgggagagagagaggaaagaagagctgagaggagggggaggcgatatggccgagcctagcgaggccggagacgccccacccgatgatggacctcccggagaacttggcccagacgggcctgacggaccagaggaaaaaggccgagatagggaccgagaaagacgtaggtcacaccggtctgaacgggaaagaagacgcgacagagacagggaccgggatagagacagggaacacaagagaggggaacggggttccgagagagggagggacgaggccagaggaggcggaggtggacaggacaatggtctcgaaggacttggcaacgatagccgcgacatgtatatggaatctgaaggcggtgatggttacctggccccagaaaatggctatttgatggaagccgcaccagaatag

SEQ ID NO: 24338 - DNA, 1314 bp, Artificial Sequence
  Description of Artificial Sequence: Synthetic coding sequence
atgactcagtttctgcctcctaaccttctcgccctgtttgccccaagggatccaatcccgtatctccctccacttgaaaagctgccacacgagaaacaccacaatcagccttattgtgggatcgccccttatatcagggaatttgaagaccccagagatgcaccaccgccaacgcgggctgagaccagggaggaacggatggagcggaaacgcagggaaaagatcgagaggaggcagcaagaggttgagactgaactgaaaatgtgggacccacacaatgatcccaacgcccagggcgatgcctttaagacactcttcgtcgctcgagtgaactacgataccaccgagtcaaaattacggcgtgagttcgaggtctatggccctattaaaaggatacatatggtctactcaaagcgctccggaaaacccagggggtatgcatttattgagtatgaacacgagagagacatgcactctgcgtacaaacacgctgatggcaagaaaattgacgggcgtcgtgtgctggttgatgtggagcgaggacgcactgtgaagggctggcggccaaggcgcctgggaggcggactcggcggtacgcgcagagggggtgccgatgtgaacatccggcactcgggcagagatgacacttctcggtatgatgaaaggcccggacctagcccactgccacatcgagatcgtgacagagatagggagcgtgaaaggcgtgagcgctccagagagagggataaagagcgagagcggaggcggtcccgaagcagggataggcggaggaggtctcgctccagagacaaggaagagaggagaagaagtcgcgagagatccaaagataaggatcgggataggaagcggagatcatcacggtcaagagagcgcgctcgaagggagagggaaagaaaagaagagcttaggggcggagggggtgatatggccgagccaagcgaagccggtgacgctcctccagatgatggcccacccggagagttagggccagacgggccagatggaccagaggagaaagggcgagatcgggaccgagagagaaggcgaagccatcggtcagagagagaacggagacgtgacagggatcgcgacagggaccgagatagagagcataagcgcggtgagcgagggtcagagaggggcagagatgaggctcgcggtggaggcggtggccaggacaatggtctggaaggcctgggcaacgattctcgagacatgtatatggagtccgaagggggtgacggttatctcgcaccagagaatggttaccttatggaggcggctccagaatag

SEQ ID NO: 24339 - DNA, 678 bp, Artificial Sequence
  Description of Artificial Sequence: Synthetic coding sequence
atggacatccgccctaaccatacaatttacattaacaatatgaatgacaaaattaagaaggaagaactcaaaaggtccctgtatgccctgttctcgcagtttggtcatgtcgtcgatattgttgccctgaagacaatgaaaatgaggggccaagcatttgtgatattcaaagagttaggctcatccactaacgcacttcggcaacttcaggggtttcctttctacggaaaacccatgcgaattcaatacgccaaaaccgatagtgacatcatcagcaaaatgcgaggtaccttcgcagacaaggaaaagaaaaaggagaagaaaaaagccaaaacagtggagcaaacggctaccaccaccaacaagaagcctggacagggcacccccaatagcgctaacacacagggcaacagcacacctaatccgcaggtccctgattatcctccaaattacatattgtttctaaataatcttcccgaagagactaacgagatgatgctctcgatgttgtttaatcagttccccggatttaaagaggtgcgactggtgccaggacggcatgatattgcctttgtcgagtttgaaaatgacggccaagctggggctgccagagatgcactgcaaggcttcaagatcactccgagccatgccatgaagatcacttacgccaaaaagtag

SEQ ID NO: 24340 - DNA, 678 bp, Artificial Sequence
  Description of Artificial Sequence: Synthetic coding sequence
atggatattaggcccaaccatacaatctatattaacaacatgaatgacaagattaagaaggaggagctgaagaggtccctttacgccctcttttcccaattcgggcacgtagtggacatagtggccctgaagaccatgaagatgagaggccaagcctttgtgatttttaaggagctggggtccagtaccaatgctctgaggcagttgcaggggttccccttttatgggaaacccatgcgcatccaatacgctaaaacagattctgatattatttctaagatgcgtggcacctttgccgataaggagaagaagaaggagaagaagaaagccaagaccgtcgagcaaaccgccacaacaacgaacaaaaagcccggacaaggcacaccaaatagtgcaaatacacagggcaactctacgcccaacccccaggtgcccgattacccccctaactacatcctcttcctgaacaacctccctgaggagacaaacgagatgatgttgagcatgttattcaaccagttcccaggattcaaggaggtaaggctcgtgcccggtcggcacgacatcgcattcgtggagtttgagaacgatggacaggctggcgctgctcgggatgcactgcagggttttaagattacacccagtcacgccatgaaaattacgtatgcgaagaagtag

SEQ ID NO: 24341 - DNA, 2142 bp, Artificial Sequence
  Description of Artificial Sequence: Synthetic coding sequence
atgagcaccagaacccctctgccaacagtaaacgaacgcgataccgagaatcacacgtcgcacggagatgggaggcaggaagttaccagccgtacctctagaagcggtgccaggtgccggaatagcattgccagttgcgcggacgaacaaccgcacattggaaactaccggctgctcaaaacaattggaaaggggaattttgccaaggtgaaactcgctcgccatatattgaccggcagagaagtggccattaaaattattgacaaaacgcaacttaatcctacgtcactgcagaagctgtttagggaagtacgtatcatgaaaatcttgaaccatcccaatattgtaaaactgtttgaggttattgaaactgaaaagaccctgtacctgatcatggaatacgcaagcgggggagaagtgtttgattatcttgttgcccacggcaggatgaaagaaaaggaagctcgctctaagttccgacagattgtgtccgctgtccagtactgccatcagaagcggatagtgcatcgggacttgaaagctgagaatctgctgctggacgctgatatgaacatcaagatcgccgactttgggttttcaaacgagtttacagtgggcggtaaactagatacattctgcggatcgcctccctatgccgctcccgagctgttccagggaaagaagtacgacggtccagaagtagatgtgtggagcctgggcgtcattctctatactcttgtcagcggttcactccctttcgacggtcagaaccttaaggaattgcgggagcgcgtgttacgcggaaagtataggattcccttttacatgtcaactgactgcgaaaacttattgaaaaggttcctggttcttaaccccatcaagcgaggaaccctggagcagataatgaaggataggtggatcaatgcgggtcatgaggaagatgagctgaagcctttcgtcgaacccgagctcgatattagcgatcaaaagagaatagatattatggtggggatgggttacagtcaggaagagattcaagagtctctttctaagatgaaatacgatgagataacagctacatatctgctgttgggccgaaaaagctccgaagtcaggccaagcagcgaccttaacaactctacggggcaaagccctcatcacaaggtgcagagaagcgtcttctcctcacagaagcagcgacgatattcagatcatgccggaccagccatcccatcagtagtggcctaccctaaacgatcgcagacctcgaccgctgactccgacttgaaagaggacgggattagcagcagaaagtcatctggatctgctgtgggtggcaagggcatcgcaccagcctcccccatgctgggaaacgcctctaaccccaacaaggccgatattccagaaagaaaaaagagctctaccgtccctagttctaacaccgcgtccgggggaatgacccggcgtaacacctatgtgtgcagcgagagaaccactgccgaccgacacagcgtgatccagaacggtaaagagaactctactattccagatcagcggacccccgtagcatccacacactccataagctccgcggctacacctgatcgcatccgattccctcgtgggaccgcatccaggtctaccttccatggccaaccccgagaaagacggactgcaacttacaatggcccacccgcatctcctagcctttcccatgaggctacgcctctcagtcagacaaggtcccgcggaagcactaatttgttctccaaactaacttcaaaattgactcggtcaagaaacgtcagcgcagaacagaaggacgagaacaaagaggccaagccgcgtagcctgcgcttcacctggtctatgaagaccaccagtagtatggatcctggtgacatgatgcgggaaatcagaaaagtgctcgatgcaaataattgcgattatgaacagcgcgaacgctttctccttttctgtgtgcacggcgatggacatgcagaaaatctagtgcagtgggaaatggaagtatgcaaacttccacggctcagtctaaacggcgttcgatttaaaaggatttccggcacctctatcgcctttaaaaatatagcatccaagattgcgaacgagttgaaattatag

SEQ ID NO: 24342 - DNA, 1059 bp, Artificial Sequence
  Description of Artificial Sequence: Synthetic coding sequence
atggcccctaagctgattacagtactgtgcctcggattctgcctaaatcagaagatatgcccccacgccggagcccaggacaaattctcactgagcgcttggcccagtccagtggtgcctctgggcggtcgcgtgacattgtcctgccacagccacctgaggttcgtgatctggacaatcttccagactacgggaactcgttctcatgagctgcacaccggcctcagcaataacataactatctcacctgtgacaccagagcatgccggtacctaccggtgtgtgggcatctacaagcatgctagcaagtggagcgcagagtcaaattctctcaaaatcatcgttactgggttatttacaaagcctagtattagcgcccatccgagcagtctggtgcacgcaggcgctagagtgagcctccgttgtcacagcgaacttgcattcgacgaattcattctgtataaagagggccatatccagcacagccagcagcttgaccaggggatggaggcaggcattcattacgtggaggcggtgttcagcatgggcccagtgacaccagcccatgccggtgcttacaggtgttgtggctgtttctcccatagcagatatgagtggtccgcgccttccgatccactggatatcgtgattacaggcaagtataaaaaaccctcgctgtctacacaggtggatcccatgatgagactaggagagaagctgacacttttctgcagcagcgagattagctttgaccagtatcatttgttccggcatggcgtggcgcatggccaatggctctcgggtggacagagacacagggaagcgttccaggcaaattttagtgtcggcagggcaactccggtcccaggaggcacctataggtgctatggctctttcaatgacagtccttataagcccccagtgacgagatgcaattttactcctcaggagaccctgagggtgctgttatgtcacagccagaatccaccactgaatctgacccatttagctcttaaggatagcccagccacctgcatatgttccctcgatagccagtag

SEQ ID NO: 24343 - DNA, 75 bp, Artificial Sequence
  Description of Artificial Sequence: Synthetic coding sequence
ctggcttcctcttgggatctgagccccgaaccagtgcctgagagcctgggtccccctgtgggtcctggtctatag

SEQ ID NO: 24344 - DNA, 375 bp, Artificial Sequence
  Description of Artificial Sequence: Synthetic coding sequence
atgctggtgctcggtagccaaaaactgactcagttacgtgactctattaggtgtgtgtctgaccttcagataggcggagaattttctaacactcctgatcaagctccagaacacatttcaaaggacctgtacaaaagtgcctttttctatttcgagggtacgttttataacgataaaagataccctgaatgtcgtgatctctcccggacaatcatcgaatggagtgagtcccatgaccgcggttacgggaagtttcagactgctaggatggaggacttcacttttaacgacctgtgtatcaaactcgggttcccctacctctactgtcaccaaggtgactgcgagcacgtgattgtcatcaccgacatccgttag

SEQ ID NO: 24345 - DNA, 732 bp, Artificial Sequence
  Description of Artificial Sequence: Synthetic coding sequence
atggccgagggcagcagaggagggcctacctgtagtggagtcggaggcagacaggaccctgtatcaggcagtggtggctgtaactttcccgagtacgaactcccagaattgaacacaagggccttccatgttggagcttttggcgaactctggcggggaagactcaggggggcaggcgatctgagcctgagggaaccccctgccagcgccctccccggaagccaggccgcagactcagaccgggaggatgccgcagttgctcgcgaccttgactgttcactggaagccgctgccgaactgagggctgtatgcggcttagacaagcttaagtgtttggaggatggagaggatccggaggtgatcccagagaacaccgatctcgtgaccctcggtgtgcggaaacggttccttgagcaccgggaggagactattacgatcgaccgagcctgtcgccaggaaacgttcgtgtacgaaatggagtcccacgccatcggtaaaaagccagagaattccgccgacatgatcgaagagggcgagttgatcctatcggtgaatatcctgtatccagtgattttccataaggacctctataagtccgcctttttctatttcgagggtacattttacaatgacaagcgataccctgaatgtcgagacttatctaggacaattatcgagtggtccgaaagtcatgatcgaggctacgggaagttccagaccgcgcgtatgtag

SEQ ID NO: 24346 - DNA, 1236 bp, Artificial Sequence
  Description of Artificial Sequence: Synthetic coding sequence
atggctgaaggtagtcggggaggcccaacctgctccggggttggcggacgtcaggatccagtgtcaggaagcgggggatgcaactttcctgagtacgaactgccagagctgaacacccgggcatttcacgtcggtgccttcggagagctttggagaggaagactacggggtgctggtgatctgtccttacgggaaccgcctgcatccgctttgcctggatctcaggcggctgacagtgacagagaagatgccgctgtggcgagagatctcgactgttccctggaggcggcagccgagctgcgagccgtgtgcggcctagataagttgaagtgtctggaagacggagaggatcccgaggtcatccctgagaataccgacctcgtgaccctgggtgttcgcaaacgctttctggagcacagggaagagaccattacaattgatcgggcatgcagacaggagacatttgtatacgagatggagagccacgccatcgggaagaaaccagaaaattcagccgacatgattgaggagggcgagctgattcttagcgtcaacatcctctaccctgtgatcttccataagcataaggaacacaagccatatcagaccatgcttgtcttagggtcccagaagttgacccagttaagagatagtattcgctgtgtgtcagacctgcaaatcggtggcgagttctcaaatactcccgaccaagcccctgagcatattagcaaggatctgtataaaagcgctttcttctacttcgagggaactttttacaacgacaaaaggtatccagagtgccgcgatttatcgaggacaatcatcgaatggagcgagtctcatgaccgaggatatggaaaatttcagacggctcgcatggaggatttcactttcaacgatctgtgcatcaagttgggattcccttacctatattgccatcaaggcgattgtgaacacgtgatcgtgatcaccgatatcagactagttcaccatgacgactgtctggataggacgctttatccgctcctgatcaagaagcactggctatggaccaggaagtgcttcgtctgcaaaatgtatactgcacgatgggtaacaaataacgattcctttgctcccgaggatccgtgtttcttctgtgatgtgtgtttcaggatgctccactatgatagcgaggggaacaagctcggagaattcctagcatacccttatgtggacccgggaacatttaactag

SEQ ID NO: 24347 - DNA, 732 bp, Artificial Sequence
  Description of Artificial Sequence: Synthetic coding sequence
atggcagaggggtctagaggcggtccgacctgtagcggagtgggaggccgacaggatccggtctcaggttccggaggatgcaacttcccagagtacgaactgcctgagctcaatactcgcgcatttcacgtcggtgcctttggggagctttggagaggcaggcttcggggagcaggagacctgtcactgcgggaaccgcctgcctcagcactgccagggtctcaggcggctgatagcgatcgagaagatgcggctgtggccagggatctggactgcagcctagaggcagcggctgagctacgagctgtgtgcgggttagacaagctgaagtgcctggaggacggagaggatcccgaagtcatccccgagaacacagatcttgtgacgctgggggtgcgaaaaagatttctggagcaccgcgaggagaccatcactattgaccgtgcctgtcgacaggagaccttcgtgtacgaaatggagtctcacgccatcgggaaaaagccagagaatagcgccgatatgattgaagaaggagagctgattctctctgtaaacattctgtacccagtaatatttcacaaagacctctataaatccgccttcttctactttgaagggaccttttacaatgataaaaggtatccagagtgtagagacctgtcccgtactattatagagtggtcagagtctcatgacagaggatatggcaaatttcagaccgccaggatgtag

SEQ ID NO: 24348 - DNA, 657 bp, Artificial Sequence
  Description of Artificial Sequence: Synthetic coding sequence
atggccgagggaagtagggggggtcctacctgttctggcgtcgggggtaggcaggatcccgtgagcggttccggaggttgtaattttccggagtatgagttgcctgagctgaataccagagcattccatgtcggcgcttttggagagctttggcggggacgcctgcgaggtgctcgagatttggactgtagcctcgaggctgctgccgagctgagggcagtgtgtggtctcgacaaactgaaatgcctggaagatggcgaggacccggaggtaatccctgagaacacagatctggtcactctgggagtcagaaagcgctttctggagcacagagaggagacaattacaatagaccgggcatgtaggcaggaaacattcgtctacgagatggagtctcatgccatagggaaaaagccagaaaattccgcggatatgattgaagaaggcgagctgatactgtcagtgaatatactgtaccccgttatctttcacaaacacaaggagcataagccgtaccagacgatgctggtcctgggttctcaaaaactcacacaactccgcgattctattaggtgtgtgagcgaccttcagattggcggagagttctcaaacacccctgaccaggctcccgaacatatctccaagaattatcactag

SEQ ID NO: 24349 - DNA, 1236 bp, Artificial Sequence
  Description of Artificial Sequence: Synthetic coding sequence
atggccgaaggatctcgaggcggacccacatgctctggtgttggtggtaggcaggatccagtcagcggttccggtggatgcaacttcccagaatacgagcttccagaactcaacacccgtgcttttcatgtgggggcattcggtgagctgtggcggggtcgactgcgaggagccggagacctgtccctacgggagccccctgcatcagccttgcccggatcccaagccgctgattctgacagagaagacgccgctgtggccagggacttggattgttctctcgaggcagcagccgagctcagagcagtctgtggtctcgataagctcaaatgtctggaggacggagaggatcccgaggtcataccagagaacactgacctggtgacattgggcgttcgcaaacggttcctcgaacacagggaggaaactatcaccatcgatcgcgcatgcagacaggagacattcgtttatgagatggaaagccacgctatcggcaagaaacctgagaactcagcggatatgatcgaggaaggcgagttgattctctctgtgaacatcctttacccagtgatttttcataaacataaagaacacaaaccgtaccagacaatgttggttcttgggagccagaagctgacgcagctgagagatagcatcaggtgtgtgtctgatttgcagataggcggtgagttctctaacaccccagatcaggcccctgaacacataagtaaagatctatataagtctgctttcttctactttgagggcactttctataacgacaagagatatcccgagtgtagagacctctcacgaacaatcattgagtggagcgaaagccacgatagaggctacggcaaatttcaaacagccaggatggaggactttacatttaacgacctatgcatcaagttagggtttccatacctgtattgccatcagggggactgcgaacatgtgatagtcattacagacatcagactcgtgcaccacgacgactgtctggacagaacactgtacccactcctgattaaaaagcactggctgtggacccgaaaatgcttcgtatgcaagatgtataccgcgcgttgggtgaccaacaacgacagctttgccccagaggatccctgttttttctgcgacgtgtgcttccgcatgcttcattacgacagcgagggtaacaaactgggcgagtttctggcatacccctacgtggacccagggacattcaattag

SEQ ID NO: 24350 - DNA, 1236 bp, Artificial Sequence
  Description of Artificial Sequence: Synthetic coding sequence
atggccgaaggatcccggggagggccaacttgttcaggggtgggtggacgacaagatccagtctcaggatcagggggttgcaattttccagagtacgagctgcctgagctgaatacacgggcatttcacgtgggtgcattcggtgagctatggagaggaagattgaggggagccggagacctctctcttagggaacctcctgcaagcgccctgcctggaagccaggctgcagactccgacagagaagatgcagctgtagctcgcgacctggattgcagtctggaggccgcagccgaactgagagccgtttgcggtctagacaaattgaagtgccttgaagatggcgaggaccctgaggtcattcccgaaaatactgatctggtgactctcggcgtacggaaaaggttcctggagcacagagaggagactattactatcgaccgggcatgtagacaggaaactttcgtatatgaaatggaatctcatgccatcgggaagaagcccgagaactccgcagatatgattgaggagggagagctgatcttgtccgtaaatattctgtaccctgttatatttcacaagcataaagagcataaaccataccaaactatgctagtactaggctcccaaaaattaacacagcttcgggatagcatcaggtgtgtgtcagatttgcagatagggggtgaattcagcaatacacctgatcaggccccagaacacatatctaaggacctctataaatcagctttcttttacttcgaagggaccttctacaacgacaagcgatacccagagtgccgtgacctaagccgaacaattattgaatggagcgagagccatgaccgcggatacgggaaattccagacagctagaatggaagatttcacgttcaacgacctctgcatcaaactgggcttcccatacctatactgccatcagggagactgtgagcacgtgatcgtaataactgacattcggcttgttcatcatgatgattgcttggaccggaccctctaccctctgctcatcaagaagcactggttatggacgcgcaaatgctttgtgtgtaaaatgtacactgcacgctgggtaacgaataacgattcttttgccccagaagacccctgtttcttttgtgatgtgtgtttccgcatgctgcactatgattcagagggaaacaagctcggggagtttctcgcgtacccatacgtcgaccccggtacttttaattag

SEQ ID NO: 24351 - DNA, 4410 bp, Artificial Sequence
  Description of Artificial Sequence: Synthetic coding sequence
atggacgtcgatgcagaaagggagaaaattacgcaggagattaaggagttggagcgcatcttagatccaggctcgagcgggtctcacgtggagattagtgagtcctctctcgaaagcgacagcgaggcagattcattgccgagtgaagacctggaccccgcagacccgcctattagtgaggaggaacggtggggcgaggcctctaacgacgaggatgacccgaaagacaagacactccctgaagaccccgagacttgtctgcaacttaacatggtttatcaagaggtcattcaggaaaagctcgcagaagccaatctgttactagcacagaacagagagcagcaagaggagttaatgcgagatctcgccggatcaaaaggtactaaggttaaggacgggaagtctctgccgccatcaacgtatatgggtcactttatgaagccctactttaaggataaagtaaccggcgtcggccctcctgccaatgaggataccagagagaaagccgcacagggaattaaagcttttgaagagctcctggtaactaagtggaagaattgggagaaagctctccttaggaagagtgtggtgagcgatagactgcagcggttgttgcagcctaaactgctcaagcttgaatacctgcatcaaaaacagagcaaagtgtcctcagagcttgaaaggcaggcccttgaaaagcagggcagagaagccgagaaggagatccaggacatcaatcagttaccggaagaagccctgctcggcaacaggctggactcccacgattgggagaaaatctctaatatcaactttgagggcagcagatcagcagaggagatccgcaagttttggcagaacagcgagcacccatcaattaataaacaggaatggtcacgtgaagaggaagagaggctgcaagcaatcgccgctgcacacggccatcttgagtggcagaaaattgcggaggagctgggcacctcaaggtccgccttccagtgccttcagaagttccaacagcataataaagccttaaaacgaaaggaatggacagaggaggaggatcgcatgctgactcagctcgttcaagagatgagagtcgggtcccacattccatacagacggatcgtgtattacatggagggacgggactccatgcaactgatctatcgttggaccaagtctctcgatcctgggctgaagaaaggctactgggccccagaagaagatgccaaattgctacaggcagtagccaaatacggggagcaagactggtttaagatcagagaagaggtgcccggtaggtccgacgctcagtgccgagaccgataccttcgaagactccacttttccctaaagaagggcaggtggaacttgaaggaggaggaacagttaatcgagctcattgaaaaatatggtgtgggccactgggctaagatagcctccgagctgcctcaccggagtggatctcagtgcctgagtaagtggaagataatgatgggcaaaaagcaaggtctgaggcgcagaaggcgcagggccaggcattctgtgcgctggtcctctacctcttcaagcggctcctcatccggcagtagcggagggtcatcttctagctcaagtagttcttcagaggaagacgagccggaacaggctcaggccggtgaaggagaccgcgctctgttatcaccccaatacatggtaccagatatggacctctgggtgcctgctcgccaatcaacttcccagccctggaggggcggtgcaggggcatggttagggggacctgcagcttctttatcaccgccaaaggggtctagtgccagtcagggtggctccaaggaagcatccacaaccgcagccgcaccgggagaagagactagcccagttcaggtgccagcccgtgcccatggccctgtgcccagaagcgcccaagccagccacagcgccgatacaaggccagcgggagccgagaagcaagccctcgagggcggaaggcgcctgctgacagtgcccgtagagaccgtactgagagtactgagagccaataccgccgcaagaagctgtactcaaaaggagcagcttcggcagccacccctgcctacgagcagtccaggggtatcttccggagactcagtggcgagatcacacgtccagtggctcaggcaccgtgcaactcagagcggccagaggcgttggcgccacgcactgcaccgccgattgctgaatcgaagattgctgctggcagtgaccccatgggtgggagacgtggttgtcccatgcacacaggccagccaaagaccggctgtggtgcagacacaggctgacggtctccgcgagcagctgcagcaggccaggctcgcatcaactccagtattcacccttttcacgcagctgttccacattgacactgcaggctgcctggaagttgtaagggaaagaaaagccctgccaccgcgactgcctcaggctggagcacgggatccacccgtgcaccttctgcaggctagtagctctgcccagtccacgcccggacacctcttccctaacgtgccagcacaggaggccagcaaaagtgccagtcataaaggaagtcgtcggctggcttctagtagagtcgagcgtaccctgccacaggcaagcctgctggcttctaccgggccacggcctaagcctaagacagtgagcgaactgctccaggagaaacggcttcaggaagcccgtgctagagaagccaccagaggccctgtcgttttgcccagtcaactcctcgtgtccagtagtgtgatactgcagccaccgttgcctcacaccccccacggaagaccggcacctggccctactgtactaaacgtgcccctaagcggacctggcgcaccagccgcagccaagccaggaacctcaggcagctggcaagaagctggaacaagcgctaaagataaacggctgagcaccatgcaagcccttcctctcgcacccgttttcagcgaggcagaggggaccgcgccagctgcctcacaagcaccggctctgggacccggtcagatatctgtgtcatgcccggagtccggcctgggtcagtcccaggcacccgctgcttctcggaagcagggcctccctgaggctcccccttttctaccggcagctcccagtcctacacctctccctgtccagcctctctcgctgacacacatcggagggccacatgtcgctacttcggtgccactaccggtgacctgggtcctaaccgcccaggggctgctacctgtccccgtgcctgcagttgtctcccttcctcgaccagccggtactcccggtccagccggtctactcgccactctgctgccacccctaaccgaaacccgggctgcccagggcccacgggcacccgctctttcaagtagctggcaaccacccgctaatatgaacagagagccggagccctcgtgtcgaaccgatacgcccgctcccccaacgcatgctttaagccagagtccagctgaggccgatgggtctgtcgctttcgttccaggggaagcccaggtggctcgggagattcccgagcctcggacaagttctcacgcagacccaccagaggccgaaccaccttggtctgggagattgcctgctttcggaggagttattccagcaacagagccccgtgggacacccggttctcccagtggaactcaggaacctagggggcctcttggcctcgagaagttacccttacggcagccgggaccagagaaaggtgccctggacctggaaaagccacccctgccccagcctggtcccgaaaaaggcgcacttgacctgggattgctgtcacaggaaggcgaggctgcgacgcagcagtggttgggagggcagcggggtgtgcgcgtgccactgttaggatcacgccttccgtaccaaccccctgccttatgctccctcagggcactgagcggactgcttttgcacaagaaagctctagagcacaaagctacttcattggttgtcggaggggaggcggaacggccagcaggcgcattgcaagcctcgctgggcttagttagggggcagttgcaagacaacccagcatacttactgctcagggcaagatttttagctgctttcacactgccggctctactggctactctggccccacagggggtgaggaccactttatctgttcctagcagagtcggcagcgagtcggaggatgaagatctcttgagtgagctcgagcttgccgatcgggacgggcaacctggctgcaccacagccacttgtccaatacagggagcccctgacagcggcaagtgctcagcctcttcctgcctggacacatccaatgatcccgatgacctcgacgtgcttagaaccaggcatgccagacatacccggaaacgtcggagacttgtttag

SEQ ID NO: 24352 - DNA, 207 bp, Artificial Sequence
  Description of Artificial Sequence: Synthetic coding sequence
atgctatcaagactgcaagaactcaggaaggaagaagagaccctgttgaggcttaaagcagctctacatgatcagctgaaccggttgaaaatgctagtgcatgtcgataacgaagccagcataaaccagactacacttgagctaagcacgaaatcccatgttactgaggaggaagaggaagaagaggaagaagagagcgatagttag

SEQ ID NO: 24353 - DNA, 297 bp, Artificial Sequence
  Description of Artificial Sequence: Synthetic coding sequence
atgctgagccggctgcaagaacttaggaaggaggaagagaccctcctccgtctcaaagcagccctccacgatcagcttaatcgcctcaaggtggaggagctggcactgcagagtatgatctccagccgcaggggggacgagatgctctcctcccatactgttccagagcaatcccacgacatgcttgtgcacgtggacaacgaagcatccatcaaccaaaccacactggaattgtctaccaaaagccatgtgaccgaggaggaagaggaggaagaagaggaggaaagtgattcatag

SEQ ID NO: 24354 - DNA, 297 bp, Artificial Sequence
  Description of Artificial Sequence: Synthetic coding sequence
atgcttagccggctgcaagaacttagaaaggaggaagaaacacttttgagactgaaggcagctttacatgaccagctcaaccgactcaaggttgaggagttggcgctccagtccatgatatcctccagacgaggcgatgagatgctgagctcccacacagtgcccgagcagtcccacgatatgcttgtccacgtggacaatgaggcatctattaaccagactaccctggagctgtccacaaaatcccacgtgactgaagaggaggaagaagaggaagaggaggagtccgattcttag

SEQ ID NO: 24355 - DNA, 5052 bp, Artificial Sequence
  Description of Artificial Sequence: Synthetic coding sequence
atgagctccaggcgcaagcgggcacctcctgttcgagtggacgaggaaaagagacagcagcttcactggaatatgcatgaggaccggagaaacgagccaatcatcatttccgacgatgatgaacagccttgcccgggaagcgacactagtagcgcacactacatcattctatctgattctctcaaggaggaagtcgctcacagagacaaaaagaggtgcagcaaagtggtgagcttttcaaagcccattgaaaaggaggagaccgtgggtatcttcagtcccctgtcagtgaagctgaacatagtgatcagcccctatcactttgataattcttggaaggcattcctgggggagctcacgctccaactgctccctgcccaatctctgatcgaaaatttttcagagcgctccatcaccctgatgagctctgagtccagcaatcagtttctgatctacgttcactcaaagggcgaagatgtcgaaaaacaaaaaaaagagcccatgtctatctgtgacaaaggaattcttgtcgaatctagctttagcggcgagatgctggaagatctaggatggctgcagaagaagcgtcgcatcaaactgtaccagaaacccgaagggaatcacatcattaaagtcggtatttacctcttggaggccggactagccaaacttgatttcttatctgatgcaaattctcgtatgaaaaagttcaaccagctgatgaagaaggtgatggaaaaactgcacaatagtattataccggacgtgttggaagaagacgaagatgatcctgaatctgaaccggaagggcaagatattgacgaattgtatcacttcgttaaacagacccatcaacaggagacgcagtcgattcaggtagacgtgcagcaccccgctctgattcccgtactacgcccttaccagagggaagctgtcaactggatgctgcaacaggagtgctttcgctctagccccgcaaccgagagcgcgctgcactttctctggcgtgagatagttacaagcgaggggcttaagctctattacaacccatacaccgggtgcattatcagagaatatcccaacagcggaccccaacttctgggtggcatcttagctgatgagatgggccttggcaaaacagtggaggttttggcccttatcctcactcacaccaggcaggatgtgaagcaagatgcactgacattgcccgagggaaaagtggtgaattactttattccctctcactactttggcggtaaactgaagaagacggagattcaaaatattgaatttgagcctaaagagaaggtacaatgccctccaacacgtgtgatgattttgacagctgtgaaggaaatgaacgggaagaaaggtgtctctattctcagcatatacaagtacgtgtcatctatctatcgatacgacgtgcagaggaacagatccctgctgaagagaatgcttaaatgcttgatttttgagggcttggtgaagcagatcaagggacacggcttctcaggcacatttaccctgggcaaaaattacaaagaagaagacatttgtgacaaaaccaaaaaacaggccgtcgggtccccaagaaagatccagaaggaaacacgtaagtccggaaacaaagacactgatagtgagtacctgcctagcgatacatccgacgacgacgacgacccatactactattactataagtctagaagaaatcgctctaagctaagaaagaagctcgtgccttccaccaagaagggaaaatcacagccgttcatcaatcccgattcccagggccactgccccgctacaagcgatagtgggattaccgatgtagctatgagtaaatccacttgcatcagcgagttcaaccaggagcacgagactgaagattgcgcggaatctttgaatcacgcggactctgacgtgcccccatccaataccatgagcccatttaacacaagtgattataggtttgagtgtatctgcggcgagctcgatcagattgatcgcaaacccagggtccagtgtctgaagtgccacctatggcagcatgctaaatgcgtgaactacgacgagaaaaaccttaagattaagcccttttattgtccacattgcctcgtagccatggagccagtctcaacgcgagcaacccttatcatttcaccctcaagcatttgccaccagtgggtggatgagattaatcggcacgtccggagtagctcactgcgagtgctggtataccagggagttaagaaagacggcttcctccagccacactttctggccgagcaggatatcgtcatcatcacttacgatgtacttcgatccgaattaaactacgtggatattccgcactccaactcagaggacggtagacggcttaggaaccagaagagatatatggctattccctcccctctggttgcggtggaatggtggagaatttgcttagatgaagcacagatggtcgaatgccctaccgtgaaagccgcagaaatggctcaaagacttagtggtatcaacagatggtgcatcagcgggactcccgtgcagcggggtctcgaggacttattcggcctggtggtgtttcttggaattgagccctattgcgtgaagcattggtgggtgcgcctcctgtatagaccttactgtaagaaaaacccacaacacctgtactctttcatcgcgaaaatcctctggcgtagcgccaagaaggacgtgatcgaccagatccaaataccgcctcagaccgaggagatacactggttacacttctctccagttgaacggcatttctaccaccgccagcatgaggtgtgttgccaggatgtggtcgtgaagctcagaaagatatctgattgggccctcaagctctcttccttggaccgcaggactgtgactagcatcttgtaccccctcttgcgactgcgccaggcctgttgccacccccaggctgtccgtggcgagtttctcccactgcagaagtctaccatgaccatggaggagctgctgacttccctgcagaaaaaatgcggtaccgagtgtgaagaggcccatcgtcaactagtgtgcgcgcttaatggactggccggaatccatatcattaagggcgagtatgcccttgccgctgaactctatagagaggtgttgcggtcctcagaagaacataagggcaagcttaagacggatagtttgcaaagactccatgccacacacaatttgatggaacttcttattgcacggcatcccggaattccacctaccttgagggatgggcgtctcgaagaggaggccaagcagctcagggagcactatatgtcgaagtgtaatacggaagtcgccgaggcccagcaggccctataccccgtccagcagaccatccacgagttgcaacgcaaaattcacagtaattccccatggtggctcaatgtgattcatagggctatcgagtttacaattgacgaagaactggtgcaaagagtccggaacgaaatcaccagtaactataagcagcagacaggtaagctgtccatgtccgagaagtttagggattgtcgaggcttacagtttctcttgactacccagatggaagaactcaataagtgtcagaagctggttagggaggcagtcaaaaatttagaaggacctccatccaggaatgtgatcgagtccgccactgtgtgccacttgcgacctgctaggctcccactgaactgttgcgtcttttgtaaggccgacgagctgtttactgagtatgaaagtaagctgtttagcaatacagtgaaagggcagacagctatctttgaagaaatgattgaggatgaagagggcctggtcgatgacagagctcctacgactaccagaggactgtgggccatctccgaaacagagcgctcaatgaaggccatcttatccttcgccaaatcacatagatttgacgtggaattcgttgacgaagggagcacctccatggacctttttgaggcctggaagaaggagtataagttacttcacgagtattggatggcactgcgtaaccgcgtgagcgccgtggatgaacttgcaatggccacagagagactccgggtacgagatcctagggagccaaagcctaatccaccagtgttgcacatcatcgaacctcacgaggtcgagcagaaccgtatcaaacttctcaacgataaagccgtagcgacctctcaactgcagaagaagctgggacagctgctctacctgaccaacctggagaaatctcaggataagaccagcggtggggtgaatcccgagccctgccctatttgcgcccgacagttaggaaagcagtgggcagtgctgacatgcggccattgcttctgtaatgagtgtatctcaattattattgaacaatacagtgtgggatcccacaggagttccattaaatgcgccatttgtcggcagacaacatcccataaggagattagctatgttttcaccagcgagaaggccaatcaggaggaagacatcccagtgaaggggagtcacagcacgaaggttgaagccgtggtgcgcactctgatgaaaatccagctgcgggatcccggagccaaagcactagtcttttctacctggcaggacgtcttggacattatctctaaagctctgactgacaacaacatggagttcgcacagatatcaagggtgaagaccttccaggaaaatctcagtgcattcaagagggatccccagattaacatcctccttttgccactccacactggctccaacggtctaactatcatcgaagcaacacatgtactgcttgtggagcctatcctgaatcccgctcatgagctccaagccatcggccgtgtccatagaattggtcaaacgaaaccaaccatcgtacacagattcttaatcaaagcaacaattgaagaacgcatgcaagcaatgttaaaaaccgccgagcgttcacacaccaacagtagcgcaaagcactctgaggcctccgtgcttactgtggccgaccttgccgacctgtttactaaggagactgaagagctcgagtag

SEQ ID NO: 24356 - DNA, 5063 bp, Artificial Sequence
  Description of Artificial Sequence: Synthetic coding sequence
atgagtagcaggaggaagcgggctccacctgtccgcgtcgacgaagaaaagcggcagcagctgcactggaatatgcatgaggatcggaggaacgagccaattattattagcgacgatgacgaacagccctgtccaggcagtgacacctcttcagcccactatattatcctgtctgattcgctgaaagaggaggttgcccatagagataagaaaagatgttctaaggtggtttctttcagcaagcccatcgaaaaagaggagacagttggaatctttagcccattaagcgttaaacttaacatcgtgatctccccctaccattttgacaactcctggaaggcttttctcggtgagcttacacttcagctgctgcctgcgcagtcactgatagaaaacttttccgagcggagcataacacttatgtctagcgagtcctccaatcagttcctgatttatgtccattctaaaggggaggatgtagagaagcagaagaaagaaccaatgtccatatgtgataaagggattctggtggaatccagcttcagcggcgagatgcttgaggatctcggttggttacagaaaaagagacggattaaactataccaaaaacccgagggaaatcacattattaaggttggaatttacctgcttgaagcaggattggccaaactggactttctgtccgatgccaacagccgcatgaaaaagttcaatcagctgatgaaaaaggtcatggaaaaattacacaattctataattccggacgtgttagaggaggatgaggatgacccagagagtgagcctgagggtcaggatattgatgagctgtatcacttcgtgaaacagacccatcagcaggaaacccagagcattcaggtcgatgttcagcaccccgcattaatacctgtactgagaccatatcagagggaggctgttaactggatgcttcaacaggaatgctttagatcctccccagcgaccgagtctgcattgcattttctttggcgagagattgtaacttccgagggcctgaagctttactataatccttatacgggttgtatcatccgggagtacccgaattccggccctcagctgctgggcggaatcctggcggacgagatgggccttggaaagacagtggaggtgctcgccctcattctaacacatactcggcaggatgtgaagcaggacgctctgaccctgcctgaaggtaaagtggtgaactattttataccctcacactactttggcggaaaactcaaaaagactgaaatacagaacattgagtttgaaccaaaagaaaaggtccagtgcccacccacccgagtcatgatacttacagcagtaaaagaaatgaacggaaagaagggcgttagcattctgagtatttataagtacgttagctctatctatcggtacgacgtccagcgaaatagatctcttctcaaaaggatgctcaagtgtcttatcttcgaagggctcgtgaagcagattaaggggcatggattctccggaacatttacactcggcaaaaactacaaggaggaggatatttgtgataaaacgaagaaacaggccgtgggtagcccccgaaagattcagaaggagaccaggaaaagcgggaacaaagacactgattctgagtatttaccttctgacaccagtgacgacgatgatgatccgtactactactactacaaaagcagacgtaacagatctaagttgcggaaaaaacttgtgcctagcactaagaaaggcaaatctcagccctttatcaaccctgatagtcaggggcattgtcccgcaacctctgattccggcattaccgacgtagcgatgagtaagagcacatgtatatccgagttcaatcaggaacacgaaaccgaggattgcgccgaatccttgaatcacgccgactcagacgtgccccctagcaatacaatgagcccctttaacaccagcgactataggttcgaatgcatatgcggcgagctggaccagatcgataggaagccaagggttcaatgcctgaaatgtcacctttggcagcacgcaaagtgcgtgaattacgacgaaaaaaatttgaagataaagcctttctattgcccacactgcctggtggcaatggagcccgtgtcaacgagagcgactctcattatctctccttcttctatctgccaccaatgggtcgatgaaattaacagacacgtaaggagtagcagccttcgcgttctggtctatcagggcgtcaagaaggacggattcctgcagccacacttcctggcagagcaggatattgttattatcacctacgacgtgctccgctcagagctaaattacgtggacattccacatagtaactccgaagacggcagacggttacggaaccaaaaacgatatatggccataccttctccactcgttgctgtggagtggtggcgaatttgcctggacgaggcccaaatggtggaatgccccaccgtgaaagctgccgagatggcccaaagattgtctggcatcaaccgatggtgtatcagcggtactcctgtgcagcggggactggaggatctgttcggcctggttgtgttcctgggcattgaaccttactgcgtgaagcactggtgggtgcgactcctgtatcgaccatattgcaaaaagaaccctcaacacctttattccttcattgctaaaatcctttggagatcggccaaaaaagatgtaatagaccagatacagataccaccacagacagaggagatacactggctgcacttttcacctgtggaaaggcacttctatcacaggcaacatgaggtctgctgtcaggacgtcgttgtgaagctgcgaaagatctcagattgggctctcaagctgtctagcttagaccgtagaaccgttacaagcatcctctatcccctgctcaggctcaggcaagcctgctgccatccacaggccgtcaggggtgaatttctccctctccagaagtccttcgagcagagtaccttttctttcagcacaatgactatggaggagcttctgaccagcctgcagaagaaatgtggcacggagtgcgaagaagctcacaggcaactagtttgtgcactgaacggcctcgccggtattcacataattaagggcgaatacgctctggcagctgagctgtacagggaggtgctgaggagctcagaggaacataaaggaaagcttaaaaccgacagtctgcagcgtctccatgccacgcataacttgatggaattgctgatcgcaagacacccaggtattccaccgactctccgggatgggaggctggaagaggaagccaaacagctgcgcgaacactacatgagtaagtgtaacacagaggtagccgaggcacagcaagctttatacccagtgcagcagaccatccacgagctccagcgtaaaatacattccaactctccttggtggcttaatgtgatacatcgtgccattgaattcaccattgacgaggaactcgtacaaagagtgaggaatgagattacctcaaattacaagcagcagactggaaaattaagcatgagcgagaaggggttgcagtttctgctaactacccagatggaagagctcaacaagtgccagaagctagtgcgggaggctgtcaaaaacctagaggggccaccctccagaaacgtgatcgagtcagcaactgtgtgccatctgagaccggcaaggctaccattgaactgctgtgtcttttgcaaagccgatgagctctttacagagtacgaatccaagctattttccaatacagtcaaagggcaaactgcaattttcgaagagatgattgaagacgaggaggggctggtcgatgatcgggcaccaaccactacccgcggattatgggctatctccgagactgaacgctcaatgaaggccattttgagcttcgccaagagccatagatttgatgtcgaatttgtcgatgaagggtctaccagcatggacttgtttgaggcctggaagaaggaatataaacttttacacgaatactggatggctctgagaaatcgggtttctgccgtcgatgaactggctatggccaccgagcgcctcagggttcgggaccctcgcgagcccaaacccaaccccccagtgctccacatcattgaaccccatgaggtcgaacagaaccggataaagctgctcaatgataaagcagttgcaacctctcagctgcagaagaagctcggacagttattgtacctgaccaacctggagaagtcccaagacaagacgagcggtggggtgaacccagaaccttgcccaatttgcgcccgtcagctgggaaagcagtgggccgttctgacatgtggccattgcttctgtaacgaatgcatctcaattatcatagaacagtactctgtcggaagccacagatctagcataaaatgcgccatttgcagacagacaacatctcacaaggagatcagctacgtgtttacgagcgagaaggccaatcaagaggaggatattccggtgaaggggagtcattcaaccaaggtcgaggccgtggtccgcacactgatgaagatccagcttcgtgaccctggagcaaaggccctagtgttctccacatggcaggatgtgctcgatataatatctaaagccctcaccgacaataacatggaatttgcccaaatcagccgggtgaagacatttcaagaaaacctgtccgcctttaaacgcgaccctcagattaacatccttctgcttcccttgcacaccggaagcaatggcctcaccatcattgaagccactcatgttctgctggtagagcccatcctcaatcccgcacacgagctgcaggccataggaagagtacaccgcatcgggcagacgaagcctacgatcgtacataggttcctcatcaaagctactatcgaggagaggatgcaggcgatgctgaagactgccgaacggtcacacacgaattcttcagccaagcattccgaggctagtgtccttaccgtggctgacctcgccgatttgtttaccaaggagacagaggaattggagta

SEQ ID NO: 24357 - DNA, 5052 bp, Artificial Sequence
  Description of Artificial Sequence: Synthetic coding sequence
atgagtagccggagaaaaagggctccaccagtccgcgtggacgaggagaagaggcagcagctgcattggaacatgcacgaggacagacggaacgaacctatcattatctcagacgatgacgagcagccttgtcccggtagtgatacaagttcagctcactatataatactgagcgacagtctgaaagaggaagtggcccaccgagacaaaaagcgctgctccaaggttgtctctttctccaagccaattgagaaagaggaaacagtcggaatcttctcacctctctccgtaaagctaaacatagtgattagcccttaccacttcgacaatagctggaaggccttcctgggcgagttaacgcttcagctactgcctgctcagagtctgatcgaaaatttctctgagcggagcatcacgctcatgagctcggagagctctaatcaatttctgatatatgtgcactcaaaaggcgaggacgtggagaaacagaagaaggagcctatgtccatctgcgataaaggaatattagtcgaaagttcgttcagcggggaaatgctggaggatttgggttggcttcagaagaagcgacgaattaagttataccaaaagccagagggaaaccacatcatcaaggtgggtatttacctgttggaggccggactggcaaagctggatttcctgtctgatgccaattcgcggatgaagaagttcaaccagctcatgaaaaaagtgatggaaaagctccacaattctatcatccccgacgtgctcgaagaggatgaagacgatccggagtcagagcctgaaggccaagatattgatgaattgtatcacttcgtgaaacaaacacaccaacaggaaacccagtctatccaggtggacgtccaacaccctgctcttatccccgtgttacggccttaccagagggaggccgttaactggatgctgcagcaggagtgctttcgctcaagtccagcaacagagtccgcgcttcattttctttggagagaaatcgttactagtgagggactgaagctatactacaatccgtacaccggatgtatcatccgggaataccctaattctggacctcagctgttgggcggtatcctggcggacgaaatgggcctgggaaaaacggtggaggtactcgcactcatcctgacacatacccgtcaggatgtgaaacaggacgccctgactctcccagaggggaaagtggtaaactatttcatcccaagtcattattttggaggaaagctcaagaagactgaaatacagaacatcgaatttgaacccaaagaaaaggtccagtgccctccaacccgcgtgatgatcctgacagctgtgaaagaaatgaacggtaagaaaggcgtctcaatccttagtatctataaatatgtcagtagcatctacagatacgacgtgcagagaaaccggtccttgcttaaaaggatgctgaaatgcctgatctttgaaggcctggtcaagcagattaagggacacggttttagtgggacctttactctaggcaaaaattataaggaggaggacatctgcgataaaacaaaaaaacaggccgtgggctccccaagaaaaatacaaaaagaaacaagaaagagtggaaacaaggatacagattcagagtacctacccagcgacacttccgacgatgacgacgacccctactattattattataagtcaagacgaaacaggagtaagctcaggaaaaagcttgtgccctctacaaagaaaggcaagagccagccatttataaatccggactcgcaggggcactgccccgctacttccgatagtggcataaccgatgtggcaatgtcaaaatcaacctgcatcagtgaattcaaccaggaacacgagaccgaagactgtgccgagtccctgaaccatgccgattcagacgtccccccttctaacaccatgtctccttttaacaccagcgattatagattcgaatgtatttgcggagaacttgatcagatagacagaaaacctagggttcagtgtcttaagtgccacctgtggcagcatgccaagtgcgtaaactatgacgagaaaaatcttaagatcaaaccattctattgtccgcattgtctggtggcaatggagcctgtgtcaactagagccacactgattatttcaccgtcaagcatttgccatcagtgggtggacgagatcaacaggcacgtgaggagcagtagtttgcgagtccttgtgtaccagggcgtgaagaaggacggttttctccagcctcactttctggcagaacaagatatcgtgataatcacgtacgacgtcctgcgctcggagctcaactatgtggatatccctcactcaaactcggaggatggtcgtagactgcggaatcaaaaaagatacatggccatcccatctcctctggtcgcggtggagtggtggagaatttgcttggacgaagcccaaatggtcgaatgtcccacagtgaaagcagccgaaatggctcagcgcctcagcggcataaatagatggtgcatttcaggcacgccagtccaacgcggtcttgaggatctctttggccttgtggtcttcttagggatcgaaccatattgcgttaagcattggtgggtgcgactgctataccgaccctactgtaagaagaacccccagcatctctactctttcatcgccaagatcctgtggcgcagcgcaaagaaggacgtgatcgaccagattcagatacccccacagacggaggagatccattggctgcatttttccccagtcgagagacacttttaccacaggcagcatgaggtgtgttgccaggacgtggtagtgaagctcaggaagatttcagactgggccctcaagttgtccagtctggacaggcggacagttacgtccatcctctaccccttgctgcgtctccgccaggcctgttgtcacccccaagctgtgagaggagagtttctacccttgcagaaatcgacgatgactatggaggagttactgacttcgctgcagaaaaaatgtgggaccgaatgtgaggaggcccatagacaactcgtgtgcgccctgaatggcctggcagggatccatatcatcaagggcgaatacgcgctcgcggctgagctttatcgcgaggtgctccgctccagcgaggagcacaagggcaaattgaagacggacagcctgcagcggctgcacgctactcataacctcatggagcttctcatcgcgaggcaccccggtattccccctactcttcgcgatggaaggctggaggaggaagctaaacagctccgagaacactacatgtctaaatgcaacacagaggtcgctgaagcgcagcaggctctttacccagtacagcagactatccacgaactacagaggaagatccacagcaacagcccttggtggctgaacgtgattcaccgagctattgagtttacaatcgacgaggagctggtgcagagggtgaggaacgagatcacatcaaattacaagcagcagactggaaagctcagtatgtccgagaagttccgcgattgcagaggcttgcagttccttctgactacacagatggaagagttgaacaagtgccagaagctcgttcgcgaggctgttaagaacctagagggacccccttctaggaacgtaatcgagtcggctacggtgtgccatctccggcctgcgagactccccctgaactgctgtgtcttttgtaaagcagatgaactgttcacagagtatgaatccaaactgttttcaaataccgtcaaggggcaaaccgctatttttgaagaaatgatcgaagacgaggaggggttggttgatgatagggctcctaccacgaccaggggactgtgggccattagtgagacggaaagaagcatgaaggctatattaagctttgctaagtcacatcggttcgacgttgagtttgtggatgaaggatcaactagcatggacttgttcgaagcttggaagaaggaatacaagctgctgcacgagtactggatggctctgcgtaatcgcgtgtcagcagtggacgaactcgccatggctaccgagagactgagggtgagagacccacgggaacccaaaccaaatccacctgtcctgcacattatcgaacctcacgaggtagagcaaaacagaataaagctgttgaatgacaaggccgtggctacttcgcaattgcagaagaaactgggccagcttctgtatctgaccaacctggaaaaatcgcaagataaaaccagcgggggtgtgaatcctgagccatgtcctatctgcgccagacagttgggtaaacagtgggccgtgcttacctgcggtcactgtttctgtaatgagtgcatcagcataatcatcgaacagtactccgtgggcagccaccgttcgtccattaagtgtgccatttgccgtcagaccacaagtcacaaagagatctcatatgtcttcacttcagaaaaagccaaccaggaggaggacattccagtgaaaggatcccactctacaaaggtagaggcagtggtgaggaccttgatgaagatccagcttagagacccaggcgcaaaggccctggtcttcagcacatggcaggatgtcctcgacataatctctaaggccctgactgacaacaacatggaatttgctcagattagcagagtgaagacattccaggagaatctgagcgcctttaagagggatcctcagatcaacatcctgcttctcccactccatactgggagcaacggccttacaattatcgaggccacacacgtactccttgtcgaaccaatactgaatcctgctcatgagctccaggcaattgggagggtgcaccgtattggtcaaactaaaccaactatcgtgcacagatttctgattaaagccactatcgaggagcggatgcaggcgatgctgaagactgcggaacgatcgcacactaattcctctgccaagcattctgaggcatccgttctgacggttgcagatttggcggatctgtttacgaaagaaaccgaggaactggagtag

SEQ ID NO: 24358 - DNA, 468 bp, Artificial Sequence
  Description of Artificial Sequence: Synthetic coding sequence
atggaatttgcgcagatcagtagagtcaagacgtttcaggagaaccttagcgcattcaaacgcgatccccagatcaatatcctactgctgcctctgcacaccggtagcaacggcctgactataatcgaagctacacacgtgctcctggttgagcctattttgaatcccgcacacgaactgcaagccatcggtagagttcacaggattggccagaccaagcccactattgtgcaccggtttttgatcaaggctacaattgaagagcgcatgcaggctatgctgaagaccgccgagcgccgattctttgaggagcaggctctgttttgttttcatgacatcacccccttctcgcacccctggagtcttactacagccatactgcaactacgggatttagtcatttgtgaactctttttcatttattttaaaaatttcctcatatgcttcctgtcatcgttctctatctag

SEQ ID NO: 24359 - DNA, 4979 bp, Artificial Sequence
  Description of Artificial Sequence: Synthetic coding sequence
atgtcgagccggaggaagcgggcacctcctgtccgcgtggacgaggaaaagcgccagcaactgcactggaatatgcacgaggatcgacggaacgagcccataattatctcagatgatgatgagcagccatgccccggatccgatacctcttctgcccactacataatcctctcagacagccttaaggaggaggtggcccatagagacaaaaagcgttgcagtaaggtcgtctcattttctaagcccatcgagaaggaagagacagtgggcatcttcagtccgctgtccgtcaagttgaacatcgtgatctcaccataccatttcgataatagctggaaggcattcctaggggagctcaccctgcaactgctacctgcacagagcctaatagagaattttagtgagagatccataacgcttatgtcatccgagtcctcgaaccagtttctcatttacgtacactccaagggagaagatgtggaaaaacagaaaaaggaaccgatgtctatatgtgacaagggtatactggtggagtcttccttcagtggagagatgttagaggaccttggatggctgcaaaagaagcgaagaattaaactataccaaaagccggaagggaaccacattataaaggtgggtatttatctcttggaagccggacttgccaagttagattttctgagcgatgctaatagcaggatgaagaaattcaaccagttaatgaagaaggtaatggagaagctccacaactctattataccagatgtactcgaggaagacgaggacgaccccgagtcagagccagaaggacaggatatagacgagctctatcacttcgtgaaacagacacaccaacaggagacacagagcatacaagtggacgtccagcaccccgctttgattcctgtccttcggccataccaacgggaggccgtaaactggatgctccagcaggagtgtttcagatcctcaccagctacagagagtgccttgcactttctatggcgtgagatcgtgacatcagagggccttaagttgtactacaacccatataccggttgcataatccgggaataccctaattcagggccacagcttctcggcggaattcttgctgatgaaatgggactcggcaagacggtcgaagtacttgctctcattctcacccacactaggcaggatgtgaagcaggatgccttgacattgcccgagggtaaagtagtgaactatttcatcccttctcactatttcggtggtaaactgaagaaaacagaaatccagaatattgagttcgaacctaaagagaaggtccagtgcccacccacccgcgtgatgatacttaccgccgtgaaggaaatgaacggtaagaaaggagtttctattctgagcatctataaatacgtgtcctccatctatcgctatgatgtgcagagaaatagatctctgctgaaacggatgttgaagtgcctgatttttgaaggtcttgtcaagcagataaaaggccacggattcagcggtacattcacccttggcaaaaactataaggaggaagatatatgcgacaaaactaaaaagcaagccgtgggatccccccgtaaaatccagaaagaaacaagaaaatctgggaataaagacaccgactctgagtacctgccctctgacaccagtgacgatgatgatgatccctactactactactataaatcccgcaggaaccggagtaaactgcggaaaaagctggtgccttcaactaagaagggcaagtctcagcctttcataaatcctgatagccagggccactgtcccgctacttccgacagcggcatcactgacgtggcaatgtcgaaatctacctgcatttccgagtttaatcaggaacacgaaaccgaggactgcgcggaaagcctaaatcacgcagatagtgatgtgccaccttcaaacaccatgtctccatttaatacaagtgattatagattcgaatgtatctgtggagaactggaccagatcgatagaaaacccagagtccagtgcctgaagtgccacctctggcagcatgccaagtgcgtcaattatgacgaaaagaacctgaaaattaagcccttctattgccctcattgtctggtggctatggaacccgtctccacacgagccacgctgataatatctccatccagcatttgtcaccaatgggttgacgagatcaacagacacgtccgatcgagcagtctccgcgtgctagtttaccagggcgttaagaaggacggcttcctgcagccccacttcctcgccgaacaggatattgtgatcatcacctacgacgtactccgaagtgagctcaattacgttgatatcccccactccaactcagaggacggccgacggctgcggaatcagaaaagatacatggcaattccatcaccactcgtggcagtggagtggtggagaatctgcctcgacgaggcgcaaatggtagaatgcccaactgtaaaggccgctgaaatggcccagagactgtccggcattaatcgatggtgtatctccggcacccctgtccaacggggtctggaggacctttttggactggtcgtgtttctgggtatcgaaccctactgcgtaaagcactggtgggtgcggttattgtacaggccatattgtaaaaaaaatccgcagcatctgtatagctttattgccaagatcctatggaggtctgctaaaaaggatgtcattgaccagatacagatacctcctcagaccgaggagatacactggcttcacttttctccagtagaaaggcatttctatcatagacagcacgaagtgtgttgccaagacgtggttgtgaagctcaggaaaatttcagattgggccctgaagctttcttctctggacagacggaccgttactagtatcctctaccccctcctccgtctgcggcaggcctgttgccacccccaggctgtaagaggtgaatttttgcccctgcagaaaagttttgagcagtctacattttccttttcgacgatgaccatggaagagttactcacctctctgcagaaaaagtgcgggactgagtgcgaggaagctcatcgccaactggtatgtgcgctgaacggcctggctgggatccatatcattaagggagaatatgctctggccgctgagctgtatagggaggtcctcagaagcagcgaagagcataagggtaagctaaagacagactctttacaaaggctgcacgcgacccacaacctcatggaactgctgatcgccaggcatccagggattccgccaaccctgcgggatggacggttagaagaggaagcaaagcaattgcgcgagcattacatgtccaagtgtaataccgaagtggccgaggctcagcaagctctgtacccggtgcaacagactatccacgagctgcagagaaagatccattccaatagtccctggtggctcaatgtgattcatagggctatcgagtttacaattgacgaggagctcgtccagcgcgtcaggaacgaaattactagcaactacaaacagcagacaggtaagctttctatgtccgaaaaggggctgcagtttctgctgacgacccagatggaggaactgaataaatgtcaaaagcttgtgcgcgaagcggtcaaaaaccttgagggtcctccatcgcgcaatgtgatagaaagcgccactgtttgtcacctcagaccagctaggctgccactgaactgctgcgtattctgcaaagcagatgagttgttcacggagtatgaatccaagctattctccaacaccgtcaagggccagacagcgatttttgaggagatgatcgaggatgaggaaggtctcgtcgacgatcgcgctccaacaacaactagggggttatgggcgataagcgaaactgaaagaagcatgaaggccattctgagctttgcaaagtcccatcggtttgacgtggagtttgtcgacgaggggtctacctcgatggacctcttcgaggcctggaagaaggaatataagctcctgcacgaatactggatggcgctgcggaaccgcgtctctgcagtggatgaactggctatggcaaccgagagactgcgggtcagagacccaagggaaccaaaacctaatcccccagtcctccacattattgagccacacgaagtggagcagaatagaatcaaattgctaaacgataaggccgtagccacctcacaactgcaaaaaaagctgggacagctcctctatctcactaatctggagaaaagccaggacaaaacatctggtggggtcaacccggagccttgcccaatctgtgccagacaactgggcaagcagtgggctgtgctcacatgtggccattgcttctgtaatgagtgtattagtattatcattgagcagtattccgtggggagccaccgttcatctatcaagtgtgctatctgtagacagacaactagtcataaggaaatttcctatgtattcacttctgagaaggcaaaccaggaggaagacatccctgtgaaaggttctcattccactaaggtcgaagcagttgtaagaacccttatgaagattcagcttagagatcctggggctaaggcactcgtgttctcaacctggcaggacgtcctggacattataagcaaggcgctgacagataataacatggagtttgcgcagataagtagggtcaagacatttcaggaaaatctgagtgcttttaagcgggacccacagataaacatcctgctactgcccctgcatacaggcagcaatggcctcaccatcattgaggctacccacgtactcctcgtcgagccaattttgaatccagcccatgagttacaggccatcggaagagtccacaggatagggcagaccaaacctactattgttcaccggtttcttattaaagctacaatagaagagagaatgcaggccatgctgaaaacagccgagcgatctatatatatcta

SEQ ID NO: 24360 - DNA, 1983 bp, Artificial Sequence
  Description of Artificial Sequence: Synthetic coding sequence
atgtcctcccgacggaagcgggcaccacctgtgcgggtggatgaggagaagagacagcagcttcattggaacatgcacgaggatcgtcgtaatgaacctataatcattagcgatgacgacgaacagccatgtcctggtgaagatgttgaaaagcagaagaaagagccgatgtccatttgcgacaaaggcatacttgtggaaagctctttcagcggggaaatgctggaagatctcggatggttgcagaagaaacggaggatcaagctctatcagaagcctgagggcaaccacattataaaggtcggaatttacctactggaggctggtttagcgaagcttgacttcctctccgatgcaaattcaagaatgaaaaagttcaatcaacttatgaaaaaagtgatggaaaaactgcacaactcgataattccagacgttctggaagaggatgaggacgatcccgaaagcgaaccagaaggtcaggacattgatgaattgtatcatttcgttaaacagacacaccagcaggaaactcagtctatccaagtcgacgtgcaacatccggctctcatacccgtgctcagaccctatcagcgcgaggccgtcaactggatgctacagcaggaatgctttcgctctagccctgcaaccgagtccgcactgcattttctttggcgcgagatcgtgacttcagaaggactcaaattgtactacaacccctataccgggtgcatcatacgcgagtatcccaattctggacctcagcttctgggcggaatactggctgatgagatgggcttaggtaaaacagtggaggtcttagccctgatcctaacgcataccagacaagacgtcaagcaggacgcacttaccctgcccgagggtaaagtcgtcaactatttcatccctagccattactttggtggcaaactgaaaaaaacagagattcagaatatcgaattcgagccaaaagaaaaagtgcaatgtcccccaactagagttatgattctcactgccgtgaaagagatgaacggcaagaagggggtcagcatactatcaatctacaaatacgtgagcagcatctaccgctacgatgttcagagaaatagaagcctgctcaaacgcatgctcaagtgcctgattttcgaaggcttagtgaaacagattaaaggccacggattttcaggaacgttcaccctcggtaagaactacaaggaggaggatatttgtgacaaaacaaagaagcaggcagtgggttctcccaggaagatccagaaagagaccaggaagtcaggaaataaggatacggactccgagtacttgccatcagacacttccgacgatgatgacgatccctactactattactacaagagcagacgtaacagatctaaacttcgcaaaaagttggtaccatccaccaagaaggggaaatctcaaccattcatcaatccagattctcaggggcactgtccagccacctccgattccgggatcactgatgtcgcgatgagtaagtctacatgtatttcagaatttaaccaagaacacgagaccgaagactgcgccgaatccctgaatcacgctgattccgatgtcccaccaagtaataccatgagcccattcaatacaagtgactacagatttgagtgtatatgtggagagttggatcagattgacaggaagccccgagtgcagtgcctcaagtgccacctttggcagcacgccaagtgtgtcaactacgacgaaaagaatctaaaaattaagccattttactgccctcactgtctggtggcaatggagccggtgagtacgcgcgctacccttatcattagcccttctagcatctgccaccagtgggtggacgaaatcaaccgtcatgtgcggtcaagctcgcttagggtcctggtttaccagggagttaagaaggatggcttcctccagcctcatttcgggaggactgggtactcatatcactacctatag

SEQ ID NO: 24361 - DNA, 216 bp, Artificial Sequence
  Description of Artificial Sequence: Synthetic coding sequence
atggaaagggcaagggatcggctgcacctaagaagaacaaccgagcagcatgtccccgaggttgaagtgcaggttaaacgcagacgaactgccagcttatctaatcaggagtgccagctttaccccagaaggtctcaacagcagcaggtaccagtcgtcgattttcaggcagaacttcggcaggccttcctcgcagaaaccccgcgtggtgggtag

SEQ ID NO: 24362 - DNA, 216 bp, Artificial Sequence
  Description of Artificial Sequence: Synthetic coding sequence
atggagcgggctcgcgatcgtctccacttacggagaacaaccgagcagcacgttccagaggtggaggtgcaggtaaagcgcaggcggaccgccagcctgagcaatcaggaatgccagctgtatcctcgacgcagccagcagcagcaagtcccagttgtagattttcaggccgagctgaggcaagcctttctggcagaaacgccaagaggagggtag

SEQ ID NO: 24363 - DNA, 375 bp, Artificial Sequence
  Description of Artificial Sequence: Synthetic coding sequence
atgactccccaaggcaggggaaccgttgccgcagcagccgttgctgcaaccgccagtatcgcaggggctcccacccagtaccccccaggccgtggtacacctcctccacccgttggtagagctacaccgcctcccggtatcatggcaccacctcctggaatgcggccaccgatgggtccacctatagggctgcccccagcaaggggcacacctatcggaatgcctcctcctggtatgcggcctcctcccccagggattcggggagaggcattcctgctggctctggtatgctggtacggctggcccttagatttcggtatgagtgattatgccgcttacttgaaaaaaacatgcttccaggacttgtttaactag

SEQ ID NO: 24364 - DNA, 216 bp, Artificial Sequence
  Description of Artificial Sequence: Synthetic coding sequence
atggagcgggctagggatcgactgcacttgcgtcgtaccacagaacagcatgtgccagaggtggaggtgcaggtcaaacggcgtcggacagcttctctctcgaaccaagaatgtcagctgtacccgagaaggtcccagcagcagcaggtgccggtggtcgatttccaggccgagctgcgacaggcatttttggccgaaaccccgaggggcggttag

SEQ ID NO: 24365 - DNA, 1611 bp, Artificial Sequence
  Description of Artificial Sequence: Synthetic coding sequence
atggcactgacctcctttctgccggctcctacgcagctatcacaggaccagttggaagccgaggaaaaggcacggtctcagagatcaagacagacaagccttgtgtcgtccagacgtgaaccccctccctatggttataggaaaggatggattcctcggctcctggaagactttggagacggaggggcattccccgaaatccacgtggcacagtatccactggacatgggacgcaagaagaaaatgtctaacgcactcgctatccaggtggactcggagggcaaaatcaagtacgacgcaatcgcccgtcaggggcaatccaaagataaagttatttactcgaaatacacggacctagtccccaaggaagttatgaatgccgacgaccctgatctccagcgccctgacgaagaggctattaaggagataaccgagaagacgcgcgtcgccctggagaaatccgttagtcagaaagtcgcagctgcaatgcctgtgagggccgctgataaactggcgcctgcccagtacattcgatataccccaagccagcagggtgtggctttcaacagcggcgcaaaacaacgagtgattagaatggtggaaatgcagaaagaccccatggagcctcccagatttaagattaacaagaaaattccaagggggcctccttcccccccagctccagtgatgcactcgccttctcgaaaaatgaccgtgaaagagcaacaggaatggaaaatcccgccttgcataagcaattggaagaacgctaaaggctacaccatacctctggacaaaaggttggccgctgatggaagagggctgcagaccgtgcacatcaacgagaatttcgcgaagctggctgaagccctgtatatagccgacaggaaagctcgggaagctgtcgagatgagagcccaggtcgagaggaagatggcacaaaaggagaaggaaaagcatgaggagaaacttcgtgaaatggcacagaaggctcgcgagcgacgcgctgggatcaaaacacatgtggagaaggaggacggcgaggccagggaaagagacgagatcaggcacgatcgccgaaaagagcggcaacacgatcgcaaccttagcagggctgcacctgataagagaagtaagcttcagcgtaatgagaaccgcgatataagcgaggtgattgcactcggcgtgccgaacccaagaacgtccaacgaggtgcagtatgatcagcggctgtttaaccagtcaaaagggatggactcaggttttgccggaggtgaagatgagatctacaacgtgtacgaccaagcctggagggggggaaaggatatggctcagtccatttacaggcctagcaaaaacctggacaaggacatgtatggagatgatcttgaggccagaatcaaaaccaaccggttcgtgcccgacaaagagttctctggcagcgatcgcagacaacggggacgcgaaggcccagtccagtttgaggaagaccctttcggactggataagttcttggaagaggccaaacagcatgggggtagtaaacgcccatccgactcatcacgcccaaaagagcacgaacacgaggggaaaaagcgcaggaaggagtag

SEQ ID NO: 24366 - DNA, 867 bp, Artificial Sequence
  Description of Artificial Sequence: Synthetic coding sequence
atggccctgacatctttcctgccagctccgacccagctttctcaagatcagcttgaagcagaagaaaaggcacgatctcagcgctctcggcagacctccctagttagctcacggagggagccccctccgtacgggtatcgtaaagggtggattcctaggcttttagaggacttcggagacggaggcgctttcccagagattcacgtggcccagtaccccctagacatggggaggaaaaagaagatgtcgaatgctcttgccattcaggttgattccgagggcaagataaaatatgatgcaattgccaggcagggccagtccaaggacaaagttatctactccaaatacacagacctggtccccaaggaagtgatgaatgctgacgaccctgacctgcagcgccctgacgaagaagccatcaaggaaattactgagaagacaagagtcgcactcgagaaaagcgtcagtcagaaagtggcagctgccatgcccgtgagagccgcagataagttggcgcctgcacagtacattaggtatactcctagtcagcagggagttgcgttcaacagcggggctaagcaacgggtaattaggatggtggagatgcagaaggatcccatggaacccccacgattcaaaatcaataagaagattccgcgtggcccaccttccccaccggctcctgttatgcacagccccagcaggaaaatgacagtgaaagagcagcaagagtggaaaatccccccttgtatttccaactggaagaatgcaaaggggtacaccattcccctggacaagagactcgcggcagacggccgaggcctccaaaccgtgcacaagaagaagaaaaaaaaaaaacggaagtag

SEQ ID NO: 24367 - DNA, 558 bp, Artificial Sequence
  Description of Artificial Sequence: Synthetic coding sequence
atggcccttacatcctttttacccgcacctacgcagctttctcaagaccaactggaggctgaggaaaaggctaggtcccagaggtcgaggcagacatctctcgtgtctagccggcgtgagccaccaccctatggctataggaaaggctggattcccagattactggaggattttggggatgggggtgccttcccagagattcacgtggcccagtaccccttggatatgggaagaaaaaaaaagatgtcaaatgccttggctattcaggtcgactccgaaggcaagattaagtacgacgctatcgcccgacagggccagtcaaaagataaggtaatttattcaaagtacacagatttggtgcccaaagaggtgatgaatgcagacgaccctgacctccagaggcctgatgaagaggccattaaggaaatgacagtcaaggagcaacaggaatggaaaatccccccatgcattagcaattggaagaatgccaaggggtacactatcccactggataagcgactggcagcggatgggagaggactgcagacagttcattag

SEQ ID NO: 24368 - DNA, 2211 bp, Artificial Sequence
  Description of Artificial Sequence: Synthetic coding sequence
atggttgctgagatacagaatgttgaaggacaaaatctgcaagagcaggtttgtcctgagcctattttcagattctttcgcgaaaacaaggttgagattgcttccgcaattacccgtccatttccattcttgatgggcctgcgtgatcgtagctttatctccgagcaaatgtatgagcacttccaggaagctttccgaaacctagtcccagtgacgcgggtaatgtattgtgtgctctctgagctggagaaaacttttgggtggtcacacctggaggcgcttttttcacggatcaatctgatggcttatcctgacctgaatgagatttacagatcctttcagaatgtgtgctatgagcacagcccgctccagatgaataacgtcaacgacttggaagatagacccaggttgttaccttatgggaaacaggaaaactctaatgcttgccatgaaatggacgacattgcagtgccccaggaagcgttaagttctagtcctcgatgtgagcccggattcagctcagagtcatgcgaacagttggccctcccgaaagcagggggtggagacgcagaggacgcgcctagtctacttccaggtggcggtgtgagctgcaaacttgccatacagatcgatgagggtgaatcggaggaaatgccgaagctgctgccctacgatactgaggagacctttgacctgaaaactcctcaagtcacaaatgagggcgagcctgaaaaaggactctgcctgcttcccggtgaaggcgaagaagggagcgacgattgttccgaaatgtgcgatggcgaggaacggcaggaggcatcatccagcctggcacggaggggcagcgtcagctcagaattggagaatcaccccatgaatgaagaaggtgaatcagaagaactggccagctccctgctgtatgataacgttcccggtgcagaacagagcgcctatgagaacgagaaatgcagctgtgtgatgtgtttcagcgaagaagttccagggtcacccgaagcacggaccgagtctgaccaagcatgcgggaccatggatacggttgacattgcaaacaactccactctggggaaacccaagagaaaacggagaaaaaagcggggacacggctggtcccgaatgaggatgcgtcgccaggaaaacagccaacagaacgataactcaaaagccgatggccaggtggtgagctccgaaaagaaggccaatgtgaatctcaaggatctgtctaagattagagggagaaagcgtggtaagcctgggaccagatttactcagagtgaccgggcagcacagaaaagggtgcgtagcagagccagtaggaagcacaaggacgagaccgtggatttcaaggcccctctccttcccgttacatgcgggggagtcaaggggatactccataagaaaaaacttcagcaggggatcttggtcaagtgcatacaaaccgaagacggaaaatggtttacccctacagaatttgaaattaagggagggcatgctagaagtaagaattggagactgagcgtgcgttgcggcggttggcccttgaggtggttgatggagaacggcttcctgccggaccccccaagaattaggtatcgcaagaagaagaggatcttgaagtcacagaacaattctagcgtcgatccctgcatgagaaatctagatgaatgcgaggtttgcagggacggcggtgaactgttttgttgcgatacatgcagccgagtgttccatgaggactgtcatattccccctgtcgaggccgaacgaaccccatggaattgtatcttctgcaggatgaaggaaagccccggatctcagcagtgttgccaggagtctgaagtgttagagcggcagatgtgccccgaagaacagctaaaatgtgaattcctcctcctaaaagtttactgttgctccgagtcaagcttcttcgcgaagatcccatattattactatatccgagaagcatgccagggtctaaaggaacctatgtggctcgataaaatcaagaagcgtttaaacgagcacggctatccccaggtagagggattcgtccaggatatgcgcctgatcttccaaaaccacagagctagctataaatacaaagatttcgggcaaatggggtttcgattggaggcagagtttgagaagaattttaaggaagttttcgcaatacaggagactaacgggaacaactag

SEQ ID NO: 24369 - DNA, 519 bp, Artificial Sequence
  Description of Artificial Sequence: Synthetic coding sequence
atggcccaacagggacagcagggacaaatggcctccggcgacagcaacctgaactttcgcatggtagcagagattcagaatgtcgagggacagaacctgcaagagcaggtctgcccggagcctattttccgcttcttcagagaaaacaaagtagagattgccagtgccattacccggccatttccatttctcatgggcctgcgcgaccgttcattcatctccgagcaaatgtacgagcactttcaggaggccttccgtaatctcgtgccagttactcgtgtgatgtactgtgtgttgtccgaactcgagaaaacattcgggtggtcacacttagaagcgcttttttcccgaataaatctaatggcttaccccgatttaaacgagatttaccgctcgtttcagaacgagaacttgtcctcgagcgccgtgctctgccagcttgtaagcccaaataaagactggaggagccatgaggaatctcttgctcacaccggaacccttcggcgatcttgtatgtag

SEQ ID NO: 24370 - DNA, 1218 bp, Artificial Sequence
  Description of Artificial Sequence: Synthetic coding sequence
atggctcagcagggccagcaaggccaaatggcgagcggcgactccaaccttaacttccgcatggttgctgagatccagaacgtggaagggcagaacctccaggagcaggtgtgccccgaaccaatttttagatttttcagagaaaacaaagtcgaaattgcctccgccattaccagaccttttccctttctcatgggcctgcgagaccgatcttttatatcagaacagatgtacgaacacttccaggaggccttccgaaatttagtaccagttaccagagtgatgtattgcgttctgagcgagctggagaaaacatttgggtggtcccatttagaggctctgtttagcagaataaatcttatggcctatcctgacctgaacgagatctaccgtagtttccaaaatgtgtgttatgagcattccccattgcaaatgaataacgtaaacgacctggaggataggccccgactgcttccgtacggcaagcaagaaaactcaaacgcgtgtcatgagatggacgatatcgcagtccctcaagaagcattgagtagttcaccacggtgtgagccaggattctcctcagagtcttgcgaacagctcgccttacccaaggcgggtgggggtgacgctgaggatgcaccatctctgctgcctggcggaggggtcagttgcaaactggccatccagattgatgaaggagagagcgaggagatgcctaagctgctcccatacgacaccgaagtgctggaatcaaatgggatgatcgacgccgcacgtacctatagtacagctcccggtgaaaaacagggagaggaagagggacggaattccccacgaaagaggaatcaggacaaggagaaataccaggagtccccagagggtagagataaagagacttttgacctaaagaccccccaggtgaccaatgaaggggaacccgaaaagggattgtgtctgctgcctggcgagggagaagagggtagtgacgactgtagtgagatgtgtgatggagaggagcctcaagaagcctcttcatcactagctagatgcggatctgagggaagtgatgattgctctgaaatgtgcgacggcgaggaacgccaagaggcccagaagcaggggaggaaggtcatcaagagagtggctcagtggattctctggattctgcaaacaacccccttgtgggaaaacccacggggaaaggaagataagcggtag

SEQ ID NO: 24371 - DNA, 2604 bp, Artificial Sequence
  Description of Artificial Sequence: Synthetic coding sequence
atggctcagcaaggccagcagggacagatggcttccggagactcaaacctcaacttccggatggtggcagagatccagaatgtggagggtcagaacctacaagaacaggtttgtcctgaaccaatattcaggttctttcgagagaataaagtggaaatcgcgagcgccataactaggccatttccctttttgatgggtctgcgggatcggtcttttatttctgagcaaatgtacgaacacttccaggaggcattccggaacctcgtcccggtaactcgggtgatgtactgcgtgctttccgaacttgagaagaccttcgggtggagccacctggaagcactcttctccagaattaatctgatggcctaccctgatctgaacgagatttataggtctttccagaacgtgtgttatgagcactcccccctgcagatgaacaacgtcaatgacttagaggacaggccacggctgttgccatacgggaaacaagagaattccaacgcttgtcacgagatggacgacatagctgtgccacaggaggccctcagttcatcaccgagatgcgagccgggttttagctcagaaagctgtgaacagctggcactgcccaaggcaggaggtggcgatgctgaggatgcccctagtctgctgccagggggtggggtctcctgcaaactagccatccaaattgatgagggggaatcagaagaaatgcctaaactactgccctatgatacagaagtgctggaatctaacggtatgatcgatgctgcccgtacatacagtacagccccaggagagaagcagggggaggaggaggggaggaacagtccaagaaagcggaatcaggacaaggagaaatatcaggagagccccgagggaagagataaggagacctttgatctgaagacccctcaggtcaccaacgagggcgagcccgagaaaggactatgtttgctacctggggagggcgaagagggttccgacgactgtagcgaaatgtgtgatggagaagaacctcaggaggcgtcgtcatctctcgcccgttgtgggtctgtatcgtgcctatctgctgagacattcgacctgaaaacaccccaggttaccaatgaaggcgagccagagaaagagctcagtctcctgcctggagaaggagaagaaggaagcgatgactgttccgaaatgtgcgatggcgaggagcgccaggaggcctcttcttcactcgcaaggaggggttctgtttcttctgaactggaaaatcatccaatgaacgaagagggcgagtcagaggagctggcgagctcactactgtatgacaatgtgcccggagccgaacaaagcgcatacgagaatgaaaagtgcagctgcgttatgtgcttttcggaggaggttcctggtagccctgaggccaggacggaaagcgaccaagcctgcggcaccatggacactgtggatatcgcaaacaattcgactctcggtaagccaaagcgcaaacgcaggaaaaaacggggacacggctggtcccggatgagaatgcgtcgccaggagaactcccagcagaatgataacagcaaggctgacggccaggtcgtctcttccgagaagaaggcaaacgtcaatctcaaggacctctcaaaaattcggggacgcaaaagaggaaagcctgggacacgcttcacccagagcgacagagccgcacagaagcgggtcagatccagagcctctcgcaaacataaggatgagaccgtagacttcaaggctccactactgcccgtcacctgtgggggagttaaaggcattctgcataagaagaagctgcagcagggaatcctcgtgaaatgcatccagaccgaggacggaaagtggtttacccccacggaatttgaaatcaagggtggacacgccaggagcaagaactggcggctgtccgtgcgctgcggtggttggcccctcaggtggttgatggaaaacggattcctgccagatcccccacggataagataccgaaagaagaagaggattttgaagagtcaaaataactcttcagtcgatccctgtatgcggaatctggacgaatgtgaagtctgtagagacggcggtgagttattttgctgcgatacctgttcccgtgtcttccatgaagactgtcatattcctcctgttgaagctgaacgtacgccttggaactgtattttctgtagaatgaaggagtctccaggaagtcagcagtgctgtcaagagtctgaagtcctagagcgtcagatgtgtcctgaggaacagctgaagtgtgaattcctcctgctaaaagtgtattgctgctcagaatcctccttctttgccaagataccgtactactactatatccgtgaagcttgtcaaggtctaaaggagcctatgtggttggacaagatcaagaagcgccttaatgagcatggataccctcaggtggaggggtttgttcaagatatgcggttgatctttcagaaccatagggcttcttataaatacaaggacttcggccagatgggcttccgactagaagcagaattcgagaagaacttcaaagaagtgtttgccattcaggagacaaatggaaacaactag

SEQ ID NO: 24372 - DNA, 2523 bp, Artificial Sequence
  Description of Artificial Sequence: Synthetic coding sequence
atggcacaacagggacagcaaggccagatggctagtggcgactcaaatcttaattttagaatggttgccgaaatacaaaatgttgaaggacagaacctgcaggagcaagtgtgtccagagccaattttccgcttcttcagagagaacaaggtggagattgcctcagctatcacccggccatttccttttctgatgggtctacgggatcgtagttttatctctgaacaaatgtacgagcattttcaagaggctttccgtaatctggtgccggtcacgcgagttatgtattgtgtgttgagtgagctagagaaaacctttggctggagtcaccttgaagctctgttctccagaataaatctgatggcctatccagatctcaatgaaatttataggagtttccagaacgtgtgctacgagcatagtccactgcagatgaacaacgtgaatgatttagaagaccggccacgcctcctgccatacggtaagcaggaaaactccaatgcatgtcacgaaatggacgatatagccgtcccccaggaggcactcagcagctccccgagatgcgaacccggattctccagtgaaagctgcgagcaactggcattacccaaggccggaggcggtgatgccgaggatgcaccctcactgctccccggaggtggggtgtcttgcaagctcgcgatccaaattgacgaaggagagtccgaggagatgcctaagctgctgccctacgatactgaggtgctggagtctaacggaatgatagatgcagccagaacttattcgactgcgccaggggagaagcagggtgaggaggagggacgtaattcacccagaaagcgaaaccaggacaaggagaagtaccaagaaagccccgagggcagggacaaggaaacctttgacctgaagacacctcaggttaccaacgagggggagcctgaaaaaggactatgtctcctgccaggcgagggggaggaaggaagcgacgattgtagcgagatgtgtgatggggaggaaccacaggaggctagctcatctctggcacgctgtgggtcggtctcctgtctttcagcagaaaccttcgacctgaagacaccgcaagttacaaacgagggagagcccgagaaagaactctccttgttgccgggagagggagaggtgagcagtgagctggagaatcacccaatgaacgaagaaggagaatctgaggagctggcgtcaagcttactgtacgacaacgtgcctggcgctgaacagagcgcctatgagaacgaaaagtgttcttgtgtcatgtgcttcagtgaggaggtgcccggttcacccgaggcaaggaccgaatctgaccaagcttgcggcacgatggatactgtcgacatagcgaataactccactctgggcaagcctaaacggaagcgcagaaaaaaaaggggccacggctggtcccgtatgcgaatgagaagacaggaaaattcccagcagaacgacaacagtaaggctgacggccaagtcgtgagcagtgagaagaaggccaatgtaaacctgaaggatctttccaaaatcagagggcgtaaacgaggaaagccagggactcggtttacacaatcagaccgggctgcccagaagcgggtaaggtcccgggcaagtagaaagcacaaagacgagactgtcgattttaaagccccacttctgcctgtgacctgtggcggagtcaaaggcatcctacataaaaagaagctgcaacagggcattttggtaaaatgcattcagacagaagacgggaaatggtttactcccactgagttcgaaatcaaaggaggacatgcccgatctaagaactggcgtctgagcgtgcgatgtggcggatggccgcttcgttggctgatggaaaacggattcctcccagacccccctcgtatccgataccggaaaaagaagcgaatcttgaagtcgcagaacaatagtagcgttgatccatgcatgcggaacctggacgaatgcgaggtgtgcagagacgggggagagcttttctgctgcgacacttgctccagggttttccatgaggactgtcacatcccacccgtcgaggctgagaggactccgtggaactgtattttctgtcgcatgaaggagtcccccggttcccagcaatgctgccaagagagtgaagtgctggagagacaaatgtgccccgaagagcagcttaaatgcgaattcttactcctcaaagtgtattgttgtagtgaatcatccttcttcgcaaagattccctactattactatatccgggaagcttgtcaaggactgaaagagcccatgtggcttgacaagataaagaagagactgaacgagcatgggtacccgcaggttgaaggctttgttcaggacatgcgtctcatcttccagaaccatagggccagttacaagtataaagacttcggacagatgggcttcaggctcgaggctgagttcgagaagaatttcaaggaagtgttcgccatacaggagactaatggtaacaactag

SEQ ID NO: 24373 - DNA, 2307 bp, Artificial Sequence
  Description of Artificial Sequence: Synthetic coding sequence
atggcccagcagggtcagcagggacagatggcatccggagattccaaccttaatttcaggatggttgcagaaattcaaaatgtggagggtcagaacctccaggagcaggtttgcccagagcccatctttcggtttttcagggagaacaaggtagagatcgcctcagctatcacacggccatttccgttcctgatgggccttagagatcgctcttttatctccgagcaaatgtatgagcacttccaagaggcttttagaaatctggtgcctgtgacaagagtgatgtattgtgtgctgtctgaactggaaaagacattcggctggagccaccttgaagcactattttcaagaatcaatctgatggcgtaccccgacttgaacgaaatttaccgcagttttcagaatgtttgctatgagcactctcccctgcaaatgaataacgtcaacgacctggaggatcggccaagactgctaccctatggaaagcaagagaactccaatgcatgccacgagatggatgacattgccgtgcctcaggaggccctctctagctcacccaggtgcgagcctggattctcctccgaaagctgcgaacagctagccttgccaaaggccggaggaggtgatgcggaagacgccccttcactgcttccgggagggggagaaactttcgacttgaagacgccacaggtgacgaatgagggcgaacccgagaaagggctctgtcttctccccggagaaggggaagaaggatctgacgattgttctgagatgtgcgacggagaggaaccccaggaggccagctccagtctggcaagatgtggtagcgtgtcttgcttatcggccgagacttttgatctgaagaccccgcaagtgaccaatgagggcgagcctgagaaagaactgagtttgctgcctggagagggggaggaaggatccgacgattgcagcgagatgtgtgatggagaggagcgtcaggaggcatcaagttcactagccaggcggggtagtgtcagtagcgaactcgagaaccacccgatgaatgaggagggagagagcgaagagctggctagtagtctcctgtacgataacgtgccaggcgctgagcagtccgcctatgagaatgaaaagtgcagttgtgtgatgtgcttctctgaggaggtgcctgggtcccctgaagccagaacagagagtgaccaggcatgtgggaccatggatactgtggatattgctaacaacagcacgctcggcaagcctaagaggaagagaagaaaaaagagggggcatggctggtctcgcatgcgcatgaggcgccaggagaattcccagcagaacgacaactcaaaagccgacgggcaggtcgtgtccagtgaaaaaaaggcaaacgtgaacctgaaggacctgtcaaaaatccgtggtcgcaaaaggggaaagcctggtacccgatttacccagtctgaccgcgctgcacagaaacgtgtccggtccagagcctcgcggaagcacaaggatgaaaccgtcgactttaaggctcccctactcccagtcacatgcgggggtgtgaaggggatcctacataagaagaagttgcagcaggggatccttgtcaagtgcatccagacagaagacggaaagtggtttacccctacagagtttgaaatcaagggtggtcacgctcggtcaaagaactggcgcctcagcgtgagatgcgggggttggccactgagatggctcatggaaaacgggttcctccctgatccacccagaatcaggtatagaaaaaaaaaaagaatcttaaaaagtcaaaacaattcttccgtagatccgtgtatgaggaatctcgacgagtgtgaagtgtgtcgagacggaggggaactgttctgctgtgacacatgttcgcgtgtgtttcatgaagattgccacattccccctgtggaggctgaaagaactccgtggaattgtatcttctgtcgcatgaaggagagccctggcagccagcagtgctgtcaggaaagtgaagttttggagcgccagatgtgccctgaggaacagttaaagtgcgaatttctgctgctcaaggtatattgttgttccgaaagtagcttctttgctaaaatcccctactattactatattcgggaagcttgccaaggacttaaagagccaatgtggcttgataaaatcaagaaaaggttgaatgagcacggctaccctcaggttgagggcttcgtgcaggacatgcggctcatctttcagaaccaccgcgcaagttataaggccgtacacgggaggcctggttgccggtag

SEQ ID NO: 24374 - DNA, 570 bp, Artificial Sequence
  Description of Artificial Sequence: Synthetic coding sequence
atggctcagcaaggacagcaggggcagatggcttctggcgacagtaaccttaacttccgtatggtcgccgagattcagaacgtggaaggccaaaacctgcaggagcaagtctgtccggagccaattttccgcttcttccgcgaaaacaaagtagaaatcgcttcagctatcactaggcctttcccattccttatgggtttaagggatcgttccttcatctcggagcagatgtacgagcacttccaggaggccttccgaaacctggtgcccgtaacccgtgtgatgtactgcgttttaagcgagcttgagaagaccttcgggtggagccacctggaggcgttgtttagtagaatcaatctcatggcctaccccgacttaaacgaaatctaccgaagcttccagaacgtgtgctacgaacactctcctttacagatgaacaatgtgaatgaccttgaggataggccaagactgctcccatatggtaaacaggaaaatagcaatgcttgccacgagatggacttttgcctgattctgcaagagtacgtgactgggaagaaacgggagtactag

SEQ ID NO: 24375 - DNA, 1317 bp, Artificial Sequence
  Description of Artificial Sequence: Synthetic coding sequence
atggcaggcggagggtctgatctatccactcgcggacttaacggaggagtaagtcaggttgcgaacgaaatgaatcacttgcctgctcacagtcagtctcttcagagactttttaccgaagaccaagatgtggatgaggggctcgtgtacgacaccgtcttcaagcacttcaagaggcacaaactggaaataagtaacgcaataaagaaaactttccccttcctagaaggactgagggaccgcgaacttatcaccaacaagatgttcgaagattcagaggactcttgcagaaacctcgtgccagtgcagagggtggtgtacaacgtgttgtcagaactcgagaagactttcaatctgtccgtgctcgaggccctttttagcgaggttaacatgcaagagtaccctgatctgatccacatttataagagcttcaagaacgccatacaggataaactaagtttccaggaatccgaccgtaaagagcgggaagagcggcctgatatcaagctgagcctgaagcagggcgaggtgccggaaagccccgaggctagaaaggaatcggaccaagcctgcgggaagatggataccgtagacatagccaataactcgacactgggtaagccaaagcgcaagcgaaggaagaagaagggccacggttggagtagaatggggacccgcacacaaaagaataatcagcaaaatgacaatagcaaggccgatggacagctggtgagttccgagaaaaaggctaacatgaatctaaaggacctgagcaagatcagaggtcggaaacgcggtaagcccggaacccacttcacgcaatctgaccgagctccacaaaagcgcgtgcggtcccgcgcaagccgcaagcataaggacgagactgtggatttccaggctcctctgctcccagtgacttgcggtggggtgaaaggcatccttcataaggagaaactggagcagggcaccctcgcaaaatgcatccagactgaagacggaaagtggtttacccccatggaatttgagatcaaggggggatacgcacggagcaaaaattggagattaagcgttcgttgtgggggttggcctctcagaaggctcatggaggagggcagcctgccgaatcccccaaggatctactatcgcaataagaagaggatcctgaaaagtcagaacaatagcagcgtagatccctgcatgcgcaatctcgacgagtgtgaagtatgccgcgacggtggcgagctgttctgttgtgacacttgttcaagggtgttccacgaggactgccacatccctcccgtcgagtcagaaaagtag

SEQ ID NO: 24376 - DNA, 1212 bp, Artificial Sequence
  Description of Artificial Sequence: Synthetic coding sequence
atggctggagggggatcggatctgtctacacgcggtcttaatgggggagtcagccaggtcgccaacgagatgaatcatttgcctgcgcatagtcaatccctacaacgattatttacagaagaccaggatgttgacgagggattggtctacgataccgtttttaaacacttcaagcgacacaagctcgaaatttctaacgcaatcaagaagaccttcccattcttggagggcttgagagacagagaacttataactaacaagatgtttgaggattccgaggattcctgccgtaatcttgttccagtacagcgagttgtgtacaacgtactcagcgagctggagaagacctttaatctatctgttttagaagccctttttagtgaagtcaacatgcaggagtatcccgatctaatccatatttataagagttttaagaacgctattcaagacaagttgagctttcaggagtcggacaggaaggaacgagaggaacggcctgacattaagcttagcctgaaacagggggaagtgccagagagccccgaagctcggaaggagagcgaccaggcgtgtggcaagatggatacagtggatatcgccaacaactcaaccttgggcaagcccaagcgaaagcggcgtaaaaagaagggccatggatggtcgagaatggggacccgcacgcaaaagaataatcagcaaaacgacaacagcaaggcagacggccagctagtttcatctgaaaaaaaggcaaatatgaacctgaaggacctctctaagattagagggaggaagcgagggaagcctggcacacacttcactcagagcgaccgcgcacctcagaaacgtgttagatccagaggtactttggccaagtgcattcagactgaggacggcaagtggtttactcccatggagttcgagattaagggcggttatgctcgatcaaaaaactggcggctgtctgtgcggtgtggtggatggcccttgcgaagactcatggaggaaggtagcctgcccaatccacccagaatatattacagaaacaaaaaaaggatcctcaagtcacaaaacaatagctcggtggacccatgcatgcgcaacctcgatgaatgcgaggtgtgtagagacgggggtgagctgttctgttgcgatacttgctcccgggtgttccacgaggattgccacataccacccgtggagagcgagaaatag

SEQ ID NO: 24377 - DNA, 1743 bp, Artificial Sequence
  Description of Artificial Sequence: Synthetic coding sequence
atggcagggggtggaagcgaccttagcacacggggattgaacggaggtgtgtctcaagtggcaaacgaaatgaaccacctgccagctcatagccaaagcctccagcgcctgttcacggaggatcaggatgttgacgagggccttgtctatgacacagtgttcaagcactttaaacggcataaattggagattagcaacgctattaaaaagacgttcccttttctcgagggcttgagagaccgggagctgatcactaacaaaatgttcgaagatagcgaggacagctgcagaaatttagtgcccgtccaaagggtggtgtacaatgtgctctcggaactggagaagacgttcaatctctccgtccttgaagctttattctctgaggtgaacatgcaggagtatcccgaccttatccatatctataagtccttcaaaaacgcaatccaggacaagctttcgtttcaggagagcgataggaaagaacgcgaagagcggccagatatcaaattatcgctgaagcaaggagaagtccccgaaagcccagaagccagaaaagagtctgatcaggcctgcggcaaaatggacacagtagacatcgcaaataattccaccttgggaaagcccaaacggaagcgacggaagaagaaaggccacgggtggagcagaatgggtacacggacacaaaagaacaatcaacagaatgataatagcaaagcagatggccagctggtgtcctccgagaaaaaggctaatatgaacttgaaggacctctccaagatccgagggcgaaagcggggaaaacctggcacacacttcacccagagcgaccgagcccctcagaaacgagtccgctccagagcctcccgaaagcacaaggacgagaccgtggattttcaggccccacttttgcccgtgacatgtggcggagttaaaggcattcttcataaagagaagttggagcaggggacgttggccaaatgcatccagacagaggacggcaagtggttcaccccgatggagttcgagataaaggggggttacgcaagatccaaaaattggaggttaagcgtgcgctgcggcggttggccacttcgtcgcctgatggaggaaggatctctcccaaacccgcctagaatctactatcgcaataaaaagcggatactcaagagtcagaacaacagttctgtcgatccctgcatgaggaatctggatgaatgtgaggtctgtcgggacggcggagaactgttttgttgcgatacctgttctcgggtgtttcatgaagactgccacatacctccggtggaaagcgagaaaacaccatggaactgcatcttctgtcggatgaaggaaagtcctggatcccagcagtgttgccaggaatcagaagtcttagagcgccagatgtgtcccgaggaacagttgaagtgcgagttcttgctgctcaaggtgtattgctgctcggaatcttccttttttgccaaaattccatactattattacatccgcgaagcctgtcaggggttgaaggagcctatgtggctcgataaaattaagaaaaggttgaacgaacacgggtacccacaagtggaaggctttgtgcaagacatgagacttatatttcagaatcaccgcgcaagctacaaatataaggattttggacagatggggttgcggctcgaagcagaatttgaaaaagacttcaaagaggtgtttgccatacaggaaacgaacgggaatagctag

SEQ ID NO: 24378 - DNA, 1317 bp, Artificial Sequence
  Description of Artificial Sequence: Synthetic coding sequence
atggctgggggtggctccgacctgagcacccgcggactcaacggtggcgttagccaggtagccaacgaaatgaaccatctgcccgcacactctcagtcactgcagaggttgtttacagaggaccaagatgttgacgaaggcctcgtctatgacaccgtgttcaagcacttcaagcgacacaagctagagatctccaatgctattaagaagacattccccttccttgaaggcctgcgcgacagagaactaataacaaataaaatgtttgaagattcagaagacagttgccggaacctggtcccagtccagcgggtggtgtacaacgtgctgagtgagctggagaagacattcaacctctcggtcttagaggcgttgttctccgaggtgaatatgcaagagtatcctgacttgatccacatttacaaatctttcaagaacgcaattcaggataaactgtcatttcaggagtctgatcgaaaagagagggaggaaaggcccgatattaagctatcccttaagcagggggaggtccccgaaagtcctgaagccagaaaagagtcggaccaggcatgtggcaagatggacactgttgatatcgccaataatagcactctcggcaagcccaagcgaaagagaagaaaaaaaaaggggcatggctggtcgcgtatgggtacccgcacccagaagaacaaccagcaaaatgacaacagtaaagccgacggacaactggtgtctagtgagaaaaaagcaaatatgaatctgaaagacctgagcaaaattcgtggccgaaagcgcggaaagccgggtacgcattttacccaatcagacagagccccacagaagagggtgcgatcacgggcaagtagaaagcataaagatgagacagtagatttccaggctcccctactgccagtgacatgtggaggcgtgaagggtattctccacaaggaaaagctggagcagggtaccctggccaaatgtattcagacagaggacgggaaatggtttacgccaatggaatttgaaatcaagggcggatacgccagatccaaaaattggcgcctgtctgtgcgttgcgggggttggcccctgaggcgcttaatggaagagggaagcctgccaaatccgcctaggatttattaccgcaataagaagcgaatactgaagagtcagaataactctagtgtggatccctgtatgcggaatctagatgaatgtgaagtctgcagggacggaggcgagttattctgttgcgacacctgctcgcgtgtgtttcatgaggactgccacattcccccagttgaatcagagaaatag

SEQ ID NO: 24379 - DNA, 390 bp, Artificial Sequence
  Description of Artificial Sequence: Synthetic coding sequence
atgttcgaagattcagaggactcttgcaggaatcttgtgccagttcaacgggtggtgtacaatgtgctgtcagaattggagaagaccttcaatctgtcggtgttggaagccctattctctgaggtcaatatgcaggaataccccgatctgattcacatttataaatccttcaaaaacgccatccaggacaagctgagtttccaggaatccgaccggaaagaacgggaggagaggcccgacatcaaactaagcctcaaacagggcgaggtgcccgagtcaccagaggccagaaaagagtcggatcaggcctgtggcaaaatggacactgttgatatcgctaacaattccaccctggggaaacctaagcgaaagagatctaaaaataagtag

SEQ ID NO: 24380 - DNA, 750 bp, Artificial Sequence
  Description of Artificial Sequence: Synthetic coding sequence
atggcagctacagctgcagtctcgcccagcgactatctgcaacccgcagctagcactacgcaggactcccagccctctccactggcattgttagcggctacttgttctaagatagggcctcccgcagtggaagcagccgtgacccctcccgctcctccccagccgactcctcgaaaacttgtgccaatcaagccagctcccctccccctgtcgccaggcaagaattcttttgggatcttgtcttctaagggaaatatattacaaatccaggggagtcaactcagcgcctcataccccggagggcagcttgttttcgcaatccagaatcccactatgatcaataagggcacccgtagcaacgccaatattcaataccaggcggtgccacagattcaggcgtccaactctcaaacgatccaggtgcagcccaatctcactaatcaaatccaaatcataccgggtacgaaccaagccattattactcctagcccgtcatcgcataagccagtacctattaagcctgcaccaatccaaaaatcctcaactacaaccacgccagtacagagtggagccaacgtcgtgaagctgactgggggaggagggaatgtcactttgacacttcccgtaaataaccttgttaatgcatctgacaccggagctcctacccagctgcttacagccagttgtcagaccggcatgcttaattcaacgcgtatgttcctgttcctcgcctttatcaatgtcctctag

SEQ ID NO: 24381 - DNA, 1842 bp, Artificial Sequence
  Description of Artificial Sequence: Synthetic coding sequence
atgagcgatccccagacctccatggctgccactgctgcggtgtccccttccgactatttgcaacccgctgcctcgacgacccaggattcccaaccaagccctctagcgcttctcgccgcaacatgttcaaagattggccctcccgcagtcgaagccgctgtgactccacctgccccacctcagcctacccccagaaaattggtacctatcaagcctgcccctcttcccctgagccctgggaaaaacagctttgggatactgagttcgaaaggaaatattctccagatccaaggatcgcagctgagcgcatcctacccgggtggacagctggtatttgcaatccaaaatcctactatgattaataaaggcactagatccaatgctaatattcagtaccaggcagttccccagattcaggccagcaattcgcaaacgattcaggtgcaaccaaatctgactaaccaaattcagattattcctggaaccaatcaggctattattaccccttcaccgtcatcccacaagccagtgccaattaagcctgccccaatccagaagtcctccacaacgaccacacccgtgcagtccggtgcgaatgtggtgaagctcaccggcggaggaggtaatgtgacactcacccttcctgtgaataacctggttaatgcttcagacacgggcgctcccacccaactcctcaccgagtctccacccaccccactctccaaaacgaacaagaaagcaagaaaaaagtccctgcccgcaagtcaaccgccagtggctgtggccgaacaggttgaaacggtgttgatagagactacagcagataacatcatccaagcaggcaataatctgctcatagtgcaaagtccaggcggaggtcagcctgctgtggttcagcaggtgcaagtggtgcctcccaaggccgaacagcagcaggtggtgcagatcccacagcaggcactgcgggttgtgcaggccgcttctgccacgcttcccaccgtcccccagaagccatcccagaatttccagatccaggctgcagaacctactcccacccaggtgtacatacgaacaccttcaggagaggtgcagacggtactggttcaggattcgcctccagcaacagcagcagcaacctctaatactacttgtagctcacctgcctccagagccccacatctctcaggcaccagcaagaagcattctgccgctattctgcggaaagagagacctctcccgaaaattgctccagccggatccattattagcctgaatgccgcacagttggccgctgccgcacaggcaatgcagaccatcaatattaatggcgtccaggtccagggagtcccagttactatcactaacaccgggggacagcagcagctaaccgtgcagaacgtcagcggcaacaacctcacaataagcggattgtctcccacccagatccagctacaaatggagcaggccctggccggagagacccagcccggagagaagaggcgtagaatggcttgtacgtgtccaaactgtaaggatggcgagaaacgctcgggtgagcaggggaaaaaaaaacacgtttgccatatacccgattgtgggaaaaccttccggaagactagtctattacgggcacacgttaggctgcatactggcgagcggcctttcgtgtgcaactggtttttctgtggcaagcggtttacaaggtctgacgagctgcaaaggcacgccagaactcataccggcgataaaaggtttgagtgtgcccagtgccagaaaaggttcatgaggagtgatcacttaacgaagcactacaaaacacatctagtgaccaagaatctatag

SEQ ID NO: 24382 - DNA, 1197 bp, Artificial Sequence
  Description of Artificial Sequence: Synthetic coding sequence
atggccgctgttgctgtattgcgaaacgattccctgcaagcctttctgcaggatcggactccatcagccagtcccgatttgggtaaacattccccactggccctactcgcggctacctgttcaaggataggccagcctggagccgcagctccccctgattttctccaggtgccatacgaccccgcactgggtagcccatcccggctgtttcacccatggaccgccgacatgcccgctcactctcctggcgctctaccccctccacacccatcacttggcctcactccccaaaagactcacctccagccatcatttggggctgctcacgagctgcccctgaccccgcctgctgacccatcatatccttacgaattctcacccgtcaaaatgcttcccagcagcatggccgctcttcctgcctcctgcgccccagcatacgttccctacgcagcacaggcagctctgcctccaggttacagtaacctgctcccaccgcctccacctccgccaccaccacccacatgtcgccaactgtcccctaatccagctcccgatgacctcccctggtggagtatcccgcaggccggtgcagggcctggcgcttctggcgttccgggaagtggattgtcaggcgcttgcgccggagctccccatgcacctcgctttcctgccagtgctgccgctgcagcagccgctgcggctgcactgcagcgagggctggtcctgggtccttcagacttcgcacagtatcagtctcagatagcagctttgctgcagacgaaagctccactcgctgcaactgcccgtagatgcaggagatgtcgatgtcctaattgccaggccgcaggcggtgccccagaagcagagcctggcaagaaaaagcaacacgtgtgtcacgtgcccggttgcggcaaggtctacgggaagacatcccacctaaaagcacacctgcgttggcacacgggagaacggccattcgtctgcaattggttattttgtggtaagagcttcacgagaagcgatgagttacagagacacctgagaacacacacaggggagaagagatttgcctgcccagaatgcggcaagcgctttatgaggtcagaccacttagcaaaacatgttaaaacacaccagaataagaagttgaaggttgcggaggcaggcgtgaaaagagaggacgcacgtgacctctag

SEQ ID NO: 24383 - DNA, 1131 bp, Artificial Sequence
  Description of Artificial Sequence: Synthetic coding sequence
atgctaaccgctgtatgtggctccctcggcagtcagcacaccgaggctccgcacgcgtctcctccacgcctggatctgcagcctttgcaaacttaccaggggcacacttctcccgaggccggagattacccgtctcccctgcagccaggcgaattgcagagcttgcccctcggccctgaagtggatttcagccaaggctacgagctgccgggtgcctcctctcgggttacttgtgaggacctggaatcagatagccccctggcaccaggaccctttagcaaactgttacagccagatatgtcgcaccactacgaatcttggttccggcctactcaccctggggctgaagatggctcttggtgggatcttcacccgggtacaagctggatggacctacctcacacccaaggcgcacttacttctccagggcacccgggagctctgcaagcaggattgggtggctatgtgggagatcaccagctgtgtgcgccaccgccacacccgcacgcccaccacctcttgcccgcagctgggggacagcaccttctcggtccaccggacggagcaaaagccctggaagtcgcggctcctgagtctcaggggctggatagctcattggacggggcagccaggcctaaaggttctagaagaagtgtacccaggtcctcagggcagacagtgtgcaggtgcccaaactgtctggaagcggagcggttgggcgcaccttgcggcccagacggaggcaagaagaaacacttgcacaattgccacatccccggatgtggcaaggcctacgccaaaacgtctcaccttaaagcccatttaagatggcacagtggcgatcggcctttcgtatgcaattggctgttctgcggcaaacggtttactaggagtgacgaacttcaacgacacctccagacacatactggcacaaaaaagtttccgtgcgcggtctgttcacgcgttttcatgcgatccgatcatttggcaaagcacatgaagactcacgaaggcgcaaaggaggaagctgctggcgctgctagcggtgaaggaaaggctggtggagcagtggaacccccagggggaaaggggaagcgagaggccgagggctccgttgcaccgtccaattag

SEQ ID NO: 24384 - DNA, 1131 bp, Artificial Sequence
  Description of Artificial Sequence: Synthetic coding sequence
atgctgaccgcagtgtgtgggagtctgggctcccagcacacagaggcaccacatgctagccccccaagattggaccttcagccacttcagacctaccagggccatacaagtcccgaggccggtgattacccctctccccttcagcctggcgagctccaatccctcccgctcggacctgaggtggacttctcccaaggatacgagcttcccggagcctccagccgggtcacatgcgaggatctggaatcagattctcctctggcccctggtcccttttcaaagctgctgcagcctgacatgtcacatcactatgaaagttggtttcgacctacgcaccccggagctgaagacgggtcttggtgggacttgcatcctgggacatcttggatggacttaccacatactcagggcgctctcacatcacccggacaccctggcgctctccaagccggactcgggggatacgtgggtgaccaccagctgtgcgcaccccctccccacccccatgcccaccacctgctgcccgctgccggtggccagcatcttttgggcccaccggacggagctaaggccctagaggtggctgcaccagagagtcagggccttgatagtagcttggacggtgcagctcgtccaaagggatctcgtaggagtgtccccagatcctcaggccaaacagtgtgccggtgtcccaactgcctagaagccgaaagattaggcgctccttgtgggccagacgggggaaaaaagaaacacctgcacaattgccacatcccaggatgcggcaaagcctatgctaagaccagccacctaaaagctcatctgcgttggcactcaggcgatagacctttcgtctgcaattggctgttctgcggaaagagatttacgaggtctgacgagttgcaaagacacctgcagacccacacgggcaccaagaaatttccctgtgccgtgtgctcacgggttttcatgaggtctgatcacttagcaaaacatatgaaaactcacgaaggagcaaaggaggaggccgcaggtgcagcttccggggagggaaaggccggaggggctgtggaaccccctggcggtaaaggcaagcgagaggctgagggaagtgttgcaccctcaaattag

SEQ ID NO: 24385 - DNA, 1455 bp, Artificial Sequence
  Description of Artificial Sequence: Synthetic coding sequence
atggccacgtccatactgggcgaagaacctcgcttcggaacaacgccattagccatgctggccgcaacttgtaataagataggcaacacctcccctttgaccacccttccagagtcgagtgcatttgctaaagggggatttcatccttggaaacgcagctcatccagttgcaacctcgggagtagtctctcaggctttgccgtggccaccggtggcaggggatccggcggactggctgggggatccggagcggcaaactctgccttttgcctggccagcacatccccaacctcctcagctttttcatctgattacggcggactgttttctaattctgctgccgctgccgctgccgctgccggtgtcagcccccaggaggcgggagggcaaagtgccttcattagcaaggtacacactactgcagctgatggcctgtacccgcgtgtcggcatggctcacccctacgagtcttggtataagagcggattccatagcactctggccgctggtgaggtcaccaatggcgctgctagcagctggtgggacgtgcattcctcccccggatcgtggctcgaggtccaaaatcctgctggagggctccagtcatctctgcacagcggtgccccacaggcttccctccattcacagcttggcacatacaaccctgacttttcctctttgacccacagtgcattctcctccacaggcctggggagttctgcagctgctgcatcacacctgctcagtacttcccaacacctgctggctcaggacggcttcaagcccgtgttgcccagttactctgatagctccgcagccgtggccgctgcggcagcgtcagccatgatatccggagcagcggctgcagcagctgggggttcttctgcaagatctgcccgtcggtactccggtagggctacgtgtgattgccccaactgccaggaggctgagaggctggggcctgctggggcatctcttagaaggaaaggcttacattcctgtcacattccgggatgcggaaaagtgtacgggaaaacaagccacctgaaggctcacctgcgttggcacacgggggaaagaccttttgtgtgcaactggctcttctgcggaaagcgctttacccgatcagatgagttgcagaggcaccttcgaacacacactggagaaaagagatttgcttgcccggtgtgtaataagcgattcatgcggagtgaccacctgtccaagcatatcaaaactcataacggcggaggcggagggaaaaagggcagcgattcagacaccgacgcctcaaacctagagacaccacggtcagagtccccagatttaattctccatgactcgggggtctcggccgctcgggctgccgcagcagctgccgcagccgctgccgcagccgcagctgctgcgagtgctggaggcaaagaggctgcctcaggccctaatgattcctag

SEQ ID NO: 24386 - DNA, 1125 bp, Artificial Sequence
  Description of Artificial Sequence: Synthetic coding sequence
atgtcacgggtgccttcccccccacctcctgcagagatgtcctccggaccggtggctgagagctggtgttatacacagattaaggtcgtgaagtttagctatatgtggacgatcaacaactttagcttctgccgagaagaaatgggagaggtaattaaaagctctactttcagcagcggggcaaatgataagctgaaatggtgtctccgcgtgaaccctaaagggctagacgaggagtccaaggattatcttagtctgtacctgctgctggttagctgccctaaaagcgaagtaagagctaagttcaagttctccatcctgaatgcaaagggggaggaaaccaaagcaatggagagccagcgggcataccggtttgtccagggaaaagattggggattcaagaaattcattcgacgggattttcttcttgacgaggcaaatgggctcctcccagatgacaaactgaccctcttctgtgaggtgtcagtggtccaggatagcgtgaacatctctggacagaacaccatgaatatggtcaaagtgcctgaatgtagactcgcagacgagctgggcggactctgggagaactcgcggttcaccgactgctgcctgtgcgtggccggacaagaattccaggctcataaagccattctggccgctcggagtccagttttctccgctatgttcgagcatgaaatggaggaatccaaaaaaaatagggtggagattaatgacgttgagcctgaggtctttaaagaaatgatgtgttttatttataccggcaaggcacctaacctcgacaagatggcagatgacttgcttgccgctgccgataaatatgctctggaaaggttaaaggtaatgtgtgaagacgcactttgttctaatctgagcgttgaaaatgcagcagagatccttatcttggcggaccttcatagtgcagatcagctaaagacacaagccgtggatttcatcaactaccacgctagcgacgtgcttgaaacgtcaggctggaagtctatggtcgtgtcacatccacatcttgttgctgaggcttaccgctccctcgccagcgcacagtgtcctttcttgggcccacctcggaagcgcctgaaacagtcatag

SEQ ID NO: 24387 - DNA, 1125 bp, Artificial Sequence
  Description of Artificial Sequence: Synthetic coding sequence
atgtctcgtgtcccctctcctccaccaccggcagagatgtcgagcggcccagtggctgagagctggtgctacacacagataaaagtggtgaaatttagctatatgtggactattaacaacttcagcttctgtagggaagaaatgggcgaggtgatcaagtcaagtacctttagcagcggggcaaacgataaactcaagtggtgccttcgcgtgaaccccaaaggtctggacgaggaaagtaaggactatctatccctttacctgctgctcgtctcatgccccaagagtgaggtacgcgcaaaattcaagttttctattctgaatgccaagggcgaggagacgaaagccatggagagtcagagagcgtacaggtttgttcagggtaaggattggggctttaagaaattcattcggcgtgattttttactggacgaggcaaatggtctactccccgatgacaaactgactctgttttgtgaggtgagtgttgtgcaggattcagtgaatataagcgggcagaataccatgaatatggtgaaggtaccggaatgcagattggctgatgagctggggggactctgggagaactctaggttcaccgactgctgcctgtgtgtcgcaggtcaggagtttcaggcccataaagctatccttgccgcacgcagccccgtcttcagtgcaatgtttgagcacgagatggaagagagtaaaaaaaatcgcgtcgagattaatgatgttgaacccgaagtgtttaaggagatgatgtgttttatatacacgggcaaagcaccaaatctggataagatggccgatgacttgcttgctgcagcggacaaatacgccttagagcggctcaaagttatgtgcgaggacgctctgtgtagtaacttatctgtggagaacgcagccgaaatactcatcctggccgacctgcactccgcagaccagctgaaaactcaggcagtggattttatcaactaccacgccagcgatgtgcttgagacttcaggctggaaatcgatggtcgtaagccacccacacctcgtcgcagaggcttaccggagcctggcttctgcacagtgcccctttcttggcccaccgcgaaagagattaaaacagtcctag

SEQ ID NO: 24388 - DNA, 1125 bp, Artificial Sequence
  Description of Artificial Sequence: Synthetic coding sequence
atgagcagagtcccgtcacctccaccacctgctgaaatgtcctcaggccctgtcgccgagtcttggtgctatacacagattaaagtcgtcaaatttagttatatgtggacaatcaataatttttccttctgcagggaagagatgggcgaagttatcaagagctccacgttctccagcggagccaacgacaagctgaagtggtgcctacgcgtcaatccaaaggggctggacgaggagtcaaaggattacctatcactgtatcttttgttagtttcctgccctaagagtgaggtccgcgcaaaattcaaattttctattctcaatgcaaagggtgaggaaaccaaagccatggaatctcagagggcgtataggttcgtgcaaggaaaggattggggattcaagaaatttatacgtcgggacttcttgctcgacgaggcaaacggactgctccccgacgacaagctgactttgttttgtgaggtgagcgtagttcaggattctgttaacatctctggtcagaataccatgaacatggtgaaggtgcccgaatgtagactggccgacgaactgggagggctgtgggagaactccaggtttaccgactgttgcctgtgcgtagccggtcaggagttccaagcacacaaagctatattagccgcacgctccccagttttttctgcaatgttcgagcacgagatggaagaatctaaaaagaacagggtagaaatcaatgatgtggagccagaggtgtttaaagaaatgatgtgctttatttacacggggaaggctcccaacctcgataaaatggcagatgacctgctggccgcagcagacaagtacgccctagagaggcttaaagtaatgtgcgaggacgctctgtgctctaacctgtccgtggagaatgccgcagaaatcctgatcctggcagaccttcacagtgccgatcagctaaaaacacaagccgtggatttcattaactaccacgcctctgatgtcctggaaacttctgggtggaagagcatggtggtcagccacccgcatctggtggccgaggcctacagaagccttgcttccgctcagtgcccgtttctcgggcctcccagaaagcgcctcaagcagtcttag

SEQ ID NO: 24389 - DNA, 99 bp, Artificial Sequence
  Description of Artificial Sequence: Synthetic coding sequence
atgtcacgggtcccaagtccccctcccccagccgagatgagctccggaccagtggctgaaagttggtgttacacgcagatcaaagtggtgaagttttag

SEQ ID NO: 24390 - DNA, 777 bp, Artificial Sequence
  Description of Artificial Sequence: Synthetic coding sequence
atggagtcccagcgggcatacagattcgtccagggcaaagattggggcttcaaaaaatttattaggcgagattttctgctggacgaagctaatggtctattgcccgacgataaattgactcttttctgcgaggtgtccgtggtccaggattccgtgaatattagtggacagaacacaatgaacatggttaaagtccctgagtgcagactggccgacgagctgggaggactctgggaaaactcgcgcttcacagactgctgtctgtgcgtcgctgggcaagaattccaagcacacaaggccatcctggctgcgcgatcgcctgtgttttcagccatgttcgaacacgagatggaagagtccaagaaaaaccgggtggagataaatgacgtggagccagaggtcttcaaagagatgatgtgctttatttacacagggaaggcaccaaatttagataaaatggccgacgatctcctcgctgcagcagataagtacgcgctcgaacggttaaaggtcatgtgtgaagatgcattatgctctaacctcagcgtcgagaatgctgctgagatcctcattctcgctgatctacactccgcggatcagttgaagactcaagctgttgacttcattaactaccatgctagcgatgttttggagacttcagggtggaaatccatggtcgtatcccacccacatctggtagcagaggcctaccgtagtctcgcgagcgcccagtgtccgttcttggggcctccgaggaagcggctgaagcagtcctag

SEQ ID NO: 24391 - DNA, 1125 bp, Artificial Sequence
  Description of Artificial Sequence: Synthetic coding sequence
atgtcccgggtcccttccccgccaccgcctgccgagatgtcttcagggccagttgcggaaagttggtgctacactcagataaaagttgttaagttctcctacatgtggacaattaataactttagcttttgcagagaagagatgggagaggtcatcaaaagttctaccttctcgtccggtgctaatgataagctgaagtggtgcttgcgtgtgaaccccaaagggctggacgaagagtcaaaagactacctcagcctgtatctgctgctcgtctcttgccccaaatccgaagttcgagcaaagtttaagttctccatactcaatgccaaaggtgaggagacaaaagctatggagtcgcaaagagcctacagattcgtccaaggaaaggactggggctttaaaaaatttatccggagagactttctgctggacgaagctaacggactgctgcctgacgacaagctgacattgttttgtgaggtatctgtggtgcaggattccgtgaatatttccggtcaaaatacaatgaacatggtgaaagttccggagtgtaggctcgctgacgagttggggggattatgggaaaacagcagattcactgactgctgcctttgcgtcgcaggccaggaattccaggcgcataaggccattctagccgctcgaagccccgtcttctccgccatgtttgagcacgaaatggaagaatcaaagaaaaatcgcgtcgaaattaacgatgtcgagcctgaggtgtttaaggagatgatgtgctttatctacaccggcaaggccccaaatttggataagatggccgacgacctgctcgcggctgcagacaagtatgccctggaaaggttgaaggtgatgtgcgaagacgcactgtgcagcaatctctcagttgaaaatgcagcagaaattctcattctggccgatttgcactccgccgaccagcttaagacccaagcagtggatttcatcaactaccacgcttctgatgttttagaaaccagcggctggaagagcatggtggtctcccacccacatctggttgccgaggcataccgctcactggcttcggcgcagtgtccatttctcggtccaccacgcaaacgactgaagcaaagttag

SEQ ID NO: 24392 - DNA, 1125 bp, Artificial Sequence
  Description of Artificial Sequence: Synthetic coding sequence
atgtcgcgcgttccttcaccccctccacctgcggaaatgtcttcaggccctgtggcagagagctggtgctatacccagataaaggtagtcaagttctcatatatgtggaccatcaataacttcagtttctgccgagaggagatgggagaggtgattaaaagcagcacgttctcctcgggggctaacgacaagctcaaatggtgccttcgcgtaaaccctaagggcttagacgaagaaagcaaggactatctttcactctacctattgctggtctcgtgccctaagagcgaagtgcgcgctaagttcaaatttagcatcctcaacgctaagggcgaagaaaccaaggctatggagagccaaagagcttacagatttgttcagggcaaggactggggatttaagaaatttatcaggagggatttcctcctggacgaggcgaatggcctcttgcccgatgataaactgaccctattttgcgaagtgagcgtcgtccaagattctgtgaacatctctggccagaacactatgaatatggtgaaagtgccggagtgccggctagccgacgagctgggtgggctgtgggagaatagcaggtttactgattgctgcctgtgtgtagccggtcaggaatttcaagcgcacaaggctatccttgccgcacggtctccagtgttttcagcaatgtttgaacacgaaatggaagaatctaaaaagaacagggtcgaaattaacgatgtcgagcccgaagtgtttaaggaaatgatgtgctttatttatacagggaaggcccctaatctcgataaaatggcagacgacctattagcggctgccgacaagtatgcactggaacgtcttaaagtgatgtgtgaggacgctctgtgttcaaatctgtctgtagaaaacgcagccgagatcctgatcctcgccgatttgcattctgcagatcagctgaagactcaggctgtggatttcataaattaccacgcatctgatgtgctggaaaccagcggatggaagtcaatggtcgtcagtcatccacatttagtggctgaagcctataggtcactcgcgagcgcacagtgtccgtttctgggtccaccacgcaaacgcctcaaacagtcatag

SEQ ID NO: 24393 - DNA, 717 bp, Artificial Sequence
  Description of Artificial Sequence: Synthetic coding sequence
atgtccagggtacctagccccccacctccagccgaaatgtcaagcgggcctgtggctgagagttggtgttacactcaaatcaaagttgtcaagttttcctacatgtggaccataaataacttctctttttgtagggaagagatgggcgaagtgattaaaagcagtaccttttcctccggtgcaaacgataaattaaagtggtgtttgcgggttaatcctaagggactagacgaagaatctaaagattatttgtcactgtacctcctgctggtgagttgcccaaagtctgaggtacgcgcaaaattcaagttttctatcttgaatgccaaaggggaggagaccaaagctatggaaagccaaagggcatatcgcttcgttcagggaaaagactggggatttaagaagtttattcgcagggatttcctcctcgacgaggccaacggcctcctgcccgacgataaattaaccttgttctgtgaagtgtctgtggtgcaagattccgtgaatattagtggccagaataccatgaacatggtcaaagtccccgagtgtcgcttagctgacgagctgggcggtttgtgggagaattcacgcttcaccgattgttgcttgtgcgtggccggacaggaatttcaggcacataaggcgattctggccgctaggagccctgtcttcagtgccatgttcgaacacgaaatggaagagagtaagaaatag

SEQ ID NO: 24394 - DNA, 561 bp, Artificial Sequence
  Description of Artificial Sequence: Synthetic coding sequence
atgagtagggtgccctccccaccacctcctgccgaaatgtccagcggccctgtggcagaatcttggtgttatactcaaatcaaggtagtcaaattttcatatatgtggactattaataatttctctttctgccgtgaagagatgggcgaagtgataaagagcagtacttttagttcaggagcaaacgacaaactcaagtggtgcctcagagtgaaccctaaaggcttggacgaggaaagtaaagattatctcagtctctacctgctgctggtctcatgccctaaatccgaagtcagggccaaattcaaattctcaatcctgaatgccaaaggtgaggagacgaaggcaatggagagtcagcgagcctatcgttttgtgcagggtaaggattggggctttaagaagtttatacgccgagactttttacttgatgaggcaaatggtttgctgcctgatgacaagttgaccctattctgtgaggtctcagtggttcaagacagcgtgaacatttcgggtcagaacacaatgaacatggtgaaagtgcccgaatgtcggctttag

SEQ ID NO: 24395 - DNA, 123 bp, Artificial Sequence
  Description of Artificial Sequence: Synthetic coding sequence
atgagccgcgtgcctagcccaccaccaccagccgaaatgtcctccgggcctgttgccgagtcttggtgctacacgcagatcaaggtggtgaagttttcctatatgtggacaatcaacaactag

SEQ ID NO: 24396 - DNA, 789 bp, Artificial Sequence
  Description of Artificial Sequence: Synthetic coding sequence
atgtcacgggttccctcgcctcctccccctgctgagatgagttccgggccagtcgcagagtcttggtgttacactcagatcaaggttgtcaagttttcgtacatgtggaccatcaataattttagtttttgccgggaagaaatgggtgaggtgattaaatcttctacattttcctccggagcaaacgacaagctgaaatggtgcctgcgagtgaacccaaaagggttggatgaagagtccaaggactacttgtccctatatctgttacttgtcagctgccccaagtccgaggtgcgagccaagttcaaatttagcatcctgaatgcgaaaggcgaggaaactaaggctatggaatcccaacgcgcataccggttcgttcagggcaaagattggggttttaaaaaatttatccggagggacttcctgctggacgaggcaaacggcctactgcctgatgacaaattgactttattctgcgaggtgtcagttgtgcaggattctgtgaacatatctgggcagaacactatgaacatggtgaaggtgccagagtgtcgcctggccgatgagctgggcggtttgtgggaaaattccaggttcacggactgttgtttgtgcgttgcgggacaagagtttcaggcccacaaggccattctggctgcgaggtcacctgtcttctcggcaatgtttgaacacgaaatggaagaaagcaagaagaaccgggtggagataaatgacgttgagcccgaagtattcaaagagatgatgtgcttcatttataccgggaagtag

SEQ ID NO: 24397 - DNA, 201 bp, Artificial Sequence
  Description of Artificial Sequence: Synthetic coding sequence
atgtcacgcgtgccgtcccctccaccaccagcggaaatgtccagtgggcctgtagccgagagctggtgctatactcaaattaaagtagtaaaattcagttacatgtggacaattaataatttttccttctgccgtgaagagatgggagaggtgataaaaagttcaactttcagcagtggggctaatgataagctgaaatag

SEQ ID NO: 24398 - DNA, 984 bp, Artificial Sequence
  Description of Artificial Sequence: Synthetic coding sequence
atgggggaggtaattaagtcctccacctttagctctggggcaaacgataagttgaagtggtgtcttagagtgaatccaaaaggactcgacgaggaatctaaggattatctgtccttatatctactgctcgtgagctgcccgaagtccgaagtcagggctaaatttaaattctcaattctgaatgcaaagggggaggagaccaaagcgatggagtctcaaagagcctatcggttcgttcaaggcaaagactggggattcaaaaaattcattcgcagagatttcctgctcgacgaggcaaacgggctgttgcccgacgacaaactgaccttgttctgcgaagtgtctgtcgtccaggacagtgtaaatataagtggacagaacacaatgaatatggtaaaggttcccgagtgccgactggccgacgagttaggcggtctgtgggaaaattccaggtttaccgattgctgtctgtgtgtcgctgggcaggagtttcaggcccacaaggctatcctggccgctcgaagtcctgtcttttcggcgatgttcgagcatgaaatggaggaaagcaagaagaacagagtggaaatcaacgacgttgagcctgaagtgttcaaggagatgatgtgctttatttacacaggcaaggccccaaatttagataaaatggccgacgacctgctggccgcagctgataaatatgccctggagcgtctgaaagtgatgtgtgaagacgccctgtgctctaatctgtccgttgagaatgctgccgagatactgattctggctgatctccattccgcggatcagttaaaaacgcaagctgtggactttatcaattaccatgcgtccgacgtcctggagacaagcggatggaaatccatggttgtgtcgcacccccatctggtggcagaagcataccgatctctggcatcagcacagtgtccattcttgggcccaccccgtaagagactaaagcagtcttag

SEQ ID NO: 24399 - DNA, 417 bp, Artificial Sequence
  Description of Artificial Sequence: Synthetic coding sequence
atgtctcgggtgccatccccgccacctccggctgaaatgagttctggaccagttgcggaatcttggtgctacacgcaaatcaaagtcgtgaagtttagttatatgtggacaattaacaacttttctttctgccgagaagaaatgggagaggtcataaagtcatctacattctccagtggggctaatgacaaattgaagtggtgtctgcgggtcaaccccaaggggctggacgaggaatctaaggactatttgagtctctatctgttattagtttcctgcccaaagagcgaagttcgggcaaaatttaagttctctatcctgaatgctaagggagaggaaactaaggctatggagtcccagcgggcatatagatttgtgcagggtaaggactggggattcaaaaaattcattagatag

SEQ ID NO: 24400 - DNA, 354 bp, Artificial Sequence
  Description of Artificial Sequence: Synthetic coding sequence
atgtctagggtaccttctcctcctcctccagctgagatgtcgagtggccctgtagccgaaagctggtgctacactcaaattaaagtggtaaagttttcatacatgtggactattaacaatttttccttttgccgagaggagatgggcgaggtcattaaatcttcgaccttcagtagtggggcaaatgataagctgaagtggtgtttgagggtgaatcctaagggcctcgacgaggagtctaaggactatttgagtctgtatctgttactggtatcctgccctaaaagtgaggtccgtgcgaaattcaaatttagcatcctgaatgctaaaggcgaagaaaccaaagccatgtag

SEQ ID NO: 24401 - DNA, 1179 bp, Artificial Sequence
  Description of Artificial Sequence: Synthetic coding sequence
atgtctcgcgagccaacccctccgctccccggtgacatgagcacaggccctatagcagagagttggtgttatacccaagtaaaagtggttaaattcagttacatgtggactattaataatttcagcttttgtcgtgaagagatgggggaggtcctgaagagtagtactttctcctccggaccctcagataaaatgaaatggtgcttgcgtgttaatcccaagggtctcgatgacgagtctaaagactacctctcattgtacctactgttagtgtcctgcccgaagtcggaggttcgagccaaattcaagttctcactgctgaatgctaagcgggaggagaccaaggcgatggagtcccagagagcttaccgcttcgtacaagggaaagactgggggtttaaaaaatttatcagacgggacttccttttagacgaagcaaacggcctgttacccgatgacaagctgacactgttttgcgaggtgtcagtcgtgcaggatagtgtgaacatctctggtcatactaatactaacaccttgaaagtgcccgaatgccgcctggccgaagaccttggcaacctgtgggagaatacccggttcaccgattgcagcttttttgtgagagggcaggaatttaaagcacataaatcagtgctggcggctaggtcgcctgtcttcaatgccatgttcgagcatgagatggaggagagtaagaaaaatagagtggagattaatgatcttgacccggaagtatttaaagagatgatgcgattcatttatacaggtcgcgctcccaatctagataaaatggccgataatctcctggcggcagcagataagtacgctctcgagcgccttaaggtgatgtgcgaagaagctctctgttcgaatctctctgtcgagaacgttgcagacactctggttctggcagatctgcactctgccgagcagttgaaagcacaggcgattgactttattaatcggtgttcagtgcttcgccaactaggctgcaaagacgggaagaattggaattctaatcaggcaacagacattatggaaacttctggctggaagtcaatgattcagagtcacccacatttggttgctgaagctttccgggctctcgctagcgcgcagtgccctcagtttgggatcccaagaaaacgcctgaagcaatcttag

SEQ ID NO: 24402 - DNA, 9675 bp, Artificial Sequence
  Description of Artificial Sequence: Synthetic coding sequence
atgcagaaagcccgaggaacacgtggcgaggatgctggaaccagggcacctccctctcccggagttccgcctaagcgggctaaagtgggagcagggggaggagctccggtcgccgtcgctggtgcacccgtttttcttcgtcccctgaaaaacgccgcagtgtgcgcaggttctgatgtacgtctgcgggtcgtggtgtcagggactccccagccctcgttgcgctggtttcgcgatggccagctgcttcccgcacccgcaccagagccttcttgtctgtggcttagacgttgtggagctcaggatgccggagtctattcgtgcatggcccagaacgaaaggggccgagcttcatgcgaggccgtgctgacagttttggaggtgggggactctgaaacggctgaagatgatataagcgacgtgcaggggacccagaggttggaactgcgcgatgacggtgctttctctacaccgaccggcggttctgacaccttggtggggacatctctggacacgccacctacctcagtgacaggtacctctgaagaacaggtgtcttggtggggttccggccagaccgtgctggaacaggaagcagggtcagggggaggcacaaggagactccctggatctcctagacaagcccaggccaccggtgccggacctcgccatcttggagtggagccgctggtgagggcttcacgggcaaacctcgtcggagcctcttgggggagcgaagactcactgagcgtggccagtgacctgtatggtagcgccttttctctctaccggggtcgggcactttcaatccacgtgtctgttccacagagcggtctgcgtagagaggaacctgatttgcagccacagctcgcttccgaggctcccaggcgaccagcacaacctcccccatctaagagcgcattgctgcctcccccatcaccgcgagttgggaaaagaagtcctcctggtccaccagctcagcccgcagccacacctacctcacctcaccgccgtactcaagaaccagtgctgcccgaggatactactacagaggaaaaacgtggtaagaaaagtaaaagctccggaccctcgcttgcgggaacggctgagagcagaccacaaacacccctttcagaggcctccggacggctctctgccctgggcaggagtcccaggctggtgcgcgctgggagcagaattctggataagctgcagttctttgaggaacgcagacgatccctcgagagatcagatagtccacccgctcctttgagaccctgggtgcccctgcgaaaagcacgctctctagaacagcctaaatcagagagaggagctccatgggggacccccggagcaagccaggaggaactccgcgcacctgggagtgtggctgaacggcgtagactcttccagcaaaaagcagcttcactcgatgagagaacccgccagaggtcccctgcctcagacttggagctcagattcgcccaagagctaggacggattaggcggagtacatcacgtgaagaacttgttcgctctcacgagtctcttcgtgcgaccctgcaaagggccccttccccaagggagccaggtgagccacctctgttctcacgacccagcaccccgaaaacctctcgcgcagtgtcccccgcagctgcccagcctccctctccctcttccgccgaaaaaccgggtgatgagcctggtcgcccaaggtccagaggacccgcaggtagaaccgagccgggtgaagggcctcagcaggaagtgcgtcgtagggaccagtttccgctgactcgtagccgggcaattcaagaatgccggagcccggttcccccacccgcagccgatccccctgaggctagaaccaaggctccaccaggacggaaaagagaacctcctgctcaggctgtgcgttttctcccttgggccacccctggactggaaggcgctgccgttccccagactcttgaaaagaatagagccggtccagaagccgaaaaaaggctgcggcgtggacccgaggaagatgggccatggggcccatgggaccggagaggagcaaggagccagggcaaggggagaagagctaggcctacatctcccgagctggaaagttccgatgactcatatgtctccgccggagaggaaccgctggaggcccctgtcttcgagatccctctgcagaacgtggtcgtggccccaggcgctgacgttctcctcaagtgcatcattacagcaaacccgccacctcaagtttcctggcataaggatgggagtgcactgcggtccgagggcagactgctactgagggctgaaggagagagacatacccttctcctgcgcgaagctagagcagccgatgctgggtcttatatggctacggctacaaatgagttgggacaagctacctgcgctgccagtttgacagtgcgacccggtggcagcacttctcctttcagttccccgatcactagcgatgaagagtatctgagccccccagaggagtttcctgagccgggtgaaacctggccccgtactcctaccatgaagccttcccctagccagaatcgcaggtcttcagatactggtagcaaggcccctccgacttttaaagtgagtctcatggatcaaagcgtaagggagggtcaagacgttatcatgtctattagagtccagggcgaaccaaaaccagttgtaagttggctgcgtaatcgtcagcctgtgagaccagatcagagaaggtttgccgaggaagcagaaggcggactgtgtcggctgaggatcctggctgctgagcgcggtgatgcgggtttctacacctgtaaggctgttaatgagtatggcgcaaggcaatgtgaagctcggctggaggtgcgggctcacccagagagccgctctttggccgtgctggcaccccttcaggacgtagacgtgggcgcaggtgaaatggctctgttcgaatgtctggtcgccggacccactgatgtagaggtcgattggctgtgtagggggaggctgctccagcctgctctgttaaagtgtaagatgcactttgacgggaggaaatgtaagcttctgctaactagtgtccacgaggacgatagtggtgtgtacacctgcaagctcagtactgctaaagatgagctgacatgctcagcaagactgacagtgcggcctagccttgcaccacttttcacaagattgctggaggacgtggaagttctagagggacgcgcagccaggtttgattgcaagattagcggtacacctcccccagtggtaacttggactcactttggttgtcccatggaggagtctgaaaacctacgcctaagacaggacggaggactacacagcctccatatcgcacatgtagggtctgaggacgagggactgtatgcagtctccgccgtgaacacccacgggcaggctcactgttccgctcaactctacgtcgaggagccacgcactgccgcaagtggccctagctctaagttagagaaaatgcctagcatccctgaagaacctgaacagggcgaactggaaaggctctcaatacccgacttcttgagacctcttcaggacctcgaagtgggcttagctaaggaagctatgctggaatgccaagtcactggactcccttaccctaccatatcttggtttcacaatggccacaggatccagtccagcgacgacagacgtatgacgcaataccgggacgtgcacagattagtgttcccagccgtgggcccacaacacgcgggtgtgtataagtccgtgatcgctaataagctgggcaaggcagcatgttatgctcatctttacgtgaccgatgtggttcctgggcctcccgacggtgcccctcaggttgtggctgtgactggcagaatggtcacattgacttggaacccccctagatccttggatatggccatcgatccagatagcctcacttacaccgttcagcaccaggttctgggatctgatcagtggactgccctcgtgacggggctgcgagagcctggctgggccgcaaccggcctgcggaagggcgttcaacatatattccgcgtgctgagcaccacagttaagagttcctcaaaaccctccccaccctcagagccagtgcagctcctagaacacggtcctacgctggaggaggcccctgcaatgctggataaaccagatatagtttacgtcgtggaaggccaacccgcttctgtgacggtcacatttaaccacgtcgaggcacaagtggtctggaggtcctgtcggggagctctcttggaggccagagccggtgtctatgaactatctcagccagacgacgatcaatattgtctcagaatttgtagggtgagcagaagggatatgggagccctgacttgcactgctcgcaacagacacggcactcagacctgctcagtaaccctggaactggccgaggcgcctagatttgaatcaatcatggaggatgtggaggttggcgctggagaaaccgccagattcgccgtagttgttgaaggcaagccactgccggatattatgtggtataaagatgaggttctgttaacagagtcttctcatgtaagctttgtgtacgaagaaaacgagtgtagtctggtggtcctttccaccggtgctcaggacggtggagtatacacttgcaccgcccagaatctggccggtgaagtaagctgtaaagctgagctggccgtgcacagtgctcaaaccgctatggaagttgaaggcgtgggggaggatgaggatcacagaggtaggaggctaagcgacttctatgacatccaccaggaaattggacgcggagcctttagctacctgcgtagaatcgtcgagcgctcctccggactcgagtttgcagctaagtttataccctctcaggctaagccaaaggcctcagcaaggagggaggcacggctgctggcacggctgcagcacgattgtgtgctttattttcatgaggccttcgagcgcaggagggggctagtgatagttacagagttgtgcaccgaggagctgctcgagaggatcgcccgaaaaccaaccgtatgcgaatcggagatcagggcctacatgagacaagtcctcgagggcatccattatttacaccagagccacgtactgcaccttgatgtcaaaccagaaaatctcctagtctgggatggcgctgcgggtgagcaacaggtccgcatctgcgactttgggaacgcacaggagctcactccaggggagccacaatattgtcagtatggaacccctgagttcgtcgctcctgaaattgtaaaccaatctcctgtgagcggcgtgaccgatatttggcccgtcggagtagtggcattcttatgcctaactggaataagtcctttcgtaggcgaaaacgaccggacaactctgatgaacatcagaaactacaatgtagcttttgaagagaccacctttctgtctctctctcgggaagccagaggattcctgattaaagttttagtgcaggatagactccggcctactgcagaagaaaccctggagcacccgtggttcaaaacgcaggcaaagggagccgaggtttcaacagaccatttaaagctatttttaagccgcagaagatggcagagaagtcaaatatcttacaagtgccacttggttttgcggccaatccccgagcttctgcgagctccgccagagcgagtttgggtgactatgcccaggagaccaccgcctagcggcggtctgagctcctcgagcgacagcgaggaggaagaactcgaggaacttcccagtgtgccgcgacccctgcaacctgaattcagcggatctagggtttctctgacggatatccccaccgaggatgaggcgcttggaacccctgagactggggcagccaccccaatggactggcaagaacagggacgtgcccctagtcaggaccaggaggccccaagtccagaggccctcccctccccagggcaggagcccgctgccggtgcctcccctcgaagaggagagctgcgaagaggaagctctgcagagtcagcgttgccacgtgctgggcctcgtgagctggggagggggcttcataaagcagccagcgtggagctgccccagcggcgatcccccagccccggtgcaacccgactcgctcgaggaggcttaggcgaaggcgagtacgctcagagattgcaggcccttcggcagcgccttctccgcggaggcccagaagatggaaaggtgtccgggttgaggggaccgcttctagaatccctagggggtcgcgctagggatcctcgcatggcacgcgcagcttccagtgaagcggcaccccaccaccaacctcctcttgaaaaccggggactccagaaatcatcctctttctcccaaggagaagcagagccaagggggagacaccgcagggccggagctcctcttgagattcccgtggccagactgggtgcaagaaggttgcaggaatcgcctagtctgtctgccctctccgaagcacaaccttcatccccagccagaccctcggcacctaaaccgagcacgcccaagtcggccgagccctctgctactacaccaagcgacgccccacagccccctgcgcctcagcccgctcaggacaaggctcccgaaccacgacccgagcctgtgcgtgcctccaagcccgctccaccaccacaggccttacagaccctcgccctcccactgaccccctatgctcagattatacagtccctccaactcagcggccatgcgcaaggcccttctcagggccctgctgcacctcctagtgaacccaagccccatgcagcggtgtttgccagagttgcaagccctcctcccggtgcacccgagaagagggtgccttcagctggtggccctcccgtgctcgccgaaaaggctcgagtgccaaccgtccctcctcggcctgggtcaagcctttcaagctccattgagaacctggagagtgaggctgttttcgaggcaaaatttaaaaggtctagagagtctccactgtcactagggttacgacttttgagtcggtccagaagtgaggagagagggcctttcaggggagctgaggaagaggacggaatctatcgcccatccccggctgggaccccacttgagttggtgcgaaggccagaaaggtcccgtagcgtacaagacctccgggctgtcggggagcctgggctggtcaggaggttgagcctgtccttatcccagcgcttacggagaaccccacctgcccagaggcaccccgcatgggaggcacgcggtggtgacggggaatcaagcgagggcggatctagcgcaaggggatctccggtgctggctatgagacgcaggttatcttttactttggagaggttgtcttctcgcttgcagaggtctgggtccagcgaagactctggaggcgcttccgggaggagcacccccctgtttggtcgactccgacgagccactagtgagggagagagtctcaggagactgggcctgccccataatcagctggccgctcaagcgggagctacaacccctagtgccgagagcctgggttctgaggcctccgccacgtcgggttcctccgcgcctggcgaatcacgatcccggctacggtggggtttcagtcgtcccaggaaggataaaggtttgtccccaccaaatctgagcgcaagcgtgcaggaggagctcgggcaccagtacgttcgcagtgaatcagactttccccctgtgttccatattaagctgaaagaccaagtcttactggagggggaagctgccaccctcctctgtttgcctgcagcctgccccgcaccccacataagctggatgaaagacaaaaaatccttgcggtctgagccaagcgtgatcattgtgagttgcaaagacgggagacagctcctctcgatacccagggccggaaagcggcacgccggtctctacgaatgtagtgcgaccaatgttctgggctctatcacatcaagctgtaccgttgctgtggcacgggttccgggtaagcttgctcctccagaagttccacagacataccaggacacagctttggttctatggaagcccggagattcgagagccccttgcacttatacgctggaacgtcgggtggacggcgaatccgtgtggcacccagtgtcctccggcatcccagactgctactacaatgtgacgcacttgccggtgggtgtaactgtgaggttcagagtggcctgcgctaacagagcaggccagggtcccttctcaaactcttccgaaaaggtctttgtgcggggaacccaagactcttctgctgtgccgagcgccgctcatcaggaagctcctgtgaccagccgaccagcacgcgcacggcctccggattccccaacttctcttgccccaccactagcacccgctgctcctacccccccatccgtaacagtctcgccgtcttctcctcccacccccccatcccaggctctgtcctccctgaaggccgtgggaccaccgcctcagactccacctagacgacacaggggcctgcaggctgcgcgtcccgctgaaccgaccctgcctagcactcacgtgacaccctcggaaccaaaacccttcgttctagatacaggaaccccaatcccggctagtacaccccagggtgtgaagcctgtgagcagcagcacaccagtctacgtggtgacctcctttgtgtcagcccctcccgctccagaacccccagcacctgaaccccctcctgaacccacaaaagtgaccgtacaatccttgtccccggcaaaagaagtggtgagcagccctggatcaagtcctcgtagtagtccccgtccggagggcaccacactcagacaagggcctccccagaaaccgtacacatttttggaagagaaagctagaggcagattcggcgtggtgcgtgcgtgccgagagaatgccaccggcaggacatttgtcgccaaaatcgtgccttacgcagctgaaggcaaacgacgcgttctgcaggagtatgaagtgctccgtaccctacaccacgagcgtattatgtccctgcacgaagcttacatcacgccaaggtatctggtattgattgctgagtcctgtgggaacagggaattactttgcggtctgagcgatcggtttaggtacagcgaagatgacgtcgccacatacatggttcaattactccagggtctagactatctccatggccaccatgtactacatctggatatcaaaccggacaacttgctccttgcgccagataatgcgctcaaaattgtggactttgggtccgcacagccctacaacccacaggctctgcgtccactgggacaccgaactggtaccctagaatttatggctcctgagatggttaagggagaacccatcgggtcggccacggatatctggggtgcaggcgtactcacctacatcatgctcagtggccgtagccccttttatgagccagaccctcaagagaccgaggcacgcatagtgggcggacgtttcgacgcattccagttgtaccccaatacttctcaatctgccacactgttcctccggaaggtgctgtctgtgcacccgtggctgagtagacccagctcttgcctgagcgtttgtcacaaggagattaagatggccagctcatag

SEQ ID NO: 24403 - DNA, 9804 bp, Artificial Sequence
  Description of Artificial Sequence: Synthetic coding sequence
atgcaaaaggctcggggaaccagaggtgaggacgcaggcacaagagcccctccatctcccggagtcccacccaaacgcgcaaaggtcggagctgggggaggtgccccagtcgccgtggccggagccccagtttttttgcggcctttaaagaacgccgctgtgtgtgcaggatctgatgtgaggttgagggtagtagtgagcgggactccgcagccatctttacggtggtttcgagatggacagttgttgcctgccccagcacccgagccaagttgcctgtggctgcggaggtgtggggcacaggatgcaggcgtctactcgtgtatggcccagaatgagaggggaagagcctcttgcgaggctgttttgacagtgttagaggtgggggacagtgaaacagccgaagacgacattagcgatgttcagggtacccagagactcgagctaagggatgacggcgctttttctacacccactgggggttctgataccttggtggggacgtccctggacacccctcccaccagcgtgactggcacatcggaggaacaagtgagttggtggggtagcgggcagacagtgctagaacaggaggcagggagcggagggggaacccgcagactacccggatcccccaggcaggcccaggctacaggagctgggcctagacacctcggcgtggagccgctggtacgcgcaagccgagcaaatctggtgggggcatcctggggaagcgaggactctctgagcgttgcctcggatctctacggaagtgcattctcactgtataggggaagggctctgagcattcatgtgtcagttccgcagtccggattgcgccgagaagaaccagacctgcaaccacaactggcttcggaagccccacgccgtcccgctcaaccgccaccttctaagagcgcccttcttccgcctcccagccccagagtggggaagcgaagcccgccaggccctccagcacagcctgctgctacacctaccagccctcatcggcgaactcaggaacccgtgctacccgaggataccaccaccgaagagaagagaggtaagaaatcaaagtcgtctggcccttcgctcgctgggactgctgagtctagaccccagaccccgcttagtgaggctagtgggcgactatcagccctcggaaggtcccctaggctcgtcagagccggatcccggattttagataaactccagttctttgaggagcggagaagaagcctggagcgatcggatagcccacccgcaccactgcggccatgggttcccctgcggaaggcccgatcactggagcagcccaagtcggagcgaggtgcaccttgggggactccaggcgcttcacaagaggaactgagagcccctggatccgtggctgagcggaggcgcctgtttcagcaaaaggccgctagtttggacgaacgtactaggcaacggagccctgcttcagatctggagctgcggttcgcacaggaacttggcagaattcgacgctctacaagtcgggaggaactcgtgcgttctcacgagagcctgcgcgcaactcttcagagggctccatcacccagagagccaggagaacctccattattcagtcgccctagcacaccaaagacatccagagcagtgtcccctgccgcagcccagccaccaagccccagctcagcggaaaaacctggtgatgaacctgggaggccacgtagccggggtcccgcagggagaacggagcctggcgagggccctcagcaagaagtgaggaggcgcgatcaatttcctctgactaggagtagggcaatacaggagtgtaggtcccccgtgccgcctccagcagcagacccccctgaggctagaacaaaagcacccccaggacgtaagcgcgaacctccagcacaggcggtacgtttcctcccctgggccactccaggactcgagggggctgccgttcctcaaacgctggagaaaaaccgagccggaccagaggctgagaaaagactgcgaaggggtcctgaggaggatggtccatggggaccttgggatcggagaggagccaggagccaggggaagggacggagggccagaccaacttcccccgaattggaaagttctgatgattcgtatgtgtccgctggggaagagcctctcgaagctcctgtcttcgaaatccccctgcaaaatgtggtcgttgcgcctggagctgatgttctgctgaagtgtatcatcacagctaatccccctccgcaggtgagctggcacaaagatggatccgcgctgaggagtgaaggtcgccttctattaagggccgagggtgagcgtcatacactgctgctgcgtgaggctcgagcagcggatgctggaagctatatggccaccgctacaaacgagctgggacaggccacatgcgcagcaagccttactgttagacccggtggctcgacatcccctttttcatccccaataacttcagacgaagagtacttgagcccccctgaggaatttccagaacccggtgagacgtggccaaggaccccgaccatgaagccaagtcccagccaaaaccggaggagtagcgatactggttccaaagctccccctacctttaaagtgtcgctgatggaccagagcgtgcgggagggacaggatgtgattatgtcaattcgcgtccagggggaacctaaacctgtggtgagctggcttcgcaatcggcagccagtgaggcccgaccagagaagatttgctgaggaggccgagggcggtctgtgtaggctgcgcattcttgccgcagagagaggagacgccggtttctatacatgcaaggccgttaacgagtacggggcacggcagtgtgaagccagactagaagtgcgagcccaccccgaatctagaagcctggcagtgctggccccactgcaggacgtggacgttggcgcaggagagatggccctgttcgagtgtcttgttgctgggcctactgatgtcgaggtagattggctctgcagggggaggctgttacaaccagccctgttaaagtgcaaaatgcactttgacggcaggaagtgtaagttgctcctcacttctgtccacgaggacgattccggcgtgtatacttgcaagctaagcaccgctaaggacgaactgacatgcagtgcccgactgaccgtgcggccatccctggcccctcttttcacccggttacttgaagatgtggaagttctggaagggagggctgccaggttcgattgtaagatatctggcacccccccacctgtcgtgacctggactcatttcggatgccctatggaggaatccgagaatctccgtttacggcaagacggcggtctacattcgctgcatatcgcccatgtgggcagcgaggacgaagggctgtatgcagtgagcgctgtgaatactcatggtcaggcgcattgtagtgctcagttatatgttgaggagcctagaactgccgcttccggcccttcctcaaaacttgagaagatgccaagcatacctgaagaaccagaacaaggcgagttggagcgactatccatacctgatttccttagacctctccaggacttggaagtcggactggcgaaagaagccatgctggagtgtcaggtcacaggactcccttatcccactatctcctggttccataacggccatcgcatccagagtagtgatgatcgcaggatgacacagtacagagacgtccaccggctcgtcttccctgccgtgggtccacagcatgcaggtgtgtataagagcgtgatcgcgaataaattaggaaaggcagcctgttacgctcatctgtacgtcaccgatgtggtccctggtccaccagacggggcaccccaggtggtcgccgtgacagggaggatggttacactgacatggaatccaccgcgttctttggatatggctatcgaccctgatagcttgacgtacaccgtccaacaccaagtattgggctccgaccagtggaccgctctggtgactggcctgcgggagccaggctgggcggcaacaggactccggaagggcgtgcaacacatctttcgcgttctttccaccacagtcaaatccagcagcaaaccttcgcctccctctgaaccggtgcagctgttggagcatgggcctaccctggaggaggcgcctgcgatgctcgataagccggatatcgtgtatgtggttgaggggcaacctgcctcagtgaccgtcacgttcaatcacgttgaagcacaggtcgtatggcgctcttgtagaggggctctgttagaagccagggctggcgtgtacgaactttcccagcccgatgacgaccaatattgccttaggatttgtagagtttcaaggagggatatgggcgctcttacttgtacggcccgtaatcgacatgggacccaaacatgtagtgtgacactagaactggccgaggcccctcggttcgaatcaattatggaggatgttgaagtgggggcaggcgagacagccaggttcgcagtagtcgtggagggcaaacccctgccagatatcatgtggtacaaggacgaagtgctcctgactgagagctcacacgttagcttcgtgtatgaagagaacgaatgttctctggttgttctgagcactggtgcgcaagacggcggagtgtacacatgtaccgctcaaaatctggctggagaggtttcttgtaaggccgagctggccgtccatagcgctcaaacagccatggaggtcgaaggcgtgggtgaggacgaggaccatcggggtcgcagactgtcggacttctacgacattcaccaagagattgggcgtggcgcatttagctatctccgacggattgtggagcggagttctggactggagtttgccgcaaaatttatcccatctcaagctaaacctaaagccagcgcaagacgtgaagccaggttactggctaggctccaacatgattgcgtattgtatttccacgaagccttcgaaaggcggaggggcctggtgatcgtcaccgagctctgtacagaggagctattggaacgcatcgcaagaaagcccactgtgtgtgaaagcgagatccgcgcatacatgcggcaggtgttggaagggatccattacctccatcagtcccatgtgctgcacctggatgtgaagcctgagaacctgctggtatgggatggagccgctggtgaacagcaagtgcgcatctgtgacttcgggaacgctcaagaattaaccccgggtgaacctcagtattgccagtacggcacacctgagttcgttgcacctgaaatcgttaatcagagccccgtgagcggagtcacagatatctggcccgtcggtgtcgtggcttttttgtgcctaactggcatatcaccgtttgtcggggaaaacgaccgcacaacactaatgaacattagaaactacaacgtggctttcgaggagacaacgtttctgtcgttgagccgcgaggccagggggttcctgatcaaggtgctggttcaggaccgcctgcgcccaactgcagaggagactcttgaacacccttggttcaagacgcaggctaaaggagccgaggttagcaccgatcatctgaaactgtttttatcgagaaggcgatggcaacggtcacagataagctacaagtgtcacctggttctcaggcccatccccgagctgctgagagcccctccagagcgcgtgtgggtaaccatgcccaggagaccgccaccttccgggggactctcctcctcatcggatagcgaagaggaagagctggaagagcttccatctgtgcctagacccctccagcctgagttcagcggatctagagtttctttaacagatatacccacggaggacgaagctttaggcacccccgagactggcgcagcaacgcctatggactggcaggaacagggccgtgccccttcccaagatcaggaggccccttcaccagaagcgctgccctctcctggtcaggagccagcagcaggcgcttcccccaggcgtggggagcttagacggggatccagcgcggaaagcgcactccccagggcgggacccagagagcttggccgagggctacacaaagccgctagcgtggaattgccacagcgcagatctccaagtcccggagcaacccgactggccagaggcggactgggagagggggaatacgcccagaggcttcaggcactgaggcagagactacttcggggaggaccagaggatggcaaagtgtctgggctgaggggacccttactcgagtccctaggtggacgggcaagggatccaaggatggcccgagccgctagttcagaggcagccccacaccatcaaccaccgctggaaaacaggggtctacagaaaagtagttcattcagccagggcgaagcagaacctcgtgggaggcacagaagggccggagctccactcgagatcccagtggcccgattgggtgccagaagactccaggagtcacccagcctgtccgcactgtctgaggctcagccttcttctccagctcgaccatctgccccaaagcctagcacacctaagagcgccgaaccatctgcgacgacccccagcgacgctccgcagccccctgccccacagcccgctcaagataaggctcccgaacctaggcctgaacctgtgagggcctctaaacctgcccctcccccacaggcactgcagaccctggcgttgccgctaacaccctacgcgcagatcattcagagccttcaactgagcggccatgcccaaggaccttcgcaggggcctgccgctccgccaagcgaacctaagcctcacgccgctgtctttgcgcgtgtggcgagccccccaccgggagctcctgagaagagggttccctccgctggaggtccgccagtgctggccgaaaaggctagagtgcccacagtgccccctagacctggatccagtctgtcttcatcaatcgagaatcttgagtcagaggctgtcttcgaggccaaattcaagcggtcgcgggaatcacctctctctctgggcctgcgcttactgtcacggtctaggtctgaggaacgaggaccctttagaggggctgaggaagaagatggtatctatcggccatcccctgcaggcactcctctggagctcgtcaggcggccagaaagatccagatcagtccaggacttgagagcagtgggcgagccaggactcgtccgcagactctctctgagcttgtcacagcggttgcggcgtacccctcccgcacagcgccatccagcatgggaagcacgcggtggtgatggggaaagcagcgagggtggatcttctgctagaggatcaccagtgctggctatgagacgcaggctgagtttcaccctcgagcggctttcttcacgcttgcagaggagcgggagctcagaggactctgggggagcttccggtcgatcgaccccgctgttcggacgactgagacgggctacctctgaaggagagtccttacggagactgggactgcctcacaatcagctcgccgcacaggccggagccaccacgccatccgctgagtcacttggttctgaggcgtccgctacctctggctcgagcgccccaggagaaagtcggagcaggctccgatgggggttctcacgccctaggaaggacaagggattatcgcctcccaatctgtctgcctctgtccaagaggaattaggtcaccaatacgtgaggtccgaatcagactttcctcctgtgtttcacatcaagcttaaggatcaggtactactggaaggtgaggctgccacactcctgtgccttcctgctgcctgccctgcccctcacatcagttggatgaaggacaagaagtctctgaggtcggagccgtcagtgattattgtgtcttgtaaagacggacgccagctgttatccatccctagggcgggtaaacgccacgctggtctgtatgagtgctccgcaactaacgtgctaggaagcattacctcttcatgcacagttgccgtggccagagtacccggaaagctggcgcctccggaggtgccgcagacgtaccaggacacagccctggtcctttggaagcctggtgattccagagctccctgcacatatacactcgagcggagggtggatggggagtccgtctggcatccagtgtccagcgggatccctgactgttactacaacgtgactcacctgcctgtaggggtcacagtgaggtttagggtagcttgtgccaacagagctgggcagggcccattctctaattctagtgagaaggtattcgttcgcggtacccaagactcttctgcagtgccaagtgcagcacaccaggaggcccctgtcacatcaagaccggcacgcgcacgcccaccagattccccgaccagtctggcccctcctctggcacccgcagcccctacaccaccctctgtgacagtcagtccgtcgtctccccctacccctccgtcccaggctcttagctcactaaaggccgtagggcctcctccccagactccaccacgccgacatagaggtctgcaggccgcacgccctgcagagcctacactcccttccacccatgtaactccaagcgagccaaagccatttgttctcgataccggtactcctattccagcaagcacccctcaaggcgttaagccagtatcatccagcactccagtgtatgtagtgacctcattcgtgtccgctcccccagcaccagagccacctgctccagagcccccaccagaacccacgaaggtgacagtgcagtccttgagcccagcaaaggaggttgtcagtagccctggctccagcccgagaagcagtccaaggcccgagggaacaaccctgcgacaggggcctccccagaagccatatacatttctggaagaaaaggctagggggagattcggcgtggtccgagcctgtcgggaaaatgcaactgggaggactttcgtggccaaaatagtgccctacgccgctgagggaaagaggcgtgtgctccaggagtatgaggtgttgaggactttacatcacgaacgcatcatgtctctgcatgaagcttatattacaccaaggtacctggtactcatcgctgagagttgtggtaaccgggagctcctttgtggcctctccgaccgctttcgttactccgaggatgatgtcgcaacgtacatggtacagcttctccagggattggattacttgcacggtcaccacgttttacatcttgatatcaaaccagataatctactgctggccccagataacgcattaaagatcgtggatttcggcagtgcacagccctacaatccccaggccctgcggcctctcggccaccgtacaggcacgctggagtttatggctcctgagatggtcaagggcgagcccatcggctccgcaacagacatctggggggcaggagtgctgacatatattatgttgtctggccgttctcccttctatgagcccgatcctcaggagacggaagcgagaatcgtgggcggacgtttcgacgcttttcaactgtacccaaacacaagccagagcgctacgctgttcctcagaaaggtcctgagtgtgcacccctggagtcggccaagccttcaggactgtctggcacatccatggctgcaggatgcatacttgatgaagctgcgacggcagacgctcacctttacgacaaatcggcttaaggagtttcttggcgaacagcgcagacggagggcagaagccgctacacggcacaaggttttgctgaggtcttatccaggaggaccctaa

SEQ ID NO: 24404 - DNA, 342 bp, Artificial Sequence
  Description of Artificial Sequence: Synthetic coding sequence
atgaagccctctcccagtcagaaccgcagatcatcagacacaggaagcaaagcacctcctacattcaaggtctcacttatggaccagagtgtgagggaaggtcaggacgttatcatgtctatccgcgtccaaggtgaacccaaacctgtggtctcgtggttacgcaatcggcagccagtgaggcctgatcagagacgattcgcagaagaggccgaggggggactctgtaggctgaggatcttggctgcagaaagaggagacgccggtttttacacatgtaaggccgtgaacgaatacggtgctcgccagtgtgaggctcggctcgaggtgcggggagagtag

SEQ ID NO: 24405 - DNA, 342 bp, Artificial Sequence
  Description of Artificial Sequence: Synthetic coding sequence
atgaagcccagtcccagtcagaatcggagatctagtgacaccggctccaaagcaccacctacctttaaggtgagcttaatggaccagagcgtgcgggagggccaggatgtaataatgtcaattcgcgtgcaaggcgagcccaaacccgtagtgtcatggttgaggaatcggcagcctgtgagacctgaccagcgaagatttgctgaggaggccgaagggggactgtgtaggctcagaattctggcggctgaaagaggcgatgcagggttctatacttgtaaagccgtgaatgaatacggcgcaaggcagtgtgaagctcggctggaagtcaggggtgaatag

SEQ ID NO: 24406 - DNA, 342 bp, Artificial Sequence
  Description of Artificial Sequence: Synthetic coding sequence
atgaaacctagcccgtcccagaaccggcgttcctcggacactggaagtaaggctccacccacctttaaagtgtcactgatggatcagtcagtccgcgagggacaagatgttattatgtcgatcagggtgcaaggtgagcccaaaccagtcgtttcttggttgcggaatcgccagcccgtgaggcctgatcagcgcaggttcgccgaagaggctgaaggcggtctgtgcaggctaaggatactagctgctgagcgaggggatgccggattctacacctgtaaagccgtcaacgagtacggcgcacgacagtgcgaagccaggctcgaggttcgaggagagtag

SEQ ID NO: 24407 - DNA, 513 bp, Artificial Sequence
  Description of Artificial Sequence: Synthetic coding sequence
atggcgactgccacaaacgagttagggcaggccacctgtgcagcatcactcactgtccgccctgggggaagcaccagccctttctccagccctatcacctctgatgaagagtatttgtcaccccctgaggagttccccgagcccggtgagacatggcccaggactccaaccatgaaacccagtccctcccagaaccggcgtagcagcgacactggctctaaagcaccacccacctttaaagtcagcttgatggaccagtctgtcagagagggccaggacgtgatcatgagtatcagagttcagggcgagcccaaacctgtggtgtcttggctgcgcaacaggcagccagttcggccagaccagaggcgattcgccgaggaggctgagggagggctatgtaggctgcggatcctggcagctgaacggggtgatgctgggttttacacatgcaaagccgtgaacgagtacggggctcggcagtgtgaagcgaggctggaggtgaggggtgagtag

SEQ ID NO: 24408 - DNA, 1038 bp, Artificial Sequence
  Description of Artificial Sequence: Synthetic coding sequence
atgatcagcccagtactgattttattttcatcctttctgtgccatgtcgccatagctgggaggacctgccctaaacccgatgacctccctttcagtaccgtagtcccgttaaagaccttttatgagccaggagaggagattacatacagctgcaaacccggttatgtgtcaaggggtggcatgaggaaatttatatgtcctctaacaggcctgtggcctatcaatactctcaagtgtacccccagggtgtgtccttttgctggcatcctcgaaaatggcgcagttcgttatactacattcgaataccctaacaccatatctttcagctgtaatacagggttttacttgaatggagctgattcagccaaatgcacggaggagggcaaatggtctccagaactgcccgtgtgcgctcctatcatatgccctccaccaagtatccccaccttcgccactttgcgcgtctataagccctccgctggcaacaactctttgtacagagacacagcagtcttcgagtgcttgcctcagcacgcaatgttcggtaatgacactatcacatgcaccactcacgggaactggacaaaactccccgagtgcagagaagtgaagtgccctttcccttctagacccgacaacggctttgtcaattatccagctaagcccacgctctattataaagataaagcgactttcggttgtcacgacggatatagtcttgacggccctgaggaaatagagtgtactaagctgggaaactggtcagctatgcctagttgtaaagcaagctgtaaggtgccagtgaagaaagccacagtggtgtaccagggcgagcgcgtgaagattcaggaaaagtttaagaacgggatgctgcacggcgataaagtgtcctttttctgcaaaaacaaagagaaaaagtgcagctatactgaggacgcccagtgcatcgatggcaccatcgaggtgccgaaatgttttaaagaacatagttcactcgctttctggaagaccgacgcttctgatgtcaagccttgttag

SEQ ID NO: 24409 - DNA, 1278 bp, Artificial Sequence
  Description of Artificial Sequence: Synthetic coding sequence
atggcttctagcattatttgccaggagcattgtcaaatatccggtcaggcaaaaattgatatcctcctcgtcggcgacgtgaccgtcggatacttggcagataccgttcaaaaattattcgccaatattgccgaggtgaccattacaatttctgataccaaggaggcagccgcacttctggatgactgcatttttaatatggtgctgctaaaagtgccatccagcctgtccgcagaagaattggaggccattaagctgataagattcggaaaaaagaagaacacccacagtttgttcgtctttataatcccagaaaactttaaaggctgcatatctggacacggcatggacatcgccctgaccgagcctctgaccatggagaaaatgtctaacgtcgtgaagtattggaccacatgtccatccaacaccgttaagaccgaaaatgctacaggccctgaagagctgggcttgcccctccagcgtagttactccgagcatttaggctatttcccaactgatctatttgcatgcagtgaaagcttacggaatgggaatgggctggagttgaacgcaagtctgagcgaattcgagaaaaataagaagattagtttgttgcacagtagcaaggagaaacttcggagggaacggattaaatactgctgcgagcagctccggaccttgctcccatatgtcaaaggccgaaagaacgacgcggcaagcgtgctggaggcaacagttgattacgtgaagtacatacgagagaagataagtcccgctgtgatggcacagatcacagaggcactgcaatctaacatgagattttgcaaaaagcagcagacacccattgagctctctctgcctggtacagtgatggcacagcgggaaaactctgttatgtctacatactcgcccgaaagagggctgcagtttctgactaacacctgttggaacggatgttcaacccccgacgcagaaagttctctagacgaagccgtccgcgtcccctctagtagcgcctctgaaaatgccatcggagacccatacaaaactcacatctctagcgccgctttgagccttaactccctgcacaccgtgagatactacagtaaggtcactcccagctacgatgccactgccgtaaccaaccaaaacatctccattcaccttccttctgccatgccccctgtgtcgaaattacttcctcggcactgtacttcaggactcgggcagacgtgcaccacacaccccaactgcctccagcagttttgggcatattag

SEQ ID NO: 24410 - DNA, 1509 bp, Artificial Sequence
  Description of Artificial Sequence: Synthetic coding sequence
atggagacgctgcaggaaagcctgaacactctgcttaaacagctagaagaagaaaaaaagacccttgagtctcaggttaaatattatgcactaaaactcgaacaagagagtaaggcgtaccagaaaattaacaacgaaaggcggacctatctggcagaaatgtcacagggttccggcttacatcaggtgtccaaaagacaacaggtcgaccagcttcctaggatgcaggaaaacctcgttaaaacgttactgctgaaagaggaactggatcctttaaaggctaagattgacattttactggtgggtgacgttaccgttggctacctagcagataccgtccagaaactcttcgcaaacattgctgaggtcaccattacgataagcgacacaaaggaagcagctgcgttactagatgattgtatcttcaatatggttctactcaaggtgccctcatccctgtctgccgaggaactggaggctataaagttgattagatttggtaaaaagaaaaacacacacagcttgtttgtgttcattattcctgaaaatttcaaaggctgtataagcggacacggcatggacatcgcccttacagaacctctgacaatggagaagatgtcaaacgtcgtcaaatactggactacgtgcccctccaacacagtcaaaacggaaaacgccaccgggccagaggagctcggactcccattacagcggtcctacagcgagcatctcggatattttcctactgacctcttcgcctgctcggagtctttacgcaacggcaatggcttagaactgaacgcatccttgtccgagttcgaaaaaaataaaaaaatctccttactgcattccagcaaggaaaaacttcgccgtgagcgcatcaagtactgctgcgaacagctccgcactttgttgccatacgtgaagggtagaaaaaacgatgccgcaagtgtactggaggccactgtggattacgttaagtatatcagagagaaaatttcccccgcagtcatggcccagattaccgaagcactccagtctaatatgaggttctgcaaaaaacaacagacgcccattgagctctctcttcctgggacggttatggcacagcgggagaactcagtaatgtccacttactcacccgaaagaggactgcagttcttgacgaacacgtgttggaacggctgctccacacctgacgccgagtcctctctggatgaggccgttcgcgtgcctagcagttcggcctcagagaatgcaattggagacccctacaaaacccacataagttccgccgctctgtcactgaattctcttcacaccgtgcggtactacagcaaagtgacaccgtcttatgacgctactgctgtgactaatcagaacattagcatccacttacccagcgccatgccgcctgtgagcaagttactgccaaggcattgtacttccggattgggacagacctgcaccacccaccccaattgtctacagcaattttgggcttattag

SEQ ID NO: 24411 - DNA, 777 bp, Artificial Sequence
  Description of Artificial Sequence: Synthetic coding sequence
atgaaaacacccaatgcccaggaggccgaaggacagcaaacaagagccgcagccggtcgcgctacgggttccgctaatatgacaaaaaagaaagtgtcacaaaagaagcagagaggaagaccgtcctcccagccaagaaggaatattgtgggttgtcgcatctcgcacggctggaaggagggcgacgagcctataacgcaatggaaaggcacggtgctcgatcaggtccccatcaacccctccttgtatctagtgaagtacgatggaatcgactgtgtgtacggtttagaattgcatagagatgagcgagtgttgtcgctcaaaatacttagcgatcgggtagctagcagccacatctcggacgccaatctagctaacaccattatcggaaaggcggtggaacatatgttcgagggggagcacgggtccaaagacgaatggcgcggtatggtgctggcacaagctcccattatgaaggcgtggttctacatcacctacgaaaaggatcctgtgctttatatgtaccagctcctggacgactacaaggagggcgacttgcgcataatgcccgaatcctccgaatcacccccaactgaacgagaacccggaggggtagtcgatggactgattggaaagcacgtcgagtataccaaggaagacgggagcaaaaggatcggtatggtgatacaccaagttgaggctaaaccatctgtgtatttcatcaaatttgacgatgatttccacatctatgtgtatgatctagttaaaaagagttag

SEQ ID NO: 24412 - DNA, 777 bp, Artificial Sequence
  Description of Artificial Sequence: Synthetic coding sequence
atgaaaaccccaaatgcccaggaggccgaaggtcagcagaccagggcggctgctggccgagccaccggatctgctaacatgactaagaagaaggtatcgcagaaaaaacagagaggtagaccatcctcccagccgaggaggaatattgtcgggtgcagaatctctcatggttggaaggagggcgacgagccgataactcagtggaagggtaccgtcctcgatcaagtgcctattaacccttcactgtatcttgttaagtatgacggtatcgattgcgtgtatggccttgagctgcacagggacgaaagagtactgtctcttaagatactgtccgatcgcgtggccagcagtcatatcagtgacgctaacctcgctaatacgatcataggcaaggcagtggaacacatgttcgagggggaacatggaagtaaagacgagtggcggggtatggtgctggctcaggcccctataatgaaagcctggttctatataacgtacgaaaaagatcccgtgctgtatatgtaccagttactcgatgactataaggaaggtgacctgcgtatcatgccagaaagtagcgagtctccccctactgagcgggaacctggaggagttgttgacgggcttatcggtaaacacgtggagtacacgaaggaggatggttccaaacggatcggaatggtgattcatcaagtggaagccaagccgtctgtgtactttataaagttcgacgatgattttcacatttacgtctacgatctggtgaagaagtcctag

SEQ ID NO: 24413 - DNA, 474 bp, Artificial Sequence
  Description of Artificial Sequence: Synthetic coding sequence
atgaagacacccaacgcccaggaggccgagggccagcagacccgcgctgcagcaggacgggcaacggggtctgctaacatgacgaaaaagaaggtttcgcagaagaagcagcgcggtcgaccttcaagccagccccgtcggaacatagtgggctgtaggatctcccatggttggaaagaaggagatgaacctatcacacaatggaaaggaactgttctagaccagttgttggacgactacaaggaaggggatttgcggattatgccagaatcttccgagtctccaccgactgagagagagccgggtggcgtggtcgatggattgatcgggaagcatgtcgagtatacaaaagaggatggttcgaagagaattggtatggtcatacatcaggtggaggctaagccgtccgtttatttcattaaattcgacgacgactttcacatctatgtgtatgacctagtcaagaaatcttag

SEQ ID NO: 24414 - DNA, 777 bp, Artificial Sequence
  Description of Artificial Sequence: Synthetic coding sequence
atgaaaactcctaacgcgcaggaagcagaggggcagcaaactagagccgctgccggtcgagccaccggttccgccaatatgactaagaaaaaagtgtcacagaagaaacagcgtggtaggccgtcctcgcagcctcgccgtaacatcgtggggtgtcgaataagtcacggatggaaggaaggcgatgaaccaataacacagtggaaggggacagtgttagatcaggtgccaatcaacccgagcctctacttggtgaaatacgatggtatcgactgtgtatatggtctagaactgcacagggacgagcgtgtcctgtctctcaagattcttagtgatcgcgtggcgagcagccatattagtgacgcaaatcttgctaacaccataatagggaaggcagtagagcacatgttcgaaggtgaacacggcagcaaagatgagtggagaggaatggtcctggcccaagcgcctatcatgaaagcttggttctacatcacatatgagaaagatccagtgctatacatgtaccagctgctagatgattacaaggagggggatctccggatcatgcctgagagcagtgaaagcccacctacggagagggagcccggaggcgtggtggacgggctcatcggaaaacatgtggaatacactaaagaagacgggtctaaacgcatcggaatggtcatccaccaggtggaggctaaaccgtcagtttacttcattaaatttgacgacgacttccacatttatgtatatgatctggtgaagaaaagctag

SEQ ID NO: 24415 - DNA, 744 bp, Artificial Sequence
  Description of Artificial Sequence: Synthetic coding sequence
atgaaaacccccaacgcacaggaagcagagggccaacagacgagggcagcagcaggccgagccacaggtagtgcgaatatgacgaagaaaaaagtgagtcagaaaaagcagcgtgggcgaccgtccagccagcctaggcgaaatatcgtgggatgcagaatatctcacggctggaaagagggggacgagcccatcacgcaatggaaggggaccgtcctggatcaggtaccgataaatccttcgctgtatctcgtgaagtatgacggcattgactgtgtgtacggcttggagctccatagagatgagagggtcctgtctctcaagatactgtctgatcgcgtggcttcatctcacatcagcgatgctaacctagcaaataccattattggcaaggccgtcgaacacatgttcgaaggggagcatggctccaaagatgagtggcggggaatggttttagcccaggcaccaatcatgaaagcatggttttatattacctacgagaaggaccccgttttatacatgtaccagctcttagatgactataaggagggagacctgcgaattatgcccgaaagtagcgagagccccccaaccgagagagagcccggaggcgtggttgatgggctgattggtaagcatgtggaatatacaaaagaagatggttctaaacgtatagggatggtgattcatcaggtcgaagcgaagccctcagtttatttcataaagtttgatgacgacttctag

SEQ ID NO: 24416 - DNA, 1506 bp, Artificial Sequence
  Description of Artificial Sequence: Synthetic coding sequence
atggagacaatcttggagcagcaaagaagataccatgaggaaaaagagaggctgatggacgtcatggccaaggaaatgctgactaagaaatccacacttcgagatcaaatcaatagcgatcacaggacacgcgcaatgcaggaccgctacatggaggtgtctggaaacctcagggacctgtatgacgataaagacgggcttcggaaggaagagttaaacgctattagtgggcctaatgaattcgcggagttttataataggctgaagcaaataaaggagtttcaccgcaaacatcccaatgaaatctgcgtcccaatgagcgtcgaattcgaagagctgctaaaagccagggagaatccaagcgaggaggcccagaacctggtggagtttacagatgaagaaggttatggtagatacctagatttacatgattgctacttaaagtacattaaccttaaggcttcagagaagctggactatattacgtatctatccatatttgatcagctgttcgacatccctaaggaacggaagaacgccgagtataaacgctacctagaaatgctcctggagtacctgcaggactacacagatagggtgaagcccctgcaagaccagaatgagctctttggaaagatccaggccgaatttgaaaaaaagtgggaaaacgggacgttcccgggatggccaaaggagacatcctctgccttgacccacgccggagctcatttggatctgagcgcgttttcatcctgggaggaactggctagcctgggcctggataggctgaaatcagcactcctggcattaggtttgaagtgtggcggtactctggaggaaagggcccagagactctttagcactaaaggcaagtccttggagagcttggacacatcgttgttcgcaaaaaatccaaaaagcaaaggaacgaaacgtgacaccgagaggaacaaagacatcgcctttctggaagctcaaatttatgagtatgtagagatcctgggggagcagcggcacctaactcacgagaatgtgcagcgaaaacaggctagaaccggtgaagagagggaggaggaggaggaggaacagataagcgaatcagaaagtgaggatgaggaaaacgaaatcatttacaatccaaagaacctccctctggggtgggacggaaagcctatcccttattggctgtacaaactgcacggtcttaacatcaactataattgcgaaatctgcggcaattacacctatcggggtcctaaggccttccaaaggcatttcgcggaatggagacatgcccacggaatgcgatgcctcggtattcctaacaccgcccattttgcaaacgttactcagattgaggacgccgtcagtctctgggcaaagctgaagctgcagaaagcgagtgagcgttggcagcctgacaccgaggaggaatatgaagactcgtctgggaacgtggttaataagaaaacatatgaagacctgaaacggcagggtcttttatag

SEQ ID NO: 24417 - DNA, 1347 bp, Artificial Sequence
  Description of Artificial Sequence: Synthetic coding sequence
atggagacaatcctcgagcaacagaggcggtaccacgaagagaaagagcggcttatggacgtaatggcaaaagagatgctaactaaaaaatctacactgagagatcagattaatagcgaccaccggactagggccatgcaggatatctgtgttccgatgtcagttgaatttgaggagttgctgaaggctcgggagaatccttccgaagaggcccaaaacctggtagaatttaccgatgaggaaggatatggacgttacttggatctgcacgattgctaccttaaatatatcaacctcaaagccagtgaaaaacttgattacatcacgtacttgagcatcttcgaccagctctttgacatccccaaggagcggaaaaacgccgagtacaagaggtatcttgaaatgttactggaatatctacaggactacacagacagagtgaaaccattacaggatcagaacgaactgttcgggaaaatacaggctgagttcgagaagaaatgggagaatggcacatttccgggttggcccaaggagacatccagcgcattgacccatgccggagcacatctcgatcttagtgccttttcatcgtgggaagaacttgcttcactgggtctggatcggttgaagtcggcattgctggccctcggcctgaaatgcgggggtacactggaggaacgggctcaacgtctgttttctacaaaagggaagtcccttgagtccttggatacttcactcttcgctaagaaccccaagagtaaaggcactaaacgggacacagaacggaataaggatatcgcctttctcgaagcacagatatacgagtacgtagagatcctgggtgaacaacgacacctgacacacgagaacgttcagaggaaacaagctcgtactggtgaggaacgtgaggaagaagaagaggagcagatctcagaaagtgaaagtgaggacgaagagaatgagatcatatacaatcctaaaaacctacctctagggtgggacgggaaacccataccttattggctgtataaactccacggcctgaacataaattataattgcgaaatctgcggcaattacacttatcgcggacctaaggcgttccaacggcactttgcagaatggcgccacgcccacggcatgcgctgtctcggtatccccaatacagctcactttgccaatgtgacgcagattgaggatgccgtgtcattatgggctaagcttaaactgcagaaggcaagtgagcggtggcaacccgacaccgaagaagagtatgaagactcctctggaaacgtggtcaataaaaaaacttacgaagacctaaagcgacaaggcctgctgtag

SEQ ID NO: 24418 - DNA, 261 bp, Artificial Sequence
  Description of Artificial Sequence: Synthetic coding sequence
atgactgacaggtatactatccattctcagctagaacacttgcagagtaagtacatcggcaccggccatgcggacactaccaagtgggagtggctggtcaaccagcacagagattcttactgcagttacatgggacacttcgatctcctgaattactttgcaatcgcggaaaacgaaagtaaagctagagttcggttcaacttaatggaaaagatgcttcaaccctgcgggccacccgctgataaaccggaggaaaattag

SEQ ID NO: 24419 - DNA, 3012 bp, Artificial Sequence
  Description of Artificial Sequence: Synthetic coding sequence
atgtacggggcaagcggcggaagagcaaaacccgagcggaaaagtggagctaaggaggaagctggaccgggaggcgctggcggtggcggaagcagggtggaattacttgttttcggctatgcatgcaaactgtttcgagacgacgagagagctctcgctcaagagcagggccaacacctgataccttggatgggcgaccacaagatactgattgaccggtacgacgggcgagggcaccttcacgatctgagtgagtatgacgctgagtacagcacgtggaaccgcgattatcagctcagtgaggaagaagctcgcattgaggccttgtgcgatgaggagaggtatctggcattgcatacagatctcctggaggaggaggctaggcaggaggaggaatataagcgattgagcgaagccctggctgaggacggatcatacaatgctgtcgggttcacctacgggtcggactattatgatcctagtgagcccactgaagaagaggaaccttcaaaacagagggaaaagaacgaggctgaaaatctcgaagagaacgaggaacccttcgtcgctcctctgggtctgagcgtgcccagcgacgtagaactgccgccaaccgcaaagatgcatgctataatcgagagaaccgcctcttttgtttgccggcagggggctcagttcgaaatcatgctgaaggcgaaacaggccaggaacagtcagttcgacttcctgaggttcgatcattacctcaacccatactacaaatttatccaaaaggctatgaaggaggggcgttacacggtgctggccgagaacaaatcagatgaaaagaaaaagagcggggtgagtagcgataatgaggatgatgacgacgaagaggacggaaactacttgcacccctctctgttcgcatctaaaaaatgtaataggctagaggaactaatgaaacccctgaaagtggtggaccctgatcatcccttggcggcattggtgcgcaaagcccaggctgatagcagtacacccaccccacacaatgccgatggagccccagtacagccatctcaagtggagtatacagctgactccactgtggccgcaatgtattatagctactacatgctgccggacggcacatactgccttgctccccctcctccaggcatcgacgttacgacatactatagcactctacccgctggagtgacagtaagtaacagtccaggtgtcactaccacggctccgcctcctcccggaaccacacccttgccacccccaactaccgctgaaacttcatctggggctacgagtaccacgactaccacaagtgccttggcacccgtggccgcaatcatccccccaccccctgatgtgcaacccgtgattgataagttggctgaatatgtggctaggaatggcctgaagttcgagacaagcgttcgcgcaaaaaatgatcagcgctttgagttcctccagccctggcatcagtacaatgcctattacgagttcaagaaacagttcttcctccagaaagaaggaggagactccatgcaggccgtctctgccccagaggaggcccctactgattccgccccagaaaaaccctctgacgcaggcgaggatggcgcacccgaggacgctgccgaagtgggcgcacgcgctggctccggtggcaaaaaagaggcaagcagttcaaaaaccgtgccggatggaaagctggtgaaagctagtttcgctccaataagtttcgccattaaagccaaagagaacgaccttctgcctctggaaaagaatagggtgaagttagatgatgattctgatgatgacgaggagtccaaagagggacaggagtcttcctcatccgctgctaacacaaatcccgctgtagctcctccgtgtgtggttgtggaggaaaagaagccccagctgactcaggaagaattggaggctaagcaggcaaagcagaaactcgaagacagactggctgccgcagcgagggagaagctggctcaggcctctaaagaatctaaagagaagcagctgcaggccgagcgcaaacgaaaggccgcactatttcttcagactctcaagaatcccctccccgaggccgaagccggaaagatcgaggaaagcccctttagcgttgaagagtctagcacgactccgtgccccctccttactgggggacggcctctcccaacgctagaggtcaagcctcccgaccgaccgagctcaaagagcaaagatccgccaagagaagaagaaaaggagaagaagaagaagaagcacaaaaaacggtccagaactcgctccaggtcaccaaagtaccattcatcatccaagagtcggtcccggagccactccaaagccaagcactccctgccatctgcgtaccgtaccgtgcggcgttcacgggtgacagcctcccccggaacattgcgagccgagccgtgtcagtccagcgcttcggtgacagctgcagccgaacccggaagctaccaagccgctagtactacaactcggttcgattctgccagcagtttcgagggtaaaccgggaaaaacgtcaagatctaggagcaggtcaccgagacgccgagcgcattctcccgaacgtcgtagagaggagaggtcagtccccacagcatatcgcgtatcccgttcacctggcgcatcgaggaagaggactaggtctcgcagcccccatgaaaagaagaagaagaggcgtagcagaagccgaaccaagtcaaaggctcgttctcagtcagttagcccctctaaacaggcggcacccagaccagctgccccagcagcacacagcgcacacagcgcctccgtctctccagtggaatcgaggggctcgagtcaggagagaagcagaggagtatctcaggaaaaagaagcccaaatctcatccgctattgtgtcttctgttcagtccaaaatcacccaagacctaatggccaaagtccgcgcaatgcttgctgcaagcaaaaatttgcagacctcagcatcctag

SEQ ID NO: 24420 - DNA, 2856 bp, Artificial Sequence
  Description of Artificial Sequence: Synthetic coding sequence
atgtatggagccagcggcggtcgggcaaaacccgagcgtaaatcaggcgctaaggaggaagccggtccagggggagcagggggtggtggcagtagggtcgaattgttagtgttcggatatgcttgtaagctctttagggacgacgaacgcgctctggctcaggagcaaggacaacacttaattccatggatgggggaccacaagattctgattgatcgttacgacggacgcggtcatctccatgatctctcggagtacgatgcagaatactccacttggaatcgggactatcagttgagcgaagaggaggctcggatcgaggcgctgtgcgatgaggagcggtacctggctctccatacagacctgctcgaagaggaggcaaggcaggaggaggaatacaaaagactgtccgaagcacttgcggaagacgggtcttacaacgccgtgggattcacatatggttccgactactacgaccccagtgagcctaccgaggaggaagagcctagtaagcaaagagaaaagaatgaggcggagaatctggaggagaacgaagagccctttgtggcccctctggggctctctgtcccttctgacgtcgaattaccccctactgctaaaatgcacgccattattgagcggaccgcaagtttcgtgtgtcgtcaaggagcccagttcgaaatcatgcttaaggcaaagcaggcgaggaattcccaattcgatttcctgcggttcgaccattatctgaatccttattacaaatttattcagaaagccatgaaggagggaaggtatacagtgctggccgagaacaaaagtgatgaaaaaaagaagtctggcgtgtctagtgacaacgaggatgatgatgacgaagaagatggcaactatttgcatccctcattattcgcaagtaaaaagtgtaatagactggaggagcttatgaaacctctgaaggtggtcgaccctgaccaccccttggctgcattggtccggaaagcgcaagcagactctagcacccctaccccgcacaatgcggacggcgctcccgtgcagccctctcaggtcgagtacactgctgattctaccgtagctgccatgtactattcatactacatgctaccggacgggacttattgtctcgccccaccgccacctgggatcgacgtcacgacttactactctaccctccccgctggagtgaccgtatcaaactcccctggtgtaaccacgaccgctccaccccctcctgggacaaccccgctccctccccctacgaccgctgagacaagtagcggcgctacctccacgactactacaacaagcgctctcgcacccgttgctgccatcatcccccctccaccggacgttcaaccagtgatagataagctggctgaatatgtggctcgtaacgggctgaaattcgaaacctcggtgagagccaagaacgaccagagatttgaatttctccaaccttggcatcaatacaatgcctattatgagttcaaaaaacagttctttttgcagaaagagggcggtgacagcatgcaggccgttagcgctccggaagaagcccctaccgatagtgctccggaaaagcccagtgatgccggagaagatggggctccggaagacgctgctgaagttggtgcaagggccggttcaggcggaaaaaaggaagcctctagcagtaagaccgtgccagatggcaaactcgtgaaggcgagctttgctccgatttcatttgctatcaaggcaaaagaaaacgacctactgccgttggagaagaaccgcgtgaagctggatgatgattcggacgacgacgaggagagcaaagaaggacaagaatctagttcatctgcagccaatacaaatcctgcggtggctcccccttgtgtcgtcgttgaggagaagaagccccaactcacccaagaagagttggaggccaaacaggccaaacagaaacttgaggatagactcgcagcagcagcaagagagaagctcgcccaggcaagtaaagagtcgaaggagaaacagctgcaagccgaaaggaagcgcaaagctgccctgttccttcagactctaaaaaaccctctcccggaggccgaggcaggcaagatcgaggaaagcccattcagcgtagaagagtcatcaacaactccctgcccgttactgacgggaggacgacccctaccaacactggaagtgaagccgcctgataggccctcctcaaagtctaaggaccctccccgagaagaggagaaggaaaagaagaagaagaagcacaaaaagcgcagtaggacaagaagccgctcccctaaataccattcttcttcaaagtccaggagtaggtcccatagtaaggcgaaacactccttaccctctgcctatcgaaccgtgagaaggagcaggtcccgtagtcgtagtccacggaggcgcgctcacagtcccgagaggagaagagaagagcgatcagtgccaaccgcctacagggtgtcaagaagccctggggcatccagaaaacggactcgttcccgcagccctcacgaaaaaaaaaaaaagagaagatcacgctctaggactaagagtaaggcccgttcccaaagtgtgagcccatccaaacaggcggctccaaggcctgctgcccctgcggctcactccgcccacagtgcttccgtgtctcctgtagagagtcggggttcaagtcaggagcgaagtcgcggtgtgagtcaggagaaggaggctcagatttcctctgcaatcgtgagttccgtgcagtcaaagataacccaggatcttatggctaaagtccgggctatgctcgcagcaagcaaaaacttgcaaaccagcgcctcctag

SEQ ID NO: 24421 - DNA, 1644 bp, Artificial Sequence
  Description of Artificial Sequence: Synthetic coding sequence
atgggcgatcacaaaattctcattgataggtacgatggacgcggacacctgcatgatctgtcagaatatgatgccgagtactcaacgtggaaccgcgattatcagctctctgaagaagaagcacggatagaggctttgtgtgatgaggagaggtatctggcccttcacacagaccttcttgaggaagaggctagacaggaggaagagtataagagactgagcgaggctctcgctgaagatggaagctataacgccgtgggcttcacctacggcagcgactactacgaccccagcgagccaacagaggaagaggagccctccaagcagagagaaaaaaacgaggcggagaatttagaggagaacgaggaaccattcgtggcccctctcgggctgagcgtaccgtccgacgttgagctgcccccaactgccaagatgcatgctatcattgagaggactgcgtcctttgtgtgccgccaaggcgctcaatttgagataatgctcaaggccaagcaagccagaaacagtcagttcgactttttacgctttgaccattatctgaacccctactacaaattcattcagaaggcgatgaaggagggcaggtataccgtgttagctgaaaacaaaagcgatgagaagaaaaagtcaggagtaagctctgataacgaagacgatgacgatgaagaagacgggaattatctacacccctcactcttcgctagcaagaagtgcaataggctcgaggaactgatgaagcctttgaaggtggtggaccccgaccaccctctggcagctctggtgcggaaggcacaggcggacagcagtaccccaacacctcacaacgccgacggtgcacccgtgcagccatcccaggttgagtacaccgccgacagtaccgtcgccgctatgtactactcctactacatgctgccagatggaacatactgcctagctccccctcctcccggtattgatgtgacgacatattacagtaccctgcccgctggagttactgtcagcaatagcccaggggtgacgactactgccccaccaccgccagggacaacccccctgccccctcctaccacagccgaaacttcctcaggtgccacaagcacaactacgacaacttccgccctagccccagtggcagcaatcatcccgcctcccccagatgtacagcctgtgattgataaactggcagagtatgttgccagaaacggcctcaagtttgagacttctgtacgcgctaagaacgatcagaggttcgagttcctacagccgtggcaccaatacaacgcttattatgagttcaagaaacagtttttcttgcagaaagagggaggcgattcgatgcaagccgtctctgccccagaagaagcacccacagacagcgctccagagaagccttccgacgcaggcgaggatggcgcacccgaggatgcagcagaggtaggcgcacgagctgggagcggtggaaagaaggaggcatcttcgtcgaaaacggtacccgatggtaagctcgtcaaagcatcctttgcccctatcagctttgctattaaggccaaagagaacgacctgctgccgctcgaaaagaaccgcaaaaagcgcaaaaaacgtaagagaaaaagcactaagaagtag

SEQ ID NO: 24422 - DNA, 2091 bp, Artificial Sequence
  Description of Artificial Sequence: Synthetic coding sequence
atggaagtgagttctccatcgccagcccaaaggctcaggcgaaaaaagcgcccaatggttcagggcccagccggttgtcaggtgtttcagccatcaccaagcggcggtacggccggagatccaggcggactttcagatccattctaccctccgcgaagcggctccctggccctgggagatccgagcagcgaccccgcttgtagtcaaagtgggcctatggaggccgaggaagatagcttgcccgagcagcctgaggattcagcccaattgcagcaggagaagccctcactgtacattggagtccgtggcactgtggttcgctctatgcaagaagtcctatggactcggctgcgagagctgcccgacccagtgctgtccgaagaggtggtggagggtatagcagcaggaatcgaggccgctctctgggacctcacacaaggtacaaatgggagatataagaccaagtacagaagtctgctgtttaacttgcgagacccgagaaacctggatctgttcctcaaagttgttcacggggatgttaccccctatgacctggtgcgcatgtcttccatgcagctcgcaccgcaggagttggcccgatggcgcgatcaagaggaaaagcggggactgaatatcattgaacaacagcagaaagagccctgtaggctccctgccagtaaaatgacgcacaagggtgaggttgaaatccagcgcgacatggaccagacgctcaccctcgaggacttagtagggccacagatgttcatggactgctcaccacaggccctccccattgcctccgaggacacaaccggacagcacgatcatcacttcctagaccccaattgtcatatctgcaaagattgggagccaagcaatgagcttctcggttcattcgaggccgctaagtcatgtggcgataacatttttcagaaggcacttagccaaactcctatgcctgccccagagatgcctaagacacgggagctgagtcctacggaaccacaggacagagtaccccctagcggcctgcacgttcccgctgcccctaccaaggcgcttccctgcctcccgccatgggaaggtgtgctagatatgttttcaattaagcggttccgcgctagagcacagttggtgtctggacactcttgtaggctggtgcaggctctccctaccgtgataagatcagccggttgcataccctctaatattgtgtgggacctcctggcctcaatctgtcccgctaaggccaaggatgtgtgcgtcgtgcgcctgtgcccacacggtgccagggacactcaaaattgccgtttattatactcgtatctcaatgacagacaaaggcacggtctggctagtgtcgagcatatgggcatggtgctccttcctctgccggcattccagcccttgcctacacgcttgcggccacttggaggacctggtctggaagttacccatagcagcttattgctggccgtgcttttgcctaaagaaggtcttccggacacagctggcagctctccctggctcggtaaagtccagaagatggtatcattcaactcaaaagtagaaaagagatattatcaacccgacgataggcgaccgaacgtccccttaaagggtaccccaccgcctggcggtgcctggcagcagtctcagggacggggttcgatcgcccctagaggtatttccgcctggcagcggccaccaagaggcagggggagactgtggccggagcctgagaactggcaacaccctgggagagggcagtggcccccagagccaggacttcggcagtcccagcacccttatagcgtcgcccctgctgggcacgggttcggtcggggacaacatttccaccgcgactcctgtccacatcaagctcttctcaggcacctggaatccctcgctacaatgtctcaccagttgcaggccctgttgtgtccacagacaaaatcatccattccccgtccattgcagcgtctttcttcagcactcgcggcaccagagccaccaggcccagcccgtgacagctcgcttggtcccaccgacgaggcaggcagcgagtgcccatttcccaggaaagcttag

SEQ ID NO: 24423 - DNA, 1032 bp, Artificial Sequence
  Description of Artificial Sequence: Synthetic coding sequence
ggtactaaatgtctggaatccttgttggggtctgtgccaccgccttgtcccggactgcactccctgcgcgagctgcctgatcctgtgttatcagaggaggtggtcgagggaattgcagccggtatcgaagcagctctgtgggacctaactcaaggaaccaacgggcgttataaaactaagtacaggagtcttttatttaatctccgcgatccccgaaatctagacctcttcctgaaggtcgtacatggcgatgtgacaccctacgacctggtgcgcatgtcgtctatgcaactggcaccacaggaactcgcacgttggcgggatcaggaggagaaacgcggactgaacatcattgaacagcagcagaaggaaccctgccggctcccagcgagtaagatgacccacaagggagaggtggagatacagagagacatggaccagacactgacactggaggacctggggcctcagatgttcatggattgcagcccgcaagccctacctatcgcaagtgaagataccacgggtcaacacgatcaccactttcttgatcccaactgccacatatgtaaagattgggaaccctctaacgaattgctgggctcctttgaggctgccaaatcatgcggagacaatattttccaaaaagccttaagtcaaacccccatgcctcctccttgggagggggtattagacatgttcagtatcaagcgcttccgagccagggcccagttggtctcaggccactcctgccgcctcgtgcaggctttaccgaccgtgataagatcggccggttgcatcccaagcaatattgtctgggatctgttagccagcatctgtcctgccaaagctaaggtgtggagatctctcacacaagtctgttgctggttgtgttgtagtcctcgaaaaggttttcaaacccagcagggacccgcacccggttgggggagattcaaacgttggtcaccgagcacagtgcgctggaggagggatacgatcagccaaatgacaggcggtcgaatgtgtccttag

SEQ ID NO: 24424 - DNA, 3651 bp, Artificial Sequence
  Description of Artificial Sequence: Synthetic coding sequence
atgtctcaggccggagacgtggagggacccagcactggggacccggtcctcagcccccaacataattgcgagctcttgcagaacatggaaggagcgagctccatgcctgggctgtcccccgatggacctggagcatcctccggacccggagtcagggctggatcccgcaggaagataccccgaaaagaggcactgagaggaggtagcagccgcgctgcgggtgccgctgaagtacgacctggggttctggaattgctggccgtagttcagtccagaggaagcatgctggccccaggactgcatatgcagcttccaagcgtaccgacccaaggaagagccctcacttcaaagagactgcaggtctccctctgcgatatcctagatgactcatgtccgagaaagctttgttcgcggtctgccggacttcctgaacgagctctagcctgccgggagcgacttgcaggggtggaggaagtgtcttgtctgcgaccacgggaggcacgcgatggcggaatgtcatctccaggttgcgacagacggtcaccgaccctgtctaaggaggagccgccaggaagacccctgactagctcgcccgaccccgtgcccgtgcgtgtccgtaaaaagtggaggcggcagggagcacactccgagtgcgaggaaggtgcaggggattttctctggctggatcaatcgcctcgtggagataacctgctgtccgttggcgatccccctcaggtggcggacctggaatctctggggggaccgtgccggccaccgtccccgaaagacacaggtagcggccctggcgaacccggagggagtggggctgggtgtgcatccggcacggaaaagtttggctacctccccgctaccggggatggcccacagcctggatctccatgtggcccagtcggttttcccgtgccttcaggcggagagtccctgtctagcgctgcgcaggcacctccccaaagcgcagcattgtgcctgggggcatctgcccaggcaagcgccgagcagcaagaggctgtctgcgtagtaagaacaggatcggacgagggccaggcaccagcccaggaccaagaggaactggaagcgaaagctcagccagcgagccgcggacgtctagagcaggggttggcagcgccagccgacacgtgcgctagctctagagaacctcttgggggattgtcttcctcattggataccgaggctagcagagcttgctctggacccttcatggaacagcgcagatctaaaggaacaaagaaccttaagaaaggacccgttccctgcgcacaggaccgtgggactgaccgctcctctgacaattcacaccaggaccggccagaagagcctagtcctggaggctgccctaggctcgaagaggtgaaaatccctcatggggtaaaattggtatgctatctgggcagtggtcccgtgatacagttactgggagctatcagccatgggcaggcaggcggtcaactgccacctaaattagaagttcttgaagacttgatggaggtttcatcacccagtccagctcaacgcctaagaagaaagaagcggccaatggtgcaggggccagccggttgtcaggtttttcagccaagccccagcggtggtactgctggcgacccaggcggtctctctgatcccttctaccctccacgtagtggcagcttggctttaggcgatccctcctcagatcctgcctgttctcaaagcggaccaatggaagctgaagaggattccctccccgagcagcccgaagactctgcccagttgcagcaagaaaagccctccctgtacattggtgtcagaggcaccgttgtgcgctctatgcaggaggtcctgtggacccgcttaagggagcttccagaccctgtcttgtccgaagaggtggtcgagggcatcgccgctggcatcgaagcagctctgtgggacctgacacaaggcactaatgggaggtacaagaccaaatatagatctttactgttcaatttgcgcgatcctaggaacttagacttatttcttaaggttgtccacggtgacgttacaccttacgacctcgtcagaatgagcagtatgcagctagcgcctcaggagctcgccaggtggcgggaccaggaggaaaaaagaggattgaacattatcgagcagcagcaaaaggagccctgccgattgccagcttctaaaatgacccataaaggagaggtggaaatacaacgggatatggatcagaccctgacacttgaggacctcgtgggccctcaaatgttcatggactgctcaccgcaagccctcccaattgcgtccgaggacaccactggccaacacgaccaccacttcttggatcctaactgccatatttgtaaggactgggagccgtcgaatgaactgctcggttcttttgaagctgccaagtcgtgtggggacaacatcttccagaaggcactgtctcaaactcccatgcctgccccagaaatgccaaaaactagagagctgagccccacagagcctcaagaccgcgtgccacccagtggcctgcacgtgccggctgctccaaccaaggccctgccctgcctgcccccatgggagggcgttttggatatgttctccatcaaacggtttagggccagggcccaacttgtttctggtcatagttgcaggctcgtgcaggccctgcctactgttatccggtctgcaggctgcattccctccaacatagtgtgggatctgctggccagcatttgcccagctaaggccaaagatgtttgtgtggtccgactgtgccctcatggggctagagatacgcagaactgtcggctgctctacagctacctaaatgacagacagcgacatggcttggccagtgttgaacacatgggcatggttctgctgcctcttccggctttccaacccctgccaactcgcctgcggccactggggggacctggattgtgggccctgccggtaagtcctttgctgagcccaggcctggaagtcacgcattccagtttactgttggccgtgctactgcccaaggaaggactcccggatacagcagggagctcaccctggttaggcaaagttcagaagatggtgagctttaattcaaaggtcgaaaaacggtattatcaacccgacgaccgaagacctaacgtcccactgaaaggcaccccaccgccagggggagcctggcaacagtcccaggggaggggttctattgctccccgaggaatctcggcgtggcagcgacctcccagaggcaggggtagactttggcccgagccagagaactggcaacaccccggtcgagggcagtggcctccggaacccggactacggcagtcacagcatccctacagcgtagcccctgccggtcatggctttggtcgaggacagcacttccatcgagatagctgtcctcaccaggctctgctacgacacctggagtccctcgccacaatgtcacaccagctccaggctttgctgtgcccgcagactaagtcctccattccaaggccgttacaaagactttcttcagctctggccgcaccagagccacctggccctgcaagagacagcagcctcggcccaactgacgaggctggtagcgagtgcccattccctagaaaggcctag

SEQ ID NO: 24425 - DNA, 1635 bp, Artificial Sequence
  Description of Artificial Sequence: Synthetic coding sequence
atgtctcaggcaggggacgtcgagggccctagtactggcgatcctgtactctctccccagcacaactgtgagcttcttcagaacatggaaggtgcttcctctatgcccggtctgtcaccagatgggccaggggcatcttccggccctggcgtacgggcaggcagccggaggaagataccgagaaaggaggcacttcgaggcggtagctcaagagccgcaggagccgctgaggtgcgtcccggtgtgctggaactcctggcagtcgtacagtcccggggatctatgctagcccctggattgcacatgcagttaccttcagtccctactcaaggcagagctttgacctctaagcggttgcaagtttccctttgcgatattcttgatgacagttgccctcgaaagctgtgttccagaagcgctggtctcccagagcgagcattggcatgcagggagcggctcgctggggttgaggaagtttcttgcttgcgtccacgcgaggccagggatggcggtatgtcatccccaggttgcgaccgcaggtctcccacccttagcaaagaagaaccgccaggtagaccgctcacttcttccccggaccccgtgcccgtgagggttcgcaagaagtggcgacgacagggagcacattcagagtgtgaggaaggcgcaggggattttttgtggttagaccagagtcctcgcggagataacctcttatccgtaggggatcccccacaggtagcagatttggaatctttgggaggcccatgccgcccaccctctcccaaggataccggcagcggccctggggaacccggtggatccggcgctggatgcgcatcaggtacggagaaatttggctatctgcccgctaccggggatggcccacagccaggaagtccatgtggtcccgtcggattcccagtgccctcaggcggagaatctttgtctagcgctgctcaggcacctccacaaagcgctgccctttgtctgggagcctcagctcaagcttccgcggagcaacaggaagcggtctgtgttgtacggaccggatctgacgagggccaggcccctgcccaagatcaggaggaattggaagctaaggctcagcctgccagtagaggccgactggagcagggcttagcagctcccgctgacacctgtgcttccagccgcgagcctttagggggtctgagttccagcttagacactgaggccagcagagcctgttcaggtcccttcatggagcagcggagatccaagggcaccaaaaacctcaagaagggacccgtgccgtgcgcgcaagacagagggacagacaggtccagtgacaactcccaccaagaccgacccgaggagccctccccaggtggctgcccgcgattggaggaggtcaagattccacatggggtgaagctggtgtgttacgtgtttcagcccagtccctccggcggaaccgccggtgaccctggaggactatcagatcctttttacccccctcgcagtggaagtttggccctgggagatccttctagcgaccccgcatgctcacaatccgggcctatggaggccgaggaggatagccttcctgagcagcctgaagatagcgcttttggcagcagtcagacccagtgttag

SEQ ID NO: 24426 - DNA, 810 bp, Artificial Sequence
  Description of Artificial Sequence: Synthetic coding sequence
atgcaggaggtgctgtggacgcgcttgagggaattgccagatccggtcctgtccgaggaggtggtggagggcattgcagctggtattgaggcggctttatgggatctcacacaagggactaacggtcggtataagacaaagtatcgctctctgctgttcaatctgcgagacccaagaaatctggatctattcctcaaagtggtccatggcgatgtcaccccctacgacctggttcggatgagctcgatgcagctggccccacaggaactggcgaggtggagagaccaggaggagaaaagggggccacagatgttcatggactgtagcccccaagcgttaccgatcgcgtcagaggataccactggacaacacgatcaccactttctcgaccctaactgtcatatttgcaaagactgggaacccagtaacgagctgctgggaagtttcgaggctgccaagtcttgtggagataacatctttcaaaaggccctctcacagactcccatgcccgcacctgaaatgccgaagactcgcgagctatctcccactgagcctcaggaccgatgtggggtcggcagcagggaagtggacaatcccgcaggtctgcgcggtcgtcctccccctggggctacggacatcgcactggcattcccagtgtggccctgggcaagtctgccctccctgggcaatctaacgtttcctatttgtgctatggaattgatcatacccgcttcgtggcagcctcccgcacagggccaggcatgggcgtcagtccccgtgccaacggtagggacccaggatctgctatag

SEQ ID NO: 24427 - DNA, 63 bp, Artificial Sequence
  Description of Artificial Sequence: Synthetic coding sequence
atggaagtgagctccccctctccagcccagagactgagacgtaaaaaaaggccaatggtgtag

SEQ ID NO: 24428 - DNA, 264 bp, Artificial Sequence
  Description of Artificial Sequence: Synthetic coding sequence
atggaagtctccagcccaagtccagctcagcgcctgaggcggaaaaagcggcctatggtacagggtcctgccggatgtcaagtgtttcagcccagccctagcggcggtacagccggtgaccccggtggcctaagcgatcctttttatcctcctcgatccggaagcttggcgctgggtgatccatcctcggatccagcgtgtagccaatcaggccctatggaggctgaggaggacagtttgccagagcagcctgaagattcctag

SEQ ID NO: 24429 - DNA, 3612 bp, Artificial Sequence
  Description of Artificial Sequence: Synthetic coding sequence
atgagtcaggccggtgacgtcgagggtccaagcaccggggaccccgtgctgagccctcagcataactgtgagctgctgcagaacatggagggcgcttcttccatgccagggttatcccccgatggccctggagcttcttctggccctggcgtgcgagccggttctaggaggaagattcctagaaaagaggctctccggggaggcagttcccgggctgcaggagctgcggaagtgcgccctggcgtactggaattgctggctgtcgttcagagccgagggagcatgcttgctcccggtcttcacatgcagctgccctcagtgcctacgcaagggcgtgccctgacttcaaaacgcctccaagtcagtctgtgcgacatcctcgacgattcctgcccaagaaaactgtgctcccgcagcgcaggcctgcctgaaagagccttggcgtgccgagagcgcctcgcaggggtggaagaggtctcgtgcctgcgtcctcgagaagccagagacggcggtatgtccagcccaggttgcgacaggcgcagcccaacactgagcaaggaggagcctcctggaaggcccttaaccagttcacccgatccggtccctgtacgggttcgtaaaaaatggcggaggcagggcgctcactccgaatgtgaagagggggctggagattttttgtggctcgaccagtcaccaaggggtgacaatttgctcagcgtcggagatccgcctcaagttgccgatctggaaagtctggggggaccttgtcgtcctccaagcccaaaagacacgggaagtgggccaggggagcccggtggctccggcgcaggatgcgcaagcggaaccgagaaattcggatatctgccagcaaccggcgatggccctcaaccgggaagcccttgcgggccagtaggatttcctgtgccaagtggcggagagagtctaagctccgctgcccaggcccctccgcagagtgctgccctgtgtctgggtgcatcggcacaggcctcagccgaacagcaggaggcagtgtgcgtggttaggactggctcggatgagggccaggccccagctcaggatcaggaagagctggaggctaaggcccaaccagcaagccgcggtcgattagagcagggactagctgcacccgcagatacctgcgctagtagtcgggaacccctgggtggtcttagcagctctctagacacggaagcatcaagagcctgttctggtcctttcatggaacagaggaggagcaaaggaaccaagaacctcaagaaggggcctgtgccctgtgcccaggaccggggtaccgacaggtcctctgacaactctcaccaggataggcctgaagaacctagtcctggaggctgccccaggttggaggaggtcaagatcccacacggcgtcaagctggtgtgttacctgggaagtggaccagtcatccagttgttgggggctatttctcacgggcaggccggaggccagctccctccaaagctggaagtgctcgaagaccttatggaagtgagctcgcctagccccgctcagagattgagaagaaaaaagaggccaatggtacagggcccagcaggctgtcaagtgtttcaaccaagtcctagtgggggaacagccggagaccctggaggtctttccgatcccttctacccacctagatctggtagcctcgcactcggcgatccaagcagtgaccctgcatgcagtcagagcggccctatggaagccgaagaggacagcctgcccgagcagccagaggactcagcccagctccagcaagagaagccctctctctacataggggtacgcggtaccgtcgtgagatccatgcaagaggtcctgtggactcgactgagggaactccccgatcccgtcttgagcgaagaagtcgttgagggaatcgctgcaggcatcgaagccgcactgtgggatctcacccagggaaccaatgggaggtacaaaacaaaataccggagcctgctgtttaatctacgggatccaaggaacctcgacctgtttttgaaggtcgttcatggcgatgtgacaccttatgaccttgtgaggatgtcctccatgcagctcgcacctcaggaactcgctagatggcgggaccaggaggagaaaagaggccttaacatcatcgaacagcagcaaaaggagccttgcagacttccggctagcaagatgacacataagggcgaagtggagattcagcgggacatggaccaaactcttaccttggaggatctcgtcggaccccaaatgttcatggactgtagcccccaggctctcccaattgcatcggaggataccactggccagcacgatcatcattttctggatccaaactgtcacatatgtaaggactgggaaccatccaatgagctattggggtcgttcgaagcagcgaagagttgcggagacaatatcttccagaaagcattgtcccagacccccatgcctgcacccgagatgcccaagaccagagaactttcccctactgaacctcaggaccgggttccaccctccgggcttcatgtcccagctgcgcctaccaaagcgctgccctgcctgccaccttgggagggcgttctggacatgttttccatcaaaaggttcagggcacgggcacagcttgtatccgggcactcttgtcgacttgttcaggctctccccacagtgattcggtccgcaggctgcattcctagcaatatagtttgggacctcctagccagtatttgccctgccaaggccaaggatgtctgcgttgtgagactgtgtcctcacggagccagagacactcaaaactgcaggctgctgtatagctatctgaatgaccgccagagacacggtctggccagtgtggaacacatgggtatggttctattacccctgccggctttccaaccgttaccaacacgattgaggccgctgggaggtcccggattggaagtaactcactcttctctcctgcttgcagtgctccttcctaaagaaggcttacctgacactgccggttcatcaccctggttaggaaaggtgcagaagatggtgagcttcaatagcaaagttgaaaagcggtactaccagccagacgatcggagacccaacgtccccttgaagggcaccccaccgccaggcggtgcctggcaacagtcgcagggcaggggctccattgcacccagagggattagtgcttggcaacgtcccccacgcggtcgcggacgactatggccagaacccgaaaattggcagcaccctggaaggggccagtggcctcctgagccgggtctccgccaatcccagcacccatactcagtggctcccgctgggcatggttttggccgaggacagcactttcacagggatagttgcccacaccaggcactcctaaggcatctcgaaagtctggctaccatgtctcaccaactgcaggcccttttatgcccccagaccaagtcctctatcccaaggcctctccagcgattgtcctctgcgttagctgcacctgagcccccagggcctgcccgtgattcatctctgggtccaactgatgaggccggatcagaatgtccattccccaggaaagcttag

SEQ ID NO: 24430 - DNA, 3939 bp, Artificial Sequence
  Description of Artificial Sequence: Synthetic coding sequence
atggaggaggaagacgagtccagagggaagaccgaagagtcaggggaggaccgcggagatggcccaccggaccgcgatcccaccctttcacctagcgcatttatactgcgagccatacagcaggcagtcggatcttctcttcagggggacctgcctaatgacaaagacgggagcaggtgccacggactgaggtggcggaggtgccggtcccccaggtctgagccacgcagtcaggaatccggcggtacagacactgcaactgtgctcgacatggctacagactcatttttggctgggctcgtgtctgtcttggaccccccagatacttgggttccttctagattagacctgcgtcctggcgagtcggaagacatgctggagttggttgccgaggtccggatcggggacagagaccccattcccctgcccgtgcccagtttattgccccgtctgagagcctggcggacaggaaagactgtctcccctcagtccaactcctcacgaccgacctgtgctaggcatctgacgctgggtactggagacggagggccagctccaccacccgcaccaagttccgcgtcatctagccctagcccctccccttcctcaagttccccctctccaccacccccaccaccacccccagcccctcctgccccacctgcaccaagattcgacatctacgatccattccaccctaccgatgaagcttactcaccgcctcctgccccagagcagaagtacgacccatttgaaccgaccgggtcaaacccttcttctagtgctggcaccccgtccccagaagaggaggaagaggaggaggaggaggaagaggaggaagaagaggatgaggaggaggaggagggactatctcaatctatctcccgaatctctgaaactcttgccggaatttacgatgacaattcgcttagccaggattttcccggagatgagtcccctagacccgatgcccaaccgacacagccaacgccagctcccggtactccccctcaagttgattccaccagagctgacggtgccatgcggaggagggtctttgtggtgggcaccgaggctgaagcctgtagggagggaaaagtatcagtggaggtggtcactgcgggaggagccgcactaccacctcctctactaccgccaggcgactctgaaatcgaggagggggaaattgtgcagccagaggaggagcccaggctagctttgtcgctgttcaggccaggaggcagggcagcacggccaactccagccgctagcgcaacacccacagctcagccattaccccagcctcctgcccctagggcccctgagggagacgattttttgtcactgcacgctgaaagcgatggtgaaggtgcccttcaggtcgaccttggagaaccagccccagcgcctcctgccgcagattcacggtggggtggcctagacttgcgcagaaaaattctcacccagcggagggagagatacagacagaggtcaccatcccccgctcctgctcccgcaccagcagccgcagcgggaccacccacccgcaaaaaatccagacgcgaaaggaaacgtagcggggaggcgaaagaagcggcaagcagcagttctggtacacagccggctccgcctgccccagcaagcccctgggatagtaaaaagcataggagcagagatcgcaaacctggctcccatgcttccagtagtgcacgacggaggtcacggagccggtcccgaagtagatccacaaggaggcgatcccggagtactgatagaagacgcggagggagcaggcgcagtagaagccgggagaaaagaaggaggcggaggcgttcggcatctccaccaccagccacctcaagtagcagtagctctcgacgcgaaaggcacagggggaagcacagagacggcggaggctcaaagaagaagaagaaacgatcaaggagccgcggtgagaagaggtcaggagacgggtccgagaaagctcccgcaccggctcccccaccctccggctccaccagctgtggcgatcgggactctaggcgcaggggcgcagtacctcccagcatacaggacctcacagatcatgacctattcgccattaagcggactatcactgtggggaggctggacaagagcgatcccagagggccatcaccggcacctgcatcatctcccaagcgggaggttctctatgactccgaaggactctccggagaggaacggggtgggaagagttcccagaaggataggagacgcagcggagccgcatcttcatctagctcttcgagggagaaaggctctcggagaaaggcattagacgggggagatagagatagagatcgtgatcgcgaccgtgatcgtgatcgctcctctaaaaaagcccgtccacccaaagagtcagcccctagcagcggtccaccaccaaaaccgccagtgtcatccggatccggatcttccagttcttctagttcttgcagctctagaaaagtgaaactccagagcaaagtcgcggtcctaatccgcgagggcgtcagctctacgactcccgcaaaggatgccgcttcagccggactgggaagtataggcgtaaagtttagtcgggaccgggagagtagaagcccttttctgaaacccgatgagcgggctcctacggaaatggctaaggcggcacctggctctactaagcctaaaaagacgaaagtcaaggccaaggctggggcaaagaagactaaaggcaccaagggtaagacgaagccctcaaagacgcgcaagaaggtgcgctcaggaggaggctctgggggtagcgggggacaggtgtcactgaaaaaaagcaaggcagattcctgttcacaagcggcaggaaccaaaggtgctgaggagacttcctggtccggggaagagcgggctgccaaggtgccatccacacctccacctaaggcagcacctcccccaccagcacttaccccagacagtcagaccgtagatagctcatgtaagacccccgaggtgtctttcctccctgaggaggcgaccgaagaagccggtgtgaggggaggggcagaggaagaggaagaggaggaagaagaggaggaggaggaggaggaggaagaggaacaacaaccagcgactacaacagccacttccaccgcggctgcagcaccaagcacagctcctagcgccggatctactgccggtgactccggggctgaagacggaccagcctcaagagtctcccagttgccgacattacccccacctatgccctggaatctacccgctggtgtggactgcacaacctccggggtattggccctcaccgctctgctatttaagatggaagaagccaacctcgcctcacgcgctaaagcccaggagctgatccaggctaccaaccagatccttagccaccgcaagccgcctagttccttggggatgacccccgctcccgtacctaccagtctcggactaccaccaggacccagtagctatctcctgccgggtagcctgccgcttggaggttgcggttccacaccacccacccccactgggctggccgctaccagcgataaacgcgagggttccagttcttcagaaggcaggggcgatacagataaatacctcaagaagctgcatacccaggagcgggctgtggaggaagtgaaactagctatcaagccctattaccagaaaaaggacatcacgaaggaagaatacaaggacatactaagaaaggcggtccacaagatctgccactccaaaagtggggagattaatcctgtcaaagtgtcaaacctggtgcgggcttatgtccagaggtacagatacttccggaagcacgggaggaaacccggagatccacctggacctccccgacctccaaaagagcctggcccaccagacaaaggcggacctggtctgcccttgcccccactgtag

SEQ ID NO: 24431 - DNA, 660 bp, Artificial Sequence
  Description of Artificial Sequence: Synthetic coding sequence
atggaggaggaagacgaatcgagaggtaaaaccgaagaaagcggcgaggacaggggggacggcccacctgacagagaccccaccctctctcctagcgcgttcatcctgagggctatccagcaggcagttggctcatcactgcagggcgatttgcctaacgataaggatggctcacgctgtcacggactgagatggaggaggtgtagatctccccgtagcgaaccccgtagccaggagagtggtgggaccgacaccgcaactgtccttgacatggcaactgatagcttcctcgccggactggtatctgttttagacccacctgatacatgggtgccttccagattggacctgcggcctggcgaaagcgaagatatgctggagctggtggccgaggttagaattggcgaccgagacccaatccctttgcctgtgccctccttactgcctcgcctccgtgcatggcgaacggggaaaacagtcagcccccagtccaacagctcccgtccaacatgtgctagacacctcactcttgggacaggggatgggccttgtccaacaccttgtccacttctctgcatcctgctacccttccccttctcactgattttcctgcctttcccaagcccaacccctaccgcaccaagcccacagtttcattag

SEQ ID NO: 24432 - DNA, 3444 bp, Artificial Sequence
  Description of Artificial Sequence: Synthetic coding sequence
atggacgccgttaatgctttcaaccaggagcttttctccctgatggatatgaagcctccaatctctcgggctaagatgatactgattaccaaggccgcaatcaaggccattaagctctataagcacgttgttcaaattgtggagaagttcattaagaagtgcaaacccgaatacaaagttccaggcctctacgtgatcgactcaatcgtgagacagtccagacatcaattcggcacggacaaagacgtcttcggccctcgtttcagcaaaaacatcaccgccacctttcagtacttgtacctctgcccctctgaggacaagtcaaagatagtgcgtgtcttaaacctctggcaaaaaaatggggtctttaaaattgaaattatacagcccttgcttgacatggcagctggaacctcaaacgccgcacctgttgcagagaacgttaccaacaatgagggctcaccacctccgccagtgaaagtctcctccgagccaccgactcaggccactcccaacagcgtccctgccgtgccccagctgccttccagtgacgccttcgcagcagtggcccagctttttcaaactacccagggccagcagttgcagcagatactccagaccttccagcaaccgccaaaacctcagtccccagctctggacaacgccgtcatggcccaggtgcaagcgatcacggcacagctcaagaccacccctacacagccctccgaacagaaagcagctttcccaccacctgagcagaaaacagccttcgataaaaaactcttggatagattcgactacgacgatgagcctgaggcagtcgaagaaagcaagaaggaggacacgactgctgtcacaaccacagccccagcagccgctgtaccccctgcaccaaccgctacagtgcctgctgcagctgcaccagcagctgccagcccacctccacctcaagcacctttcggcttccctggagatggtatgcaacagcccgcatatacgcagcaccaaaacatggaccagttccagcccaggatgatgggaatccagcaggacccaatgcaccatcaagtccccctcccacctaatggtcaaatgcctggcttcggcttactccccacacctccattcccccctatggcacagccagtaattccccctacgccccctgtgcagcagcctttccaggcatcttttcaggcacagaacgaacctctgactcagaaaccccaccaacaggagatggaagtggaacagccatgcattcaagaagttaaacgccatatgtcggacaatcgtaagagtcggtcacggagcgcttccaggtcgcctaagcgcagaagatcccggtccggatcccgcagccggaggagcagacatcgcaggtcacgctcacgtagtagggaccggaggaggcactcccctaggtcccgaagccaagagaggcgagatagggagaaagagcgtgagcgcaggcagaagggcctgccacaggttaagccggagaccgcctccgtgtgttctactactctttgggttggccaactggataagcgcacgacccagcaagacgtagcctctttactggaggaatttggccctatcgagagcatcaatatgataccgcctcgaggatgcgcttatattgtcatggtgcacaggcaagatgcttacagggctttacagaagctcagtaggggaaactacaaggtaaaccagaaatccatcaagatagcatgggctctgaataaaggcatcaaggccgactacaaacagtattgggacgtagagttaggtgtcacatatataccttgggataaggtaaagcccgaggaactcgaatctttctgcgaggggggtatgctggacagcgatacgcttaatcccgattggaaagggatccctaagaagcctgaaaacgaagtagcccagaacggcggtgcagagacatcccatacggagcctgtgagcccgattccaaagccacttccggtgcccgttccaccaattccagtacccgctccaattaccgtaccgcctccacaagtccccccacaccagccgggacctcctgtggtgggagctttgcagccacctgcattcacgcctcccctcggtataccccctccgggatttggcccaggggttccgccacctccgcctcccccacccttcctccgaccgggattcaatcctatgcaccttcctcccggattcctgccaccaggtcctcctccgcctatcacgcctccagtgagtatcccccctccccacaccccacctatcagcatccccaattccaccatagccggaatcaacgaggataccacgaaggatctcagcatcggcaatcccatacctacagttgtgtctggcgctcgtggtaatgccgaaagcggggactccgtgaagatgtacggctcggctgtgcctcctgcagcccctacaaatctgccgacacctcccgtgacacagcctgtgtcacttctagggacccaaggggtcgcaccgggacctgtgattggtctgcaggcacctagtaccggcctcctgggtgctcgacctggcctgataccactgcagcgcccacccggaatgccaccaccccatctgcagcgcttcccgttgatgccccctcgacctatgcctccccacatgatgcacagagggcctcccccaggccctgggggattcgcaatgccaccgcctcacggcatgaaggggccatttccaccacatgggccattcgtgcggcctggaggcatgcccggtttaggcggaccgggtccgggacccggaggtcctgaggacagagatggtcgccagcagccgccacaacaaccccagcaacagcctcagccccaggctccccagcagccgcagcagcagcaacagcagcaaccgccaccttcacaacagccacctcctactcaacagcaacctcagcagttccgtaacgataatcggcaacagtttaatagcggcagagatcaagaaaggtttgggagacgcagcttcggtaatcgcgtcgagaatgatcgcgaacgctacggcaacagaaatgatgatcgggacaatagcaatagagaccgcagagagtggggaagacgtagtcctgacagggatcggcacagggatcttgaagagagaaacagaagatcgtcaggacaccgtgaccgagaaagggactctagagatcgcgagtctcgcagagaaaaagaggaggctcggggaaaagagaagccagaggtcacggaccgcgctggcggaaataagaccgtggagcctcccatctcccaggtgggtaacgttgacacagcctctgaactggagaaaggcgtctccgaggcagcagttctgaagccctccgaggaactgcctgccgaggcgacttcctctgtggaaccagagaaggattccggatctgcggcagaagccccaagatag

SEQ ID NO: 24433 - DNA, 3378 bp, Artificial Sequence
  Description of Artificial Sequence: Synthetic coding sequence
atggacgctgtgaacgctttcaatcaggagctgtttagtctgatggatatgaaacccccaattagtagggctaaaatgatccttataaccaaagccgctatcaaagcaataaagctctataagcacgtagtgcagatcgtcgagaagtttatcaaaaagtgcaagcccgaatacaaagtgcccggtctgtacgtgatcgactccattgtccgtcaatcacgccatcagttcggaacagacaaggatgtgttcgggccaaggttcagtaaaaatatcactgctaccttccaatatctgtatctctgtccgagcgaggacaagtccaagattgtgagagtcctgaacctgtggcaaaaaaatggtgtcttcaagatagagattatccagcctctgctggacatggcagccggaacctccaacgccgcaccagtggctgagaacgtgacaaacaacgaaggtagccctcctccacctgttaaagtctcctccgagcccccaacgcaagctacacccaactccgtgccagcagtgccacaactgccttctagtgacgcattcgccgctgtggcccagcttttccagaccacccagggccagcaattgcagcagatcttgcagacctttcagcagccccctaaaccccaatcacctgctttggataatgctgtgatggctcaggtgcaggccattactgcccagctcaagacaaccccgacgcaacctagcgagcagaaagcagccttccccccacctgagcagaagaccgcttttgataaaaagctcctggacaggttcgactacgacgatgagcccgaagctgtggaagaaagcaaaaaggaagacacaacagcagtcacaaccactgcccctgcagcagccgtccccccagcgccaaccgccaccgtgcccgctgctgcagccccagccgcagcctcccctccaccacctcaggctcctttcggattccccggtgatggaatgcagcagcctgcttacacccagcatcaaaacatggaccagtttcagccacggatgatgggtatacagcaggatccaatgcatcatcaggtcccgttgccacccaatggtcaaatgcctggtttcggcctgttgcctactcctccatttccgccaatggctcagccagtgatcccacccaccccccctgtgcagcagcccttccaggcatctttccaggcacagaatgagcctcttacacaaaagccacaccagcaagagatggaagtggaacagccatgtatccaggaagtgaagaggcatatgagtgataacaggaagtctcgcagtcgatcagcttctcgttctccaaagagaaggagatcccggagcggtagccggtctcgccgaagccggcaccgcaggagccgcagcaggagccgcgaccggagacggcattctccccgatccaggagtcaagagcgaagggatcgagagaaagaaagggagaggaggcagaaaggcttaccgcaggttaaaccagagactgccagcgtttgtagcaccaccctgtgggtcgggcagctcgacaagcgaaccactcagcaggacgtggcgtctctgctcgaggagtttggacccatagagtctattaacatgatcccacctcggggatgcgcttatatcgtcatggttcacagacaagacgcttatcgggctttacagaagttgagccgagggaactacaaagtcaatcagaagagtattaagattgcctgggctttgaacaagggcattaaagctgactataagcagtattgggacgttgagttaggcgtcacctacattccgtgggataaggtaaaacctgaggaacttgagagtttctgtgagggagggatgttggattctgacactctcaaccccgactggaaaggaatccctaagaaacccgaaaatgaggttgctcagaacggcggagcagaaactagccacactgagcccgtctcacccattcccaaaccattgccggtacctgtgcccccaatccctgtgcccgcacctatcaccgtgcctccaccgcaggtgccccctcaccaacccggaccacctgttgttggcgcactccaaccaccagccttcaccccaccactgggtataccgccacccggattcggtccaggagtgccaccaccgcctccacctcccccttttctgcgccctggctttaaccccatgcatctgcccccagggtttctgccccctgggcctccaccaccaatcacgcctcccgtgtctattcctcccccacacaccccccctatcagcatccctaacctggtgtccggtgctcgcggaaacgccgagtcaggcgactccgttaaaatgtacgggtctgcggttccccctgcagccccaaccaacctacctactcctcccgtcacacagccagtctccctgctgggtacacagggggtggcacccggaccagtcatcgggctacaggcaccatcaacaggccttttgggtgctcggcctgggcttataccactgcagcggccaccaggcatgccccctccgcacctccagagatttccgctcatgcccccacggcctatgcctccccatatgatgcatagaggccctccacccggtcccggtggattcgccatgcctcccccacacgggatgaagggccctttcccgccacatggcccatttgtccgccctggtgggatgcccggattgggaggacccggacccggaccagggggaccggaagacagagatggtcggcagcagccaccgcagcaaccccagcagcagcctcaaccacaggctccacaacagccgcagcagcagcagcagcaacagccgccaccttcgcaacagcctccccctacacagcaacagcctcagcagttccggaacgataaccgtcaacaatttaattcaggacgcgaccaggagcggtttggcaggagatcattcggtaatcgggtcgagaacgacagggaaagatatggtaatcgtaacgatgatcgcgacaacagcaacagggaccggcgagagtggggacgcaggagtccggatagagaccgccaccgagatctggaagagcgcaatagaaggtcctctgggcatcgggaccgtgagcgggacagtagagaccgggaaagcaggcgcgagaaagaagaggcacgcggtaaggagaagcctgaggtgaccgatcgagcaggaggcaataaaaccgtcgaaccccctatcagccaagttgggaatgtcgacacagctagcgagctcgagaaaggggtgagcgaagccgctgtgctgaaacccagtgaggaactacctgccgaagctacttccagcgtagaacccgaaaaagactccgggtccgcagcagaagctcctcgttag

SEQ ID NO: 24434 - DNA, 3399 bp, Artificial Sequence
  Description of Artificial Sequence: Synthetic coding sequence
atggacgcagtcaatgcctttaatcaagaactatttagcctgatggacatgaagccaccaatcagtagagctaaaatgatcctgataactaaggccgctattaaggctatcaaatgcaagcctgagtataaggtgcccggattgtatgtgattgacagtatcgtcaggcagagcagacaccagttcgggacagataaagatgtcttcggcccacgatttagcaaaaacattactgctacctttcagtacctctacctgtgcccgtctgaggacaagtctaaaatcgtgcgcgtcttaaacttgtggcagaaaaacggagtgtttaagattgagattattcaacccctcctggacatggcagcgggtaccagtaatgctgcaccagtggcggagaatgtcacaaacaacgagggatctccccctcctcccgtcaaagtgtcctctgagcccccaactcaggctacaccaaactcagtgcccgcagtcccacaattgccgagttctgatgcttttgccgctgtggcacagctttttcagaccacccagggacagcagctgcagcagattctgcagactttccagcagcctcctaaacctcagtcaccagcactggataatgcagtcatggcccaagtccaggctatcacggcccaattgaagacaacccctacccaaccgtccgaacagaaagcagcttttccccctcctgaacagaaaacagccttcgataaaaaactgcttgataggttcgattacgatgatgagccggaggcagtggaggagtctaagaaggaagacacaacagcagttactaccaccgctccagctgctgccgtgccccctgccccaaccgctactgtgcccgcagctgcagcgcctgccgctgccagtcccccaccacctcaggctccgtttggattccctggagacggcatgcagcagccagcgtatacacaacatcagaatatggatcagttccaacctagaatgatgggtattcaacaggacccaatgcaccatcaggtgccactgccaccaaatggccagatgcctggttttggcttgttgcccacaccacccttcccccctatggcccaaccagtcatcccgcctacacccccagtgcagcagccgttccaggcatcatttcaagcccagaatgaacctcttacccaaaagccgcaccaacaggaaatggaggtggagcaaccatgtattcaagaagttaagaggcatatgtccgacaaccgaaagtcccggagcaggtcagccagcagatcccccaaaagacggcgttccagaagtgggagccgctctcggagaagcaggcatcgtaggagccggtcgcgtagcagagaccggcgaaggcactcccccaggtcgcggtcacaggaacgcagggacagggaaaaggagcgcgagcgtcgtcagaaaggcttgcctcaggtcaagcctgaaacagcatcggtgtgtagcaccaccctctgggttggtcagcttgacaagcggaccactcaacaagatgtcgcgtctcttctggaagaatttggacctattgagtctatcaacatgatccctcccagggggtgcgcctatatcgtgatggttcatcgccaagacgcgtacagggccctgcagaaactgagtagaggcaactataaagtgaaccagaagagtattaagattgcttgggccctgaacaaaggcattaaagccgattacaagcagtattgggatgtagaactcggggtgacgtatatcccatgggataaagttaaacctgaggagctggagagcttctgcgaggggggtatgttggactctgacactcttaaccccgactggaagggcattccgaagaagcctgagaatgaagtggcgcagaatggaggcgcagaaacttcacacactgagcccgtgagcccaattcctaagcctttacctgttccggtgccacccattcctgtgcctgctcccatcacagtgcctcccccacaggtgccccctcaccagccaggtccacctgttgtgggggcactgcagccgcctgcttttaccccaccactcggtatcccccctccaggctttggtccaggcgtgccgcctccgcctccaccgcctcccttccttcggcctgggtttaaccctatgcatctgccgcctggtttccttccccctgggcctccccctcccatcacccctcccgtgagcatacctcctccccatacccccccaatttccataccgaacagtaccatagccggtataaacgaggacacaaccaaggatctgtccatcggcaatccaattcctacggtggtctcaggggcacggggaaacgcagaatcaggcgactccgtgaagatgtacggctcagccgtcccacctgcagcaccgaccaacctcccaaccccccctgtcacgcagccagtgagtctactaggaacccagggggtagctccgggtcctgtgatcggtttacaggctccctccaccggtcttctcggcgctcggccaggtctaatccctctgcaacgacctcctgggatgcctcccccacacctacagaggtttcccctgatgccccctaggcccatgccccctcacatgatgcatcggggaccaccacctggacccggaggattcgccatgcctccccctcatggaatgaagggaccctttcctccacatggaccgtttgtgcgaccagggggaatgcccggtcttggcggtcccggaccgggacccggtgggcctgaggaccgagatgggagacagcagccaccacagcagcctcagcagcagccccagccgcaagctccacagcagccacagcagcagcagcagcagcaaccaccaccctctcagcagccccctcctacccagcagcagccccagcaatttcgtaacgacaaccgacagcagttcaatagcgggagggatcaggagcggttcgggcgacgatcgtttggcaatcgcgtggaaaacgaccgcgaacggtatgggaatcgaaatgacgacagagacaatagcaacagagatcggcgtgagtggggcagaagatcccctgatagagaccgtcatcgagacctcgaggagcgaaatagacgatcatcaggccacagggaccgagaacgagattcgagggaccgagaatcccgacgggaaaaggaagaggctagaggaaaggaaaaacctgaggttacagacagggccggaggaaacaagaccgtggagccgccaatttcccaagtggggaatgtggacaccgcctccgagctggagaaaggcgtttccgaagccgcagttctgaaaccatctgaggaactgcccgcagaagccacttcatccgttgagccggagaaagattccgggtccgcagccgaggcgcctcgttag

SEQ ID NO: 24435 - DNA, 3816 bp, Artificial Sequence
  Description of Artificial Sequence: Synthetic coding sequence
atggaggcggttaagacatttaatagtgagctttactctcttaatgattataaaccacccatctcaaaagcaaagatgacccagatcaccaaggccgcaattaaggcaattaaattctataagcatgtcgtccagtccgtggagaagttcattcagaagtgtaagccagaatataaagtccccggtctgtatgtgatcgattcaatcgtccgtcagtctcgacatcagttcggtcaggaaaaggacgtgtttgccccacgattctccaacaatatcatttctacttttcagaatctgtatcgctgtcccggagacgataaatctaaaattgtccgggttctaaacctgtggcaaaagaataatgtcttcaaaagtgaaattatccagcctctcctcgacatggccgcaggcattccgccaccagtggtgactcccgtgctcgcctctacaaccacggccatgtctaacactccaggcacacccgtcaccccggtgacccccgcaaacgtggtacaaggattacctgatccttgggtttcccagataaccaacaccgataccctggctgcagtcgcacagatactccagagcccccaaggccagcaactacaacagttgattcaaaccttgcaaatccagcagcaaaagccacagccttccattttgcaggccctggatgccggtctggtggtgcagctccaggctctgacagcccagctgacagctgccgctgcggcagccaacactctcacacccctggagcagggggtgtcattcaataagaagctgatggaccggttcgacttcggggaggatagcgagcactccgaggaacctaagaaagaaatccctgccagccagctgagccacgtcagcgaatccgtgaacaactccatcttccatcaaatcgcggaacaactacagcagcagaacctggagcatctgcggcaacaactcctggagcaacaacagcctcagaaagcgacaccccaggactcgcaagagggaacttttggctctgagcactctgcatccccctctcagggaagctcccaacagcactttttggagcctgaagtgaatttagatgactctatcgatattcagcaacaggacatggatatcgatgagggacaagacggcgtggaggaggaggtattcgagcaggaggctaaaaaggtggccgtaaggagcaggagtaggacccactcgaggtccaggtcgagaagtccaagaaagcggagatccaggtcaaggagcggttcccggaagaggaaacacagaaagcgtagtaggagccgtagcagggagaggaagagaaagtcctctagatcctatagctccgagcgcagagcacgagaacgcgagaaggaacggcagaaaaaggggcttcccccaataaggtctaaaactctaagcgtctgctctactaccctatgggtggggcaagtcgacaagaaggctacgcagcaagatcttacaaacctgtttgaggagtttgggcagattgaaagtatcaatatgataccgcctcgtggctgcgcttatgtgtgcatggtccaccggcaggacgcattccgggctttacagaagctgagctccgggtcatacaagatcggatctaaagtgatcaagattgcgtgggccctaaataagggggtgaagaccgagtacaagcagttttgggacgttgacctcggcgtgacctacattccctgggaaaaggtgaaggtggatgatctggaagggtttgccgagggcggaatgattgaccaggaaaccgttaataccgaatgggagacagtcaagtcttccgaaccggttaaggagactgtgcagacaacccaaagtcctacccccgtggaaaaagaaacagttgtaacgacgcaggcagaggttttcccccctcccgtcgcgatgttgcagatcccagtcgctcccgctgtgcccaccgtgtctctagtgcccccagcatttcctgtgagtatgccagtgcctcctcccggttttagcccgattcctccgccaccattcctgcgggctagtttcaacccctcccagcccccaccaggctttatgccgccacccgtccctcctccagtggttccgcctcctaccattccgccagtggtccccacaagtctggtgcagcccagcctgtctatgacccccgaaacggtcaaagacgtgggcttcggcagccttgtaattccagggggatcagtcgcaagcaatctggccacctccgccctaccagcaggaaacgtattcaacgccccaaccaaacaggcagaacccgaggaaaaagtgccccaccttattgatcatcagatcagttctggagaaaataccaggtccgtcatcccaaatgacatctcttcaaacgcagctatactggggggacagcccccaaatgtcacgagcaattccggaattctcggcgtgcagaggcccaacgtgagcagcaactcagagatcctgggcgtgagaccgtccaacgtgtctagttctagcggcataattgcagctcagccaccaaatatccttaataatagtggtattttgggcatccagccgccttcggtcagcaatagtagcggccttttaggcgtcctgcccccaaatattcctaacaactcaggcttggtaggagttcaaccacctaacgtgcctaacaccccaggtctgctcggtactcagcctccggctgggcctcaaaatctgccaccgctgtctataccaaaccagcggatgccaacaatgcctatgctggacatcagaccgggactcattccgcaggcccctgggccaagattccctctcattcagcccggaattccaccccagcgagggatccctcccccaagcgtactggacagtgctctgcaccctccaccccgaggcccatttcccccaggggacattttctctcagcccgaacgaccttttctcgccccaggccgtcagagcgtggataatgtgaccaatcccgagaaacgcatccctctcggcaatgataatatccagcaggaaggggatagggactaccggtttcccccaattgaaacccgagaaagcattagccggccacctcccgtcgatgtgcgcgacgtcgtggggaggccaatcgatccaagggagggacccggtcgacctcctctggacggccgagaccacttcggcagacctcctgtggacatcagagagaatcttgtccggcctggaattgatcacctgggacgcagagaccatttcggcttcaatccggagaaaccctggggccacaggggagactttgatgaacgcgaacacagggtgttacctgtctacggaggtcctaagggtctgcacgaggagcgcggtagatttagatctggtaactacaggtttgatccgagaagtggaccttggaatcggggtttcggccaggaagttcaccgagatttcgatgacaggaggcgcccttgggaacggcagcgggacagggatgacagggatttcgacttctgccgcgagatgaatggaaataggcttggtcgggatcgcatacaaaatacctgggtgccccctccccacgcgcgagttttcgattacttcgagggggctacttcccaacgcaaaggggacaacgtaccccaggtaaatggggagaacaccgaaagacacgcacagccaccgcctatccctgtgcagaacgaccctgaactgtacgaaaagctaacttcatccaatgaaatcaacaaagagaaaagtgatacagtcgcggatatcgagtctgaacccgtggtcgagtctacagaaacagagggcacctag

SEQ ID NO: 24436 - DNA, 4014 bp, Artificial Sequence
  Description of Artificial Sequence: Synthetic coding sequence
atgccgcaacctctactgcctgccctcccccctctcagctcccctagcggtgcagggagctgcggaccatccgggggagagtgctctgggcgtcgtctgtttcgtagacgggctcgtggactgcggagtgataacatggaggctgtgaaaacctttaatagcgaagattgcgcctccacgccagcatgcactgattgtttctccagcagtatggacacaagaagcattctgtatagcttaaatgattacaagccccctatctctaaggccaagatgacacagataaccaaggcagctatcaaagctattaagttctataagcacgtggtgcagagcgtagagaaatttatccaaaaatgtaagcctgagtataaagtcccaggcctgtatgttatcgacagcattgtcagacaatctcgtcatcagttcggccaagagaaagatgtctttgcccctcgcttcagtaacaacattataagtaccttccagaacttgtacaggtgtccgggtgacgataagagtaagatcgtccgggtgctgaatctatggcagaaaaataacgtgttcaaatctgaaattatacagccactgctagacatggccgctgggattcctccaccagtggtgacgccagtgctcgcaagcacaaccactgcaatgagtaacacccccggaacacccgtcaccccagtgacaccggctaatgtggtgcaaggactaccggatccatgggtctctcagattactaacacagacacgctggccgcagtcgcccagattctgcagtccccccagggccagcaattacagcagctcatacagacactgcagattcagcagcagaagccgcagccttccattctccaagccctcgatgccggacttgtggtgcagctgcaggcacttaccgcccagctgaccgccgctgcagccgctgccaacacccttactccactcgagcagggggtcagctttaacaagaaattaatggataggtttgacttcggcgaagacagcgagcactccgaagagccaaagaaggagataccggctagccagcttagccatgtctccgaaagcgtaaataattccatttttcatcagatcgctgagcagcttcaacagcagaaccttgagcatctcagacagcaactgttggagcagcagcaaccccagaaggcaacgccgcaggacagccaagaggggactttcggttccgagcactcagcgtctccctcacagggcagtagtcagcaacactttttggagccagaggtgaaccttgatgactccattgacattcaacagcaagatatggatatagatgagggccaggatggggtggaggaagaggtctttgagcaggaagctaaaaaagtggcagtaaggagtcgctcaagaacccactccaggagccgctccaggagccccaggaagaggaggtcgagatctaggagcggctccaggaagaggaagcataggaagagaagtcgtagtagatcacgagagaggaagcggaagtcttctaggtcctactcttctgaacgacgcgctagagaaagggaaaaagagagacagaaaaagggccttccgccaatcaggagtaagaccctctccgtgtgctccacgaccctctgggtcgggcaagttgataagaaagctacccagcaagacctgaccaacctctttgaagagtttggccaaatcgaaagtataaatatgattccccctaggggttgcgcctacgtgtgtatggttcaccgccaggatgcatttagagcactgcagaagctgtcctctggcagctacaaaattgggagcaaagtcattaagatagcttgggcattgaataagggcgttaaaaccgagtacaagcagttctgggacgtggatctcggggtcacatatatcccatgggagaaggttaaggttgacgacttggaaggctttgcggaggggggtatgattgatcaggagaccgtgaatacagagtgggaaaccgtgaagtcatcagagcctgtgaaggagaccgtgcagaccacgcagagccctactccggttgagaaagagactgtggtaacgacccaggctgaagtgtttccccctcccgtagccatgctgcagataccagtcgctccagctgtgcccactgtatcattggtcccgcctgcctttcctgtcagcatgcccgttccaccacctggtttctcccccatccctccaccaccgtttctgcgcgcttccttcaacccatcacagccccctccaggctttatgccacccccagtccccccacctgtggtcccgccaccgacaattccaccagttgtccctacgtcgctggttcagccctctctttctatgacaccagaaactgtgaaggatgtggggttcggatccctggtgatccccggaggctctgtggcaagtaatctagcaacatctgccttacccgcagggaatgtgtttaacgccccaaccaagcaggcggagccggaggaaaaagtgccgcacttaattgaccaccagatctccagcggcgagaatacaaggtcagttattcccaacgacatcagctctaatgccgctatactcggtggccagccacctaatgtcacctcaaacagcgggatcctgggagtgcagagaccaaacgtttcctcaaactctgaaatcctgggagtgcgcccatctaacgtgtcatcctcttcaggtatcatcgccgcacagcctcctaacatcctgaataacagtggcattcttggaatccagccgccttccgtgtccaactcatcgggcctcctgggcgtgctgccgcctaacatccctaacaatagcggtttggtcggggtgcagccccctaatgttccaaacactcccggacttctcgggacccagcccccagctggccctcagaacttgcctcccctgagcatcccgaatcaaagaatgcctactatgcctatgttggacattcgcccaggtttaatcccccaggctcccggaccacgctttccgctgatccaacctggtatccctcctcagcggggtattccccctcccagtgtcctggatagtgctttgcatccaccccctagggggccttttcccccaggcgatatcttctctcagcccgagcgcccattcctggcgccaggccgacagtctgtcgacaacgtcacgaatcccgagaaacgcattccactcggaaatgataatatacagcaggagggcgatcgggactaccgcttccccccaatcgaaacacgcgaatcaatttccagacctcctcctgtggacgtgcgggatgtggtggggcgacccatcgacccccgtgaaggacctgggcgacctccgctcgacggcagagatcacttcggaaggccacccgtagacattcgcgaaaacctggtccgtcctggtattgaccacctgggcaggcgtgaccatttcggcttcaatcctgagaagccttggggacaccgaggagatttcgacgagcgcgagcaccgggttctgcccgtatatggcggtcctaaggggctgcatgaggagcgagggaggttcagatccggaaactaccgattcgacccgagaagcgggccatggaatcgcggattcggacaggaagttcatcgcgatttcgacgacagacgccgaccttgggaacgacaacgggatcgggatgatcgcgattttgatttctgtcgggagatgaatggcaataggctaggcagagacagaattcagaacacctgggtaccgccaccccacgccagggtttttgactatttcgaaggtgcaacttctcagcgcaagggagacaatgttccacaggtaaacggtgagaacacggaacggcacgcgcagcccccaccaattcctgtgcagaacgatccagagctgtacgagaagctgacctcctccaacgagattaacaaggagaagagcgatactgttgccgatatcgagtccgagcccgtggtggagtccaccgaaacggaaggcacatag

SEQ ID NO: 24437 - DNA, 3816 bp, Artificial Sequence
  Description of Artificial Sequence: Synthetic coding sequence
atggaggccgtgaagacattcaactccgaactctattccttgaacgactacaaacctcctatctcgaaggctaagatgacacaaatcactaaggcggctatcaaggcaattaagttttacaaacatgtggtgcagagcgttgagaagtttattcagaaatgcaagcctgaatataaggtgcccggtctgtacgtaattgatagtatcgtgcgacagtcccgtcaccagttcggtcaagagaaggacgtgtttgcgccacggtttagtaataatattatttccactttccagaacctgtaccgatgccccggagatgacaagagcaaaatcgttagagtcctaaacctgtggcagaagaacaacgtctttaaaagcgaaatcatccaacccttgctggatatggccgcaggcatccctccccctgtcgtgactccagtgctggcttccactacaaccgctatgagcaacactccgggaactccagtcacaccagtgactccagccaacgtggtgcaaggcctccctgatccctgggtctctcagatcactaatacagacacgctcgccgcagttgctcagatcctgcagtccccacagggacagcaattgcaacagctcatccaaactctgcagattcagcagcagaagccgcagccttcaatcctgcaagcgctggatgccggactggtggtgcagcttcaggcactcacagcccagctgacggccgctgccgcagccgctaacactctaacaccgcttgagcagggggtgagcttcaacaagaaacttatggatagatttgattttggcgaagactccgagcattccgaggagcccaagaaggaaatcccggcatcacagctctcacatgtatcagagagcgtcaacaactcaatttttcaccaaatcgcggaacaactgcagcagcaaaacttggaacatctgagacagcagttactggaacagcagcagccccaaaaggccacgccccaggatagccaggagggcacttttgggtcagagcatagcgcatccccaagccagggcagcagtcagcagcatttccttgagcctgaagtaaacctggacgacagcattgatatccaacagcaggacatggacattgatgagggacaagacggtgtcgaagaagaggtctttgagcaggaggcaaagaaggtggctgtgcgctcccgcagtagaacacactcccgatctcggagccggtcccccaggaaaagacgctcaaggagccggagcggcagccgcaagcgaaaacatcgcaaaagaagccgttccaggagcagagagcggaagcggaagtcatccaggagttattcctctgagcggcgagcacgagaaagggagaaagaacggcaaaagaaaggcttgcctcctatccgttctaagaccctgtccgtgtgttccacgaccctttgggtcgggcaggtcgataagaaggccacacagcaggacctgactaaccttttcgaggagttcggacagattgagtctattaacatgatcccacccagagggtgcgcctacgtttgtatggtgcatcgccaggacgctttcagagcgctccagaagctttcctcaggaagctataagatagggagcaaggtcatcaagatcgcttgggcattgaacaagggagtgaaaaccgaatacaaacagttctgggacgttgatctgggcgtcacatatatcccctgggagaaagtcaaggttgatgacctcgaggggtttgcagagggcggtatgatcgaccaagaaactgtgaacacagagtgggagactgttaagagttccgaacccgtgaaagagacggtgcagaccacccagagcccgacgcctgtcgagaaggagactgtggttaccacacaggccgaagttttcccgcctcccgtcgctatgctgcaaattcctgtcgccccagcagttcccactgttagcttggttccaccggcttttcctgtttccatgcctgtgccgcctccaggcttctcccccataccaccaccccctttccttcgggcttcattcaatccttcacagcccccaccgggttttatgccaccccctgtcccccctcccgtagtgccacctcccacgatcccccctgttgtgcctaccagccttgtacagccaagcctgtcaatgacacctgaaaccgtgaaggatgtgggattcgggagcctggtgatcccgggtggctctgtagcgagtaacctcgcaacctctgctctccctgccggaaatgtgtttaatgctccaacgaaacaagccgaacctgaggagaaagtgccccacctgattgaccaccaaatcagcagcggtgagaatacaaggagtgtgattccaaatgacattagcagtaatgctgccatattggggggtcaacctcccaatgttacttcaaactctgggatcctcggtgttcaaaggcccaacgtttcaagtaacagtgagatcctaggcgtccgacccagtaatgtctccagctcgagcggaataatcgctgcccaacctccaaacatactcaataatagtggaatattggggatacaacctcctagtgttagcaatagtagcggcctccttggggttctcccgcctaatatccccaacaatagcggactggtaggtgttcagcctcctaatgtgcccaatactcccggtcttttggggacgcagccccctgctggtccgcagaatctgccgccactttccattcctaaccagaggatgcccaccatgcccatgcttgacattaggccaggtcttattccccaggcaccaggaccgagattccctttaatccagcctggaatcccaccccagcgaggcattccccctccaagcgtcctcgattccgccctgcacccaccgcctcggggaccctttcctcccggagacatatttagccagccagagaggccttttctcgcccctggcagacagagcgttgacaacgttaccaatcccgagaagcggatacctctcgggaacgataacatccagcaggagggcgatcgcgattaccgatttcccccaatagagacaagagagtctatctcacgaccacctcctgtcgacgtgcgcgatgtcgtgggtcgcccaattgatcctcgcgaaggcccaggacgccctcctcttgacgggcgagatcatttcggcagaccacccgtcgatatcagagagaacttggtgagacctgggattgatcatcttggacgcagagatcacttcggctttaatcctgaaaagccctgggggcaccggggagactttgacgaaagagagcatcgggtgctgccagtgtacggtgggcctaagggactgcatgaggagcgtggtcgatttcggagtgggaactatcggtttgatcccaggtccggtccatggaatagagggttcggccaggaggtgcaccgagatttcgatgataggagacggccttgggagcggcaaagagatcgagatgatcgcgattttgacttctgtagagagatgaatggcaatagactgggcagagaccgcattcagaatacctgggtcccccctccccatgcacgcgtatttgactactttgagggagctacaagtcagaggaaaggtgataacgtgccacaggttaatggcgaaaataccgaaaggcatgcacagcctccgccaatccccgtgcagaatgatcccgaattgtacgaaaaactgacttcctcaaacgagatcaataaggaaaagagcgacacagtcgccgacatcgagtccgagccagtggtggagtccactgagacggagggcacctag

SEQ ID NO: 24438 - DNA, 2262 bp, Artificial Sequence
  Description of Artificial Sequence: Synthetic coding sequence
atggaacgggcaaggcccgagccccctccccaacctcggcctctccgaccagctccaccccctctccctgtggagggcacatccttttgggctgccgcaatggaaccaccaccaagctcccccacccttagcgccgcagcatctgctacgctggcttccagttgtggcgaggcagttgccagcgggctgcagccagcggtgaggagactgttgcaagttaagccagaacaggtactcctcttgccccaaccccaggcacagaatgaagaagccgcagcttcatccgctcaggcacggttgctccagttccgtccagacctgcgcctgctgcagcctccaactgcctcagatggggcaacctctagacccgaactgcatcctgtccagcctttggcactccacgttaaagccaagaaacagaaactgggaccttccttggaccagagtgtgggcccacggggagcagtggagaccggcccacgcgcaagcagagtcgtgaaactcgaaggtccaggtcccgctctgggttactttaggggcgacgaaaaaggtaagctggaggctgaggaagttatgagggacagtatgcagggtggtgccggtaagtccccggcagctataagggaaggtgtcatcaagactgaagagcccgagcgcctccttgaagattgccgcttgggcgcagaacccgcatcaaatggcctggtacacggctccgctgaggtgatcttggctcctacctccggtgcgttcggaccacaccagcaggatcttcgcatccctctgactttacacactgttccacctggcgcaagaattcagtttcagggcgctccccctagtgagttgattcgactgaccaaggtcccgctcactcctgtgccgaccaagatgcagagtctgctggagccctctgtaaagatcgagacgaaggatgtacccctaacagtgcttccatccgatgctgggatacctgacacaccattcagcaaggacagaaacggacatgtgaagagacctatgaatgcgtttatggtttgggccaggattcatcgccctgccctggctaaagcaaacccggcagccaataatgccgaaattagtgtgcaactcggtctggagtggaacaaactctccgaagagcagaaaaagccttattacgacgaggcgcagaagatcaaggaaaagcaccgggaagaattccccggatgggtgtatcagcctagacccggtaaacgcaagcgctttccactgagcgtttctaatgtgttttccggaactacacaaaacattataagcacaaatcccacgacggtgtatccgtacaggtcgccaacatactcagtggtgatcccttccctgcagaaccctatcactcacccagtgggggagacatcacccgctattcagctgcccacacccgctgtccagagcccaagcccggtgacactttttcagccctcagtgtcttcggcagcacaggtcgcagtccaggacccgtctttgcccgtgtacccggcattgccacctcagaggttcaccgggccttctcagactgacactcatcagctccattccgaagcgacgcacaccgtcaaacagccaacaccggttagcctggagtcggccaatagaatctcatcatctgctagcactgctcacgcgagatttgctacaagtacgattcaacctccaagggaatactcctctgtttctccatgcccaaggtcggccccaatccctcaggccagcccgataccacacccacacgtctaccagcctccccctctcgggcaccccgctacactgttcgggaccccacctcgattttccttccaccatccttacttcctacccggaccccattatttcccatcttccacgtgtccctattccaggcctccttttggatatggaaatttccctagttcaatgcctgaatgtttatcgtattacgaggaccgttaccctaaacacgaagggattttcagcacactgaatcgggactatagcttccgggattattctagcgagtgcacgcactctgagaattctcggtcttgtgaaaacatgaatgggacctcctactataatagccacagtcactcaggggaagagaacctaaaccctgttccacagctggacatcggaactcttgaaaatgtgtttacggcacctaccagcacgccttcatcaattcagcaggtaaacgttaccgatagcgacgaagaagaagaagaaaaggtgctgagggatttatag

SEQ ID NO: 24439 - DNA, 1506 bp, Artificial Sequence
  Description of Artificial Sequence: Synthetic coding sequence
atggaaagggcccgaccggaacctccaccacagcccagaccactgaggcctgccccacccccactaccagttgaagggacaagtttctgggcagccgctatggaaccccctccttcttcccccacgctgtctgctgctgcctctgccacactcgcctctagctgcggtgaggctgtggcatcagggttacagccagcggtgagacgattactccaggtgaaacccgagcaggtccttctactcccccagccccaggctcagaatgaagaagcggctgcctcgtcagctcaggcacggctgctccagtttcgtcctgacctacggctgttacagcccccaactgcctctgacggagctacctccaggcctgagctccacccagtccagccactcgctctgcatgtcaaggcaaagaagcagaagctgggaccatcactcgaccaatcagtgggtccaagaggagccgtggagacaggtccgagagcttccagagttgtgaagctggagggcccagggccagcccttgggtatttccgcggtgatgaaaagggtaagctggaggccgaagaggtaatgcgagattccatgcagggcggtgcaggtaaaagtccagcagccatccgtgagggagtgatcaaaaccgaggagcctgaaagactcctcgaggactgccggctgggggcagaaccagctagtaatggattggttcatggcagcgccgaagtcatcctggcacccacttctggtgcattcggccctcaccagcaagacctccgcatcccattgactctgcatactgtgcctcccggtgccaggatccaatttcagggcgctcccccttctgagctgattcgactgacaaaagttcctctcacccctgtgcctaccaagatgcagagcctgctggagcccagcgttaaaatcgaaactaaggacgtgccacttaccgtgttaccgtctgacgctgggatacccgacactcccttcagcaaggaccgaaacggtcatgtcaaacgccctatgaatgcttttatggtgtgggcaagaattcatcgcccagcgttggctaaggccaaccccgcagcgaacaacgcagaaatatcggtgcaactgggccttgagtggaacaagctgagcgaagagcaaaaaaaaccctactacgatgaagcacagaaaatcaaggaaaaacacagagaagagttccccggatgggtgtaccagcctagaccgggtaagcggaaacggtttcctttaagcgtatcaaacgtgttctcaggaaccacccaaaacattatcagcactaaccctaccaccgtgtacccataccggtctcccacatattcagtcgtaattccatctctgcagaatccaataacacatccggtcgtacacgcactgacagtaggattacctctggcaatggagatcttccgcgtgcagtgtcagaacgctctggtgattatgaaaactggcacacagaacatgagagtatcttttcagctatag

SEQ ID NO: 24440 - DNA, 585 bp, Artificial Sequence
  Description of Artificial Sequence: Synthetic coding sequence
atgccgtcaagtcccctgcgggttgccgtggtgtgcagttccaaccagaaccgctctatggaggcacataatatactgagcaagcgcggattcagcgtgagaagtttcggaactgggactcacgtgaaactgcccggacctgcacctgacaaaccaaatgtctacgatttcaaaaccacgtacgaccagatgtataacgatctcttgagaaaggacaaggagctgtatacccagaacgggattctgcatatgcttgacagaaacaaacgaatcaagcccaggcccgaacggttccagaactgcaaggacctttttgacctcatactgacttgcgaagagagagtctatgaccaggtcgtggaggacttaaatagccgcgagcaggagacgtgtcagcccgtacatgtggtgaacgtagacattcaggataaccatgaagaagccaccctgggcgcattcctaatctgcgagctctgccagtgtatccagcataccgaggacatggagaacgagattgacgaactcttgcaggagtttgaggagaagtccggacgtacctttctgcacaccgtgtgcttttactag

SEQ ID NO: 24441 - DNA, 462 bp, Artificial Sequence
  Description of Artificial Sequence: Synthetic coding sequence
atgccatcttcccccctgcgtgtggctgttgtgtgctcctctaaccaaaatcgcagcatggaggcccataatatcctgtcaaaacgcggattttccgtaaggtcttttgggactggtacccacgtgaaacttcccggacccgctcccgataaaccgaatgtgtacgacttcaagacaacttatgatcagatgtacaatgatctccttaggaaggacaaggaactgtatccatcgggtttaccattcaagaatccgccttgcggtcccccatggaaagttctgagggtggctagagcccaagaagcgtgtcaccctgtgcagtgcacacattggctgctgtgtctgtgcgaatccctcgtcagtattcctggcgctcgccgtatagtacacggcttggttcccgtgcccccaatggccgttggcgtcgtcagacgcactgatactgtttggggcagcccttag

SEQ ID NO: 24442 - DNA, 489 bp, Artificial Sequence
  Description of Artificial Sequence: Synthetic coding sequence
atgccaagttcacctctgcgggtggcagtggtgtgtagttcgaaccagaatcggtccatggaggcacataatatcctgagcaagagaggcttctctgtgcgctcttttggtactggcactcacgtgaagctgcctggtcctgcacccgacaagcctaacgtctatgacttcaaaacaacctacgatcagatgtataacgacttactgaggaaggacaaagagttgtacactcagaatggaatcctgcatatgctggacagaaataagcggatcaaaccccgacccgagcggtttcagaactgtaaagatctctttgatctcatcctcacatgtgaggaacgggtttacgaccaggtagtggagggcgaagaggccgctgcttgttgggccggactgcaacagctgagccaaggactcggcatgcccgctgggccacatcatgaccaatattcccccagcagagttgcaggggctggcgaacagacctag

SEQ ID NO: 24443 - DNA, 336 bp, Artificial Sequence
  Description of Artificial Sequence: Synthetic coding sequence
atgctggaccggaacaaaaggatcaaaccccgaccggagcggttccagaattgtaaagacctttttgatctgatcttgacttgtgaggagcgtgtctatgatcaagtcgtggaggatctcaattctagggagcaggagacatgccagcccgtgcatgtcgttaatgtggatattcaggacaaccacgaagaagccacgttaggcgcttttctaatatgcgagctttgtcagtgtattcaacacactgaggacatggagaatgagattgacgaactgctgcaggagttcgaggagaagtcgggaaggacgttcctgcacaccgtttgtttttactag

SEQ ID NO: 24444 - DNA, 609 bp, Artificial Sequence
  Description of Artificial Sequence: Synthetic coding sequence
atgttcactgaactgaggtccaaactgagccccccacgaggcagggcaggcgctgtgcgggcaggctttggggagcggagagatgttgacgccactgcccacttcagtttctgcaggaccctgctcgagcataccgtgtctgccgaaagtattccatgtcacctgccccgaactcccggaacctccttgacttggcacgacagcaggtcacagagagctgcatccagtcgccctatcaagctcctgcaacagccgggaaccgatactccccagggacggctgtacagcgatcactatggtctgtatcatacttccccatccctgggcggattaaccaggcccgtcgtcctttggtctcagcaagacgtgtgcaagtggctgaagaagcattgccctcacaattaccttgtttatgttgaagctttctcacagcacgctatcaccggtcgagctcttctgaggcttaacgccgaaaagctgcaaaggatgggactggcccaagaagctcagcggcaagaggttttacagcaggtactgagacttcaggtccgcgaggagggacggagcctgcagctgctttctcaagcgtcattcgggaagatgtcttag

SEQ ID NO: 24445 - DNA, 321 bp, Artificial Sequence
  Description of Artificial Sequence: Synthetic coding sequence
atgttcactgagctccggagcaagctctcaccccctagagggagagccggtgccgtgagagcaggcttcggcgaacgaagagatgtggatggttctgtccacttacagatcccttaccgagctttcattcatagcttcattgacaatgagtgtggggtgccactttgtaaccagacctggataaagacacctgcctcccctgactccgctaccgctcacttctctttttgccgcacgttgctggagcatacggtgtctgctgaatccattccttgccacctgccacggacacccggaaccagtttgacatggcatgattag

SEQ ID NO: 24446 - DNA, 2046 bp, Artificial Sequence
  Description of Artificial Sequence: Synthetic coding sequence
atgagtaagggcattttacaggtgcatcctcccatttgtgattgccccggttgtcggattagctccccagtgaaccgtggcaggcttgctgataaaagaacagtggccttaccagccgctaggaatctgaagaaggagcggaccccgtctttttcagcttcagatggggattcggatgggagcggccctacatgcggacgccgtccaggactcaaacaggaggacggcccacatatcaggatcatgaaaagaagagtacacacccactgggatgtgaacatttcgtttcgagaggcaagttgttctcaggacgggaacctgccaacgcttattagcagcgtgcaccggtctaggcatcttgtgatgcccgagcaccagtcgcgctgcgaattccagagaggctctcttgagatcggactgcgccctgcaggcgacttgctcggcaagcggctgggcagatcgccacgcatatcatccgattgcttttcagaaaagcgagctcgctccgagtcaccccaggaggccttgttactcccacgggagcttggtccctcaatggcgcctgaggatcattatagaaggctggtgtctgctttgtctgaagcttccacttttgaagatcctcagagactctaccatttggggcttccatcgcacggggaggaccccccttggcacgatcctccacatcacctgccgagccacgatttgttgagggttaggcaggaagtagcagccgctgccttacgagggccttcagggctcgaagcacatctgcctagtagtactgcaggccaaaggcggaagcagggattggcacagcaccgggaaggagccgcaccagctgctgccccttctttttccgaacgtgagctgcctcagccacctccactgttatccccacagaatgcccctcatgtggcattaggaccacacctgagacctccattcctcggagtaccgagcgccctatgccagacacccggttatggtttcctcccacctgcacaggcagagatgtttgcatggcaacaagaactgctgcgaaaacagaatctggctcgtctagagctgccagccgacctgctcagacagaaggaacttgagtcggccagaccccagttgctggcccctgagaccgcgttgcgccctaatgacggcgcagaggagctccagcgacggggagcccttctagtactcaaccatggcgcagcaccactgctagcgttgcccccacagggtcctccaggcagtgggccaccgaccccgagtcgtgactctgcacggagggcccctcggaaaggtggccctggcccagcttccgcacgaccaagtgagtccaaagaaatgaccggagctagactgtgggcccaggatgggtcagaggatgagccacccaaggatagcgacggagaagaccccgagaccgctgcagtcggatgcagggggccaacaccaggtcaggcacccgcaggaggcgctggtgcagagggcaagggtctcttccccggatctacgttaccactgggattcccatacgccgttagtccttatttccatacgggggctgtaggcggactgtccatggatggagaggaggccccagccccagaggatgtgacaaagtggaccgtggacgatgtatgtagtttcgtgggagggctcagtggctgcggagaatataccagagtgttccgcgagcaggggatcgacggcgagacactcccgttattaacagaagagcatctcctgaccaacatgggccttaagctcggccctgcactcaaaatacgtgcacaggtcgctagaagactgggccgagtattctacgttgcgagctttccagttgctctgcccctgcagccaccaacacttagagcgccagaaagggagctggggaccggggaacagccactgagccctacaacagctaccagcccctacgggggaggacacgcactcgcaggccaaactagcccgaaacaggagaatgggactttagctctcttacccggtgcaccggatccttcgcaaccgctgtgttag

SEQ ID NO: 24447 - DNA, 540 bp, Artificial Sequence
  Description of Artificial Sequence: Synthetic coding sequence
atgagtaaagggatactccaggtgcacccgcctatctgtgattgtcctggatgcaggatatcttcccccgtcaatagaggcagactcgccgataagaggacagtggccctccctgccgctagaaatctcaagaaagaacgaactccaagcttttcagcgtcggatggggactctgacgggtcagggcctacatgcggacgcaggcctggcctcaaacaagaggacggcccacacatccgaatcatgaaaaggcgcgtgcacacccactgggacgtgaacatcagcttcagagaggcttcatgtagccaagacgggaatcttcccacactgatttcgagtgtacacagaagtcgacatttagtgatgccggaacaccagtccagatgtgaattccaacggggtagtctcgaaatcggcctgcgacctgccggtgatttgcttgggaaacggctcggcaggtcccctcggatctcatccgactgcttttctgagaaaagggctaggagcgagtcccctcaggaggcgctcctgcttccgtag

SEQ ID NO: 24448 - DNA, 330 bp, Artificial Sequence
  Description of Artificial Sequence: Synthetic coding sequence
atgtccaaggggattcttcaagtgcatcctcccatctgtgactgcccgggttgccggatttcctctcccgtaaaccgagggcgtctggctgacaagcggacagtggcgttgcctgccgcaagaaacttaaagaaggaacggactccctccttcagcgcttcagatggagactctgacggaagcggccctacttgcggacgaagaccagggttaaagcaggaagacgggccacacatacggatcatgaagagacgtgtccatactcactgggatgttaatatttcctttcgcgaggcctcatgttcccaggatggaaatttacccacttag

SEQ ID NO: 24449 - DNA, 606 bp, Artificial Sequence
  Description of Artificial Sequence: Synthetic coding sequence
atggccgtggaggccctgcattgcggtttaaatcctagaggcattgaccatcccgctcacgcggaagggatcaaactgcagattgaaggagaaggcgtcgagtctcagtctattaagaataagaattttcagaaggtgccagatcaaaaagggacacctaagcgacttcaggccgaggccgagaccgccaagtctgcaacagtgaagctgtccaaacctgtggcactctggacccagcaggatgtgtgcaagtggctcaagaagcattgcccaaatcagtaccagatttactcagagagtttcaagcagcatgacatcaccgggagggcgttactgcggcttactgataagaaactagaacgaatggggatcgcccaagaaaatctccgacagcacatccttcaacaggtgctgcaattgaaggtgagagaagaggtacgcaacctgcagttgctgacacagggcactctcctgctgccagatggctggatggacggcgagattcgtaggaaaacaacactgctcctgggccagactggtgtccgtgaaaatcttctcctgttcttgcaccggatctcaatcatcgaaaatagcattcaaatatag

SEQ ID NO: 24450 - DNA, 486 bp, Artificial Sequence
  Description of Artificial Sequence: Synthetic coding sequence
atggcagtggaagctctgcactgcggactcaaccctcgcggtatagatcaccccgctcatgcggaaggcataaagctgcagatcgagggggaaggcgtcgagtcacagagcatcaaaaacaaaaattttcagaaggtaccagatcagaaaggcacccctaagcgcctgcaagctgaggccgagacagccaaatctgccaccgtgaaactatccaaaccagtggccctgtggacacaacaggatgtgtgcaaatggcttaagaagcactgccctaaccagtaccagatctatagcgagtctttcaaacagcacgatatcaccggcagggctcttctgcggctaaccgacaagaagttagaacggatgggcattgcccaggaaaatctgcgtcaacacatcctgcagcaggtgctgcagctgaaggttagggaggaagtcaggaatctccagcttctcacgcaggcctcaagcgagggaagtccatag

SEQ ID NO: 24451 - DNA, 279 bp, Artificial Sequence
  Description of Artificial Sequence: Synthetic coding sequence
atgcgcagttgcctgatgcccggtaatgaaatgtctatgacttcccctgagggcacggagcccaaaggcaaacagcggcgatggcagagacaaaagacatttggcggaggcaccatgcattcacaagatagccaggaaattgatggaaagtcactgctgttaatgaccaggaatgacgtcctaactggacttcaattaaagctaggacctgctctgaaaatatatgaataccatgtgaagcctctccagacaaagcacctgaagaacaactccagctag

SEQ ID NO: 24452 - DNA, 309 bp, Artificial Sequence
  Description of Artificial Sequence: Synthetic coding sequence
atgcttagcgttgacatggaaaacaaagaaaacggcagtgtgggagtgaaaaactcaatggagaatggcagacctccggatcccgctgattgggccgtgatggatgtggtcaattatttccggaccgttggctttgaggagcaggctagcgcctttcaggagcaggagatcgatggcaagtcactactgctgatgactaggaatgacgtgctaacgggccttcaactgaagcttggaccggcactcaagatttatgaataccacgtgaagccccttcaaaccaaacatcttaagaacaactcatcctag

SEQ ID NO: 24453 - DNA, 309 bp, Artificial Sequence
  Description of Artificial Sequence: Synthetic coding sequence
atgctttcggtggatatggagaataaggagaatggcagcgtgggtgtgaagaactcaatggagaacgggagacccccagatccggctgattgggccgtcatggacgtcgtcaattatttcaggactgttggcttcgaggagcaggcctcagcctttcaggagcaggaaattgatggaaagtccttgctactgatgacaagaaacgatgtgttgaccggactacagctaaaactcggtccagcccttaagatctacgagtaccacgtcaagccactacagacgaaacacctgaagaacaattcgagttag

SEQ ID NO: 24454 - DNA, 309 bp, Artificial Sequence
  Description of Artificial Sequence: Synthetic coding sequence
atgctgtcggttgacatggaaaacaaggaaaatggatctgtcggggtgaagaacagtatggagaacggccgacctcccgaccctgcggactgggccgtgatggacgtcgtgaattattttcgcacggttgggttcgaagagcaagctagcgcctttcaggaacaggaaatcgacgggaaaagccttcttctgatgaccagaaatgacgtgttgacaggactgcagctgaagcttggccctgcgttaaaaatatatgaataccacgtgaagcctttgcagaccaaacacctgaagaacaattcctcctag

SEQ ID NO: 24455 - DNA, 369 bp, Artificial Sequence
  Description of Artificial Sequence: Synthetic coding sequence
atggccaactctctgctagagggcgttttcgctgaagtaaaggagccctgttctctgcctatgctgagcgtcgatatggagaataaagagaatgggtcagtgggcgtaaagaatagcatggagaacggacggcctcctgaccctgcagactgggcggtgatggatgttgtgaactacttcagaaccgttggcttcgaggaacaagctagcgcttttcaggaacaggagatcgatggaaaaagtttgcttctcatgacaaggaatgacgtgctcacaggactccaactgaagttgggacccgcactgaagatctatgagtaccatgttaaacctctgcagacaaagcacctcaaaaacaattcctcatag

SEQ ID NO: 24456 - DNA, 351 bp, Artificial Sequence
  Description of Artificial Sequence: Synthetic coding sequence
atgcgcggtgttgccgaggtgaaagaaccttgtagtctaccaatgttgtctgttgatatggagaacaaagaaaacggttcagttggggtgaagaattctatggaaaatggacggcctccagatcctgccgattgggcagtgatggatgtggtgaactattttcggaccgtgggcttcgaggagcaagcttcagctttccaggagcaggaaatcgatggtaagtccttattgctgatgacacgtaacgacgtgctaacagggttacaactcaagctgggcccagccctgaagatttatgaatatcatgtgaaacctcttcaaacgaaacacctcaaaaacaattcttcctag

SEQ ID NO: 24457 - DNA, 309 bp, Artificial Sequence
  Description of Artificial Sequence: Synthetic coding sequence
atgttatccgtggacatggaaaacaaggaaaatggaagtgttggggtgaagaattccatggagaatgggcgaccaccagaccccgctgactgggctgttatggatgtagtcaattacttccggacggtcgggtttgaagagcaagcatcagctttccaggagcaggagatcgatgggaaatccctgctgttaatgacaagaaacgatgtgttgacagggctgcagctgaaactcgggcctgcccttaagatttacgaatatcacgttaaacctctgcagacaaaacacctgaaaaataacagttcttag

SEQ ID NO: 24458 - DNA, 3666 bp, Artificial Sequence
  Description of Artificial Sequence: Synthetic coding sequence
atgatcacctccgagttgcctgtactgcaggattctacaaatgagactacggcccactctgatgccggtagtgaactcgaagaaacagaggtgaaaggcaagcgcaaacgcggacggccaggtaggcccccatctacaaataaaaagcctcgaaaaagccccggtgagaagtctcggattgaagccggtattagaggtgccggacgcggacgcgcaaatggccacccccagcagaatggtgagggagaaccagtcaccctcttcgaggttgtgaagcttggcaagagtgcgatgcaaagcgtcgtggacgactggattgagtcctataaacaggaccgggatattgcgctacttgatctcatcaactttttcattcagtgctctggctgcagaggaacggtccgaatcgaaatgttcagaaacatgcagaacgcagaaatcattcgaaagatgacagaggagtttgatgaggacagtggtgactacccactcacaatgcccggtccacagtggaagaagtttagaagcaacttctgcgagttcatcggagtgctgatcagacagtgtcaatactccatcatctacgacgagtatatgatggataccgtgatctccttattgactggcctgtctgactcccaggttagagcttttcgccacaccagcaccctcgccgctatgaagctcatgactgcactcgtgaatgtagctcttaacctatctattcaccaagataatacccagcgccagtatgaagccgagagaaataagatgataggaaagagagctaatgaacggttggagctcctgcttcagaagaggaaggaacttcaggagaatcaggatgagatcgaaaatatgatgaactccatttttaaagggatcttcgtccatcgttatcgcgacgcaattgccgaaatcagggccatatgtatcgaggagatcggggtgtggatgaagatgtactcggatgcttttctcaatgactcgtaccttaagtacgtcgggtggactctccacgaccgacagggagaagtgcgcctcaagtgcttgaaggccctccaaagcctctacacaaaccgtgagctcttcccaaagctcgaactatttaccaaccgtttcaaagaccgaattgtgagcatgacactggataaggaatatgacgtggccgttgaggctatccgtctggtaaccctcattctgcatggctcagaagaggctctgagcaacgaggattgtgagaatgtttatcatctggtgtactctgcacaccgtcccgtggccgtggcagcaggtgagttcctgcacaaaaagctgttttctcgccacgacccacaggccgaggaagctctggctaaacgcagaggacgaaacagcccaaacggcaacctcattagaatgctcgtgctattctttctcgaaagtgaactccatgagcacgcagcttatttggtggacagcctgtgggaaagtagccaagaactgctgaaggactgggagtgcatgactgaactgctgctcgaagaacccgtccagggagaagaagcaatgtctgaccggcaggagtcagccttgattgagctgatggtgtgcaccatccggcaggcggctgaagcccaccccccagtcggtcggggtacaggcaagcgggtgttgaccgccaaagagcgcaaaacgcaaatcgatgataggaacaaactcaccgagcatttcattataaccttgccaatgctgctgtccaagtactccgcagacgccgagaaagtggctaatttgctgcagatcccgcagtattttgatctcgagatttacagcacaggccgaatggaaaaacatctggatgcattactgaagcaaattaagtttgtcgtggagaagcacgtcgagtctgatgtcctcgaggcctgttcaaagacatactccattttgtgtagcgaagagtatacaatccagaaccgcgtcgacatcgcccgatcgcagctgatcgatgagttcgttgacaggtttaaccactccgtggaggatctccttcaggaaggagaagaggccgacgacgacgacatttataacgttttaagtaccctgaagaggcttacgtcgtttcataatgcccacgatttgacaaaatgggatctgtttggtaactgttacagactactgaagaccggcattgaacacggggctatgcccgagcagattgtggtccaggccctgcagtgctcacactattccatcttgtggcagctggtgaagattaccgacggatctccttccaaagaagacctgttagtcctgcgtaagaccgtgaaatcttttctggccgtatgccaacagtgccttagcaatgtgaacacccccgtgaaagaacaggcctttatgctgctgtgtgaccttctgatgatcttttctcatcagctcatgaccggcggacgcgagggtctccaacctcttgtgttcaatcccgacactggactccaatccgagctgctgagctttgtgatggaccacgtgtttatcgaccaggacgaagagaaccagtcgatggaaggcgacgaggaggacgaggcgaataaaattgaggccctccataaaaggcgtaatctcctggccgcattctcaaaacttattatatacgatatcgtcgacatgcacgccgctgccgacattttcaagcattacatgaagtattacaacgattacggagatatcatcaaggaaacgctgtctaagactcgccaaattgacaaaatccagtgcgccaagacccttatactgtcactgcaacagctgttcaacgagctcgtgcaggagcagggtcccaatctcgataggactagcgcgcacgtctccggaatcaaagaactggcacggcgtttcgctctaactttcggtttggatcagatcaagaccagggaggccgtggcgacactccataaggatggcatagaattcgcctttaagtaccaaaatcaaaagggccaggagtatcctccaccaaatctggccttcctggaggtgctgtcagagttttcttctaagctgctgaggcaggataaaaagacagtgcattcttatctggaaaagttcctgacagaacagatgatggagcgtcgggaagacgtgtggttgccgctgatctcttacaggaattccctggtaaccgggggagaagacgacagaatgagtgtgaactccgggagctccagttccaagacctcctctgttcgaaacaaaaagggtcggccacctctgcacaagaagcgggtagaagatgaaagtttagacaacacctggctcaatagaactgatacgatgatacagacccctgggccactgccggctccacaactcacatcaaccgttctgagggaaaactcgcgtcctatgggtgatcagattcaggagcccgagagcgaacatggtagtgagccagacttcctgcataaccgtggcctgatggaggaagacgcagaacctatctttgaggatgtgatgatgagtagccgctcacagctggaagatatgaatgaagagtttgaagacaccatggttatagacctccctccctcccgaaatcgcagggagagagcggagctgagaccagacttctttgattctgccgctatcatcgaagatgactccggctttggaatgcctatgttttag

SEQ ID NO: 24459 - DNA, 3777 bp, Artificial Sequence
  Description of Artificial Sequence: Synthetic coding sequence
atgattaccagcgaactccccgtgctccaggacagcacaaatgaaactacggcccacagtgatgctggctctgaactcgaagagactgaggtcaaaggtaagagaaagagagggagaccgggtcgccctccttccaccaacaagaaaccccgaaaaagcccaggcgaaaaaagtcgcatcgaggctggaattcgcggagccggaagaggccgtgctaacgggcatccccagcagaacggagagggggagcctgtgaccctattcgaggtcgtgaaattaggtaagtccgccatgcagtcagtggtggacgattggattgagtcttacaaacaagatcgagatatcgcgctattagatctgattaatttctttattcagtgcagcggctgcagaggaacagtcaggatcgaaatgtttagaaatatgcagaacgcagaaataatccggaaaatgactgaagaatttgacgaagattccggcgattaccctttgacaatgccagggccacagtggaaaaagtttaggtctaatttctgcgaattcatcggcgttctgatcagacagtgccagtactctattatctatgatgaatatatgatggacaccgtaatttccctgttgacaggcctgagtgatagccaggtgcgggcttttcggcatacctccacattagccgcaatgaagcttatgacagctctggtgaacgtcgcactaaacctcagcatccaccaggataatacgcagcgccagtacgaagcggaaagaaacaagatgataggaaagagagccaatgaacgattggaacttctgttgcagaagagaaaggagttacaagaaaaccaagatgagatcgagaacatgatgaatagtatcttcaaaggcatctttgtgcaccgatacagagacgcaattgccgaaatcagagcgatctgtattgaagagataggcgtttggatgaagatgtactcggacgcctttctaaatgatagctatctcaaatatgtcggatggacactgcacgacagacagggcgaggtgcgcttaaagtgcctcaaggccctacaaagtttgtacactaatagggagctgttccccaagttggaattgtttaccaatcgttttaaggaccgaatcgtttctatgacgttagataaggagtacgatgtggcagtcgaagctatcaggttagtcacactcatactgcacgggtcggaagaggccttgtcaaatgaggactgtgagaacgtctaccatctggtgtattccgcacaccgacccgtcgccgtggccgctggcgaattcctgcataagaagttatttagtcggcacgacccccaggccgaagaggccctggccaagagaagggggagaaattcccccaatggtaacctgatccgaatgttagtgttgttcttcctcgagtctgagttacacgagcatgcagcgtacctagttgattcattgtgggagagctctcaggaactcctgaaggactgggaatgtatgactgagctgcttttggaagagccagtgcagggcgaggaggcgatgagtgaccgccaggagagtgccctgatcgagctcatggtttgtaccattaggcaggcagctgaggcccacccaccagtgggcagaggaaccgggaaacgcgtgttgactgccaaagaacgcaaaacgcaaattgacgatcggaacaagctgaccgagcatttcatcatcacactgcctatgctgctctcaaaatacagtgccgacgcagaaaaagtggcaaacctgctccagatcccccagtatttcgacttggagatttacagcacaggcaggatggagaagcacctggatgcgctactgaagcaaattaagttcgttgtggagaaacatgttgaaagtgacgtgttagaagcttgcagcaagacttactccattttatgttcagaggagtataccattcagaaccgcgtagatattgcgcgaagccaattgatcgatgaattcgtcgatcgcttcaatcattcagttgaggatctgttgcaagaaggggaggaagctgatgacgacgacatttacaacgtgctgtccaccctaaagcgcctgacctcatttcataacgcgcacgacttgaccaaatgggacctgtttggtaactgctatcgtctgctaaagaccggcattgagcatggagcgatgccggaacagatcgtcgttcaggccctccagtgctcccactattccatactgtggcaactggtgaagatcacggatggaagtcccagtaaggaagatctgctagtattacgaaagacagtgaagtcattccttgcagtgtgccagcagtgtctgtccaatgtgaataccccagttaaggagcaggctttcatgctcctgtgtgatctgctcatgattttcagtcaccagcttatgactggaggtcgagagggcctgcaaccgctagtatttaaccctgacaccggcctgcagtctgaactcctgtcattcgtcatggaccatgtcttcatcgatcaggacgaagagaatcagagtatggaaggtgacgaagaggatgaagcaaataagattgaggcattgcataaacgcaggaatctcctcgccgcattcagcaaacttatcatctacgacatcgtggatatgcacgcagctgctgatatctttaaacactacatgaagtattataatgattacggagacataatcaaggagactctatctaagaccaggcagattgacaaaatccaatgtgccaagactctgatcttgagtctgcagcagctgtttaacgagctcgtgcaggaacagggcccaaacctggatcgtacttcagcacatgtctctggtatcaaggaactcgcgcgtcgctttgccctcactttcggattagaccagataaagacccgcgaggcggtggcaaccctccataaggatggcatcgaattcgcattcaaatatcagaatcagaagggccaggagtatccacccccaaatctcgcgttcctggaagtgttaagtgagttctctagcaaacttctcaggcaagacaaaaaaacagtgcactcttatttagaaaaattcctaacggagcagatgatggagaggagggaggatgtgtggctgccgctgattagctaccgcaactcccttgtcaccgggggagaggatgatcgcatgtctgtcaactccggcagttctagcagcaaaactagtagcgtccggaacaaaaagggcagaccaccactccataagaaacgagtggaggacgagtccctcgacaacacatggctcaataggaccgatacgatgatccagactcctggaccactccccgcaccgcagctcacttctaccgttctgcgtgagaactcgaggcccatgggagatcagattcaggagcctgagagtgaacacggttctgagccggatttcctgcataatccgcaaatgcagataagctggctcggacagcctaagctcgaggacctgaaccggaaagatcggacgggaatgaactatatgaaagtacgaacaggcgtacgccacgccgttcggggactcatggaggaagatgccgagcctatcttcgaagacgtgatgatgtctagtcgatctcaactagaggatatgaatgaggaatttgaagacacaatggtcatagatttgccacctagcagaaatagaagagaaagggccgaattaaggcccgatttctttgacagtgccgctatcatagaagacgatagcggcttcggcatgccaatgttctag

SEQ ID NO: 24460 - DNA, 2997 bp, Artificial Sequence
  Description of Artificial Sequence: Synthetic coding sequence
atgaagctgatgacggcactggtgaatgtggccctcaatctgagcatccatcaggacaacacacagcgccagtacgaggctgagcggaacaaaatgattggcaaaagggccaatgagaggttggaactactgctccaaaagaggaaggagctgcaggaaaatcaagatgaaatcgaaaacatgatgaattccatctttaagggcatcttcgtccacaggtacagggacgccatcgctgagattagggctatttgtatagaggaaattggcgtgtggatgaaaatgtacagcgacgccttccttaacgacagctatctgaagtatgttggatggactcttcacgatagacagggtgaagtccggctgaagtgccttaaggctctgcagtccctgtataccaatagagaactatttcccaagctggagctatttaccaacaggtttaaggataggatcgtgtccatgactctggacaaagaatatgatgtagctgtggaagctatccgacttgtcacgctgatccttcatggcagtgaggaggccttatcaaatgaggactgcgagaacgtgtatcatctggtctacagcgctcaccgcccagtcgccgtcgcagctggcgagttcctccacaaaaagctcttttctcggcacgacccccaggccgaggaggcattggccaagcgaaggggacgtaattctccaaacggaaacctgatcagaatgctggtactcttctttcttgaatctgagctgcacgagcacgccgcttacctagtggactctctttgggaatcctcccaggaactcctgaaagattgggaatgcatgactgagcttctcctcgaagagcctgtgcagggggaagaggcgatgtctgacaggcaagagagcgccctgattgaattgatggtgtgcaccatcaggcaagccgcagaggcccaccctcctgtgggacggggtacaggcaagcgcgtcctcacagcgaaggagcgcaaaacacagatcgatgaccggaataaactgaccgaacatttcatcattacactcccaatgcttctgtccaaatattcagctgacgccgaaaaagttgccaatctgctacagatccctcagtactttgatcttgagatctacagcaccgggcgaatggaaaaacatctggacgctctgctgaaacagatcaagtttgttgtggaaaaacatgtcgagtctgacgtacttgaagcatgcagtaagacctactcaatcctgtgttcagaagagtatacaattcagaacagggttgacatcgccaggagccagttgatcgacgaatttgtggatagatttaaccactcagttgaggacctgctgcaagagggggaggaggcggacgacgacgacatttataacgttctgagcacactgaaacggctgacatcatttcacaatgctcacgatttaacaaaatgggacctttttggcaactgttaccgcttactgaagacgggaatcgagcacggtgctatgcctgagcaaatcgtggtgcaggctctgcagtgttcccactacagtatcctatggcagctagtaaaaattaccgacggctcaccctcgaaagaagacttgcttgtcttacgcaaaactgtaaaatcatttctagccgtatgtcagcagtgtttgagcaacgtgaacacacccgtcaaagagcaagcattcatgctcctatgcgacctgctcatgatcttttcccatcaactgatgacaggcggtagagagggcctccagccactcgtcttcaatccagataccggcttgcagagtgagctgctgagtttcgtgatggaccatgtatttatcgatcaggatgaggaaaatcagagtatggagggcgatgaggaagatgaggccaacaagattgaggcccttcataaacgtaggaatctcctagcggctttttcgaaactcatcatttatgatatagttgacatgcacgcggcagcggacattttcaaacactacatgaaattatttaacgagcttgtccaagagcagggtccaaatctggatcggaccagcgcacacgttagtggaatcaaagaactggctcgccgatttgctctgacatttggcctggatcagataaagacacgagaagctgtggcgaccctccataaggacgggatagagttcgctttcaagtaccagaaccaaaaggggcaagaatatcccccacctaacctcgccttcctcgaagtcctcagcgagttcagttctaagcttttacgtcaggacaaaaagactgtgcacagttacctcgagaaatttctgaccgagcagatgatggaaaggagagaggatgtatggctcccactaatcagctaccggaactcactagtcaccgggggtgaggatgataggatgagtgtcaacagtgggagctctagctccaaaacgtcctctgtgagaaacaagaaggggagaccacccctccacaagaaacgcgtcgaggatgaatccctggacaatacgtggctcaatcgcacagacacaatgatacagacgcccggaccccttccggcaccccaactcacgagtaccgtgttgcgcgaaaattctcggcctatgggggaccagattcaggaaccagagagtgagcacgggagcgaaccggactttcttcacaacccacagatgcagatcagctggctcggccaaccaaagctcgaggacttaaacaggaaggacagaacaggaatgaattatatgaaagtcagaaccggggtgcgacacgccgtgagagggctcatggaagaggatgctgaacccatcttcgaggacgtgatgatgagcagtaggagccagcttgaagacatgaacgaggaatttgaggatactatggtgatcgatctgcccccatcccgtaatcgcagagagagagccgagcttaggccagatttttttgacagcgcagcaattattgaggacgatagcggctttgggatgcccatgttttag

SEQ ID NO: 24461 - DNA, 2529 bp, Artificial Sequence
  Description of Artificial Sequence: Synthetic coding sequence
atgacactcgacaaagagtatgacgtggccgtagaagccataagacttgtgacactgatactgcagttatttagtcggcacgatccacaggccgaagaagccctagcgaaaaggcgaggaaggaattcccccaacgggaacctgatcagaatgcttgtactgttcttcctggaatcagaactccatgagcacgcagcttatttggtggactcgctgtgggagtcgtcgcaggaattactgaaagactgggaatgtatgaccgagttacttctggaagagcctgttcagggggaggaggcaatgagcgatcgccaagaaagtgcacttattgagctcatggtctgcaccatacgtcaggccgcagaggcacacccacccgtcggcagaggaactgggaagagggtcctaacagcgaaagagcgcaagacccagattgacgatcggaacaagctcacggaacattttataataaccctccccatgctcctctccaaatactcagccgatgctgaaaaggttgcaaatttgctgcagatccctcagtacttcgaccttgagatctactctactggcagaatggaaaagcacctggatgcattacttaaacagattaagttcgtggtggaaaaacacgttgagtctgatgtcttagaagcatgttccaagacatacagcattctgtgtagtgaggaatatactattcagaatcgggttgatattgccagatctcagttgatagatgaatttgtggatcggttcaatcacagtgtagaggacctcctacaggaaggagaggaggctgatgatgacgacatctacaatgtcctgagtacactgaagaggttaacttctttccacaatgcgcatgacctcacaaagtgggaccttttcggtaactgttacagactgctgaaaaccgggattgagcatggagccatgcctgagcagatcgtcgtgcaagccctgcagtgttcacactattccattctatggcaacttgtaaagatcactgatggttccccttccaaggaagacctcttggtgctgaggaagaccgtgaaatcctttctcgcagtctgtcaacagtgcctgtcaaatgtgaatacaccagttaaggaacaagcattcatgctgctctgcgatctgctaatgattttttcacaccagctgatgactggtggcagagagggcctccagccccttgtattcaacccagataccgggctgcagagtgagttactcagtttcgtgatggatcacgtatttatcgatcaagatgaagagaatcaatcaatggaaggcgacgaggaagacgaggccaacaaaatcgaggcgctgcacaagcgccgtaatctcctcgctgctttcagtaagctcatcatttacgacatcgtcgacatgcatgccgcagcagatatcttcaagcactatatgaagtattataacgactacggggatatcatcaaggagacgctgtcaaaaactcggcagattgacaagattcagtgtgccaaaactctgattttatccctccagcaactgtttaatgaactcgtacaggagcagggacccaatcttgataggaccagtgcgcatgtctctggaatcaaagagctggctcgacgtttcgcattgaccttcggtctagatcagattaaaactcgtgaggctgtcgccaccctgcataaggacggcatcgagtttgcgttcaagtatcagaatcagaaagggcaagaatatcctccacctaatttggcattcctggaagttttgagcgaattctcgagcaaactgctccgccaggataagaaaaccgtgcactcctacctagagaagttcttgacggaacagatgatggagcggagagaggatgtttggctgccactgatctcctaccgtaattctctggtgacaggaggggaagatgataggatgagcgtcaatagcggttcgtcatcttcaaaaacatcgtcagttcgtaacaaaaagggcaggccaccgcttcataagaagcgtgtcgaagatgaatcattggataacacctggttaaatcgcaccgatactatgatccagacgccaggccctctgccggcacctcaactcacctcgactgtcttgcgagagaattcacgccctatgggggatcagatccaggagccagagagcgagcatgggagtgagccggatttcctccacaatccccagatgcagatttcatggctcggccagcccaaactcgaggacttgaatagaaaagatagaaccggtatgaattacatgaaggttcggacaggcgtgaggcacgccgtcagggggctaatggaagaagatgccgaacccatctttgaagatgtcatgatgagcagtcgatctcagctggaggacatgaatgaggagttcgaagataccatggtcatcgatctgccaccgtccaggaacaggagagaaagagccgagctgcgacctgacttctttgattctgctgcaattatagaggatgattctggttttggcatgcccatgttttag

SEQ ID NO: 24462 - DNA, 405 bp, Artificial Sequence
  Description of Artificial Sequence: Synthetic coding sequence
atgattttttccatgcttcgcaagttgcctaaagtcacctgccgagacgtattgcctgagattagagccatctgtatcgaagagattggatgctggatgcaatcgtatagtaccagcttcctgactgactcctacctgaaatatattggctggaccctgcatgataagcacagggaggtgcgggtgaagtgtgtcaaagcccttaaggggttgtacgggaatagggacctgacagccagactcgaactttttaccggccgtttcaaagattggatggtaagcatgatcgtggatcgagagtattctgttgccgtagaagccgtgcgcctcctgatcctcatactgaagaatatggagggagttctgatggacgttgattgcgaatccgtgtatcccattgtctag

SEQ ID NO: 24463 - DNA, 618 bp, Artificial Sequence
  Description of Artificial Sequence: Synthetic coding sequence
atgatctttagcatgttgcgcaaactgcctaaagttacatgtagggatgttttgcctgagattagggccatctgtatagaagaaattgggtgctggatgcagtcctacagcactagcttcctcaccgattcctacctaaaatacattggctggacactacatgataaacaccgcgaggtgcgtgtcaagtgcgtcaaggctttgaaagggttgtacggtaatcgagatttgacagccaggctcgagctttttacggggaggtttaaagactggatggtgtcaatgatcgtagatagggagtactccgtagctgtggaagcagtgaggctactgatccttatactgaaattgttctatccagaatgtgaaattaggactatgggaggacgcgagcagcgccagagccccggagcacagcgaactttctttcagcttttactatcttttttcgtagagtccaaattgcacgatcacgcggcttacctggtggacaacctctgggactgtgcgggtacccaacttaaagattgggaaggtctcaccagcctgcttctcgagaaagatcaaagtacttgtcacatggaacccggtcctggcacattccatctgcttggttag

SEQ ID NO: 24464 - DNA, 456 bp, Artificial Sequence
  Description of Artificial Sequence: Synthetic coding sequence
atgcagcacagagaagtgcgggtgaagtgcgtgaaggctctgaaggggctgtacggaaatagagatctgacagcacgtctcgagctctttactggtagattcaaagactggatggtgtccatgattgtcgaccgcgagtacagcgttgcggtcgaggccgtgaggctcctcatcctaattttgaagctattctatccagagtgtgaaatccggactatgggtggccgtgaacagcgacagagcccaggagctcagcggacattttttcagctcttgctgtcattttttgtggagtcaaagttgcacgaccatgccgcttatcttgttgataacctgtgggactgcgctggtactcagttaaaagactgggaagggcttacaagcttgctgctggagaaggaccagagtacatgtcacatggaaccaggccctggtaccttccatttgctggggtag

SEQ ID NO: 24465 - DNA, 387 bp, Artificial Sequence
  Description of Artificial Sequence: Synthetic coding sequence
atgatcttttccatgcttcgcaaactgccgaaggtgacctgtcgggatgtgttacccgagattcgcgcaatctgcatcgaggagattggctgttggatgcagagctacagtacttcattcttgacggacagctacctcaagtatattggatggacactccacgacaagcatcgggaggtccgagtgaagtgcgtgaaggctttgaaaggcttatacggtaaccgcgacctgactgccaggctcgagctcttcaccgggaggttcaaggattggatggttagcatgatagtagaccgggagtacagcgtggccgtggaagcggttagactcctcattcttatactcaagatcggtagccagacccccgcaacaagagaatgtatttag

SEQ ID NO: 24466 - DNA, 378 bp, Artificial Sequence
  Description of Artificial Sequence: Synthetic coding sequence
atgcagcacagagaagtccgcgtgaagtgtgttaaggctcttaaaggactttacggcaaccgggacctgacggccagactggaactgttcacggggcgatttaaagactggatggtgtctatgattgtcgaccgggaatactctgtcgcagtagaggcagtaagactcttgatcctgatccttaagcttttctatccagaatgtgagatcagaacaatgggagggagggagcaacgccagtctccaggcgctcagcgaaccttctttcaactgctcctttctttcttcgtggagagtaaggtgacatacacagagcggacactggccgtggtccataggacatataagtgggccggtgtgggcggaagcaggctgtag

SEQ ID NO: 24467 - DNA, 240 bp, Artificial Sequence
  Description of Artificial Sequence: Synthetic coding sequence
atgggcggacgagaacaacggcagtcacccggtgcccagcgcacatttttccaattgctgctttcttttttcgttgaatctaagctgcatgatcatgcggcttatttggtggataacctttgggactgtgccggaacccagcttaaggattgggaagggctgacgtctcttctgctagaaaaggaccaaagcacttgccacatggaacccggacccggaaccttccatctgctggggtag

SEQ ID NO: 24468 - DNA, 405 bp, Artificial Sequence
  Description of Artificial Sequence: Synthetic coding sequence
atgatattcagcatgctccgcaagctgccaaaagtgacatgcagggatgtgctgccagagataagagctatttgcatcgaagaaatcggatgttggatgcagtcatactcaacaagcttccttacagactcatatctcaagtacataggatggacgctgcatgacaagcacagggaagtgcgggttaagtgcgttaaagccctgaaagggctctatggtaatagggatttgacagccagactcgagctcttcaccggacggtttaaggattggatggtttccatgatagtggaccgcgagtattcagttgctgttgaagctgtgagacttcttatcctcatcctgaaaaacatggaaggggttctcatggacgttgactgtgagagtgtgtaccccattgtttag

SEQ ID NO: 24469 - DNA, 405 bp, Artificial Sequence
  Description of Artificial Sequence: Synthetic coding sequence
atgatttttagcatgctcagaaagttgcccaaggtaacctgtagggacgtgttaccagagatacgcgcaatctgtatcgaagagatagggtgctggatgcagagctattccacatcttttctcactgattcctacttgaaatacattggttggactcttcacgacaagcaccgggaggtgcgtgtcaaatgtgttaaggccctgaagggcctatacgggaatcgagacctgactgcacggctagagctatttacaggtcgttttaaagactggatggtgtccatgatcgtcgaccgcgagtactcagtcgccgtagaagctgttcggctcttaatcttaattctcaagaacatggaaggtgtcctcatggacgttgactgtgaatccgtgtaccctatcgtgtag

SEQ ID NO: 24470 - DNA, 405 bp, Artificial Sequence
  Description of Artificial Sequence: Synthetic coding sequence
atgatattcagcatgctgcgtaagctgcccaaagtgacttgtagagacgtgctccccgagattagggctatttgcattgaggagatcggatgttggatgcagtcctattctactagttttcttactgatagctaccttaaatacatcggctggacccttcatgacaaacaccgcgaggttagggtaaaatgcgtgaaggccctgaaaggcctgtacggaaacagggatttgacagcacggttggagctcttcacgggcaggttcaaagattggatggtcagcatgatcgtagatcgggagtacagcgtggcagtggaagctgttagactgctaatcctgattctcaagaatatggaaggtgtcttgatggacgtggattgtgaaagtgtttaccctatagtgtag

SEQ ID NO: 24471 - DNA, 618 bp, Artificial Sequence
  Description of Artificial Sequence: Synthetic coding sequence
atgattttttccatgctgcgcaagttgcctaaggtgacttgcagggatgtattacccgaaattagggcaatttgcattgaagagattggatgctggatgcaaagttattctacgagtttcttgacggattcatacctcaagtacatcggctggacactgcatgacaagcaccgcgaggttagggttaagtgtgttaaggcactcaaggggctgtacggcaaccgtgacttgacggctcgacttgagctcttcaccggctgcttcaaagattggatggtatcaatgataatggatagggagtatagtgtggccgtcgaagcggtgcgtctcttgattctaattctcaaactattctatccggaatgtgaaatcagaacaatggggggaagggagcaacgccagtcaccgggagcacagaggaccttttttcagcttttactaagctttttcgtagagtccaagctgcacgatcatgctgcctacctggtcgacaacctgtgggactgtgccggaacacagttaaaagactgggaggggttaacatcgctcctgttggaaaaagatcagagtacgtgtcacatggagcccggtccaggcacatttcatcttcttggctag

SEQ ID NO: 24472 - DNA, 405 bp, Artificial Sequence
  Description of Artificial Sequence: Synthetic coding sequence
atgatcttttcaatgcttcgtaagctcccaaaggtgacctgtagggacgttttgccagaaattcgcgctatatgcattgaggaaatagggtgttggatgcagtcttacagcacatcgtttttgacagattcctatctaaagtacattggatggacccttcacgataaacatagggaggtccgggtgaagtgcgttaaggccctgaaaggactgtacggcaatcgcgatttaaccgcacgccttgagttgttcactggatgtttcaaggattggatggtatcaatgatcatggatcgagagtacagtgtcgcagtggaagctgttcggctgctaatactaatcctaaagaacatggaaggggtgctgatggacgtggactgcgagtcagtgtacccaattgtctag

SEQ ID NO: 24473 - DNA, 456 bp, Artificial Sequence
  Description of Artificial Sequence: Synthetic coding sequence
atgcagcaccgtgaggtccgggtcaaatgtgtgaaggctctcaaagggctatatggcaatagagatctcactgctcgcctagagctctttactgggtgcttcaaggattggatggttagcatgataatggaccgcgagtactccgtagcagttgaggctgtacggctgctgatactgatcctaaagctattttatcccgaatgcgagatccgcacgatgggcggtagagagcagcgccagagtccaggcgctcagagaacttttttccagctgctgttgagtttttttgttgaatccaaactccacgaccacgccgcttatcttgtggacaatctttgggattgcgcaggcacccagctcaaggactgggaaggattgaccagtttactgcttgagaaggatcagagcacttgtcatatggagccagggcctgggacctttcacctgctggggtag

SEQ ID NO: 24474 - DNA, 351 bp, Artificial Sequence
  Description of Artificial Sequence: Synthetic coding sequence
atgattttcagcatgctacgcaaactcccaaaagtgacatgtcgcgacgtgctccccgagattcgcgctatatgcattgaggagattgggtgttggatgcagtcctacagcacttcatttctgaccgacagttatctgaaatacattggctggacactacacgataaacaccgtgaagttagagtgaagtgcgtaaaggctctgaaaggcttgtacggcaatagggatttgacagccagacttgaactgtttacaggatgttttaaggattggatggtcagcatgatcatggatcgagagtactctgtcgccgttgaagctgtcaggttattgatcctgatcctcaagtag

SEQ ID NO: 24475 - DNA, 3708 bp, Artificial Sequence
  Description of Artificial Sequence: Synthetic coding sequence
atggcccacctagaactgctcctcgttgaaaattttaaatcgtggcgtggaaggcaggtaatcggcccattccgcaggttcacttgtatcattgggcctaatgggagcggcaagagcaacgtgatggatgccctgagcttcgtaatgggcgagaaaatcgccaacctacgcgtaaagaatatccaggaattgattcatggggctcacattggaaagccgatcagcagttcagcatctgtaaaaattatttacgtggaagaaagtggcgaggaaaagacgttcgcccgaatcattagaggcggatgttctgaatttcggttcaacgataacctcgtgtctagaagcgtgtacattgcagagctcgagaagattgggatcatcgtcaaagcgcagaactgcctggtattccagggcacagtcgagagcatcagtgtcaaaaaacctaaggaacgtactcagttctttgaggagatcagcacttccggcgagctcataggcgaatacgaagaaaaaaagagaaagttacagaaggcagaggaggatgcccagttcaattttaacaagaaaaagaacatagccgcagagcgccgacaggcaaaactcgagaaggaggaggccgaacgataccagagccttcttgaagagctgaaaatgaataagatccagctgcagctttttcagttgtaccacaacgagaaaaagatacatctgcttaacaccaaacttgagcacgtcaatagggatctcagtgtgaaacgcgagagcctttcacaccatgaaaatatcgttaaagcaaggaagaaggagcatgggatgctgacaagacaactccagcagacagaaaaggaattgaagagcgtggagacccttctcaaccaaaagaggcctcagtatatcaaggctaaagaaaacacctcacatcacctgaaaaaactggacgtggcaaaaaagtccataaaagactctgagaagcaatgtagcaagcaggaggatgacattaaggcactggagaccgaactcgccgaccttgacgctgcctggcggtcatttgagaaacagatcgaggaggagatcctgcacaagaagcgcgatatcgaacttgaagcatcacagctggaccgctataaagaactcaaggagcaggtcagaaagaaggtggccaccatgacacagcaactggagaagctgcagtgggagcagaagacagacgaagagaggctcgctttcgagaaacgtaggcacggggaggtgcaaggcaacttgaagcaaatcaaagagcagatagaagaccataaaaaacgaatcgagaaacttgaggaatacaccaagacttgtatggactgcctcaaggaaaagaagcaacaagaagagacattagtcgacgaaatcgagaaaacaaagagccgcatgtccgagtttaacgaagagctgaatcttatcagaagtgaactgcagaatgcaggtatagatacccatgagggtaagcgccagcagaaaagagccgaagtgctcgaacacctgaagcgtttataccccgacagtgtgttcggccgtctctttgacctttgtcatcccatccacaaaaagtaccaattggcggtgacgaaggtttttgggaggtttattactgctattgttgtggcctctgaaaaagtggctaaggactgcatacgcttcctcaaagaagaacgtgccgagccggaaacatttctggctctggactatctcgacattaaaccaatcaatgagagacttcgggagcttaaggggtgtaagatggtcatcgacgttattaagacacagttccctcagcttaaaaaggtgattcagtttgtctgtggcaacggtctggtctgtgagacaatggaagaggcaagacacatagctctgagcgggcctgagcgccagaaaacagttgcattagatgggacgctgttccttaagagtggagttattagcggcggtagtagtgacctgaagtacaaagcccgttgctgggatgaaaaagagcttaagaacctccgggatagaaggagtcagaagatccaagagctcaagggcctcatgaaaacccttcgaaaggagacagacctgaaacagatccaaacacttatccagggaacccagacacgcttaaaatacagccaaaatgagctggaaatgataaaaaagaagcacctggtagcgttctaccaagaacaaagccagctccagtccgagctgcttaacattgaatctcagtgcattatgcttagcgaaggtatcaaggaaaggcagaggcgaataaaagaattccaagagaagatcgataaagtggaagatgatatcttccagcacttttgtgaagaaattggtgtggaaaacatcagggaatttgagaataagcacgtaaaaagacagcaggagattgatcagaagcgactggaattcgaaaaacagaaaactcgccttaacgtgcagctagagtacagcagaagtcatttgaaaaagaagctgaacaaaataaacactcttaaggagacgatccagaagggtagtgaggacattgatcacctgaaaaaagctgaggagaactgtctccagactgtgaacgagttgatggcaaaacagcaacaattaaaagacatccgggtgacccagaatagtagtgcagagaaggtccagactcaaatcgaggaggagcggaaaaagttcctcgcagtcgaccgggaggtaggaaagctccagaaggaggtggtgtctatccaaaccagccttgagcagaagcgtctggagaagcacaatctgttgttggactgcaaggtgcaagatattgagattatcctgctctccggcagcctggatgatatcatcgaagtcgaaatgggaaccgaggccgaatctactcaggctacaattgacatctacgaaaaggaagaggcgtttgaaattgattattcgtcgctgaaggaagacctgaaagccctacagtcagatcaggagatcgaggctcacctgcgccttttactgcagcaagtggccagccaagaggacatcctcctcaaaactgcagcccctaacctgagagcgctcgagaacctgaaaacggtccgagataaattccaagaatcaactgatgctttcgaggcatctagaaaagaggcccgtctctgtcgccaggagttcgagcaagttaagaagagacgctacgacttgttcacgcaatgcttcgagcacgtttctatatccatcgaccaaatctacaagaagctatgccggaataactcggcccaagcattcctgtccccagaaaacccggaagagccctatttggaggggatcagctacaattgtgtagccccaggcaagagattcatgccgatggacaacttgtcaggtggcgagaagtgtgtggctgccttagccctcctatttgctgttcatagctttcggccagctccttttttcgtcttagatgaagtggatgcagccctggacaacacaaacattggcaaggtgtcatcatacattaaggaacagacacaggatcagttccagatgattgtcataagccttaaggaggagttctattctcgtgcagatgcattgattggaatatacccggaatatgacgactgtatgtttagtcgggtcctgactttggatctttcccaatatccagacactgagggacaggaatcttcaaagcgacatggcgaaagccggtag

SEQ ID NO: 24476 - DNA, 3486 bp, Artificial Sequence
  Description of Artificial Sequence: Synthetic coding sequence
atggcccatctcgaacttctgcttgtggagaactttaagagttggagggggaggcaggtgataggccctttccgcagatttacctgcatcattggcccaaacgggtctgggaagagtaacgtgatggatgctctgagctttgtcatgggtgagaagatagctaatctgcgtgtgaaaaatatccaggaactgattcatggcgctcatatcgggaagcccatcagtagtagtgcttccgtcaagatcatctacgtggaggagtccggcgaggaaaaaactttcgccagaataattcgcggaggctgttccgaattccggttcaacgataatctggtgtctcgcagcgtttatattgccgagctggaaaagatcggtattattgtgaaggctcagaactgcctggttttccagggcaccgtggaatcaatctccgttaagaagccgaaagagcggacccaattttttgaggagatctccacgtcgggagaactgattggcgagtacgaggaaaagaagcggaaactccagaaggctgaggaggatgcgcagttcaatttcaacaaaaaaaaaaacatcgcagcagaaaggcgccaggctaagctggaaaaggaagaggccgagcgctatcagagcctcctggaggagttgaagatgaacaagatacagctgcagctatttcagctttatcacaacgagaaaaagatacacctcctgaataccaagctggaacacgtgaaccgggatctttcagtaaagcgcgaatctctgtcccatcacgagaacatcgtgaaagctcggaaaaaggagcacggcatgctgactcgtcaacttcaacaaaccgagaaggagctcaaatccgtggagacgctccttaatcagaaacgaccgcagtacattaaggctaaggaaaacacgagtcaccatctcaagaagctggatgtggccaagaagtccatcaaggacagcgagaagcagtgtagcaagcaggaggacgacataaaagcccttgagaccgaattggccgatttggatgccgcttggcgcagcttcgagaagcagattgaggaggagatcctacacaaaaagagggatatcgagctagaagcatctcagcttgaccgttacaaggaactgaaggagcaggtgagaaaaaaagttgccactatgacccaacagctcgaaaagttgcaatgggaacaaaaaactgatgaggagcgcctcgcctttgaaaagaggcggcacggagaggtgcaggggaatcttaagcagataaaggagcaaattgaggaccataagaaacgtatagagaaattggaggagtacaccaagacctgcatggactgcttgaaagagaagaagcaacaggaggagacactggtcgacgaaatagagaaaaccaagtcgagaatgagcgaattcaacgaggagctgaatttgatacgctcagagctgcagaacgctggaattgacactcacgaagggaagaggcagcagaagagagccgaggtactggaacacttgaaaagactgtaccccgattccgtgttcgggaggctgtttgacctttgccacccaatacacaaaaaatatcagctggctgttacaaaggtcttcggcaggttcattacggccattgtggtggcatcggagaaggtggccaaggattgtataagattcttgaaggaagagcgcgctgaacccgagacctttctggcactagactatctggacatcaagcctatcaacgaaagacttagggagctcaaaggctgcaagatggtgatagacgtcatcaagacacagttcccacaactcaaaaaagtgatccagtttgtgtgcggcaacggtctggtgtgcgaaaccatggaggaggccagacatatcgccctctccggacccgaacgccagaagaccgtcgccttggacggcaccctcttcttaaaatccggagtgattagtgggggaagcagtgatctgaaatataaggcgagatgttgggatgagaaagagttaaaaaaccttcgcgaccgaagaagccaaaagatccaggagcttaaggggttaatgaagactctgcgcaaggagactgatctaaagcagattcagaccctcatacagggaactcagactcggctaaagtacagccaaaacgagctggaaatgataaagaagaagcatctagtggcattttaccaagagcaatcacagctgcagagcgagcttctgaacattgagtcccagtgcattatgctatcggaaggcataaaagagaggcagagaaggatcaaggagttccaagagaagatcgataaagttgaggatgatatatttcagcacttctgcgaggaaattggcgtggagaacatccgagaatttgagaataaacatgtcaaaagacagcaggaaatagaccagaagaggttagagtttgagaagcagaaaacacggctaaacgtgcagctcgaatactcgagaagccatctcaagaaaaaactgaataagatcaacacccttaaggaaaccattcagaaaggatccgaagatatcgatcacctcaagaaagcagaggaaaattgcctgcagactgttaacgaactgatggctaaacaacagcaactgaaagacatccgggtgacgcagaatagcagcgcagagaaggtgcagacgcagattgaagaagagaggaaaaaatttttggcggtggaccgggaagtgggaaagctccagaaggaggtcgtgtcaattcagaccagtcttgagcagaaacgattggagaaacataatttactccttgactgcaaggtacaagacattgaaatcattctcctcagcggctccctggatgatatcatcgaagtcgagatgggtacggaggccgagagcacccaggccacgattgatatttacgaaaaggaagaggcatttgagattgattacagttctctgaaagaggatctgaaagcattacagtcggaccaggagattgaggctcatctgaggctacttctgcagcaagtggcttcacaggaggatatcttattaaagactgcagcaccaaacctgcgagccctggagaacctgaagacagttcgagataaatttcaggaatctaccgacgccttcgaggcctcgaggaaggaggcccgactgtgccgacaagagttcgaacaggtaaagaaacggagatatgacctttttactcaatgctttgagcatgtcagcatttccatagaccagatatataagaaactctgtaggaacaactccgcccaggtttcaagttatatcaaagagcagacccaggatcaatttcagatgattgttatctccctgaaggaagaattctatagccgggctgatgctctcattggcatctaccccgaatatgacgattgcatgtttagccgcgtcctgacgttggatctaagtcagtaccccgatactgagggccaagagtccagtaaaaggcatggcgaaagtcggtag

SEQ ID NO: 24477 - DNA, 5754 bp, Artificial Sequence
  Description of Artificial Sequence: Synthetic coding sequence
atggcggcagcagatggcggaggccctggaggggcaagtgtggggaccgaggaggacgggggtggggttggacaccggacagtatatctgttcgacaggagagagaaggagtcagagttaggcgatcgccctctccaggttggagagaggtccgactatgccggattcagagcgtgtgtctgccagaccctcggaataagtcctgaggaaaaattcgtcattaccacaacctcaaggaaggagatcacctgtgacaactttgacgagacagtgaaggacggggtaacactttacctactgcagtctgtcaatcaactgctcctgacggccaccaaggaacgcatcgacttcctcccccactatgacacattggtgaagtctggtatgtatgaatattatgcaagtgagggtcagaatccgttgcccttcgctctggccgagttgatcgacaattccctctctgcaacttcacggaatataggcgttaggcgcattcagatcaagctcctgtttgacgaaacacagggaaagccagccgtggcagtgattgacaacgggaggggcatgacatcaaagcaactaaacaactgggctgtttatcggctgtcgaagttcactagacagggggatttcgaaagtgatcacagcggttacgtaagacctgtgccagtcccaaggtcactcaacagtgatatctcttattttggggtaggcggtaaacaggcagtgttctttgtgggacaaagcgcacgcatgattagcaaaccggcagacagtcaagacgtgcacgagttggtgctctccaaagaagatttcgagaagaaggagaaaaataaagaggcaatttactctgggtacatccgtaacagaaaaccttccgactccgtccacattacaaatgatgatgaacgctttctgcaccacctaattattgaggagaaggagaaagactccttcactgccgtcgtgatcacaggcgtccagccagaacatattcagtatttaaagaactacttccatctgtggacaaggcaactcgcacacatatatcactactacattcacgggcctaaaggcaacgagatccggaccagcaaggaagtggagccgttcaacaatatcgatatcgagatttctatgttcgaaaagggaaaagtgccaaagattgtcaacctgcgggagattcaggacgatatgcagaccctctacgtcaacaccgccgcagattcctttgagtttaaggcccacgttgagggagatggtgtcgtggaggggattatcaggtatcatccgttcctgtatgacagggaaacataccccgatgatccctgcttcccgtccaagttaaaagacgaggatgacgaagacgactgttttatcctggaaaaagccgctcgcggaaaacggccaatattcgagtgtttttggaatggacgccttattccttacactagcgtcgaggactttgactggtgtaccccaccaaagaaacgaggactcgccccaattgaatgctacaatagaatcagcggcgcactgttcacaaatgacaaattccaagtgagcaccaacaagttaacttttatggatctcgaacttaaactgaaggacaagaacactttgttcactcgcattctgaatggccaagaacagcgcatgaaaatagatagggagttcgccctgtggctgaaagattgtcatgagaaatacgataagcaaataaagtttacactgttcaaaggcgtgataacacgaccagatttaccttctaagaagcagggaccctgggctacctacgctgctatcgaatgggatggcaagatttacaaggccggtcaactggtaaagaccatcaagactcttccgttattttatgggagtattgtgcgtttcttcctgtatggggatcatgacggggaagtttatgccactggcggtgaggttcagattgctatggagccccaggcactgtatgatgaagttcgcacggtgccgatcgcaaaactggacagaaccgtggcagaaaaggcagtcaaaaaatatgtagaagatgagatggcccgactacccgataggttgagcgtgacatggccagaaggcgacgagcttctgcctaacgaggtccggccagccggaaccccgatcggcgcattacggatagagattctgaacaagaaaggcgaggctatgcaaaagttgccagggacgtcacatggcggatccaagaaacttctagtagaacttaaggttatcctccatagttcatctggtaacaaggaaatcataagccacatctctcagcacggaggaaagtggccttactggttcaaaaagatggagaacattcagaagctgggcaactacacccttaagctgcaggtcgttctcaatgaaagcaatgctgatacatatgctggcagacctttgcccagtaaagccatcaaattctcagtgaaagaaggaaagcctgagaagttctcatttggtcttttggatctgccattccgggtgggtgtccctttcaatatccctctggaatttcaggatgaattcgggcacacatcccagctggtgaccgacatccagcccgtgctggaggcttctgggctgtccctgcactatgaggagataacgaaaggtcccaactgcgtgattagaggggtgaccgcaaaaggccctgtgaattcttgccaaggaaagaactacaaccttaaagtgacattgcccggtctgaaggaggattcccagatcctcaagattaggctgcttccagggcatccccgtagactcaaggttaagcctgacagcgagattttggtgatcgagaatggaactgcctttccctttcaggtggaggtgcttgatgagagcgacaacatcactgcccagccaaaactgatagtgcactgtaaattcagtggcgctccaaatcttccagtgtacgtggtggactgctcaagctctgggacaagcattttaaccggtagtgctatccaggttcagaacatcaagaaggaccagacattgaaagcgaggattgaaattccttcctgcaaagacgttgctccagtggagaagactattaagctcctcccttcctcacacgtggcaaggctgcagatttttagtgtagagggccaaaaggccattcagattaagcatcaggatgaagtgaactggattgctggtgacatcatgcacaaccttatatttcagatgtacgacgagggcgagcgggagataaatataacctctgccctcgccgaaaaaatcaaagtgaactggactcccgaaatcaacaaagaacatttgctgcaaggactcctccctgacgtgcaggttccaacttctgtgaaggacatgcgatactgccaggtctccttccaggacgaccacgtttcattggagagcgcatttactgtgaggccacttccagacgaacccaaacatctgaagtgcgagatgaagggcggaaaaacagtgcagatgggacaggagctccaaggagaagtggtgataatcattacggatcagtacgggaaccaaattcaggccttcagcccttcttcgctttccagcctatcaattgctggggtcggcctggatagttcaaatctgaaaacaactttccaagagaacacgcaatccatctcggttagaggtatcaagttcatccccggaccacccggaaacaaggatctctgttttacatggcgcgagtttagcgactttattagagtccagcttatttctggccctccagcgaagttattgctgattgattggcccgagctgaaagagagtattcccgtcattaatggcagggatttgcagaaccccataatcgttcagctctgcgatcagtgggacaaccctgccccagtgcagcacgtgaaaatttcccttaccaaggcaagtaatctcaaactaatgccttccaatcagcagcacaagacagatgagaaaggacgtgcaaacctcggcgtatttagcgtttttgccccacgcggtgaacacacactacaggtgaaagcaatatacaataaaagcataatcgagggccctataattaaattaatgatactccccgatcccgagaagccagtccgcctaaatgtaaaatacgacaaggacgcctccttcttagccggaggactgttcacagatttcatgattagcgtgatcagcgaagatgactccatcattaagaacataaatcccgctcgaataagtatgaaaatgtggaagctcagtaccagcggcaacagaccacctgcaaatgccgagacgtttagctgcaataaaatcaaagataatgacaaagaagatggatgtttttattttcgtgataaagtgatccccaacaaggtgggtacttactgtatacagttcggattcatgatggacaagaccaatatccttaatagcgagcaggtcatcgtagaagtgctgccgaatcagcctgtgaagttggttcctaaaattaagccaccaactccggctgttagcaacgttaggtctgtggcttcaaggacactggtgcgagatctgcatctgagcataactgacgattatgataaccacactggcattgatctcgtgggtactattatcgccacgatcaaaggcagcaatgaagaggataccgatactcctcttttcatcggtaaagtcagaactttggaatttccgttcgttaacggatctgcggagataatgtcgctggtgctagctgagagctcaccaggacgcgactcaactgaatatttcatcgtttttgaaccacggctgccgctgttgagcagaaccttggaaccgtacatcctacccttcatgttttacaatgacgtcaagaagcaacagcagatggccgcattgactaaagagaaagaccagctgtcccagtctatagtgatgtacaaaagtcttttcgaagcctcgcagcagctgcttaatgagatgaagtgtcaggtggaggaagccaggcttaaggaggcccaactgcgcaacgaactgaagatccataacatcgatatcccaacaacacaacaggtgccacatatagaggccctcctgaaaaggaagttgtcagaacaggaagaactgaaaaaaaaaccaagacgttcctgcactctgcccaattacaccaaaggcagcggagacgtgctgggcaagatagcgcacctcgcccaaatagaagatgatagggctgctatggttatttcctggcatctagcgtccgatatggattgtgtcgttaccctgaccaccgatgccgctcgcagaatatatgacgagactcaggggcgtcagcaggtgctgccattagacagtatctacaaaaagacgctgccagactggaaaaggtctttgccccacttccgcaacggcaagctgtattttaaacctatcggagacccggtattcgccagagacctgctcaccttccccgataatgttgagcactgtgaaacagtgttcgggatgctgcttggagatacaattattcttgataatctcgacgccgctaaccactaccgaaaagaagtagtgaagattacccattgccctactctccttaccagggatggggaccgaatcagatccaacgggaagtttggcggactgcaaaacaaggcacctcccatggataagctcagaggcatggttttcggtgcccctgtccctaaacagtgtctgatcctaggtgagcagatagtccacgcctgcgtgcctagttattcaggcggatac

SEQ ID NO: 24478 - DNA, 6017 bp, Artificial Sequence
  Description of Artificial Sequence: Synthetic coding sequence
atggccgctgccgatggaggaggacctggcggagcctcagtgggtacggaagaagatggcggaggcgtcggacaccgcaccgtgtacctgttcgaccgcagagaaaaggaatccgagctgggagataggcccttgcaggttggggagcggtctgactatgccggttttagggcctgtgtctgtcagacgctggggatatctcccgaggagaagttcgtcatcactaccacgtctcggaaggaaattacctgcgataatttcgatgaaacggtaaaggacggtgttactctttatctcctccagtcggtaaatcagttgctgttaactgcaacaaaggagaggatagatttcttgccacactatgatacactcgtcaaaagtggaatgtacgagtactacgcctccgaagggcagaatccgctccctttcgccctggcagagctgatagataactctttgagcgctacttcaagaaacatcggcgtacgcagaattcaaattaagttgttgttcgacgagacccagggcaaacctgctgtggccgtgatcgacaacggtagggggatgacatccaaacagctcaacaactgggcagtttacagactgagtaagttcactaggcaaggcgattttgagtccgatcatagtggatatgttaggcccgtgccagtgcctagaagcctaaacagtgacatttcctattttggcgtgggtggaaaacaagcagttttcttcgtcggacagtctgctcgcatgatctcaaagccagcagatagtcaggacgtgcacgaactggtgctgtcgaaggaagactttgaaaagaaggaaaaaaataaagaagccatttattccggttacataagaaatcgcaagccttctgactcagtgcatataaccaacgacgacgagcggttcctccaccatctgattattgaggaaaaagaaaaggactcattcacagccgtcgtaattactggggtccagcctgagcacattcaatatctcaagaactattttcatttgtggacacgtcagctcgctcatatataccattactacatccacggccctaagggcaacgagatccggacgagcaaggaggtggagcctttcaacaacatcgacattgaaatctccatgtttgagaaaggaaaggttcccaaaattgtaaatctgcgggaaattcaggacgacatgcagactttatatgtgaataccgccgctgattccttcgaatttaaagctcatgtggagggggacggcgtagttgaggggataattcgctatcatccctttctttacgacagagaaacctatccggacgatccgtgctttcctagcaagctaaaggatgaagatgacgaggacgactgcttcattctcgagaaagccgcacgtggcaaacgcccaatcttcgaatgtttctggaatggcagactaatcccatatacaagcgttgaagatttcgactggtgtacaccccctaagaagagagggctggcacctatagaatgctataatagaatctcgggcgctttgtttacaaacgataagttccaggtgtcaaccaataagctcaccttcatggatcttgaactcaagctgaaggacaaaaatactctctttacccggatcttaaatggccaagaacagaggatgaagattgatagggagtttgcattatggctgaaggattgtcacgaaaagtacgataaacagataaagtttaccctctttaagggggttatcactagaccagacctaccttcaaaaaagcagggcccatgggctacgtacgccgcaattgagtgggacggcaaaatttacaaggctgggcagctggtaaaaacaattaagacattacctttgttctacggttctattgtccggttctttctttacggcgatcatgatggagaagtttacgcaacggggggagaggttcaaatagcaatggagcctcaggcactctacgacgaagtgcgaacggtaccaattgcaaaactggatcggacggtcgccgaaaaagctgttaaaaagtacgttgaggatgagatggccagactcccagatcgcctgtcagtgacctggccagaaggggatgagctccttcccaacgaagtgcgtcccgcaggcacaccgataggggctctgaggattgaaatccttaacaagaaaggggaggccatgcagaagctccccggaacatcacatggtggttcgaagaaactgctagtcgagctgaaagtcatcctgcattctagcagtggcaataaggaaatcatttcccacatcagccaacatggcggtaagtggccctactggtttaaaaagatggaaaacattcagaaactggggaactatactctgaagttacaggtggtgctgaacgagtccaatgcggacacttacgccggacggccattgccatctaaggctataaaattttccgtgaaagagggcaaacccgaaaagtttagctttggcttgctggatctgccctttagagtcggcgtacccttcaatattcctctcgagtttcaggacgagtttggccacacatcgcagctcgtgaccgacatccagcccgttctggaggcaagcggtctgagcctgcactatgaggagattactaagggaccaaactgcgtcattcggggagtcacagccaaagggccagtgaacagttgtcaaggtaaaaattacaacctcaaggtcactctccctggactgaaggaagattcccagatcctgaagataaggctgctccctgggcaccccagacggcttaaggtgaaacctgacagcgaaattctcgtgatcgagaatggcaccgccttcccatttcaagtggaggtgcttgatgaaagtgacaatattaccgcccagccaaagcttatagtacactgtaaattttcaggagcccctaacctcccggtctacgtggtcgattgttcctcctccggcaccagtattttgacgggtagtgcaattcaggttcagaatatcaagaaggaccagaccctgaaggcacgaatcgaaatcccgtcatgtaaagacgtggctcccgtagagaagaccatcaagctcctgccatcatcacatgtggcccgtctgcagatcttcagcgtggagggacagaaagcaatccagataaagcatcaggatgaggtgaactggatcgccggagatatcatgcataacctaattttccagatgtatgatgagggggagcgagaaataaatatcaccagtgcgctggcagagaagataaaggtcaattggactccagagattaataaggagcatttgttacagggcttactcccagatgtccaggtgcccacctccgtgaaagacatgcgttattgccaggtgtccttccaggatgatcatgtgtctctggaaagcgctttcaccgtccggcctcttcctgacgagcctaagcatctgaagtgtgagatgaagggaggaaaaactgtgcagatgggccaggagcttcagggagaagttgtgattatcatcaccgaccagtatgggaaccagatccaggcttttagtccttcctcgctctcaagcctgtcaatcgcaggcgtcgggttagattcaagtaacttaaagaccacgttccaggagaatactcagtccatctctgtgcgcggaatcaagttcatcccaggtcctcccggtaataaagatctgtgcttcacctggagggagttcagcgactttatccgggtccagctgatctccggaccacccgcaaagttacttctcattgattggcccgagctgaaagaatctatccccgtcatcaatggtagagacctgcaaaatcctattatcgtccagctgtgcgaccagtgggataatcctgcccctgtgcagcatgttaagatctccctgaccaaggcttcgaatctgaaactgatgccatctaatcaacagcacaagaccgatgaaaagggacgagccaacttaggagtcttctctgtgttcgccccaaggggagaacatacgctacaggtcaaggccatctataataagagcattatcgagggccctataatcaagttaatgattctgccagaccccgaaaaacctgtgaggctgaatgttaaatatgacaaagatgcaagcttcctggcaggagggttgttcacagattttatgatatccgtaatctctgaggacgattccatcatcaaaaacatcaaccccgctcgaattagcatgaagatgtggaaactgagcacaagcggcaatcgcccaccagcgaacgccgagacttttagctgcaacaaaatcaaagataatgataaagaggacgggtgtttctacttccgagataaggtcataccgaataaagtgggtacatactgtattcagtttggcttcatgatggataagacgaatatccttaatagcgaacaggtcatcgtggaagtgcttcccaaccagcccgttaaactagtcccaaaaattaagccgccaacacctgcagtgtctaatgtccgatctgttgcctcaaggactttagtgcgcgacctgcatctgagcattacagatgattacgataatcatacagggatcgatctcgtgggcacaattatcgcaacaataaagggctccaatgaggaggacaccgacacacctttgttcatcggcaaagtgaggacactggagttcccttttgtgaacggctctgccgagatcatgtccttggtactggccgagtcttctccagggcgagattccacagagtatttcatcgttttcgaaccgaggctccccctgttgtctcgaacactagagccctatattctgccattcatgttttataacgacgtcaaaaaacagcagcagatggccgcactgacaaaggagaaggatcagttgtcgcagagcattgtgatgtataaatcgctgtttgaggccagccagcagttgctcaatgagatgaagtgtcaggttgaggaggcgcgactgaaggaagcccagctgcgcaacgaacttaagatccacaatattgacatacccactactcaacaggtgccccatatcgaggccctcctgaaaaggaaactatcagagcaggaggaattaaagaagaaaccgcgacggagttgtacactcccaaactacacaaaaggcagtggcgacgtattaggtaagatcgctcatctggcccagattgaagacgaccgggctgctatggtaataagctggcacctggcttccgacatggactgcgtggttaccctcactaccgatgctgctcgccgtatttatgacgagactcagggcaggcagcaggttcttcctctggattcaatctacaaaaagaccttgcctgattggaaacgcagcttgccgcactttcggaacggcaagctgtatttcaaaccaattggtgatcctgtgttcgctcgggacctgctcacatttcctgataacgtggagcattgtgagaccgtctttggtatgctcttaggtgacactattatcttggataacttggacgctgcaaaccattacaggaaggaggtggtgaaaattactcactgtccgactcttcttacaagagacggggacaggatcagatcaaatggtaaattcggagggctgcaaaataaggcccctcccatggataagttgcgcggaatggtattcggagctcctgttcctaagcaatgtctgatcctgggcgagcagattgacctgctacagcagtaccggagcgccgtgtgtaaactggactcagtgaacaaagatctaaattctcagctggagtacctccgcacccctgacatgcgtaagaagaagcaggagctcgacgagcatgagaagaatctgaagttaattgaggaaaagctggggatgacccccatcagaaagtgcaacgatagcttgagacactctcctaaggtggaaacaaccgactgtccggtaccccctaagaggatgagaagggaggctacaagacagaaccggatcattaccaagacagacgtgta

SEQ ID NO: 24479 - DNA, 384 bp, Artificial Sequence
  Description of Artificial Sequence: Synthetic coding sequence
atgcctaaaagcaaagaactggtgtcttcttcttcgtctggctctgatagcgacagcgaagttgacaagaaactgaagagaaagaagcaagtggcccctgagaagccggtgaagaaacagaaaacaggggagacctctagggcgctgagctcctccaaacagagttcttcatctagagatgataacatgtttcagatcggaaagatgcgttatgtgagcgttagagatttcaaaggtaaggtattgatcgacattcgggaatattggatggaccctgaaggtgaaatgaagcccggtagaaaaggtatttctctaaaccccgaacagtggtcacagttaaaggaacagatttccgatatcgatgacgctgtacggaagctgtag

SEQ ID NO: 24480 - DNA, 384 bp, Artificial Sequence
  Description of Artificial Sequence: Synthetic coding sequence
atgccgaaaagtaaagaactagttagcagtagctcctccggcagtgactcggattctgaagtggacaaaaagcttaaacgcaagaagcaggtggcacccgaaaagccggtgaagaagcaaaagacaggcgaaacttcacgcgcactctcttcatctaaacagagttcaagctctagagatgataacatgtttcagatagggaagatgaggtatgtgagcgtgcgggacttcaaaggaaaggttctgatcgacatcagagagtattggatggatcccgaaggggaaatgaagccagggaggaagggaatttcactgaatcccgagcagtggtcccaactaaaggaacagatcagcgacattgacgacgcggtgcgcaagttgtag

SEQ ID NO: 24481 - DNA, 384 bp, Artificial Sequence
  Description of Artificial Sequence: Synthetic coding sequence
atgccaaagtctaaggaattggtttcttcatcaagcagcggctctgattccgactctgaagtggataaaaaactaaagaggaagaagcaagtggcacccgaaaaacccgtcaagaagcaaaagaccggggagactagtcgcgcactttcgagcagtaagcaaagcagttcatcccgcgatgataatatgttccaaattggtaaaatgagatacgtctctgtgagggatttcaagggaaaggtgctgatcgatattcgagagtattggatggatcccgagggggaaatgaagcccggtcggaagggtatctctcttaatcccgaacagtggtcgcaactcaaagagcagatctccgacatcgatgacgccgtgcgcaaactgtag

SEQ ID NO: 24482 - DNA, 201 bp, Artificial Sequence
  Description of Artificial Sequence: Synthetic coding sequence
atgcccaagtctaaagaactggttagtagctcctcctcagggtcggattccgactcggaggtggacaaaaagctgaagcgaaaaaaacaggtggctcctgaaaagccagtgaaaaagcagaaaacgggtgagacaagtcgcgcactcagcagctctaagcagagttcttcctccagagacgacaatatgttccaagtctag

SEQ ID NO: 24483 - DNA, 384 bp, Artificial Sequence
  Description of Artificial Sequence: Synthetic coding sequence
atgcctaagagcaaagagctggtgtcaagctcttcctctggatcagattctgacagcgaagtggataagaagttgaagagaaagaagcaggtggctcctgaaaagccagttaaaaagcagaaaaccggtgaaacgtccagagccctgagttcttccaaacagtcctcttcctcccgcgacgacaacatgttccagatcggaaaaatgcggtatgtgagtgtgcgagacttcaagggtaaagtactgattgacataagagaatactggatggatccggagggcgaaatgaaaccgggaagaaaaggcatttccctcaaccctgagcagtggtcccagctcaaggaacaaataagtgacattgatgacgctgtgcgcaagctctag

SEQ ID NO: 24484 - DNA, 384 bp, Artificial Sequence
  Description of Artificial Sequence: Synthetic coding sequence
atgccaaaatctaaagagctggtgtctagtagttcttcaggttcagattcggactccgaggtcgataagaagttaaagaggaagaagcaggttgctccagaaaagcctgtgaagaaacaaaagaccggcgagacctcacgcgctctgtcgagcagtaagcagtcctccagctctcgcgatgacaatatgttccagatcgggaagatgagatatgtaagcgttcgggattttaaagggaaggtgctcatcgacataagggaatactggatggatcccgagggcgaaatgaagcctggacgcaagggaatctcattgaatccagaacagtggtctcagctcaaggagcagatcagcgatatagacgatgccgtccgtaagctctag

SEQ ID NO: 24485 - DNA, 372 bp, Artificial Sequence
  Description of Artificial Sequence: Synthetic coding sequence
atgcccaagtcgaaagaactcgtgagtagctcatcttcagggtccgactctgattcggaagtagacaagaaattgaagagaaagaaacaagttgcccctgaaaagccggtgaagaagcagaagactggcgaaaccagccgagctttatctagttctaagcaaagcagcagtagccgggatgacaatatgttccaaatcggcaaaatgagatatgtttctgtgcgcgatttcaaaggcaaggttctcatcgacattagagagtactggatggaccccgagggtgaaatgaagcctggccgaaagggtatttctcttaaccccgagcagtggagccagttgaaagaacagatcctagtcgctctctggcagtag

SEQ ID NO: 24486 - DNA, 2241 bp, Artificial Sequence
  Description of Artificial Sequence: Synthetic coding sequence
atggcttggatacgtagtacctgcattctcttcttcactctgctgtttgcccacatcgccgctgtccctataaagtatctgccagaagagaatgtgcatgacgctgactttggcgagcagaaggacatctcggaaatcaacctcgccgctggccttgatctcttccaaggggatatccttctgcagaaatctcggaacggcctgcgcgatccaaatacccggtggactttcccaatcccctatatcttggctgataatctgggactcaacgctaagggggcaatcttatacgccttcgaaatgttccggcttaagtcttgtgttgattttaagccttatgagggcgagagctcttacatcatcttccaacaatttgacggatgttggtccgaggtgggcgaccagcacgtcggccagaacatctccattgggcaggggtgtgcgtacaaggcaataatcgagcacgagattttgcatgcactcggcttttaccacgagcaatcaaggacggaccgcgacgattacgtcaacatctggtgggaccagatcctaagtggatatcagcataattttgacacctacgatgacagccttattacagacttgaatacgccttatgactacgaatctctcatgcactaccaaccctttagcttcaataagaacgcgtcagtcccgaccatcactgcgaaaatcccagagttcaacagcataattggacagcgactcgacttctccgcaatcgatctggagagactcaaccgaatgtacaactgtactaccacgcatactttgctcgatcactgcacatttgaaaaagctaacatttgcggaatgatccagggtactcgggacgacactgactgggcacatcaggatagcgcacaggccggtgaagtggaccacactctactcgggcagtgcaccggggctggatacttcatgcagttcagtacctcgtcaggtagcgcagaggaagccgctctgttggagagccgcatcctgtatcccaagaggaaacagcaatgtttgcagttcttctacaagatgacaggcagtccgagcgaccggttggtcgtgtgggtcagacgagacgattctactggcaacgtcaggaaacttgtaaaagtccagacatttcagggagacgatgaccataattggaagatcgcccacgtagttttgaaagaggaacaaaaattcagatacctgttccaggggacgaaaggggacccacagaacagtaccggaggtatttaccttgatgacattacgcttacagaaacgccatgtcccactggagtgtggactgtacgtaacttttcccaggttttggagaacacgtccaaaggcgataagctccaatctccaaggttttacaactcagagggatacggcttcggcgtgacactttatcctaattccagggaatcaagtggatatctgagactggcgttccatgtttgtagcggtgagaacgatgccatcctcgaatggcccgtggaaaacaggcaggtcataataacgattttagatcaggagccagacgtgcgaaaccgtatgagttcttccatggttttcacaacatctaagtcacatacttccccggcaatcaatgacactgtcatttgggatagaccatcccgggtcggaacttaccatactgactgtaattgcttccggtccattgacctggggtggagcgggtttattagccatcagatgttaaagcgacgatccttcctcaagaatgacgatctgatcatattcgttgattttgaggacattacccacctttcccagactgaagttcccacgaaaggcaagaggctttctcctcagggcctgatcctgcagggccaagagcagcaggtcagcgaagagggttcaggtaaggcaatgctggaagaagcattacccgtcagcttatcgcaaggacagccttcacgacaaaagagaagtgttgaaaacacaggcccattggaagatcacaactggcctcagtattttcgcgatccttgtgacccgaacccctgtcagaacgacggaatctgcgttaacgtgaaggggatggcttcatgtagatgcatctcagggcatgcattcttctacacaggcgagagatgccaggctgtacaggtacacggaagcgtcctaggaatggtgattggcggaacagcgggagtaattttcctgacattttccatcattgcaattttgagtcagcggccacggaagtag

SEQ ID NO: 24487 - DNA, 2826 bp, Artificial Sequence
  Description of Artificial Sequence: Synthetic coding sequence
atggagggtgcatccagggtgtgcagacaaggcagagtcgctctgccagctgaggaggactacctcccgctgaagccaagagtcggaaaagcggctaaagagtatccgttcattctggatgcttttcagcgagaggccatccaatgtgtggataacaaccagagcgtcctcgtgtcagcccacactagcgctggtaagactgtttgcgcagagtatgccattgccctcgctctgcgcgaaaagcagcgggtgatctttacttccccgattaaggcactcagcaatcaaaagtaccgggaaatgtatgaggaatttcaggacgtcggccttatgaccggtgacgtgaccataaacccaacagctagctgtctggtgatgactactgagattctacggagtatgctatacagaggcagcgaagtaatgagggaagtagcatgggtaatctttgacgaaattcattacatgagggacagcgaacgaggtgtggtctgggaggagacaattatactgctccccgataatgtgcattatgtgttcctgagcgcaacaatccctaatgccaggcaattcgccgagtggatatgccacctccataaacagccatgccacgtgatttatacagattacagaccaacaccattgcagcattacatctttccagccggaggcgatggtcttcacctcgtagtagatgagaacggggattttagagaagacaactttaataccgcaatgcaggtgctgagagatgcgggtgacctggccaaaggcgaccagaaaggcagaaagggcggaaccaaaggcccttccaatgtgtttaagatcgtcaaaatgatcatggagagaaacttccagcccgtcattatcttttctttcagcaagaaagactgtgaagcctatgctttgcagatgacaaagcttgactttaacaccgacgaggagaaaaaaatggtggaggaagtcttctccaacgccatcgactgtctaagcgacgaagataaaaaattaccccaggtggagcatgtgctgcctctgttgaagaggggaataggcatccaccacggcggtctgctgcctatcctaaaggagactattgagattctgttctctgaaggactgatcaaggccttgtttgccactgagactttcgccatgggcattaacatgccggctcggactgttctcttcactaacgcacgaaaatttgatggtaaggactttaggtggatttccagcggcgagtacattcagatgtccgggagagccggtaggaggggcatggacgataggggcatcgtgatcctcatggtagatgaaaagatgtccccgacaatcgggaagcagctcctgaaggggtccgcagatccactcaattctgcttttcacctaacatacaatatggtcctgaacctcctacgggtggaggaaattaatcctgagtacatgctggagaagtccttctaccagtttcagcattatcgggctatccccggagtcgtcgaaaaggtcaaaaattctgaggaacagtacaacaagattgtcatccctaacgaagaaagcgtggtgatctattataagattagacagcagctagcgaaactgggaaaggaaatagaggaatacatccacaaacctaaatactgtctgccttttttacaacctggacgcctggtcaaagttaaaaacgagggcgacgacttcggatggggagtggtggtgaacttcagtaagaaaagcaacgtcaagccgaattccggcgagcttgaccctctgtatgttgtggaggtgctgcttcgatgttcaaaggagtcacttaagaattcagcaacagaagccgcaaaacccgctaagccagacgagaagggcgaaatgcaggtagtgcccgtactggtacacctgttgagtgctattagctccgtgcggctttatatcccaaaagatctcagaccagtggataaccggcagtctgtgctcaaatccatccaggaagtacagaaacggttccccgacggaattcctttactggaccccatagacgacatggggatccaagatcaggggcttaagaaggtgatccagaaagtagaagcttttgagcataggatgtactcccacccactgcacaatgaccccaacctggaaacggtctatacactatgcgagaaaaaagcacagattgccatcgatatcaaatctgcgaagcgagaactaaagaaggccagaaccgttcttcagatggacgagctcaagtgcaggaagagggtcctgcgcaggctcggcttcgccacctcatccgacgtgatagagatgaagggcagagttgcatgcgagatcagcagcgctgacgagctcctcctgaccgagatgatgttcaacggcctgttcaacgatctctccgccgagcaggccacggctttgttgtcttgcttcgtttttcaggagaacagttcagagatgccaaagttaaccgagcagctggccggacccctgcggcaaatgcaggagtgcgcaaagaggattgctaaggtaagcgctgaagctaaactcgagatcgacgaggagacttacctgtcatcgttcaagccacatttaatggatgtcgtgtatacatgggcaaccggggctaccttcgctcatatctgtaaaatgacagacgttttcgaaggtagtattattaggtgtatgcgccgtttagaggaactgcttaggcagatgtgtcaggcagctaaagcaatcgggaataccgagctcgagaacaagtttgccgaaggaattacgaaaattaaacgagatatcgtgtttgcagccagcctttacctgtag

SEQ ID NO: 24488 - DNA, 3144 bp, Artificial Sequence
  Description of Artificial Sequence: Synthetic coding sequence
atggatgcagaggctgaggataagacccttaggacacgtagcaaaggtactgaagtccccatggacagtctcatacaggagctaagtgtagcttatgactgctccatggccaagaagcgcacagccgaagaccaggctctcggtgtacctgtgaacaagaggaaatcactgctcatgaaacccaggcactattcacccaaggctgattgccaggaagataggtccgatagaaccgaagacgacgggccactggagacccatgggcactctaccgccgaggagattatgatcaaaccaatggacgaaagcttgctgtcgaccgcacaggaaaattcctcgcgaaaggaagatagatactcctgctatcaagagcttatggtgaaaagccttatgcatcttggtaagtttgagaaaaacgtgtccgttcagactgtgtccgaaaatctgaatgacagtggtatacagagcctgaaagccgaaagcgacgaagccgacgagtgtttcctgatccactccgacgatggtagagacaagattgacgactcacaaccaccgttttgttcctctgatgataatgaaagcaattccgaatcagccgagaacggttgggactcaggctctaacttttcagaggagactaaaccaccgcgagtaccaaagtatgtccttacggaccataagaaggacctgctggaagtccccgaaattaagactgaaggtgataaatttatcccttgcgaaaataggtgtgattctgagactgaaagaaaggatccccagaatgcacttgccgagcccttggatggcaacgcccagccgtccttcccggacgtcgaggaggaggactctgaatcccttgctgtgatgactgaggagggtagcgatctggagaaagctaaggggaatctgtcccttctggaacaagctattgctctgcaggccgagagaggatgtgtgtttcataacacctacaaagagctggaccggttcctgcttgaacacttggcaggggagaggcgccagaccaaggtaatcgatatgggtggaagacagatattcaacaataaacacagtcccaggccagagaagagggagaccaagtgtcctataccaggatgtgatgggacaggacacgtaactggactgtacccccatcacaggagtttatccgggtgtcctcacaaagtccgggtgcccttggagattctcgccatgcatgagaatgtattgaaatgccccaccccaggttgcactggtcgtggccacgtgaatagcaacaggaatacacaccgatccttgtccggctgcccaatcgcagccgcagagaagctcgcgatgagccaagataagaaccagctggattcaccacaaacgggccagtgtcccgatcaggcacacagaacttctcttgttaagcaaattgagttcaacttcccatctcaggccataacttcacctagagctactgtctcaaaggaacaggaaaaattcgggaaggtccctttcgactacgcatccttcgatgctcaagtgtttggcaagcgacctctgatacagacagtccaggggaggaagactcctccctttcctgagagcaaacacttccccaatcctgtgaagtttccgaatcgtctgcccagtgctggcgcacacacccagagtccaggcagagctagctcctatagctacggccagtgctctgaagatacgcacattgctgctgccgctgccatactgaatctatccactagatgtagagaagcaaccgacattttgagcaataagcctcagtccctgcacgccaaaggggctgaaattgaggtggacgaaaacggcactcttgatctttctatgaaaaaaaacagaatcctcgataaaagtgcgcctctgacatcaagcaatacctctatccccacacctagctccagtccctttaagacctcgagcatactcgtaaatgcagcattttatcaggcactttgcgatcaagagggttgggacacaccaataaactactcaaagactcatgggaagaccgaagaggagaaggagaaagaccccgtgtcatctctggagaacctggaagaaaagaaattccctggggaggctagcatcccttcccctaaaccaaagctccacgctcgcgacctgaagaaagagctgattacgtgcccaacgccagggtgcgacgggtcaggacacgtaactgggaactacgcctcccacaggagcgtatcagggtgccccttggctgacaagaccctgaagtctctcatggccgcaaattcccaggagcttaagtgtcctacacccggttgcgacgggagcggccacgtgactggaaattacgctagccacagatctctctcaggctgtcctagggcgagaaagggtggagtgaaaatgacccctaccaaagaggagaaagaggatccagaactgaaatgcccggtgatcggatgtgatggccagggacatatttctggtaagtacacttctcacaggacagcctcggggtgtccactggcagctaagcggcagaaggagaaccctttaaacggtgccagtctgagctggaagctgaacaagcaggagctgccccactgccctcttcctggctgtaatggacttgggcacgtgaataacgtattcgtcacccaccgttccctctcaggctgtcctctcaacgcacaagtcatcaaaaaagggaaggtgagtgaagaattaatgactatcaaattaaaagccactgggggaattgagagcgacgaggaaatacggcaccttgacgaggagatcaaagagcttaacgagagcaatttgaagatcgaggctgacatgatgaaactccagacccagataacaagcatggagtccaatctgaaaactatcgaggaagagaacaagttaatagaacagaacaacgagagcctactgaaagagctcgccggattgtctcaggccctgatctcatccctcgccgacatacaactgccccagatgggcccaatcagcgagcagaatttcgaagcttacgtgaatacactgacagacatgtattccaatctggaacgagattactcaccagagtgcaaggccttactggagtccattaagcaagccgtgaaaggaatccacgtatag

SEQ ID NO: 24489 - DNA, 1863 bp, Artificial Sequence
  Description of Artificial Sequence: Synthetic coding sequence
atggacgccgaagccgaagataaaactctgcggacacggagcaagggtaccgaggttccaatggactccttgatacaggagctgagcgtggcctatgactgtagcatggctaaaaagcggaccgctgaggatcaggcactgggcgttccggtcaataaacgcaagtctcttcttatgaagcccaggcactattctcccaaggcagactgccaggaagaccgttccgacaggaccgaggatgatggacccttggaaacacatggccacagcacagccgaggaaatcatgattaagccaatggatgaatccctcctgagcacggcccaggagaatagtagtcggaaggaagataggtacagttgttaccaggagctcatggtcaagtcccttatgcatctgggcaaattcgagaaaaatgttagcgtgcaaactgttagcgagaatttgaatgacagcggaattcaatctctcaaagccgaaagtgatgaagcggacgaatgctttttgattcactcggatgacggcagagacaaaattgacgactcccagcccccattttgtagctccgatgataatgaaagcaactctgaatccgctgaaaatgggtgggactccggcagcaatttcagcgaagagaccaagcctccaagagtccccaaatatgtgctgaccgatcataagaaggacctgttggaagttcctgagatcaaaacggagggtgacaagtttattccgtgtgaaaatagatgtgacagcgagactgagcggaaggacccccaaaatgccctcgcggagccattagacggaaacgcacaacctagcttccccgatgtagaggaggaggacagtgagtccctagcagtgatgaccgaagagggctcggacctggagaaagcaaaggggaacctatcgttgctcgaacaggccatcgctctccaggcagagaggggttgcgtgtttcacaacacatacaaagagctggaccgctttctcctcgagcacttagccggtgagagacgtcagaccaaagtgatagatatgggaggcaggcagattttcaacaataaacatagtccccgacctgaaaaacgggaaacgaaatgcccgatccccggatgtgatgggacaggacacgtgacaggtctctatccccaccaccgatctctgagtggctgccctcacaaagtgagagtgccactggagattctggccatgcatgagaatgtactgaagtgcccaacgcccggttgtaccggacggggacatgtcaactccaacaggaacacacataggtcgctgtctggctgtccaatcgccgctgctgaaaagcttgccatgtcacaggacaaaaaccagctagactccccccagaccgggcaatgcccagatcaggcccaccgaacatcactagtgaaacagatcgaatttaacttcccgagtcaggccataactagccccagggccaccgtttccaaagagcaggaaaaatttgggaaggtgcccttcgattacgcctcattcgacgctcaggtatttggcaaaaggcccttgattcagaccgtgcagggtagaaaaacccctcccttcccagaaagtaagcacttccctaatcccgtgaagttcccaaatcggctgcccagtgctggggctcacacacagagccctgggcgagctagcagttactcctacggccagtgttccgaggacacacacattgcagctgcggcagctattctgaacctctccacacggtgtcgcgaggcaacggatatcctgagcaacaaacctcagagtctccatgcgaaaggcgcagagatagaggtcgacgagaacgggacgctggacctgtctatgaaaaagtag

SEQ ID NO: 24490 - DNA, 42 bp, Artificial Sequence
  Description of Artificial Sequence: Synthetic coding sequence
atggacgctgaagctgaggataagacgctgcggacccgatag

SEQ ID NO: 24491 - DNA, 990 bp, Artificial Sequence
  Description of Artificial Sequence: Synthetic coding sequence
atgtcagctgcagggctgctggccccagcgcctgctcaggcgggagcccctcccgctcccgaatattacccggaagaagatgaggaactggaaagcgcagaggacgacgagcggagttgtcggggacgagagtcagacgaagacactgaggacgcgtccgaaactgacctcgccaaacacgacgaggaggactacgtggagatgaaggagcagatgtatcaggacaagctggccagtctcaagagacaacttcaacaactgcaagagggcaccctgcaggaataccaaaagaggatgaagaaattagaccagcagtacaaagaacggatccgaaatgctgacaccctgttgctgcaggcacagacagagcaagttgagcggaattacataaaggagaaaaaggcagccgtgaaagagttcgaggataagaaggttgagctgaaagagaacctcattgcagaactggaagaaaagaagaagatgatcgagaacgaaaaactcacaatggaattaaccggggacagtatggaagttaagcccattatgacacgcaagttaagaaggcgccctaatgatccagtgcctatccccgacaagaggaggaaaccagcacccgcacagttaaattacctcctcactgatgagcagattatggaggacctcagaactctcaacaaactcaagagcccaaaacgacccgcatcacccagcagccctgaacacctgcctgccacccctgctgagtctcccgcacagcgcttcgaagctcgcatcgaagatgggaaactgtactatgacaaacggtggtatcacaagagccaggcaatttatctggagagcaaggacaaccaaaaattatcatgcgtgatctccagcgttggagcaaatgaaatctgggtccgaaaaaccagcgatagtaccaaaatgcgcatctaccttggccaattgcagagggggttgtttgtgattaggcgcagatcagccgcttag

SEQ ID NO: 24492 - DNA, 987 bp, Artificial Sequence
  Description of Artificial Sequence: Synthetic coding sequence
atgtccgcagcaggacttctggcaccagcgcctgcacaagctggagctccgcctgcgcctgagtattatcctgaggaggatgaagagttagaaagtgccgaagatgacgaacgtagctgccgtgggagagagagtgacgaggacacagaggatgcaagcgaaaccgacctggcaaagcatgatgaagaggactacgtagagatgaaggaacaaatgtaccaagacaagctggcatctctgaaacgccagctccaacaactccaggaaggcactctgcaggaataccagaagaggatgaagaaactggatcaacagtacaaggaacgaataaggaacgccgagctttttcttcagcttgaaacagagcaggtggagcggaattatatcaaggaaaaaaaggccgcagtgaaggagttcgaagacaaaaaagtggaactgaaagagaatctgattgcagaactggaagaaaagaagaagatgatcgagaacgagaaacttacaatggagctgacaggcgacagcatggaggtaaagcccattatgacacggaaacttcggcgacgccctaatgacccagtgccaattcccgacaagagacggaagccagctcccgctcagttgaactacctgttaaccgatgagcaaatcatggaagaccttaggactctcaacaagctgaaatcccccaaaagacctgcttctccatcctccccagagcacctgcctgccactccagccgagtcacccgctcagaggtttgaggcacgcatagaagacggtaaactgtattacgacaaaaggtggtaccacaaaagccaggccatatatctggagtctaaggataaccagaaactgtcatgtgtcatttcgtccgtaggagccaacgaaatttgggtccgaaagacttccgactctacaaagatgcggatctacctcggacagctgcagcgcggtctgttcgtcattcggagacgcagtgctgcctag

SEQ ID NO: 24493 - DNA, 591 bp, Artificial Sequence
  Description of Artificial Sequence: Synthetic coding sequence
atggccagcaatgtgacgaataagaccgatccattgttctcgagttcatttgacttggattatgactttcagcgagactactatgaccgaatgtattcgtacccagccagggtccccccaccgcctcctattgccagagccgtagtgccgtccaaacggcagagggttagtgggaatacctcccggagagggaagagtggcttcaacagcaagagcggtcagagggggtctagcaaaagcggcaaacttaagggagacgatctgcaggcaataaagaaagaactgactcagattaagcaaaaggtcgattcactgctggaaaatctggagaagattgaaaaagagcaatcaaagcaggccgttgaaatgaagaacgataagtccgaggaggagcaaagtagctcatctgtgaagaaggatgaaactaacgttaagatggagagcgaggggggtgctgatgatagtgctgaggaaggcgatttgcttgacgacgatgacaacgaggaccgcggagacgaccaggtaaaaaccacagggaaagagagaaagaggtggtggcgtggcgcacaaggacatatggagtgcttatag

SEQ ID NO: 24494 - DNA, 1197 bp, Artificial Sequence
  Description of Artificial Sequence: Synthetic coding sequence
atggccgtgacgctggataaagatgcatattatcgaagagttaaacgtttgtacagtaactggcgcaagggcgaagacgagtacgctaacgtggatgcaatcgtggtgtcggtgggggtggatgaggagatcgtctatgccaagtccacagccctgcagacgtggctgttcggatatgaactgactgacaccatcatggttttctgcgatgacaagatcattttcatggcatccaagaaaaaagtcgagttcttgaagcagatcgccaacacaaagggaaacgagaatgcgaatggcgcacccgcaattacccttctgattcgcgagaagaatgaatccaacaaaagctctttcgataaaatgatagaagctattaaggagagcaaaaacggaaagaaaataggcgtcttctctaaggacaagtttccgggagagtttatgaaaagctggaacgactgtctcaacaaggaagggttcgataagattgatatatctgccgtggtcgcctacacaatagcagtgaaggaggatggcgaattgaatcttatgaagaaggcagcttcaattacctccgaggtcttcaacaagtttttcaaggaaagagtcatggagatagtagatgccgacgaaaaggtccggcactccaaactcgccgagtctgtagagaaggcgatcgaagaaaagaaatatctggcaggcgcagatccatcaaccgtggagatgtgttacccacccattattcagtccggcggaaattataatctcaagttctccgtagtgtctgataaaaatcacatgcactttggggctattacttgtgctatgggcattcgtttcaagagttattgttcaaacctggtcagaaccctgatggtcgacccatctcaggaggtccaggagaattacaacttcttactccagctccaggaagaattgctgaaagagctacgtcacggagtaaagatctgcgatgtgtacaacgccgttatggacgtggtaaagaaacagaagccggagctgctgaataagatcaccaagaacttgggttttggaatggggatcgaattcagggagggtagccttgttataaactctaaaaaccaatataagctcaagaaaggcatggtgttcagcattaacttaggcttcagtgatttaaccaacaaaaagaaaaaaaaaaagaaaaaagcaaagtag

SEQ ID NO: 24495 - DNA, 954 bp, Artificial Sequence
  Description of Artificial Sequence: Synthetic coding sequence
atgaacaatactgcagccagcccgatgagcactgcgacatcttcgtctggcagaagcactggaaagtcaatctcctttgcaacagagctgcagtctatgatgtactcattgggggatgccaggcgccctctgcacgagactgccgtgctcgtcgaagatgttgtgcacacacaactcatcaacctccttcaacaagctgccgaggtcagtcaactgcgcggagcacgagtcattacacctgaggacctgttgttcctgatgcgaaaagacaaaaagaagttacgcagactgctcaaatatatgtttatccgcgactataaatccaagatcgtgaagggaatcgatgaagatgatttgctggaggacaagctatccggtagcaataatgctaacaaaaggcagaagatcgcccaagattttctgaatagtatagaccagactggcgagttgctggccatgttcgaagacgacgaaatcgatgaagtaaaacaggagcgcatggagagagcagagcggcagaccagaattatggacagtgcccagtacgcggagttttgtgagtctcgccaactgtccttcagcaaaaaggcttccaaattccgggattggctcgactgctcttctatggaaattaagcctaatgtggtggccatggagattctggcatatcttgcgtacgagacagtggctcagttggtcgatctggcactgctcgtgaggcaagatatggtgaccaaagctggagatcctttcagtcatgctatttcagcgacatttatccagtaccacaatagtgctgaaagcacggctgcgtgcggtgtagaagcacactctgacgccatccaaccctgtcatattcgagaggcgattcgcaggtattcccaccggatcggtcctctcagccccttcacaaacgcataccgcaggaacggcatggcttttctggcctgttag

SEQ ID NO: 24496 - DNA, 327 bp, Artificial Sequence
  Description of Artificial Sequence: Synthetic coding sequence
atggaaatactagcatatcttgcttatgaaactgttgcacagctggttgatctggctctactcgtgcggcaggacatggtgactaaagccggagatccgttctcccacgcaatcagcgcgacctttatacagtatcataactctgctgagtcgactgcagcttgcggcgtggaagcacattcagacgcgattcaaccatgccacatccgagaggcaattcgtaggtactcacaccgcatcggcccactgagtccttttactatctccttctccctgacggaatgtcttccccaggaatgggatgggttctcctccctgctcatgtag

SEQ ID NO: 24497 - DNA, 954 bp, Artificial Sequence
  Description of Artificial Sequence: Synthetic coding sequence
atgaataatacagctgcttcccccatgtccacagcaacgtcatcttcagggcgttccaccggtaaaagtatttcctttgcaacggagcttcagagtatgatgtacagcctgggcgacgccagacggcctctgcatgagacagccgtgctcgtggaagacgtagttcacactcaactcattaacttgctgcagcaggctgctgaggtatcgcagttacgcggtgcccgtgtgatcacgcccgaggaccttctgttcctaatgcggaaagataagaagaaattgagacgtctactaaagtacatgtttattcgcgactataagtccaagatcgtgaagggtattgatgaagatgacctgcttgaggataaactctcaggaagcaataatgccaacaagagacagaagatagcccaggatttcctgaattcaatagaccagaccggcgagttgcttgctatgtttgaggatgatgagattgacgaagtgaagcaagagagaatggagcgtgcagagcgacaaactaggattatggactctgctcaatatgccgagttttgtgagtcacgccaactgtcattctctaagaaagcctccaaatttagggattggctggactgtagctctatggagatcaaacctaatgtcgtggctatggagatactggcttacttggcttatgaaaccgtagcccagctggtggatctggctctgctggtacgccaggacatggttactaaggcgggagaccccttcagccatgcgatatccgcgacctttatccagtatcacaacagcgcggagagtacggccgcttgtggcgtggaggcgcactcggatgcaattcagccatgccacatccgtgaagctatccgcaggtactctcaccgcattgggcctttgtctcccttcaccaacgcataccgacgaaatggcatggcattcctcgcctgctag

SEQ ID NO: 24498 - DNA, 987 bp, Artificial Sequence
  Description of Artificial Sequence: Synthetic coding sequence
atggtggttttcggtaccacgtttttcaattttgattcatttattggcaagacggacagtatcgagattatcgggaagtccgtgtttccttactgttatcacaatatcctcccactcctaaacgactcaggtcgttactcactgggggatgctcgtagacctctgcacgagaccgccgtgctggtcgaggacgtcgtccatacacagttgattaacctcctccagcaggcagccgaggtcagccagctccgcggtgcccgagtaatcacacccgaagatctgctgtttttgatgcgaaaggacaagaagaaattgagacggcttctaaaatacatgtttatccgagactacaaatctaagattgttaaaggaatagacgaggacgatctgctggaggacaaattatccggctctaacaacgcaaataagcgccagaagatagcacaggattttctcaatagcattgatcaaactggagagctcctggctatgttcgaagatgatgagatagatgaggtgaaacaggagcggatggaacgggctgaacggcaaaccaggatcatggattctgcccagtacgcagagttttgcgagtcaagacagctctctttctccaaaaaagctagtaagtttagggactggttagactgcagttccatggagattaagccaaatgtagtagctatggaaatattagcatacttggcttatgaaacagtagctcagctcgtcgacttggccctgctggtgaggcaagacatggtgactaaggcaggggatcctttctctcatgccatctccgctaccttcatccagtatcataacagtgctgagagtaccgccgcatgcggcgtcgaggctcactcagatgctatccagccatgtcacatccgggaagccatccggcgttactctcacaggattggcccactgtcaccctttactaatgcttacagaaggaacggtatggcctttttagcatgttag

SEQ ID NO: 24499 - DNA, 987 bp, Artificial Sequence
  Description of Artificial Sequence: Synthetic coding sequence
atggtggtatttggcaccacctttttcaattttgactccttcattgggaagaccgacagcattgagattattgggaaatcagtctttccctattgttaccacaatatcctgcctctgctgaacgacagcggccgatacagtttgggggacgcccgtagaccactccacgagactgcagtgctcgttgaagatgtcgttcatactcagctgatcaacctcctgcagcaagcggcagaagtgtcacagctgcggggtgcacgcgtgataacgcctgaagacttgcttttcctgatgcgaaaagacaaaaagaaactccgacgcctgcttaagtacatgttcatccgcgactataaatcaaagattgtcaagggcatcgatgaggacgatctgttggaggataagctcagtggatcaaacaacgccaacaaaaggcaaaaaatagcacaggattttctgaacagcatcgaccaaacaggagaacttcttgccatgttcgaagatgacgagattgatgaggtcaagcaagagaggatggaaagagcggagcggcagacacggatcatggacagtgcccagtacgctgagttctgcgagagcagacagctatcatttagtaaaaaggctagcaaattccgggattggctggactgctcctctatggagatcaagcccaacgtggttgcgatggagatcctggcctatttggcatatgaaaccgttgcgcaactcgtagatctggcactgttggtcaggcaggacatggtgacaaaggccggtgatcccttttctcacgctatcagtgcgaccttcatacagtatcataactctgctgaatcgactgccgcttgcggtgttgaagcacattccgacgccatacagccttgtcacatcagggaagccataagaaggtacagtcaccgtatcggcccactgtcccccttcaccaatgcttatcgccgaaatgggatggcttttttagcctgttag

SEQ ID NO: 24500 - DNA, 954 bp, Artificial Sequence
  Description of Artificial Sequence: Synthetic coding sequence
atgaacaatactgctgcctcacccatgagtacggctacttcctctagcgggagaagcacgggcaagagcatctctttcgcaacagagcttcagtccatgatgtactccttgggagacgccaggcggcctctccacgagacagcagtgctagtggaggatgtggttcacactcaactcattaacttgctgcagcaggctgcagaagtgagccagctgaggggcgctagggtcatcacccctgaggacctcctttttctgatgaggaaggataagaagaaactgcgccgactcttgaaatacatgtttatcagagactacaagtcaaaaattgtgaagggcatcgatgaggacgacctactggaggacaagctctctggatctaataacgcaaacaaaagacaaaaaattgcccaggactttctgaatagcatcgaccagacgggagagctccttgccatgtttgaagatgatgaaatcgacgaggtgaagcaagagagaatggagagggccgagcgtcagacacgcataatggattctgcgcaatacgcggaattttgtgagagcagacagttgagtttttcaaaaaaagcatccaaattcagggactggctagattgttcaagcatggagattaagcctaacgtggttgccatggagatcctggcctaccttgcgtacgagactgtagcccaattggtcgatttggccctgctcgtacgccaggatatggttacaaaggcaggggacccattctcgcacgccatttcagccacctttatccagtatcacaactccgcagaaagtactgccgcttgcggcgttgaagctcacagtgacgcgatacagccctgtcacatacgggaggctatcaggcgctattctcaccgcatcggcccactctctcccttcacgaacgcctatagaaggaatgggatggcattcttagcatgctag

SEQ ID NO: 24501 - DNA, 624 bp, Artificial Sequence
  Description of Artificial Sequence: Synthetic coding sequence
atggctggcccagctacccagtcgccaatgaagttaatggctctccagctgctgctgtggcactccgcactgtggactgtgcaggaagcaacacctttgggcccagcctcttctcttcctcagagtttcctgctgaaatgccttgagcaggtgcggaagattcagggcgacggcgcagctttgcaggagaagcttgtgtctgagtgtgccacatacaagctgtgccatccagaagagcttgtgctgctcggacatagcctcgggatcccatgggctcctttgagtagctgtccatcacaagccctccaactcgctggatgtctgtcccagcttcactccggcttgttcctttaccaaggacttcttcaggcccttgagggaatctcaccggaactcggcccaaccctagacacgctccagctcgatgtcgccgactttgccaccaccatctggcagcagatggaagagctagggatggccccagccctccagcccactcagggagcaatgccggctttcgcaagcgcgttccagagaagagccggaggagtgctggttgcatctcatcttcagagcttccttgaggtctcctaccgcgtactacggcatctggcccaaccctag

SEQ ID NO: 24502 - DNA, 2220 bp, Artificial Sequence
  Description of Artificial Sequence: Synthetic coding sequence
atggcccctcagaaacatgggggtgggggtggcggtggctccggccctagcgcgggatcgggcggtggcggtttcggaggctctgctgctgtggctgctgcaactgcctccgggggtaaatccggcggaggaagttgcggcggtggcggtagctactccgcatcctcttcgtcgagcgccgctgctgcggctggcgctgctgttctcccagtcaaaaagcctaagatggaacacgtgcaggccgatcacgaactattcctgcaagcttttgagaagcctacccaaatttaccggttccttcggactcggaaccttatcgcacctatctttctccatcggaccctgacatatatgtcacaccgtaacagcaggactaatattaagcgcaaaaccttcaaggtcgacgatatgttgagcaaagtggaaaaaatgaagggggagcaagaatctcattcgctctccgcccatctccagctgacgttcacagggttctttcacaagaatgataaaccatctcccaattctgaaaacgagcagaattccgtgaccctagaggtgctccttgttaaagtgtgtcacaagaagaggaaagatgtgagctgccctattagacaagtgccaacgggtaaaaagcaggtgcccttgaatcccgatttaaaccagactaaacctggcaacttcccatcactagctgtgtccagtaatgagttcgagccctctaactcacatatggttaagtcctatagcctcttattccgagttaccaggccaggcagaagagaattcaacgggatgataaacggggagactaatgagaacattgatgttaacgaagaattgcccgctcggaggaaaagaaaccgcgaggatggggaaaagacattcgttgcccagatgacagtattcgataagaaccggcgtctgcagctgcttgatggagaatatgaggtcgctatgcaagagatggaggaatgccctatttccaagaagcgtgccacctgggagacaattctggacggcaagcggcttccgccatttgagaccttctcccagggacccactctccaatttaccctgagatggacaggagagaccaatgataagtccactgctccaattgccaaacccctggcaacacgaaactctgagtctctgcaccaggagaacaagcccggaagtgtgaaacctacccagactattgctgtaaaggagtcactaacaactgacctccagacgcgcaaggaaaaggataccccaaatgagaatagacagaagcttagaatcttttaccaattcctctataataataataccagacaacagacagaggctcgggacgatctccactgcccatggtgcactctcaactgtcggaagctgtactcgttgcttaagcatctgaaactgtgtcacagccgcttcatcttcaattatgtttatcatccgaagggcgcacgcatcgatgtgtcgattaacgaatgttatgacgggtcgtacgccggaaacccccaagatatccatcggcaacctggctttgcttttagcaggaatgggcctgtgaaaaggactccaattactcacatcctagtctgtaggcctaagcgaacaaaggcttcaatgagtgaattcctggaaagcgaagacggtgaagtggagcagcagcgtacctatagcagcggacacaatagactgtattttcactctgatacctgtttgcctttacgaccccaggaaatggaagtggatagcgaggatgagaaggaccctgaatggctgagagaaaagactatcactcagattgaagagttctcagacgtgaatgagggcgagaaggaagtgatgaagctctggaacctgcatgtaatgaagcatggatttatagctgataaccagatgaatcacgcctgcatgttgttcgtggagaactacggccagaagatcatcaagaagaacctgtgtaggaactttatgcttcacctggtcagtatgcacgacttcaatctgatctccattatgtccattgataaagctgtgacgaagctgcgtgagatgcagcagaaactagagaagggagagagcgcatccccagccaacgaagagataactgaggaacagaacgggacggccaatggatttagcgagattaatagtaaagagaaagccctcgagaccgatagtgttagcggagtatcaaaacagtcaaagaagcagaaactgtag

SEQ ID NO: 24503 - DNA, 1938 bp, Artificial Sequence
  Description of Artificial Sequence: Synthetic coding sequence
atgtctctcaaaatggataaccgggacgtagctggaaaagctaatcgctggtttggcgtggcccctcctaagtccgggaagatgaatatgaatatcctccatcaggaggaactaatcgcccagaaaaagagagaaatcgaggccaagatggagcagaaggctaagcagaaccaggtagcctccccacaacctccccacccaggggagatcaccaacgcgcataatagctcctgtatcagtaataagttcgccaacgatgggtctttcctccagcagtttctaaaacttcaaaaggctcagacctccactgacgctcctacaagtgctccatccgcacccccatcaactcccactccatccgctggtaaaaggtctctgcttattagccgaaggacagggcttggcctggcgtcactccccggtccagtgaaatcttattcacacgccaaacaactaccagttgcccatcgtccgagtgtctttcaatccccagatgaggatgaagaggaggactacgaacaatggctggagatcaaggtatccccgcctgaaggagcagagactagaaaagttatcgaaaagctggctcgctttgtcgccgaggggggacccgagctcgagaaagttgccatggaggattacaaggacaacccagccttcgccttcctccatgacaagaattccagggaatttctgtactataggaagaaagtggcggaaatcaggaaggaggcccagaagtctcaagcggcatcccagaaggtatcacctcccgaggacgaagaagtcaaaaatctggctgaaaagcttgctcgttttatcgccgacggtggacccgaggtagagacaattgccttacaaaacaatagggagaatcaggcgtttagcttcctgtatgaaccaaactcacagggatacaagtactaccgtcagaagcttgaggaattcaggaaggccaaggccagttcgactggaagctttaccgcaccagaccccggactaaaacggaagtctcctccagaggcactttctgggtctcttcccccagcaaccacatgccctgcctcgtccacaccggcaccaaccattattcctgccccagccgcaccagggaaaccagcctccgccgctactgtcaaaagaaagaggaagtctcggtggggaccggaggaagataaggtggagttaccacccgctgaactcgtacaaagggatgtggacgctagtccgtcacccctgtcagtgcaggatttgaaggggctggggtacgaaaaaggcaagcccgtcgggctggtgggcgtcactgaattgagtgatgcacagaaaaagcagctgaaagagcaacaggaaatgcagcaaatgtacgatatgattatgcagcacaaacgggctatgcaagacatgcagctgctctgggagaaggcagtgcaacagcatcaacatgggtatgactctgacgaggaagtggactccgagctggggacttgggagcatcagctgcgacgtatggagatggacaaaacgagggagtgggccgagcagcttacaaaaatgggcagaggaaagcatttcattggggactttctccccccagatgaactagaaaagttcatggagacatttaaggcactgaaggaaggtcgtgagcctgactactccgaatacaaggaatttaagttaacagtagagaacattggttatcagatgctcatgaaaatgggctggaaagagggtgagggcctgggaagtgagggccagggcatcaagaatccagttaataaaggcaccacaacggtggacggggcaggctttggtatcgatcgccctgccgaactctcaaaagaagacgacgaatacgaggcatttcgcaaaaggatgatgctggcctaccgcttccgcccaaacccccttaataaccctcgccgaccatactattag

SEQ ID NO: 24504 - DNA, 669 bp, Artificial Sequence
  Description of Artificial Sequence: Synthetic coding sequence
atgtcactgaagatggacaacagggatgttgccggtaaagcgaatcgctggtttggagttgcgccacccaagtcaggaaaaatgaatatgaatatccttcaccaggaggaactcatcgcccagaaaaagcgcgaaatagaagcaaagatggaacaaaaagcaaagcagaatcaggtcgccagccctcagccccctcatccgggagagattacgaacgctcacaactccagctgtatcagtaacaagtttgccaatgatgggtcgtttctccaacagttcctcaaacttcagaaggcgcaaacatccactgacgcgcctacctctgcgccaagcgccccaccttcaactcctacccctagtgccggaaagagaagcctactgatttcgaggcggaccggcctcggccttgcaagcctacccggtccagtgaaatcgtactcacacgcaaaacagttgccggtcgcacatcgtccttccgtttttcagagccctgacgaggatgaggaggaagactatgaacagtggttggaaatcaaagtctgcctcaccaagaccgttaggcctactccaccaagctcttggtgtttcgtccctggattgggcacgcctgactccctgctacacctgacgcttttctctcctcatccgctatgccgatgtgggccttag

SEQ ID NO: 24505 - DNA, 558 bp, Artificial Sequence
  Description of Artificial Sequence: Synthetic coding sequence
atgagtctgaagatggataacagggacgttgccggaaaggccaaccggtggtttggcgtagcccctcctaagtcagggaagatgaacatgaatatcttacaccaggaagaactcatcgctcagaagaaaagagaaattgaagcgaagatggagcagaaagctaaacaaaaccaagtggcaagcccccaacctccccaccctggcgaaatcacaaacgcacataattcaagttgtataagcaacaagttcgcaaatgacgggtcctttttacaacagtttcttaagctgcagaaagcccagacatccactgatgcgcctactagtgccccatccgccccaccaagtactccaacaccttctgccggaaaacgcagtctcctgattagcagaagaacaggactgggactcgcctctctcccaggaccggtgaagagctacagccatgctaagcagctgcctgtggcccaccgtcctagcgtctttcagtctccagacgaggacgaagaggaggattatgagcagtggctggaaatcaaaggcagacgatggctgaggtag

SEQ ID NO: 24506 - DNA, 3093 bp, Artificial Sequence
  Description of Artificial Sequence: Synthetic coding sequence
atggccgctcgaaggatcacacaggagaccttcgatgccgtcctacaggaaaaggcaaaacgctatcacatggacgccagcggcgaggcagtgagtgaaacgctgcagtttaaagcgcaggatttactaagggccgttccaaggtctcgagctgagatgtacgacgacgtccactccgacgggaggtattccttatctggttccgtggcccatagccgcgatgccggtcgggagggccttagatcagacgttttccctggtccttcattccgctcctccaacccctctatcagcgatgactcatatttccgtaaggagtgcggcagggatctcgagttttcccactccgattcccgggaccaggttataggccaccgcaagctgggccacttccggagtcaagattggaaatttgccttaagaggctcgtgggagcaggatttcggtcatccggtaagtcaggagagcagctggagccaggaatattcctttggccctagtgctgtactaggtgactttggaagttcccgtttaatcgaaaaggagtgcttagagaaagagtctcgcgattacgacgtagatcatcctggcgaggccgattctgtgctgagggggggaagtcaagtgcaggcccgtggccgtgctctgaacatagttgaccaagaggggtcacttctcgggaaaggagagacccaggggctccttaccgctaagggcggagtgggaaagcttgtaactctgagaaacgtctctaccaaaaaaattcctactgttaataggatcacccctaagactcagggaacaaaccagattcagaagaatacccctagcccagatgtgactcttgggaccaaccctgggacggaggatattcagttccccatccagaaaatacctttaggcctcgacctgaagaatcttagattacccagacgcaagatgtcttttgacatcattgataaaagcgatgttttcagcaggttcgggatcgagattattaagtgggctgggttccataccatcaaggacgatatcaagttttctcaactgttccaaaccttgttcgagctcgagaccgaaacctgtgccaagatgctggcctcctttaaatgttccttgaagcccgagcaccgggatttctgtttcttcacgataaaatttctcaaacatagtgcattgaagacccctcgggtcgataacgagtttctgaatatgctccttgataagggggctgtgaagacgaagaactgctttttcgaaatcatcaagccattcgacaagtacattatgagactgcaggatcgcctcctgaaaagcgtgacccctttactgatggcctgcaacgcttacgagctctccgttaagatgaaaactctttcaaaccccctcgacctcgccctggccctagagacgacgaactctctatgccgcaagagcctggccctgttggggcagactttttcacttgcttcctccttccggcaggaaaaaattctggaggcggtgggcctgcaggacatcgctccatcacctgcagctttccccaacttcgaagactccacgttattcggtagggaatatatcgaccatctgaaagcatggttggtcagctccggctgccccctgcaggtcaaaaaggctgagccagagcccatgcgcgaagaagagaagatgattccacccaccaaacctgagattcaagccaaggcaccttccagcctcagtgatgccgtacctcagagggccgaccacagagtggtcggtaccatcgaccagcttgtgaagcgcgttattgaaggttccctgtcccccaaggagaggacactgttaaaggaagatccagcgtactggtttctgagtgacgaaaactctttggaatacaaatattataagctgaagctcgcggaaatgcagcgtatgtcggagaacttgcggggagccgaccagaaacctacttccgcagactgtgccgttagggctatgctctatagccgcgctgtcagaaacctcaaaaaaaagcttcttccttggcaaaggcgtgggctgctgcgagcccagggtttgagagggtggaaggcaaggagagccactaccggtacccagaccttgctctcctctgggacccgtctcaagcaccatggcagacaggctccgggattgagccaggccaaacccagtctcccggatcgcaacgatgccgctaaagattgccctccagatcccgtcggacctagccctcaggatccatcactggaggcctcgggccctagtcccaaacctgctggtgttgacatttcagaagctccacaaactagctctccctgccctagtgcggacatagacatgaagaccatggagacggccgagaaattggctcgattcgtggcccaggtcggtccagagatagagcagttctcgatcgagaactccactgacaaccctgacttgtggttcctgcatgatcagaattcatctgcctttaagttctaccgtaagaaggtgtttgagttgtgcccctccatctgcttcacatcaagtccacacaatctacatacgggaggaggagatacaaccggttcacaagagtcccctgtcgacctgatggagggcgaggctgaatttgaggatgagccgccaccacgcgaagcagagctggagtcccctgaagctagctccggcacatgtttccctcgcaagagaatctctagcaagagtctgaaggtgggtatgatccccgcacccaagagggtgtgtctcatccaagagcccaaggtccacgaaccggtcagaatcgcatacgatcgtcccagagggcgtccaatgagcaaaaagaaaaagcctaaagaccttgattttgcccagcagaagctgacggacaaaaacctggggtttcagatgcttcagaaaatggggtggaaagaaggacatgggctggggagtttaggcaaggggattagggagcccgttagcgtggggactccttctgagggggaggggctcggcgctgatggccaagagcataaggaagacacttttgacgtttttcgccaaagaatgatgcaaatgtatcgacataagagagctaataaatag

SEQ ID NO: 24507 - DNA, 3249 bp, Artificial Sequence
  Description of Artificial Sequence: Synthetic coding sequence
atggcggcacggcgtatcacccaagagaccttcgacgcagtccttcaggaaaaggcaaagcgctatcatatggatgcctcgggcgaggccgtgtcggaaaccctgcaatttaaagcccaggacctgctgagagctgtccccagatcaagggcggaaatgtacgacgacgtacacagtgacggccgttattccttgtcagggtcagtggctcattccagggacgcaggcagagaagggttgcgaagcgatgtgttccctggcccatctttccggtctagcaacccgtcaatcagtgatgacagttattttcgtaaagaatgcggaagagaccttgaattctctcacagcgactcaagagatcaggttattggacacaggaaactgggtcacttccggtcccaggactggaagttcgctctcagaggctcttgggagcaagactttgggcaccccgtgtctcaagaaagctcttggtcccaggagtatagtttcggccctagcgctgtcctcggagacttcgggagctcacgactgattgaaaaggagtgtctggagaaagagtcccgcgactacgacgtggatcacccgggtgaggccgatagcgtgctgcgcggtggatcccaggtgcaggccaggggcagagcactcaacatagtcgatcaggaggggagtctcctcgggaagggagaaactcaaggtctattgactgctaagggcggagtggggaaactggtgacactccggaacgtttctaccaaaaagatcccgaccgtgaaccgtattactccgaagactcaagggacaaatcaaatccagaagaacacaccttcgcccgatgtgactctcggaaccaatccaggcaccgaagacattcagttccctattcagaagatcccacttggtttagatctcaagaacctgaggctcccaaggagaaaaatgtcctttgatatcatcgacaaatctgacgttttctctagattcggaattgaaattattaaatgggcgggattccacacgatcaaggacgatataaaattttcacaactgttccagaccttatttgaattggagaccgaaacctgtgccaagatgctggcttccttcaagtgtagtctgaagcctgagcatcgcgatttctgcttcttcaccataaagttcctaaagcacagcgcgttaaagaccccgcgtgttgacaacgagttcttaaatatgttgctcgacaagggcgctgtgaaaaccaagaattgctttttcgagatcattaagccctttgacaaatacataatgcggctgcaggatcgcttgctgaagtccgtaacccctcttcttatggcctgcaatgcatacgaactgtcagttaaaatgaaaaccctgagcaacccactagatctggcactcgccctggagacgaccaactctctgtgtagaaaaagtttggcactgctgggccagacattctccctcgcctctagctttcgccaagagaagattctggaggcggtcggattacaggacatagctcccagcccagctgcctttcccaatttcgaggactctactcttttcgggagggagtatatagatcatctgaaagcctggcttgtgagctcaggctgccctttgcaggtaaaaaaagcggagcccgagcccatgcgggaggaggagaaaatgatcccgcctaccaaaccggagattcaggccaaagcacctagcagtctcagcgacgccgtgcctcaacgggcagaccatcgagtggtgggaactatagatcaattagttaaacgagtcattgagggctccctgagtccaaaggagaggactctactcaaagaagaccccgcttattggtttttgtctgatgagaatagcctggaatacaaatattacaaactgaaactggccgagatgcagcggatgtcggaaaatcttcggggagctgatcagaaacctacaagtgccgattgtgcagttcgcgctatgctttattcccgagcagtccgcaacctcaagaagaagctgctaccatggcaacgccgaggcctcttgcgggcacagggactcagaggatggaaggcacgtcgggctacaaccggcacacagactctgctctcttctggcacaaggctgaagcaccatggcagacaagcccctggactatcccaggccaagccctcccttcctgaccggaacgatgccgctaaggactgccccccagaccccgttggaccttcgccacaggatccctcccttgaagcaagcggcccatctccaaagcccgcaggcgtggatatctctgaagctccacagacgtctagtccctgcccgagcgccgacatagatatgaagaccatggagacggcagagaaattggcaaggttcgttgcacaggtgggacccgagattgagcagttcagtattgagaattcaacggacaaccctgatttgtggttcctgcacgatcagaactctagcgcgttcaaattctaccgcaaaaaagtgttcgaactttgtccctcaatttgtttcacgtccagcccacataacctccacacagggggtggagataccaccggctctcaggaaagccctgttgacctcatggagggagaagccgagtttgaggatgagccacctcctagggaagccgagcttgagagccccgaagtgatgcctgaggaggaggacgaggatgatgaggacggcggagaggaagcaccagcgcctggaggtgccggaaagagcgaggggtctacccctgccgacggactccctggagaggcagcggaggacgacctggctggtgccccagccctgtcccaggcctcgtctggaacatgttttcccaggaagcgtatttcctcgaaaagcctgaaagttggcatgattccagcacctaagagagtctgtttgattcaggaacctaaagtacacgaacctgtgcggatcgcttatgataggccacgcggacggcctatgtcaaagaagaagaagcctaaggaccttgacttcgcccagcagaagttgaccgacaagaatctgggctttcagatgctgcagaagatggggtggaaggaagggcatggcctgggatccttgggcaaaggaatccgcgagccggtgagcgtcggtacgcctagcgagggcgaagggctgggtgccgatggccaagaacacaaagaggataccttcgatgtgttcagacagcggatgatgcaaatgtacaggcataaaagagctaacaaatag

SEQ ID NO: 24508 - DNA, 3249 bp, Artificial Sequence
  Description of Artificial Sequence: Synthetic coding sequence
atggccgcaagacgaatcacccaggagaccttcgacgccgtgctgcaggagaaggctaaacgttaccacatggacgcctctggggaagccgtgtcggaaacactgcagtttaaggcccaagacctacttcgcgcagtgccccgaagcagagccgagatgtatgacgatgtgcactcggacggacgttatagcttgtcaggcagtgtagctcattcaagagacgcaggacgagaggggctgagatctgacgtatttccaggccctagcttccgcagctcaaatcctagcatctccgacgattcatatttcagaaaggagtgcggtcgagatcttgagttctcacatagtgactcacgagatcaggtcataggacacagaaaacttggtcattttcgcagccaggactggaaattcgcgctgcggggatcctgggagcaagacttcggacatcccgtgtctcaggaaagttcctggtcccaggaatactcctttggtccttctgccgtgttgggggactttggcagctcgcgcctgattgaaaaggagtgcctagaaaaagaatctagggactacgacgtggaccaccccggagaagcagactctgtgctccgtgggggttcccaggtccaagcacgcggtcgagctctgaatatagtagatcaagagggttccctgctgggcaagggggagacgcagggccttttgacagctaagggcggtgtgggcaagctggtcaccctgaggaacgtatctaccaagaagatccccaccgtgaaccggatcacccctaaaacccaaggcaccaaccagattcagaaaaataccccctctcctgacgttacgcttggcaccaatccaggcaccgaggatattcaattccccattcaaaagattcctctgggccttgacttgaagaacttacgtttgccaagacgcaaaatgagctttgatattatagacaaatccgacgtgttctcacgcttcgggatcgagattatcaagtgggccggatttcacactataaaggacgatattaagttttctcagctgttccagacattatttgagctggaaacggagacctgtgcaaagatgctggccagttttaagtgttccctgaagccagaacatagagacttctgcttcttcaccatcaaatttctaaagcactctgccctaaaaacacccagagtggacaacgaattcctgaatatgctgttagataagggtgccgtgaagacaaaaaattgcttcttcgagataattaagccattcgacaagtacattatgagactgcaggatcggctactgaaatctgttacaccacttctcatggcttgtaatgcttacgagctgtcagtgaagatgaagaccttgagcaacccactcgacttagcccttgcattagaaaccaccaattccctgtgtcgaaagtctctggccctcctcgggcagaccttttctctggcctccagcttcaggcaggagaagatactggaggcggtaggtctgcaggatatcgctcccagtcccgctgcttttcctaactttgaggactccactctgttcggacgggaatatattgaccaccttaaggcatggctggtctcctccgggtgtcctttacaggtgaagaaagccgagccggagccaatgcgtgaggaggaaaaaatgatccccccaaccaaaccggagattcaggccaaggcccctagcagccttagtgacgcggtgcctcagagagccgaccaccgcgtggtgggcaccattgatcaactggttaaaagggtgatcgagggctcacttagcccaaaagaacggacattgcttaaggaggatcccgcttactggtttctatcagacgagaactctcttgagtacaagtattataagctcaagttagcagaaatgcagcggatgtcggaaaacctgagaggcgctgatcaaaagccaacgagtgccgactgtgcggtccgcgctatgctctactccagagccgtaaggaacttgaagaaaaaactgcttccatggcagcggcgaggattgttgcgcgcacaaggactgcgaggatggaaagcacgcagagccactacgggcacccaaacactactcagctcggggacccggctaaaacaccacggtcgtcaggccccaggcctcagccaagccaagccatcgctgcctgaccggaacgacgccgctaaagactgccctccggaccctgtagggccatcccctcaggatcccagcctggaggccagtggaccttcacctaagcctgctggagttgacatctcagaggctcctcaaacttccagcccatgcccgtctgccgacattgatatgaaaacaatggaaactgctgagaagcttgcaagattcgttgctcaggttggcccagagatcgaacagtttagcatcgaaaacagcactgacaacccggacctgtggttcctgcatgaccagaactcttctgcgtttaagttttaccgcaagaaagtgtttgaactgtgcccgtccatctgtttcacatcctctcctcacaacctccatactgggggtggtgacacaacaggtagccaagaaagccccgtggacctcatggagggagaggctgagtttgaggacgagcctccacccagggaggcggaactggaatcgcctgaggtcatgcctgaggaggaggatgaagatgacgaggatggcggagaagaagcaccagccccaggcggtgccggaaagtctgaagggagtacaccagcggatggattaccgggagaggccgctgaggatgatcttgctggagcacccgctctcagtcaggcatcctctggcacttgctttcctaggaaaaggatatccagtaaaagtcttaaagtaggcatgatccccgctcctaaacgggtgtgtctgatacaggagccaaaagtgcatgagcctgttcgcatcgcttatgaccgccctcggggacgtccaatgagtaagaagaaaaaaccaaaggatctggatttcgcccagcagaaactcactgataaaaacctcggattccaaatgctgcagaaaatgggatggaaagagggccatggattaggaagcctgggtaaggggatcagggaaccagtttcagtgggtactcctagtgaaggtgagggccttggagccgacgggcaagaacataaagaggatactttcgatgtcttccggcaaagaatgatgcagatgtacaggcataagagggcaaataagtag

SEQ ID NO: 24509 - DNA, 2586 bp, Artificial Sequence
  Description of Artificial Sequence: Synthetic coding sequence
atgacagctacttttgcaaagaatgtggccggaatttggaacttcttaaccttaatccttggcacgagaagcctcgctacgggcaattgggggatctcggtgctgcggaccgggaatctgagatcagtggtcctgggaaataagacccttgcaatccaattcctgaagtccccactgggccaccgcagcatcgtcctgataccccttggtctcgatctaaagaacctgcgcctgccacggaggaagatgagtttcgacatcatcgataagtcagacgtattcagcagatttggaatcgagattatcaaatgggccggatttcataccatcaaggatgatatcaagttcagccaattgtttcagactttattcgaattagagacggagacttgcgccaagatgttagcttcctttaagtgtagcctcaaacccgaacaccgcgatttctgcttctttaccatcaaatttctcaagcactctgctctgaaaacgccacgggttgataacgagttcctgaatatgcttctcgacaaaggcgctgtcaagacgaaaaattgtttcttcgagattatcaaaccgtttgacaagtacatcatgcggctacaggaccggcttctgaagtcggtcactcctctccttatggcctgtaacgcttacgagctcagcgtgaagatgaaaacactgtcaaacccgctggatctggccctggctctggagaccaccaatagcttgtgccgcaagtcacttgcgctcctcggtcagacctttagcttggcctcttctttcagacaggaaaagatactcgaagccgtcggattacaagatattgctccctcaccggctgcttttccgaacttcgaggacagtactctgtttggccgagagtatatagatcatttgaaagcatggttggtgagtagcggctgccccctccaagttaagaaggccgaacccgaacccatgcgggaggaggaaaaaatgatccctcccacaaagcccgagattcaagccaaggcccctagttctctgagtgacgctgtcccgcagagagcagaccatcgggtggtaggaaccattgaccaactggttaaacgtgtcatcgagggctctctgagccccaaggaaaggaccctcttgaaggaagatccagcctactggtttttgagcgacgaaaactcacttgaatataagtactataaattgaaactggcagaaatgcagagaatgtctgagaatttaaggggggcagatcaaaaacccaccagcgccgactgcgcagtcagggctatgctgtatagtcgggcagtgcgcaatctgaaaaaaaagcttttgccatggcaacgcaggggcctgctgcgggcacaggggctcagaggttggaaggccagacgcgcaacaaccggtacacagactctgttgtcgagtggcactaggttgaagcaccatggtagacaggcgcctggcctatcgcaggccaagcccagcctgcccgaccgaaatgacgccgcaaaggactgtccgcctgacccagttggtccctctccccaagatcccagcttggaggcgtccgggccatctcctaaaccggctggcgtggatatctccgaagctccccagacatcctccccatgtccatccgccgatatagacatgaagacaatggagacggccgagaagttagccagatttgtggctcaagttggccctgaaattgaacagtttagcatcgaaaacagtaccgataatccagacctatggtttcttcatgatcagaatagctctgctttcaagttttacagaaagaaagtctttgaactctgtccatccatctgttttacttcctctccccataatctgcacaccggaggaggagacaccactggctcacaggaatcacccgtcgacctcatggagggggaggcagagttcgaggacgaaccccctccacgcgaagcagaactggaatccccagaggtcatgcccgaagaagaagacgaagatgatgaggatggtggggaggaggccccagctcctgggggtgctggaaagtcagaggggtccactcctgccgatggtctgcctggcgaagccgcagaagacgatttagctggagctccagctctatcacaagcctcttccggcacatgcttccctaggaaacggattagctcaaaatccttgaaggttggtatgatcccagccccaaagagggtgtgccttatacaagaacccaaagtacatgaacctgtaagaattgcctatgaccgaccgcgaggcaggcctatgtccaagaaaaagaagccaaaggacttagatttcgcacagcagaagcttaccgacaagaatctgggctttcaaatgcttcagaagatgggatggaaagagggacacggtctgggcagcctgggaaaaggcataagagaacctgtgtccgtttacgcagccggatctctgggctgggagtgggtgggtccacagtccttccatctgcaaccagcagcgtggctgctgcattcacaggatgggctgcagctagccgtggacttttgtttcctcaacagaaggcacctccagatgagatcatag

SEQ ID NO: 24510 - DNA, 534 bp, Artificial Sequence
  Description of Artificial Sequence: Synthetic coding sequence
taaatgaagcacactgccacagcgaggtttcaacggaatcacaggcttatctccgaaattctgtcagaatcggtggtccctgacgttaggagcgttgtgactactgctagaatgcaggttctgaaacggcaagtgcagtcgctgatggtccatcagcgcaaactcgaggccgaactcctgcaaattgaggagcgtcatcaagaaaaaaagcgtaagttccttgagtcaaccgatagttttaataatgagctcaaacgcctgtgcggccttaaggttgaagtggacatggagaagatcgctgctgaaatcgcccaggcagaggagcaggctaggaaacgccaagaggagagagaaaaagaggctgccgaacaggcggagaggtcacagtccagcattgtgccggaggaggagcaagctgccaacaagggagaagaaaaaaaagacgatgaaaacattcctatggaaaccgagaaaaattgtcaactttgtccacgcaagaccctgacaagccgttacacagatttccccgactag

SEQ ID NO: 24511 - DNA, 1236 bp, Artificial Sequence
  Description of Artificial Sequence: Synthetic coding sequence
atgtccaaaagacctagctatgctccgccacctacaccagcacccgctacccagatgcctagtacccctggttttgtgggatacaacccttactcccacctagcctacaacaactatcggctcggaggtaacccgggaactaattccagggtgacagcttcctccggcattacgatacccaaaccccctaagccgcctgataagccactgatgccctacatgaggtactctcggaaggtatgggatcaggtgaaagcttccaacccggacctgaaactgtgggaaatcgggaagattatcggtggtatgtggcgcgatttaacagacgaagagaagcaggaataccttaacgagtatgaagccgagaaaattgagtacaatgaatcaatgaaggcctaccacaattctcctgcctacctggcctatatcaacgctaaatcaagagccgaggcagcacttgaggaggagtcaaggcagcggcaatctagaatggagaagggagagccttacatgtctatccaaccagcagaggaccctgatgattacgatgacggcttcagtatgaaacacaccgccactgcaagatttcagagaaaccataggctcatctccgagattttaagtgagtccgtggttcctgacgtacggagcgttgtgactacagctcggatgcaggtgctgaaacgtcaagtgcagtctcttatggtgcaccagaggaaactcgaagccgaactgttgcaaatcgaggagcgccaccaggaaaagaagcgcaaatttctggaatccaccgacagcttcaacaacgaactgaagcgcctgtgcgggctgaaggtggaggtagacatggaaaagattgccgcagaaattgcccaggccgaggagcaggctagaaagcgacaggaggaacgggaaaaggaagctgctgagcaagcggaacgctcccagtcatccatagtgcccgaggaggagcaggccgcaaacaaaggagaagagaagaaagacgatgagaacattccaatggagaccgaggagacccacctggaggagacaacagaatcacagcaaaatggcgaggagggtacatctactcccgaggataaagaatctgggcaagaaggagtggattccatggcggaggagggcacatccgatagcaacactggctctgaaagcaacagcgccaccgtcgaagagccccctaccgaccccattcctgaggacgagaagaaagagtag

SEQ ID NO: 24512 - DNA, 987 bp, Artificial Sequence
  Description of Artificial Sequence: Synthetic coding sequence
atgagtaaacgacctagctacgcaccccctcctacccctgcacccgcaacagctagctctggcatcactattcctaagccacctaagccaccggacaaaccactcatgccatacatgcgctacagcagaaaggtgtgggaccaagttaaagcaagcaatcccgatttaaagctttgggagatcgggaaaataattggcggtatgtggagggacttgactgatgaagagaagcaagagtatcttaatgagtacgaagcggaaaaaattgaatacaatgagagcatgaaagcgtatcataactcacctgcttatctggcctacatcaacgccaagagccgagccgaggcggctttagaagaagagagccgccagcgtcaaagtcgtatggagaaaggcgagccctatatgagcatccagcctgcagaggatcccgatgactatgacgacgggttttctatgaagcacactgcaactgccagattccagagaaaccatcgtctgatcagtgaaatcctaagtgagagtgtggtgcccgatgtccggagcgtggttaccacggctcgaatgcaggtactgaaacggcaagtgcagagtcttatggtccaccagcgcaagctggaagccgaattgctgcagattgaagagcgacatcaagaaaaaaagagaaaattcttagagtccaccgactcctttaataacgaactgaagaggttatgcgggttaaaagtggaggtggatatggaaaagattgccgcagaaatcgctcaggctgaggagcaggcccgtaagaggcaggaggaacgcgagaaggaggccgctgagcaggccgagcgctctcagtcctcaattgtgccggaggaagaacaggccgcaaataaaggggaggagaaaaaagatgatgaaaacatccctatggaaaccgagaagaattgccagctgtgcccaagaaagaccctaaccagtagatacactgattttcctgattag

SEQ ID NO: 24513 - DNA, 570 bp, Artificial Sequence
  Description of Artificial Sequence: Synthetic coding sequence
tgagcggaagatccagacgattacgatgacggcttcagtatgaagcacactgctactgcacggttccagagaaatcatagactgatctctgaaatcctaagcgagtccgtcgtccctgatgtgagatccgtagtgaccaccgcgaggatgcaggtgttgaagcggcaggtgcagagtctgatggtccatcagcggaagctggaagcagagctcctgcaaatcgaggagagacatcaggaaaagaagcgcaaattcctcgaatcaacagactccttcaacaatgagcttaaaagactctgcggacttaaggtcgaggtggatatggagaagatcgctgccgaaatcgcgcaggctgaagaacaggcgcgaaaaagacaggaggagagagagaaggaggctgcagaacaggccgagagatcacagtcctccattgtgcccgaggaagagcaggctgcaaacaagggagaagaaaagaaggatgatgaaaacattcctatggagacggaaaagaattgccagctctgcccacgcaaaaccctgacctctaggtacaccgacttccccgattag

SEQ ID NO: 24514 - DNA, 1182 bp, Artificial Sequence
  Description of Artificial Sequence: Synthetic coding sequence
atgcccagcacacccggatttgtgggatacaacccatactcacacctcgcgtataataattatcgcctagggggtaaccccggtacaaacagccgcgtcacggcttctagtggcatcacgatacctaagccaccaaaacctcccgataagccactgatgccttacatgcgctactctcggaaggtatgggaccaggtcaaggcatccaatcccgacctgaagctgtgggaaattgggaagattatcggcggaatgtggcgggatctgactgatgaagaaaaacaagagtacctgaacgagtatgaagctgagaagatagagtacaatgaaagcatgaaggcctaccataattccccagcgtatttagcttatattaatgccaaatccagggcagaagcagctctagaggaggaaagtcgtcaaagacagagccggatggagaaaggagagccatatatgtccatccaaccggcagaggatcccgatgattacgatgatggattctcgatgaaacacactgcgactgcccgatttcagaggaatcatcgcctgatttccgaaatcttgagtgagtcggttgtgcccgacgtgcggtctgtggtcaccaccgcgagaatgcaagtgctgaagaggcaggtgcagagcctgatggtacatcagcggaagctcgaggctgagctcttgcagattgaagagcgccatcaggagaagaagcgaaagttcctcgagtcaaccgactcctttaataacgaactcaagaggctgtgcggcctgaaagttgaagttgatatggagaagattgctgccgaaatcgcccaggcggaagagcaggcacggaagaggcaggaggagagagagaaagaggcagcagagcaggccgagcggtctcagtcatcaatcgttccagaggaggaacaggccgcaaataagggcgaggagaagaaagatgacgaaaatattccgatggagaccgaggaaacacacctggaggagaccactgagagccaacagaacggtgaggaaggcacctccaccccagaggacaaggagtccggccaggaaggggtggactcaatggccgaagaaggcacctcagatagcaacactgggtctgagtctaactcagcgactgtagaggagcccccaaccgatccaattcctgaggatgagaaaaaggaatag

SEQ ID NO: 24515 - DNA, 474 bp, Artificial Sequence
  Description of Artificial Sequence: Synthetic coding sequence
ctttccgagtccgttgtacccgatgtccggagcgtggtgacgaccgcccgtatgcaggtgctgaagcgccaagtgcagagcctgatggtgcaccagaggaagctagaggccgagctgctccagatcgaggagcggcatcaggagaaaaaacgcaagtttctagaatcaaccgactcctttaataacgaactgaaacgtctttgtggcctcaaggtggaagtggacatggagaagattgctgctgaaatcgctcaagccgaggagcaagcaaggaagcgtcaggaagaacgagagaaggaggccgctgagcaggctgaacgatcccagtcctcaattgtcccagaagaggaacaggccgcaaataagggggaagaaaagaaggatgatgagaatatcccgatggagactgagaagaattgtcagttgtgtcctcgcaaaaccctaacctctcggtacactgactttccggactag

SEQ ID NO: 24516 - DNA, 1026 bp, Artificial Sequence
  Description of Artificial Sequence: Synthetic coding sequence
atgccttacatgcgatattcccgcaaggtttgggaccaagtgaaggctagcaatccggaccttaagctgtgggagatcggaaaaatcatagggggaatgtggcgagacttgacggacgaggagaagcaggagtatcttaacgagtatgaggctgaaaagatagaatataatgagagcatgaaagcttaccataactcccccgcatatctggcctacatcaacgctaaaagtagagctgaggcagcgttagaggaggaatcccgccagcgccagagccggatggaaaagggagaaccttatatgtccattcaaccagccgaagatcccgatgactatgacgacggtttctccatgaagcataccgcaactgcacgcttccagagaaaccaccgactcattagtgagattctgtcagagtcagtcgttcctgacgtgaggagtgttgtgaccactgctagaatgcaggtcctgaagaggcaggttcagagtctaatggtccatcagcggaagttggaggctgagcttctgcagattgaggaacgacaccaggaaaaaaagcggaagtttcttgagtccaccgacagctttaacaacgagctaaaacggctgtgcggcctaaaggtggaagtggacatggagaaaatcgcggctgagatagctcaggctgaggagcaggcccgaaagaggcaggaggaacgggagaaagaagccgctgagcaggccgagcgaagccagagctctatcgtgcctgaggaggagcaggccgcaaacaagggcgaggagaaaaaggatgacgagaacatccccatggagactgaagaaacgcacctcgaggaaaccactgaatcacagcagaatggagaggaggggacaagcacgccagaggacaaagaatcaggacaggaaggggttgatagcatggcagaagaaggaacatccgattctaacacaggcagtgagagtaacagtgccactgtcgaggagccacctactgaccccatacccgaggacgaaaaaaaggaatag

SEQ ID NO: 24517 - DNA, 708 bp, Artificial Sequence
  Description of Artificial Sequence: Synthetic coding sequence
atgcagcggcgaggtcagagggacttatggcgccacaataagagctgcgccaggaaccgttgccctcggccacctcgggagagaggcggagcgggttttccatgggtgcgcgctcagctcagtgtgcggcagttcacacttcgagttcgcgtgccagggcctgtgcacctaaggggtcgaagccccactccggcacttgaccctttggccccactgaatcccttaattcgcggacccaggacaccagggctgcgtcgctggatccagagtctcgcgctgcttctacctaactgttcatctagccgcattcctacggttcctcgcccacactccgggctctgggtgcagagcgattttcctctcggctttctcagccggactgaaccacgactgacccgttcctgccggggagcattccggagtcctcggccactacctaagtcaggccaggcggatggtacaagcgaagagtcgctacatctcgacattcagaagctcaaggaaaaaagagatatgttggacaaagagatatcacagttcgtttcggaaggctactcggttgatgaactagaagaccacatcacgcagctgcacgaatataacgacatcaaggacgttggtcagatgctcatgggaaagttggccgtcatccggggagtcaccaccaaggagctgtaccctgagtttggcttggatatgaacgactag

SEQ ID NO: 24518 - DNA, 924 bp, Artificial Sequence
  Description of Artificial Sequence: Synthetic coding sequence
atgaagaatctggtagtccctatgtgggaaggcaaatggaaaactgctaagagggccaggatgaactacaaggtcaaattagaggaaatcagtggactactggtcgacgccctctacacaaacaccatctactacctaatcaaagtggattaccgtgaggtttggctgattaggttattttataacttcagtttcctcgagaagaaccaggactttacgttcaagatggagtcaccttccgatagcgctgtggtcctgccgtccacaccacaggcctccgcgaacccgtcgagcccttacacgaattccagcaggaagcaaccaatgagcgccactctaagggagcgcctgcgtaagactaggtttagcttcaactcttcttataacgtggttaagcgattgaaagtggagagcgaggaaaacgatcagacttttagtgaaaaacccgcttcctcgactgaggagaattgtctggagtttcaggagagttttaaacacattgactccgagtttgaggagaacactaatctgaaaaataccctcaagaatctcaatgtttgcgaatcacaaagccttgactccggcagttgcagcgccttgcagaacgaatttgtgtccgagaaactgccaaagcagcggttgaacgccgagaaagctaagttggtgaaacaggtgcaggagaaagaagacctgctgaggagactgaaactcgtgaaaatgtaccgctctaagaatgacttgtcccagcttcagctcttgatcaaaaaatggcggtcctgctcccagcttctgttgtacgagctccagagcgccgtgtctgaggaaaataagaagctgagcctcacccagttaattgaccactacggactggatgacaaactcctgcattataatagatccgaagaagaatttattgacgtttag

SEQ ID NO: 24519 - DNA, 738 bp, Artificial Sequence
  Description of Artificial Sequence: Synthetic coding sequence
atggctgaaggagagaagaaccaggatttcactttcaagatggagtctccgtccgactctgccgtggtactgccatccactccacaggcctccgccaatccttcatctccatatacaaattcctctagaaagcagcctatgtcggctactctgcgcgaacgactccgaaagacaaggttttcattcaactcttcctataacgtagtgaaacggctgaaagtggaatcagaggaaaacgaccaaacttttagcgagaaacccgcatctagtacagaggagaattgtctcgagtttcaagaatctttcaaacacatcgattctgaattcgaggagaacactaatcttaagaatactctcaagaatttaaatgtctgcgaaagccaatcacttgattcgggaagttgttccgcacttcaaaatgaattcgtgagcgaaaaattgccgaaacagcggcttaatgcagagaaggcaaagttggtgaaacaggtacaggaaaaggaggatctgcttaggagactgaagctcgtgaaaatgtatcgtagcaagaatgatctctcccaactgcagctcctaatcaagaaatggagatcatgttctcagctactgctgtacgaattgcagtcagcagttagcgaggaaaacaagaagctgtctttaacccaactcatcgaccattacggcctcgacgataagttactgcattacaatcggagcgaggaggaatttatcgacgtgtag

SEQ ID NO: 24520 - DNA, 699 bp, Artificial Sequence
  Description of Artificial Sequence: Synthetic coding sequence
atggagtcaccatctgactctgccgtggtactcccttccaccccccaagccagtgcaaatccatcatcgccttacacaaacagctctcgcaaacagcccatgtctgctaccctcagagagagactgcgcaaaacccggttttcgttcaattcttcttataacgtggtgaaaagactgaaagttgagtccgaagagaatgatcagacattctcagagaagcctgcctcttcaaccgaagagaactgtctcgagttccaagagagcttcaaacatatcgacagcgaattcgaagaaaacacgaacctgaagaataccctcaaaaacctgaatgtctgtgagtctcagagcctcgatagtggctcctgttccgctctacagaacgagtttgtgagtgaaaaactgcccaagcaacggctgaatgcagaaaaggcaaagttggtcaagcaggtgcaggagaaagaggacctcctaagacgactaaagctggtcaaaatgtaccgtagtaaaaatgacttgagccagttgcagctgctcatcaagaagtggcggtcgtgtagccagttactcctctacgagctccagagcgctgtgtccgaggaaaataagaagctctctttaacacagctaatcgaccactatggtctggatgataaacttctgcattataacaggtccgaagaagagttcatcgacgtgtag

SEQ ID NO: 24521 - DNA, 1059 bp, Artificial Sequence
  Description of Artificial Sequence: Synthetic coding sequence
atgttcaggggcttgagctcttggcttgggttgcagcagcctgtagcaggcggagggcagcctaacggcgatgcgcctccagaacagccgagtgagaccgtcgcggagagcgccgaggaggagctgcagcaggccggagaccaggagctcctacaccaagctaaggatttcgggaattacctgttcaattttgcgagcgctgccactaagaagataactgagtctgtagctgaaaccgctcaaactatcaagaagagtgtggaagagggaaaaatcgacggcatcatcgacaaaacgattattggggatttccagaaagagcagaaaaaatttgtagaggaacagcataccaagaagtcggaggctgcagtgcccccatgggtcgatacgaatgacgaagagacgatccagcaacagattttggccctgtctgcggataagaggaactttctgagggaccctcctgctggagtccagttcaattttgacttcgatcagatgtacccagttgcactagtcatgctccaggaggacgaacttctgtcgaaaatgcggttcgccctggtccccaaactggtgaaagaggaggtgttctggcgaaattacttttaccgggtgtccctgatcaaacagtcagctcagctgacagcacttgcagcacagcagcaggcagccggaaaggaagagaaatctaatggtcgagagcaagacttaccattggcagaagctgtgagacccaaaaccccacctgtagtaattaagtcacagctgaaaacacaggaagacgaagaggagatctccacatccccaggagtgtctgaattcgtgtctgacgccttcgacgcgtgtaatctcaaccaggaagatctccgaaaagagatggaacagttagtgctggataagaaacaggaggagacagccgtccttgaggaggattcagccgactgggagaaggaacttcagcaggagctgcaggaatatgaggtcgtgaccgagtctgagaagcgcgatgagaactgggacaaggaaatcgagaaaatgttgcaagaggaaaactag

SEQ ID NO: 24522 - DNA, 2439 bp, Artificial Sequence
  Description of Artificial Sequence: Synthetic coding sequence
atgcaagcaaagaacaaagatgcacttcagccgataaaggaagaccggactgggaaagcacaggatgatgcgttttggctacagtcactgattactgacgccttccacgataaaggcttccaaaagatcaaggaatactttcagcagaaagaaagtcatttccctcaaaaatacaatcggctgctcctttacagattagaccgaagcataaacaaagaactggacaagaacgagtttcagtctgtgagtctgctgctgaagtgcatccagcggtttttagtcgacgggttaaaggaagatgaacccctgttaattagacagggcctgattccgaagcttgtgagctggttcgaacggaccaccggaatcctgacatccgaaggactcgcttctgatacgtcgttgatctgtgtgatcgaagacttttttgatactgctctcattatttccagaagttcatcggaaggaaaaatccagatgcttgactcttttctcctgtctttaggttttctggtgaccgaaaagaccgtcaaccacctgctgcagcaggagggcctaaagactttcaactgcattcttcatgccgttcctcgcgaagagcgcaaaaagttccccctgtcggaaggaatgtgccaccttatgaaggatctggccaggactctcctgaccgtgggtgactacgaccaacaggtcgccatcagcgaggccctctgtcggctgaccatcaaaaagtctcgggatgaattagtacataaatggtttgacgatgaagttatcgctgaagcgtttaaggaaatcaaggacagggaattcgaaaccgactcacggaggtttttaaatcaccttaacaacaggctcggcgatcaacgacgggtctactcctttccatgcatcgctgcctttgccgatgagcatgaaatgagaaagcccgcagatgaaaagcttgagaagttttggatcgatttcaatttgggatcacagtccgttactttctacatagacaacgccgaaaataccctttgggactctgttacactgcctaaagaagcggtcatgaatttttcaattactgagacagagaaaataaagatttttatcatctatctgaagaaacctatgatcatctcctacaaagaagtgatgaaaattgagattcactttgatctgcagtttaatattagtcaggtgtctatccaagcgttgggagaggacaagcagatgctccccgaccaaacaaaaatcagcagcgagctcttcagcaaatctgataaagaggaccgggaatccccctcagggttagagagagaaacagaacaggcagaagagagcacaaatatggtggagttcatgtccgccgaagatgaccgttgtttgattactctccaccttaatgaccagtccgaacccccagtcatcggcgaaccagcctccgattcccacttgcaacctgtgcctccttttggagtgcctgatttcccacagcagcccaagtctcattaccgtaaacaccttttcagtgaaagcaaccaggatagcagtacatccgaactgagctggacgagcaaccagaagaaaaagtccctgaaatcatattcttccagaaaaaagactcgcaccagatctaacttgcggatattgccagttttccccccatctagcggctctggccatgaaaaagaccaggcaaaacttctgtctccatctgagaaggagatccccgaacagaacaatacaacaagccccaagacatcggaacaaaagttccaagactccttcgccttcctgaccgccgaggacagtgcccaaaagaccgagctccaggacccccactccctctcagagttgagctccctgaagcatagcgaggatgaagagaagcctaagattgtcaaccaagagtctctcactgaatcaacttctctgaagcataaattacggaatctagaagacaaggacattccggagggatccttcgccaagtctcagcagtcccgcctggaggaggaagtggctcctggctcaccattttctatcaccgaggaacgagagctgcccgaggggatctctacatctagcctggaagttgttcctgagaatctgaacggatctgcaattctccccaccttcgaaaactttaccaaaaaacggaaacggaagtatgaactacgctacagaaagcgccctttcaacagtgaaaacgctaagaaagcccctgattgcctcatcaaactcctgaatcagatgcaactcttcaggctgaataaattagaacggttccagaatctagtactccaggaactctccagcttgaaacaggatatccaagccctcgagcatctcgaaaaggaggtgttagaattttgggggaagcagtctgccgacttgcaatcattttgtgacttgcaggtgcttaggtttaactccacccaaacaagctag

SEQ ID NO: 24523 - DNA, 867 bp, Artificial Sequence
  Description of Artificial Sequence: Synthetic coding sequence
atgctcgatagtttcctcctctccctcggctttttagtgacggaaaagaccgttaaccatctgctgcaacaagagggcttgaaaacattcaactgcatccttcacgcagtgccacgggaagagcgtaaaaaatttcctctgtcagaaggcatgtgccacctgatgaaggatctggccaggacactcctcacggtgggcgactacgatcagcaggtggccatatctgaagccctatgcagactcacaattaaaaaatccagggatgagttagttcacaaatggtttgacgacgaggtcatcgcagaggcgtttaaggagattaaagaccgcgaatttgaaaccgattctcgaaggtttctgaaccatcttaataacaggctgggtgatcaaaggagagtatacagtttcccatgtatcgcagctttcgctgatgagcacgagatgcgtaaaccagccgacgaaaaattggagaaattttggatcgatttcaatttgggttcccagagcgtgacattctacattgacaacgctgagaataccctatgggactccgttacgttacctaaagaagctgtgatgaatttctctatcactgagactgaaaaaattaagattttcataatctatttgaaaaagcctatgatcatatcatacaaggaagttatgaagattgaaatccacttcgacctccagtttaatatcagccaggtttccattcaggccttgggagaggacaagcagatgttacccgatcagaccaagataagttctgagctgtttagtaagtctgacaaggaggatcgggagagtccgtcaggcctggagagggagaccgaggtctccctgcagaagactagtcttctatag

SEQ ID NO: 24524 - DNA, 1845 bp, Artificial Sequence
  Description of Artificial Sequence: Synthetic coding sequence
atgggtgactggatgacagtgacggatcctggtttatcgtccgaaagcaaaaccatttcccaatacactagtgagactaaaatgtcaccctccagcctgtatagccagcaggtgctgtgtagctctatacctctcagcaagaacgtccacagtttttttagcgccttttgtaccgaagataacatcgagcagagcatcagctaccttgatcaggagctgaccacttttggctttcctagcctctacgaagagagcaaggggaaagaaacaaaacgagaactgaacatcgtcgccgtgctgaactgtatgaatgagctactagtgctgcagagaaaaaatctgttggcccaagaaaacgtagaaacccagaatctgaagctgggatctgacatggatcaccttcaatcctgttattcaaaactgaaggagcagctggagactagtcgaagggagatgattggattgcaagaaagagaccgacagctgcaatgtaaaaacaggaatctgcaccagctcctgaaaaacgaaaaagacgaggtgcagaagctccagaatatcatcgctagtcgcgcaactcaatacaaccatgatatgaagagaaaggaacgagagtataataagttgaaggagaggctgcatcaacttgtcatgaacaagaaggacaagaagattgcaatggacatcttgaattacgtgggacgagccgacggcaagcggggaagttggcgcacaggcaaaacagaggccagaaatgaagacgagatgtacaaaatactgcttaatgattacgaatatagacagaagcagatcttaatggaaaacgctgaactcaagaaagtcctccagcaaatgaaaaaggagatgattagtcttctgtctcctcaaaaaaaaaaaccacgggaacgtgtggacgacagcacgggcacagtcatctcagatgttgaggaggacgctggagagctgtcacgggagagcatgtgggatttgtcttgcgagacagtgcgagaacaattaaccaattcaatccgcaagcaatggagaatcttgaaaagccatgttgaaaagctggataaccaggtatcaaaggtgcatctcgaagggttcaacgacgaagacgtgatcagtcgtcaggatcacgagcaggaaacagaaaaattggaactggagatacagcagtgtaaagaaatgatcaaaactcagcaacagctcttgcagcagcagcttgcaactgcttacgacgatgacaccacatcgctgctgcgggattgttatctgctggaagagaaagaacgcctcaaggaagagtggagcttgttcaaagagcaaaaaaagaacttcgaacgcgaaagacgtagcttcacagaggcggctatccgcctgggtcttgaaaggaaggcctttgaagaggaacgggcttcatggctcaagcagcagtttctaaacatgaccacttttgaccaccagaactcagagaacgttaaactgttttcggctttttcgggctcttctgattgggacaatctcattgttcactctaggcaaccacagaaaaaacctcattctgtctctaatggttctccggtctgcatgtctaaactgaccaaaagtcttccagcatcaccaagtaccagcgatttttgccagactagatcttgtattagcgagcattcatccatcaacgtgttgaatattactgccgaggaaattaagcctaaccaggtgggcggtgaatgtaccaaccaaaagtggtcagtggctagcagaccagggtcccaggaggggtgttactccggatgttccctgtcatataccaactcacacgtggagaaggacgatctgccttag

SEQ ID NO: 24525 - DNA, 1683 bp, Artificial Sequence
  Description of Artificial Sequence: Synthetic coding sequence
atgggggattggatgacagtgacagatcctggtcttagttcagagagcaagacaatctctcagtacacctcggagaccaaaatgagcccctcctctctgtactctcaacaggtactgtgcagctctattccactgagtaagaatgtgcacagctttttttctgccttctgcactgaggataatatcgagcagtcgatttcctacctggatcaggaactgactacattcgggttccctagcctctatgaagaatcaaaaggaaaggagacaaagcgggagctaaatatcgttgctgtgcttaattgcatgaatgaacttctagtacttcagcgaaaaaatctgctggcccaagagaatgtagagacccaaaacctaaaacttggctccgatatggatcacctacaaagctgttactcaaagctcaaagagcagctggagacctcgagacgtgagatgatcggcctacaggagcgagatcggcagctgcagtgcaaaaaccgcaatctccaccagctgctgaagaacgagaaggacgaagtccagaaactgcagaatattattgcctcccgagccacgcaatacaatcacgacatgaaacggaaagaacgggagtacaacaaactgaaagagcgcctgcatcagctcgtgatgaataaaaaggacaaaaaaatcgcaatggacattttgaactacgtcggccgagccgacggtaaacgtggctcttggaggacgggcaaaactgaggcccgaaatgaggacgaaatgtacaaaatcctgcttaacgattatgagtacagacagaagcaaattctcatggagaatgctgaactgaagaaggtactgcagcaaatgaagaaagaaatgatcagcttactgagtccccagaagaagaaacccagagagcgggtggacgacagcaccggcacagtgatcagtgacgtagaggaggatgctggcgagctgtcacgagaatccatgtgggatctgagctgcgaaacagttagagaacagcttacaaactctatccgcaaacaatggaggattttaaagagccatgtcgagaagctggacaatcaggtgtcaaaggtgcacctggaaggatttaacgatgaggacgttataagtaggcaggaccacgagcaggagaccgagaagctggaactcgagattcaacagtgcaaagaaatgatcaagacacaacagcagctgctgcagcagcaattagctactgcatatgatgacgatacaacttcgcttttaagagattgctatttactggaagagaaagagaggctgaaagaggagtggtctctcttcaaagagcagaagaaaaatttcgaacgggagcgcaggtcctttacagaagccgcaatacggcttggattagaaaggaaagcatttgaagaagagagagccagttggctcaagcagcagttcctgaacatgactacttttgaccatcaaaattccgagaatgtgaagttgtttagcgctttcagtgggtcgagcgactgggacaacctgatcgttcacagcagacagccacagaaaaaaccccattccgtctccaacggtagtccagtctgtatgtctaagctgacaaagtcattacctgcctcgccctcaacgagtgatttctgccagacccgaagctgcatttccgaacatagagctaaaaactag

SEQ ID NO: 24526 - DNA, 543 bp, Artificial Sequence
  Description of Artificial Sequence: Synthetic coding sequence
atgggggattggatgaccgtgactgaccctggtttgtcgtccgagtctaagaccatatcccagtacacatctgagacgaaaatgtccccgtcttccctttactcccaacaggtcctgtgttcttcaataccgctcagcaagaacgtgcatagcttcttctccgcgttttgtaccgaggataatattgagcaatccatcagctacttagatcaggagctgaccacattcgggttcccttctttatacgaagagtcaaaagggaaagaaacaaagagggagctaaacatcgtggccgtgttgaattgtatgaacgaactattagtgctccagaggaaaaatctgcttgctcaagagaatgtggaaacccagaacctgaaactcggatccgatatggatcaccttcagtcttgctattccaagctgaaagaacaactcgaaaccagtaggcgggaaatgattggcttgcaagaaagagatcgccaactccagtgtaaaaatagaaatctgcaccagctcctgaagaatgagaaggacgaggtttag

SEQ ID NO: 24527 - DNA, 1764 bp, Artificial Sequence
  Description of Artificial Sequence: Synthetic coding sequence
atgtcaccctccagcttatactcacagcaggtgctgtgcagctctatacccctgagcaagaacgtgcactcgttttttagtgctttctgcacagaggataatattgaacagtcgataagttacctagaccaagaactgaccacatttgggtttccttctctgtacgaggaatctaagggcaaagaaaccaaaagggagttgaatatcgtggcagtcctcaattgtatgaacgagctcctggttttgcagaggaagaatctcctcgctcaggagaacgttgagacacagaacctgaagctgggatcagatatggaccacttgcaaagctgttattccaagcttaaagaacagctggagactagcagacgggaaatgatcgggctccaggagcgggaccggcaattacagtgcaaaaatcgtaacttgcaccaactgcttaaaaatgagaaagatgaggtccagaaactccagaatatcatcgccagtagagctacacagtataatcatgacatgaagagaaaagaacgagaatacaacaagttaaaagagcgtctgcaccaattagtcatgaataaaaaggataagaaaatcgcaatggatatactgaattacgtgggcagagcagacggcaagcgaggctcatggcgcaccggaaagactgaagcgcgtaatgaggatgaaatgtataagatcctgttgaatgattatgagtacaggcaaaaacaaatattgatggagaacgccgaactgaagaaggtgctgcagcagatgaaaaaggagatgatcagtttgcttagcccgcagaagaagaagccacgtgagcgggtggatgattctaccggcactgtaataagcgatgtagaagaggacgcaggtgagttatctcgtgagagtatgtgggatctgtcatgcgagaccgtgcgagaacagctcacgaatagcataaggaaacagtggcgaattcttaagtcccacgtggagaagttggataaccaggtgagtaaggtgcatctcgagggattcaatgacgaggatgtgatttcacgccaagaccacgagcaggaaactgagaagctggagctcgaaatccagcagtgtaaggaaatgatcaagacccagcaacagctcctacaacagcagttggccacagcttacgatgacgacacaacatccctgctgagggattgctatcttctggaggaaaaggaacggctgaaagaggaatggagcctttttaaggagcaaaaaaagaactttgagcgggagcgtaggtcctttacagaagcggctattaggttgggactggagcggaaagccttcgaagaagaacgagcctcatggctgaagcagcagtttctcaacatgacaacctttgaccatcagaactccgagaatgtaaaactattttccgccttttccgggtcgtccgactgggataatctgatagttcatagtaggcagccacagaagaagccacactccgtgagcaacggatcacccgtctgcatgagcaaactcacaaagagtctaccggcaagcccatcaacttctgacttttgtcaaacccgcagctgtattagcgaacacagttccattaacgttcttaacatcaccgcagaggaaataaagcccaatcaagtcggcggtgagtgtacgaatcagaagtggtccgtggcctctcgccctggctcccaggagggatgttacagcggatgctcactctcatacacaaactcccacgtggaaaaagatgacctgccctag

SEQ ID NO: 24528 - DNA, 1515 bp, Artificial Sequence
  Description of Artificial Sequence: Synthetic coding sequence
atgggcgattggatgaccgttaccgaccccgagtcaaaaaccatcagccaatacaccagtgagacgaaaatgagcccctcaagcctctatagtcagcaagtcctctgtagctctattcctctgagtaaaaacgtccactctttcttcagcgcgttttgtacagaggataatatcgaacagtctattagctatctggaccaggaactgactacctttggtttcccttcactgtacgaagaatcgaaaggtaaggaaacgaagagggagttgaatattgtagctgtcttgaactgcatgaatgaactactggtgcttcagaggaagaatctcctcgcgcaggaaaacgtggaaactcaaaacctgaaacttggctccgatatggaccacttgcagagctgctatagcaagcttaaggagcagttggaaacctcacggagggaaatgataggtctccaggagagggataggcaactgcagtgcaaaaataggaatctgcatcaactgctaaagaacgagaaggacgaagtccagaagcttcagaacataattgcttctagagctacacaatataaccatgacatgaagagaaaggaaagagaatacaataagctcaaagagagacttcaccagcttgtcatgaataagaaagacaaaaaaatcgctatggacatcctcaattatgtcggacgggcagacggaaagcgcggatcatggaggaccggtaagaccgaagctcgtaacgaagatgagatgtacaaaattctgttgaacgattacgagtatcgacagaagcagattctgatggaaaacgctgagctgaagaaggtgctgcaacagatgaagaaggagatgatctcacttctctcgcctcagaaaaagaagcccagagagcgggtggatgactcgaccgggacagtaatctcggatgtggaggaagacgccggtgagctgtcaagggaaagcatgtgggatttgtcttgcgaaacagtccgtgaacagctgacaaattctataagaaagcagtggcgcatcctgaagtctcacgtggagaagctggataaccaggttagtaaagtacacttggagggttttaacgatgaggacgtgatcagtcgccaggatcacgagcaagaaactgagaagttggagctggagatccagcaatgtaaagaaatgatcaaaactcaacagcaactgctacagcagcaactcgcgacggcctacgatgatgacacaacttcactgttgcgcgattgctacttacttgaagagaaagaacgattaaaggaagaatggagcttgttcaaagaacagaaaaaaaatttcgagcgggaacgcagaagttttacggaggctgccattagacttggtcttgagattgggtttttgctcttaagtgtactccacaaaaaaagcctcctagggatccatcactcctcgaccgtgtccaggtgtggagtaaggcgtcagtgtaatcaggactacatctgctgcctgaaaaagaaggggatctag

SEQ ID NO: 24529 - DNA, 672 bp, Artificial Sequence
  Description of Artificial Sequence: Synthetic coding sequence
atgaacggggatgatgcatttgctaggagacctaccgttggggcacagataccagaaaagattcagaaagcgtttgacgatatcgccaaatattttagcaaggaggagtgggaaaagatgaaggcaagtgagaaaatcttctacgtgtacatgaaacggaagtacgaagcaatgactaaactgggcttcaaggctaccctcccaccttttatgtgcaataagcgcgctgaggatttccagggaaatgaccttgacaatgatccgaaccggggaaaccaagtggaaagacctcaaatgacatttggtaggctgcaggggatctctcctaagatcatgcccaaaaagcctgctgaagagggcaatgatagcgaagaagtcccagaagccagcggaccccagaatgacggcaaagaactgtgtccaccagggaaacccaccacgtcagagaaaatccatgaacgaagtggcaacagggaagcccaagagaaggaagagaggcgtggcactgctcaccggtggtcctcacagaacacccacaacataggacggtttagcctgtctacttccatgggcgctgtgcatggcaccccgaaaactatcactcacaatcgcgatcccaaaggcggaaacatgccaggcccaacggactgtgtgcgggaaaacagctggtag

SEQ ID NO: 24530 - DNA, 567 bp, Artificial Sequence
  Description of Artificial Sequence: Synthetic coding sequence
atgaatggtgatgacgcttttgcgaggaggcccaccgttggtgctcagataccagagaaaatccagaaggcttttgatgatattgcaaaatacttttccaaggaagaatgggaaaaaatgaaagcctctgaaaaaatcttctacgtctacatgaaacgaaagtacgaggctatgaccaaattgggtttcaaagccactcttcctcctttcatgtgcaacaaacgggctgaggattttcaggggaatgacctagacaatgacccaaaccgtggaaaccaggttgagcggcctcagatgaccttcggaaggctccaagggatcagtccaaagattatgcctaagaaacccgctgaggaagggaatgactcagaggaagtgcccgaggcttccggcccacagaacgatggaaaggagctgtgtccccctggaaaacccacgacatcagagaagatccacgagagaagtggaccaaaaagaggcgaacatgcatggacacaccgactccgggagcggaagcagttggtgatttacgaagagatatcagaccctgaggaggatgacgagtag

SEQ ID NO: 24531 - DNA, 567 bp, Artificial Sequence
  Description of Artificial Sequence: Synthetic coding sequence
atgaatggtgatgatgcttttgcaagaaggcctagggacgatgcccagattagcgaaaaactgaggaaggcatttgatgacattgcaaagtacttctctaaaaaggagtgggaaaagatgaagtcttcagagaaaattgtgtatgtctacatgaaattgaattatgaagttatgacgaagctgggcttcaaagttaccctgcccccatttatgagatccaagagagccgctgactttcacggaaatgattttggcaatgaccgtaaccacaggaaccaggtggagcgccctcagatgactttcggtagcttgcagcgaatcttcccgaaaatcatgcctaagaaacctgcggaggaggagaacggactgaaggaggttccagaagcctccggaccacagaacgacgggaagcagttgtgccccccaggaaacccctccaccctagagaagatcaacaagacctccggccctaagagaggaaagcatgcctggactcaccgtctaagagaacgaaaacagttggttgtgtacgaggaaatcagcgatcccgaggaagatgacgaatag

SEQ ID NO: 24532 - DNA, 462 bp, Artificial Sequence
  Description of Artificial Sequence: Synthetic coding sequence
atgaatggagatgatgcctttgctcgcagacctcgggacgatgcccagatctcagaaaagcttagaaaggcatttgatgacattgcgaagtacttcagcaagaaggagtgggagaagatgaagtcttcagaaaagattgtatacgtgtatatgaagctcaattatgaggtgatgacaaaactgggctttaaggtgacgctaccccctttcatgagatctaagcgggctgccgacttccacggcaacgatttcgggaatgatcgaaatcatcgtaatcaggttgagcggcctcagatgacgtttggatcactccagcgaatctttccaaaggaccccaaaggaggcaacatgccgggtcctaccgactgcgtgcgcgaatccagctggtggttcatgaaacgcagcgccacattgcgcaagatgacctctaacagccctcggggttacgacacatgcccgtag

SEQ ID NO: 24533 - DNA, 690 bp, Artificial Sequence
  Description of Artificial Sequence: Synthetic coding sequence
atgaacggcgacgatgcttttgtgagacggccacgtgtgggttcccagattcccgagaagatgcagaaacacccttggcgccaggtgtgcgatcggggtatccacctggttaatctctccccattctggaaggtagggagagagccagccagcagcatcaaagccctgctctgcgggaggggtgaggcccgagctttcgacgacattgccaagtacttttcggaaaaggagtgggaaaaaatgaaggcttccgagaagatcatctacgtctatatgaagcgtaaatatgaggccatgacaaagcttggatttaaagccacccttcctccatttatgaggaacaagcgagttgctgatttccagggcaatgactttgacaatgaccccaacaggggaaaccaagttgagcacccacagatgaccttcggcaggctgcaaggcatattcccaaagataacccccgagaaaccagctgaagagggcaatgatagcaaaggtgtgccagaagcctccgggccacaaaacaacggcaagcaactaaggcccagcgggaagctgaacacgtctgagaaagtcaacaagacgagtggcccaaagcgcggaaagcacgcttggacgcatagggtccgcgaaaggaaacagctggtcatatacgaagaaattagcgatccccaggaagacgatgaatag

SEQ ID NO: 24534 - DNA, 567 bp, Artificial Sequence
  Description of Artificial Sequence: Synthetic coding sequence
atgaacggtgacgatgcttttgtccgcaggcccagagttgggagtcagataccggagaagatgcaaaaggcattcgacgatattgcaaaatatttctctgaaaaagaatgggagaagatgaaggcatccgagaaaatcatctacgtttatatgaagcgcaaatacgaggccatgactaagttgggattcaaggccactttgcccccttttatgaggaataaacgcgtggccgatttccaagggaatgacttcgacaacgaccctaaccggggtaaccaagtggagcatccacagatgacattcgggcgactgcagggcatttttccgaaaattaccccggagaagccagccgaagaggggaacgattcgaagggagtgcctgaggcaagtggccctcagaacaacggcaagcagctgcggccttccgggaaacttaacactagcgaaaaggtgaacaaaacaagcggcccaaaacgaggcaagcacgcgtggactcatagggttcgggagcggaaacagttggtcatttacgaagagattagcgaccctcaggaggacgacgagtag

SEQ ID NO: 24535 - DNA, 567 bp, Artificial Sequence
  Description of Artificial Sequence: Synthetic coding sequence
atgaacggagatgatgcgtttgtgagaaggcctagggtcggaagccaaatcccggaaaaaatgcagaaggcgtttgatgacatcgcgaaatacttttcggagaaggaatgggagaaaatgaaggcatccgaaaagatcatatatgtttatatgaagcgcaagtacgaggccatgacaaaactcggctttaaggccacgttacccccattcatgcgcaacaagagagtcgccgacttccagggaaatgattttgacaatgatccaaaccggggaaatcaggtggaacacccccagatgacattcggcaggttgcagggaatcttcccaaagattactcccgagaagcccgctgaggagggcaacgatagcaagggagtacctgaggcatcagggcctcaaaacaacggcaagcaactgcgaccctccgggaaattgaataccagcgagaaagtgaataagacatccggcccaaagagagggaagcacgcttggacccaccgggtgagagaaaggaaacagctggttatatacgaagagataagcgatcctcaggaggatgatgaatag

SEQ ID NO: 24536 - DNA, 387 bp, Artificial Sequence
  Description of Artificial Sequence: Synthetic coding sequence
ctcattacaagtgccgcagagtgtccgcatgccaccgaagtgagcttggagttcgggaatctgtatcagcaaaggaagattctcatgtactctctgtcagtcgagcacccacagatgaccttcggccgactccagggcatcttccctaagattactcccgagaaacccgctgaagaaggcaatgattcaaaaggagtgcccgaagcttcagggcctcagaacaacgggaaacagctccgtcctagtggcaaactgaatacttcagaaaaggtcaacaaaacatccggcccaaaaagggggaagcacgcctggacccacagggttcgcgaaaggaaacagctcgtgatttacgaagagatctctgacccccaagaagatgatgagtag

SEQ ID NO: 24537 - DNA, 273 bp, Artificial Sequence
  Description of Artificial Sequence: Synthetic coding sequence
atgactttcgggcgactccagcgtattatcccgaagattatgccagaaaagcccgcagaagaggggtctgactctaagggagttcccgaagcatccggcccacagaacgatggaaaaaagctctgcccaccaggaaaggcttcttcaagcgagaaaatccatgaacgcagcggtcccaagcgtggtaagcacgcttggacccatcgcctgagagagagaaagcagctggttatctacgaggagatatcagatcctgaggaagatgacaagtag

SEQ ID NO: 24538 - DNA, 567 bp, Artificial Sequence
  Description of Artificial Sequence: Synthetic coding sequence
atgaatggtgatgatgccttcgctaagcgccctcgtgacgatgctaaggccagtgaaaaaaggtctaaagccttcgatgacatagcgaagtacttctccaaggaagagtgggagaagatgaaatttagcgaaaagatttcatgcgttcatatgaagaggaagtacgaggccatgacgaagctgggcttcaacgtcaccttatccctgttcatgcggaataagcgcgctacagacagtcaaagaaatgactccgacaacgataggaaccgcggaaacgaggtcgagagacctcagatgacctttggccgactgcagaggattattcctaaaattatgccagagaaacctgcagaagaggggagcgattctaagggagttcctgaggcttccgggccacagaatgatggcaaaaaattgtgtcctcctggcaaggccagctcgtcagaaaagatacatgaaagaagcgggcctaaacggggaaagcacgcttggacccatagactcagggagaggaaacaattggtcatctacgaggagatttcagaccccgaagaggacgacaaatag

SEQ ID NO: 24539 - DNA, 567 bp, Artificial Sequence
  Description of Artificial Sequence: Synthetic coding sequence
atgaatggggacgatgcgttcgcccgtaggcctagagcaggagctcagatcccggaaaagatccagaagagttttgatgacatagcgaagtattttagcaagaaggagtgggaaaagatgaagtcattggaaaaaatcagttatgtttatatgaaaaggaagtatgaggctatgaccaagctcggcttcaaagccaccctgcccccattcatgcacaacaccggagcgaccgacctccagggaaatgattttgacaacgacaggaaccagggcaaccaggttgagcgaccacaaatgacattctgccgtctgcagcggatctttccaaagattatgcctaaaaagcccgctgaggagggaaatgattctaagggggtgcccgaagcgtccggatcccaaaatgatggcaagcatttgtgccctcctggaaaaccctccacatctgaaaaaatcaacaagacttcaggcccaaagcggggtaaacatgcatggactcaccgactccgggagcgaaaacagttagtaatctacgaggagattagtgaccccgaggaagacgatgaatag

SEQ ID NO: 24540 - DNA, 567 bp, Artificial Sequence
  Description of Artificial Sequence: Synthetic coding sequence
atgaacggggacgacgcttttgctagaagaccgcgagcaggcagccagattccagaaaagatccagaaagctttcgatgacatcgcaaaatatttttcaaagaaagaatgggagaagatgaaaagcagcgaaaagatcatatatgtttacatgaagagaaaatatgaagctatgacaaaactgggtttcaaggccacccttccaccctttatgtgtaacaccggagcgaccgatttgcagggaaatgacttcgacaatgacaggaatcatagaaaccaggtggaaaggtctcagatgacattcggcagactgcaggggatctttccgaagatcatgcctaaaaagccagccgaggttggcaacgactccaaagaagtccccgaggcctccggtctccagaacgatggcaaacagctctgtccgcctggaaagccaaccaccagcgaaaaaatcaataaagcgagcggtcccaaacgcggaaaacacgcttggactcaccgacttcgggagcgtaagcagctggtcatctacgaggagatcagcgaccctgaggaggatgatgagtag

SEQ ID NO: 24541 - DNA, 567 bp, Artificial Sequence
  Description of Artificial Sequence: Synthetic coding sequence
atgaacggcgatgacgccttcgctcggaggccccgagcagggtcacagattcctgagaaaatccaaaaagccttcgacgacattgcaaagtacttctccaaaaaggagtgggaaaagatgaaatcctcagagaagatcatctatgtctacatgaaacggaaatatgaggccatgactaagctggggttcaaggccacgctcccaccattcatgtgcaacactggcgctactgacctgcaaggcaacgactttgataacgacagaaatcacagaaatcaagtcgaaaggtcacagatgacttttggtcgacttcaaggcatctttccaaaaatcatgccaaagaagccagcagaggtcgggaacgattctaaggaagtcccggaagcatcaggactgcagaatgatggcaaacagctctgccccccaggtaagccaaccacatcagagaagataaacaaggccagtggccctaagaggggcaagcacgcctggacccaccggctaagagagagaaagcagctagtgatttatgaggaaatcagcgatcctgaggaagacgatgagtag

SEQ ID NO: 24542 - DNA, 5481 bp, Artificial Sequence
  Description of Artificial Sequence: Synthetic coding sequence
atgcggcctggctgtgacctgcttcttcgggctgccgcaaccgtgaccgcggctatcatgtctgacagcgactctgaggaggattcctcaggcggtgggccttttaccctggctgggatattattcggtaacattagcggagctggtcagttggaaggggaaagcgtgctcgatgacgaatgtaagaaacaccttgccggactaggcgcattgggcctgggcagcctgatcaccgaattgacggccaacgaagaactgacaggtacagggggtgcactagtaaatgatgaaggttggatcaggtctactgaagatgccgtagactactccgatatcaatgaggttgccgaggacgagagccagcgccatcagcagacaatgggttctcttcaacccctgtaccatagcgattacgacgaggacgactacgacgccgattgcgaggacatagattgtaagctcatgccacctccgccaccaccccctgggccaatgaaaaaggacaaggaccaggatgcaataacatgcgtgtcggagtccggggaggatatcattctaccatcaatcattgcgcctagtttcctggcgtccgaaaaagtggatttttccagttactcagatagtgaaagtgagatggggccacaggaagccacgcaagctgagtctgaggacggaaagctgacgcttcccctagccggtataatgcagcatgacgcaaccaaactactgcccagcgttactgagctgttccctgaatttcggcctggaaaggtgttgcgttttctccacctgttcggtcccggtaaaaatgtgcccagcgtttggagatccgccaggagaaagagaaagaagcatagggaactcatccaagaggagcagattcaggaagtggaatgctccgttgaatctgaggtgagccagaaatctctatggaattatgactatgctcctcctcctccaccagagcagtgtctcgccgacgatgagatcaccatgatggtgcccgtggagagtaagttctcccaaagtaccggagacgttgacaaagtgaccgacactaaacctagagtggcagagtggcgttatgggccagcacgcctatggtatgatatgcttggggtctccgaggacggaagtgggttcgactatgggttcaagcttcggaagacccagcacgaacccgtgatcaagagcagaatgatggaggagttccggaagctggaggagtctaatgggactgaccttctggctgacgagaatttcctgatggtgacccagttacattgggaggattcaatcatttgggacggggaagacattaagcataagggcacaaagccacaaggcgcaagcctagcgggttggttgcctagcatcaaaacgaggaacgtgatggcctataatgtacagcagggtttcgccccaacactcgatgacgacaagccctggtacagcatctttccgatcgacaatgaggatctggtgtatggacgctgggaagacaacatcatctgggatgcacaggcgatgccacgactgctggagccccctgtcctggcgcttgaccccaatgacgaaaatctaatactggagatcccagacgaaaaagaggaggcgacctcgaattcaccctctaaagagtcaaagaaagagtcttctctgaagaaatcccgcattttactgggtaaaacaggcgtgatcagagaggaacctcagcaaaacatgtcccagccagaagtgaaggacccttggaatctgtccaacgacgagtattacttcccaaaacaacaggggctgaggggaacctttgggggtaatatcattcagcacagtatccccgctatggagttgtggcagcccttctttcctacacacatgggacccatcaaaatcagacaatttcacagaccacccctgaaaaagtacagtttcggagctctttcccagcctggtccccacagcgtgcaaccacttctcaaacacatcaaaaaaaaggctaaaatgagagaacaagagcgccaggcaagcggcggtggcgagcttttcttcatgcgcacacctcaagacttaaccggaaaggacggagatctgattttagctgagtacagcgaggaaaatggaccactgatgatgcaggtgggtatggccacaaagatcaagaattattataagaggaagcccggaaaggatccaggcgctcctgactgcaagtacggagaaaccgtgtactgtcatacttcaccatttctcgggagcctccaccctggccaactcctccaggcattagagaataacctgtttagagctcctgtgtatcttcataaaatgcccgaaacggactttttgatcattcgcactaggcagggctattacatacgagagttggtcgatatcttcgtggttgggcaacagtgccccttgtttgaagtgcctggccctaactctcgtcgggcaaatatgcacatccgtgacttcttacaggtattcatttatagactcttttggaaatcgaaggatcgtccccgacggatcagaatggaggatatcaaaaaggcctttccaagccacagcgagagctccattcgcaaaaggttaaagctctgtgctgactttaagaggacggggatggatagtaactggtgggtcttgaagagtgattttcggctccctaccgaagaggagatcagggctaaagtgtcccctgagcagtgctgcgcatactactctatgatcgcggctaagcagagactaaaggatgccggatatggggagaaatcttttttcgcccctgaggaggaaaacgaggaggacttccagatgaagatcgatgatgaggttcacgccgctccgtggaatacaacccgcgcattcattgcagccatgaagggtaagtgcttgttggaggtgactggagtggccgatcctacgggttgtggagagggcttctcatacgtgaaaataccaaacaaacctacccaacagaaagacgacaaagaacctcaggcggtgaagaagactgtgacaggcaccgatgccgacctgaggagattaagcctcaagaacgccaagcagctcctcagaaagtttggagtaccggaggaagagatcaagaaactttcgaggtgggaggttattgatgttgtgcgcaccatgagcaccgaacaggcccactccggagaaggccctatgagcaagttcgcgcgtggttcacgtttctcagtggccgaacatcaggagcggtataaggaggagtgccaacgcatcttcgacttgcagaacaaggtgctgtcaagtactgaggtgctgtccacggacactgacagcatctccgcagaagactctgacttcgaggagatgggcaagaatattgagaatatgctgcagaacaaaaagacctcgtcccagcttagtcgcgagtgggaggagcaggaaaggaaagagttgcgccgaatgctcttggtcgctggatctgccgcaagcggaaataatcaccgagatgatgtgacggcttcaatgactagtttgaagagctcggcaaccggtcactgtctcaaaatttacaggacctttagggacgaagaaggtaaggaatacgtgagatgcgagaccgttcgcaaacccgctgtaatagatgcctatgtacgaattcgcacgaccaaagatgaaaagttcattcaaaagtttgccctctttgacgagaagcaccgtgaggaaatgcgcaaggaacggaggcgaatccaggagcagctccgcaggttgaaaagaaaccaggaaaaggagaaactgaagggcccaccagagaagaagcccaagaaaatgaaggagaggccagatctgaagctgaagtgcggcgcttgtggcgcaatcggccatatgcgcacaaataagttctgcccgctttactaccagactaacgtccctccctctaagcccgtcgcaatgactgaagagcaagaagaagaattggaaaaaacagtgatccacaatgataacgaagagctcattaaggttgagggaacaaaaatcgtattcggaaagcagctcattgagaacgtccacgaggtaagaagaaaatcactggtactgaagtttccaaagcagcagctcccgccaaagaagaagcgcagggtgggaaccactgttcactgcgattacctgaatattccccataaaagtattcaccggagaagaaccgacccaatggttacactgtctagcatcttggagagcatcatcaacgacatgcgagacctccctaatacacacccattccacaccccagtcaatgccaaagtggttaaggactactataagattatcactaggcccatggacttgcaaaccctacgggagaatgtgcgcaaatgcttatacccttcaagagaagaatttcgagagcacttagagctgattgtgaagaattctgccacttacaacggccctaagcacagtctcacccaaatatctcaaagtatgctggacctgtgtgacgagaagttaaaggagaaggaagataaacttgcacgactcgagaaggcaataaatcctctgctggatgatgatgaccaggtggcttttagttttatcttagataatatcgttacccagaagatgatggcagtgcctgactcctggcccttccaccacccagttaataaaaagttcgtaccggactactacaagatgatcgtgaacccggtagacttggagacaataagaaagaacatttcaaagcacaagtaccaatctcgagagagcttcctagacgatgtgaatctgatcctggcgaattctgttaaatataacggcccagagtcccaatacacaaagacagctcaggaaatcgttaacatttgttatcaaactattacagagtatgatgagcatttgacccaactggagaaggacatttgcaccgccaaggaagccgctctcgaggaagcagagcttgagagtcttgatccgatgacgcctggaccctatacctctcaacctcccgatatgtacgacacaaatacatctctaagcacctcgagggatgctagtgtgttccaagacgagtcaaatctgagtgtgctcgatatttccacagccactcccgaaaagcagatgtgccaagggcagggtcggttgggtgaagaggactcagatgtggatgtggagggatatgacgacgaggaagaagatggtaagcccaaaccaccagctccggagggaggcgacggagatttggccgatgaggaggaaggtacagtccagcagcccgaggcttctgtgctgtacgaagatttgctgatcagcgagggagaggacgatgaagaggatgctgggtcagacgaagagggggacaatcctttcagcgctattcagctgtccgaatccggttcggacagtgacgtcggatatgggggaatcagaccgaagcagccattcatgttacagcatgcaagcggtgagcataaagacggacacggcaagtaa

SEQ ID NO: 24543 - DNA, 375 bp, Artificial Sequence
  Description of Artificial Sequence: Synthetic coding sequence
atggccgatgaagaagaagaccccacttttgaggaggaaaatgaggagatcgggggtggagcagagggcggtcaggggaagagaaagcgactgttctccaaggaactccggtgtatgatgtatgggttcggggatgaccagaacccatatacagagagtgtggacatccttgaggatctagtgatcgagtttattactgagatgacgcacaaagccatgtccattggaagacagggccgagtacaagtagaggacattgtatttctaataaggaaggaccctcgtaaatttgcacgggtcaaggacctattaacaatgaacgaggagcttaaaagggctagaaaagcctttgacgaggcaaactacggttcatag

SEQ ID NO: 24544 - DNA, 375 bp, Artificial Sequence
  Description of Artificial Sequence: Synthetic coding sequence
atggccgatgaggaggaggaccccaccttcgaggaggaaaatgaggagattggcggaggagcagagggagggcaggggaagcgaaagcgtttattctccaaagagctgagatgtatgatgtacggttttggggacgaccaaaacccgtacactgaaagcgtcgatattctggaggacctggtgatagaattcataactgaaatgacacacaaggcgatgtccatcggcagacaagggagggtgcaggtggaagacatcgtctttctaatcaggaaagatcccaggaagttcgctagagttaaagatctgctgacaatgaacgaggaactaaagcgcgctaggaaggctttcgacgaggctaattacggctcctag

SEQ ID NO: 24545 - DNA, 3600 bp, Artificial Sequence
  Description of Artificial Sequence: Synthetic coding sequence
atgcccttgaccggtgtagagccagctagaatgaatcgtaagaaaggggacaagggtttcgagtctccacggccatacaagctgactcaccaggtggtgtgcatcaacaatattaatttccagaggaaatcagtcgtcggctttgtcgagctgacaatatttccaacagtggccaatctgaataggataaagttgaattccaaacagtgccggatctacagagtaaggatcaacgatcttgaagctgcctttatctacaatgacccaacgctggaggtgtgtcactcagagagtaaacagcgcaacctgaattatttctctaacgcttatgctgctgcggtaagtgccgttgatcctgatgctggtaacggagaactgtgcatcaaggtgcctagcgagctctggaagcacgttgacgagctgaaggtattgaagattcacatcaacttctcactggatcagcctaaggggggactccattttgtcgtgcctagcgtcgaggggtctatggcagagcgcggagcccatgtcttctcctgcggatatcaaaacagtacaaggttctggttcccatgcgtggatagctacagcgagctgtgcacctggaagctggaattcacagttgatgccgcaatggtggccgtgtctaacggtgatctcgtcgagacagtatacacccatgatatgagaaaaaaaaccttccactacatgttgacgatacccactgctgcctctaacatctcactggcaattggcccattcgaaatcttagtcgatccttacatgcatgaggtgactcacttttgcctacctcagctgcttccgcttttgaagcacaccaccagctatctgcatgaagtcttcgagttttacgaagaaatcttgacctgtcggtatccctattcatgctttaagaccgtcttcattgacgaagcatacgtcgaggttgcagcctatgccagcatgtcaatcttctcaacgaatctgctccactctgccatgatcatagatgaaacaccacttacgcgaaggtgcttagcacagtctctggctcagcagttctttggctgcttcatttctcggatgtcgtggtccgacgaatgggtcctaaaaggcatctcaggctacatctacggtctgtggatgaagaagaccttcggtgtcaacgagtaccgacactggattaaggaagagctcgataagatcgttgcatatgaacttaagacaggcggtgtactgctgcacccaatcttcggtggaggaaaagagaaggataatcccgcaagccatctgcacttttcaattaagcacccacatacgctctcatgggagtactattccatgttccaatgcaaagctcacctggtaatgcgcctgattgagaatcgcataagcatggaattcatgttgcaggtgttcaacaaactgctctcattggcttctacagccagctctcagaagtttcaaagccacatgtggagccagatgctcgtctcaaccagcggatttctgaaatctatttccaacgtatctgggaaagacattcagccccttataaagcagtgggtggatcaatctggggtcgttaagttttatggttccttcgccttcaacaggaaacggaacgttctggaattggagatcaagcaggattatacaagcccaggaacacagaagtatgttggacccttgaaggttacagtgcaggagttggatgggtcctttaaccacactctgcagatcgaggagaactccctaaagcatgacatcccctgccattcgaaaagccgcagaaataagaaaaagaaaatacctctcatgaacggggaggaggtggacatggacctgagcgctatggacgcagactccccgttgctgtggatcagaatagatcctgacatgtctgtcctgcggaaggtggagttcgaacaggcagattttatgtggcagtaccagctgaggtatgaacgggatgtagtggcccagcaggaatcaattctcgcccttgagaaattccctactccggcttctaggcttgcactcaccgatatcttggagcaagagcagtgtttttaccgcgtgcgaatgtcggcatgcttttgtctcgccaaaatcgccaacagtatggtttccacctggacgggccctccggctatgaagagcctttttacacgcatgttctgttgcaagtcttgtccaaatattgttaagaccaataatttcatgagcttccagagttattttctccagaagactatgccagtggcaatggctctgctgagagacgtgcataatctgtgcccgaaggaagtgctcactttcatactagatctgatcaaatataacgataaccggaaaaataagttttcagataactactatagggccgagatgatcgacgctctggccaacagcgttactccagcggtgtccgtgaataacgaggtacggacactggacaatctcaatcccgatgtgagacttattctcgaggagatcaccagatttctgaatatggagaaactattgccaagttaccggcacactatcactgtttcctgtctgcgagctattagggtgctgcaaaaaaatggtcatgtccccagtgatcccgctctgttcaaatcgtatgcggagtatggccacttcgtggacattcgaattgcagccctggaggccgtggtcgactacacaaaagtggatcgatcgtacgaggagctgcagtggctcctgaacatgatccagaatgatccggttccctatgtgcgccacaagatcttgaatatgctgacaaaaaatcctccctttaccaaaaatatggaatccccactttgtaatgaggcccttgtggaccagctgtggaagttaatgaacagcggaacaagccatgattggcgcttgagatgcggcgctgtggacctgtattttaccctttttggtctgagccgcccaagttgtctgccactgcctgagctgggtctcgtcttgaatctaaaagaaaagaaagcagttcttaacccgactattatccccgaatctgtcgccggaaaccaggaagccgctaataatccctccagtcaccctcagcttgtcgggttccagaatcctttctcctcaagccaggatgaagaggagattgacatggatacggtgcatgatagtcaggcattcatcagtcaccacctgaacatgctggagcgtccttccacccccggtctgtccaagtaccgcccagcttcaagtcggagtgctcttattcctcagcattctgcaggttgtgattccacccctaccacaaagccccaatggtcactagaactggctcgcaagggcacaggcaaagaacaggcccctttagaaatgtcgatgcacccagccgctagcgccccactctccgtgtttacaaaagagagcactgcttccaagcattctgaccatcatcaccaccatcaccatgagcacaagaagaagaagaaaaagcacaagcacaagcacaaacacaaacacaaacatgactcaaaagagaaggacaaggagccatttacctttagcagccctgctagtggacgatctatacggagcccctcactttcagactag

SEQ ID NO: 24546 - DNA, 1770 bp, Artificial Sequence
  Description of Artificial Sequence: Synthetic coding sequence
atgaaacgagtccgcacggaacagatccagatggccgttagttgctatcttaaaagacgtcagtatgtggactctgatggaccactaaagcaggggctgcgccttagtcagaccgccgaggagatggcggcaaatctcacagtgcagtccgaatcgggctgtgcgaatatcgtgagtgccgcaccttgtcaggccgaaccccagcagtatgaagtccaatttggtcggctgcgcaactttttaacagattctgactcccagcattcccatgaggtgatgccccttctttatcccctttttgtgtatttgcacctgaacctcgtgcagaattcccccaaatcaaccgtggaatccttttattcccggttccacggaatgtttctgcagaacgcctcacagaaggacgtaatcgaacagctccaaactacacaaaccatacaagacatcctctccaatttcaagctgcgggctttcttggataataaatatgtggttaggttgcaggaggattcatataattatcttataaggtacttgcaatcagacaataatactgcactatgtaaggtgcttactttgcacattcacttagacgtccaacccgcaaagcgcactgactatcagctgtacgcatcagggtcttctagtcgctctgagaacaatggcctcgagccacctgacatgccttcccctatactgcagaacgaagcagcactcgaggtgctacaagagtcaataaaaagagttaaggatgggccaccctctctgacaaccatttgcttctacgccttctacaataccgaacagctcctcaatactgccgagattagccctgattctaaactcctcgcagcaggttttgataactcctgcattaagctatggtcgctccggagcaaaaagctgaagtccgaacctcaccaagtcgacgtgagtcgaattcatctcgcctgcgacatcctggaggaggaagacgacgaagatgataacgccggtaccgagatgaaaatcctcagaggccactgtggtcccgtttattccactagatttctggccgactccagtggtcttttatcttgctccgaagacatgagcataagatactgggatctaggtagcttcactaacactgttttatatcaaggacatgcctaccctgtgtgggacttggatatcagcccttactcactttacttcgcatctgggtctcatgacagaacagctaggttgtggagtttcgatcgcacctacccgctgcggatctacgcgggtcacttagccgacgtggactgtgtgaagtttcacccgaactcgaactacctcgcaacgggctccaccgacaaaacggttagactctggtccgctcagcagggtaactctgtgagactcttcaccgggcacagggggcctgtgctctcactcgcctttagtcccaatggtaagtaccttgcctcggctggagaggaccaaagattaaaattgtgggatctcgccagcgggactctttataaggagctcagggggcacaccgacaatatcacttctttgacgttcagtccggacagcgggcttattgcgtctgcgtcgatggataactccgtgcgcgtgtgggacattcggaacacatactgctcagccccagccgatggcagttcttcagaactggtgggagtgtatacagggcagatgtcaaatgtattgtcagtacaattcatggcctgtaacctgctgctggtgaccggcataacccaggaaaatcaggaacactag

SEQ ID NO: 24547 - DNA, 255 bp, Artificial Sequence
  Description of Artificial Sequence: Synthetic coding sequence
atgaagagggtgcggacagagcagatccagatggctgtctcctgctatcttaagaggcgtcaatatgtggactcggacggccctctgaagcagggcctgagactcagccaaacggctgaggaaatggccgctaaccttacagggaatggcggtgggtcctccggcggagtgtcactggagcaagaaaactctcggcaatacccatgcggcattactagtcctctcctgaaaacagtgcctgaacgcgcagactag

SEQ ID NO: 24548 - DNA, 978 bp, Artificial Sequence
  Description of Artificial Sequence: Synthetic coding sequence
atgaaacgggttaggacggaacagatccagatggccgtgtcttgctacttgaagagaaggcagtacgtggacagtgatggccctctgaaacaaggcttgagactgtcgcagacagctgaagagatggccgcaaatctgacggtacaatccgagagcgggtgtgctaacattgtgtcagcggctccatgtcaggctgaaccacagcagtatgaagtgcaattcgggaggctgcgtaattttcttacggactctgactcccagcactcacatgaggtcatgcctctactgtatcctctctttgtctacctgcatctgaacctggtgcagaacagtccaaagtccactgtggagtcattctatagtaggtttcatgggatgtttttgcagaacgcctctcagaaagatgtgatcgagcagctgcagactacgcagacgatacaggatatcctgagcaactttaagttacgtgcatttcttgataacaaatacgtcgtgagactgcaagaagatagttacaactatttgatacggtatctgcagtctgataataatactgcgttgtgcaaagtgctgaccctccacatccacctcgacgtacagccagcgaagaggacagactatcagctgtacgcatcagggtcttcctctaggtccgagaacaacggcctggagccccctgatatgccatcgcccatacttcagaatgaggccgcactcgaggtcctgcaggaatccataaagcgagttaaggatggccctccttccctaaccacaatctgcttctacgccttttataacacggaacagctgttaaataccgctgagatttcaccagatagcaagctgttagccgctggtttcgacaattcctgtatcaagctttggtcacttcgatctaagaagttgaaatccgaaccgcaccaagtggatgtgtcgaggattcacctagcatgtgatatattagaggaggaagtttag

SEQ ID NO: 24549 - DNA, 1770 bp, Artificial Sequence
  Description of Artificial Sequence: Synthetic coding sequence
atgaaaagagtgcgtactgagcagatccaaatggcggtgagctgctacttgaagcgtagacagtacgttgacagcgacggccctctgaaacagggcctgcgtctgtcccagaccgccgaggaaatggccgctaacctgacggtacagtccgaaagtggttgcgccaacatagtgagtgccgcaccttgtcaggctgagccccaacagtacgaggtgcagtttggccgactgcggaactttctcaccgattcagattctcagcacagccatgaagtgatgcctttattatatccgttgtttgtgtatttacaccttaatttggtccagaattctccgaagagcacagtggagtcgttctatagcagatttcacgggatgtttttacagaacgctagccagaaggacgtgatcgagcagctccagaccacccagaccatccaggatattctctccaattttaagttaagagcatttctggataacaagtatgtcgtacggctgcaagaggactcgtataactatctcatccgatatctccagtccgataacaacactgctctgtgcaaggtgctaacccttcacattcacctggacgtccagccagctaagaggacagattaccaactatacgcttccggatccagcagtcgaagcgagaataacggactcgaaccgccagatatgcccagccccatcttgcagaatgaggccgctctggaggtgctgcaggagtccattaagagagtgaaggacgggccaccatccttaactacgatatgcttttacgccttttacaacactgaacagcttttgaatactgccgaaatttcaccagactccaagttgctcgctgctggctttgacaatagctgtatcaaactctggagccttcggtcaaagaagctcaaaagtgagccacaccaggtggacgtgtctcggatacacctggcatgtgacatcctggaggaggaagacgatgaagatgataatgcaggtacagagatgaagattctgaggggacactgcggtccggtgtactcaacaaggttcctggcagactcctcaggcctgttaagctgctcagaggatatgtctataaggtactgggatttgggcagtttcaccaacaccgtgctgtatcagggacacgcttacccagtttgggatctcgacataagtccttattccctttacttcgctagtggctctcacgatcggacagctcggctgtggtcgtttgataggacgtatcctttaaggatatacgccggacacctcgccgacgtggattgcgtaaaattccaccctaacagtaattacctcgctaccggatcaacagacaagacagtgaggctgtggagcgcccagcagggcaatagcgtcaggctctttaccggacaccgcggtcccgtgctcagtttagctttcagcccgaatggaaagtacctcgcgagcgcaggggaggaccagcggctgaaattgtgggacttggcatccggaactttgtacaaggaactgcggggtcacaccgataacattaccagcttaacgtttagccctgacagtggactgatcgcatccgctagcatggataatagcgtaagagtttgggatatccgaaacacttattgtagcgcccctgctgacgggtctagtagcgagcttgtaggagtgtacacagggcaaatgtccaacgttctgtccgtgcagttcatggcatgcaatttactcctggtcacaggcatcacccaagagaaccaggaacactag

SEQ ID NO: 24550 - DNA, 1869 bp, Artificial Sequence
  Description of Artificial Sequence: Synthetic coding sequence
atgagcgaaagagaggaaagaagattcgtagagatcccaagagagtctgttaggctcatggcagagtctacaggcctggaactgtctgatgaagtcgctgcacttctggctgaggacgtgtgctatcgcctccgagaggccacgcagaactcctctcagttcatgaaacacactaaaaggcgcaagctaactgtggaggactttaacagagcgctgcgttggtccagtgtggaagcagtgtgtggttacggctctcaggaagccttacccatgaggccagcccgtgagggagaactgtatttcccagaggatagggaagtcaatctagtggagctcgccctggctaccaatatcccgaaaggttgcgctgaaaccgcagtacgcgttcatgtatcgtatttagatggcaagggaaacctcgcgcctcagggttccgtcccgagcgcggtgtcctccctgacggacgacctccttaagtactaccatcaagtgacgcgagcggtccttggcgatgaccctcagctgatgaaggttgccctgcaagacctccaaacaaacagtaaaattggggctctcctgccctactttgtgtatgtggtcagcggtgtgaagtcagtgagccacgatctcgaacagttacacaggctgctacaggtggcacgctccctgtttcggaacccccacctctgtctagggccatacgtcaggtgcctggtcgggtctgtgttgtactgcgtcctcgagcctctggcggcttccattaaccccttgaacgaccattggacactgcgggacggcgcagccttactcttgagccacattttttggacccatggggatctggtgtcaggactgtaccagcacatcctcttgtctcttcaaaagatcctggctgacccagtaagacccctgtgttgtcactatggtgctgtggtcggcctgcacgcccttggctggaaggcagtagagagggttctttatccacacctgtcaacatattggacgaacctgcaggctgtgctggacgattatagcgtcagtaacgcccaggttaaggcagatggtcataaggtctatggcgctatcctcgtggctgtggaaagactgttgaaaatgaaagcacaggctgctgagcccaaccggggtggccctggcggacggggatgtaggaggctcgacgacctcccctgggattcattgctgttccaagaatctagttcgggcggtggtgcggagccatccttcggttccggccttcccctgcctcccggtggtgccggtccagaggacccctctctttccgtcaccctggcagacatatatcgggaactctatgccttcttcggggacagtttggctacccgatttggtacagggcaacctgccccaacggcccctaggcccccaggggataagaaggagcccgctgccgctcccgatagcgtcaggaagatgcctcagctgacagcctccgccatcgtttcaccacatggcgacgaaagtccacgtggatcagggggagggggtccagcctcagcatccggaccagccgcttcggagagcagacccttgccccgagtgcacagggccagaggagctcctaggcagcagggcccaggaaccggtactcgcgacgtattccaaaaaagcagatttgctccaagaggggctccacacttcagattcattatcgctggtcgccaagctgggaggcgatgtcggggaaggctgtttcagactgctttccctgccccttatgggccatcgccagcctctaggtacgttcagaagctgccaatgatcggcagaacgtcccgacccgcaaggcggtgggccttaagtgattattccctgtacctgcccctctag

SEQ ID NO: 24551 - DNA, 153 bp, Artificial Sequence
  Description of Artificial Sequence: Synthetic coding sequence
atgtccgagagagaagaacgcagattcgtggagatccccagggaatcagtgcggctcatggccgagtcaacgggcttagagttgagcgatgaggttgctgctctattagcggaggatgtatgctacagactaagggaggcaacgcagaattag

SEQ ID NO: 24552 - DNA, 438 bp, Artificial Sequence
  Description of Artificial Sequence: Synthetic coding sequence
atgagtgaaagggaggagcggcgatttgtggagataccgagggagagcgtaagattaatggcagaatcaacgggactggaactttccgacgaagtggccgcacttctcgccgaagacgtgtgctaccgactgcgggaggcaacccagaacagttctcagttcatgaaacataccaagcgccgaaaacttaccgtcgaggatttcaatcgtgcgctgagatggtccagtgtggaggcggtttgcgggtacgggagccaggaggctctgcctatgcgccctgcgagagagggcgagctctattttccagaagacagagaagtgaacttggtagaactggccctggccacaaacatacccaaaggctgtgctgaaaccgcagtgagagtgcacgtgtcctatttagatggcaaaggaaatctcgctccccagggatcttag

SEQ ID NO: 24553 - DNA, 1473 bp, Artificial Sequence
  Description of Artificial Sequence: Synthetic coding sequence
atggcgactgaattcattaagagttgttgcggcggttgtttttatggagagaccgagaaacacaactttagcgtggagagggactttaaagccgcagtgcccaacagtcagaacgccactatctcagttccacccttgacaagtgtctccgtcaagccccagttgggctgcactgaagattacctgttgagcaagttaccatcagatgggaaggaagttcccttcgtcgtccccaagttcaagttgtcctatattcagcccagaactcaagagacccccagtcatctcgaggaattagaggggagcgctagagcctcttttggtgacaggaaagtggaacttagttcctcaagtcagcacggtccgtcgtatgatgtctacaaccctttctacatgtaccaacatattagcccagacctgtcgagacggtttcctcctcgttcggaggtgaaaaggctctacggttccgtgtgcgacctccgcaccaataagctacccggttctcctggactttctaaaagcatgttcgacctgacgaatagctctcagaggtttatccaacggcacgactctcttagcagtgtgccttcatccagtagctcaagaaagaattctcaaggaagtaatcgatcactggatactatcaccctgagcggcgatgaacgagatttcggaaggctgaatgtgaagctcttttataattcaagcgtagagcagatctggatcactgttctgcaatgtcgcgatctgagctggccgtcatcctacggagataccccaaccgtgagcattaaaggtatattgactttgcccaaacccgtgcactttaagtcaagtgcaaaagagggctccaacgcgattgaattcatggaaacctttgtgttcgcaattaaactgcaaaatttacagactgtgaggctggtgttcaagattcagacgcagaccccaagaaaaaagacgataggagagtgcagcatgtcccttagaacacttagcacccaggaaatggattactcattagacatcacccccccaagtaagatctcggtgtgccatgctgagttagagctgggtacttgtttccaggcagttaatagccggatccagttgcagattcttgaggcgcgttacctgccttcaagctccactcctttgacattaagctttttcgttaaggttggaatgttctccagcggagagctgatatacaagaagaaaaccagactcctcaaggcctcaaatggcagggtgaagtggggagagactatgatctttccactgatccaaagtgagaaggagattgtattccttatcaaattatattctaggagcagtgtccgtcggaaacacttcgtgggtcaaatctggatttccgaggactccaacaatattgaggcagtcaaccaatggaaagaaaccgtgatcaatccggagaaggttgtgatcagatggcataagctaaacccatcatag

SEQ ID NO: 24554 - DNA, 1473 bp, Artificial Sequence
  Description of Artificial Sequence: Synthetic coding sequence
atggctaccgaattcattaaaagttgctgtgggggttgcttctacggagagactgaaaagcacaatttctccgtggagagagacttcaaggctgccgtccccaactcccagaacgccaccattagcgtcccgcctctgacgagcgtgtctgtcaaaccacagctggggtgcactgaagattatctgttgagcaaattgcctagcgatggaaaagaggtgcctttcgtggtcccgaaattcaagctttcatacatccagcctaggacccaggagacaccttcccacctggaggaactagagggaagcgcacgggcttccttcggcgacaggaaagtggaattatcctcttcttctcagcacggaccgagttacgatgtgtacaatccgttctatatgtaccagcatatcagtcctgatctgagcaggcgtttccctccacgttccgaggtaaaacgcctctatgggagtgtgtgtgatctgcgtactaacaagctgcctgggagtccaggactgagtaaatcaatgtttgatttaactaacagctctcagagatttatccaaagacacgacagcctgtcctctgtgccaagcagttcatctagcaggaaaaattcccaaggctctaatagaagcttggatactatcactctttctggggatgagagagatttcggacggttgaatgtgaagctgttctataactcaagcgtggaacagatctggatcactgttctgcagtgtcgggaccttagctggccgagctcgtacggggataccccaactgtcagtatcaaagggatcttgacactgcccaagcccgtgcacttcaagtcaagcgcaaaagaggggagcaacgccattgagtttatggaaacattcgtgttcgctattaaactgcagaacttgcagactgtgcgtttggtattcaaaattcagacccaaacccctcgtaaaaaaaccataggggagtgcagcatgtcactgcgtacccttagcacccaggagatggactacagcctggatatcacgccaccatccaagatctctgtgtgccatgcggagctggaactgggtacctgctttcaagctgtgaattcaagaatccagctgcagatacttgaagcgaggtatctgccaagcagttctacccctctgactctttcctttttcgtgaaggtgggcatgttcagttcaggtgagctcatctataagaaaaagaccaggctgcttaaggcatctaatggcagagttaagtggggcgagactatgatcttcccactcatccagagcgaaaaggagatcgtcttccttatcaaactatattcacggagttccgtgcggaggaaacatttcgtggggcagatttggatttcagaagatagcaacaacatcgaagcagtgaatcagtggaaggaaactgtgatcaacccagagaaggtggtcatcagatggcataagctgaatccatcctag

SEQ ID NO: 24555 - DNA, 1473 bp, Artificial Sequence
  Description of Artificial Sequence: Synthetic coding sequence
atggcaaccgaatttatcaagtcgtgttgcggtggttgcttttatggtgagaccgaaaaacataatttctctgttgagcgcgatttcaaggccgcagtgccaaactcccagaacgccacaatctcggtaccccctctgacctccgtgagcgtcaagccccaactcgggtgtaccgaagactacctcctgtctaagctgcctagcgacggaaaggaagtgcccttcgtggtccccaagtttaagttatcctacattcagccacgtacccaggagactccatcccatctcgaggagttagagggctccgccagggcatcctttggcgaccggaaggtagaactctcaagctcctcacagcatgggccatcatacgacgtgtacaatccattctatatgtatcagcatatctctccagatctgagccgacgatttccaccccgttcagaggttaaacgtctgtacggctctgtgtgtgatctgcgtacaaataagctgcctggctctcccggactgtctaaatctatgtttgatctgacaaatagcagtcaacggttcattcagaggcatgactccctctcttctgttcctagtagcagctcctctcgtaagaactcacagggatcgaatcggtctctggatacaatcaccctgagcggcgacgaacgggattttggcaggcttaatgtaaaattgttctacaacagttccgtggagcagatatggattaccgtactacagtgccgagacctttcctggccatccagctacggtgatacgcccaccgtgagcataaaaggaatcctcacactgcccaagcccgttcatttcaaaagcagtgctaaggagggcagtaatgctattgagtttatggagacttttgtgttcgctatcaagctgcagaacctccagacagtccgcctggtgttcaagattcaaacccagaccccaagaaaaaaaaccattggcgagtgttccatgagcttacggactctgtctacacaggagatggattactccctcgacatcaccccaccatctaaaatttccgtatgccatgcagagctcgagctgggaacatgcttccaggctgtaaactcccgcattcagttacaaatactggaggccaggtacctgcccagctcctcaactcccctgacactgtctttttttgtcaaagttggcatgtttagtagtggagagttgatctacaagaagaagacacgcctgcttaaggcctccaacggtagggtgaaatggggcgaaactatgatttttccgcttatacagagcgaaaaagagattgtgttcctcataaagctttactcccggtcttccgtgcgaagaaagcacttcgtcggacagatatggatctctgaggattccaataacatcgaagccgtcaaccaatggaaggagactgtaattaatccggaaaaagtggtcattcggtggcacaagcttaacccctcttag

SEQ ID NO: 24556 - DNA, 1281 bp, Artificial Sequence
  Description of Artificial Sequence: Synthetic coding sequence
atggcaaccgaattcattaaaagctgctgtggtggctgcttctacggagaaacggaaaagcacaacttcagcgtagaaagagactttaaggctgcggtcccaaatagccagaatgctaccatcagcgtgccaccactgacaagcgtgagcgtaaagccacagctggggtgtaccgaagactacttattgtctaaacttccctcggacggcaaggaagtcccattcgtcgttcctaagttcaagctctcgtatatccagccccgtacccaagaaactccctcgcatttggaggagctggagggttctgcaagggcatctttcggggatcggaaggtggaactgtcaagtagctcacagcacggtcccagctacgacgtttacaacccattctatatgtaccaacatatctcaccagatctcagcaggaggtttcccccacggagcgaggtgaaaaggctatatggttccgtgtgtgatttaaggaccaacaaactccctggctcccctggactctctaaaagtatgttcgacctaaccaatagtagccagcgcttcatccagcggcacgacagcctgagcagcgttccgtcgagctcttcatcacgtaaaaacagccagggatccaatcgctccctcgatacaattacactgtcaggggatgaacgagactttggcaggcttaacgtgaagctcttctataactcaagcgtggagcagatatggatcactgtccttcagtgtcgagacctgtcctggccctccagctatggtgatacccccacggtgtcaattaaaggtattttgactctgccaaagcctgtgcactttaaaagcagcgcaaaagagggctccaacgtgtgccacgctgaactggagctgggtacatgtttccaagcggtcaattcacgcattcagctgcagatcctggaggctaggtacctccccagctcttccaccccactgacattatctttttttgtgaaagttggcatgttcagttcaggcgaattgatttacaaaaaaaagacaagactgctgaaagccagtaatggacgagtgaagtggggtgaaactatgattttccctctgatacaatccgaaaaggagatagtgttcttaatcaaattgtactcacgctctagtgtcaggcggaagcatttcgttggccaaatctggattagcgaagattccaataacatcgaggccgtgaatcaatggaaggagaccgtgataaaccccgagaaggtagtgatcaggtggcataaattgaacccttcttag

SEQ ID NO: 24557 - DNA, 1767 bp, Artificial Sequence
  Description of Artificial Sequence: Synthetic coding sequence
atggacctagaggaggctgaagagttcaaagaacgatgtacgcagtgcgcagccgtctcctggggcctgaccgatgaaggaaagtactattgtacttcctgccataacgtcaccgagcgatatcaggaggttacaaatacggatttgatccccaacactcaaataaaagctctaaacagggggctgaagaagaagaataacaccgaaaagggctgggattggtacgtctgtgaggggtttcagtatatcctctaccagcaagctgaagctcttaaaaatcttggcgttggtccagaacttaaaaatgacgtgctacacaacttctggaagagatacctgcagaagtccaagcaggcatattgtaagaacccagtgtatacaaccggacggaagccaacagttctggaggacaatctctctcactccgactgggccagcgaacccgaactgctgagcgacgtgagctgccctccattcctggagagtggggcagaatcacagagcgacatccacaccagaaaaccatttccggtaagcaaggcaagccagtccgaaaccagcgtgtgctctgggagtctcgatggcgtcgagtactcccaaagaaaggaaaagggtatagtcaagatgaccatgccacagactctggcgttttgttacctatcgctgctgtggcaaagggaggccataactctatcagatttgctgcggttcgttgaagaggatcatattccgtacattaacgccttccagcattttcccgagcagatgaaattgtatggccgagataggggcatttttgggattgagagctggcccgactacgaggatatatataaaaagaccgtggaggtgggaaccttcctcgacctcccacggtttcccgacatcaccgaagactgctacctgcaccctaatattttgtgcatgaagtacctgatggaagtcaatctgcccgatgaaatgcattcactgacgtgccacgttgttaagatgactgggatgggagaggtggatttcctgacatttgatcccattgctaagatggctaaaactgtcaagtatgatgtccaagctgtcgcaattattgtggtggtacttaagcttctgtttcttttagatgactctttcgagtggagcctgtccaatttggccgaaaagcataatgagaaaaacaaaaaggacaagccttggttcgactttagaaaatggtaccagatcatgaagaaagcttttgacgagaaaaaacaaaaatgggaggaagccagagctaaatacttgtggaagtcagagaaaccactttattactcctttgttgacaagccggtggcttacaaaaaacgcgagatggtcgtaaacttgcagaagcagttctcaaccttggtggagtcaacagcaaccgccggtaagaagagcccttcgagttttcagttcaattggacagaggaagacaccgacagaacatgctttcacggccactctttgcagggagttcttaaggaaaaagggcagagcctcctcacgaaaaattctctctactggctgagcacccagaagttttgcagatgttactgtacgcacgtcacaacatacgaagaatcaaactactccttgtcttaccagttcatcctcaacttgttcagcttcctgctaagaatcaaaacaagcttgctccacgaagaggtgtccctggttgaaaagaagttattcgagaaaaaatattcggtaaagaggaagaaatccaggtcaaagaaggtccggcgacattag

SEQ ID NO: 24558 - DNA, 1002 bp, Artificial Sequence
  Description of Artificial Sequence: Synthetic coding sequence
atgaaactgtatggtcgggatcgcggaatcttcggaattgaatcctggcccgactacgaggacatttataagaagactgttgaagtgggtacatttctggatctgccaagattccccgatatcacagaggattgctacctccatcctaacattctttgcatgaaatatctgatggaggtgaatctgccggatgagatgcactcgctgacatgtcacgttgtcaagatgaccggtatgggggaagtggactttctcacgttcgatcccatcgctaaaatggcgaagacagtgaaatacgatgtgcaggcagtggctatcatcgtagtcgtgctaaaacttctcttcctcctggacgactcatttgagtggtccctaagcaacctggccgagaaacataatgagaagaataaaaaggacaaaccctggtttgacttcaggaaatggtatcagatcatgaagaaagcattcgatgagaaaaagcaaaagtgggaggaagccagagccaaatacctgtggaagagtgaaaagcccctgtattactcgtttgtcgacaagccagtggcttataaaaagcgggagatggtcgtaaacctgcagaagcaattctctacgctggtggagtcaaccgccactgctggcaagaagagtcctagttcctttcaatttaattggactgaggaggacactgaccgcacatgcttccatggtcactctttgcagggagtgctgaaggagaaaggacagtcacttcttacaaaaaattcactctactggctgtcgactcagaaattctgcagatgttactgtactcacgtgaccacatacgaggagtccaattactccctctcataccagtttatccttaacctatttagctttcttttacgtatcaaaacctccctactccacgaagaggtgagcctggttgagaaaaaactgttcgagaagaagtatagcgtgaagagaaagaagagtaggtccaagaaagtcaggcggcattag

SEQ ID NO: 24559 - DNA, 894 bp, Artificial Sequence
  Description of Artificial Sequence: Synthetic coding sequence
atgagcaggttcaagttcattgacataggcatcaatctgaccgacccaatgtttcgcggtatttaccgtggcgtgcagaaacaccaggacgacctgcaagacgtgatcgggcgtgcggtcgaaatcggggtgaagaaatttatgatcaccgggggtaatctgcaggacagcaaggacgcactgcacctagcccaaactaacggcatgttctttagcaccgttggatgccatcccactcggtgtggtgagtttgagaaaaacaatccggatctgtatctgaaagagcttctaaatttggcagagaacaataaggggaaagtcgtagcaattggagagtgtgggctggattttgacagactacagttctgtcctaaggacacccagctgaagtatttcgagaaacagtttgagctttccgagcagacaaagctgcccatgttcctgcattgtcgtaacagccacgctgagtttctggatattatgaagaggaacagagaccgatgcgtgggcggtgtagtacactcatttgacggcactaaagaagctgccgcagccctcatcgatctagacctgtatattgggttcaacggatgctccctgaaaactgaggccaacctggaggtattgaagtcaattccaagtgagaagctgatgatcgagaccgacgctccatggtgcggcgttaagtcgacacacgcagggtctaagtatatcaggactgcttttccaaccaagaaaaagtgggagagcggtcactgcttaaaagacagaaatgagccctgccatattattcagatcctggagatcatgagcgctgtacgggacgaggacccccttgaactcgcaaacacactctataacaataccataaaggtgtttttccctggaatctag

SEQ ID NO: 24560 - DNA, 753 bp, Artificial Sequence
  Description of Artificial Sequence: Synthetic coding sequence
atgattacaggtggaaacctgcaggattccaaggacgctctgcacctggctcagaccaacggcatgttttttagcaccgtcggatgtcatcccacaaggtgtggcgaattcgaaaaaaacaatccggacctctatcttaaagagctactaaatctggcagaaaataataagggtaaagtggtcgccataggtgaatgcggtttggactttgacaggcttcagttctgccctaaagacacgcagttgaaatattttgagaagcaatttgaactctctgaacagacaaagctcccgatgtttctccactgtcggaactcccatgcagagtttttagacatcatgaagcggaatcgggaccggtgcgttgggggagtggtacattcatttgacgggacaaaagaagcggcagcagctctgatagacctggacctatacattgggtttaatgggtgttccctgaaaaccgaagctaatttggaggtcttgaaatctatcccatccgagaaactaatgatagaaaccgatgccccatggtgcggtgtgaaatctacgcatgcgggatcgaagtatatcaggactgccttccctacgaagaaaaagtgggaaagcgggcactgccttaaggaccgcaatgaaccctgccacattatccaaatcttggagatcatgagcgccgtgcgggatgaggatcctctggaactcgccaacacactgtacaataatacgatcaaggtgttctttccaggaatctag

SEQ ID NO: 24561 - DNA, 333 bp, Artificial Sequence
  Description of Artificial Sequence: Synthetic coding sequence
atgatcaccgggggaaacttgcaggacagtaaggatgcgcttcacctggctcagaccaatgggatgtttttttctactgttggttgccacccgacaagatgtggtgagtttgaaaaaaacaacccagatctctatctgaaagaactgctaaatctggccgaaaataataaaggcaaggtcgtggctattggagagtgcggcctggactttgacagactgcagttctgccccaaagatactcagctgaaatacttcgagaaacagtttgagctgagtgaacaaaccaaactcccgatgtttttgcactgtcgcaactcccacgctgagttctag

SEQ ID NO: 24562 - DNA, 2286 bp, Artificial Sequence
  Description of Artificial Sequence: Synthetic coding sequence
atggcttccgagcggggtaaggtgaaacacaattggtcttccacatctgaaggctgtccacggaaaaggagctgtctgagggaaccttgtgatgtggctccctctagccgccctgcccagaggagcgctagccggagcggcggtcccagcagccccaagaggttgaaggcacaaaaagaagatgatgttgcttgttcccgtcggctgagctggggctccagtcggcgaagaaataacagcagtagttcatttagtcctcacttcctgggtcctggagtagggggagcggcatctaagggctgtttaatccggaacacacgcggtttcctttcctccggcggtagccccctccgtccagcaaatgcttctctggaggagatggcaagcctggaggaggaagcctgctccttgaaggtcgattcaaaggacagcagccataacagtacaaactcagagtttgcagctgaggctgaaggccagaacgacactatcgaggagccaaacaaagtgcaaaaacggaagagagatcgcctgagggatcagggcagcactatgatttacctaaaggcaattcaaggcatcctgggcaagagcatgcccaaacgaaagggagaagcagccaccagggcaaagcccagcgccgctgagcatccctctcacggcgaagggccagcacggagtgaaggcccagccaaaaccgcagaaggagctgccagatccgtcacggtgactgccgcacagaaagagaaggatgctaccccagaagtctccatggaggaagacaagaccgtccctgaacgctctagcttttacgatcgccgagtcgtgatcgacccacaggagaagcccagcgaggagccactcggggaccggagaaccgtgatcgacaaatgctctccgcctctggaattcttagatgatagcgactcgcacctggagatccagaagcacaaagatcgcgaggtggtcatggaacaccccagtagtggcagcgactggtcagatgtggaagaaatcagtacagtcaggttttcgcaagaggagcctgtgagcctgaagccctcagcagtgccagagccttcctcttttacaactgattatgtgatgtatcctccccacctgtacagtagtccctggtgcgactacgcttcctactggactagtagccctaagccctcttcctatccttccaccgggtcctcttctaacgacgccgcacaggtcgggaaaagttccaggtcaagaatgagcgattacagtcccaattcgaccgggagtgtgcagaatacctcacgtgatatggaagcatcagaagaagggtggtcccagaattccagatcctttcggttctcccgttctagcgaagaacgggaggtcaaagagaagcggacgtttcaagaggaaatgccacccaggccatgtggcggtcacgcatcaagcagtctaccaaaatctcacctcgaaccgagtctcgaggaggggttcattgacacccactgtcatctcgacatgctctactctaaattatccttccaaggaaccttcacgaagttcagaaagatctactcaagctccttccctaaggagtttcaaggctgcataagcgatttttgtgaccctcgaaccctcaccgactgcctctgggaggaattactaaaagaggatttagtttggggcgctttcggctgccaccctcattttgcgaggtattactcagagagccaagagcggaacctgttacaggccctgcgccacccaaaagctgtggcgttcggcgagatgggtctggactactcttataagtgtacaacgcccgtgccagagcagcacaaggtgtttgagaggcaactgcagctggctgtgagtctgaaaaaacctctagtgattcactgccgcgaggccgacgaggatctgttggagattatgaaaaagttcgtgccgcctgattataaaatccacaggcattgttttactggctcctaccctgtgattgagcctcttctgaagtactttcccaacatgtctgtggggtttacagcagtgctgacttactcaagcgcatgggaagccagggaggcgctcagacagatccctctggagcgcattatcgtggaaaccgacgccccatattttctccctagacaagtgccaaagtcactgtgtcagtacgcccatccaggtctcgcactgcacaccgtgagggagatcgccagggtgaaagaccaaccactgtccctgaccctcgctgctcttagagagaatacttcacggttgtatagcctctag

SEQ ID NO: 24563 - DNA, 2286 bp, Artificial Sequence
  Description of Artificial Sequence: Synthetic coding sequence
atggcaagcgaacgaggaaaagtgaaacataattggtcctccaccagcgaagggtgcccgagaaagagatcctgtcttcgggaaccctgcgacgtggccccttcatcaaggccagcccagagatccgcgtcaaggagcgggggtccctcgagcccaaagaggctcaaagcacaaaaggaggacgatgtggcatgtagccgtcggctgagttggggaagctcaaggcgacggaataactccagctcctctttttcaccccactttcttgggcctggggtcgggggagctgcatcaaagggctgcctcatccgaaatacacgtggattcctctcaagtggcggatccccgctgagacctgctaatgcgtcacttgaagaaatggcctccttggaggaggaagcatgcagtctgaaggttgattctaaggactcctcccataactctaccaatagtgaattcgcagcagaagctgagggccaaaatgacacaattgaagagccaaacaaggttcagaagcgcaaacgtgaccgcttacgggatcaaggctccaccatgatctatttaaaagcgatacagggaatcctgggcaaatcgatgcccaaacgaaagggtgaagctgccacaagagcaaagcccagtgcagccgaacacccctcccatggagagggtccagctcggagtgaaggaccagctaagacagccgagggcgctgcgaggagcgtgacagtgaccgccgcacagaaagagaaagatgccacgccagaagtgagtatggaggaggacaagacggttcccgagcgcagttctttctatgaccggagagtggtgatagaccctcaggaaaaaccgtccgaggaacccctgggtgatcggagaactgtaattgacaagtgcagcccgcctctagagttcctggatgatagtgactcacacctggaaatccagaagcacaaggatagagaagtcgtcatggagcatccatctagcggcagcgactggagcgacgtggaggagattagtactgtgagattttcccaggaggaaccagtgagtctcaagccttcggcggtcccagagcctagctcattcaccaccgactacgtcatgtacccaccacatctctactccagtccctggtgcgattacgctagctattggaccagctccccaaagccttcctcttacccaagcacaggaagttcttccaacgatgccgcacaggttggcaaaagttcccgctctagaatgagtgactatagccctaacagcactggatccgtgcagaatacctctagagatatggaggccagcgaagaagggtggagtcagaactcacggtctttccgcttttcccggtcgtctgaggagcgcgaggtcaaggagaagagaacctttcaggaagaaatgccacctagaccgtgcggagggcatgcatcttcatctctcccaaagtcccaccttgagcctagtctcgaggaagggtttatcgatacccattgccatctggacatgctatacagtaaattgagtttccaggggaccttcacgaaatttcggaagatctactcctctagcttcccaaaagaattccaagggtgcatctcagatttctgtgatcctcgtaccctgacagattgcctgtgggaagaattgctgaaggaggacttggtttggggtgcatttggatgtcatccgcattttgcgcgttattactcggagtcccaagaacggaatttactgcaggccctccgacatccaaaagccgtggcctttggcgaaatgggattagattattcctacaagtgtactacccccgtgcccgagcaacacaaggtcttcgagcgccaactacagctagctgtctcgctgaagaagccgctcgttattcattgcagagaggcagacgaggacctgctagagattatgaaaaagtttgtgcctcctgattataaaattcaccgccattgctttacagggtcctatcccgttattgagcctctgctgaaatatttcccaaatatgagtgttggttttaccgcggttctcacgtacagcagcgcttgggaagctcgtgaggccttgcgacaaataccgttagaaagaatcatcgtggaaacggacgcaccgtacttcctgccaaggcaggtacctaaaagcctttgccagtacgcacaccccggactggcgttacacaccgtccgtgagatcgctagagtaaaggatcaacccctctctctgacattagccgctctaagggagaatacttcccggctttatagtttatag

SEQ ID NO: 24564 - DNA, 822 bp, Artificial Sequence
  Description of Artificial Sequence: Synthetic coding sequence
atgcgggctgctggcgtcggcctggtagactgtcactgccacttgtccgcgcctgatttcgaccgggatcttgatgacgtactggagaaagccaaaaaggcgaatgtggtcgccctcgtggcggtcgcagagcattccggcgagttcgaaaagatcatgcagctgagtgagagatataatggcttcgtgctgccttgtttgggcgtacatcccgtgcaaggcctgccgccagaggaccagcgcagtgtcaccctcaaagacctcgatgtggctcttccaattattgagaactataaggacaggctgctggcgatcggcgaggtggggctggatttttctcctagatttgcagggactggtgaacagaaagaggagcagaggcaggtgcttattagacaaatacagttagcaaaaagattgaacttgccggtgaatgtacatagtcgctccgccggacgtcctacaattaacctcctacaggagcagggggctgagaaggtgctgctgcacgccttcgatggccgaccctcagtggccatggaaggcgtgcgcgcaggatactttttctcaatccccccttcaattatacgctctggccagcaaaaattggtcaagcaactgcccctcacatctatctgccttgaaaccgactctcccgctttaggaccggaaaagcaggttcgaaacgagccttggaatataagcattagtgccgagtatatcgcccaggtgaaaggtatttccgtggaagaagtgattgaagtaactacccagaacgctctgaagttgttccctaagctgcgtcatctgctgcagaaatag

SEQ ID NO: 24565 - DNA, 825 bp, Artificial Sequence
  Description of Artificial Sequence: Synthetic coding sequence
atgcgggcagccggagttgggctcgtggactgccactgtcacctctcagccccagattttgatcgagacctcgatgacgtattagagaaagccaagaaagcgaacgtggtagcattagtggctgtggcggagcattccggtgaatttgagaagattatgcaactttcagaaagatacaacgggttcgtgctgccctgtctcggagttcaccctgtgcaaggccttcccccagaggatcagagaagcgtaaccctgaaggatttagacgtggctctgcccataattgaaaactacaaagaccggttactcgccatcggggaagtgggtcttgacttcagccccaggtttgctggaactggggagcagaaggaagaacaaagacaggtcctcatccggcagattcagctcgccaagaggttaaacttgcccgtcaacgtgcactcacgaagcgccggacggccaacaattaatcttctgcaagaacagggggcagagaaagttctcttgcatgccttcgatggccgtcccagtgtggcaatggagggggttcgggctggatactttttctccattccaccctccattattaggtccggccaaaaacagaagcttgtgaaacaacttccactcacatccatttgcctggaaaccgactcccccgcacttggccctgagaaacaggttcgcaatgaaccatggaatatcagtatatctgcagaatatatcgctcaagtgaagggcatcagcgttgaggaagtgatcgaagtcacgacccaaaacgcattgaagctcttcccgaagctgcggcacctccttcagaagtag

SEQ ID NO: 24566 - DNA, 762 bp, Artificial Sequence
  Description of Artificial Sequence: Synthetic coding sequence
atgcgcgctgccggagttgggctggtcgactgccactgccacctcagtgctcccgactttgatcgtgatttagatgatgtcctcgagaaagcgaaaaaagcaaatgtcgtcgcccttgtggcggtggccgagcatagtggtgagtttgagaagataatgcagctgagcgagcgctataatggattcgtcttaccctgcctcggcgtccatccagtgcagggcttgcctcctgaagatcagcggagcgtgacccttaaggtggggctggatttctctcccaggtttgccggtactggcgaacagaaagaggaacagcggcaggtgcttattagacagatccaactagctaagagattaaatcttccagtgaatgtccactccagatccgccggtcgccctaccattaatctgttgcaggaacagggcgcagagaaagtgcttttgcatgcattcgacggtcgtccatctgtagcgatggagggcgtccgcgctggatactttttttccatccctccatctatcattaggtctgggcaaaagcagaaactggtcaagcagctgcccctgacatctatttgtttagagaccgattcacccgctttggggccagagaagcaggttcgcaacgaaccatggaacatcagtatatccgccgaatacatcgcccaggtgaagggcataagcgtggaagaagtgatcgaggttactactcagaatgctcttaagttgtttccaaaactgaggcacctattgcagaagtag

SEQ ID NO: 24567 - DNA, 723 bp, Artificial Sequence
  Description of Artificial Sequence: Synthetic coding sequence
atgcgcgctgcgggtgtgggcctcgttgattgccactgccacctgtctgctccggattttgatcgcgatcttgatgacgtcctggagaaagccaagaaggccaatgtggtggcactggtcgccgtggccgagcatagcggcgagttcgagaagattatgcagttatccgaaagatacaatggcttcgtcttgccttgcctgggcgtgcatcccgtgcagggactccctcccgaagatcagcggtctgtgacacttaaggatctcgatgtggccttacccatcattgaaaattataaagatagattactggcgatcggtgaggtgggccttgactttagtccccgattcgccggtacaggcgaacagaaagaggagcagcgtcaggtgcttatacgccaaatccaactggcaaagcggcttaacctgcctgtcaatgtacattctagaagtgccggacgcccaaccatcaatctcttacaggagcagggagctgagaaagtcctcctgcatgcatttgatggacgtcccagtgtcgccatggagggggtgagagcaggctacttcttttccattcccccttctataatccgaagtggacagctgctgagtctcttctccaaaaaacaaaagctcgtaaaacaacttcctttgacctcgatttgtctcgaaactgacagccctgcacttgggcctgagaagcaacagaacatcctcccgcgatag

SEQ ID NO: 24568 - DNA, 846 bp, Artificial Sequence
  Description of Artificial Sequence: Synthetic coding sequence
atgcgcgcagcaggcgtgggcctggtggattgtcactgccatttgtccgctcccgatttcgatcgggatctcgatgatgtgctggagaaggccaagaaagcaaacgtagtggcattggtggcggttgctgagcattccggagagtttgagaagatcatgcagctgagcgagcgctacaatggctttgtcctgccatgcctgggcgtgcaccctgtccagggacttcccccagaagaccagcggagtgtgactctgaaagatctggatgtggccctgccgatcatagaaaactacaaagacagactgctggctatcggggaggtggggctcgatttttctccacgcttcgctggaaccggggagcaaaaggaggaacagcgacaggtcctgattaggcagatccagctcgcgaagaggctcaatttgcctgtcaacgtacactctaggtctgctgggaggccgacaattaacctcttacaggaacagggcgcagagaaagtgttactgcatgccttcgatgggcgaccttcagtggctatggagggagtcagagcaggatacttcttttccataccaccttccatcataagatcaggccagttgctctccctattcagcaagaaacagaagttggtaaagcagctccccttgaccagcatctgcctcgaaacggatagtccagccctaggacccgagaaacaggttcgaaacgagccatggaatatctctatctcggcagaatatatagctcaggtgaagggtatctcagtcgaggaagtcattgaggtgaccactcaaaatgctctgaaattgtttcccaagctgagacatcttcttcagaaatag

SEQ ID NO: 24569 - DNA, 1824 bp, Artificial Sequence
  Description of Artificial Sequence: Synthetic coding sequence
atggccgaaaaacggaggggtagtccctgctctatgctgtcactcaaagcacatgctttttctgtggaagctctgatcggagccgagaagcagcagcagctgcagaaaaagcgacgaaaactaggtgcggaggaggccgcaggcgctgtggacgatggtggctgttcaagaggtggaggagcaggtgaaaagggttcttctgagggagatgagggtgccgcacttcctcctcctgcaggcgcaacgtctgggcctgccagaagtggggcagatttggaacggggtgcggcagggggatgcgaggacggcttccagcagggggcttctcctctggcctctcccggaggaagccccaagggcagccccgcaaggagtctggcacgcccaggcacacccctgccttctccgcaggccccaagggtcgatctgcagggggctgagctttggaagcggttccacgaaatcgggactgaaatgatcatcacaaaggccggtcggcgaatgttccccgcaatgagggttaaaatttctggattagaccctcatcagcagtattacattgcaatggatattgtgcccgttgacaacaagaggtatagatatgtgtatcatagtagcaagtggatggtggcaggaaatgccgattctccagtgcctcccagggtctatatccatcctgatagtccagcttcgggagaaacgtggatgcgccaggtgatctcattcgacaaattgaaactgaccaacaacgagctggacgaccaagggcacatcatcctccacagtatgcacaaatatcagccacgagtgcacgtgattcgcaaggattgtggtgatgacttgtctcccataaagcccgtgccatcaggcgagggcgtcaaagcatttagcttccccgaaacagtctttactaccgtgacagcgtaccagaaccagcaaatcacaaggctgaaaattgaccggaaccctttcgccaaggggttccgggactctgggcgtaacagaatgggactggaggctttggttgagtcctatgccttctggcggccaagtctgagaaccctaacatttgaggacattccaggtatacctaagcagggaaacgccagctcgagcactctgttgcaggggaccggcaatggcgtaccagccacccacccacacctgctgtcaggttctagctgttctagcccagccttccatctggggcctaacacatcgcagctgtgttctctggctcccgcagactactcagcatgtgccaggtctggcctgacgcttaatcgttactctactagccttgcagagacttataatcgcctgactaatcaggcaggagagactttcgcccctccccgaacaccctcatacgtcggagttagttcaagcactagcgtcaacatgtcaatgggtggtaccgatggcgatactttcagctgtccccagacaagcctgtcgatgcagatcagcggaatgagccctcagttgcagtatatcatgccttccccctcctcaaacgctttcgccactaatcagacccaccaaggatcttataacaccttcaggttgcactccccttgcgccttgtacggctataacttttctacttctcctaagctggctgcatccccggagaaaattgtgtcctctcagggaagcttcctggggagtagccccagtggaacaatgaccgacaggcagatgttgccaccagttgagggggtacatctgctgtcctcaggtggtcagcagagcttcttcgattcccgaactctcggtagcctgacactgtcttcaagtcaagtgagcgcacatatggtgtag

SEQ ID NO: 24570 - DNA, 918 bp, Artificial Sequence
  Description of Artificial Sequence: Synthetic coding sequence
cggggacggcacatatggaagctgggattcccaaaaggcggttgcgaggacgggtttcaacaaggggcttccccattagcatcgcccggtggcagtccaaaagggtctccagctagaagccttgcgcgacccggaacacctctcccaagcccccaagcccctcgggtcgatctgcagggggcagagctgtggaaaaggttccacgagatcggtaccgaaatgattatcaccaaggccggacggcgtatgttccccgctatgcgagtgaagatctctggcctcgatccgcaccaacaatactatatcgccatggacattgtcccagtcgataataaaaggtaccgatatgtgtaccactcttccaaatggatggttgccggaaacgctgattccccagtgccgcctcgagtgtacatccacccagattccccagctagtggggagacttggatgcggcaggttatcagtttcgacaaactcaagctgacgaacaacgagctcgacgatcagggacatataattctgcattccatgcacaaatatcagccacgagtgcacgtcataaggaaagactgtggcgacgatctgtcgcccattaagccagttccctctggagagggcgttaaagcattcagtttccctgagacagtcttcacaacggttaccgcatatcagaatcaacagatcaccagactgaaaattgacaggaacccctttgcaaagggctttagggactcaggtcggaaccgaatgggtctagaggcattagtggagagttatgccttctggagaccatctctgcgcacccttacatttgaggacatccctgggatccccaagcaggagtatcgggatctcaaaactgactatatttttcctgaaagggataatctggtgtctcgcgaaactaaactatag

SEQ ID NO: 24571 - DNA, 2049 bp, Artificial Sequence
  Description of Artificial Sequence: Synthetic coding sequence
atgcagctcgaacattgcctgagcccaagtattatgctgagcaaaaagttccttaacgtctcgtctagttacccacacagtggtggctctgagctagtgctgcacgatcatcctattatcagcacgacagataatctggagcgtagctcgccccttaagaagatcacccggggaatgactaatcagtctgatactgataattttccagacagcaaagatagccccggagatgtacaacggtctaaactgtcaccagtgctcgatggcgtcagtgaattgcggcactcttttgacggcagtgccgcagatcgctacctgctgagtcagtcatcccagccacagagcgctgccaccgcgccttccgctatgtttccctatccaggtcaacatggaccagcacacccagctttctcaatcggcagcccttcacgctatatggctcatcatcccgttatcaccaatggcgcttacaactcgctgctgagtaacagcagtccacagggctatcccactgcaggctacccttacccccaacagtatggacacagttaccagggagcccctttctatcagttctcaagtacacagcccggtctcgttcctgggaaagcacaagtgtacctttgcaacagacccctatggctgaagttccacagacaccagaccgagatgatcattacaaagcaaggaagacggatgttccctttcctaagctttaatatatccggcctagatcccaccgctcattataacatctttgtggatgtaatcctcgccgatcctaatcactggcgttttcagggcggaaagtgggtgccctgcggtaaggcagataccaacgtgcagggcaaccgagtctacatgcatccggattctcccaatacgggggctcactggatgaggcaggagattagctttggaaaattaaagctgacaaataataagggggcatccaacaataatgggcagatggtcgtgctccagtctttgcacaagtaccaaccacggttgcacgtggtggaagtcaatgaagacggaacggaggatacctcccagcctggacgcgtgcagacatttaccttccccgagacacagttcattgctgttactgcctaccagaatactgacataacacagctgaagatcgaccacaacccattcgctaaaggatttagggacaattatgacaccatatatactggatgtgatatggatcggctgacaccatcccccaatgactcgccgagaagccagatcgtgcccggtgctcggtatgctatggctggttcctttctccaggatcagtttgtaagcaattacgctaaagctcgattccacccaggggctggagccggacccggtcccggtactgatagatctgtcccccacaccaatggtctgctctcacctcagcaagccgaagacccaggcgcaccctcacctcagaggtggtttgtgaccccagcaaataaccgcctcgacttcgcagcttcagcatacgatacggctaccgacttcgcgggaaacgccgctacattacttagctacgccgcagccggagtgaaggctttacccctgcaagctgcaggctgcaccgggcgaccactggggtactacgccgatccgtcggggtggggggcacgttcccccccacagtattgtgggaccaagagcggaagcgtactgccctgctggccaaacagcgcagcggcagcagctcgaatggcaggcgcaaacccttacttaggcgaggaagcagagggactggctgccgaacggtcacctctgccacctggtgctgcggaagacgccaagcctaaggacttgtctgattcgtcctggattgagactcctagctcaatcaagagcatcgatagcagcgatagcggaatttatgaacaggctaagcgtaggagaatctcgcccgcagatacccctgtcagtgagtcaagctcacccctgaaatccgaggtcctcgctcaaagggactgcgaaaagaactgtgctaaggacatctctggctactatgggttctattcgcacagctag

SEQ ID NO: 24572 - DNA, 1188 bp, Artificial Sequence
  Description of Artificial Sequence: Synthetic coding sequence
atgcaccccgattcacccaacaccggggctcattggatgaggcaggaaattagttttggcaagttgaaattaaccaataacaaaggggctagcaacaataacggacagatggtggtgctacagtcactgcacaaataccaacctcgcttgcacgttgtcgaggtgaatgaggatgggaccgaggacacctcccagcctggacgggtgcagacctttacttttcccgagacgcagttcattgccgtcacagcctaccagaacacggatattacacagctcaaaattgaccacaacccatttgccaaaggatttcgggacaactatgataccatttacactggttgtgacatggaccgcctgacaccttctcccaatgactcccctaggtctcagatcgtgcccggagctagatatgcgatggccggaagcttcctgcaggatcaattcgtctccaattatgccaaagcacgatttcatccaggggctggcgctggtcccggaccaggcaccgaccgatctgtgccccacaccaatggtctgctgagtccgcagcaagctgaagatccaggagcaccaagcccccagagatggttcgtcacaccggctaacaacaggcttgatttcgccgcttccgcctacgacacagctactgatttcgcaggcaacgccgcaacacttctctcctatgccgcagcaggggttaaagcactcccactgcaagctgctggttgcactggtagacccctggggtactatgctgacccgtccgggtggggcgctcgatccccaccacagtactgcggaactaagagcggttccgtgctgccgtgctggcctaacagtgccgctgcagcagcaagaatggcaggcgcaaacccctaccttggcgaggaggccgagggtttagcggctgagcgctcccctcttccacccggagctgcggaagacgcaaagccaaaggacttgtccgactccagctggattgaaactccatcaagcattaagtctattgactcgagtgattcgggcatctatgaacaggctaagagacggaggatttctccggctgacacacccgtctccgagtccagctcccctctcaaaagcgaagtactggcgcagcgcgactgcgaaaaaaattgtgccaaagacataagcgggtactacggcttttattcacactcctag

SEQ ID NO: 24573 - DNA, 1056 bp, Artificial Sequence
  Description of Artificial Sequence: Synthetic coding sequence
atgcaccccgattcccccaacaccggcgctcattggatgcggcaagagatatccttcggcaagctgaaactcaccaataacaagggggcttccaacaataatggtcagatggtggtccttcagtctctgcacaagtaccagccccgtttacacgtggttgaagtgaacgaggatgggacagaagacacatcgcagccaggcagagtccagactttcacattccctgaaactcagttcattgcagtgacagcttaccagaataccgacataacccagcttaagatagaccataacccttttgctaagggtttccgagataactacgatactatatatacgggttgtgatatggatcgggcaggtcccggtcctggaactgacagatcagtcccccacaccaacggcttgctgagtccgcagcaggcagaggatcctggcgcaccctcccctcagagatggttcgttacgcctgccaacaacagactggactttgccgcttccgcctacgacactgccaccgatttcgcaggcaacgccgctactctattgagctatgccgctgcgggtgtgaaagcattacctttacaggccgctggatgcaccggtcgacctcttggatattatgccgatccatctgggtggggcgcacggtcacctccacaatactgtgggacgaagtccgggtctgttttgccatgttggcccaacagcgctgctgcggcagcaaggatggccggagccaatccatacttgggagaagaggctgaaggactggcagctgagaggagccccttacctcctggagccgctgaagacgccaaaccaaaggacctcagtgacagctcctggatagaaactccgtccagcatcaaaagcatcgacagctccgattccggaatctacgagcaggcaaagaggcgcaggatctcccctgctgacactccagtgtctgagtctagctcacctctgaaatcggaggttctggctcaacgagactgcgagaagaattgtgcaaaggacataagcggctattatggattctacagtcacagttag

SEQ ID NO: 24574 - DNA, 2739 bp, Artificial Sequence
  Description of Artificial Sequence: Synthetic coding sequence
atgtcactgccgatcggatccgcggaggtcgccagcgagcgagttgaactgtggcgctccggattccggtggtggcagcggtgtctctgtttttgcaggtaccgcagggtggccatggctgccgtagattctgatgtggagagcctccctcgtggtggatttcggtgttgtttatgccatgtgacaacagcaaatagacccagccttgacgcccacctcgggggacgcaagcacaggcacctagtggaactcagagctgctcgaaaagcccagggcctaaggtctgtctttgtgtctggtttccctagagacgtcgactcagctcagttgtccgaatactttcttgccttcggacccgttgcaagcgtggtgatggataaggataaaggagtgtttgccattgtagagatgggcgatgttggcgcacgcgaggccgtgctgagtcaatctcaacacagccttggcggtcatcggcttcgcgtgagaccaagggaacagaaggagtttcaaagtcccgcttctaaatccccaaagggcgctgccccagattcccaccagctggcaaaagcactagctgaggccgctgatgtgggagcgcagatgataaagctggtggggttaagggaacttagtgaggctgaacggcaattgaggtccttagtggtagcccttatgcaggaagtgttcacggaattttttcccggttgcgtggtgcatccattcggctcatccattaatagctttgacgtccacgggtgcgacctcgatctgttcctcgatctgggagacctggaggagccacaacccgtgccaaaggcacccgagagccccagcctggattcggcactagccagtcctctggatccacaggcactggcatgtacacccgcatctcctcctgattctcagccgcctgcttcccctcaggatagcgaagccctcgacttcgagaccccctcatccagtttggcccctcaaacccccgactctgcacttgctagcgaaaccctcgcctctccgcagtcactgccccctgcttcccccctccttgaggacagggaggaaggagacctcggtaaagcatcggagttagccgagacccccaaggaagagaaagctgagggggcagcgatgctggaactggtcgggtctatcctgcgcggttgcgtccccggagtgtacagggtgcaaactgtgccatcggcccgacggccagtggtgaagttctgccaccgaccatcagggttgcatggcgacgtttcactgtcaaatcggcttgcacttcacaacagccgtttcctatccctatgctccgaacttgatgggcgagtgaggcccctggtgtataccttaagatgctgggcccagggccgaggtctgtcgggaagcggaccactcctgtccaattatgcgctgacattgcttgttatctatttcctgcagaccagggatccgccagtcttgcccactgtgtcccagcttacccagaaagccggagaaggtgaacaggtggaggtcgacggctgggattgctcctttccaagggatgctagccgcctcgagcccagtatcaatgttgaacccttgtccagcctgctggcacagttcttctcctgcgtatcatgttgggatctgagaggctcacttctgtcattgagagagggccaggctctgccagtcgccggtggactgcccagcaatctgtgggaaggcttgcgactaggtcctctgaatcttcaagatccatttgacttgtcgcataacgtggctgccaacgtgacttcaagggtcgcaggacgactgcagaactgttgtagggctgcggctaattattgtaggtccctgcagtatcagcgcagatcctctaggggacgagattggggcctcctgccattgttgcagcccagttctccaagtagcttattaagtgctacacctattcccttgccactggccccatttacccaattgacagcggcactcgtacaagtgttcagagaggcactgggctgtcatatcgaacaagctacaaaaaggacccgatctgaaggaggaggtaccggcgaaagttcacagggtggcacctctaagcggcttaaggtagatggccagaagaattgctgcgaggagggcaaagaggaacagcagggctgcgccggtgatggtggcgaagacagggtcgaggagatggtgattgaggtcggcgagatggtccaagactgggccatgcagtccccgggacagcctggcgacttacccctgacaactggaaaacacggggcacctggagaggaaggacaaccatcccatgcagcgctggcagaaagggggccaaaaggccatgaagcggctcaggaatggtctcagggcgaggccggaaagggcgcaagcctgcctagcagcgcgagttggagatgtgccctgtggcacagggtttggcaagggcgtcggagagcgcgacgaagactgcagcaacaaactaaggaaggggcaggagggggagccggaacacgagctggatggctggccacagaggcacaggtcacacaagaactgaaggggctgtctggtggtgaggagagacctgaaactgagcctctgctgtcgttcgtggcgtcagtgtccccagcggaccgcatgctgaccgtcacaccacttcaggaccctcagggattattccctgatctgcaccactttctccaggtattcctgccacaggcaatccggcacctcaagtag

SEQ ID NO: 24575 - DNA, 2625 bp, Artificial Sequence
  Description of Artificial Sequence: Synthetic coding sequence
atggcggctgtcgacagtgatgtggagagccttcctagaggtgggtttcggtgttgtctatgccacgttactacggcaaaccggccttccttggacgcccacttgggcggaagaaaacatcggcacttggttgaattgcgggctgccaggaaagcgcaggggttgcgctcagtctttgtaagtggcttccccagggacgtggacagtgctcagctctccgagtattttctggcttttggaccagttgcgtctgtggtaatggacaaagacaagggggtgtttgccattgtggagatgggtgacgtgggcgcaagggaggccgtcttgtcccagagccagcattctctaggagggcataggcttcgcgtccggcctagagaacagaaggagttccagagtcctgctagcaaaagcccaaagggtgccgcacctgattcgcaccagctggccaaggcattagccgaggcagccgacgttggggcacagatgattaaacttgtagggctccgcgagctctcagaagctgagaggcagctgaggtcccttgtggtagcgttgatgcaagaggtgttcactgaattctttcccggatgtgtggtgcacccttttgggtcatccatcaactccttcgatgtgcacgggtgtgatctggacctctttcttgatctcggtgatctcgaggaacctcaacctgtcccaaaagctcccgaaagcccctccttagactcagccctggcatccccactagacccacaggctctggcatgcacccccgctagcccaccagacagccagcctccagccagcccccaggacagcgaggctctcgacttcgagaccccaagctcgtctttggcaccacagactccagatagcgccttggcctcagagaccctcgcatctccgcaatctttaccacccgcttcccctttgctcgaggatcgggaggagggcgatctgggcaaggcctctgagctggccgagacccctaaagaagagaaagctgaaggtgctgcaatgctcgagctagtagggtctatcttgaggggctgcgtgcccggagtataccgcgtgcaaacagtgcctagtgctaggagacccgtggtaaagttttgtcacagacctagtggcttacacggggacgttagtctttcaaataggctggcactacacaactctcggttcctaagcctttgcagtgagctcgacggacgtgtgagacctctggtctacacattaaggtgctgggcacaaggtaggggcttgtccgggagtggtccccttctttccaattacgccttgactctactagtgatttacttcttacaaactcgagatcctcctgtcctccccacagtctcacagctcacacagaaagccggagaaggagagcaagtcgaagtagacgggtgggactgctctttcccaagagacgcctcaagacttgaacctagtattaatgttgagcctctgtcgagtctacttgctcagtttttttcttgtgtaagctgctgggacctcagagggtcccttctcagtcttagggaaggacaggcactgcctgtggctggcggactaccctctaacctctgggaggggcttagactgggacccctaaacttgcaggatcccttcgacctctcccacaatgtcgcggcaaatgttacaagcagggtcgccggaaggctgcaaaactgttgtagggcagctgctaactattgcagaagccttcagtaccagagacgtagcagtagggggagagattggggcctgctgcctctgcttcagcccagctccccatcaagtttgctctcggcaacccctatccccctaccgttagcaccatttacgcagctgactgcagcgttagtgcaagtgttccgtgaggccctaggttgtcacatcgagcaggcaacaaagagaactcggtccgagggtggcggtacaggagagtcctcccagggtggtacttcaaagaggctcaaagtagatggacagaaaaactgttgcgaagagggtaaggaagaacagcagggatgtgcaggcgatggtggagaggacagggtggaggagatggttattgaggtcggggaaatggtacaagactgggcaatgcagagccctgggcagcccggtgatttgccactgacaacgggcaaacacggtgcacctggagaggaggggcagccatctcatgctgctttggcagaacgcggaccaaagggccatgaagcggcacaggaatggtcccagggggaggctggcaagggcgctagtctcccaagcagcgcaagttggcgatgcgcgttgtggcatcgtgtgtggcagggcagaagacgagcacggaggcgtctccagcagcagaccaaagagggagccggagggggtgcaggcacacgcgctgggtggctggccacagaggcccaggtcacccaggagctgaaaggactgagtgggggtgaagaaagacctgaaacagaacctctcctatccttcgttgccagtgttagcccagctgaccgcatgctgaccgtgacccccttgcaagatccacagggcctttttcccgacctgcatcactttctgcaggtgtttctcccacaggccatccgtcacctgaaatag

SEQ ID NO: 24576 - DNA, 495 bp, Artificial Sequence
  Description of Artificial Sequence: Synthetic coding sequence
atgtgtccgccagtctccatgcgatatgaagaggaagggatgtcgtacctgtacgcttcttggatgtaccagctccaacatggcgatcagctgagtatttgtttcacttgtttcaaagccgcatttctagatttcaaagatctgctggagagcgaggactgggaggaagacaactgggacccagagctgatggaacacacagaggcagagtcggaacaggaagggagcagcggcatggagttatcctggggccagagccctggacagcccgtgcagggaggctctgaggcatgggggcctggaaccctagctgccgcacctgagggactggaggatgccggacttgatccccacttcgtgcccacggagctttggccccaggaagccgtgcctctcggcctcggcttagaagatgcagactggacacaagggctgccgtggagatttgaggaattgctgacttgctcccactggccgagttttttcccatcatag

SEQ ID NO: 24577 - DNA, 1236 bp, Artificial Sequence
  Description of Artificial Sequence: Synthetic coding sequence
atgctgagtctacgggagcagcagttacaagtgtggttcaagaatcgacgggcaaagctggctcgggagcggagattacaacagcagccacaacgtgtgcctggacagcggggtcgtggcgctagggccgcacccctagttcccgctgcaagcgcctcggctccccagaggggaccctctggcatactgcctgctgctgagcctactatctgttctctgcaccaagcatggggcggacctggatgtcgcgcacagaaagggatcccagctgcattgagtcctggaccaggacccatccccgctcctataccaggcccagcccagattccaggacccctccctggcagtattcctggtcccattcctgggcctgctcaaattccatcccctattcctgcaccaatccccggtcctatctctggccctgtccagatacctggtccctttaggggacccattcctggacctatcagcggccctgcacctattccaggcccaatttctggacctttctctggacctaatccagggccaatcccgggaccgaatcctggccctatccccggacccataagtggcccaattccgggacctatttctgtgccaatacccggaccaattccaggccctatcagcggaccaataagtgggccaaatcctggcccaatacctggaccgattcccggaccgatcagcgggccaaacccagggcctataccaggacccatcagcgggccaaatcccggactgattcccggtccgatcccaggcccaatcagcggccctggacccattataggccctatcccctcccctgcacaaatccctgggccaggtcgcttgcagggcccaggacccatcctttcaccaggaaggatgcgctctccaggctcacttccagggctcgcccctattcttggccctggtagcggtcccggaagcggatctgttccagctccaatcccaggccctggatctttgccggcacccgctccactctggccccagtcaccggacgcaagcgactttttgccagacacccagctttttcctcatttcactgaacttctgcttccactggatcccttagagggctcttccgtgtctaccatgacctcccagtatcaggaaggcgatgatagcatgggtaagaagcactccgggtcccagccccaggaagagggcggaagcgtgaacgaaaaccactcaggaccgcgattgctgctggacctgtag

SEQ ID NO: 24578 - DNA, 1527 bp, Artificial Sequence
  Description of Artificial Sequence: Synthetic coding sequence
atggacgaagcaggcaatcaccactccgagcaaactataacgagaactgaaaatcagaccccgcacgccctcgcccatcggagaatgggaccatgtttatcatgctcacagttatattcccagtacctggggcttagccagacacactcatctccaccattggctcttgatccgccacgccgacagcgtcaggaaaggaccgtgtacacagaatcccagcaaaaagtcctggaattttactttcagaaggaccagtaccctaactatgatcaacgcctgaatcttgccgaaatgctgtcactgcgggagcaacaactccaggtgtggttcaaaaaccggcgagctaaacttgccagagagcgtcggcttcaacagcagccgcaaagagtacccggacagaggggcagaggggctcgggctgccccactggttccagcagcctccgcctccgcgcctcagcgtggcccttccggcatccttcccgcagccgaaccgacgatttgttccctgcaccaggcctggggcggaccaggctgccgtgcacagaaggggatccctgccgcactctcaccagggcctggaccaattccagcacctatcccaggcccagctcagatccctggccctctgcctggaagcatacccggacctataccgggacccgctcagatcccgtccccaatccccgcaccgatcccaggcccaatttccggcccagttcagatccctgggccttttagaggccctatccctgggcctatctcaggcccagcgccaataccaggaccaataagcggccctttttccggccctaatccaggccctattcccggtcccaacccgggacctattccaggccctatttccggccctattcccggtcccattagcgtaccaatccctgggcctatccctggcccaatcagtggccctatcagtggacctaaccctgggcctatccctggacctatccccggtccaatttccggccctaatccaggcccaattcccggtcccatcagcggaccgaacccgggtctgatacccggacctatccctgggccaatttcaggacctggtcctataatagggcctattccctccccagcgcagattcccggaccgggtcgtcttcagggccctggaccaattctgagcccagggagaatgcgcagtcctggctctctgcccggtctcgcccctatactgggccctggaagtggtccagggtccggttctgttccagcccctataccaggacccggttccctgcctgcacccgctcccctctggccgcagtcaccagacgccagcgacttcctgcctgacacccaattattccctcatttcaccgagctgctgctccctctggaccctctcgaggggtcttctgtgtctaccatgacctctcagtatcaagagggagacgatagcatggggaaaaaacatagcggctctcaacctcaggaagaaggcggtagcgtgaacgagaatcattctgggcctcgtttgctgctagacctgtag

SEQ ID NO: 24579 - DNA, 1206 bp, Artificial Sequence
  Description of Artificial Sequence: Synthetic coding sequence
atgctgagtcttcgcgaacagcagcttcaagtgtggttcaagaatcggagagccaagctggcacgggaaaggaggttacagcagcagcctcagcgcgtccctgggcagcgtggaaggggggctagagccgctccactggtccctgccgcatcggctagcgcccctcagcgcggtccttcagggatcctgcctgcagcagaaccaactatctgtagtctccaccaagcgtggggtggccctggatgccgcgcacagaaaggtatccctgctgctctgtctccaggaccgggtccaattcccgctcccatcccaggacccgctcaaattcccggacctttgccagggtcaatcccaggcccaatcccaggccctgcccagatcccaagtcccatcccggctcctatccctggtccaatctctggcccagtccagattccgggaccatttcgtggacctattcccggaccaatctccggaccgttttcgggccctaaccccggaccaataccaggtcccaatcctggtcccatccctggacctatcagcggccctatccctggacccatcagtgttcctatacccggtccaatccctggaccaatttccggtcccatttccggcccaaacccagggccaatccccggacccattccgggacctatctctggtcccaaccctggcccaatccccggacccattagtgggccaaacccaggactgatacctggacctatcccagggccaatcagtggccctggacctatcatcggtccaataccgtctccggcacagataccgggaccgggaaggctccagggaccagggcctattctgtcacctggtcggatgagaagcccgggtagcctgcccggtttggcccctattctcggccctgggagcggcccaggttccggttccgtgccggcacctattccaggccctggctccctgcctgcacccgcaccactatggcctcagtccccggacgcaagcgatttcctgccagatacgcagctgtttccgcacttcactgagctgctccttccgcttgaccctcttgagggaagctctgtgtccaccatgacaagccagtaccaggaaggagacgattctatgggtaaaaaacattctggaagtcagcctcaagaggaaggcggatctgtgaacgaaaatcactccggacctcggctcctcctagacttatag

SEQ ID NO: 24580 - DNA, 1206 bp, Artificial Sequence
  Description of Artificial Sequence: Synthetic coding sequence
atggtgctggctcagtctcgcgtgtccgccggagtcggaagtccacactgttctgggtcgggcggaggtggttcggattcattcccatggccagctagccaccctggcaacccccagtgctcattcagtacggcattcctggctagcccaaggctcagcaggggtaccttggcgtacctgcctcctgccccttggagcagcttagcaacacccagcgctcttctaggttcttcttgtgcgccacctcccccacctgcacgttgtccacagccgagggccctgagccccgagctcggaaccaaagcgggtccacgacgtccgcacagatgggagctcccgaggtccccttcacagggagcacagggaccggcaccgagacgtcgccttcttgagacgatgaagggcatcgtggcagcaagtgggtcagagacggaagatgaggattctatggatattcctctggacttaagctcaagcgccggatcgggtaaacgacggagaagaggaaatctacctaaagagtcagttcaaatcctccgtgactggctgtacgaacataggtacaatgcgtaccctagcgagcaggaaaaggcccttctatctcaacagacacatctgagtaccttacaagtttgcaactggttcatcaatgcacgcaggcggctgctgcctgatatgttaagaaaggatggaaaggaccctaatcagttcactatctcacggagaggcgcaaaaattagcgaaacttcctctgtggaatctgttatgggcataaagaattttatgcctgctctggaagaaactcctttccatagctgtaccgcgggacctaatcctacactcggtcgcccactgtcccccaaaccctcaagtcccggatccgtccttgcccgaccgtccgtgatctgccacacaaccgtgactgccctgaaggacgtcccattttccctgtgtcagagcgtgggggtgggtcagaatacagacatccagcagattgctgccaagaactttacagataccagcttgatgtatccagaggacacctgcaaaagcgggccatccacaaatacccagtcggggttatttaatactccaccacctacaccccctgacctgaaccaggacttcagcggctttcaactacttgtcgatgtggctctgaagagggcagctgagatggaactccaagctaaactgacagcgtag

SEQ ID NO: 24581 - DNA, 819 bp, Artificial Sequence
  Description of Artificial Sequence: Synthetic coding sequence
atgaaaggtaagaaggggattgtcgccgcatctggctcagagaccgaagatgaggactcgatggatattcccctcgacctgagtagctcagcgggaagcggcaagaggcgcagaagaggcaatctgccaaaagagtcagttcaaatcttgcgggattggttatacgaacacagatataacgcatacccaagcgaacaagagaaggcactcctgtcacagcaaacccatctgtccacactgcaggtctgcaactggttcataaatgccagaagaaggctactgcctgacatgctacgcaaagacggtaaagaccctaatcagtttacaatcagcaggcgtggagcaaagattagtgagacaagctccgtagagtccgtgatgggcattaagaatttcatgccggcactcgaagagaccccgttccattcttgcaccgccggacctaacccaactttagggaggcctctgtctccaaagccttcatcacctggatctgtgctcgcacggccttctgtgatttgccacaccactgtaactgccctgaaggatgttcctttctccctgtgccagtctgttggagtagggcagaatacagatatccaacaaattgctgctaagaatttcactgacacatcactaatgtaccctgaggatacctgtaaatccggaccatctactaacactcagagcggtctgtttaacaccccaccgccaacacctcctgacctgaatcaggacttcagtggattccaattgctggtcgacgtggcactgaagcgagctgccgaaatggaattgcaagccaaactgactgcctag

SEQ ID NO: 24582 - DNA, 759 bp, Artificial Sequence
  Description of Artificial Sequence: Synthetic coding sequence
atggatatccctctggatctgtcttcttctgctggatccggtaagcgtaggcggagagggaatctgcccaaagagtccgtccaaatcctgcgtgactggctctacgagcaccggtataacgcgtaccctagtgagcaagagaaagctcttttgtcccaacagacccatctatccactcttcaagtttgcaattggtttattaacgctagaaggagactgcttcccgacatgctgcgaaaggacgggaaagacccaaatcaattcacaatcagtcggcgaggcgcaaagatctcagaaacaagtagcgtagaaagcgtgatgggcattaaaaattttatgccggctctggaggagacccccttccacagctgtactgccggtcctaaccccacgctgggtcgcccactgtctcccaagccaagttctcccggtagtgttttggcacgcccttctgtcatttgtcataccaccgtgaccgccttaaaagatgtgcctttctctctctgccaatctgtcggcgtaggacagaacaccgatattcaacagatagctgctaagaacttcacagataccagcctgatgtatccagaggatacttgtaagagcgggcctagcacaaatacacagtcggggctgtttaatactccaccccctacgccaccagatctgaaccaggacttctctggtttccagctcctagtcgatgtggccctaaagagggcagccgagatggagttgcaggccaagctgaccgcatag

SEQ ID NO: 24583 - DNA, 759 bp, Artificial Sequence
  Description of Artificial Sequence: Synthetic coding sequence
atggatattccgttggaccttagcagctccgcaggcagtggcaagaggcggcgaagaggaaatcttcccaaagaatcagtgcagatcctgcgtgactggttatatgaacacagatacaatgcatacccttccgaacaggaaaaggcactgctgtcccaacagacccacctgagcactctccaggtctgcaattggttcattaacgctcgaaggaggctgttgccggacatgctgcgcaaggacggcaaagatccgaatcaatttacgatatctaggaggggagccaagattagcgagaccagctctgtcgagagcgtcatgggcattaagaacttcatgcccgctctggaggagacaccttttcactcatgtaccgccggtccaaaccccacactcggacggccactctcacccaaaccatcttcccctggcagcgtgctggcgaggcccagcgtaatctgtcacactaccgtgacggccctgaaggatgtcccttttagtctgtgtcagagtgtgggagtgggccagaataccgatattcagcaaattgccgctaagaactttaccgataccagcctgatgtacccagaggatacctgcaaatctggaccctcgaccaacacgcagtcaggtctgtttaacactcctcccccaactcccccagacctcaaccaggacttctctgggtttcagctgctcgtggatgtggcacttaaaagggcagcggagatggaattgcaggccaaactcaccgcctag

SEQ ID NO: 24584 - DNA, 759 bp, Artificial Sequence
  Description of Artificial Sequence: Synthetic coding sequence
atggatattccactggacctgagctcttcagctggaagcggtaaacgcagaaggcgtgggaacctccctaaggagtccgtccagatcctgcgggactggctttacgaacacagatataatgcatatccctcagaacaggagaaggctctgctaagtcagcagacacacctgtcaactcttcaggtgtgcaactggttcattaatgcacgtcgcaggcttctgcccgacatgctccgaaaagacggcaaagaccctaaccagtttaccatcagcagaagaggagccaagatttctgagacctctagtgtcgagagcgtgatgggaatcaaaaactttatgccggcactagaggagactcctttccactcctgcactgctggcccaaaccctacccttggtcgacctttgtctcccaaaccaagcagcccaggaagtgtcttagccaggccatcagttatatgccacactacagtgactgccctcaaggacgtcccctttagcttatgtcagagtgtgggagtgggacagaacaccgatatacaacagattgcagctaaaaactttaccgacacatcccttatgtacccagaggatacctgtaaatccggacccagtacaaatacgcagtccgggctgttcaacacaccaccccctacccctcccgacctgaatcaggatttctcaggcttccagttgctcgtagatgtggccctgaagcgagcagctgaaatggagctgcaagccaagttgaccgcctag

SEQ ID NO: 24585 - DNA, 759 bp, Artificial Sequence
  Description of Artificial Sequence: Synthetic coding sequence
atggacattcccttagatctctcttctagcgcgggaagcggcaagaggaggcgaagaggaaatctgccaaaggagagtgtgcagatcctccgagactggctgtatgaacacagatacaacgcatacccttcagagcaagagaaggctcttctttcccagcagactcacttgtctaccctccaagtctgcaattggttcattaacgcaagaaggagactgctacctgatatgctaaggaaggacggtaaggaccccaatcagttcacaatctctaggagaggcgctaagatttcggaaacatcatctgtcgagagcgtaatgggaatcaagaattttatgcccgcactcgaggagaccccctttcactcttgcacagccggtcctaatcccacactcggtagaccgctatccccgaagccctccagtcccggttctgtgctcgctcgcccatccgtcatttgccacacaacagtgactgctttgaaggacgtacccttttccttgtgccaaagtgttggtgtcggtcagaatactgacattcagcaaatcgcagccaagaattttactgacacttctctgatgtaccctgaagacacatgcaagtctgggccatccacgaatacccagtccggtctgttcaataccccacccccaacgcctcccgacctgaaccaagacttctcagggttccagctgctcgtggacgtggcactgaaacgagctgctgagatggagcttcaggctaaacttacagcgtag

SEQ ID NO: 24586 - DNA, 819 bp, Artificial Sequence
  Description of Artificial Sequence: Synthetic coding sequence
atgaagggtaagaaggggatagtggccgctagcggatccgaaactgaggacgaggacagtatggatatacctctggacctgtccagctccgccggttcaggtaaacggcgacgtcgtggcaacttacccaaggagagcgtgcagatcctgcgcgactggctctatgaacaccggtataacgcctatccaagtgaacaggagaaagcgctactcagccagcaaacacacctatcgactttgcaggtctgcaattggttcataaatgctaggagacgcctgctccccgacatgctgagaaaggacggaaaggaccctaatcaattcactataagtcgccgaggggctaaaatctctgagacgtccagcgtagagtcagtcatgggcataaagaacttcatgccagcgctcgaggagactccctttcactcctgtaccgccggtcccaaccctaccctgggcagacccctctctcctaaacccagtagccccggatcagtgctggctcggccaagcgttatttgtcacaccacagttacggcattaaaggatgttcctttttccctgtgtcagtctgtcggcgtaggccaaaacaccgacattcagcagatcgccgctaagaatttcacagacacgagtctaatgtatcctgaggacacttgcaagagtgggccttccactaacacccagagcggactgtttaacaccccccctccgactccacccgatcttaatcaggacttttctggattccagcttctggtcgatgtggcactcaaaagggctgctgagatggagcttcaggcgaagctcaccgcgtag

SEQ ID NO: 24587 - DNA, 759 bp, Artificial Sequence
  Description of Artificial Sequence: Synthetic coding sequence
atggacatccctctcgacctttcgagtagtgccggttctggaaagcggaggcgcaggggaaatctccctaaggaaagcgtgcaaatcctgcgggactggctttatgagcaccggtacaatgcttatcccagtgagcaagagaaagctctgctgtctcagcagacacatctgtcgacgttacaggtatgtaattggttcatcaacgcaaggcgcaggctgctgcctgatatgttaagaaaggatggaaaggatccaaatcagtttacaatctctcgccgaggagcaaagatttcagaaacctcgtccgtggagagcgtgatggggatcaaaaactttatgcctgcactcgaggagacaccgtttcactcgtgcacagccggacccaatccaactctggggcgtcctctttctccaaagccatcctctccaggttcagtactggccagacctagcgtgatttgtcacacgaccgttactgccctcaaggatgtaccattttcgctttgccagagcgtaggagtagggcagaatacagatattcagcagatcgccgctaaaaattttaccgatacctccctgatgtacccagaggacacctgcaaaagcggaccatctaccaacacacagtccggcctgtttaacacaccaccccctaccccacctgatctcaatcaagattttagcggatttcaactgctggttgatgtagccctgaagagggcagctgaaatggaattacaggcaaaattaacagcttag

SEQ ID NO: 24588 - DNA, 861 bp, Artificial Sequence
  Description of Artificial Sequence: Synthetic coding sequence
atgacctgctccggaaagtcttgcgctctcgcccgatcttcactcacctcaagccaagggatcgtggccgcatctggctctgagactgaagatgaagactccatggatatcccattggatctgtcttcttctgcgggatccgggaagcgcaggagacgaggtaatctgcctaaggaaagtgtgcagatactgcgagattggttatacgagcatcgctataatgcctatcccagtgaacaggaaaaggccctgttgtctcagcagacgcacctgtctacgctgcaggtgtgcaattggttcatcaacgccaggcgacgcctgcttccagacatgctgaggaaagatggcaaggacccaaatcaatttactatatcgcgaagaggcgctaagatcagtgagaccagctccgtggaatccgtcatgggaattaagaattttatgccggctttagaggaaacgccattccattcatgtacagctggccctaaccccacactggggaggcccctgtcccctaagccatcaagtcctggatccgtcctggcacgcccttccgtgatatgtcacactacagtcactgcactcaaggacgtccctttctcactgtgtcagagcgtgggggtgggccagaatactgacattcaacaaatcgccgctaaaaattttaccgacacttctttgatgtaccccgaggatacctgtaagagcggaccttccacaaacacacagtcagggttatttaacacccccccaccaacccctccagacctaaaccaggacttttcaggctttcaactcctggtggacgtggccctcaaacgcgcagcagagatggaactgcaggctaagctgacagcctag

SEQ ID NO: 24589 - DNA, 279 bp, Artificial Sequence
  Description of Artificial Sequence: Synthetic coding sequence
atggacatcccgctcgacctgtctagttcagccggtagcggtaaaagacgaaggcggggtaatcttcccaaagaatcggtccaaattctaagggattggctgtatgaacatcgatacaatgcgtatccgtccgagcaggaaaaagcattgctcagccagcaaactcatttgagcacactgcaggtttgcaactggttcatcaatgctcggaggagactgctgcctgacatgcttaggaaggacgggaaagaccccaaccaattcacaatatcaagatag

SEQ ID NO: 24590 - DNA, 402 bp, Artificial Sequence
  Description of Artificial Sequence: Synthetic coding sequence
atggacattcctctcgatctctcaagcagcgcagggagcggcaagcgcaggagacggggaaacttacctaaagaatcagtgcaaatcttgcgtgactggctgtacgaacatcgctacaatgcatatccctcagagcaggagaaggctctgttgtcccagcagacccacctctcaaccctgcaggtgtgtaattggttcataaatgctcgtcgtcggctgctgcccgacatgctccggaaagatggtaaagatcctaaccagtttaccatttctcgcaggggtgctaaaatctcagagacgtcatcagtggagagtgttatgggaattaagaacttcatgccagcacttgaggaaacgcctttccacagctgtaccgcagggccaaaccctacgttagggtag

SEQ ID NO: 24591 - DNA, 741 bp, Artificial Sequence
  Description of Artificial Sequence: Synthetic coding sequence
atggatattccattggacctgagctccagcgctggctcgggcaagcgcagacggaggggtaacctgccgaaggagagtgtgcagatcctgagagattggctctacgagcatcgttacaacgcgtatccaagtgagcaagagaaagcactgctgtcccaacagacacatctgtcaacactccaggtctgcaactggttcattaatgcgagaagacgactcttgccagacatgttaaggaaagacggtaaggatcccaaccagttcaccatcagcaggagaggtgcaaagatctccgagaccagctccgtggaaagcgtgatgggaatcaagaattttatgccggctttggaagagaccccttttcatagctgtactgctggacccaacccaaccctgggaaggccactgagtcccaagccttcatcaccagggtccgttctggccagacctagtgtgatctgtcacactacggtgaccgccctgaaggatgtcccattctcactctgccagtcagttggtgtgggacaaaatactgatattcaacagattgcagccaaaaatttcacagacacaagcctcatgtatccagaggatacttgtaaatcaggccctagcaccaatactcagtctggcctgttcaacacccctcctcctaccccaccagatttgaatcaggactttagcggttttcagcttcttgtggatgtagccttgaagagggccgcagagatggagctgtag

SEQ ID NO: 24592 - DNA, 660 bp, Artificial Sequence
  Description of Artificial Sequence: Synthetic coding sequence
atggacatcccactcgatctgtcttcatccgccggttccggcaaacgtcgcagaaggggcaatttacctaaggagagtgtgcagattctccgcgactggctatacgaacatagatacaacgcgtatccgagtgagcaggagaaagccttattgagccaacagactcacctgtccactctccaagtatgcaattggttcataaatgcaagaaggcggttactacccgatatgctacgcaaggacggaaaggacccgaaccagttcactatttccagacgaggggctaagattagcgaaacatcctccgtggaatccgtaatgggaattaaaaactttatgccagctctggaagaaaccccttttcactcctgcaccgctggtcccaatcccaccctggggaggccactttcccctaagccaagttctccgggtagcgtgcttgcacgcccatcagtgatctgtcacacaactgttactgccctcaaggacgttccctttagtctgtgccagtccgttggcgtcgggcagaacactgatatccagcagattgccgctaagaactttactgacaccagcttaatgtaccctgaggatacctgcaagtctggccctagcacgaacactcagagcggactgttcaacacaccccctcccacctag

SEQ ID NO: 24593 - DNA, 396 bp, Artificial Sequence
  Description of Artificial Sequence: Synthetic coding sequence
atggacataccccttgatctaagcagctctgccggaagcggcaagaggcggcgtagaggcaatctacctaaggagtccgtccaaatcctgcgcgactggctgtatgaacatagatataatgcatatccctctgagcaggagaaagcactactgtcacagcagacccacctaagtacactacaggtctgcaattggtttattaatgccaggaggcgcttgcttcctgatatgctcagaaaagatggcaaggaccccaaccagttcaccatttcccgccgaggggcaaagatttccgaaacgtctagcgtcgagtccgtgatgggcattaaaaacttcatgcctgctctggaggagactcccttccattcctgcactgccggtcctaaccccacctag

SEQ ID NO: 24594 - DNA, 417 bp, Artificial Sequence
  Description of Artificial Sequence: Synthetic coding sequence
atggacatcccgttagacctctctagctcagccggaagcgggaagcgcagacggcgtggaaatctgcccaaggagagtgtccagatcctacgagattggttgtacgaacatcggtataatgcataccccagtgaacaggagaaagcacttctgtcccagcagacacatctttcaaccctgcaagtctgcaactggtttattaacgccagacggaggctcctgccagatatgttgcggaaggatgggaaagatccaaaccagtttacaatctccaggcggggtgccaagatcagcgaaacatcgtccgttgaatcagtgatgggcataaagaattttatgcccgctctggaggaaaccccttttcactcgtgcactgccggaccaaaccccaccttagggcgacctctctcaccctag

SEQ ID NO: 24595 - DNA, 759 bp, Artificial Sequence
  Description of Artificial Sequence: Synthetic coding sequence
atggatatccctctggatctcagcagttctgctggcagcggcaagcggagaaggagggggaatctgccaaaagagtccgtccagatcctgagggactggttatatgaacatagatacaacgcctatcccagcgagcaggagaaagccctcctgagtcaacagacccatctgtcgacgttacaggtttgtaattggttcattaacgcccgacgcagactgttaccagacatgctgcgaaaggatggcaaggatccaaaccagttcacaatttctcgacgcggagcaaaaatttccgagacatcttccgttgaatccgtgatgggtattaaaaattttatgcccgctctcgaggagactccatttcactcttgcactgccggtcccaatcctactttagggaggcccctgtccccgaagccttccagccctggaagcgtgctggcacggccttcagttatctgtcacaccacggtgaccgcattgaaggatgtgcccttttctctatgccaatccgtcggtgtgggccagaacaccgatattcagcagatcgcggctaagaattttacagacacctcgctgatgtatccagaggatacttgtaaatctgggcctagcactaatactcagagcggactattcaatacaccacctcctaccccccctgacctgaatcaggacttttcgggctttcaactccttgtggacgtcgctctgaaaagggcagctgaaatggagctgcaggctaaattaactgcatag

SEQ ID NO: 24596 - DNA, 507 bp, Artificial Sequence
  Description of Artificial Sequence: Synthetic coding sequence
atggatatcccgctggatctttctagctccgccggatctgggaagcggcgaaggcggggaaacttgcccaaggagtctgtacagatactccgggattggctgtatgaacaccggtataacgcctatcccagcgagcaggaaaaggccttattgtcccagcaaacccatctctccacgctgcaggtgtgtaactggttcattaatgcacgacgacggctactgccagacatgttgcgaaaagacggcaaggatccgaaccagttcaccatctcacggcgtggagcaaagattagcgaaacctcaagcgttgagtctgtcatgggtatcaagaatttcatgccagctttagaagaaactccgttccatagttgcacagccggaccaaatcccacacttgggaggcctttatcaccaaagccatcctccccaggcagcgtactggccagacctagtgtgatttgtcatacaactgttacggctctgaaagatgttccgttctccttgtag

SEQ ID NO: 24597 - DNA, 2523 bp, Artificial Sequence
  Description of Artificial Sequence: Synthetic coding sequence
atggcaggccctggttcaacaggcggtcagattggggctgccgcattggctggtggtgcccgatctaaggttgccccttccgtggatttcgaccactcctgctccgatagcgtcgagtatctgaccctcaattttggtccatttgaaactgtgcatcgatggcggaggctgccgccttgcgacgagtttgtgggtgctaggcgatctaagcatactgtcgtggcatataaggatgccatctatgtgtttggcggagataatggaaaaaccatgctgaatgatttgctccggtttgatgtaaaggactgttcctggtgccgcgcattcacaactggcactccgccagctccacgatatcaccatagtgcagttgtgtacggcagttctatgttcgtctttggtggatatacaggtgacatctactctaacagcaacctcaagaataagaacgatctgtttgagtacaagttcgccactggacaatggaccgaatggaagatcgagggaaggctgcctgtggcccgatcagcccatggagcaacagtgtattccgacaaactctggattttcgccggttatgatgggaatgcccgacttaatgatatgtggacgattggactccaggacagggagctcacctgctgggaagaggtcgcccaatccggagagattccacctagttgctgcaacttccctgtagcagtgtgccgagacaaaatgtttgtctttagcggccaatctggtgcaaaaatcaccaacaatctgtttcagtttgagttcaaagataaaacttggacccgtattcccacagagcatcttctgcgaggcagccctcctcctccacagagaagatacggccatactatggtagccttcgatcgccatctttacgtcttcggtggcgcagctgacaacaccttgcccaatgaactccattgctatgacgtggattttcagacttgggaagtggttcagccaagctccgactctgaagtgggcggagcagaagtgcctgaacgcgcttgtgccagcgaagaggtgccaactttgacatatgaggagcgcgtgggcttcaagaaatcgcgagatgtgttcggactcgattttgggactacctctgccaaacaacctactcagcctgcctccgaattgcctagcggcaggctatttcacgccgctgccgtgatctcagacgccatgtatatatttggtgggaccgtcgacaacaatatcagatctggcgagatgtataggttccaattctcctgctacccgaagtgcactcttcacgaagattatggcagactttgggaaagccgccagttctgtgacgtggagtttgtcctgggggagaaggaggaatgcgtgcaaggacacgtagcaatcgtcacagccaggagtagatggctgagacgaaagattacacaagccagggagaggctggcgcagaagttagaacaggaagcggcaccggtgcccagagaggccccaggtgtggctgcaggaggcgctcgccctcccttgctccatgtcgcaatcagagaggctgaggctcggcctttcgaggtgttgatgcagttcctgtacaccgataaaattaagtacccgcgtaaggggcatgtggaagacgtcttactgattatggacgtttacaagctcgctctctcatttcagctctgtaggctcgagcaactctgtagacagtacatcgaggcctccgtcgacctgcaaaacgtgctggtcgtctgtgagagtgcggctcgtctccaactgtcccaacttaaggagcactgcctgaacttcgtggtgaaggagtcccatttcaatcaggtgattatgatgaaagagtttgaacgactgtcttctccgctaatcgtggaaatcgtgcggagaaagcagcagcctcctccaagaactcccctggaccagcccgtggacatcggcactagtctgattcaggatatgaaagcgtacctggagggcgcaggggcagagttttgcgacatcacactcctcctagatggccacccacggcctgctcacaaagccatcctagccgctcgctcctcctatttcgaggcgatgtttcgcagtttcatgccagaagacgggcaggtcaacatcagcattggtgagatggtgccctctaggcaggcattcgagtccatgttacgctatatatactatggcgaggtgaatatgcctcccgaagatagtttatatctgtttgccgctccctattactacggattttataacaaccggctgcaggcatactgcaagcagaacttagagatgaacgtgaccgtgcagaatgtgctgcagatcctcgaggcagccgataaaacacaggcactggacatgaaaaggcactgtctccatattatcgtgcaccagtttactaaggtgagtaagctgcctaccctcagatccctaagtcagcaactgttgctcgacatcattgacagcttagccagccacatatccgacaagcagtgcgcggaactcggagccgacatctag

SEQ ID NO: 24598 - DNA, 930 bp, Artificial Sequence
  Description of Artificial Sequence: Synthetic coding sequence
atgccaagacactgcagcgcagcaggttgttgcacacgtgatacacgagaaacccggaatagaggaatttcgtttcaccggttgcctaagaaagacaacccccgtcgcggactctggctggctaactgccaaagattagatcccagcggccagggactttgggacccggcaagtgaatatatttacttctgcagcaaacactttgaagaggactgctttgagcttgtagggatttccggatatcacaggcttaaagaaggggcagtgcccactatattcgagtctttctctaagctgcgaaggaccacgaaaacaaagggacacagttaccccccaggacctgctgaagtgtctcgattgcgcaggtgcaggaaaagatgtagcgaggggcgtggaccaacaactcctttcagtccccctccacccgctgacgtcacttgctttcccgtggaggaggctagtgctcctgctacattgcccgcatccccggctgggagacttgaacccggactctccagtcctttcagtgatctgcttggaccattgggcgctcaggccgatgaggccggttgtagtgcccagccaagccccgaaaggcagccttcacccctggagcccagaccagtcagcccttcagcatacatgctgcgtctgccccctccagcaggagcatacattcaaaatgagcattcgtaccaggtgggctccgcgttgctgtggaaaagacgggctgaggctgctctggatgcactcgataaggcgcaacgacagttgcaggcatgtaaacgtagagaacagagactacgcttaagactaaccaagttgcaacaagagcgagccagggaaaagcgcgcacaagccgacgccaggcagacgctgaaggagcatgtgcaggatttcgccatgcagctctccagtagcatggcatag

SEQ ID NO: 24599 - DNA, 1140 bp, Artificial Sequence
  Description of Artificial Sequence: Synthetic coding sequence
atgggtgacagtcggcgtcgaagcctgggcaatcagcccagctcagaggcggcaggcaggagtgaacgcgagcaggatggtgaccctcgcggattacagtcttctgtgtatgagtctaggagggtgactgacccggagcggcaagatctcgacaatgcagaattgggccctgaggacccggaggaagaattgccacctgaagaggtggcaggagaagaatttcccgagactttggatccaaaggaggcgttatccgagcttgaacgtgtgctggacaaggaccttgaagaggatattcctgagatcagtcgcttgtcaatttcccagaagctgccatcaactaccatgaccaaggcgaggaaaaggcgcagaagacggagactgatggaactcgcagagccaaagatcaactggcaagtgctgaaggaccgtaagggccgatgtggcaagggttacgcgtggatctcaccctgtaaaatgtccctccatttctgcctctgctggccctccgtctattggacagagcgtttcctggaggatacgactctgacaatcaccgtgcccgcagttagtcgcagagtggaggaactatctagaccgaagcgtttctatctggaatactacaacaataaccgaactactcccgtctggcctatccccagatcatcactggaataccgagccagcagtcgtttgaaagagcttgcagcacccaagattagagataacttctggtctatgccaatgtcagaagtgtcccaggtctccagagcagcccaaatggctgttccttcttcacgcatccttcaactgagcaagcctaaagccccagccaccctactggaagagtgggatccggtgcctaaacccaaaccacatgtgagcgaccacaatcgcctcctccatctggcaagacccaaagcacagagtgacaagtgtgttccagatagggaccccaggtgggaagttctggatgtgacaaaaaaggtggtcgccagtccacgcattatttctctggctaagcctaaagttcggaagggcctcaacgaggggtacgatcgcagacctttggctagtatgtctctgcctccgcctaaagcatccccagagaagtgtgatcagccaaggccaggactctag

SEQ ID NO: 24600 - DNA, 1068 bp, Artificial Sequence
  Description of Artificial Sequence: Synthetic coding sequence
atgggggactcgaggcggagaagcctggggaatcagccatcgagtgaagccgctgggagatccgagcgtgaacaagatggcgatccccgaggactccagtcaagcgtgtacgaaagtcgacgagttacagatcccgaacgccaggatctggataacgccgagttgggccctgaagatcccgaggaagagctgccgccagaggaagtggctggggaggagttccccgaaaccctcgatcctaaggaggccctttccgagttggagcgtgtccttgacaaagacctggaagaggacatccctgaaatctcacgactgtccatatcacaaaagctcccctctacaacaatgacaaaagcccgaaagagacgaaggcggaggaggttaatggagttggcggagccaaaaatcaattggcaggtgctaaaagatcgcccaagtgtttattggaccgagcggttcctggaagacaccacactcacaattacagtccctgccgtctcccgccgagtggaggaactgtcaaggcccaaaagattttatctggagtactacaacaataatcgaactacccctgtttggcctattccccgatcgagtttagaataccgcgcatcaagtcgcctcaaggagttggcagctccgaagataagggacaacttctggagtatgcctatgtcagaagtatcccaggtcagccgcgcagctcagatggctgttccctctagccggatcctgcagctgtcaaagcccaaggcccctgccactctcttggaggaatgggatcctgtccccaagcctaagccccacgtctctgaccataacagactgctgcacctggcgagacccaaagctcagagcgacaagtgcgtcccagacagggatcctaggtgggaggtgctggacgtcacaaagaaagtggtggcttcgcccagaatcatctccctagccaaacccaaggtcaggaagggtttgaacgaggggtatgaccgcaggccactggcctccatgtcgctgccaccgccaaaggcctcacctgagaagtgcgaccaaccccgacccggtctctag

SEQ ID NO: 24601 - DNA, 450 bp, Artificial Sequence
  Description of Artificial Sequence: Synthetic coding sequence
atgagttttctgcttccaaaactgacctcaaaaaaagaagttgatcaggcaatcaaaagtacagcggaaaaagtgctggttctgcgttttgggagggacgaagacccagtgtgcctgcagctggatgatattctgagcaagacgagtagtgacctgagtaaaatggcagccatctatctggtggatgtggaccaaaccgccgtctatacgcaatatttcgacatcagctacatcccaagtaccgtgtttttctttaatggacagcatatgaaagttgattacgggagtcctgatcatacaaaatttgtcggctcattcaaaacaaagcaggacttcatagatttgattgaagtcatctaccggggtgcaatgcgtggtaaactgatcgttcagtctcccatcgaccccaaaaacataccaaaatatgatttgctgtatcaggatatctag

SEQ ID NO: 24602 - DNA, 450 bp, Artificial Sequence
  Description of Artificial Sequence: Synthetic coding sequence
atgagctttttactcccgaagcttacctccaaaaaagaggtggaccaggccataaagtcaactgccgaaaaggtcctggtcttgagatttggacgggacgaggacccggtgtgcttgcagctggacgacattttgagcaagacctcatcagatcttagcaaaatggccgctatctatctggtggatgtggaccaaaccgcagtgtatacacagtactttgacatttcatacattccttccaccgtgttcttttttaacggccagcacatgaaagttgactatggctcacctgaccacaccaagttcgtcgggtcatttaagaccaagcaggactttattgatctaattgaagtgatttacaggggtgctatgcgaggcaaacttatcgtgcagtctccaattgaccccaaaaacattccaaagtatgacctgctgtatcaggacatctag

SEQ ID NO: 24603 - DNA, 450 bp, Artificial Sequence
  Description of Artificial Sequence: Synthetic coding sequence
atgagcttcctgttaccgaaactaaccagcaagaaagaggttgatcaggcaatcaagtctaccgccgagaaggtgctggttctgcgattcgggagagacgaggatcccgtgtgcttacagctggatgatatcctctcaaaaacaagctccgacctgtccaaaatggctgctatctatctggtggacgtggatcaaaccgcggtatacactcagtacttcgacataagctatatcccatctaccgtctttttctttaatggccagcacatgaaggtagactacggcagcccggatcacactaaattcgtaggctcttttaagacaaagcaggacttcatagaccttattgaagttatctaccgcggagcaatgagaggcaagctgatcgtgcagagcccaatcgaccccaagaacatccctaaatatgacctgttataccaggacatctag

SEQ ID NO: 24604 - DNA, 891 bp, Artificial Sequence
  Description of Artificial Sequence: Synthetic coding sequence
atggagcgggcagtgcccctggccgtgcccctaggacagacggaagtattccaggcacttcaacgcctgcatatgacaatctttagtcagagcgtgagtccttgcggaaagttcctagccgcaggaaacaattacggtcagattgccattttttcgctgtcttccgctttgtctagcgaggccaaagaggagtctaagaagcccgtggtgacattccaggctcacgacggcccagtgtactccatggtgtccacagataggcatctgttaagcgctggagacggagaggtcaaagcttggctatgggccgagatgttgaaaaagggctgtaaagaactgtggaggcggcagcctccctatcgcaccagtctcgaggtaccggaaatcaacgcgctgctccttgtgcccaaggagaacagcctcattcttgctggcggagattgccagcttcataccatggacctggaaacgggcacctttaccagagtgttgcgaggacatactgactacatccactgtctggctctgcgggagcgcagtccggaggtcctgagcggtggggaggacggagctgtgaggctgtgggacctgcgcacagccaaggaagtccagactattgaagtttataaacatgaagagtgcagtcgaccgcacaatggcaggtggatcggctgcctcgcaaccgattccgattggatggtgtgtggtggcggacctgccctgaccctgtggcacctccgttcttccaccccaaccacaatctttccaatccgggcaccacagaagcacgttacattctaccaggatctcgtgttgacagctgccggaaatagttgtagggttgacgtttttacgaatttgggataccgggcatttagtctatccttttag

SEQ ID NO: 24605 - DNA, 1026 bp, Artificial Sequence
  Description of Artificial Sequence: Synthetic coding sequence
atggaaagagctgtaccgctggctgtccctctgggtcagactgaagtttttcaggctctccagagactccatatgaccatcttttcacaatctgtctctccatgcggtaagttcctggctgccggaaacaattatggccagatagccattttcagtctcagttctgctctgagctcggaagctaaggaagagtcaaagaagccagtcgtcacgtttcaggctcacgacggccctgtgtacagtatggtctccacagaccggcatctgttgtcagccggtgacggcgaggtgaaggcctggctgtgggcggagatgctgaagaagggctgtaaggagctttggcgaagacaacccccttacaggacaagcctggaagttcccgaaattaacgctctgttactggtgccaaaagagaactcactgatcctagcgggaggcgactgccaactccacactatggacctcgagaccggtacgttcaccagagtgcttcgcggtcacactgactacattcattgtctagccttacgggagcgcagtcctgaggtactgagtggcggagaagacggggcagtgcggctctgggatttgagaaccgccaaggaggtacaaactatagaggtgtataaacatgaggaatgctccaggccccacaatggacgatggatagggtgtctggctacagatagcgactggatggtgtgcggaggcggtccagcccttaccctttggcacttacgtagtagcacccctacgactatttttcccatccgcgctccacagaaacatgtcacgttctaccaggaccttattctaagtgcaggccaagggcgatgtgtcaatcaatggcagctgagtggcgaactgaaggctcaggttccgggttctagccccggtttgttatctctgtccctgaatcagcagccggctgccccagagtgcaaggtactgaccgctgcaggcaactcctgtagggtggatgtgttcaccaacctgggatatcgtgcattttcactgagcttctag

SEQ ID NO: 24606 - DNA, 2868 bp, Artificial Sequence
  Description of Artificial Sequence: Synthetic coding sequence
atgtccaagaccaataagagcaaaagcggcagccggagtagtcggtctcggagcgcctcccgttcacgttctcgttctttctctaaaagcagatctcgcagcaggtcattgtcacgatctcgtaagagacgcctcagctcacggagtagatcccgctcttactccccagcccacaaccgggaaaggaaccacccaagggtctaccagaacagagattttaggggtcataacagggggtatcgtaggccctattatttcaggggacgaaaccgtggcttctacccctggggacagtacaaccggggtggctacggcaactatagatccaactggcagaattacagacaggcatattctccaaggaggggtaggtctcgatcacgatctccaaaacgccgttcacctagccccagatcaaggtcacatagtcggaacagtgacaaatccagctcagacagaagcagaagatcttctagctccaggtcctcttctaatcatagcagagtggagtctagtaaacggaaaagtgctaaagagaagaagagctcatctaaggattccaggccatcccaggccgctggggataaccagggcgacgaggcaaaagagcagacgtttagcgggggaaccagccaggacaccaaagcttcagagagcagtaaaccttggcctgacgcgacttacggcacgggctcagctagtcgtgccagcgccgtgagcgagctgagtcctagggaacgctcccccgcactgaaaagtccactgcagagtgtcgtcgtgcgaagaaggagtcctaggccttcccccgtccccaagccatctcctcccctgagctcaacttctcagatggggtccacactcccctcaggtgccggttatcagtctggtactcaccaaggccagttcgaccacggctcaggcagtctgtccccctcaaaaaagagccccgttggcaagtccccgccatccacgggctctacgtatggttcaagtcagaaggaagaaagcgctgcctccgggggagccgcttatacgaaacgatatctcgaggagcagaagacggagaatgggaaggacaaggagcagaagcaaaccaacactgataaggaaaagattaaagagaaaggcagcttcagcgataccggtctgggcgacgggaagatgaaatccgactccttcgccccaaagaccgacagcgagaagccatttaggggaagccaaagccccaaacggtataaactccgggacgatttcgaaaagaagatggcagattttcacaaagaggaaatggatgaccaggacaaagacaaagcaaagggtcgcaaagagagcgaatttgatgacgaaccaaagttcatgagtaaagtaattggcgctaataaaaatcaagaggaagagaagtccggcaaatgggaggggctagtctatgcacccccagggaaagagaagcagaggaaaactgaggaactggaggaagagtcctttccagaaagatctaaaaaagaagatcggggtaaacggtcagagggaggtcaccgcggatttgttcccgaaaagaactttagggtcaccgcgtacaaagccgtgcaggagaagagcagttccccgccaccccgaaagacaagtgagtctagagacaagcttggcgctaagggggactttcctaccggaaaaagctccttctctatcactcgagaagcgcaggtgaacgtgcgcatggacagtttcgatgaagatctggccaggccttctgggcttctcgcccaggaaaggaaactgtgccgggatctcgtccattcaaacaagaaggagcaggaattccgctcgatctttcagcatatccagtcagctcaaagtcagcgctctcctagtgagctgttcgctcagcacattgtgaccattgtacatcatgtcaaggaacatcatttcgggagttcgggaatgacactacacgagcggttcacgaagtatctcaagagagggaccgaacaggaagctgcaaaaaacaagaagagccccgaaatccaccggaggatcgacatctccccgagcactttcaggaagcatggcttagcccacgatgagatgaaatcccccagggaacctgggtataaggctgagggtaagtacaaggacgatccagtggacctgcggctggacattgagaggaggaagaagcataaggagcgggacctcaaacgcggaaaatcacgggaatctgtggacagcagggattcttcacattctcgagagcgcagcgctgagaaaactgagaaaacgcataaaggttccaagaagcaaaagaagcaccgccgtgcaagagatagatctaggagctccagtagttcctctcagtcctcccattcctataaagcggaggagtatactgaagaaacagaagaacgggaggagagcacgaccggctttgacaaaagccgactcgggacaaaggacttcgtgggaccgagtgaacggggtggtgggagggcccgaggcacattccagtttcgggctaggggcagaggctggggaaggggcaactatagtggtaacaacaacaacaattctaacaacgattttcagaaaaggaatagggaggaggagtgggatccggagtacacacccaagagtaagaagtactatctgcacgacgacagagagggagaaggtagcgacaaatgggtcagcaggggacggggaaggggcgcatttccaaggggaagaggacgctttatgttccgcaagtcctcaaccagccccaagtgggctcatgacaagttttcaggcgaagaaggtgagattgaggatgatgaatccggcacagaaaacagggaggagaaagacaacatccagcctaccactgaatag

SEQ ID NO: 24607 - DNA, 2868 bp, Artificial Sequence
  Description of Artificial Sequence: Synthetic coding sequence
atgtccaagacgaacaaaagcaagtccggctctcggtctagcaggagcagaagtgctagccgttccaggtcccgctcattctcaaaatctcgatccaggtctcggagcctgtcccggtcaaggaaaagacgactgtcaagcagatcacgatcaaggtcctatagtcccgctcacaatagagagcgcaatcaccccagggtatatcagaatagagacttcaggggtcataacaggggatacaggaggccatactacttccgaggaagaaaccggggattctatccctggggccagtacaatcgcggtggctatgggaactaccggtcaaattggcagaattaccgacaggcttactcacctcggaggggccgatctcgcagcaggtctcctaagagacgcagtccctctccaaggtcacggtcgcactcacgaaattccgacaagtcctcaagcgacagatcgagaaggagctcctcctctaggtcttcgagcaatcactctcgggtcgagtcctccaaacgaaaaagtgccaaggaaaaaaagtcctcatctaaggatagtcgcccaagccaggcagccggtgataaccagggtgacgaggccaaggagcagaccttcagtgggggaacaagtcaggatacaaaagcttctgaatctagcaaaccttggcctgacgccacctatggaaccgggagcgcaagcagagccagtgcagtgagtgaactcagccccagagagcggtctccagctctcaagagccctctgcagagcgtggttgtgcggagacgatcccctcgcccaagccccgtccccaagccttcgccgcctttatcaagcacgagccagatgggatctacactgccttctggcgctggataccagtccggaacacaccagggccagtttgaccatggatcgggctcattgagtcctagcaagaaatccccggtcggaaagtcgcccccatcaacaggctccacctacggctcatcccagaaagaggagtcagctgccagtggaggggcagcgtacacgaaacgataccttgaagaacagaagactgagaacggtaaagacaaagagcaaaagcaaacaaatactgacaaggagaaaataaaggagaagggatcatttagcgatactggcctgggagatggcaaaatgaaatccgacagctttgcaccaaaaaccgatagcgaaaagcccttcaggggctcccagagcccaaaacggtataagctccgggacgacttcgagaagaagatggcagactttcacaaggaggaaatggacgaccaggataaagacaaagccaagggacgaaaggagtctgagtttgatgatgagccaaagttcatgtccaaggtgataggcgctaacaaaaaccaggaggaggaaaaaagtgggaagtgggagggcctagtatatgctcccccaggcaaggaaaaacagaggaagacagaggagcttgaagaggaaagcttcccagagcgcagcaaaaaggaggacaggggaaagagatcagagggtgggcaccggggatttgttcctgaaaagaactttcgggtgaccgcgtataaagccgtccaggaaaagtcctccagccctccaccaaggaaaaccagcgaaagcagagataagctgggcgcaaaaggcgatttcccaaccgggaagagtagtttttcgatcactcgggaggcccaagtaaacgtgcgcatggactcatttgacgaagacttagctcgacccagcggcctgctggctcaggagcggaaactctgccgcgacctggtccattcaaataagaaggagcaagagtttcgttccatctttcaacatatccagtctgctcaatcgcagaggagcccctcagagctgttcgcacaacacatcgtgaccattgtgcaccacgttaaggagcatcacttcggctcaagcgggatgacactgcacgaaaggttcactaagtacttgaagagagggactgagcaggaagccgctaaaaacaagaagtcccccgagattcacaggcggatcgatatatcaccatcaaccttccgaaagcatgggttggcacacgatgagatgaaatctcctagggaacctgggtacaaggcagaaggcaaatacaaagatgacccagtggatttgagacttgatatcgagagacggaaaaagcacaaggagcgcgatttaaaacggggaaagagccgggaatcagtggattcgcgggactctagccacagcagggagaggtccgccgaaaagaccgagaaaactcacaagggctcaaaaaagcagaagaaacacaggcgcgctagggacaggtcgaggtctagcagctcatctagtcagtcttcacatagctataaggctgaggagtacaccgaagaaacagaagaacgcgaggagtcaacaacaggattcgataagagccgcctggggactaaggacttcgtgggacctagtgaacgtggaggcggacgtgctcgtgggacatttcagttccgtgcgaggggaagagggtggggccgaggcaattattcagggaacaacaataacaacagcaataacgactttcagaagaggaatagagaggaagagtgggaccccgaatacacccctaagtctaagaagtactatttgcacgacgatagagaaggagagggatcagacaaatgggtgagtcgcggtcgtggccgaggggcatttccaaggggccgtgggagatttatgttccgaaagtcttcgacatcccctaagtgggctcatgacaaattctccggtgaagaaggggagatagaggatgacgaaagtgggactgagaacagggaagaaaaggataatatccagcccacaacggagtag

SEQ ID NO: 24608 - DNA, 123 bp, Artificial Sequence
  Description of Artificial Sequence: Synthetic coding sequence
atgtccaagactaataagtccaaaagcggctcccgctcgtcccgatcacgatccgcttctcgttctcgtagtaggtcattctctaagtctagaagcagaagccgatccttatcacggtcttag

SEQ ID NO: 24609 - DNA, 1416 bp, Artificial Sequence
  Description of Artificial Sequence: Synthetic coding sequence
atggagcttagcagtaaaaagaaactccacgctctgtcccttgcagaaaaaatccaggtgcttgaacttctggacgagtccaaaatgtcacagtcggaggtcgcacgacgattccaggtttctcagccccagatttcccgcatttgcaaaaataaggaaaaactgcttgcagattggtgttccggcactgccaatagagagagaaagaggaaaagggaatcaaaatattccgggatcgacgaagccctgctttgctggtaccacatcgccagagccaaagcttgggatgtcaccggcccaatgctcctgcataaagcaaaagaactcgccgacattatgggacaggactttgtcccaagtatcggctggctcgtgagatggaaaagacgtaataacgtgggattcggtgccaggcacgtactggccccatcatttcctcccgagcctcccccaccgggactcacaagtcaggcgcaattgcccctgagtctgaaagacttttcacctgaggatgtttttgggtgtgccgaactccctctcctgtatcgagctgtgcccggttcatttggcgcttgcgatcaggtccaggtgctcctgtgcgccaacagcaggggcaccgagaaacggagagtactcctgggagggctgcaggctgcacctcgctgtttctttggaatccgttcagaagcacttcccgctagttatcatcctgacctcggaattccctggttggagtggcttgcccaattcgaccgggacatgggtcaacagggcaggcaggtggccctgctgctggctgccagggttgtggaggaattggccggactgcccggactctaccatgtgaagctccttcccctggccgctagtagcactaccccccctctgccgagcagtgtcgtgagggcattcaaagcacattacagacatcgcctcctgggcaagctcgctgcgattcagtcagagcgagatggtacctcactcgcagaagctggcgctggaatcaccgtgctcgacgcacttcacgtcgctagcgcagcatgggccaaggttccgccacagctgatattcagttctttcattcaggaaggcctggcaccaggaaaaacaccaccctcctcacacaaaacatcagaaatgcctcctgtgcctgggggtttgtcactggaggagttttcccgtttcgtggaccttgaaggggaggagcctcgcagcggggtatgcaaagaggagattgggacagaggatgagaaaggcgacagagaaggagcgtttgaacctttacccaccaaagctgacgcacttagggccctcggtaccttacgtcgctggttcgaatgtaacagcacatcccccgaactgttcgaaaaattctatgactgtgaagaagaagtcgaaaggctgtgttgcctttag

SEQ ID NO: 24610 - DNA, 1539 bp, Artificial Sequence
  Description of Artificial Sequence: Synthetic coding sequence
atggcagaggcatccgtcgatgctagcactctacccgtaacagtgaagaaaaagaagagcctgagcatcgaggagaagatcgacatcatcaacgccgtagagtcaggcaagaagaaggcagagatagctgcagagtacggcattaaaaagaattccctctctagcataatgaagaacaaagacaaggtgttggaggcattcgagtccctaagatttgaccccaaaaggaagagattgcgcaccgctttctacacagacttagaggaagcactcatgcgatggtataggattgcccagtgtttgaatgtgccagtgaatggccctatgctccggctgaaggccaacgactttgcccagaagctaggccataacgacttcaaatgtagcaatggatggctggatcggttcaaatcacggtacggcctggttttccgcgcacagcccgtcgaggcgacaggtgttccagtggacccttccacagtgtggtatcagaatgttctcccctactacctgaatgattatcaccctaagaatgtgtttaatatcaaggagacaggactgctgtatcggatgttacccaccaatacatttgcattcaagggggaaacctgctccgtggggaaactgtgcaaggaccggataaccctcgtggtgggtacaaatatggacgggtccgagaagcttcccttgctggttattggtaaaaagcgcaccccacactgctttaaaggacttaagagccttcctgtgtgttacgaagctaaccgaatggcgtggatgactagcgacgtgttcgagcaatggatgcgtaaattggatgaagaatttcaggctcagcaaaggcgagtagtgatcttcgtggaatcctttcccgctcatcctgaggttaagaacctgaagagtatcgaactggccttcttcccttcctgcctgagttcaaaatgcatcgcaatgaaacagggagtgatcaagtccctgaagattaaatataggcactgcttgataaaaaagttcctcagcagtgtagagggctccaaggagttcacattttcccttctcgatgccgtggatacgctgcatctgtgctggagggcagtgacaccggaaaccattgtcaaatcctatgaggaggccggatttaaaagtcagaaaggcgagagcgacattacaaatgccgaaaaagacaccggcctagacctagtcgccgatgcattgggagcaggggtcgagttccctgagggcctgtcgatcgaggagtacgctgccttagatgatgaccttgaaacatgtgaagctgccccaaacggggatagcatatgtaccaaagagtctaagagtgatgagaccggattttatacttctgacgaagaggacgatgacgggagcccaggtacagaactgccactcccctctaagagtgaagccatcaccgctctggacaccctgaagaaatttctgaggtcccaagacatgaacgacggcctccaaaatagtttagctgatcttgaaaacttcattaactccttaagtccgaagtag

SEQ ID NO: 24611 - DNA, 1782 bp, Artificial Sequence
  Description of Artificial Sequence: Synthetic coding sequence
atggcctttcgtaaggcatacagcatcaaggacaagctgcaggctatagagcgcgttaaagggggtgaaagacaggcttctgtctgcagagacttcggcgttcctggcggaactttgaggggttggttgaaggatgagcccaaattgcggtggtttctggaacaattgggtggcgaggtgggaactcagcgaaagaaaatgcgtctagccaacgaggaagagattgatcgggcagtctacgcctggtttctcgcactaagacagcacggcgttcctctgagcgggcctctgattcaagcacaggccgaggctttcgccaggcaaatctacggccctgagtgcacctttaaagcttcccatgggtggttttggcggtggcaaaagcgacatggcattagtagccagagattctacggcgaagctggccctcctgccccaagtccagcccctggaccgcctgtaaaggaggaacctgcccttcctagtggagctgggccacttcctgaccgggctcccgcaccccctcctccagctgaggggggttacggagatgaacagatatatagcgcatcagtgaccggcttgtactggaagctgctacctgagcaagccgctcctcctggcgcaggcgacccaggcgcagggggatgtgggcgacgctggagaggcgatcgggtgactgtgctgcttgcggctaacctcactggtagccacaaactcaaaccactggtgatcggcaggctgcccgatcctccctcgctgaggcaccacaatcaggacaagttcccggcaagctatcgatactcccccgatgcatggctcagccgacccctcttacgtggctggtttttcgaagagtttgtgcctggcgttaagagatatctccggcgttcttgtctacagcaaaaagcagttctactggtcgcacatcccccatgtccctcccctgccgcttccatgcccgctctcgattcagaggatgcccctgtgagatgtagaccagaaccattagggcctccggaagagctccagaccccggatggagctgtccgagtgctgtttctgtctaaaggctcctccagagcccacatccctgccccactggaacagggagtagtggcagcgttcaagcagttatacaaacgcgagctgctacgcctcgccgtgtcctgtgcctctgggtctcctctcgattttatgaggagtttcatgctgaaagacatgctctacttggcagggctgtcttgggacctcgtgcaggctgggtcaattgaaagatgttggttgctcgggctcagggctgccttcgagccccgacccggagaggactctgcgggacagcctgctcaggctgaggaggcggcagagcattcacgggtgctgtccgatctgacccatctggctgctcttgcgtacaagtgcctcgccccagaggaggtagcagagtggttgcatctggacgatgacggcggacctcccgagggatgccgggaagaggtcggacctgccctgcctcctgccgcaccccctgctccagccagccttccatcagcgatgggcggtggtgaagacgaagaagaagccaccgactacggcggaacgtccgttcccaccgccggagaggcagtgagaggactggagacagcgctgagatggctcgagaatcaagaccctagagaggtgggacccctgagattagtgcagctgagatctctgatatctatggcacgaaggttaggtgggataggtcacacacccgcaggcccttacgacggggtgtag

SEQ ID NO: 24612 - DNA, 1929 bp, Artificial Sequence
  Description of Artificial Sequence: Synthetic coding sequence
atgtaccctgcagggcctcccgctgggcctgttccacgcaggggcagaagaccattgcccggaccacctgctcctgcaccggctccagtgccggcagcaaggcctcctccccctgctcccggacctagacctagagtggcagtgaaaatggcattccgcaaagcttattccattaaagataagcttcaggctattgagcgggtgaagggaggggaaaggcaggccagcgtgtgtcgtgacttcggagtgccaggcggaaccctgcgcggatggctaaaggatgagcctaagctgagatggttcctggaacagcttggcggtgaggttgggacacagcgcaagaaaatgcgcctggcaaatgaagaagagatagaccgagctgtctatgcgtggtttttggccctgagacagcatggcgttccactgtctggccctctgatccaagcacaggccgaagcttttgctaggcagatctatgggccagaatgcaccttcaaggcctctcacggatggttttggcggtggcagaagagacacgggatcagctcccagagattctacggggaagctggacccccagcccctagtccagctcctgggcctcccgtgaaagaggaacctgctctgccaagtggagctggcccattgccggatcgcgcacccgcacctccacctccggctgaaggtggatacggagatgagcagatctatagtgcttctgtgacggggctctattggaagctcttgcctgagcaggcggctccacctggtgcaggggatcctggagccggagggtgtggacgtagatggagaggcgaccgggtcactgtgttgctggctgctaaccttaccggctcccataagttgaagcctctggtgattggtcggttacctgatccgccaagcttgcggcaccataatcaggataagttccccgcatcataccggtactctcccgatgcctggttaagccggcctctcctgcgcggatggttctttgaggaattcgtgccaggtgtaaagcgctatttgagaaggtcatgcctgcaacagaaagcagtgttgctggttgctcacccaccttgtccttcacccgctgcatccatgccagctctcgactcagaggacgcacctgtgagatgtagacctgaacccctggggccaccagaagaactgcagacgccggatggtgccgtgagagtgctcttcctctccaagggatcctctagagcacatatccccgcaccactcgagcagggtgttgtggccgcttttaaacagctgtataagcgcgagttgctcaggctcgctgtgtcatgcgcgagcgggagccccctggacttcatgagaagtttcatgctcaaagacatgctgtaccttgctggactctcctgggacttggtgcaggcgggatccattgaaaggtgttggttactgggacttcgtgctgcttttgagccacggcctggggaggattcagcaggtcagccagctcaggcggaagaagctgcagagcattcacgtgtcctgagtgacctgacacacctcgccgctctggcatacaagtgcttggcgccagaggaagtggctgaatggctccaccttgacgatgatggaggcccacccgagggctgtagggaggaggtgggcccagccttgcctcccgcagccccaccggcaccagccagtctgccatcagctatgggaggcggtgaagacgaggaggaagcaaccgactacggtggcaccagcgtccccaccgccggagaagctgttagggggttggaaactgccctcagatggctagagaatcaggatccgcgtgaagttggccctctcaggcttgtgcagctgcgcagtctgattagcatggccagaagactcggtggcataggacacacaccagcgggaccatacgacggtgtgtag

SEQ ID NO: 24613 - DNA, 1566 bp, Artificial Sequence
  Description of Artificial Sequence: Synthetic coding sequence
atggcaaataagggtaacaaaaagcggcgtcaattttccttggaggagaaaatgaaggttgttggggcagtggacagtggcaaacgcaagggagatgtagccaaggaattcggcatcaccccctccaccctaagcaccttcttaaaggatagaaccaagtttgaggaaaaggtacgcgaggcgtctgtaggccctcagcgcaaacggatgcggtctgctctttacgatgatattgataaggccgtcttcgcttggtttcaggagattcacgctaagaacatcctcgtgaccgggtcagtgatccgcaaaaaggccctaaacctcgccaacatgctgggttatgataactttcaggcaagcgttggctggctcaatagattccgggaccgccacggcatagccctgaaggctgtttgccgggaggactcagataggcttatgaacggactggggattgacaaaatcaacgagtggcatgcaggcgaaataataaagctaattgccgattatagtcccgacgacatattcaatgctgatgaaacaggagtttttttccagctactgccccagcatacactggccgctaagggtgatcattgcaggggcggaaagaaggcaaagcagaggctgacggcacttttctgctgtaacgcttctggcactgaaaagatgaggcccctaatcgtcgggaggagtgctagccctcattgcctgaagaatatccattctctcccttgtgactaccgagcgaaccagtgggcctggatgacccgcgatctcttcaacgagtggttaatgcaagtggatgctcgcatgaagagagcagagcgccgaattctgctgctgatcgacaactgttctgcccataatatgctgccccacttggaaagaattcaggtgggctacctgccatcaaactgcaccgccgttttacagcctcttaatttgggcattatccacacaatgaaggttctgtatcagagccatctgttgaaacagattctgctcaaactcaatagctcggaagatcaggaggaggtggatatcaagcaggccatagatatgattgctgccgcttggtggtcggtgaagccatccaccgtcgtgaagtgctggcagaaggccggtatcgtgcctatggaatttgccgaatgtgacactgagagcgccgctagcgagccagacatcgccatagagaagttgtggcatactgttgcaatcgcaacgtgtgttccaaacgaagtgaatttccaagacttcgtgaccgccgatgacgatctcattatctctcaagacaccgatatcatacaagatatggtggccggagaaaacacatccgaggccggtagcgaagacgaaggcgaggtgtctttgccggaacagccgaaggtgactatcaccgaggccatttcctctgtgcagaaactgcgtcagttcctctctacatgtgtggacatacccgatgcgatcttcgggcagctcaatgggatcgacgagtacctgatgaaaagggtaacacaaactctcatcgattctaagattacggattttcttcaaaccaaatag

SEQ ID NO: 24614 - DNA, 1566 bp, Artificial Sequence
  Description of Artificial Sequence: Synthetic coding sequence
atggccaacaaaggcaataagaaacgacgccaatttagcctcgaggagaagatgaaggtggtcggtgctgtggatagtggaaaacgaaaaggcgacgtggccaaagagttcggtatcacaccttctacattatcaactttcctgaaagatcgcacaaaatttgaagagaaggtgcgggaggccagcgtgggccctcaacgtaaacgtatgcgcagtgccctgtatgacgacattgataaggcagtgtttgcctggttccaggagatccatgccaagaacattctggtcactgggagcgtgatacggaagaaagcactgaaccttgccaatatgctcggatatgataatttccaggcttctgttggttggctgaatcgttttagggacaggcatggaatagcattaaaggccgtatgtagggaagattctgatcggctcatgaatgggctgggtattgacaaaataaatgaatggcatgccggagaaataattaagctgatcgcagattactcaccagatgacattttcaatgctgacgaaactggcgtgttctttcagttgttacctcagcataccctggccgcaaagggggatcactgtcggggaggcaaaaaagctaaacagaggctgactgctctattttgttgcaatgcttccggcaccgagaaaatgcgccctctgatagtaggacgctcggcatccccccactgtttgaaaaatatccacagcctcccttgtgactatcgtgctaatcagtgggcctggatgacacgtgatctcttcaacgagtggcttatgcaggtcgacgctaggatgaaaagagcggagcgccgaatcctcctcctcatcgacaactgctctgcacacaacatgctgcctcatcttgagcggatccaagtgggatatttaccttcaaactgtaccgctgttttgcagcctcttaacctggggattatccacaccatgaaggtgttgtaccagtcccacttgcttaaacagatccttcttaagctcaacagctccgaggaccaggaagaggttgacattaagcaggccatcgacatgattgccgctgcttggtggtcagtcaagccaagcactgttgttaagtgctggcagaaggccggaattgtgcccatggaatttgctgagtgcgataccgagtcggcagcctctgagcctgacattgctattgaaaaactttggcacactgtggccatcgcaacatgtgtccccaatgaagtcaacttccaggactttgtgaccgccgacgatgacttgatcatttctcaggacacggatattattcaggacatggttgccggagagaacacctcggaggccggttccgaagacgagggcgaagtttcccttccagagcagcccaaagtgacaatcactgaggccatcagtagcgttcagaagctgcgccaatttctcagcacgtgcgtagacatccctgacgcaattttcgggcagttgaacgggatcgatgagtacctaatgaagcgtgtgactcagacacttatcgactctaagatcacagactttctccaaaccaagtag

SEQ ID NO: 24615 - DNA, 684 bp, Artificial Sequence
  Description of Artificial Sequence: Synthetic coding sequence
atgcctggctgccgcatttccgcttgtggacccggagcccaggagggcactgccgagcaacgctcccccccacccccttgggatcctatgccgagtagtcagcctccacctcctaccccaacattaaccccgacacccacccccggacagagcccccctctgccggacgctgccggagcaagtgctggagccgcagaagaccaagagcttcaaaggtggcggcagggcgctagcgggatcgcaggccttgctggaccgggtggtgggtctggggctgctgctggcgcaggcggaagagccctcgaactggctgaagctcgccgacgccttctggaggtggaagggaggcgccgtctcgtatcggagctcgagagccgagttcttcagcttcacagagtcttcctagcagcggaacttcggctggcacaccgcgcagagagcttgagcagactgtcagggggtgtcgcccaggcggaattatacttagccgctcatggctctcgcctgaaaaaggggcctcggaggggtcggagggggaggccccctgctctgctggctagtgccctcgggcttggtgggtgtgtaccttggggcgcaggccgtctgcgcaggggccatggccctgagccagattcacccttccgacgaagcccaccgagaggtcctgcgtccccccagcgctag

SEQ ID NO: 24616 - DNA, 153 bp, Artificial Sequence
  Description of Artificial Sequence: Synthetic coding sequence
tgaggacgtcctccagcactcctggccagcgctcttggcctgggaggttgtgtaccatggggcgctggacgtctgaggcgcggacacggtccggagcctgactcgccgtttaggcggagcccaccacgtgggccagcctccccgcagcgctag

SEQ ID NO: 24617 - DNA, 375 bp, Artificial Sequence
  Description of Artificial Sequence: Synthetic coding sequence
taccttctgcttgagtactgcgaaggaaacgatctcgatttttatctgaagcagcacaaactgatgagcgagaaggaggctcggtccatcgtcatgcagatcgtcaatgccctgaggtacttaaacgagattaagccacccatcattcactacgacctgaaacccggtaacatcctgctggtagacggtacagcatgcggcgagattaagataaccgatttcggtcttagcaaaatcatggacgacgactcttatggggtggacgggatggaccttaccagccaaggagcaggaacgtattggtacttgccacctgaatgtttcgtggtcggcaaggagccacctaagatttctaacaaagtagatgtatggtag

SEQ ID NO: 24618 - DNA, 1242 bp, Artificial Sequence
  Description of Artificial Sequence: Synthetic coding sequence
atgtctgtgcagagcagttctgggtctctcgaaggtccaccttcctggtcccagctcagtacttcacctactcccggttccgctgctgccgctagatctctgctaaatcatactcccccatccggtcgcccacgggagggggctatggacgagcttcactccctcgacccccgacgacaggaattactggaggctcgttttaccggagtcgcatctgggagcacaggctcaaccggtagctgttcggtgggcgctaaggcatcaacgaataacgagtcctccaatcactcattcggtagcctaggctcattgtcagacaaagaatcggagactccagagaagaagcagtcagagtcttcgaggggaagaaaaaggaaagcagagaatcaaaatgaatcctcacagggaaaatccattggtgggcgaggccataaaattagtgattactttgaataccagggtggaaatggatctagccctgtacgtgggattccaccggctattagaagcccccagaattcccattctcactccacgccatccagctcagtcagacctaattcacctagtccgacagcactggcttttggtgatcatccaattgttcagcccaaacagttatcttttaagattatccagaccgatctgaccatgctcaaacttgctgcactcgagtctaacaagatccaggatctggagaaaaaggaaggccgtattgatgatctcctgcgtgcgaactgcgatctgaggagacagatcgacgagcagcagaaacttctggaaaagtacaaagagaggctgaacaaatgtattagcatgagcaaaaagctgctgatcgagaaatctacacaggagaagctgtcatcaagagagaaaagtatgcaggacagattgcgactggggcattttaccaccgtgagacatggagcgagcttcacagaacaatggacagatgggtttgcgttccagaacttggtcaagcagcaggagtgggttaaccagcaaagggaggacatcgaacgacagcggaagctgttggctaagagaaaacctcccacagctaataacagtcaggccccatcgaccaattctgagccaaagcaaagaaaaaataaggccgtcaatggagcagagaatgatccattcgtccgcccaaatttaccgcagctgctgacacttgctgaataccatgagcaggaagagatctttaagctgcgacttgggcatcttaagaagagatag

SEQ ID NO: 24619 - DNA, 2301 bp, Artificial Sequence
  Description of Artificial Sequence: Synthetic coding sequence
atgtcagtccagagctcatctgggagcctggaagggcctccttcctggtcccagttaagcacttcgccaacacccggttccgccgctgcggctagatcactcctgaaccacacccccccatcaggacgcccacgtgaaggagctatggatgagcttcacagcctggatccacggcgacaggagttacttgaggccaggtttactggggtggcgtccggcagcaccggctccacggggtcatgttcagtgggagcgaaagccagcacaaacaacgaaagttccaaccatagtttcggatccctcggatcattgtcagacaaggaaagtgagacaccagagaagaagcagtcagagagttcccggggtcggaagcgcaaagccgaaaaccaaaacgagtcgtctcaaggtaagagcatcgggggtaggggacacaagatctctgactacttcgagtatcagggcggaaatggcagctcgccagtgcggggtataccacctgcgatcaggtcacctcagaattctcattcccacagcaccccaagctcaagtgtgagaccaaatagtccatcacctacagccctagctttcggtgatcacccgatcgtacaacccaagcagctgagctttaagatcattcagactgacctgaccatgttgaaactggctgctttggaatccaataagatacaggacttagaaaaaaaagagggcaggatagatgacctgttgcgcgcaaactgtgatttacgacgccagatcgatgaacagcaaaagctccttgaaaaatataaagaacggcttaataagtgcatttcaatgagcaaaaaactgctcattgaaaaaagcacccaggagaaactgtcatctcgggaaaaaagcatgcaggataggttgagactgggacatttcacaactgtgaggcatggggcatcattcacagagcaatggaccgatgggttcgcctttcagaacctcgtcaaacagcaggagtgggtgaatcaacagcgtgaagacatcgaaaggcaaaggaaactgcttgctaagaggaagcctcctaccgctaacaatagtcaggccccaagtactaacagcgaacctaaacaacggaaaaataaggccgtgaatggcgctgagaacgaccccttcgttcgccctaatctgccgcagctgctgacactcgctgaatatcacgaacaggaggaaatcttcaaactccgactggggcacctgaaaaaggaagaagctgaaatccaagcagagctggaaaggttggaaagagttcggaatcttcatatacgggaactcaaacgcattaacaatgaggataactctcagtttaaggatcaccccaccctcaatgagagatatctcctgctgcatcttctagggagggggggattctccgaagtgtacaaggcattcgatttgtacgaacagcgctacgcagccgttaagatccatcagcttaataaatcatggcgggatgaaaagaaagagaactaccataagcacgcatgccgcgagtacagaattcacaaagaattggaccatcccaggatcgtaaaattgtatgactacttcagccttgacaccgataccttttgtactgtcctggagtattgtgaaggcaatgatttggatttttacctgaaacagcacaagctgatgtcggagaaggaggctcggtcaattgtcatgcaaatcgtaaatgctctgaggtacctgaacgagatcaagccccctattatccactacgacctaaagcctgggaatatacttctcgtagacggaaccgcgtgtggtgaaattaaaataactgatttcggcctgtcaaaaattatggacgacgatagctatggagtggacggcatggacctcacctcccaaggcgcaggcacatactggtacctgcctccagagtgctttgtcgtcggaaaggaacctccaaagatctccaacaaggttgatgtgtggagcgtgggcgtcatctttttccagtgcctgtatgggagaaagcctttcgggcataatcaaagccagcaagacattctgcaggagaatacaatcctgaaggccacggaggtgcagttccctgttaaaccagtggtcagttctgaggccaaggccttcatacgaagatgtctggcctatcgtaaggaggaccgtttcgacgtccatcagctagccaacgatccttacctgctcccccacatgaggcgctctaacagtagtggaaacctgcacatggcagggttaacagcttctcccactcctccctcttcctctatcatcacatactag

SEQ ID NO: 24620 - DNA, 2013 bp, Artificial Sequence
  Description of Artificial Sequence: Synthetic coding sequence
atggccgtcttatttttatatgatctaaaaacaaccggaaagacccctgagaagaagcaatccgaatcttctagagggcgaaaaagaaaggctgagaaccagaacgagtccagccagggtaaaagtatagggggtaggggacacaaaatttccgattacttcgagtaccagggtgggaacggctcatcccccgttcggggaatcccccctgccatccgctcacctcaaaactcccacagccattctacaccatcctcctcggtgaggcccaactccccaagtcccaccgctctcgctttcggcgaccaccccatagtgcagcctaaacagctctctttcaaaattattcagactgatctgactatgctgaagctggcagccctcgaatcaaataaaatccaggacctggagaaaaaagaaggcaggattgatgacctgcttcgggcaaattgcgatctgcgccgtcagattgacgaacagcagaagttgctagaaaagtacaaggaacgtttgaataagtgcattagtatgagtaagaaattgcttatcgagaaatcaacccaagaaaaactcagctccagggaaaagagcatgcaagacaggctgcgcctgggtcatttcaccactgtcagacatggggcaagctttaccgaacaatggaccgacgggttcgcctttcagaacctggtgaaacagcaagagtgggtgaatcaacagagggaagatatcgaacggcagcgtaagttattggcaaagcgtaaacctccgaccgctaacaattctcaggcaccatccactaattccgaacctaagcagcgcaagaataaagctgtcaacggagctgagaacgatccgtttgtaaggccaaatttgcctcagctgctcacgctcgctgagtatcatgaacaggaagagatattcaagctgcggttggggcacctgaagaaggaagaggccgaaattcaggcagaacttgagagacttgaacgcgtgcgtaacctccatatccgggagctgaaacggatcaataatgaggacaattcccaatttaaagaccatcccacattaaacgagcgttacctcctcctccacctgttgggtcggggagggttctccgaggtttataaagccttcgatctctatgagcagcggtatgctgccgtgaagattcaccaactgaacaagtcctggagggatgagaagaaggagaattaccacaagcatgcctgtagagagtatcgcattcataaggagctggaccatcccaggatcgttaaactgtatgattattttagcctcgacacagataccttttgcacagtgttagagtactgcgaggggaatgaccttgacttttacctaaagcagcataagctcatgtccgagaaagaggccagatccattgtcatgcaaatagtgaacgcgctaaggtaccttaatgagattaagcctccgatcattcactatgatcttaaacctggaaacatactgctggtggatgggactgcctgcggcgagatcaagatcacagattttgggctgtctaaaatcatggatgacgactcctatggcgttgatgggatggacctcacgtcccagggggctggtacatattggtacctacccccagaatgtttcgttgtcggtaaggaacctcctaagatatctaacaaggtggacgtgtggtccgtgggcgttatattctttcaatgtttgtacggccgaaaaccattcggacataaccaatcacagcaggacatactccaggagaacactatactcaaggccactgaggtgcagtttccagtgaagcccgtggtttctagtgaagctaaggcttttattcgcagatgtttggcttaccgcaaggaggataggtttgacgtccatcagctggcaaacgacccgtatttactcccacatatgaggcggagcaacagttccggtaatctgcatatggctgggcttacagcgtcacccacccccccttcaagtagcattatcacgtattag

SEQ ID NO: 24621 - DNA, 2157 bp, Artificial Sequence
  Description of Artificial Sequence: Synthetic coding sequence
atggacgagttgcatagcttggatcctcggcgtcaagaactgttggaggccaggtttaccggggtggcttcaggaagcacaggaagtacgggcagctgctctgtgggggcaaaagcttctactaacaacgaaagttcaaaccattcattcggcagtctgggctctctgagcgacaaagagagcgaaacccccgagaagaagcagtctgaaagttctcggggtcggaagcgcaaggccgagaatcagaacgaatccagtcagggtaaatctattggcggacggggacacaaaatcagcgactactttgaatatcaggggggaaatggatcatccccagtgcgaggtatccccccagctattcgctccccccagaatagtcactctcatagcaccccaagttcttctgtgagaccaaactccccttcccccaccgctctcgcattcggagaccaccctattgtccagcccaagcaactctccttcaaaatcattcagaccgacttgaccatgctgaaacttgccgctttggagtctaataagatccaagacctggaaaagaaagagggtcgcattgatgatttactgcgtgcaaattgcgacttgcgcaggcagatagatgagcagcagaaactcctcgaaaaatataaagagaggctgaataagtgcatttcgatgtctaagaaacttctaatcgagaagtcaacacaggaaaaactctccagtagagaaaaaagtatgcaggaccgtctgcggctggggcatttcacgacagttagacacggcgcatcttttaccgagcagtggacagacggctttgcctttcagaatctggtcaaacagcaggaatgggtcaatcagcagagagaagacatcgaacgccagcgcaagctcctcgcgaagagaaaacctcccaccgctaataacagccaggccccatccacaaattccgaaccgaaacagcgcaaaaacaaggccgttaacggggctgaaaacgacccgttcgtgagacctaatttaccacagctgctcacactggccgagtaccacgagcaagaagagatcttcaagttgaggctggggcatctcaagaaagaggaggctgagatccaggccgaactggagcgactggagcgagtgcgaaatctgcatatacgagagctgaaaaggattaataacgaagataattctcagttcaaggatcacccaacacttaatgaacgataccttctcctgcacctgctggggaggggcggattctccgaagtttataaagcttttgacctttatgaacagcgctacgcggctgtcaaaattcaccagctgaataaaagctggcgggacgagaaaaaggagaattatcacaagcatgcttgtagggagtacaggattcacaaagaactggaccacccacggatcgtgaagttatatgactactttagcctcgacaccgatacgttttgtacggtgcttgagtactgcgagggcaatgacctggacttttatctcaaacaacataaattgatgtccgagaaagaagcaagaagtatcgtcatgcagattgtgaacgcgctacgttatctcaacgaaatcaagcctccaataattcactatgatttgaagccagggaacatactcctcgttgacggtactgcttgcggagagatcaaaatcaccgactttggcctgagtaagatcatggacgacgacagctatggtgtcgatggaatggatctgactagtcagggcgcagggacttactggtatctgccacctgagtgctttgtagtgggaaaggagcccccaaaaatctccaataaagtggatgtctggtcagtgggggtcatcttcttccagtgtctctatggccgaaaaccgtttggtcacaatcaaagccagcaagatatcctgcaagagaataccattctcaaggccactgaggtgcagttccccgttaagcctgtggtctcttctgaagccaaagctttcattaggaggtgtttagcctatcgcaaagaagacagatttgacgtgcatcagctcgccaacgacccttacctgcttccgcacatgcgaaggtcaaactctagcggcaacctgcatatggcaggactgaccgcatcacctactcccccttccagctccatcattacctattag

SEQ ID NO: 24622 - DNA, 2157 bp, Artificial Sequence
  Description of Artificial Sequence: Synthetic coding sequence
atggatgaattgcactcactggatcccagaagacaggagctattagaggctcggttcacaggagtggcctcaggatcaactggatctacaggcagctgtagtgtcggcgcaaaagcctccacaaacaatgaaagcagcaaccatagcttcggatcactggggtccctgtccgacaaggaaagcgaaaccccagaaaagaagcagagcgagagttcacgagggagaaaacgcaaagcggagaaccagaacgagtcatcacaggggaaaagcataggcggaaggggtcacaagatttcagattattttgagtaccagggcggaaacggatcttcacccgtgcgcggaattccgccagcgattaggagtccacagaattcccatagtcacagcaccccaagctcttcagtgaggcccaattcaccctcccctactgccctggccttcggggatcatcctatagtgcaacccaaacaactgtcctttaagattattcaaactgacttgactatgctcaagctggcggctttggaatccaataagatccaggatttggaaaaaaaagagggtcgaatcgacgatctgttgcgggctaactgcgatctgagacggcagatagacgagcagcaaaaactccttgagaagtacaaggaacgtctgaataaatgtatttccatgtctaagaagctgttgattgaaaagagcactcaagagaagctttcctcacgagaaaagtccatgcaggatcgcctaagactgggacacttcactacagtcaggcatggagcctccttcactgagcagtggactgacggatttgcttttcagaacctggtgaaacagcaggaatgggtaaaccagcagcgagaagacatagaaaggcagagaaagctgttggccaaaaggaaaccccctaccgccaacaatagccaggccccatccaccaattcagaacctaaacaaaggaagaacaaggcagtgaacggtgccgagaatgatccttttgttcggcctaacctgccccagctgctgacactagccgagtatcacgagcaggaggagatttttaaactcaggctgggacatctgaaaaaagaagaggccgagatccaggcggagctggaacggctagagcgagttagaaacttgcacatacgggagctcaaacgcatcaacaacgaggacaattcacagtttaaggaccaccccaccttaaatgaacggtatctgctgttgcacctcctcggcaggggtggctttagcgaagtgtacaaagcctttgacctttacgaacaacgctacgccgcagttaaaatccaccaattgaacaagagttggcgcgacgagaagaaggagaattaccacaagcacgcttgtcgagagtaccgtatccacaaggaattggaccacccaagaatcgtgaagctgtacgactacttcagtctagacacagataccttctgtaccgtcctggaatactgtgagggtaacgatcttgacttttacctgaagcagcataagctcatgtccgagaaagaagcaaggtccatcgtaatgcagatagtcaatgccctgcgctatctaaacgagatcaaaccccctataatccactacgatttgaaaccaggcaatatacttctggtggacggaaccgcgtgtggagaaattaaaataaccgacttcggactgtccaagatcatggatgacgactcatatggcgtggatggaatggacctcacaagccaaggggctggcacctattggtacctgcccccagaatgtttcgtggttggaaaggaaccaccgaagatttcaaataaagtggacgtgtggagtgttggagtcatcttctttcagtgcctctatggcagaaagccattcggccataatcagtcccaacaggacatcctacaagagaacaccatcctgaaagcaaccgaagtgcaattccctgtgaagccggtcgtgtcatctgaggctaaggcgttcatcaggagatgcctggcgtaccgaaaggaggataggttcgatgtacaccagcttgccaacgatccttatctgttgccacatatgcgtcgttctaatagctccggtaatctgcacatggcaggcctgactgcctctccaacacctccaagctctagtatcattacgtactag

SEQ ID NO: 24623 - DNA, 2319 bp, Artificial Sequence
  Description of Artificial Sequence: Synthetic coding sequence
atgatggaagaactgcactccctggacccccgacggcaggagttgctggaggccaggttcacgggcgtcggggtctcaaaggggcctttaaactccgaatcctctaatcagtccctgtgttccgtagggtcactgagcgacaaagaagtggaaactcctgagaagaagcagaacgaccagagaaacagaaaacggaaggccgagccatatgagacgagccaggggaagggcaccccgagagggcacaagatttccgactattttgaatttgcgggaggaagcgcccctggaacgtctcccggaaggtccgtgccgcctgtggcgagatccagtccccagcattctctgagcaatccattaccaagacgcgtcgaacagccgctgtatggtctagatggtagcgctgccaaagaggctaccgaagaacaaagtgctctcccaactctgatgagtgtcatgctggcaaaacctcgcctggatactgagcagctggcccagaggggagccggtctatgtttcacattcgtaagcgctcagcaaaacagccccagcagtaccggatctggtaatacagagcatagctgttcgtcgcagaagcaaatttcgattcagcacaggcagacacagagcgatctgaccatagagaagattagtgcgctggagaattccaagaattcggacctcgagaaaaaagaggggagaatcgacgatctccttcgagcaaactgtgatctacgtaggcagatcgacgagcaacaaaaaatgctcgaaaagtataaggaaagactgaatagatgtgttacgatgtcaaagaagctgctgatcgagaaatctaagcaggagaagatggcctgtagagataaatctatgcaggacaggctgagattgggacacttcacaactgtccggcacggtgccagtttcacagagcagtggactgacggctacgcctttcagaacctgataaagcaacaggagaggatcaatagccagagggaggagattgaacggcagcgcaagatgttggctaaaagaaaaccccctgcaatgggtcaagctccccctgccacaaatgagcagaagcaaaggaagagtaagactaatggcgctgagaatgagactccaagctcaggtaacacggaactgaaggacaccgcccctgccctaggggctcactctcttctgaggcttaccctcgcagaatatcacgagcaggaagagatttttaaactgagactggggcatctgaagaaggaagaagccgagattcaggctgagttggaacgacttgagagggttagaaatttacatatccgggagctgaaacggatacacaatgaagacaatagtcagttcaaagaccaccccaccctgaatgataggtatctcctcctacatttgctggggagaggcggattctctgaggtgtacaaggcattcgatctcacagagcagaggtatgtcgctgtgaaaattcatcagctcaacaaaaactggcgcgacgagaagaaggaaaactaccacaagcatgcctgcagggagtataggatacacaaggaacttgatcatccgcgaattgtcaaactttacgactacttctctctggatactgactcgttttgcacggttctggagtactgcgagggaaacgatctcgacttttacctgaagcagcataagctaatgtcagaaaaagaagctcgctctatcattatgcagatcgtgaatgcgctaaagtatctgaatgagattaagcctcccatcatccactatgatctgaagccaggcaacattctgctggtgaatgggactgcttgcggagaaattaagattactgacttcggcctttcaaagataatggatgacgattcctataatagtgtggacggcatggaactcacttcccagggcgctggaacatattggtatctgcccccagagtgctttgttgtggggaaggagcctcccaagatttccaataaagttgacgtctggagcgtcggagtgatcttttaccaatgtctgtacggccgtaaaccttttggccacaaccaaagtcagcaggatatcttgcaggagaatactatcctgaaagccacagaagtgcagttcccccctaagccagttgtcacccctgaggccaaggcatttatcaggcgctgcctggcctataggaaggaggatcgcatagacgtgcagcagttggcctgcgacccctatttgctgccccacatccggaagagtgtttccactagctcccccgcaggggcagccatcgcctccacctccggggcatcaaacaatagctccagcaactag

SEQ ID NO: 24624 - DNA, 2157 bp, Artificial Sequence
  Description of Artificial Sequence: Synthetic coding sequence
atgatggaagagctccactcactcgatcctagaagacaggagctgttagaggcacgatttacaggtgtcggagtgtcaaaagggcctctgaattccgaatcctccaaccagtctctttgcagtgtaggcagcttgtcagacaaggaggtggagacacccgaaaaaaaacagaacgaccagagaaatcggaagaggaaagctgagccctatgaaactagccagggaaaggggactcctcgcggacacaagataagcgattatttcgaacggcgtgtcgaacagccgttgtatggcctcgatggttcagctgctaaggaggctaccgaggagcagagtgcactccccaccctaatgagcgtcatgctggctaaaccccgactcgacaccgagcagcttgcgcagagaggcgctgggctgtgttttaccttcgtgtcagcccagcagaacagcccgagcagtacgggttccggcaacacggagcattcctgttcatcgcagaagcagattagcatccagcaccgccagacccagagcgatcttacaattgagaagatctctgccctggagaattccaagaactcggatttagagaagaaggagggcagaattgacgatttgcttagggctaactgtgacctgaggcgtcagattgatgaacagcagaagatgcttgaaaaatacaaagaacgattgaaccgttgcgtgaccatgagtaaaaaactcctgatcgagaaatctaaacaggagaagatggcctgtagggacaagagtatgcaggaccgtttacggcttggtcatttcactaccgtgcgacacggtgcttccttcaccgaacaatggactgatgggtacgcatttcagaatctgataaagcagcaggaaagaatcaactcgcagcgggaggagattgagagacagaggaagatgttagccaagcgaaaaccacccgcaatggggcaggccccacctgcaacaaacgagcagaagcagaggaaaagtaaaacaaacggagccgaaaatgaaacactgacccttgcagagtatcacgaacaggaagaaatcttcaaactgagactggggcatttaaagaaggaggaggcggagatacaggcagaactggagcgactggaaagagtgcggaatcttcacatacgcgaacttaagaggattcacaacgaagacaactctcaattcaaagaccaccccacattaaacgacaggtatctcttgttgcatctgctgggaagaggtggattcagcgaagtgtacaaggcgtttgatttgactgagcagaggtatgtcgcagtcaagattcatcagttgaacaaaaactggcgagatgagaagaaggagaattatcacaagcacgcttgtcgcgagtatcggattcacaaagagcttgaccatccgaggatcgttaagctctacgactacttctcactggacactgacagcttctgtacagtgttagagtactgtgagggaaacgacttagatttttacctgaagcaacacaagctgatgtccgaaaaggaggcgcgatctatcattatgcagatcgtaaacgcactcaagtatcttaatgagattaagccaccaattatccactatgatctcaaaccgggtaatatcctcttggtcaatgggacagcttgtggcgaaataaagataaccgattttggactttccaagatcatggatgatgatagctacaattccgtggatggtatggaactgacctctcagggcgctggcacgtactggtaccttcccccagaatgcttcgtcgtggggaaagaaccacctaagatttcaaataaagttgatgtatggtccgtgggcgtgatattctaccaatgtctgtacggcagaaaaccttttgggcataatcagtctcaacaggatatccttcaggagaacacaattttgaaagctacagaggttcagttccctcccaagccggtcgtcacccccgaggctaaagcttttattcgcaggtgtctcgcctatagaaaagaggacagaatcgacgtccagcaacttgcctgtgatccgtacctgctaccacacatacgcaagtccgtgtctacctcaagtccggctggtgctgctatcgcttcaacatccggagcctctaataacagcagtagcaattag

SEQ ID NO: 24625 - DNA, 2253 bp, Artificial Sequence
  Description of Artificial Sequence: Synthetic coding sequence
atgatggaagaactccactcccttgatcccaggaggcaggaactcctggaggcaaggttcaccggcgtcggcgtctccaaggggccactgaacagcgaatcatcaaatcagagcttatgttccgtgggatcgctctccgataaggaggtggagaccccagaaaaaaagcagaatgaccagagaaaccggaagcggaaagccgaaccttacgagacaagccagggcaaagggaccccgagaggacacaaaatcagtgactactttgaattcgccggtggctcagcccctggcaccagccctggcagatccgtgcccccagttgcacggtcttctcctcaacactcactgtcaaaccctcttcctcgccgtgtggaacagcccctgtatgggctggatggctctgccgctaaagaagcgacagaggagcagagtgctctaccaaccttaatgtctgtgatgctggctaagcccagactagacacagaacagctggcgcaaagaggagctggattgtgctttacctttgtgagtgcccagcagaactccccctcctctaccggctctggaaatacggagcacagctgttcgagccaaaagcaaatcagtatccaacatagacaaacacagtcagatctcacaatcgaaaagatcagcgcgctcgaaaactccaaaaactcagatctggagaaaaaggaggggcgtattgatgatctattgcgcgcaaactgcgatttgaggaggcagattgacgaacagcagaagatgctggaaaaatacaaagagcggttgaatagatgcgtgactatgtctaagaaactcttaatagaaaagagcaaacaggagaaaatggcctgccgggacaagagtatgcaggaccgcctgcgcctgggccatttcaccacagtgagacatggagccagttttactgagcaatggacggacggctacgcttttcagaacttgattaagcaacaagaaaggataaattcccagcgcgaagagatcgaacgtcaacggaagatgttagccaagcgcaagcccccagcaatgggtcaggcccctccagcaaccaatgaacagaaacagcggaaaagtaaaaccaacggtgcagagaacgaaaccctcactctggctgagtatcacgagcaggaggagatatttaagttgagactgggccacctcaagaaagaggaggccgagatccaggccgagctagaaagactggagcgcgtcagaaatctccatattcgcgagctaaagcgcatccacaatgaagataacagtcagtttaaggaccaccccacattgaatgatcgttaccttctcctgcacctcttgggtagggggggtttttcagaggtgtacaaagcattcgacctgacagaacagaggtacgtggctgtgaagatccatcagttgaacaagaactggagggacgagaaaaaggaaaactaccataagcatgcgtgccgggagtatcgtatccacaaggaactcgatcacccaaggattgtgaagctctatgattacttttctctcgataccgattcgttttgtacagtgctcgaatattgcgagggtaatgacttggatttttacttaaaacagcataagctcatgagcgagaaggaagctcggagtataataatgcaaatcgttaacgccctgaaatacctgaacgaaatcaagccccctatcattcattacgatctgaaacctggaaacattctactcgttaatgggacagcttgcggcgagattaaaataactgattttggactgagcaagataatggacgacgatagttataattctgtggacggaatggaactcactagtcagggagctggaacttactggtacctgccccctgaatgttttgtggtgggaaaagagcctcccaagattagtaataaagtggacgtgtggtccgtgggtgttattttttaccaatgcctctacggcaggaagccctttggccacaaccagtctcagcaggacatcctgcaggagaatactatcctgaaggccaccgaggtccaattcccaccaaaaccagtcgtgactcctgaggccaaagcatttattagaagatgtttggcctacagaaaagaggaccgaattgatgtgcagcagttagcctgcgatccttacctcctgccacatatacgaaaaagtgtctccacctcgagtcccgcaggggctgcaattgctagtacgagcggtgctagcaacaactctagctctaattag

SEQ ID NO: 24626 - DNA, 2157 bp, Artificial Sequence
  Description of Artificial Sequence: Synthetic coding sequence
atgatggaagagcttcattcacttgatccacgaagacaggagctgttagaagcgaggttcactggagtgggggtgagtaaaggcccattaaattctgaatccagcaaccagagcctttgttcagtgggctctttgtcagacaaagaggtagagacccccgaaaaaaaacagaacgaccagcgcaatcggaagagaaaggccgaaccctacgagaccagccagggaaaagggactccccgaggtcacaaaatcagcgattacttcgaaaggagggtggagcaaccactctatggtttggacgggagcgcggcaaaagaggccacggaagagcagagtgctctgcctaccctcatgagcgtgatgctcgccaagccacgactagacaccgaacagctcgcccagcgtggggctggcctgtgctttaccttcgtctccgcacagcagaactccccgtcttccaccgggagcggtaatacggagcactcctgcagttcacagaagcaaatcagtattcaacaccgacagactcagtcagacctgacaattgagaaaatctccgcgctggagaactctaagaactctgacttggaaaagaaggaggggaggattgacgacttgctaagggccaactgcgacctccggagacagatagacgagcaacagaagatgttggaaaaatacaaagaacggttaaatcgatgcgtgaccatgagcaagaagctgctgatcgagaaaagtaagcaggagaaaatggcttgcagggacaaatcaatgcaggatcgcttacgcctgggccacttcacaacagtacgtcacggcgcatctttcacggagcaatggaccgacgggtacgcattccagaatctcataaagcagcaggagcgcattaacagccagcgtgaggaaattgagagacagagaaaaatgttagccaagcgaaagccccctgcgatgggacaggcgccacctgccactaatgaacagaagcagagaaaatccaagacaaatggagcggaaaatgagaccctgaccctcgcggagtaccacgagcaagaggagattttcaagctgcggttggggcacctcaaaaaggaagaggctgaaatccaagccgaactcgagagactggagcgagttaggaatctgcacattcgggaactgaaaaggatccataacgaggacaatagccagttcaaagaccacccaacactcaatgatcgatatctgctgttacatctcctaggccgaggcggattcagcgaagtgtataaggcattcgacctgactgagcagcgctatgtcgcagtgaagatccatcagttgaataagaattggagagatgagaagaaggagaattaccataaacacgcatgtcgcgagtaccgcattcataaggagttggatcatccgagaatcgtcaagctgtatgattacttctccttggataccgacagcttttgcactgtcctcgagtattgtgaggggaatgatctagacttttacctgaaacaacacaagctgatgagcgagaaggaagccagatccataatcatgcagatcgtgaatgccctgaagtacctgaatgaaattaagcccccaatcattcactacgatttaaagcctggcaacatcctgctcgttaacggaacggcttgtggggaaattaagattaccgactttggcctaagcaagattatggacgatgatagctataactcagtcgatggaatggagttgacttcacaaggagcagggacttactggtacctacctcccgaatgctttgtggtgggtaaggagccaccgaaaatctccaataaagtggatgtctggagcgtgggtgtgatcttctaccaatgcctgtacggcagaaagcccttcggacataaccaatctcagcaagatatactgcaggagaacacgatcctgaaggccactgaagtccagtttccccctaaaccagtggtgacccccgaagccaaggctttcatcaggcgttgcctggcctacagaaaagaggatcgcatcgatgttcagcaactggcctgcgatccctacctcttgccacacatccggaaaagtgtcagcacgtccagtcccgcaggcgctgctatcgcgtcaacatccggtgccagcaacaattctagcagtaattag

SEQ ID NO: 24627 - DNA, 1521 bp, Artificial Sequence
  Description of Artificial Sequence: Synthetic coding sequence
atggacgtgaggctgtatcctagcgcgccagcagttggggcaaggcccggagccgagcctgcgggactggctcacctggattactatcacgggggaaaattcgatggcgactcggcgtacgtggggatgtcggatggaaaccccgagctgctgagcacctctcagacctataatggacagagtgaaaataacgaggactatgagataccacctatcacacccccaaacctgcctgagcccagtctgcttcacttgggggaccacgaggcttcatatcactccttatgccatgggttgacccccaatggactcctacccgcttactcctatcaggcaatggacctgccggcaattatggtgagcaacatgctggctcaagactcccacctgttgtccgggcagttgcccaccattcaagaaatggtacatagcgaggtcgcagcctacgacagcggacgtccgggacccttgcttggccgaccagccatgctggcaagccatatgtccgcactgtcacagagtcagctcatatcacagatgggtatccgctcttcgattgcccacagttcccccagcccaccgggttctaagtccgctacaccatctccctcctcctctacacaggaggaagaaagcgaggtgcactttaaaatttccggagagaaaaggccatccgctgatcctggaaaaaaagccaagaatccaaagaagaaaaaaaaaaaggacccgaatgaaccccagaaacctgtttctgcgtacgctctgttctttagggacacgcaagcagccatcaaaggccagaatcccagcgctacattcggtgacgtgtcaaaaattgtggcatcgatgtgggacagcctgggggaggaacagaagcaggcttataagaggaagacggaggcggcaaagaaggagtaccttaaggccttggcggcatatcgggcttccctggtgtccaaatctagtccggaccagggggagacaaagagcactcaagcgaatccccctgcgaagatgcttcctccaaagcaaccaatgtatgctatgccgggtcttgcaagctttctcaccccctctgacctgcaggcattccgttctggggcttccccagcctccctggccaggacactcggatcgaaatctctgctgcccggactgtccgcctcaccccctcctcctccaagcttccccctttctccaactcttcatcagcagctttctcttcctccacatgcccagggagccttgttgtcaccccctgtcagcatgtctcctgcaccacagccaccagtgttgccaaccccaatggccctgcaggtgcaacttgcaatgtctccatcgccccctgggccacaggactttcctcacatttcggaatttccctccagtagtggttcatgtagtcctgggccttcgaaccctacgtcatcaggtgactgggattcttcataccctagtggtgagtgcgggatctccacatgctccctgctgcctcgcgacaagtctctttatcttacttag

SEQ ID NO: 24628 - DNA, 1467 bp, Artificial Sequence
  Description of Artificial Sequence: Synthetic coding sequence
atgcaacagactcgaaccgaggctgtggcaggggcattctctagatgtctcggattttgtggcatgagactcggcctgcttctgttagcgcgtcactggtgtatcgcaggggtatttccacagaaattcgacggtgactctgcttatgtcggcatgagtgatggaaaccccgagctccttagtacgtcccagacatataacggccagtccgagaataacgaagattacgagatccccccaatcacaccacccaatctccctgaacctagtctattgcatttgggcgaccacgaagcatcttaccactcactttgtcacgggctcacccctaatgggcttctacctgcatatagttatcaggccatggacctgccagctataatggtgagcaacatgctcgcccaggattctcatctgttgtcgggtcagctgccaacaatccaggagatggtgcactccgaggtggctgcgtacgacagcggcagacccggaccacttctcggacgccctgcaatgctggcaagccacatgagcgcactatcacagtcacaattaatctcccaaatggggatccgctccagcatcgcccatagttcaccctcccccccaggatctaaatcagcaaccccctctcctagctcatctactcaggaggaggagtccgaggtccactttaaaatcagcggggaaaaacggccaagcgcagatcccggtaagaaggcaaaaaatcccaaaaaaaaaaagaaaaaagaccctaatgaaccccagaagccggtatctgcatacgcattattttttcgcgacacgcaggcagcaattaagggacaaaatccaagcgcaaccttcggagatgtgtccaagatcgtcgccagtatgtgggactcccttggggaagagcagaagcagtcctctccagaccagggagaaacaaagagtactcaagcgaatccaccagcaaaaatgctccctccgaagcagcccatgtatgcaatgcccggactcgcttcattcctgacgccttccgatctgcaagcgttcaggtctggcgcatctccagcctcgctcgccaggacactgggaagtaaatcactgcttcccggtctgtccgcgagtcctccccctccgcctagttttccgctgagtcctacccttcaccagcagttgtctctgcctcctcatgcccagggagcgctgctcagccccccagtgtctatgagtccggcaccccagcctccggttttacccacacccatggcactccaggtccaactagcgatgagtccctccccacctggaccccaggatttcccacacatcagcgaatttccgtcatctagtggctcatgttctccaggcccatctaaccccacgtcctccggtgactgggactcctcttatccttctggcgagtgtgggatctctacatgtagcctgttgccacgtgacaagtctctctacctgacctag

SEQ ID NO: 24629 - DNA, 591 bp, Artificial Sequence
  Description of Artificial Sequence: Synthetic coding sequence
aggcgaagacgcaaacggaggactccaatgagccgacgtagtctgtgtcgccctacccactcctcctccgagacactccggcctccctccagagtgcgaacgccagtccctctttctgtgacctgtcccaaatcatggcccccttgcggaaccgcctgggaacgcaaccgcagccgcacctctaggacctcccttagcagtccagctgcacgagacccagcccacctcgcccacccaactccacctgctgcaggcacagggacggctgcaactcccgtgggttctgtcgccagcgctcctgccgcttgttccccagggactaacaggtccacatctccaaaccctgcctcgctgccttctctaaggctggcagggagacactgctctgaaccagagggcctgactgcagaaaaacggccttggcccgaagccggatggccaatcggagagagtagcgataccccaatcgcccgtgggttatctctctttcttaatcttccccctgactctgcagaggctgcccactgcccacctcccgctcagagaacctgtcggaatctcccccctgctgaccttctggctcccggttag

SEQ ID NO: 24630 - DNA, 1395 bp, Artificial Sequence
  Description of Artificial Sequence: Synthetic coding sequence
atgtctgacgggaacccggagttattgagcacatcccagacatacaatggccagtcagaaaacaacgaggattacgagattccacccatcacccctccaaaccttcctgagcctagcctgctgcacctaggagaccatgaagcctcctaccatagcctgtgtcacggactcactcctaatggactgttgcctgcctactcttatcaggccatggacctacctgctatcatggtttccaacatgctagcacaggactcccatctgttgtctggtcagctccccactatccaagagatggtgcacagtgaagtagccgcttatgatagcggacgaccgggacccctgttaggcagacctgcaatgctggccagccatatgtctgcgctgtcccagtctcagcttatctcacagatgggcatcagaagtagcattgcacactcttccccatcacctccagggtccaagagcgcgacaccaagtccctcttcttctacgcaggaggaagaaagtgaagtgcacttcaaaatctccggtgagaagcgccctagtgcagaccccggaaaaaaggctaagaatccaaagaaaaaaaagaaaaaggatcccaacgaaccgcagaagccagtgtccgcctacgccctgttcttccgagacacccaggcggcaattaagggacagaacccatcagcaacttttggggatgtaagcaaaatagttgccagcatgtgggattcactgggcgaggaacagaaacaggcttataaacggaagacagaggcagccaaaaaagaatacctgaaagccctcgcagcctaccgtgcaagtctggtgtccaagtcttccccagatcagggcgagaccaagtccacccaggctaacccaccagccaaaatgttgccacctaaacagccgatgtatgcaatgccaggactcgctagctttctgaccccttctgatctccaggcatttaggtcaggggctagccccgcatcactggcccgaacacttggtagtaagagcctccttccagggctgagtgcgtctccacctccaccccctagctttcccctgtctcctacgttgcaccagcagttgtcccttccccctcatgcccaaggcgctttactgtcccctcccgtgtcaatgagcccggctccccagccacctgtcttgccaacacccatggccctgcaggtgcagctggctatgtccccgtctccccctggtccacaggatttcccgcacatttctgaatttccaagttcctccggcagctgcagcccaggtccaagcaaccccaccagctcgggagactgggacagctcctacccttcgggcgagtgcggtatttcaacatgttctctgctcccacgcgataaaagcctgtatcttacatag

SEQ ID NO: 24631 - DNA, 591 bp, Artificial Sequence
  Description of Artificial Sequence: Synthetic coding sequence
cgacgcagacgcaaaagaagaactcctatgagtagacggagcctctgtcggcctacgcacagttcatccgaaacactgcggccaccctctagggttaggaccccagtgccactgtctgtcacttgccccaagtcttggcccccttgtgggactgcgtgggagcgtaaccggtcgcgcactagtaggacaagcttgagctcccccgctgctcgggatcctgcccacctggcacaccccacacctccagcggcaggtaccgggaccgctgcaactcctgtgggaagcgtggcgtctgcccctgcagcctgtagccccggaactaatagatctacatctcccaacccagcctccttaccatctctgaggctcgctgggagacactgcagtgaacccgagggcctaacagctgagaagcgaccttggccggaagcaggctggccgattggagagagctccgacacccctatcgccagaggactgagcctctttctgaaccttcctcctgattctgctgaggccgcacactgtcctcccccagcgcagagaacatgtaggaacttgcccccagcggacctcctcgcaccgggatag

SEQ ID NO: 24632 - DNA, 1395 bp, Artificial Sequence
  Description of Artificial Sequence: Synthetic coding sequence
atgtccgacggcaatccggaactcctctcaacatctcaaacttacaatggacaatccgaaaataatgaagattatgagatcccccctataacaccaccaaatctgcctgagccatcactgctccatcttggcgatcatgaggcatcctaccacagtctgtgtcatggcctcacccctaatgggctgttgcctgcctattcttaccaagcaatggacctgccagcaattatggtctccaatatgctggctcaggacagccatctcctgtctggccagctgccaactatccaagaaatggtgcacagcgaagtcgccgcatatgattctggacgtcccggtcctttgctgggccgaccggcaatgctggcatcccatatgtccgcactgtcgcagtctcagcttataagccagatgggaattcggtcgagtatagcacacagctccccatcacctccaggcagcaaatctgccaccccctcgccttcatcgtccacccaggaggaggagtcagaggtgcacttcaagatctccggcgagaaacggccatccgccgacccagggaagaaagccaagaatccaaaaaagaaaaaaaagaaagaccctaacgagccgcagaagccagtgtcggcctatgcactcttcttccgcgacacccaggccgctatcaaaggtcaaaatccctctgccacgttcggagacgtcagcaagatcgtcgcctctatgtgggattccttaggggaggaacagaaacaggcctataagcgtaagaccgaggcggcaaagaaagaatatctaaaagctttagcagcgtaccgcgcttccttggtcagtaaatccagccctgatcaaggtgagaccaagtccacgcaggccaaccccccagccaaaatgttgccccctaagcagcccatgtatgcaatgcccggacttgccagtttccttactccatccgatttgcaggcattccgcagcggggcatcaccagcttcactggctcgaactttggggagcaagagtctccttccgggactatccgcctctcctccccctccaccctcctttccattgtcacccacgctgcatcagcagctgtccttgccaccacatgcccagggggctctgttatcacccccagtttctatgtctcctgcccctcagccgcctgtgttgcccactcccatggccctccaggtgcaattagccatgtcaccatctccccctggccctcaggactttcctcacattagcgagttccccagctcaagtggctcctgcagccccggtccttccaacccaacgtctagcggcgactgggattcctcttacccatccggcgaatgcgggatctccacttgctctctgcttccgagggataagtctctctacctcacttag

SEQ ID NO: 24633 - DNA, 1155 bp, Artificial Sequence
  Description of Artificial Sequence: Synthetic coding sequence
atggaacaggagagggagggcttcagcgaggaggtgactttccagatccaagagatggtccacagtgaagttgccgcttatgacagcggacgccctgggcctttattaggaagaccagctatgctcgcttcgcacatgtcagcactgtcccagtcccagctcatcagccagatggggatccggtcaagcattgctcattcatccccaagcccccctggctcgaaatccgccacccctagcccatcctcctctacacaggaggaggagtcagaagttcacttcaagatctccggggagaaaaggccaagcgccgatccgggtaagaaagccaagaatcccaagaaaaagaagaaaaaggatccgaacgagccccagaaacccgtttctgcctacgctctgtttttcagagatacacaagctgctatcaagggccagaatcctagcgcaacttttggtgatgtaagtaaaatagttgccagtatgtgggatagcctgggggaagagcagaagcaagcttataagcgaaagactgaggctgctaagaaagaatacctaaaagctctcgccgcatatcgggcatctttggtctccaagtcttctccagatcagggagaaactaagagcacccaggcaaacccgcctgcaaaaatgctgccccctaaacagcctatgtatgcaatgccagggctcgcatctttcctaaccccaagcgatctgcaggcgttcaggtctggcgcatcaccagcctcccttgcacggacattggggtcgaaatctctgctgccaggcctctctgcttcacccccaccccctcccagtttcccgctgagccctacattgcaccagcagttgtcactgccgcctcacgcccagggcgctcttctgtccccacccgtgtcaatgtcccctgccccacaacctcccgtgttaccaacaccaatggctttacaggtgcagctggcaatgtctccttcaccacccggtcctcaagacttccctcacataagtgagtttccatcttcgagtggaagttgttctcctggcccatccaacccgacctcatctggagattgggatagcagttatccgagtggagagtgtggtatcagtacctgctcactactccccagggacaaatcactgtacctgacctag

SEQ ID NO: 24634 - DNA, 537 bp, Artificial Sequence
  Description of Artificial Sequence: Synthetic coding sequence
atgtcagatgggaaccctgagctgctgagcactagccaaacatacaacggccaatcagaaaataatgaagattacgaaatacctcccatcacgccgccaaacctccctgagcccagcttgctgcacttgggagaccacgaggcgagttaccacagcctgtgtcacggcctgacccccaatggcctgttgcctgcctattcttaccaagccatggacctgccggctatcatggtctctaacatgctagctcaggattcccacctgttgagcggccaactcccaacaatccaggagatggtccactcagaagtggctgcctacgactccggcagacctggccctcttctcggaaggcccgctatgctcgcgagtcatatgagcgctctgagtcaatcacagctgatcagtcaaatggggatccgatcctccatcgcccatagttcaccgagccctccaggatccaagagcgctacccccagtccctcttcttccactcaggaagaggaatctgaggtgcactttaaaatctccggctag

SEQ ID NO: 24635 - DNA, 366 bp, Artificial Sequence
  Description of Artificial Sequence: Synthetic coding sequence
atggccgctgccagagccacaaccccggctgatggggaggagcctgcacctgaagcagaggcgctcgccgctgcacgagaaaggtccagccgatttttatccggcttggagctggtcaaacagggggcagaagcacgcgtgttccgtgggcgattccaggggagagctgcggtaattaaacaccggtttcctaaaggatatcgacaccccgctcttgaggctcggctgggaaggagacgtacagtccaggaagctcgcgcactactgcggtgccggagggcaggcaaggagtaccttcctcagttatctttcttatggacgatgttacctactgcctacatttggaaaaaactgaaggctcagtag

SEQ ID NO: 24636 - DNA, 762 bp, Artificial Sequence
  Description of Artificial Sequence: Synthetic coding sequence
atggctgccgctcgggcaactaccccagccgacggggaggaaccagcgcctgaggctgaagctctcgctgccgcacgagagcgcagctcacgctttctgtctggcctagagcttgttaagcagggagcagaggctagagttttcaggggcaggttccaggggagagccgctgtcataaagcatcgatttccaaaggggtacagacatcccgctcttgaagctcgcctgggtagacgcagaacggtccaagaagccagagctctactgaggtgccggagggccggtatttccgcgcctgttgtcttctttgttgattacgcatcgaattgcctgtatatggaggagattgagggctctgtcactgtgcgtgattatattcaaagtactatggagactgagaagacaccccaaggactgtccaacctagcgaagaccatcggccaagtgttagcaaggatgcatgatgaggatctgatccatggcgacttaacgacgtctaacatgttgctcaaacctcctctggagcagctcaatattgtgctgattgacttcggtttaagctttatctctgcactcccggaggataagggtgttgatctgtacgtacttgaaaaagccttcctgtcaacgcatcctaacacagaaaccgtttttgaggcttttttaaagagctactccacatctagtaaaaaagcgcgtcccgtgcttaagaaattagacgaagtgcggctgcggggtaggaagcgctcaatggtgggctag

SEQ ID NO: 24637 - DNA, 1146 bp, Artificial Sequence
  Description of Artificial Sequence: Synthetic coding sequence
atgatttctgcccacagaaaactctgcctcccgggtagcagcaactccccggcttccgcgtttagagtggccggtaccacagccgtgaagatgagcgacaagaaccagattgccgctcgcgcaagtctcattgagcaactcatgtccaaaaggaattttgaagacctgggtaaccatctgactgagcttgagactatctacgttacaaaggaacatcttcaagagactgatgtggtcagagccgtgtatcgcgtgctcaagaattgcccctcggttgcgctgaaaaaaaaggccaagtgcctcctgtccaagtggaaggcagtgtataagcagacccacagcaaggctaggaactcaccaaaactgttcccggtgagaggtaacaaagaggagaactcgggtccctcacacgatccctcccaaaacgagacgctgggcatctgctcttctaattctctcagctcacaggacgttgccaaactgagcgaaatgatcgtgcccgaaaacagagcaatccaactaaagcccaaggaagagcacttcggcgacggtgaccctgagtccacgggtaagcggagctctgaactgctcgacccaactacccccatgcggacaaagtgtattgagctgctttatgcagctctcacaagcagctccaccgaccagcctaaagctgatctgtggcagaatttcgccagagagatcgaggaacacgtgtttactctgtactccaagaacattaaaaagtacaaaacatgtatccgcagtaaggtggcaaatctaaaaaatcccagaaatagccatctccagcagaatctgctctctggaactacttcaccaagagagttcgccgaaatgacggtgatggagatggctaacaaggagcttaaacagctgcgggcatcctacacagaaagctgcattcaggagcactacctccctcaggtcatcgacggcactcaaactaacaagatcaagtgtagacgctgtgaaaagtacaattgcaaagtaacggtgatcgatcgcggaacgctctttctgccttcttgggtaagaaacagtaaccctgatgagcagatgatgacctacgtgatatgcaacgaatgtggcgagcagtggtatcacagcaaatgggtctgttggtag

SEQ ID NO: 24638 - DNA, 1056 bp, Artificial Sequence
  Description of Artificial Sequence: Synthetic coding sequence
atgtcggacaagaatcagatcgccgcacgagccagcctgatagaacagcttatgtcaaaacgcaatttcgaggatctcggcaatcatttgactgaactggaaaccatctacgtaacaaaagaacatttgcaggagacagatgttgttcgagcagtctatcgagtgcttaaaaattgtccctccgttgcgctgaagaagaaggcaaaatgtttgctgtccaaatggaaagccgtttacaaacagacccattcgaaggccaggaattcacccaaactgtttcccgtgcgcggtaacaaagaggagaacagtggaccatcccatgacccaagccaaaatgagaccttaggaatctgtagctccaattctctgtcatcacaagacgtggctaagttaagcgagatgatcgtccccgagaaccgagccattcagctgaagcccaaggaggaacactttggcgacggagatcccgagtcaactgggaagcgatcctctgagctactggacccaacgactccgatgcgtacaaaatgcatcgagctactgtatgccgctctaacatcctcgtccaccgaccagcctaaagcagatctgtggcaaaatttcgcccgtgaaatcgaggagcacgtctttactctgtattccaagaacattaagaaatacaaaacttgtatacgcagcaaagttgccaacctcaagaatccacggaattcgcatctgcagcagaacttacttagtgggacaacttctcctagggagttcgcagagatgaccgtgatggagatggctaataaggagttgaagcaattacgcgcatcttataccgaatcatgtattcaggagcattatctccctcaggtgatcgacggaacacagaccaacaagataaagtgccgtcggtgtgagaagtacaattgtaaggtcaccgtgatagataggggaaccctgtttcttccatcttgggtgcgaaattccaacccagatgagcagatgatgacctatgtgatctgtaacgaatgtggcgagcagtggtaccatagcaagtgggtgtgctggtag

SEQ ID NO: 24639 - DNA, 1056 bp, Artificial Sequence
  Description of Artificial Sequence: Synthetic coding sequence
atgtcggacaaaaaccagattgcggctcgggcaagtttgattgagcaattgatgtccaagagaaatttcgaagatctgggcaatcacctgactgagttagagaccatctacgtcacaaaagagcatcttcaggagaccgatgttgtgcgggctgtttacagagttcttaagaattgtccttccgtagccctgaagaaaaaggcgaaatgcctcttgagcaagtggaaagccgtctataagcaaacacattccaaagcccgaaattctccaaagttattcccagtacggggaaataaagaggaaaatagcggtccaagccatgacccaagccagaatgagacattgggtatttgctcttccaattccctctcctcccaggacgtggcaaagctatctgagatgatcgtacctgagaacagagccatacagctgaagcccaaagaagagcactttggagacggagatccggagagtacaggcaaacgcagttcggaattgctggatccaaccactcccatgaggaccaagtgcatcgaactgttgtatgctgcgctgacgtcgtcgtcaaccgaccagcctaaggcagacctgtggcagaactttgccagggagattgaggagcacgtgttcaccctgtacagcaagaatattaagaaatataagacatgcattaggtcaaaggtggctaatctgaaaaaccctcggaactcgcatttacagcaaaatctgctaagtggaaccacctctcctagagaatttgctgaaatgaccgtgatggaaatggcaaacaaggaactcaagcagctgcgcgcatcgtatacggagtcttgcattcaggaacattacctgcctcaggtgatcgacggaacacagaccaataaaattaagtgtcgtaggtgcgagaagtacaattgcaaagtgaccgtcatcgataggggaactctgttcctaccgtcgtgggtgagaaattcgaatcctgacgagcagatgatgacatacgttatctgtaacgagtgtggggagcagtggtatcacagcaagtgggtctgctggtag

SEQ ID NO: 24640 - DNA, 1056 bp, Artificial Sequence
  Description of Artificial Sequence: Synthetic coding sequence
atgagtgataaaaaccagattgctgcaagggcgagtctgatcgaacagctgatgagcaaacgcaactttgaagacctaggaaatcacttaaccgagctcgaaaccatatacgtcaccaaggagcacctccaggagactgatgtcgtcagggccgtctacagagtcctgaaaaactgtcccagcgtagcactaaagaagaaagcaaagtgcctgctgtcaaaatggaaggcggtctataagcagactcattccaaggccagaaatagccccaagttatttcctgtacgaggtaacaaggaagaaaatagcggtccctctcatgacccgtcccagaatgagactttgggtatttgctcatccaactcactctcttcacaggacgttgccaagttgagcgagatgattgtgccagagaacagggcgatccagttgaagcccaaggaggagcactttggcgatggggatccagagtcaaccggcaagagaagcagtgaactgctcgacccaacaacgcccatgcggactaagtgcatcgaattattatacgccgcacttacctcctcttctaccgatcaaccaaaagcggacttgtggcagaactttgcccgtgaaatcgaggagcacgtgttcaccttgtattctaaaaatattaaaaagtataagacatgcatacgttctaaggtcgcgaatttaaagaaccctagaaatagtcatctgcagcagaacctcctttccggaacgacatcccccagggaatttgccgaaatgacagtgatggagatggctaacaaagagctgaagcagctcagggcttcgtatacagaaagctgcatccaggaacattaccttccccaggttatcgacggcacgcagaccaataagataaagtgtagaagatgcgagaaatataactgtaaagtgacagtgattgatcgaggcactctgtttctgcctagttgggtcagaaattcaaatcctgacgaacagatgatgacatatgtgatctgtaatgaatgtggtgagcagtggtatcactctaaatgggtgtgctggtag

SEQ ID NO: 24641 - DNA, 1476 bp, Artificial Sequence
  Description of Artificial Sequence: Synthetic coding sequence
atgaaaacattcacctggaccctgggcgtgctgttttttctgctggtcgacacaggccattgtaggggcggacagttcaaaatcaaaaagattaatcagagacggtacccgcgagctacggatgggaaggaggaggccaaaaaatgtgcatacaccttcttggtgcctgaacagagaattaccggccctatctgtgtgaatacaaaggggcaagacgctagcaccattaaagacatgatcacacgcatggaccttgaaaatttgaaggacgtcctgagtcggcaaaagagggaaattgacgtcttacagctcgtcgttgacgttgatgggaacatcgtgaacgaagtgaagctgctgcgcaaagaaagcaggaacatgaatagtcgtgtcacccagctgtatatgcagcttctccacgagattataagaaagcgcgacaattcgctggagctgagtcagcttgagaacaagatcttgaacgttaccacggaaatgctgaaaatggcgaccagatacagggaacttgaagtgaagtacgccagcttaaccgatctggtgaataatcaatccgtgatgatcaccctgctggaagagcagtgcctgagaattttttctcggcaggacactcacgtctctcctccacttgtgcaggtggttccccaacacattcccaattcccagcagtacacgccgggtctgctgggaggcaacgagatccaaagggatcccggatacccgagggacctaatgcccccacctgatctggcaacgtcaccaactaaatccccgttcaaaattccccctgtgactttcatcaatgagggacccttcaaagactgccaacaggcgaaggaggctggtcattccgtgagtgggatttacatgattaagcctgagaactccaacgggcctatgcagctgtggtgtgagaactccctcgaccccggagggtggaccgttatccagaaacggacggatggctctgtaaatttcttcagaaattgggaaaattacaagaagggctttggtaatatcgatggcgaatactggctgggtctggaaaatatctacatgctaagcaatcaagacaattataaattactcattgaactcgaggactggtcggacaaaaaggtttatgcggagtatagcagctttagactggaacctgagagcgagttttaccgtctaaggctgggcacctaccagggcaacgctggggattcaatgatgtggcacaatggtaagcagttcaccacactggaccgagacaaggacatgtatgcagggaactgtgcccacttccacaaaggcggatggtggtacaatgcctgtgcccactcaaatttgaacggagtttggtacaggggaggacactatcggagcaaacaccaggatgggatcttctgggccgaataccggggagggtcctattcattaagagcagtgcagatgatgattaaacctattgattag

SEQ ID NO: 24642 - DNA, 717 bp, Artificial Sequence
  Description of Artificial Sequence: Synthetic coding sequence
atggcggtgttcagtggcgttctagaaagcgcgcttttcctcgaccagaataccctgcaggctaggcaaggcagcagatctccactcacgatggataaattcgtcatccggacaccaaggattcagaacagcccgcaaaaaaaagactccggcggaaaagtgtacaagcaggctacaattgagtcactgaaacgagtcgtggtcgttgaggacattaagcggtggaagacaatgttggagctccctgatcaaacaaaggagaacttggtcgaggctttacaggaattaaagaaaaagattcccagcagggaagtgctgaaaagcaccaggattgggcataccgtaaacaagatgaggaagcactctgactccgaggtcgcttccctcgccagagaggtctacactgagtggaaaactttcaccgagaagcattctaaccggccaagcatcgaggtaagatctgacccaaagacagaatcacttcgcaagaacgcccagaaactgctgtcggaggctctcgaactgaagatggaccatctgctcgttgagaacattgaacgcgagacatttcacctctgctcaagactaattaatggtccatatcgtcggacagtgagagccctggtgttcaccctgaagcacagagcggaaatccgcgctcaggtgaagagcggctcactgcccgtgggcacttttgtccagacccacaagaagtag

SEQ ID NO: 24643 - DNA, 741 bp, Artificial Sequence
  Description of Artificial Sequence: Synthetic coding sequence
atggacctgcttcgcgagctcaaggccatgcccattactctccatcttctccagtcgaccagagtgggcatgagcgtgaatgcccttagaaagcagtcctccgacgaagaggtgatcgccctggcaaaaagccttattaagagctggaagaagctgctggacgccagcgatgccaaagcaagggaaagggggcgtggcatgccccttcccacttcctcacgggacgcctccgaggccccagaccccagtcgtaagcggcctgagctgccacgagccccttcaactcccagaataacaactttcccacccgtgcccgttacttgtgacgctgtcagaaataaatgtcgcgaaatgctgacagccgcactccagaccgatcacgatcacgtagccatcggggctgattgcgagcgactaagtgcacagattgaagagtgcattttccgcgatgtgggaaatactgacatgaagtacaaaaacagagttagatcgcgcatcagcaacttaaaggacgcaaaaaatccagacctgaggagaaatgtcctgtgcggcgctattaccccccagcagatagccgtgatgacttccgaggagatggcttcggatgaactcaaagagattagaaaagccatgaccaaagaggcaatacgcgagcaccagatggcaaggaccggcggaacacagactgatctgttcacctgcggcaaatgtcgaaagaaaaattgtacgtacacccagtag

SEQ ID NO: 24644 - DNA, 900 bp, Artificial Sequence
  Description of Artificial Sequence: Synthetic coding sequence
atgatgggaaaggaggaggagatcgccagaattgcccgacgacttgacaagatggtgacgaagaagagcgctgagggcgctatggatcttttgagggagctgaaagctatgccaatcacgctccacttactgcagagcacacgcgtcgggatgtcggtgaacgcacttcgcaagcaaagctctgatgaggaagtaattgctctggccaagtcgttaattaagtcatggaagaaattgctggacgcctccgatgccaaggctagggagcggggaaggggaatgccactgccgaccagctctcgagatgcaagcgaagccccagatccatcacgcaagagaccagaactacccagagcgccaagtacccctcgaataacaacatttccacctgtccccgtaacatgcgatgccgtgaggaacaagtgccgcgagatgctgacagcggcacttcagactgatcatgatcacgtggccatcggtgcagattgtgagaggttatctgcccagattgaagaatgtatctttcgcgatgtcggaaataccgatatgaagtataaaaatcgcgtgaggagcagaatctcaaacctcaaggacgccaaaaatcctgatctcagacgcaacgttctgtgcggggcaataacgccgcagcagatcgctgttatgactagcgaggagatggccagcgatgagctgaaggagatcaggaaggctatgacaaaggaagccatccgcgagcaccaaatggcgagaaccggcggtacacagactgacctcttcacctgtgggaagtgccgtaagaaaaattgcacttacacccaggtccaaacccgtagttcagatgagcctatgacaacattcgtagtttgtaacgagtgcgggaatcgctggaagttctgctag

SEQ ID NO: 24645 - DNA, 819 bp, Artificial Sequence
  Description of Artificial Sequence: Synthetic coding sequence
atggacctactccgggaactgaaagcaatgccaattacactccacttgcttcaaagtacccgtgtggggatgagcgtcaatgccctcagaaagcagtcgagtgatgaagaagttatcgcccttgctaagtcattaattaagtcgtggaaaaagctgctggacgccagcgatgcaaaagctagagagcggggaagagggatgccattgccaaccagttctagggatgcctccgaagctccagatccaagcaggaagcggccagagctgcctcgtgctccgtcaaccccaaggattaccactttcccacccgttcctgtgacctgcgatgccgtgagaaacaagtgccgggagatgctgaccgcagccctgcagacggaccatgatcacgtagccataggggctgattgcgagagactcagcgctcagatcgaagagtgtatattccgggatgttgggaataccgatatgaagtacaaaaacagggtgcggtcacgaatttcaaatctgaaggacgcaaagaatcccgatctacggcgtaacgtcctgtgtggagctatcacaccgcagcagatcgccgtgatgacaagtgaagagatggcttcagacgaacttaaggaaattaggaaggctatgaccaaagaggcaattcgggagcatcagatggccagaaccggtggcacacagactgatttgtttacgtgcggcaaatgcaggaaaaagaactgcacatatacccaggtacaaacaaggagttctgatgagccaatgacgactttcgttgtgtgtaatgagtgcggtaaccgatggaagttttgttag

SEQ ID NO: 24646 - DNA, 729 bp, Artificial Sequence
  Description of Artificial Sequence: Synthetic coding sequence
atgatgggcaaggaagaggaaatcgcacgtattgctcgtcggctggataagatggtcacaaagaaatccgcggaaggcgcaatggatctcctcagggaattaaaagccatgcctattacccttcacctgctccagtcgacacgtgtcggcatgtccgtgaatgccttaaggaagcagtcaagcgacgaggaggtgattgccctggccaaaagcctaatcaaatcttggaagaagttgctggacgcatccgatgcaaaagccagggagagagggagaggcatgcctctgccaacctcctcgagggacgcctccgaagcacccgacccttccaggaaacggcctgagctcccaagagcaccttctacgccaagaatcacgacattcccacccgtccctgtcacctgtgatgccgtccggaataagtgtagggaaatgctgactgctgccttgcagaccgatcacgatcatgtggcgatcggagcggattgtgagcgattatccgctcaaattgaagagtacatcctatgggtgggcgctgtgggcctagggttctggtggtcccaggaagccgcatggcccggtgctttatggtggttgctcgatgcaactgcacaactatctaggggtcacttgccaggatggtcaccagcatgggtggtgcggctgagtcacctcagacgggcacctggtcctgccgaggggctaatactgagcgcctgtggcgcttag

SEQ ID NO: 24647 - DNA, 249 bp, Artificial Sequence
  Description of Artificial Sequence: Synthetic coding sequence
atggacctgttgagggagcttaaagctatgccaataaccctgcatctgctgcaatccacacgggtaggtatgtcagttaacgcacttaggaagcaatccagcgatgaggaagttatagccctggccaaatccctgatcaaatcttggaaaaagttattagacgcatccgacgcaaaagcacgcgagcgcggacggggaatgcctctgcccaccagcagtagggacgcctctgaggcccctgacccttag

SEQ ID NO: 24648 - DNA, 741 bp, Artificial Sequence
  Description of Artificial Sequence: Synthetic coding sequence
atggacttattgagagagctgaaggctatgcccatcacgttgcatctgttgcagtcaactcgtgtcggtatgagcgtgaacgcgctgcgcaagcaatctagtgatgaagaagtgattgcccttgccaagagtctgattaaatcttggaagaagctcttggatgccagtgatgctaaggcgagagagcgtggaagaggcatgcctttgccaacatcctcaagggacgcttccgaagctccagatccaagccgcaaacgcccagagttgcctagagccccaagcacccctagaattaccactttcccacccgtgcctgtgacctgtgatgcagttaggaacaagtgtagagagatgcttactgccgctctccagaccgaccacgaccacgtggctatcggagccgactgcgagcgtcttagtgcacaaatcgaagagtgcatatttcgcgacgttggcaacaccgacatgaaatataaaaatagggtacgaagcagaatctccaacctcaaagatgctaagaaccctgacctgcgcaggaacgtgctgtgtggggctattacaccacaacagattgcggtcatgacgagcgaagagatggcgagcgacgagcttaaagagatccgaaaagcaatgaccaaggaggccattcgcgaacaccagatggccagaacgggcggtacccaaactgacctctttacctgtgggaagtgccgtaaaaagaactgcacatacacacagtag

SEQ ID NO: 24649 - DNA, 813 bp, Artificial Sequence
  Description of Artificial Sequence: Synthetic coding sequence
atggacctgttacgggaactcaaggcaatgcccatcaccctccatctccttcagtctacgcgggtcggaatgtctgttaacgccctcagaaaacagtcctcagacgaagaggttatcgcccttgcgaagtctctgataaaaagctggaagaagttgctggatgcttctgacgctaaggcacgagagagaggcagaggaatgccccttcccacctccagccgggatgcaagtgaggctcccgacccatctcgtaaacgtccggagttgccccgtgctccttcaacccccaggataactacattccctccagtcccagttacatgcgatgccgtcagaaacaaatgccgtgagatgcttacagccgcacttcaaacagaccacgatcacgtcgccataggagccgactgtgagagactgtccgcacagatcgaagagtgtatcttccgggacgttggcaataccgacatgaaatacaaaaacagagtcagaagtcgaatctccaatctaaaggatgctaagaatcctgatctcaggcgtaacgtgctctgtggggctataacccctcaacagatcgctgttatgacctccgaggaaatggcctccgacgagttgaaagaaatcagaaaggctatgactaaggaggcaatcagggaacatcagatggctaggacaggtggcacccaaaccgacttgttcacatgcggcaaatgtaggaagaaaaactgtacttatactcaggtgcagacgagatcatccgacgaaccaatgacaacctttgttgtatgtaacgagtgtggaaataggtggaagtag

SEQ ID NO: 24650 - DNA, 465 bp, Artificial Sequence
  Description of Artificial Sequence: Synthetic coding sequence
atggggcaggaggaggagctcctgcggatcgccaaaaagcttgagaagatggttgctcggaaaaatacagagggggctctcgatcttctgaagaagcttcactcctgtcagatgagcattcaactcttgcaaacgacacgcatcggtgttgccgtgaacggtgtgcgtaaacactgctctgataaggaggtggttagcctggcaaaagtgttgatcaagaactggaagcgcctgctggactctccaggcccacccaagggcgaaaagggtgaagagcgcgaaaaagctaagaagaaagagaaagggttagaatgtagtgactggaagcctgaggccggactgtccccccctcggaaaaagcgtgaagatcctaagacccgcagggattccgtcgatagtaagagcagcgccagttccagcccaaagcgcccttccgtggagcgcgcttgtagtctgatgcaatag

SEQ ID NO: 24651 - DNA, 1047 bp, Artificial Sequence
  Description of Artificial Sequence: Synthetic coding sequence
atgggccaggaggaagaactccttcgtatcgcaaagaaactcgaaaagatggtagctcgcaagaacactgaaggggcactggacctcttgaagaaactacatagctgccagatgagtattcagcttcttcagacaaccagaattggcgtcgccgtcaacggagttagaaagcactgctccgataaagaggttgttagcctggccaaggtgctgattaagaattggaaaagattgttggattcacccggacctcctaaaggggaaaagggggaggagcgcgaaaaggccaaaaagaaagagaagggactcgaatgcagtgattggaagcccgaggcaggactgtccccccctcggaagaagcgcgaggaccctaaaacacggcgtgattccgtcgactcaaaaagttcagccagtagttctcccaagcggccaagcgtcgaaaggtcgaactcctccaagagcaaggctgagagccctaaaacccctagctctcctctgacaccgacatttgcttccagcatgtgcctgctggcaccatgctatttaaccggcgattcagtccgggataaatgcgtggaaatgttgagtgccgcattgaaggccgacgacgactacaaagactacggcgtgaattgtgacaaaatggcctctgagatagaggatcatatttaccaggagctgaaatcaactgatatgaagtaccgcaatcgggtccgaagccgaattagtaacctgaaggatccacggaacccgggactgaggcggaacgtgctgagtggcgcaatctcagcaggcctcatagcaaagatgacggcagaggagatggctagcgacgagctcagggaactgagaaacgccatgacacaggaagcgatcagggaacatcagatggcaaagactgggggtaccactactgacctttttcagtgttctaagtgcaaaaagaaaaactgcacatataatcaggtccaaacccgcagcgccgacgaaccaatgaccaccttcgttctgtgtaatgagtgtggtaatcgatggaagttctgctag

SEQ ID NO: 24652 - DNA, 684 bp, Artificial Sequence
  Description of Artificial Sequence: Synthetic coding sequence
atggaaaagctttttaacgagaacgagggcatgccatccaatcagggtaagatcgataatgaggaacaacctccacatgaaggcaagcctgaagtggcttgcattcttgaggacaagaagttggaaaacgaggggaataccgaaaacaccggcaagagggtcgaagaacccctcaaggataaagagaaacctgagtctgctgggaaggccaaaggggaagggaagtctgaaagaaagggcaagtccgagatgcaaggaggtagcaaaaccgaaggaaaacccgagaggggagggcgtgctgagggcgagggtgagccggattcagaacgcgaacccgaaagtgaaggggagcctgaatcagagaccagagcggcagggaaacgaccagcggaggacgatatccccagaaaggcgaaaaggaaaaccaacaagggccttgcccaatacctcaagcagtacaaggaggccatccacgacatgaattttagtaacgaagatatgattagggaattcgacaatatggcaagggttgaggacaaacgacgaaagtccaagcagaagcttggagcctttctttggatgcagagaaacctgcaagacccattctaccccagaggccctcgcgagtttcggggaggatgtcgagccccacgtagggatactgaggacatcccttacgtgtag

SEQ ID NO: 24653 - DNA, 684 bp, Artificial Sequence
  Description of Artificial Sequence: Synthetic coding sequence
atggagaagttgtttaatgagaatgaggggatgccttccaatcaaggcaaaattgacaacgaggagcagccacctcacgaggggaagcccgaggtggcttgcattttggaagataagaagttggaaaacgaaggaaacacggaaaacacaggtaagagggttgaggagccccttaaggacaaagagaagcctgaatcagctggcaaggcaaagggagagggaaagagcgaacgcaagggcaagtcagaaatgcagggagggtccaagactgaggggaagcctgagcgtggcggacgggcagagggcgagggcgaacccgactcagagagggagccagaaagcgaaggcgagccagagtccgagacgagagccgctggcaaaagacccgctgaggatgatattccaagaaaagctaaacggaaaacgaacaagggactggcacagtacctgaagcagtacaaggaagccatacacgacatgaatttcagtaatgaagacatgatccgcgagttcgacaacatggcgagggtggaagacaagcgaaggaagtccaagcagaaattaggcgcatttctgtggatgcagaggaaccttcaagacccattctatccccgaggtccgagagagttccgcggaggatgccgagccccaagacgggacactgaggatataccatatgtttag

SEQ ID NO: 24654 - DNA, 603 bp, Artificial Sequence
  Description of Artificial Sequence: Synthetic coding sequence
atggaaaaaccatataataagaacgaaggcaatctggaaaacgaggggaaaccagaggatgaggtggagcctgacgatgagggtaagagtgacgaggaagaaaaacctgacgtggagggcaagacagagtgtgaggggaaaagagaagatgaaggggaacccggtgacgaggggcaactagaggacgaagggtctcaggagaagcagggccgatctgaaggagaggggaagccccagggcgaaggtaagcccgcatcgcaagccaagccagagtcccaaccaagagcagcagaaaagcgcccagccgaggactacgtgcccagaaaagccaaacgcaagacggatcggggaaccgacgactcccctaaggattctcaggaagacctacaggaaaggcacttaagctccgaggagatgatgcgggagtgcggtgatgtgtctagagctcaggaagagcttcgcaaaaagcagaagatgggaggatttcactggatgcagagggatgttcaggacccattcgcacccagagggcaaaggggagtgagaggagtcagaggcggtggcagaggccaaagggggctgcacgacattccatacttgtag

SEQ ID NO: 24655 - DNA, 603 bp, Artificial Sequence
  Description of Artificial Sequence: Synthetic coding sequence
atggaaaagccatataataagaacgagggaaatcttgagaatgagggcaagcccgaggatgaggtcgagccagatgacgaaggaaaatcagacgaagaggagaaacccgatgttgaagggaaaaccgagtgcgagggcaaacgggaggacgagggcgaaccaggcgatgaaggccagctggaggacgagggaagccaagagaaacaggggaggtcagagggtgagggcaagcctcagggcgaagggaagccagctagccaggctaaaccggagtcacaaccaagagctgctgagaagcggccagccgaagactacgtcccaaggaaggctaaaaggaagaccgatcgcggtacagatgactcacccaaagatagccaggaggatttgcaggaacgccacctatcttccgaagagatgatgagagaatgtggagacgtatcacgcgctcaggaagaactgcggaagaaacagaaaatgggagggtttcactggatgcagagggatgtccaagacccttttgctcccagagggcagagaggagtgcgcggagtgcgcggaggtgggagggggcagcgaggcctccatgacatcccatacctttag

SEQ ID NO: 24656 - DNA, 603 bp, Artificial Sequence
  Description of Artificial Sequence: Synthetic coding sequence
atggaaaagccgtacaacaagaatgaaggaaacctggagaatgaaggaaagccggaagacgaggtcgaacctgatgacgaaggcaaatcagatgaggaggagaagccagatgtggaaggcaaaactgaatgtgagggcaaaagggaggacgagggggaacctggagacgaaggacaactggaggatgagggctcccaagagaaacaagggagaagcgagggcgagggaaaaccacaaggcgagggaaagccagcctcgcaggcaaagccagaatcccagcccagagcggctgagaagaggcccgcagaggattatgtcccacggaaagcaaagagaaagaccgataggggtacagacgattcccccaaggacagccaggaggacttgcaggaacgccacttgagttctgaggagatgatgcgagaatgcggagacgtgagtcgagcacaggaagagctgcggaagaagcagaagatgggcggattccactggatgcagcgggatgtgcaggacccgttcgcacccagaggccagcgtggagtgcgaggcgtgaggggcggtgggagagggcagagaggcttgcacgacattccctacttgtag

SEQ ID NO: 24657 - DNA, 1077 bp, Artificial Sequence
  Description of Artificial Sequence: Synthetic coding sequence
atgccagccggagggcaggccccacagctgacacctgttatcccggcattctgggaggctcgaggtttacctaattccaaaggaagggacaaggtccacatctgtcagtgcgaagagtggaaggggcacatcagttatgtagagagagatattactacctctgaaattaagtctcttccacaggtgtccgtgcgggctttccacgctgcaagtggtactctagaatggcgaaagggcaacggctatggcagaggtaaggggtgggggtggggtagagtggaatcaagagaggcaggtccctcagtcgacagagatggtggtctgcgggtgtgctgctcccagcgtagcgcgaaacccgaaaaagaggagcaacccgttcagaacccacgccgtagcgtgaaggacaggaagaggagaggcaatctggacatggagaagctatactctgaaaacgaagggatggcctctaaccaagggaagatggagaatgaggagcagcctcaggacgaaaggaaacctgaagtgacatgtactctggaggacaaaaaactggaaaatgagggcaaaactgaaaacaagggcaagacgggcgacgaggagatgctgaaagataaaggcaaaccggagtccgaaggagaagctaaagagggcaagtcagagcgcgaaggagagtccgagatggagggcggtagtgagcgcgaggggaagcccgagatagagggcaagcctgaaagcgagggcgaacccggaagcgagacccgcgctgcaggaaagcgccctgccgaagacgatgttccacgcaaggccaagcgtaagacaaacaagggactggctcactatcttaaagaatacaaagaggcaatccatgatatgaatttctccaatgaggacatgatacgagaatttgacaatatggccaaagtgcaggatgagaaaagaaaatctaaacaaaaacttggagcgtttttgtggatgcagagaaaccttcaggatcctttttatcctcgaggccctcgcgaatttagaggcggatgtcgagctccccgacgggacatcgaagacattccttacgtgtag

SEQ ID NO: 24658 - DNA, 561 bp, Artificial Sequence
  Description of Artificial Sequence: Synthetic coding sequence
atggagaaattgtatagtgaaaacgagggaatggccagcaaccagggcaagatggagaatgaagaacaaccacaggacgagagaaagccagaagtgacttgcacgttggaggataaaaagctcgagaacgaggggaaaaccgaaaataagggtaaaaccggcgatgaagaaatgctcaaggataagggcaagcccgaaatagagggtaagcctgaaagtgaaggagagcctgggagcgaaaccagagcagccggaaaaagaccagctgaggatgacgtgcccaggaaggcaaaacgcaagacaaacaaaggcctggcacactacctgaaggagtacaaagaggctatccacgacatgaacttttccaacgaagacatgatacgggaattcgataatatggccaaggtgcaggacgagaagcgcaaaagcaagcagaagctcggcgcatttctttggatgcagcgcaacttacaggacccattttatcctaggggtcccagagagtttcgaggagggtgcagggcaccgaggagggacatcgaggacatcccctatgtatag

SEQ ID NO: 24659 - DNA, 648 bp, Artificial Sequence
  Description of Artificial Sequence: Synthetic coding sequence
atggagaagctgtacagcgaaaatgaagggatggctagtaatcagggaaagatggagaatgaggaacaacctcaggacgaacgaaaaccggaggttacctgtactctggaagataagaaactggagaacgaggggaaaactgagaacaagggtaagacaggtgacgaagagatgttgaaggataagggtaagccagagagtgaaggcgaggccaaggagggaaagagcgaacgcgaaggcgagtcagaaatggaaggtggcagtgagcgggagggcaagccggaaatagaaggcaagcccgaaagtgaaggagagcctgggtcagaaacacgcgctgccggaaaacggcctgcggaggatgatgtccctcgcaaggccaagcgcaaaaccaataaaggtttagcacactatttgaaagaatacaaggaagcaatccacgatatgaattttagcaacgaggatatgatcagagagtttgataatatggccaaggtgcaggatgagaagaggaaaagtaagcagaagctaggcgctttcctttggatgcaacgaaacttgcaggatcccttctacccacgcggacccagggagtttcggggtggatgtagagcccctaggagggacatcgaagacatcccgtatgtctag

SEQ ID NO: 24660 - DNA, 177 bp, Artificial Sequence
  Description of Artificial Sequence: Synthetic coding sequence
atggaaaaactgtattctgaaaatgaaggtatggcatccaaccagggaaagatggagaacgaagaacagcctcaagatgagcgcaaaccagaagtgacctgcaccctggaagataagaaactggaaaacgaaggcaagaccgagaataagggaaaaacaggcgacgaagagatgtag

SEQ ID NO: 24661 - DNA, 153 bp, Artificial Sequence
  Description of Artificial Sequence: Synthetic coding sequence
atggagaagctatacagcgagaatgaaggaatggcaagtaatcagggtaaaatggaaaatgaggagcagccacaggacgaacgaaaaccggaagtaacttgcacgctggaggacaagaagctggagaatgagggaaagaccgagaataagtag

SEQ ID NO: 24662 - DNA, 276 bp, Artificial Sequence
  Description of Artificial Sequence: Synthetic coding sequence
atggagaaactatatagtgaaaacgagggcatggctagcaaccaaggcaagatggagaatgaagaacaaccccaggatgaacggaaacctgaggttacatgtacgctagaggacaagaagcttgaaaatgagggcaagactgagaataaaggaaagaccggcgacgaagagatgctcaaggataaagggaagcccgaatctgagggagaggccaaagaaggtaagtctgaaagggagggcgaatccgagatggagggaggtagcgagcgtgagtag

SEQ ID NO: 24663 - DNA, 648 bp, Artificial Sequence
  Description of Artificial Sequence: Synthetic coding sequence
atggagaagctttattcggaaaacgaaggaatggctagtaaccagggcaagatggagaatgaggagcagccgcaagatgaacgcaagcccgaagtcacttgtaccctggaagataaaaaattggagaacgagggaaagaccgaaaataaagggaagactggggacgaagagatgctcaaggacaagggcaagccagagtctgagggcgaggccaaagagggcaagtccgagcgagaaggagagtctgaaatggagggaggctcagagagagaagggaagcctgagatagaagggaagcctgagtcagagggcgagcccggtagcgaaacacgcgctgccggaaaacggcctgcggaagatgatgtgccaagaaaggctaaaaggaaaactaacaagggccttgcccattaccttaaagagtataaggaggcaatccatgacatgaacttttctaacgaagatatgatcagggagttcgacaacatggctaaagtacaggacgagaaaaggaagtctaagcagaaacttggcgcttttttgtggatgcagagaaacctgcaggatcctttttatccccgaggtcccagggaattcagaggtggctgccgcgctcctaggcgcgacattgaggatatcccgtacgtgtag

SEQ ID NO: 24664 - DNA, 390 bp, Artificial Sequence
  Description of Artificial Sequence: Synthetic coding sequence
atggaaaaactgtatagcgaaaacgagggaatggcttctaatcaaggtaaaatggaaaatgaagaacaaccacaggacgagcgcaagccagaggtgacttgcacgctggaggataagaaactcgaaaacgagggaaagaccgaaaataaaggcaaaaccggtgacgaggagatgttgaaggataagggcaagcccgagagtgagggggaagccaaggaggggaaaagcgaacgggaaggggagtccgaaatggaaggaggctccgagcgtgaggggaaaccagaaatcgagggaaagcctgagagcgagggcgagcctgggtcagagaccagggcagctgggaagcgtcctgccgaagacgatgtgcctcggaaggcgaaaagaaagtag

SEQ ID NO: 24665 - DNA, 648 bp, Artificial Sequence
  Description of Artificial Sequence: Synthetic coding sequence
atggaaaagctgtactcagaaaacgaaggaatggccagcaaccagggcaaaatggaaaatgaagaacagcctcaagatgagaggaagcccgaggtcacatgcactctggaggacaaaaaattggagaatgaagggaaaaccgaaaacaagggcaagacgggcgatgaggaaatgctcaaagataagggcaaaccagagtcggagggggaagctaaggaaggtaagtcggagcgtgaaggagagtcagagatggagggaggctcggagagggaggggaagccggagatagagggcaagcccgaaagcgagggggagccaggctcagagacgagggctgcagggaagcgtccagcggaggacgatgtcccaaggaaggcaaagagaaagacaaacaagggcctcgcacactatctgaaggagtacaaggaggccatccacgatatgaacttctctaatgaggatatgatcagggagttcgacaacatggcaaaagttcaggatgagaagcgaaagtctaagcagaagctaggagctttcctctggatgcagcggaatttgcaggatcctttctaccccagaggccctagggagttcaggggcggttgtcgggctcctcgccgtgacatagaggacatcccgtacgtgtag

SEQ ID NO: 24666 - DNA, 648 bp, Artificial Sequence
  Description of Artificial Sequence: Synthetic coding sequence
atggagaagctttattctgagaacgagggcatggcctctaaccagggaaagatggaaaacgaggagcagcctcaggatgaacgaaaacccgaagtgacctgtaccctggaggacaaaaaactcgaaaatgagggaaaaacagaaaataaaggtaaaactggagacgaggagatgctcaaagataagggcaagcccgagtctgaaggagaggcaaaagaggggaaatctgagcgggaaggcgagagcgagatggaaggcggaagcgaaagagaagggaagcctgagattgagggtaagcccgagtcagaaggagagcccggatcagaaacacgcgctgcaggcaagaggcccgctgaggacgatgtaccacgaaaggctaaaagaaagacaaacaaagggctggctcactacctaaaagaatacaaggaagccattcatgacatgaactttagcaatgaggacatgattagggaattcgataacatggccaaagtgcaagatgaaaagcgcaaaagcaagcagaaactcggcgctttcttgtggatgcagcgaaatctacaggatccattctaccctcgcggtcctcgggaattccgtggagggtgtcgcgcacctaggcgagatatcgaagatatcccatatgtgtag

SEQ ID NO: 24667 - DNA, 231 bp, Artificial Sequence
  Description of Artificial Sequence: Synthetic coding sequence
atggagaaactgtatagtgagaacgagggcatggcatccaaccagggcaagatggagaacgaagaacagccacaagacgaaaggaagccagaagttacgtgcacgttggaggacaaaaaactggagaatgaagggaagaccgagaacaaggggaagacgggggatgaggagatgctcaaagataagggtaaacctgaatctgagggggaggccaaagagggcaaaagttag

SEQ ID NO: 24668 - DNA, 648 bp, Artificial Sequence
  Description of Artificial Sequence: Synthetic coding sequence
atggaaaaattgtactccgagaatgagggaatggccagcaaccaagggaagatggagaacgaagagcaaccacaagacgagaggaaacctgaagtcacctgcacactagaggacaagaaactggaaaacgaaggcaaaactgaaaataaaggaaaaactggggatgaggaaatgctcaaagacaagggaaaaccagagtcagagggagaagccaaagaaggaaagagcgagagggaaggagaatccgagatggagggaggctctgaaagggaaggaaagccggaaatcgagggcaaaccagagagtgagggtgagcctggttctgagacccgtgcggctgggaaacgtcccgctgaggacgacgtgcctcgcaaggcaaaacggaagaccaacaagggactcgcccactacctgaaggaatacaaagaggctatccatgacatgaatttctctaacgaagacatgatccgggaattcgataatatggcgaaggtgcaggacgaaaagcggaaaagcaaacagaagctgggcgcattcctgtggatgcagcggaacctgcaggaccccttctatcctcggggacctagggagttccgcggagggtgccgggctccacgcagagacattgaggatataccctatgtatag

SEQ ID NO: 24669 - DNA, 621 bp, Artificial Sequence
  Description of Artificial Sequence: Synthetic coding sequence
atggaaaaattgtacaaggagaatgaagggaaaccagaaaacgaacggaacttagagagtgaaggtaagcctgaagacgaaggaagcacagaagacgaagggaaaagtgacgaagaagagaagcctgatatggaagggaagactgagtgcgaaggcaagcgcgaagacgagggggagcccggagacgaggggcagctggaagacgaaggtaaccaggagaagcagggaaagagcgagggggaagacaagccccagtcagagggaaagccagcaagtcaggcaaagcccgagagccaacccagagccgctgaaaaacgacctgcggaagattacgtgcctcgcaaggcaaagaggaaaactgatcgagggacagatgattcacccaaggactctcaggaagatttgcaggagcgacatctgtcttctgaggagatgatgcgtgaatgtggggacgtgagcagagcacaggaggagctgcggaagaagcagaaaatggggggtttccattggatgcagagagatgtgcaagacccatttgcgcctcggggacaaaggggtgtccggggagtgaggggtggaggaagagggcagaaggatctcgaagatgttccatacgtgtag

SEQ ID NO: 24670 - DNA, 552 bp, Artificial Sequence
  Description of Artificial Sequence: Synthetic coding sequence
atggagaagccatataataagaacgagggcaacctggagaatgagggcaagccagaggatgaagttgagccagatgatgaaggcaagagcgacgaagaggagaagccagacgcagaaggaaagactgagtgcgaaggcaagcgaaaagccgaaggggaacctggtgacgaaggccagctggaggacaaaggatcccaggaaaagcagggtaaatccgaaggagagggcaagcctcaaggggaaggtaaaccggcaagtcaggccaaacctgagggacagcctcgtgcagctgagaaacgtcctgctggcgattacgtccccagaaaagccaaacgcaagactgatcggggaacggatgactctcccaaagatagtcaggaggacctgcaggaacgccacctctcaagcgaagaaatgatgcgggagtgtggtgacgtgagccgcgctcaagaggagctcaggaaaaaacagaagatggggggtttccactggatgcagagggatgttcaggatccctttgctcagggagacaacggcgtctcgggcgagtag

SEQ ID NO: 24671 - DNA, 552 bp, Artificial Sequence
  Description of Artificial Sequence: Synthetic coding sequence
atggaaaaaccctataacaagaacgaggggaatcttgaaaatgaggggaagccggaagatgaggtggagccagacgatgagggcaagtccgacgaggaggaaaagcccgatgctgagggaaagaccgagtgtgaggggaagcgtaaagccgagggcgagccaggagacgagggccagctggaagataaggggtcccaggagaaacaggggaaatctgaaggggaaggtaagccccagggggaggggaagcccgctagccaggccaagcccgagggacagccacgcgctgctgagaagcggcctgctggagattacgtgcctagaaaagcaaagcggaagaccgacaggggaacagatgattccccaaaggacagccaggaagaccttcaggagcgccatctgtcctcggaggaaatgatgcgcgaatgtggtgatgtaagtagggctcaagaagaactgagaaaaaagcagaagatgggagggttccactggatgcaacgcgacgtccaagatcctttcgcacagggcgataacggtgtctcaggcgagtag

SEQ ID NO: 24672 - DNA, 600 bp, Artificial Sequence
  Description of Artificial Sequence: Synthetic coding sequence
atggagaagccctataataaaaacgaaggcaacttggagaacgaaggcaagcccgaggacgaagtagaacctgacgatgaagggaaaagcgatgaagaggaaaagcctgatgccgaaggtaagacggagtgtgagggcaagcgaaaggcagagggggagcccggagatgagggccagctcgaggacaaagggagtcaggaaaagcagggtaagtcagagggagagggaaagcctcagggtgagggtaagcccgctagtcaggcaaagccagaaggtcagcccagagccgctgaaaaaaggccggctggagattatgtgcccagaaaagctaagagaaagacggatcggggaacagacgactctcccaaggactcgcaggaggacctgcaagaacggcacctgagcagcgaggaaatgatgcgagaatgcggagacgtgagtcgggcacaagaggagcttcggaagaaacaaaagatggggggttttcattggatgcagagagatgtgcaggatccgttcccccgaggtcaacgcggtgtgcgcggtgtgagaggtgggggacgaggccaacggggactgcacgacattccttacctgtag

SEQ ID NO: 24673 - DNA, 354 bp, Artificial Sequence
  Description of Artificial Sequence: Synthetic coding sequence
atgcaaaagtcttgcgaggaaaatgaagggaagccacaaaatatgccaaaagccgaagaggaccgacctctggaagatgttcctcaggaggcagaggggaacccacaaccttcagaagagggggtgagccaggaggccgagggaaatccaagagggggaccgaaccagccgggtcagggttttaaggaagacactcccgtgagacacctagacccggaagagatgattaggggggtcgatgagctggaaaggctgagggaggaaatccgcagggtgcgaaataagtttgtgatgatgcactggaaacagcgtcacagtcggtctcgaccctatccagtatgctttaggccttag

SEQ ID NO: 24674 - DNA, 354 bp, Artificial Sequence
  Description of Artificial Sequence: Synthetic coding sequence
atgcagaaatcatgtgaagagaacgagggtaagccccagaatatgcctaaggcagaagaggatcggccactggaggatgtcccacaggaagcggaggggaaccctcagcccagcgaagaaggcgtttcacaggaggctgaagggaaccctcgcggaggtcccaaccagcctggccaagggtttaaggaggatacaccagtgcggcacctcgacccggaggaaatgattcgtggcgtggatgaactagaaagactgcgggaagagattcgcagagtccgtaataaatttgtcatgatgcattggaagcaacgtcactctcggagcaggccctatcccgtatgctttagaccctag

SEQ ID NO: 24675 - DNA, 225 bp, Artificial Sequence
  Description of Artificial Sequence: Synthetic coding sequence
atgcagaagtcatgcgaggaaaatgaaggcaagccacagaacatgccgaaagccgaggaagacagacctctggaggacgtcccacaggaggacaccccagttcggcacttggatcccgaggagatgatccgcggtgtagacgaactggagaggctgcgcgaggaaatcagacgagtgcgcaacaaattcgtgatgatgcactggaaacagaggcactctagatag

SEQ ID NO: 24676 - DNA, 1155 bp, Artificial Sequence
  Description of Artificial Sequence: Synthetic coding sequence
atgcctcagctggattccggcggtggcggtgcaggcggtggtgacgatctgggcgctcctgacgagctgctcgcttttcaagatgagggggaggagcaggacgataaatcgagagactcggcagccggacctgaaagggatcttgccgagctcaaaagctctctggtcaacgagtccgaaggcgcagctggtggagctgggattccaggggttcccggagccggagctggcgcacggggagaggcagaagcccttggaagagagcatgctgctcaacggctgttccccgacaagttgcctgagcccttggaagacggcctgaaggcccctgagtgcacttctggaatgtacaaggagactgtgtattccgcatttaacctacttatgcactatcccccaccttctggagccggacaacacccccaaccacaacctccacttcataaagcaaatcagcccccacatggagtgccccagctctctctgtatgaacatttcaatagtccccaccccacaccagccccagcggacatctcacaaaagcaggtccacagacccttgcaaacccctgacttgtccggcttttactccttaaccagcgggtccatgggacagctgccccacactgtctcttggtttacacacccatcactgatgttgggctccggagttcccggtcatcctgctgccattccacaccccgcaattgtgccacctagtggtaaacaggagctgcagccgtttgatcgcaatctaaagacccaagcagagtctaaagctgaaaaggaggcaaagaaacccaccatcaaaaagcctctgaacgccttcatgctgtacatgaaggagatgcgggctaaggtgatagcggaatgtactttaaaagaatctgccgcaatcaatcagatcctgggccgtaggtggcacgccctgagccgagaggagcaagctaagtactatgagctggcaagaaaggaacggcaactgcacatgcagctgtacccagggtggtctgcccgtgacaactacggaaagaaaaagaggcggtctcgggagaaacaccaggagtctacaactgaaactaattggccacgagaattgaaggatggaaacggacaggaaagcctctctatgagcagtagcagctctccagcttag

SEQ ID NO: 24677 - DNA, 1098 bp, Artificial Sequence
  Description of Artificial Sequence: Synthetic coding sequence
atgccccagctcgatagtggtggcggtggggcaggtggtggcgacgacctcggtgcccctgatgaactgctggcattccaggatgaaggggaggagcaggacgacaaatccagggatagcgctgcgggacccgaaagggaccttgctgagctgaaaagcagcctagtgaatgaatctgagggcgcagcaggaggcgctggtatccccggagttcctggtgccggtgctggtgccaggggcgaggcagaggcgctcgggagagaacacgcggcacagaggttgttcccggacaagctgccagagcctctcgaggacggcttgaaggcacccgagtgcacctctggtatgtataaggaaaccgtgtacagcgcatttaatctgctgatgcattacccgccacctagcggggctggtcagcatcctcaacctcagccccctctacataaagccaaccagcctccgcatggggtcccccaactgagtctgtatgagcacttcaattcaccacatcccaccccagcccctgcggatatctcacagaaacaggttcatcgcccactccagacacccgacctcagtggcttttatagcttaacttcaggatcaatgggacagctcccccacacggtatcatggttcacccatccttccttaatgttgggatcaggggtgccaggccaccccgcagcaatcccgcacccggctatcgtgcccccttcaggtaagcaggagctgcagccgttcgatagaaatttaaagacccaggcagaatctaaggcagagaaggaggccaaaaagcctaccattaagaagcccctgaatgcattcatgctgtacatgaaagagatgcgggctaaagtgatagctgaatgtacgctgaaagagtctgccgcaatcaaccagattttgggacggagatggcatgccctttcacgggaagaacaagccaaatattacgaactcgctcggaaggagcggcagcttcacatgcaactctacccgggttggtccgcgcgagacaactacgggaaaaagaaaagaagatctcgagaaaagcatcaggagtccacaactgacaacagcctccattactcatag

SEQ ID NO: 24678 - DNA, 1155 bp, Artificial Sequence
  Description of Artificial Sequence: Synthetic coding sequence
atgcctcagctggatagcggcggagggggagctgggggaggggatgacctcggtgcgcctgacgagcttctagccttccaggatgagggagaagaacaggatgataagtcacgggattccgccgcaggcccagagagggacctcgccgaattgaagtcatcactagtgaatgaaagcgagggtgctgcagggggtgcgggtattcctggcgtccccggagcaggcgctggggctcggggagaagccgaggccctggggagagagcacgcagcccagcgcctgtttccagacaaactccctgagccactggaggacggccttaaggcgcctgagtgtacaagcgggatgtataaggaaacagtgtacagcgcgtttaatttgctcatgcactatcctcctcccagtggagctggccagcatccccagccacagcccccactgcataaagctaaccaacctccgcatggggtgcctcagttgagcctgtatgagcactttaattctcctcacccaacaccagcccctgctgatatttctcagaaacaagtgcatcggccactccagacgccagacctcagcggcttttatagcctcacctccggaagcatgggtcagctgccccatacagtgtcatggttcactcacccgtctcttatgctcggatctggggtccctggtcacccagctgctatccctcaccccgctatagtacctccttccggaaaacaggagttacagccattcgataggaatttaaagacacaggcagaatcaaaggcggagaaggaagccaaaaagcctaccatcaaaaaacctttgaatgccttcatgctgtacatgaaagaaatgagggcaaaggtgattgctgagtgtaccctgaaggaatcggccgcaatcaatcagatcctgggacgcagatggcacgccttgagtcgcgaggagcaggccaagtattacgagctcgcgagaaaggagcggcagttgcacatgcagctgtaccccggttggagtgccagagacaactatggcaagaaaaaaaggcgctcacgggaaaagcaccaagagtcaaccacaggaggaaaaagaaatgcgtttgggacttacccagaaaaagcagctgcgccagccccttttttacctatgacagtgctgtag

SEQ ID NO: 24679 - DNA, 1485 bp, Artificial Sequence
  Description of Artificial Sequence: Synthetic coding sequence
atgccccagctggattcagggggagggggagcaggtggaggggacgatctgggtgcgccagacgaactgcttgctttccaggatgaaggggaggaacaggatgacaagtctcgagacagcgccgctggaccagagagggacctggctgagttaaagtcgtctttggtcaacgaaagcgagggggcagctgggggagcgggtatcccaggcgtcccaggcgcaggagctggggctcgaggcgaagccgaagccctggggagggagcatgccgctcagcggcttttcccagataagttgcccgaaccccttgaggacgggctgaaggcacctgaatgcacttcaggaatgtataaggaaacagtgtactccgcttttaaccttctgatgcattaccctcctccctcaggtgctgggcagcatcctcaacctcagcctccgcttcacaaggctaatcagcctccccatggagtgccccagctctcactgtatgagcacttcaactcgccccatcctaccccagcacctgcagatatcagccagaagcaggtccataggcctctgcagacccctgacctgtctgggttctattcgctcacgtctggcagcatgggacagctgccccatactgtgtcttggtttacccacccctctttgatgctaggctcgggagtgcctggacaccccgctgccattccacaccctgcaatcgtgcctccctctggtaagcaggaactccagccttttgataggaatctgaagactcaagcagagtctaaggctgaaaaagaagccaaaaaaccaaccatcaagaaacccttaaatgcgttcatgttatacatgaaggaaatgagagcaaaagtgattgctgagtgcaccctgaaggaaagtgctgccatcaatcaaatcctcggtagaagatggcatgccttgagcagggaggaacaggctaaatattatgaactcgcgagaaaagaacgtcagctccacatgcaactgtaccccggatggtctgcccgtgacaattatggcaaaaagaagaggcgtagcagggagaagcaccaggagagcacgaccgatccgggaagcccaaagaagtgtagggcaaggttcggcctgaatcaacagaccgattggtgtggaccctgtaggcggaagaagaaatgcattagatatctccccggagaaggcagatgtccatctccagtcccatcagacgactccgctctgggatgtccaggttcacctgctccccaggacagtccctcctaccatcttttgcctaggtttccaaccgaacttctgacctcacctgcgagacacctgcatccacaagtcagtcccctgctgtccgcctcacagcctcaggggccacaccgccctccagctgccccttgtcgggcacacaggtactccaaccgaaatctaagagacaggtggccaagccgtcaccggacaccaggcagactacaagagccaaccccttag

SEQ ID NO: 24680 - DNA, 807 bp, Artificial Sequence
  Description of Artificial Sequence: Synthetic coding sequence
atgtacaaggagacagtgtatagtgctttcaatctgctcatgcattaccccccaccatctggcgctggccaacatccacagccccagccccctctccataaagctaatcaacccccacatggggtgcctcagctctccctgtacgaacatttcaattccccacacccaacccccgctccagccgatatatcgcaaaaacaggtgcaccgaccactgcagacacctgacctcagcggattttactcccttaccagcggaagtatgggacagttacctcacacagtgtcctggttcactcacccatcactgatgttgggtagcggagtgcccggacatcccgctgctataccccacccagccatagtacctccaagcggaaaacaggaattgcagccctttgatcgaaatctaaagacgcaggcggaatccaaagctgagaaggaggctaaaaagcccacaatcaagaagcccctgaatgcatttatgctttacatgaaagaaatgcgggctaaagtgattgctgaatgcacactgaaggaaagtgctgcgattaaccagattctcggtcgcagatggcacgcactttcccgagaggaacaagctaaatactacgaactggcacgaaaggagaggcagttacatatgcagctttacccgggatggtctgccagggacaactacggcaagaaaaagaggcgcagtagggagaagcaccaggagtctaccacagatccaggatcccccaaaaagtgtcgcgcacgcttcgggctaaatcaacaaaccgattggtgtggaccatgtaggtag

SEQ ID NO: 24681 - DNA, 1110 bp, Artificial Sequence
  Description of Artificial Sequence: Synthetic coding sequence
atgcctcagttagattctgggggaggaggagccggtgggggtgacgacctgggcgcaccagacgaactattggccttccaggacgaaggcgaggagcaggatgacaaatccagggactccgctgcagggcctgagagggatctggctgaacttaagtcctcactggtcaatgagagcgaaggagctgcgggaggggctggaatcccaggagtcccgggtgccggagcgggagccagaggggaggccgaggcccttggaagagagcatgccgcacagcgcctttttccagataagctgcccgagcccctggaggatggtctgaaggcacccgaatgcaccagtggcatgtataaggagacggtgtattcagcctttaacttgcttatgcactaccctcctccaagcggagccggacagcacccccagcctcagccaccactacacaaagcaaatcagccaccccacggagttccacagttatcgctgtacgagcattttaatagccctcacccaaccccagcacctgcagatatttctcagaaacaagtgcacaggccccttcaaacacctgacctctctgggttttatagcctgacgtcgggcagtatgggtcaattgccacataccgttagctggttcactcatccgagtctgatgctcgggagtggcgtgcctggacaccctgcggcaatccctcatccggctattgttcctccttcaggaaaacaggagcttcaaccctttgatagaaatctgaagacccaggccgagagcaaggcagagaaggaggctaaaaagccgaccatcaagaaacccttaaatgcttttatgctgtacatgaaagagatgcgagctaaggtgatcgccgaatgtaccctcaaggagtcagccgcaatcaaccagattttaggccgtcggtggcatgcactgtctcgggaggagcaggccaaatattacgaattggcacgcaaagaacgacagctgcacatgcagctgtaccccggatggagtgcccgagacaattacggcaaaaaaaagagaaggtccagagagaagcatcaggagagtaccactgatggcattcctgcctgcactatcctgagcccatag

SEQ ID NO: 24682 - DNA, 810 bp, Artificial Sequence
  Description of Artificial Sequence: Synthetic coding sequence
atgtacaaggaaactgtttactctgctttcaacctactgatgcactacccacccccaagtggagccggacagcacccccagcctcagccccctctgcacaaagccaaccagcccccacacggtgtgccccagctctctctgtacgagcactttaactcacctcatcccacaccagctcccgctgatatttctcaaaagcaggtccaccgccctctgcaaacccctgatctgagcggtttctactccctaacttctgggagtatggggcagcttcctcatacagtgagctggttcacccatcctagcttgatgctgggatcaggagtgcccggacacccagcagccataccgcatcccgcaattgttccaccatccggcaagcaggaacttcagccatttgatcggaatctcaaaacgcaagccgagagtaaagcagaaaaggaagcaaagaagccgaccattaaaaaacccctcaacgctttcatgctttacatgaaagaaatgagggcaaaagtgatcgcggaatgcactctaaaagagagcgcagctataaaccagatcctggggaggcgctggcacgccttgtctcgggaggagcaggcaaagtactacgagctagcgagaaaggagcgccagctccatatgcagctgtacccaggctggtccgccagagataattacggcaaaaagaaaaggcgaagccgagaaaagcatcaggagagcaccactggtggcaaaaggaatgctttcgggacgtaccctgaaaaagcagccgctcccgctccattccttcctatgaccgtcctgtag

SEQ ID NO: 24683 - DNA, 1446 bp, Artificial Sequence
  Description of Artificial Sequence: Synthetic coding sequence
atgcctcagctcgatagtggcggagggggagcaggaggcggtgacgatctgggtgctcctgatgagctgctcgcatttcaggatgagggcgaagagcaggatgataaatctagagactccgctgcagggcctgagcgagacctggccgagctgaaatcctcactggtgaacgagtcggaaggtgccgcaggaggcgctgggatccccggagtgccgggagctggcgcaggcgcacgcggagaggccgaggcactcggacgagagcatgccgcacagcgcctgtttcctgacaagctccccgagcccctcgaggacggcctgaaagcacctgagtgcactagtgggatgtacaaagagaccgtctattccgccttcaacctcctaatgcattaccccccaccgtcaggagctggacagcaccctcagccccagccaccattgcacaaggcaaatcagcctccccacggggtgccccagctctcgctgtatgagcattttaactcaccacaccctacccccgctcctgcagacatctcccaaaagcaggtccaccggcctcttcaaactcctgacctaagcggcttctacagccttacctccgggagcatgggtcagcttccacataccgtgtcttggttcacgcacccatccctgatgctaggctctggtgtgccaggccacccagctgctataccccaccctgcaatcgtgcctccctcaggcaaacaagaactccaacccttcgataggaacctcaaaacccaggccgaatcaaaagccgaaaaggaggccaagaaaccaacaattaaaaaaccgctcaacgcatttatgctttacatgaaggagatgcgcgctaaggtgattgcagagtgcacactgaaagagtcagccgctataaaccagatccttgggaggagatggcacgctttgtctcgggaggagcaagcgaaatactacgagctggcccgtaaggagagacagttacatatgcagttgtaccccggatggtctgccagagacaactatggaaaaaagaaaagaaggtcccgcgaaaaacaccaggagagcaccaccgacccgggttctcccaaaaaatgccgcgctcgctttggccttaatcaacagacggactggtgcggcccttgtcgcaggaagaagaaatgcattaggtacctacctggggagggacgctgtcctagtcctgtgcctagcgatgatagtgcgctaggatgccccggaagtcctgcgcctcaggacagcccctcttatcacctactccccagattccctacagagctcctgacctcccccgcagaacctgccccaacctcccccggtctcagcacagcgctaagcctgcctactcctgggcctccacaggctccaaggagtactctgcagagcacacaggtgcagcagcaggagtcacagaggcaggtcgcgtag

SEQ ID NO: 24684 - DNA, 1101 bp, Artificial Sequence
  Description of Artificial Sequence: Synthetic coding sequence
atgtataaggaaacagtgtactccgcctttaacttgcttatgcattatccaccacccagtggagcaggacaacacccacagccacagcctccactgcataaggccaaccagcctccgcacggtgtaccgcagctctctttgtacgagcactttaatagccctcatcctacccccgcacccgcagacattagccagaagcaggtccaccgtcctctgcagacccccgacctaagtggcttctacagccttacctccggctccatggggcagttgcctcatactgtctcatggttcacgcacccatccctaatgttgggtagcggggtgccgggacaccccgctgccatcccccaccctgcgattgtaccgccttccggcaagcaggaattgcaacctttcgatagaaatctcaaaacccaggccgaatccaaggctgaaaaggaagccaagaaacccaccattaagaagcctctaaatgccttcatgctgtatatgaaagagatgagagccaaggtaattgctgagtgcacactcaaagagtccgccgctattaaccagatcttaggtcgtcgctggcacgccttgtcccgagaggagcaagcaaaatactacgagcttgcacgaaaggagcgtcagctgcacatgcagctttatcctggctggagcgctcgggacaactatggcaaaaaaaagcggcgaagtcgcgaaaaacaccaggagtcaacaaccgatcctggcagtccgaaaaaatgtagggctcggttcgggctgaatcagcagaccgactggtgcggcccatgcagaagaaagaagaagtgtatcaggtacctgcccggagagggcagatgtccgtcgccagtgcccagcgacgattcagcccttggatgtccgggatcccctgctcctcaggattctccaagctaccatttactgccaagattcccaaccgagctccttacgtctcctgccgaaccggcacctacctcccccggactgagtacagcactgtccctgccgaccccagggccacctcaggcgccacgaagcacactccagtcaactcaggtgcaacagcaagagagtcagcggcaggtcgcttag

SEQ ID NO: 24685 - DNA, 372 bp, Artificial Sequence
  Description of Artificial Sequence: Synthetic coding sequence
atgtataaagagaccgtatactctgcttttaatcttctgatgcactatcctcctccctccggcgctggccagcatcctcaacctcagccgcctctccacaaagcgaaccagccccctcatggcgttccgcagctgtccttatatgagcattttaactcaccgcacccaactccagccccagcagacatttcgcaaaagcaggtgcaccgacccctccagacccctgacctttcaggcttttatagcctcacaagtgggtccatgggccagctgccgcataccgtaagctggtttacacatcccagcctcatgttaggatcaggtgtgcccggtcaccccgcagccatccctcacccagcaattgtcccctag

SEQ ID NO: 24686 - DNA, 810 bp, Artificial Sequence
  Description of Artificial Sequence: Synthetic coding sequence
atgtacaaagaaaccgtctatagcgcctttaacctactgatgcattatccacctccttctggcgcaggacagcatccacagcctcagccacccctccataaagccaaccagccaccccacggtgtcccccaactgtcattgtatgaacattttaatagtccccaccccacgcccgctccagcagatatttcccagaaacaggttcaccggccactgcaaacccctgatttaagcggcttctactcattaacatcaggctctatggggcagcttccacatacagtttcttggtttactcaccccagcctaatgctcgggtcaggcgtgcccggtcaccccgctgcgatacctcatcccgctatagtgccaccgagcggaaagcaagagctgcagcccttcgacagaaatttgaaaacgcaggccgagagcaaggccgaaaaagaggctaagaagccaacaattaaaaagcctctaaatgcctttatgttgtacatgaaggagatgcgggcaaaagtgatcgctgagtgtacgctaaaagaaagtgcggctataaatcaaattctgggtagaaggtggcacgctctgagccgggaagagcaggccaagtactacgaactagcccgaaaggaacgacagctacatatgcaattgtatccgggttggtctgccagggacaactatggtaaaaaaaagcgcaggagcagagaaaagcaccaggagtccaccactgaaaccaactggccgagagagttgaaagatgggaatgggcaggagtctctgagcatgagctcaagttcctccccagcatag

SEQ ID NO: 24687 - DNA, 444 bp, Artificial Sequence
  Description of Artificial Sequence: Synthetic coding sequence
atgtacaaagagacagtttatagcgcatttaatttattgatgcactaccctcccccttccggtgccggtcagcaccctcagcctcaacccccactgcacaaggcgaatcagcctcctcatggcgtaccacagctctcactctatgagcatttcaacagcccccacccaactccggcacccgctgacattagccagaaacaagtccaccggccactccagactcccgatctgtcaggtttctattcgctcactagtggctccatgggccaacttcctcacaccgtgtcttggtttacacacccctctctgatgctcggctccggcgtgcccggacacccagcggctataccacatccagccatcgttccaccctcaggtaaacaggagctgcagcccttcgaccggaacctgaagactcaggctgagagcaaagccgagaagtag

SEQ ID NO: 24688 - DNA, 1767 bp, Artificial Sequence
  Description of Artificial Sequence: Synthetic coding sequence
atgccacagcttgggggtgggggaggcggagggggaggcggtagtggaggcggtggaggaagcagcgcgggagccgctggcggaggtgatgatctcggcgcaaacgatgagcttattccattccaggacgaaggaggcgaagagcaggaaccatcgtccgacagcgctagcgcccaacgggacctggacgaagtgaaaagtagcctggtaaacgaaagcgaaaaccagtcatccagttcagactccgaagcagagagaaggccacaacccgttcgtgacacttttcagaaacctagggattacttcgctgaagtgaggcggccacaagattccgctttcttcaaaggtccgccttatccagggtacccatttctgatgatcccagacctcagtagcccatatctctcaaatggaccattatcaccaggcggtgcccgaacgtacttacagatgaaatggcccctgctcgatgtgccttcctccgcgaccgtaaaagatacacggtcgccctcacccgcacatttgtcaaacaaagtgcccgttgtacagcatccacatcacatgcatccacttacaccccttatcacatattctaatgatcactttagtcctgggtcacctccaacacatttgagtccagagattgacccaaaaacaggaatccctcggccaccccatccaagcgagctgagtccttattatccactttcacctggcgcagttggtcagattccacaccccctcggttggctggtaccgcagcagggtcagcccatgtactccctgccacccggaggtttccggcatccctatcccgcattagccatgaatgcctcgatgtcaagtctagtgtcaagtagatttagcccacatatggttgcaccagcccacccagggctgccgacctcaggcattcctcaccccgctattgtgtctcctatcgtaaagcaggagcctgcccctccaagcctgagccccgctgtgtccgtgaagtctcctgtaactgtaaaaaaggaggaggagaaaaaaccgcacgtaaagaagcctttgaatgcttttatgctatacatgaaagagatgagagccaaggtggtggccgagtgcactctgaaagagagtgccgctattaaccagatactgggaagaaagtggcataacctcagcagggaggaacaagcgaagtactacgagcttgccagaaaggaaaggcagttgcattcgcaactgtacccaacctggagcgccagagataattatggaaagaagaaaaagcggaagcgcgagaaacaactgtctcaaacccagtcacagcagcaagtccaagaggccgagggggcactagcctcaaagagtaaaaaaccatgcgtgcagtacctgccacctgaaaaaccgtgcgacagccctgctagtagccacggctccatgctggactcaccagcgactccatcagccgctcttgcctctccggctgcaccagccgcaactcacagcgagcaggcccaaccactgtccttgactaccaaacccgaaacgagagcacagttggccctccattcagccgcattcctgtctgccaaagccgctgcatcttcctccggccagatgggatcccagccacctttactgtcaaggcctttacccttgggtagcatgcctaccgcgctgttagcatcacctccaagcttcccagctacgctccatgcgcaccaagcccttcctgtcctgcaggcccagccactgtctttggtaacaaaatctgcacactag

SEQ ID NO: 24689 - DNA, 1017 bp, Artificial Sequence
  Description of Artificial Sequence: Synthetic coding sequence
atggaatactttatggtgcccacacaaaaagtaccatcactgcagcactttcgtaagacggagaaagaagttataggaggactgtgtagcctggcaaacatccctctgaccccagaaacccaaagggatcaagaacgcagaattagaagggaaatcgccaactcaaatgaacgtcggaggatgcagtccatcaatgccggattccagagcctgaagacactcatcccacatacagacggtgagaaattaagcaaggcagccattctgcaacaaaccgccgagtacatctttagcttagaacaggagaagacacggctgctgcagcaaaatactcagcttaagaggtttatccaggaattgtctgggtcgtcaccaaagcggagaagagctgaagataaagacgaaggtattggctccccggatatttgggaagacgagaaagcagaggatttaaggcgcgagatgatcgaactacggcagcagctcgacaaagagcgcagcgtccgcatgatgctagaggagcaagtccgtagcctcgaggcccatatgtaccctgagaaattaaaggtgattgcacaacaagtgcaacttcagcagcagcaggagcaggttcgcctcttacatcaggaaaaactcgagcgcgagcagcaacagctccgcacacagctcttgccccctcccgcacctactcaccaccccaccgttatcgtgccagcacccccaccccctccttctcaccacatcaacgtggtgactatgggcccttcaagcgtgatcaactccgtttcaaccagccgccagaacctcgacaccattgtacaagctatacagcatatcgaggggacccaggagaaacaggagctggaggaggagcaaaggagggctgtgatagttaaaccggtccgttcgtgcccagaggcgccaacgtcggacaccgccagcgacagcgaagcaagcgacagcgatgccatggatcagagcagggaggaaccaagtggggacggagaacttccctag

SEQ ID NO: 24690 - DNA, 741 bp, Artificial Sequence
  Description of Artificial Sequence: Synthetic coding sequence
atgtatcaggtctcaggccagcgtccaagcggatgcgacgctccctatggcgcacccagtgcagcaccgggaccagcacaaaccctgtctctcctgccgggactggaggttgtcactggctcaacccaccctgccgaggcggcacctgaggagggatccttggaagaggccgctactcccatgccccagggtaatggccctgggataccgcagggattagactccactgacttagacgtccccacagaagctgtcacatgtcagccacagggcaaccccctgggatgcacgccgctgctgccgaatgactctggtcatccttctgaactcggcggaactcgtcgagccggtaatggcgctcttggcggtcctaaggctcaccgcaagcttcagacgcacccctctttagcctcccaagggagcaagaagtctaaaagctcctcgaagtcaaccacttcccagataccactgcaggcacaggaagactgttgtgttcactgtatactgtcctgcctcttctgtgagttcctgacactctgcaacatcgtactcgattgcgctacttgtggctcctgctcatccgaagattcttgtctgtgctgttgctgttgcggatccggcgagtgtgctgactgcgatctcccttgtgacctagattgtggtatattggatgcgtgttgtgagagcgctgactgtcttgaaatttgcatggaatgttgtggtctgtgcttttcttcatag

SEQ ID NO: 24691 - DNA, 1689 bp, Artificial Sequence
  Description of Artificial Sequence: Synthetic coding sequence
atgtctgaggaggacaggactttttccttcggccctggaacccggaaactgggttttatgtctcaacttagcccggcatgcagtgtcaccctgggaaaaagtctgcctctctcagggctcggggttttctcttctaagatggacgcagtgcccgtgatcctggccagtccatgccagccgctctgtttcgaggaggacacctgcctcatctacctgctgcccctgctgatccaccgtgagcctgcccctgccgctactatggccagccgtattggcttgcggatgcagctaatgcgagagcaggcccagcaagaagagcaacgcgagaggatgcagcaacaggcggttatgcactatatgcaacagcagcagcagcagcagcagcagcagttagggggtccaccaaccccagccattaacactcctgttcactttcaaagcccgcctccagtacccggagaagtgctcaaagtgcagtcatacttggagaatcctaccagttaccacctgcaacagtctcagcatcaaaaggtgcgcgagtatctttcagaaacatatggcaacaaattcgccgctcacatatcaccagcgcagggctcaccaaagccccctcctgctgcctctcccggtgtaagagcagggcatgtgctctcgtccagcgcaggcaattccgcccctaactcccccatggcaatgctgcacatcggctccaacccggagagggagctcgatgatgttatcgacaacattatgaggctggacgacgttctggggtatataaacccagaaatgcagatgcccaacacgctgccgttatctagctcgcatctgaatgtctactctagtgaccctcaggtcactgcatccctggttggtgttaccagtagcagctgtccagctgacctgacacagaaaagagaactgacagatgccgagagtagggctctagctaaagaacgacaaaagaaagataatcataatctcatcgaaaggagaaggaggttcaacatcaacgatcggattaaggagttgggaatgcttataccgaaggccaacgatcttgatgttcgatggaacaaagggaccattctcaaagcgagcgtggactatattagaaggatgcagaaggaccttcagaagagtcgggagctcgaaaaccactccagaagactcgagatgacgaacaaacaactgtggcttcgtatccaggagctggaaatgcaggcccgagtacatggcctccccacaacgtccccttcaggcatgaacatggccgagctggcccagcaggtggtaaagcaggagctgccctcagaggagggaccgggagaagctcttatgctgggcgctgaagtccccgatccagaacctttgcctgccctgccaccacaggctccactgcccctgccaacgcagccaccaagcccattccatcatctggatttcagccattctctcagcttcgggggtagggaagacgagggcccacctggataccctgagcctcttgctccaggccacgggtcgccctttccatctttaagcaaaaaagatttggacttgatgcttctggacgacagccttttacccctggcctccgatcctctcctgtctacaatgagccccgaagcctctaaggcaagtagccggagatccagtttcagcatggaagagggcgacgtgctttag

SEQ ID NO: 24692 - DNA, 1473 bp, Artificial Sequence
  Description of Artificial Sequence: Synthetic coding sequence
atgaccgcctcctctggctgggaaccggcacccgcagccacaatggcttcaaggatcgggttaaggatgcagctcatgagagagcaggcccaacaagaagaacaacgggagcggatgcagcaacaagcagtcatgcattatatgcagcagcagcaacagcagcagcagcagcagttgggtgggcctcctaccccagctattaacacccccgtgcacttccagtcgccacccccagtaccaggtgaggtgttgaaggtccagagctatctagagaaccccaccagctaccatctgcagcagtcacagcatcagaaggtgcgggagtatctctctgaaacgtacggcaataaatttgcagcccacatatccccagctcagggcagtccaaagcctccacctgccgctagtccaggagtacgggctggacatgtcctgtctagcagtgccggaaacagcgctccaaattctcccatggcaatgctacatatcggatccaaccctgagcgcgaactggacgacgtcattgataatataatgaggctcgacgatgtactggggtacatcaatccagaaatgcagatgcccaataccctgccattgtcttctagtcatcttaacgtgtattcgagcgacccccaggtgaccgccagtctggttggcgtaaccagctcttcttgtccagcagatttaacccagaagcgcgagctgaccgatgcagagtcccgggcactggctaaggaacgccagaagaaagataaccacaacctgatcgaacgtcggaggaggttcaacattaatgaccgcattaaggagcttggaatgctgatccccaaagcgaacgacttggatgtcaggtggaataaggggaccatcttgaaagcctctgtcgactatatccggaggatgcagaaagacttgcaaaagtctcgggaattggagaaccattcgcgaagactcgaaatgactaacaagcagctgtggttgagaatccaagagctggaaatgcaggccagagtccatgggctgccaacgacgtcaccgagcggaatgaacatggcagaacttgcccagcaggtggtcaaacaggagttgccgtcagaggagggcccaggtgaggccctgatgctcggggcagaggtacctgatccagagcctctgcctgcactgccgcctcaggcacccctgccactgcctacccagccaccttccccttttcaccacctcgatttctcacactccctctccttcggtggtagggaggacgagggtccgcctggctaccccgaaccactggcacctgggcatggaagccctttcccgtccctgagtaagaaggatttggacctgatgctactggatgacagcctgttacccctggcttctgacccccttctatctactatgtcccctgaggcctcaaaagcaagctcacggaggtcctctttctctatggaggagggcgacgtgctgtag

SEQ ID NO: 24693 - DNA, 1431 bp, Artificial Sequence
  Description of Artificial Sequence: Synthetic coding sequence
atggccagcagaattggcctcaggatgcagctgatgcgggagcaagcccagcaggaagagcagcgggagcgtatgcagcaacaggcggtgatgcattacatgcaacagcagcagcaacaacagcagcagcagttgggaggccctcctacacctgctattaatacaccggtgcacttccagtctcctccccctgtgccgggtgaggtgctcaaggtgcaatcatatctcgaaaaccctacaagctatcaccttcaacagtcacaacaccagaaagtgagagaatacctttccgagacctacggaaacaagtttgcagcacacatttctccagcccaggggtcccctaaacccccaccagccgcaagtccgggagtccgagcagggcatgtcttgagttcctctgccggaaactccgcaccaaattcccccatggcaatgctgcacatcggctctaaccctgaacgggagctggacgacgtgatcgacaacataatgagactggatgacgtgctaggttacatcaatcccgaaatgcagatgccgaacacccttcctttatctagtagccacttaaatgtatactcttccgacccccaggtaacggctagtttggtaggggtgacatcttcctcgtgccccgcagatttgacccagaagcgcgagttaaccgatgctgagtcacgggctctcgccaaggaacggcaaaaaaaagacaatcacaacttgatcgaacgaagacgcagatttaatatcaacgacagaatcaaagagttaggtatgctgattccgaaagcgaatgacctcgacgtgagatggaataaaggcaccatactgaaagcctctgtcgattacatccggagaatgcaaaaggatctgcagaagtccagggaactggagaaccactctcggagactcgagatgactaataaacagctgtggctgcggatccaggagctggaaatgcaggctcgtgtacacggcctccctaccaccagcccatcaggaatgaatatggcagagttggcacagcaggtggtgaagcaggaattgccatctgaggaaggcccaggagaagccctcatgctcggcgcagaagtcccagatcctgagcctttgcccgcactgccgccacaggcccctcttccactacctacccagcctccaagccctttccatcacctggatttcagccactccctcagcttcgggggaagagaagatgagggtccacctggctaccccgagcctctggctccaggccacgggtctccatttccaagcttgagcaaaaaagatctagaccttatgctgctggatgactccctgctgccgctggcttctgatccactgttgagcacaatgtcccctgaggcttctaaggcatctagccggaggtcatctttcagcatggaggagggtgacgtattgtag

SEQ ID NO: 24694 - DNA, 807 bp, Artificial Sequence
  Description of Artificial Sequence: Synthetic coding sequence
atggcaagccggattggactcaggatgcaactgatgcgcgaacaggcacaacaggaagagcagcgggagcgtatgcagcagcaggccgtgatgcattacatgcagcaacagcaacagcagcagcagcagcagcttggcggtcctcctacgcccgcaatcaacacacctgtgcacttccagtccccgcctccggtgcccggagaggttttgaaagtgcaatcatacctcgagaaccctacatcctaccatctccagcagagccaacatcagaaggtgcgcgaatatttatccgagacttatggcaataaatttgcagcacatatttcgccagcgcagggttcccccaagccgccacccgctgccagtccgggagtgcgagcgggtcatgtcctgagttccagcgcaggcaacagtgcccctaatagtcccatggccatgttgcacatcgggtcgaacccagaacgggagttagatgacgtaattgacaacattatgcggctcgatgatgtgctaggctatatcaaccctgaaatgcaaatgcctaatacattgcctctgtcctcatctcaccttaatgtgtacagcagcgatccccaggtcaccgccagcctggttggcgtgacctcctcctcatgtcctgctgacctcacgcaaaagcgggagctcaccgacgcagagtcgagagcactggccaaggaacgacaaaagaaagataaccataacctgatcgagcgcaggaggagatttaacataaacgataggattaaggaacttggcatgctaatcccaaaggcaaatgacctgtag

SEQ ID NO: 24695 - DNA, 1431 bp, Artificial Sequence
  Description of Artificial Sequence: Synthetic coding sequence
atggccagtcgtattggattgagaatgcaattaatgcgcgaacaagcccagcaggaagaacaacgcgaacgtatgcagcaacaggctgtgatgcattatatgcagcaacaacagcagcaacagcagcagcagctcggaggcccaccgacgcctgctatcaatactccagtgcactttcagtcacctcctccagtaccgggtgaggtgctgaaagttcagtcctacctggagaacccgaccagctatcatttgcagcagtctcagcatcaaaaggtgcgcgagtatctatccgagacttatgggaataaattcgctgctcacataagccccgctcaaggtagccctaagccaccaccggcagctagtcccggtgttagagccggtcacgtcctctcaagcagcgccggtaactcagctccaaattcacctatggctatgctgcacatcggaagcaatccagaacgcgaactcgatgatgtgatagacaatataatgagactcgacgacgttctgggatatatcaatccggaaatgcagatgccaaacactctgcccttgagcagcagccacctaaacgtgtacagtagcgacccacaggtgacggccagtctggttggcgtcacaagcagcagctgtccagccgacctgacacagaagcgcgaattaactgatgcagagtcacgcgctctggcaaaagaaaggcagaaaaaagacaatcacaaccttatcgagaggagacgtaggttcaatataaacgacaggattaaggaacttgggatgctcatccctaaggctaacgatcttgacgtgcgctggaataaggggaccatacttaaggcatctgtggactacatcagacggatgcagaaggatctccagaagagccgggagctggaaaaccactctcgcaggctcgaaatgacaaacaaacagctctggctccggatacaagagctagaaatgcaggcacgggtgcatggcctacccacaacaagtccctctggtatgaacatggccgagctggcccaacaggtggtgaaacaggagcttccgagcgaggaggggccaggcgaagctttgatgctcggcgcagaagttcctgaccctgagccacttccagctctcccaccccaggcacccctgcctctccctacacagccaccctcaccattccatcacctggatttcagccactccctgtcatttggcggacgggaggacgaaggccctcctggatatcccgaacctcttgccccaggtcacggaagcccatttccgtcactctctaaaaaggacctggatctcatgctgctggacgatagtttacttcctctggctagcgatcccttacttagcactatgtcccctgaggcttctaaagctagctctcggcgttcctcgttctcaatggaggaaggggatgtcttatag

SEQ ID NO: 24696 - DNA, 735 bp, Artificial Sequence
  Description of Artificial Sequence: Synthetic coding sequence
atggccagccgcatcggccttaggatgcagttgatgagagagcaagctcagcaagaagagcagcgggaaagaatgcagcagcaggctgtcatgcactacatgcagcagcagcagcagcagcagcagcagcagttaggcggtcccccaacaccggctatcaacacacccgtccatttccagtctcctcccccagtgccaggggaagtcctgaaagtgcagagttatctggaaaatcccactagctaccatttacagcagagtcagcatcagaaggtccgcgagtacctgagtgaaacatacggcaacaaattcgcagcgcatatttcacctgcacaaggctcacctaagcctccaccggcagcaagcccaggcgtaagggcagggcacgtgctctcctctagcgccggaaattctgcacctaacagcccaatggccatgttgcacattggatctaacccagaacgtgaactggatgacgtgatcgacaacatcatgcgactagacgacgtcctcggttatataaaccctgagatgcagatgcccaacacgctacccctgtccagttcacacctcaacgtttactccagtgacccacaggttacggcatctctggtcggcgtgacctccagttcatgccctgctgatcttacgcagaaaagagaattaacagacgctgagtcccgcgctctagccaaggagaggcagaaaaaagacaatcacaatctcatcgagtag

SEQ ID NO: 24697 - DNA, 807 bp, Artificial Sequence
  Description of Artificial Sequence: Synthetic coding sequence
atggcatcacgtattggcctgcgaatgcagctaatgcgtgaacaagcacaacaggaagagcagagggagcgcatgcagcagcaagctgtgatgcattatatgcagcagcagcagcagcaacagcaacagcagctggggggaccccctaccccagctatcaacacaccagtccatttccaaagccctcctccggtccccggagaggttctaaaggtacagtcttacttggagaaccccactagttatcacctgcagcaaagccaacatcaaaaggtcagggaatatctctcagagacgtatgggaataagtttgccgcacacatatcacccgcacagggctcgccgaagcccccacctgccgcatcacccggagtgagggccggtcatgtgttgagttctagtgcaggaaatagtgccccaaactctcccatggcgatgctccatataggctctaatcccgagagagagctggacgatgttattgacaacattatgcgactcgacgatgtgttggggtacatcaatcccgagatgcagatgccgaatacactccctttgtcatcgagtcaccttaatgtatactcctcagatccgcaggtcacggcctcactcgtcggagtgactagctcatcctgcccagctgacctcacacagaaaagagagctgaccgacgcagagtcccgggcactggctaaagagcggcagaagaaagacaatcataatcttattgaaaggcggagacgtttcaacattaacgaccggattaaggagctgggcatgttaataccgaaagctaacgacctctag

SEQ ID NO: 24698 - DNA, 672 bp, Artificial Sequence
  Description of Artificial Sequence: Synthetic coding sequence
atggcctccagaatcggcctgcgaatgcagctcatgagagagcaggctcaacaagaggaacagagagagaggatgcaacaacaggccgtgatgcactatatgcagcagcagcagcaacagcagcagcaacaattggggggaccccctacccctgccattaatacccctgtgcacttccagtcccctcctcctgttcctggggaggtcctaaaggtccagtcctacttagaaaaccctacctcttaccacttgcaacagagtcagcaccagaaggttcgggagtatctgtccgagacttatggcaataagttcgcagcccacatcagtcctgcgcagggcagccccaagccgccacccgcagcttcccctggggtcagagccggacatgttttgtccagtagcgctgggaactctgctccgaattctcctatggccatgctgcacatcggaagtaatccggaaagagagctggacgacgtgattgacaatatcatgagattggatgatgtcctaggatatattaaccctgaaatgcagatgcctaatacgcttcctcttagtagctcccacctgaacgtgtacagttccgatccgcaggtcaccgcttccctggtgggcgtcacatcctccagttgccccgcagatctcacccagaaaagggagctgacgtag

SEQ ID NO: 24699 - DNA, 216 bp, Artificial Sequence
  Description of Artificial Sequence: Synthetic coding sequence
atggccagcagaattggactgcgtatgcagctcatgcgggagcaggcccaacaggaagaacagagggaacgcatgcagcagcaggccgtgatgcactacatgcagcaacagcagcaacagcagcaacagcagctcggcggtcctcccactcctgccattaatacccccgtccactttcagtcccctccccctgtcccaggtgaggtgctcaaatag

SEQ ID NO: 24700 - DNA, 1176 bp, Artificial Sequence
  Description of Artificial Sequence: Synthetic coding sequence
atggctagcaggataggcctgcgcatgcagcttatgcgggagcaggcccagcaggaggaacagcgcgagcggatgcagcagcaggccgtcatgcattatatgcagcagcagcagcagcagcagcagcaacaactgggagggcctcctacacctgcaattaacaccccagtccatttccagtcccctcctcctgtgccaggcgaggtcctgaaactcgatgacgtcattgataacatcatgagactggatgatgtgctaggctatattaaccccgagatgcaaatgccaaatacacttccattgagtagctctcatttaaacgtgtactcttcagatccacaagttaccgccagcctggttggcgtaacttctagctcctgccctgctgatctgacacagaaacgggaattgactgatgcagaaagtcgggcactggcgaaagagcgccagaagaaggataatcataacttgattgagcggcgtagacgcttcaatattaatgatcgaattaaggaattaggcatgctgattccaaaggccaacgatttggatgtgaggtggaacaaaggtacgatcctgaaagctagcgtggattacatccggaggatgcaaaaggatttgcagaaatcacgagagctcgaaaaccattccaggagactggaaatgacgaataagcaactgtggctgcgtatacaggagttggaaatgcaggctcgggtgcacggactgccgactacctccccttccggtatgaatatggctgagctggctcagcaggttgtgaagcaggagctgccgagcgaagaaggcccaggggaggccctcatgctcggagcggaggtgccagatcctgagcccctcccagccctgcctccgcaggctcccttgcctctgcctacacagccgcctagtccgttccatcacctcgacttcagccattctttgtcgtttggcggtcgcgaagatgagggccctccgggatatcctgagccgcttgcccctggtcatgggtccccatttccaagtctgtctaaaaaagacttggatctgatgttactggacgattctctgcttccgttagcgtcagacccgctgctgtcgaccatgagtcctgaagcatctaaagccagtagcagacggagcagctttagtatggaggagggagatgtcctctag

SEQ ID NO: 24701 - DNA, 240 bp, Artificial Sequence
  Description of Artificial Sequence: Synthetic coding sequence
atggcatcaagaatcggactgcggatgcagctgatgcgggagcaagcacagcaggaagagcagcgagagcgcatgcaacaacaggctgtaatgcactacatgcagcagcagcagcaacaacagcagcaacagttgggcggtcccccaaccccagccataaatacacccgttcacttccagtcacctcctcctgtcccaggggaagtgctgaaggtccagtcctacctcgagaacccctag

SEQ ID NO: 24702 - DNA, 99 bp, Artificial Sequence
  Description of Artificial Sequence: Synthetic coding sequence
atggccagcagaatcggcctccgcatgcaactgatgagggagcaagcgcagcaggaagaacagagagagaggatgcagcagcaggctgtgatgcactag

SEQ ID NO: 24703 - DNA, 39 bp, Artificial Sequence
  Description of Artificial Sequence: Synthetic coding sequence
atggcatcccgcattggattacgcatgcagctgatgtag

SEQ ID NO: 24704 - DNA, 216 bp, Artificial Sequence
  Description of Artificial Sequence: Synthetic coding sequence
atggcctctcggatcggactgagaatgcaattgatgcgcgagcaagcccagcaggaggaacaacgcgagcggatgcagcagcaggctgtgatgcactatatgcagcagcaacagcagcagcaacagcagcaactcggcggaccacccaccccggcaatcaatacccccgttcactttcagtcaccacccccagtcccaggggaagtgctgaaatag

SEQ ID NO: 24705 - DNA, 39 bp, Artificial Sequence
  Description of Artificial Sequence: Synthetic coding sequence
atggcctctaggataggattacggatgcagctaatgtag

SEQ ID NO: 24706 - DNA, 1044 bp, Artificial Sequence
  Description of Artificial Sequence: Synthetic coding sequence
atgaccctggaccaccagattatcaatcctacacttaaatggagtcagcctgccgtgccctctgggggacccctggtacaacatgcgcacactactctcgattcagacgctggccttacagaaaacccgttgaccaaactcctggccataggcaaagaggacgacaatgctcagtggcacatggaggatgtgatagaagatatcatcgggatggagtcatcttttaaagaggaaggagccgacagtccattactaatgcaacgcaccctgtccggtagcattctagacgtttattctggggagcagggtatatccccgattaacatgggtctgacaagcgcctcttgcccgagttccctgccaatgaagagggagattaccgagactgatacacgggctttagccaaggaacgtcagaaaaaagataaccacaacctaattgagcgtaggcgtaggtataacataaattacagaatcaaggaactcgggacattaatacccaaatccaacgacccagatatgcgatggaataagggcaccatcttgaaagcgagcgtagaatatattaagtggttgcagaaggaacagcagcgtgcacgggagctggagcacagacagaaaaagctcgagcaggctaaccggaggctgctgctgcgcatccaggagctggaaatccaggcaaggacccacggactgcccactctggcctcgctgggcaccgtggatctaggagcacacgtgaccaagcagcaatcccaccccgaacagaacagcgttgactactgccagcagctcacagtgtcccagggaccatctcctgaactttgcgatcaggccatagccttttccgacccactctcttacttcacagaccttagtttctccgccgctctgaaggaagaacagcgcctggacgggatgttgctggacgatacaatcagccctttcggaacagaccccctgctcagtgccacgagccccgcagtgagcaaagaaagttcaaggcgatcatcattctcttcagatgatggcgacgagctctag

SEQ ID NO: 24707 - DNA, 957 bp, Artificial Sequence
  Description of Artificial Sequence: Synthetic coding sequence
atgacccttgatcatcagatcattaacccaacacttaagtggtcccagccggcagtcccttcaggaggacccttagtccagcacgcacatactacactcgactcggatgccggtctgactgaaaatcccttgacaaagttgctggccatcgggaaggaggacgacaacgcccaatggcacctatctggttcaatcttggacgtatattctggagaacagggcatctcacccatcaacatggggctgacaagtgccagttgcccttcttctctgcccatgaagcgcgagattaccgagactgatacccgggctctcgccaaggagagacagaaaaaggacaaccacaacctgatcgagcgaaggcgcagatataatataaactatcgtattaaggagctaggcacccttatcccaaaatctaatgatcccgacatgcgctggaataagggcacgatattaaaagctagcgtcgaatacataaaatggctccaaaaggaacagcagagggctagggaattagagcacagacagaagaaactggagcaggcaaataggagattgctgcttcggattcaagaactcgaaattcaggcccgaacccatggactgcctacgcttgccagcctaggcacagtggatctgggagctcacgtcactaaacagcagtcacatccagaacaaaacagtgtagactattgtcagcaactaacagtgtcccagggccctagtccggaactgtgcgatcaggccatagcgttctccgatccccttagctatttcactgatctaagctttagtgccgctctcaaggaggaacagagactggatgggatgctgcttgacgacacaatcagtccgttcgggacagatccgctgttaagtgctacaagcccggcagtgagcaaggagtcatcccggaggagttcattttcttccgacgatggtgatgagctttag

SEQ ID NO: 24708 - DNA, 594 bp, Artificial Sequence
  Description of Artificial Sequence: Synthetic coding sequence
atgactctggaccatcagatcatcaaccccaccctcaaatggtcacaacctgccgtgccaagtggaggacctttggtgcagcacgcccacaccacactagattccgacgctggcttgacggaaaacccactgaccaagctcctggccatcgggaaagaagacgacaacgctcagtggcacctcagcgggtcaattctggatgtgtactctggggaacaggggattagccccataaatatgggcctgacatctgcaagctgtccgtcctcactgccaatgaagcgtgaaattactgaaacggatactagagctctggcgaaggaacgacagaagaaagataatcataacctgatcgagcggcgaaggcggtacaatatcaactatcggattaaagagcttggcaccttaattcccaagtctaatgatcccgacatgaggtggaataagggcactatcctaaaggccagtgttgaatatatcaagtggttgcaaaaagaacagcaacgagctcgggagttggaacaccgacagaagaaactggaacaggccaatcgcaggctgctcttgcgcatccaggtgttcatccggatgtag

SEQ ID NO: 24709 - DNA, 843 bp, Artificial Sequence
  Description of Artificial Sequence: Synthetic coding sequence
atgatgaaggagaaagaaaaaactattgccatagttaaagtaatcgacaccagcaagctgaaactgcttagtggcagtattctcgatgtttatagcggagaacagggcatttcaccaatcaatatggggcttacatctgcttcatgtccttcctccctgccaatgaagcgggagattaccgaaactgatactagggcgctcgctaaagagagacagaagaaagataaccataacctcattgagagaaggcgcaggtataatatcaactaccgaattaaagaactgggcaccctgatacccaaaagcaacgatccagatatgcgatggaacaagggaacaattctgaaagcttcagtggagtacattaagtggctgcagaaggaacagcagcgcgctagggaactggagcaccgccaaaaaaagctcgaacaagccaaccgccgactgctgttgcggattcaggagttagagatacaggcaaggacccacgggttgcccacgctggcctctttaggcacggttgatttgggcgcacacgtgacaaaacagcagagtcaccctgagcagaacagtgtcgactactgccagcagctgactgtatcccagggcccaagccccgagctctgcgatcaggccattgcttttagtgacccactgtcctacttcacagatttatctttctcagccgcactgaaagaggagcagcggctggatggcatgctgctggatgatacaatttcgccttttggcaccgatcctctgctgagcgcgacgtcccctgccgtctcgaaggagtcctctcgtcgcagttcattttcaagcgatgacggagatgaactgtag

SEQ ID NO: 24710 - DNA, 951 bp, Artificial Sequence
  Description of Artificial Sequence: Synthetic coding sequence
atgttacaggcccttacaggactgcagtttcagctgaaggaacaactcggagagaaggagcggaggctgcagatttcgcaagagatttctgctcaccgaacagagtttcacatgcagtttagctacaagcccgtgctccataggctggttcctgctcgtccccagatctactccagtcagctgcccagtttcacccgggtacccgctcaccttgagtcttccgcccgaccacagttacagaaagcccagcgccagaaggtcaattcgttcatgaccctggatcaccagatcattaatcccaccctgaagtggtctcagcccgctgtgccctcaggcggaccactcgttcaacacgcacacacaacgctcgatagcgatgctgggcttacagaaaacccgctgactaagctgctggctatcggtaaagaggatgacaatgcccaatggcacatggaggacgtcatcgaagatattatcggtatggaatcttctttcaaagaggagggcgctgacagcccgttgctgatgcaacgcaccctgtccggcagcatcttagatgtgtatagcggagagcaaggaattagccccattaacatgggcctgacgagcgctagctgtccaagttcattgcccatgaaacgcgagatcactgagacagacactcgagcactcgctaaagaacgacagaagaaggataaccataatctgattgaacggagacggagatacaacattaactatcgtataaaagagctcggcaccctcattccaaaaagcaatgaccccgacatgcgctggaataaaggaactattttgaaggcatcggttgagtacattaaatggctgcaaaaggagcagcaaagagccagggagctcgaacaccgccaaaagaaactggagcaggcaaacagacgcctgctgcttcgcatccaggtgtttataaggatgtag

SEQ ID NO: 24711 - DNA, 2169 bp, Artificial Sequence
  Description of Artificial Sequence: Synthetic coding sequence
atgcctctgcaccagctcggcgacaaacctctgaccttccccagtcccaatagcgctatggaaaacggtctcgatcatacccccccatcacgccgagctagtccaggaactcccctgtcacccggatccctgcgaagcgccgctcattccccgctagacacatctaaacagccactctgtcaattgtgggccgaaaaacatggagctcgcggtacccatgaggtgagatacgtttcagctgggcagtcggtggcctgcggctggtgggccttcgccccaccatgcctgcaggtgttgaacacaccgaagggaattctgtttttcctttgcgctgcagccttccttcaaggcatgacagtcaacggcttcattaacactgtgataacaagtttggagcgtagatatgacctccactcttaccaaagtggattgatcgcctccagctatgacattgccgcatgcctgtgcctgacatttgtctcctatttcggcggttcggggcacaagccacggtggctcggatggggcgtgttgcttatgggaacaggatctctcgtgttcgctctgcctcacttcactgcaggccgatacgaagttgagttagatgctggtgttcggacgtgccctgccaaccctggcgcagtgtgcgccgattctacatcaggactgtcacggtaccagctggtgttcatgctgggccagttccttcacggcgtgggtgcaaccccactgtatactcttggcgtgacttacctggacgagaatgttaaaagctcctgcagcccagtctacatcgccatattctacacagctgcaattttgggaccggctgctggttatttgatcggcggagccctacttaacatttatacggaaatggggaggagaaccgagttgactacagaatcccccctttgggttggagcctggtgggtaggttttttgggtagtggcgctgcagcttttttcaccgcagttcccatccttggatatccgaggcagctccccggatcacaacgctacgctgtcatgagggccgcagagatgcaccagctgaaggattcttccaggggcgaggcctctaacccagatttcgggaaaacgatccgtgacctgcctctgagtatctggctccttctcaaaaatccgacgttcattcttctgtgcctggctggagcaaccgaggccacacttatcacgggtatgtccacattcagcccaaagtttctggagagccagttctcactgagcgcttctgaagcagctactctgttcggttacctggtcgttcctgcgggaggagggggtaccttcttgggtggtttcttcgttaacaaactccgcttgcgtggctcggcagttataaagttctgtctgttctgcacagtggtaagcctgctgggcatcctcgtgttttctctccattgcccatccgtgcccatggctggcgtgacagcctcatatgggggaagcctgctgcctgaggggcacctcaacctgactgccccttgcaacgccgcatgttcatgccagcccgagcactacagtccagtctgtggctccgacggccttatgtactttagcctgtgtcatgccggttgtcctgctgctacagaaacaaacgtggacgggcaaaaggtgtatcgcgactgcagttgcattccacagaacttatcaagcggatttggccatgccacagccggaaagtgtacctccacatgtcagaggaagcctcttctcctggtcttcatcttcgtggttatttttttcacttttctgtcttccattcctgctctcaccgctacccttcgatgcgtgcgagacccccagcggagctttgctctgggcatacagtggattgtcgtgcgtatactggggggaattcccggaccgattgcctttggatgggtgattgacaaagcctgcttgttatggcaggatcagtgtggccagcagggctcctgcctggtgtaccaaaatagcgcaatgagtcggtacattctgattatgggactgctttataaggtcctgggagtccttttctttgccatcgcctgctttttatataaacccctgagtgaaagctcggatgggttggaaacttgtctcccttctcagtctagtgcccctgactcagccactgattcgcagctgcagtcttctgtttag

SEQ ID NO: 24712 - DNA, 1503 bp, Artificial Sequence
  Description of Artificial Sequence: Synthetic coding sequence
atgtctggccctggcccacgggaaccgccacccgaagcaggtgcggcagggggagaggcagcagtcgaaggagcaggtggaggtgacgctgctctgggagagcctgggctgtctttcacaaccacagacttgtcccttgtggaaatgaccgaagtggaatatacccaactccagcacatcctgtgctcacacatggaggccgctgccgatggcgaactggagaccagactcaatagcgcactgctggcagctgccggtccgggagccggagccggaggttttgctgcgggaggccaaggcggagccgcacccgtgtaccccgtgctgtgtccaagtgccctcgctgccgatgccccatgcctggggcatatcgatttccaggaacttcgcatgatgttactgagtgaagccggtgccgctgaaaagacttctgggggaggcgacggcgctagagcgagggccgatggcgcagccaaagagggagcaggcgcagccgctgctgcagcgggacccgacggcgctccagaggctcgggctaagcccgctgttcgtgtacggctcgaagacagatttaattccatacccgcagaaccgccacccgcacccaggggaccggaacccccagagcctgggggtgccctgaataacctcgtgaccttgatcaggcacccctccgagctcatgaatgtgccactgcagcagcagaataagtgtaccgcgctggtaaaaaataaaactgccgctaccaccaccgctttgcaatttacctatcccctgttcactactaacgcctgtagtacctcaggcaactcgaatttgagtcagacacagtcaagctctaactcctgttcagtattagaggcggcaaaacaccaagacattggcctgccccgtgcattcagtttctgctatcagcaagaaatcgaaagcaccaaacagacactgggctctcgcaataaggtgctgcctgaacaagtatggatcaaggtaggagaggctgcgctttgtaaacaggcattaaaacgaaatcgcagtcggatgagacagctagataccaatgtagaacgccgagcactgggcgaaatccaaaacgtgggcgagggcgcaacagctacccagggcgcatggcagtcttccgagagctcccaggccaacttgggcgagcaggcacagtccggaccccagggtggccgaagccaacggagggagagacacaatagaatggagagggatagacggcgtcggattagaatttgctgcgacgagctaaacctcttggtgcccttttgcaatgcagaaaccgataaggctaccacactacaatggactaccgccttcctcaaatacatccaagaacggcatggagactccctgaaaaaagagttcgaatccgtcttttgcggtaagaccggaagacggctgaagctgacacgcccagattccttggttacctgccccgcacaggggtcccttcagtcttcccctagcatggagatcaaatag

SEQ ID NO: 24713 - DNA, 1008 bp, Artificial Sequence
  Description of Artificial Sequence: Synthetic coding sequence
atggcaaccttcgtttcagaactcgaggctgccaaaaagaatttgagtgaagcattgggggacaatgtcaaacagtactgggcaaacctgaagctgtggtttaagcagaaaatctctaaagaagaatttgacctggaggcacaccgcctcctgactcaagataacgttcacagccacaatgactttctgctggccatcctgacgcgctgtcagattctcgtctcaacccctgatggtgcaggtagcctgccatggcctgggggttcagctgctaaacctgggaaaccaaagggcaagaagaagctgtccagtgtccgccagaagtttgatcaccgtttccagccccagaatcccttgagcggtgcccagcagttcgtggcgaaagacccccaagatgacgacgatctcaagctgtgcagtcacactatgatgcttccgactcgcggacagttagaggggaggatgatagttacggcctacgaacacggcctcgacaatgtgacagaagaagccgtcagcgctgtggtgtacgctgtggaaaaccatcttaaagacatcctcacatccgtggtatcgcggagaaaggcttaccggctacgcgatggtcacttcaagtatgcctttggatctaacgttacaccacagccttacctgaaaaatagcgtggtcgcttacaacaatcttattgaaagtcccccagctttcactgccccttgcgcaggacagaaccccgcttcacacccacccccagacgatgccgaacagcaagcggctttgctcctagcgtgttctggcgatactctgcccgctagtctccccccagtgaatatgtatgatctgtttgaggcactccaggtgcatcgggaggtgatccctactcatacggtttacgccctcaacatcgagcggatcattaccaaactctggcaccctaaccacgaagagttgcagcaggacaaggttcaccggcagaggctcgctgcgaaggagggtctgctgctgtgttag

SEQ ID NO: 24714 - DNA, 2286 bp, Artificial Sequence
  Description of Artificial Sequence: Synthetic coding sequence
atgagcagaaaaggtccaagggcggaagtctgcgccgactgttctgcccctgatccaggctgggctagcatttcaagaggagtccttgtgtgtgacgagtgctgctcagtccatagaagcttaggcaggcatatctccatcgttaaacatctgcggcacagcgcctggcctcccaccttgttgcagatggttcacactctggcatccaatggggcaaatagcatatgggagcactcgctgctggaccctgcacaagtgcagtctggtaggagaaaagcgaacccacaagataaggtgcaccctattaagtccgagtttatccgcgctaaatatcagatgctagcctttgtacataagcttccctgtcgtgatgatgacggagtcacagccaaagacctgagcaagcagctgcactcctccgtgcgtactgggaatctggaaacctgtttacgtctgctgtccctgggcgctcaggcaaatttttttcacccagagaaagggactactcccctgcatgttgctgctaaagccggacagacgttgcaggccgaactcctggtggtgtacggggcagaccccggaagtcccgatgtaaatgggagaacaccaatcgattatgcccgacaggccggacatcacgagctggccgaaagactggttgaatgccagtatgagctcacggataggctcgcattctatctttgcggacggaagcccgaccacaagaatggacactacattataccacagatggctgactctctcgatcttagcgaactggctaaggctgccaagaagaagctgcaggcactgagcaataggttgttcgaagagctcgctatggacgtttacgatgaggtcgatcgacgtgaaaacgatgcagtttggctagcaacccagaatcactccacactcgtgacagagcgcagcgcagttcctttcctaccagtgaatcctgaatactctgctacacgcaaccagggtcggcaaaaactggcaagattcaatgcccgtgaattcgcgactctgataatcgatatacttagtgaggcaaaacgccgtcaacaggggaagtccttgtccagtcccaccgacaatctggagctgtccttacgctcacagagcgacctggacgaccagcacgattatgatagtgtcgccagcgatgaggacaccgatcaggaacctttgaggtccacgggagctacaagatctaatagagccagaagcatggactcaagtgacctttcagatggagctgtgaccctgcaggagtacctcgaactgaagaaagctcttgctacatcagaggcaaaggtgcagcagctcatgaaagtaaattcttccctatccgacgagttacgaagactccaacgcgagatacacaaactgcaggcggagaacctacagctcaggcagcctccaggccctgtacctacccctcctctcccatctgagagagcagagcatactcccatggcccctggcggttccacgcacaggcgcgacaggcaagcgttctctatgtacgaaccaggctctgccttgaagccctttggaggaccccctggtgacgagctgaccaccaggttacagcccttccatagcacagagctggaggacgatgctatatatagcgtccacgtcccagccggtctgtaccgaatccggaagggagtaagtgccagcgcagtgccttttacaccttcaagccctctgcttagctgttcacaagagggcagtcggcataccagtaaactgagcagacatggatctggcgcagatagtgattatgagaatacacagtctggagatcctctcttgggacttgagggaaagcgattcctggagcttgggaaggaagaggattttcaccccgaactggagtcactggacggtgatctggacccaggtctgccgtctacagaggacgtcattcttaagacagagcaggttaccaaaaatatccaagagcttctcagagcagcccaggagttcaaacacgattccttcgtgccctgctcagaaaagatccaccttgccgtgaccgaaatggcaagtctgtttccgaagaggcccgctcttgagccggtgaggtccagtcttaggctgctcaatgcatccgcttaccggctccagagcgaatgccgcaaaacagttcctccagaacccggtgcacctgtggattttcagctccttacccaacaagtcattcagtgtgcgtacgatattgcaaaggccgctaagcagctggtgaccatcactacccgggaaaagaagcagtag

SEQ ID NO: 24715 - DNA, 1332 bp, Artificial Sequence
  Description of Artificial Sequence: Synthetic coding sequence
atggatagactggggcctttttctaacgaccccagtgataaacccccttgcaggggatgcagtagctatttgatggaaccatacatcaaatgcgctgagtgtggcccaccgccatttttcctgtgcctgcaatgctttactagagggttcgagtacaaaaagcaccagtctgaccatacttacgagattatgacttctgactttccggtgctcgatccttcttggactgctcaggaggagatggccctcttggaagcagtgatggattgtggtttcggcaactggcaggacgtagctaaccaaatgtgtactaagacgaaggaagaatgcgaaaaacactacatgaagcacttcattaacaatcccctgttcgcctccactcttctgaatcttaagcaagccgaggaagctaaaactgccgatacggccatcccattccacagcactgatgatcctcccaggcccactttcgacagcctgctaagcagggatatggctggttatatgcctgccagagcggacttcatagaggaatttgataattacgccgagtgggatcttcgcgacatcgatttcgtggaggatgactcagatattctccacgcattaaagatggctgtagttgatatatatcactcaaggttgaaggaaagacaacggagaaagaagattattagggaccacggcttgattaatctgagaaagtttcagctgatggaacgacggtaccctaaggaggttcaagatctttacgaaacaatgcggaggtttgcacggattgtgggtcctgtcgaacacgataaattcatcgagtcgcacgccctcgagtttgagctgcggagggagatcaagagacttcaagagtatcgcaccgctggcatcaccaatttctgcagcgcacgtacatacgatcacctgaagaagacacgggaagaagaaagattgaagcgaactatgctcagtgaggtgctgcagtacatccaagactccagcgcttgtcaacaatggctgcgtcgccaagccgatatcgacagcgggctcagtccttcaattcccatggcctccaactctgggagacgctccgccccaccccttaacctcacgggactgcctggtaccgaaaagcttaatgaaaaggagaaggaactctgccagatggtgagattagtaccaggcgcataccttgagtacaaatctgccttactgaacgagtgcaacaagcaggggggactccgcctggcccaggccagggctctgatcaaaatcgatgtcaacaagacaagaaaaatctacgacttcttaataagggagggatacattacaaaaggatag

SEQ ID NO: 24716 - DNA, 918 bp, Artificial Sequence
  Description of Artificial Sequence: Synthetic coding sequence
atggatcggctaggtccctttagtaacgacccaagtgataaacctccttgtcggggttgctcttcttacctcatggagccgtatattaaatgtgcggaatgcggccctccaccctttttcttgtgcctccaatgtttcacccgcggattcgaatataagaagcaccagagcgaccacacctacgagataatgacctccgatttcccggtgctggatccatcatggaccgctcaagaagaaatggccttactagaggccgtgatggactgcgggttcgggaactggcaggacgtagccaatcagatgtgtaccaaaacgaaggaggaatgcgaaaagcattacatgaaacactttataaataaccccttgtttgccagcaccctgttaaacctcaaacaggccgaagaagccaaaaccgcagataccgccattccctttcactccacagatgacccccctcgcccaacttttgattcactgcttagccgagatatggcagggtacatgcctgctagagccgattttattgaggagtttgataactacgccgaatgggatctgcgggatatcgactttgtcgaagacgattccgacatcctgcacgcccttaagatggcggtcgtggacatctaccatagccgtctgaaggagagacagaggagaaagaaaattattagggaccacggcctaatcaatctaaggaagtttcagctgatggaaagacgataccccaaggaagtccaggacttatatgagaccatgcgccgattcgccagaattgtcggccctgtggagcatgacaaattcatagagagtcacgcctgcaggtggttcttatctttggagcagtacttatgcgtgtacatctacattaatagaagagataacggcgtcttctacgtgaagttctacaaatag

SEQ ID NO: 24717 - DNA, 1029 bp, Artificial Sequence
  Description of Artificial Sequence: Synthetic coding sequence
atgtgcaccaaaactaaggaagaatgcgaaaagcactacatgaaacacttcataaataaccctctgtttgctagcaccctcctaaatctgaagcaggcagaggaggccaaaaccgccgacacagcaatcccctttcatagtaccgatgacccacccaggcccacctttgattccctactgtcccgagacatggccggatatatgccggcacgtgcggactttattgaggaatttgataactacgccgaatgggacctacgcgatatagattttgtagaggatgactcagacatcctccatgccctgaagatggctgtggtcgacatataccattcacgacttaaggagcgacagaggcggaagaaaatcatccgcgatcacggtttaattaatctcagaaagttccagctcatggaacgtcgctacccaaaggaggtgcaggatctctatgagaccatgaggcgcttcgccagaatcgtcggaccagtggaacacgacaagtttatcgagtctcatgccctggagttcgagcttcgaagagaaattaagcgattgcaggaatatcgtactgccggaattaccaacttctgtagcgccagaacttacgaccatctgaagaagacacgcgaggaggagaggctgaaacgcaccatgctcagcgaagtgctccagtacattcaagattccagtgcctgccagcaatggctaagacggcaggccgacatcgactcaggcctcagtccaagtattcccatggcgagtaatagcggccgacgctctgccccacccctgaatctcacaggactccccggaaccgaaaaacttaatgagaaggagaaagagctgtgtcagatggttaggctcgtgcccggagcttatcttgagtataaaagtgcgcttctgaacgagtgtaacaagcagggtggactgcgtctcgcgcaggccagagcacttatcaaaatcgacgtgaacaaaactagaaaaatctacgacttcttgatcagggaagggtatatcaccaagggttag

SEQ ID NO: 24718 - DNA, 1332 bp, Artificial Sequence
  Description of Artificial Sequence: Synthetic coding sequence
atggacaggctcggcccttttagcaacgatccgagcgacaagcctccatgcagaggctgcagttcttatcttatggagccctatatcaagtgcgccgagtgtggccctcctccttttttcctgtgcctgcagtgctttactcgcggatttgagtacaagaaacaccagtccgatcatacttacgagatcatgacatctgatttcccggtgctagacccatcctggaccgcacaagaagaaatggctctcctcgaggccgttatggactgcggcttcggaaattggcaggacgtggccaaccaaatgtgcacaaaaaccaaggaagagtgtgagaagcattacatgaagcattttatcaataatcctctcttcgcatctacccttttaaacttaaaacaagctgaagaagccaagactgcagataccgcaatcccctttcattccaccgacgacccaccccgacctaccttcgacagcctcttgagcagagatatggcaggctacatgcctgccagagccgattttatcgaggaattcgataattacgcagaatgggaccttcgggacatagattttgtggaagatgactccgatatcctccacgcactgaagatggccgtcgtggacatctaccactcacgtttgaaagaacggcagcgccgtaagaaaatcattagggatcacggattaatcaatttgcgtaagttccagttgatggagcgacgctaccccaaagaggttcaagatctatacgagacgatgcgtcgctttgcacggattgtgggcccagtggagcacgacaaatttatcgagtctcacgcacttgaattcgagctgcgaagggagattaaacgtctgcaagaatatcgaactgccggtattacaaacttttgcagcgctagaacttacgatcacctgaagaagacacgggaagaggagcggttgaaaaggaccatgctatccgaagtgctgcagtacatccaggattcttccgcttgccagcagtggcttagacgtcaggccgacattgatagtggccttagtccttccattcccatggcctctaacagcggcagacggtcagcaccccctttgaatctgaccggccttcccggtaccgaaaagcttaatgagaaggagaaggaactctgccagatggtgaggctggttccaggtgcctatctggaatataagtccgctcttttgaatgagtgtaacaagcaggggggtctaaggctggcacaagccagggccctgataaagatcgacgttaacaaaacccggaaaatttacgactttctgatcagggagggttatatcactaagggttag

SEQ ID NO: 24719 - DNA, 3390 bp, Artificial Sequence
  Description of Artificial Sequence: Synthetic coding sequence
atgggggaccagcaactctacaaaactaaccatgtggcccacggatccgagaatctgttttaccagcagccacctctgggagtccactcaggattgaaccacaactacgggaacgccgtgaccgggggaggtatggatgctccccaggcttcgccgatttcccctcacttccctcaggacacgagggatggtctgggactccctgttggaagcaagaacctggggcagatggacacttctcgccagggaggatggggttcccacgctggacccggaaatcatgtgcagctgcggggtaacctcgcgaactctaatatgatgtggggggcacccgctcaggctgagcccactgacgggtaccagtacacatactctcaggcaagcgaaatccggacacaaaagctgacatctggggtcttgcataaactggattcatttacccaggtatttgccaatcagaacctccgcatccaggtaaataacatggctcaggtccttcatacacagagcgcggtgatggatggggctccagattcagctttgagacaacttctgagccaaaagcccatggaaccgcctgcccctgccataccctctcggtaccagcaggtcccccagcagcctcatcccggatttaccggtggtctctccaagccagccctccaggtgggtcaacacccaacacagggacacctgtattacgactaccaacagccactagcacaggttcccgtacaagggggacagccactgcaggctccgcagatgttatctcagcacatgcagcagatgcaacagcaccaatattacccccctcaacagcaacagcaagccggacagcagcgtatctccatgcaagaaattcagacacagccacaacaaattagacccagccagccacagccaccaccgcaacagcagcagcctcagcagctgcagctacagcagcgacaggggtcaatgcagatccctcagtactaccagccccaacccatgatgcagcaccttcaggagcaacagcagcagcagatgcacctacagcccccatcctaccaccgggacccgcatcagtatacacctgagcaagcgcacactgtacagcttatacccctgggcagcatgagtcagtactattaccaggagcctcagcagccttacagtcacccgctttatcagcagagccacctgagccaacaccagcagcgcgaagattctcagctgaaaacatatagttcggataggcaggcccaggccatgctcagctcccatggcgatctagggccacctgatacaggcatgggcgatcctgctagtagcgatctgacccgcgtgagttcgacactgccccacaggcctcttttgagcccgtctggcatccacctaaacaacatgggccctcagcatcaacagctgtccccctccgccatgtggccccagatgcacttgccagacggaagagcacagcctgggagcccagagtcaagtggacagccgaagggcgcatttggagagcaatttgatgcaaagaataaactaacttgctctatatgcttgaaggaattcaaaaacctcccagcgctaaacggacacatgcgcagccacggcggaatgcgcgcttcccctaatcttaaacaggaaataccaagaaagcaccaaccatctgtgcccaaagccgaggagccattaaagaccgtgcaagaaaagaagaagttccggcaccggccagaaccattgttcatacccccaccccctagttacaatcccaaccccgcagcttcttacagcggcgcaacgctctatcagtctcagctgcgctccccacgagtgcttggagatcatctcctgctggaccccacgcacgaattacctccgtacactcccccacccatgctttccccagttcggcaggggtcaggactctttagcaatgtacttatatcaggccatggaccaggagcccacccccagctgccattgacacccttgactcctactccacgggtcttgctgtgtaggagtaattccattgatggatctaatgtgactgtaacccccggacccggtgagcaaaccgtcgatgttgaaccccgaataaacatcgggctgcggtttcaggcggagattccggagctccaagacataagcgctctcgcgcaggatactcataaagctacccttgtgtggaagccctggccagaattagaaaaccacgacctgcagcagcgggtggagaacttacttaacttgtgctgttcatcagctctgcctggtgggggaacaaatagcgagtttgcccttcatagtctgttcgaggcaaaaggagacgtgatggtggccctggaaatgctcctcctgcggaagccggtaaggctcaagtgccacccactggccaattatcactacgcaggctccgataagtggactagcctcgaacggaaactgtttaacaaggccctggcgacgtatagtaaagatttcattttcgtgcagaagatggtgaagagtaaaactgtggcacagtgtgtcgagtattactacacgtggaagaaaatcatgaggctgggacgaaagcacaggaccaggcttgccgaaattatcgacgattgcgtgacaagtgaagaagaggaggaactggaggaggaagaggaggaagatcccgaggaggacaggaagtccacaaaggaagaggaatcggaagtgccgaagtcacctgaaccaccccctgtccccgtactggcacccacagagggaccccctctacaagcgctgggccaacccagtggttccttcatttgtgagatgccgaactgcggcgctgattgtcggtgccacgttactccttttcttccacaggttttcagtagcagacaggccctcaatggtcatgcccgaatccatgggggtacaaaccaagtgactaaggctagaggggctatccctagcgggaagcagaagccaggaggcactcagtccgggtactgtagtgtgaagtcgtcccccagccattcaaccacgagcggggaaacggaccctaccactattttcccatgtaaagaatgcgggaaagtcttttttaagattaagtctcgaaatgcccacatgaaaacccaccgacagcaggaagagcagcagagacaaaaagcccagaaggcggcatttgcagctgaaatggccgcaactatagagcgaaccaccgggcctgtcggtgccccaggcctgctgcccctggaccagctgtctctgatcaaaccaattaaggatgtggatatcctcgacgatgacgtggtacaacaactcggtggcgtgatggaagaggctgaagtcgtggacacagaccttctccttgatgaccaagacagcgtactcctgcagggggatgcagaactgtag

SEQ ID NO: 24720 - DNA, 3603 bp, Artificial Sequence
  Description of Artificial Sequence: Synthetic coding sequence
atgggtgatcagcagctttataagactaatcacgtggcccacgggtcagaaaatcttttctatcagcagccacccctaggcgtgcacagcggacttaatcacaactacgggaatgcagtcaccggtggaggaatggatgcaccgcaggctagccccatttctccacatttccctcaggatacacgagatggcctgggactccctgtgggctcgaaaaatctgggccagatggacaccagtagacagggcggatggggaagtcatgccggacccggtaaccatgtgcagctacggggtaatctagcgaactccaatatgatgtggggggctccagcacaggcagagccaactgatggctaccaatacacctattcccaagcctcggaaatccggacccagaagttgacctctggggttcttcacaaactggactctttcactcaggtatttgccaatcagaatctacgcatacaggtgaacaacatggcccaagtcttacatacacaaagcgctgtcatggacggcgctccggacagtgctttacgtcagttactgagccagaaaccaatggaaccaccggcacccgcaatcccaagtcgctatcagcaggtgccacaacaacctcaccccggattcaccgggggactgtctaaaccagctctgcaggtcggccagcatcctacccaagggcatctctactatgactatcagcagcctctggcccaagtgcctgtgcaggggggtcaacccttacaggctccccagatgctgagccagcacatgcagcagatgcagcagcaccagtactatccaccccagcagcagcagcaggctggtcagcagaggatatctatgcaggaaatacaaacccaaccacagcaaatcagacccagccagccgcaaccacctcctcagcaacaacagcctcaacaacttcagctgcagcaaaggcaggggagcatgcagataccccaatattaccagccacaaccaatgatgcagcatctgcaagaacaacagcagcagcaaatgcatctgcagcctccgagctatcatcgggatccccaccagtataccccagagcaggcccatacagtgcaactgatccctttgggatctatgtcccagtattattaccaagagccacagcaaccttacagtcatcccctgtatcagcaatcccatctgagtcagcatcaacagcgagaggacagccagctaaagacttacagttcggacagacaggctcaggcgatgctttcctcacacggagatctcggtccacccgatacaggaatgggggatcctgcatcgtcagacctgacaagggtgagcagtactctcccacacaggccactgctgtcgccaagtggtattcatttaaacaacatgggacctcagcaccaacagctttccccttctgccatgtggcctcaaatgcatctgccagatggtcgggctcagcctgggagccccgaatccagcggacagcccaaaggggcatttggcgaacagttcgacgccaaaaacaagctaacctgttcgatttgcctgaaagaattcaagaaccttcctgccctgaatggccatatgaggtcacatggcggtatgagagcatcccccaaccttaagcaagaagaaggtgagaaggtcctgcctccacagccccagcctccactgcctccccctcctcccccacctcctcccccacagctgcctccagaagcggaaagcctcactccaatggtcatgcctgtgagcgtccctgtgaagcttctccctccaaaacccagttctcaagggtttacaaattccaccgtggccgcaccaagcgcccgtgataaacccgctagcagtatgagcgatgatgaaatgcccgtcttggagattccacggaagcatcagcccagcgttccaaaggctgaagagccattgaaaaccgtgcaggagaaaaaaaaatttcgccatcgacctgaacctttattcatcccacccccaccctcttacaatcccaatcctgccgctagctactcaggtgcaacactgtaccagtctcaattgcgctcacctagagtgctgggagatcacctgctgcttgaccccacacatgagctaccaccttataccccccctcccatgctttctccggtcagacagggaagcgggttattttcaaatgtattaatctcaggccacggtcctggagcccatcctcagttaccactaacacctctgaccccaacacctagggtgttactttgccgctcaaattccatcgatggatccaacgttactgtgacccctgggcctggggaacaaactgtggatgtggagccacgcattaatatcggcctgaggtttcaggcagaaatcccagaactccaagacatatcagctctggctcaggacacccataaagcgaccctggtgtggaagccctggccagaacttgagaatcacgatctgcagcagcgcgtcgagaatctattaaacctgtgctgctcctctgcactacctggtgggggaacaaactccgaattcgcgctccactcactgtttgaggccaaaggcgatgtgatggttgcgctggaaatgctattgctccgtaagcccgtacgactgaaatgtcatcctcttgctaactaccattacgctggcagtgacaagtggacgagccttgaaaggaaactgtttaataaagcgctggctacttacagcaaagatttcatattcgtacagaagatggtcaagagcaagacagtagcacaatgtgttgaatactattacacctggaagaaaattatgaggctagggagaaagcaccgtaccagactggccgagattatcgatgattgtgtcacatctgaagaggaagaagaactagaggaagaagaagaagaggatcccgaggaggacaggaagtcaaccaaggaggaagagtctgaggtgccaaagtccccagagcccccaccagtgccagtgctggcccctactgaggggccaccactacaggctctcggacaaccatcaggatctttcatttgcgagatgccaaactgtggagctgtgtttagcagtagacaggccttgaacgggcatgctcgaattcacgggggtaccaatcaggttacaaaggccaggggggcaattcccagcggcaaacagaagccaggaggcactcagtccgggtactgctcagtaaagagcagcccttcacatagcacaactagtggtgagacagaccccacgacgatctttccatgcaaggaatgtggcaaagtgttctttaaaatcaagagccgcaatgcccacatgaagacgcaccgccagcaggaggaacagcagcgacagaaggcacaaaaggcagcatttgcagctgagatggcggcaactatcgagcgcaccaccgggccagtcggggcaccaggcctgctgcctctggatcaacttagcctgataaaacccattaaggatgtggatatcctggatgacgatgtggtgcagcaactaggaggtgttatggaggaggcggaagttgtggatacggatcttctacttgacgaccaggactcagtgctccttcaaggcgacgcagagttatag

SEQ ID NO: 24721 - DNA, 3663 bp, Artificial Sequence
  Description of Artificial Sequence: Synthetic coding sequence
atgggcgaccaacagctgtacaagaccaaccacgtcgctcatgggtcagagaatttattttatcagcagccgcctcttggagtccattcagggctaaatcacaattatggaaatgctgttacgggaggtggtatggacgcacctcaggcatctcccattagcccacatttcccccaggacactagggacgggctggggctacctgttggcagcaagaatctgggccagatggacacctctaggcaaggcggatggggcagccatgccggacctggcaatcacgtgcaattgagaggcaaccttgcaaatagcaacatgatgtggggcgcacctgctcaggccgaacccacggacgggtaccagtatacctattcgcaagcctccgaaattcgtactcagaaactgacttctggggtcctgcacaaattagatagctttacccaggtcttcgcgaaccaaaacctccgcattcaggtaaataacatggcgcaggtccttcatacacaaagcgccgttatggatggtgcccctgactccgcgctcagacagttgctgtcccagaaaccaatggaaccacctgctccagccatccctagccgataccagcaggtaccacagcagcctcaccccggttttactgggggactgtctaagcccgctctacaagtcgggcagcacccaacgcaaggacacctatattacgattatcagcaacctttggcccaggtgcccgtgcagggcggtcagcccctgcaagccccacagatgctttcccagcacatgcagcaaatgcagcagcatcagtactacccccctcaacagcagcagcaggcgggtcagcagcgcattagcatgcaggagattcaaactcaaccccaacagatccggccaagtcagcctcaaccccctccacaacaacagcagccccagcaattgcaactgcagcagaggcaagggagcatgcagatcccacaatattaccaacctcagcccatgatgcagcatcttcaggagcaacagcagcagcaaatgcacctccaacccccaagctatcaccgggatcctcatcaatatactcctgagcaggcgcacactgtgcagttgatcccactgggatctatgagccagtactattatcaggaacctcagcagccgtattctcaccctttgtaccagcaatcacatcttagccagcatcaacaacgggaggattcacaactgaaaacctattcttcagacagacaggcgcaggccatgctgtccagtcacggggacttaggaccccctgataccggtatgggcgacccggcatctagcgatctgacgcgggtgagtagtactcttccccaccgccctttattatctccttcaggaatccatctgaataacatgggccctcagcaccagcaactttcgccctctgctatgtggcctcagatgcaccttcctgacggtcgggctcagcctggctccccggagtcttccggacagcccaaaggggcatttggcgaacagtttgatgctaaaaataagctgacatgcagcatctgtcttaaagagttcaagaatctacctgctctcaacggccatatgcgaagccatggaggcatgcgggctagccccaacctgaaacaggaagaaggggagaaagtactgcccccacagcctcagcctccccttccaccgccaccccctccccctccacctccccagctaccgcctgaggccgagtcattgactccgatggttatgcctgtttctgttcccgtgaagctgctgccccctaagccctcgagccaggggttcaccaacagcacagtagcagctccaagcgcgagggataaacctgcctcatctatgagcgatgatgagatgcctgtgctggtcaggatgacactgagccctccccacagcccgcagggcgctgcgccaaggacccccgcagagatcccacgcaaacaccaaccttctgtgccgaaagctgaggagcctctgaaaaccgtacaggagaaaaagaaattcagacacaggccagagcctctgttcatccctcccccaccatcttacaatcctaacccagcagcttcatattcaggagctactctataccagtctcagctgcggtctccaagggtactgggcgaccatctcttgctagacccaactcacgagctgccaccttatacacctcctcccatgctgagcccagtgcggcagggaagtgggttgttctcaaacgtcctgatttccggtcacggccctggggctcacccccagcttcccttgaccccactgacaccaaccccacgagtacttttgtgccgatcgaacagcatagatggcagtaacgtaacagtgaccccagggcctggtgaacaaactgttgacgttgagccgaggattaatatcggacttcgattccaagccgagattcccgaactgcaagacattagtgctctagcacaggacacccataaggcaactctcgtgtggaagccatggcccgagctggaaaatcacgatctgcagcagcgcgtggaaaaccttctcaatctttgttgctcaagcgcactgcccggaggaggcacaaattcagagtttgccctacattcactattcgaggcgaagggggatgtgatggtggctctggagatgctgttactccgaaaaccagtacggctgaaatgtcatcccctcgccaattaccactatgctggcagcgacaagtggacatctctcgaacgaaaactgttcaacaaagcccttgcaacttatagcaaggattttatctttgtgcagaagatggtgaagtccaagaccgtggctcagtgtgtggagtattattacacctggaagaagatcatgaggctcggaaggaagcataggacgcggctggctgagattattgacgattgtgttacaagtgaagaagaagaagaacttgaagaggaagaagaagaggatcctgaagaggacagaaagagcacaaaggaagaagaatccgaggtgcctaaatcccctgagccccctcctgtccccgtgttagcgcctacggagggcccacctctgcaagccctgggacagccgagtgggtctttcatctgcgagatgcctaactgtggggctgttttttcatctaggcaggccttgaacggacacgccagaatacatggcggtaccaatcaggtcacaaaggcccgaggggctataccttcgggtaaacagaagccagggggaacccagtcaggctattgcagcgtgaagagtagcccttctcactcgacaacctccggtgagacagaccctacaaccatttttccctgcaaagagtgcggaaaagtgttcttcaagatcaaatccaggaatgctcacatgaaaacccacaggcagcaggaagagcagcagagacagaaggcacagaaagcagcgtttgcagctgagatggcagccacgattgagcgaacaaccggccctgttggcgctccgggtttactgcctcttgatcagctgagcttgatcaaaccaatcaaggacgtggacatacttgatgacgacgtcgtgcagcaactaggcggagtgatggaggaagccgaggtcgtggatactgaccttctgttggatgatcaggactcagtcctgttacagggggacgccgagctgtag

SEQ ID NO: 24722 - DNA, 2247 bp, Artificial Sequence
  Description of Artificial Sequence: Synthetic coding sequence
atgatccgagacctgagtaaaatgtacccccaaacacgacacccagcccctcatcaacctgcccaacctttcaagttcacaatttccgagagctgtgacaggatcaaagaagagtttcagttcctccaggcccagtatcattctctgaaacttgagtgcgagaaactggcaagcgaaaaaactgagatgcagagacactatgtgatgtactatgaaatgtcttatggtctgaacatcgagatgcataaacaggccgagatcgttaagcggctgaatgccatctgcgctcaggtgatacccttccttagtcaggagcagcagttacaggctcagcacctctcacatgggcacggcctacctgtgccactgacaccacacccttcaggactacaaccacctgctataccccctatcggatcttccgccggactactggccctgagtagcgccctggggggtcagtcgcacctcccaattaaggacgagaaaaagcaccacgacaatgatcaccagcgcgatcgtgattcaattaagtcatccagcgtctccccatctgcctcgtttagaggggctgagaaacaccggaactctgcagattacagtagcgagtccaaaaaacaaaaaactgaggaaaaggagatcgccgctagatacgattctgatggcgagaaaagcgacgataacttagtcgtggacgtcagcaatgaagacccctcatcacccagggggtcccctgcccatagccctagagagaacggcttggacaaaactagacttctaaaaaaggacgccccaatttcccctgcatctatagcaagttctagctccaccccatcaagtaagtccaaagaactgagcttaaacgagaagtctactaccccagtgtcaaagagcaacacacctacccccaggacagacgcccctacaccaggcagcaattcaactcccggactgcgccctgttcccggaaagccacccggagtagaccccttggcttcatcgctgagaactccaatggccgtgccttgtccatacccaacgccatttggcattgtgccgcacgcaggaatgaatggcgaacttaccagcccaggggctgcatatgcaggcttgcacaatattagcccccagatgagtgccgcagcggctgcagcagctgccgctgccgcatatggcagaagtccagtcgtcgggtttgatccccaccatcatatgagagtgccagcgatcccacccaatttaactggcatcccaggtggtaagcctgcatactcgtttcacgtaagtgcagacggccagatgcagccagtgccctttccccctgatgctctcatcgggccaggtatacctaggcacgccagacagattaacaccctgaaccacggggaggtggtttgtgcagtcaccatttccaaccccacccgccatgtatatactgggggaaagggatgcgtgaaagtgtgggacatctctcacccaggtaacaaatctcccgtgtcccaattagactgtctgaaccgcgataattatatcagaagctgtagactcctgccagacggtcgtacattaatagtggggggtgaggcaagcacgctgagcatttgggacttagcggctcccactcccagaattaaggccgaactgaccagtagcgctccagcttgttacgccctcgccatcagtcccgactcaaaggtgtgttttagttgctgctcggacggcaacatagctgtctgggacttgcacaaccagaccctggtgcgtcagttccagggccacaccgatggcgctagctgcatcgacatctctaacgatggtacaaaattgtggaccggcggtctggacaacaccgtgagaagttgggatctgcgggaaggacgtcagctccagcaacacgatttcaccagtcagatctttagcctcggttattgcccaacaggtgagtggctagctgtagggatggagaactccaacgtggaggtgttacatgtgacaaagcctgataaataccagttgcacctgcacgagtcttgcgtactgagtctgaagttcgcccattgtggcaagtggtttgtgtcaacagggaaggacaacttgctaaacgcttggcgaactccttatggagctagtatcttccagtctaaagaaagttcaagtgtgctgagctgcgatatttccgtagacgacaagtacatagtgactgggagtggagacaagaaagctaccgtgtacgaggtcatttactag

SEQ ID NO: 24723 - DNA, 2418 bp, Artificial Sequence
  Description of Artificial Sequence: Synthetic coding sequence
atgatcagggatctctctaagatgtatccccaaactagacaccccgcaccgcatcagccagcccagccttttaaatttactatcagtgagagttgcgaccggataaaagaagagttccagttcctgcaggcccagtaccacagtctgaagctagagtgtgagaagctggcttcggagaagacagagatgcagcgccattatgtgatgtattacgaaatgtcctacggactaaacatcgagatgcacaagcaggccgagattgtaaagaggctgaacgcaatttgcgcgcaagtgattccattcttgtcccaagagcatcaacaacaggtcgtccaggctgtggagcgagcaaaacaggtgaccatggccgaactgaacgccataataggtcagcagctgcaggctcagcacctttcacatggacacgggttgcccgtgcctctgaccccacatccatctggtctgcaaccacctgctattccaccaatcggttcttccgcagggttgctggccctgagttcagctttgggcggtcagtctcatctgccaatcaaggacgagaagaaacaccatgacaacgatcaccagagagagcgcgataaactcaaccataaaagtctctcccctagcgcctcttttaggggcgcagagaaacaccgaaattcagccgattacagctccgagagcaaaaagcaaaaaaccgaggagaaggagattgcagcccgatatgatagcgatggcgagaagagtgacgacaaccttgtcgtggacgtgagcaatgaagatcctagttctcccagggggtcacctgctcacagcccacgagaaaacggactcgataagactcggctgctgaagaaggatgccccaatcagcccggcatcgatcgcctctagctcaagcactccttcgagtaaaagtaaagagctcagtctgaaacgtgatatgggaaagctgtccgagacccgtctgtctgaggacgagcagtgcactcttgggctccagcgatggttttgcaggctgtggtttatgaacgagaagtcaacaactccagtgtctaagtccaatacacccaccccgagaactgatgctcctacaccaggatccaatagtacccctgggttgcgccctgtgcccggaaagccaccaggcgtggaccccctggcttctagccttaggaccccaatggcggtaccttgcccctacccaacgccctttggaatcgtcccacatgctggcatgaacggagagctgacctcaccaggcgctgcttatgctgggctgcacaacatttctccacagatgtccgctgcagccgcagcagcagccgcagctgctgcctatggacgctcaccggtggtaggctttgatcctcatcaccacatgcgggtccctgctatccctccaaacctgaccggaatccctgggggaaagccggcatatagctttcatgttagcgccgacgggcagatgcagcccgtcccattccctcccgatgccctgattggtccaggcatacctaggcatgctcggcagataaatacgctcaatcatggcgaagtggtatgcgccgtcactatctccaacccaaccaggcatgtgtacacagggggaaaaggatgtgtgaaagtttgggatatctctcaccccggaaacaaatcacctgtcagccagttggactgcttgaatcgggacaattacattagaagttgtcggctgctccctgacggacgtactctgattgtcggtggggaggcctccactctgtcaatatgggacctggccgcaccaacgcccaggatcaaggccgaattgactagtagtgccccagcctgttacgctctggctatttctcccgactctaaggtgtgtttcagctgctgttcagatggaaacatcgctgtgtgggatctccacaaccaaacccttgtgagacagtttcagggacataccgatggcgcttcctgtatcgacatatctaatgacggcacaaagctttggaccggtggcctggacaacactgtaagatcttgggatctccgagagggtagacagctgcagcagcatgatttcacctcacagatcttctcactcggatactgtcctacgggagaatggctggccgtcggcatggaaaattctaatgtggaagtcttgcacgtcacaaagcccgacaagtatcagctccaccttcacgagtcatgcgtcctcagcctcaagtttgcccattgcgggaagtggttcgtgagcactggcaaagataacctcctcaatgcctggcgcacaccctacggcgcaagcattttccagtccaaagagagctcatctgtcctgtcatgtgacatttccgtggatgacaaatatattgtgacagggagcggtgacaagaaggctactgtttacgaggtaatttactag

SEQ ID NO: 24724 - DNA, 1233 bp, Artificial Sequence
  Description of Artificial Sequence: Synthetic coding sequence
atggccgttccttgtccctacccaaccccgtttggaattgtgccccatgcgggaatgaacggcgaactcacaagtcccggagccgcttacgcgggactgcacaatatttcaccgcaaatgtccgccgctgccgcagctgcagctgctgcagccgcatatggaaggtctccggtggtggggtttgatccacaccatcacatgcgggtcccggcaatccccccaaaccttacggggattcccggtggaaagcccgcatatagctttcatgtgtctgcagacgggcagatgcagcctgtccccttccccccagacgcacttatcggtccaggaattcccagacacgccagacagattaatactctaaaccacggagaggtcgtgtgcgccgttaccatcagcaacccgacccgacacgtctacactggtgggaaagggtgcgtgaaagtctgggacatctcccaccccggaaacaagtcacccgtgtcacaactggactgtctgaatcgcgataattatataaggagttgccgcctgctccctgatggcagaactctgatcgtcggcggagaggctagcacactgagcatctgggatttggcagcgcctaccccccgaatcaaggccgaactgacttcgtctgcaccagcatgttacgcactggctatttcacctgacagcaaggtctgcttctcctgttgttccgacggtaacatcgccgtttgggacctccataaccaaaccctggtgcgccaatttcagggacataccgatggggcatcctgcatcgacatcagcaacgacggcaccaagctctggactgggggactggataacacagtaagaagctgggatctacgagaagggaggcagctgcagcaacatgattttactagtcagatcttctcactgggttattgcccaacgggagagtggttggctgtgggtatggagaattccaacgtcgaggtattacatgtaacaaagcccgacaagtaccaacttcacctccacgagtcttgtgtcctctccctgaagttcgcccattgcggaaagtggttcgtctctaccgggaaagataacttgctcaatgcctggcggaccccctacggagcctccatttttcagagcaaggagagcagctcagtgctgtcatgcgacatttccgtcgacgacaagtatatcgtgaccggcagcggtgataaaaaagctacagtctatgaagttatatactag

SEQ ID NO: 24725 - DNA, 2418 bp, Artificial Sequence
  Description of Artificial Sequence: Synthetic coding sequence
atgatccgtgatctgtccaagatgtacccacaaaccaggcatcctgctccccatcagcccgctcaaccctttaagttcacaatttctgaatcgtgcgataggataaaggaggaatttcagttcctgcaggcacagtaccacagcctgaagttagagtgcgaaaaattagcaagcgagaagactgagatgcagcggcattatgtcatgtattacgagatgagctatgggctgaacatcgagatgcacaagcaggctgagatcgttaaaaggctcaacgccatttgtgcccaggtcattccatttctgagccaggagcaccagcagcaggtagtgcaagccgtggagcgcgctaaacaagttactatggccgagctcaatgcaattattggacagcaattgcaagcacaacatttgtctcacggacatggcttacccgtgcctctcaccccccacccctcaggtttgcagccgcctgcaattcctcctattggttctagtgccggactcctcgctctatcttccgctctgggcggtcagagccacttaccaataaaagacgagaaaaagcatcacgataacgatcaccagcgagatcgagattctatcaagagctcctcagtgagccccagcgctagctttcggggagctgaaaaacacagaaactccgcagactattccagcgagtctaaaaagcaaaagactgaggagaaagaaatagctgccaggtatgactccgacggcgagaagagtgatgataatctggtcgttgacgtgagcaatgaagatccatccagtccgaggggctcccccgcacacagcccgagggagaacggtttggataagactcgactacttaaaaaggatgcccctattagccccgctagtattgcctcatcatcttccacaccatccagtaaatccaaggagctttccttaaagagagatatgggaaaactcagcgagacccggttgtccgaggatgaacaatgtacactggggctccagaggtggttctgtagactctggttcatgaacgagaaatctactaccccggtctcaaaatctaatacacctactccacgcacagacgccccaaccccgggaagcaacagcactccgggactccggcctgtccctgggaagcctcctggggtggatcctctggccagcagtctgcggactcccatggcagtaccgtgcccatatcctactccgtttgggattgtgccacacgcagggatgaacggcgaactcaccagcccaggagctgcatacgctggcctgcataatatcagtccccagatgtctgctgcagccgcagctgccgcagccgcagctgcctacggtcgttctcctgtggtggggttcgatccgcatcatcatatgcgggttccggctatacccccaaacctgacaggcatccccggaggcaagccggcatactctttccacgtgtccgccgacgggcagatgcagcctgtgccctttcccccagacgcattgattggacctgggattcccagacacgctaggcagattaacaccctgaaccatggggaagttgtgtgtgccgtgactatcagcaacccaacacgtcacgtctatacagggggaaaggggtgcgtaaaggtgtgggacattagtcacccagggaacaaatctcccgtgtctcagcttgactgtctgaatagagataattacatcagaagctgtcgtctgttacctgatggtcgtaccctgatcgtcgggggagaagccagcaccctatccatctgggatctggcagctcctacgcccaggatcaaagctgaactgacttcttcagccccagcttgctacgctctggccatcagcccagacagcaaagtctgtttttcctgctgcagcgatggcaatatcgccgtatgggatctgcacaaccaaacacttgtgcgacaattccagggtcatacggatggtgcatcatgtattgacatcagcaatgacgggacaaaactctggactggcggtctcgataatacagtgcggtcttgggatctgcgggaaggacgccagttgcagcagcacgattttacctcccagattttctcccttggatactgccccacaggagaatggctggcagtgggaatggagaacagtaatgtggaagtcttgcatgtaactaagccagataagtaccagctccatctgcatgaatcatgtgtcttaagcctgaagttcgcccattgtggcaagtggttcgtttccactgggaaggacaacttactaaacgcttggagaaccccatacggagcctccatttttcagtccaaggagtcttcgagcgtgcttagctgcgatatctcggtcgacgataaatatatcgtgactggctcgggtgataaaaaagcaactgtttatgaggtcatttactag

SEQ ID NO: 24726 - DNA, 2115 bp, Artificial Sequence
  Description of Artificial Sequence: Synthetic coding sequence
atgattagagatttgagcaagatgtatccccaaacccgtcacccagcgcctcaccagcctgcccagcccttcaagtttaccatctctgagtcctgtgataggattaaagaggagtttcaattcctgcaagcacagtatcacagtctgaaactggaatgtgagaagctggcatctgagaagactgagatgcaaaggcactatgtcatgtattatgagatgagctatggcctcaacatcgaaatgcacaagcaggctgaaatagtcaaaagattgaatgcaatttgcgcccaggtcatcccctttctgtcccaagagcaccagcagcaggtggtccaggctgtcgagcgcgctaagcaggtgaccatggcggagctcaatgccatcatcggtcagcaacttcaggctcagcacctgtcccatggacacgggctgcctgtgcccctgacgcctcaccccagcggtctgcaaccaccagcaatcccccctatcggctcgtccgcgggtttgctcgcattatcatcggctctgggcggtcagagccatctgcccatcaaagacgaaaaaaagcaccacgataacgatcatcagcgcgagcgggataagctgaaccacaagtcgctttctcctagtgcctctttcaggggagccgagaagcaccgcaactccgctgattatagctcagaatcgaagaaacagaagactgaggagaaggagatcgccgcaagatataatgaaaagtctacgactccagtatcaaaatctaatactcctacaccaagaactgatgcacctactcccggtagcaacagcaccccaggtttgcgccctgtccccggaaagcccccaggggtggaccccctcgcctcctctctacggacaccaatggcagtcccctgcccatacccgacgcctttcgggattgtaccccacgctggcatgaatggcgagctgaccagccctggcgcagcgtatgctgggctgcacaatattagtccccaaatgagcgccgctgctgcggctgcagccgctgccgcagcttatggtcggagtcccgtggtcgggtttgatcctcaccaccatatgcgcgtgcccgcaattcctcccaatctgaccggaatccccggaggaaagccggcttatagctttcacgtgtctgcagacggccaaatgcaaccggtgccatttccaccagacgctcttatcggaccaggcatcccgaggcatgcgagacagattaatactttgaaccatggggaggttgtctgtgctgttactatttctaatccgactagacatgtttatacagggggtaagggctgcgtgaaggtctgggacatctcacaccccggaaacaagagcccagtgtcccagctcgactgtcttaaccgggacaactatatcaggagttgtaggttgctacctgacggccgtacactaatcgtggggggtgaagcgtcgaccctcagcatttgggatctggctgcacccacaccaaggatcaaggcagagttaactagctctgctcccgcttgttatgccctcgccatctctcccgactctaaggtgtgctttagctgttgcagcgatggcaacattgccgtgtgggatttgcacaaccagactttggtcagacaattccaaggacatactgatggagcctcttgcatagacattagcaacgacggtactaagctctggactggcggactcgataacaccgtacggagttgggatctgcgcgaaggcaggcaattgcagcagcacgactttacctcacagattttcagcttaggttattgcccaacaggcgagtggcttgcagtcggaatggagaatagcaacgtcgaggttctccacgtgaccaaaccggataagtatcagctgcatctgcatgaaagttgcgtactatctctgaaatttgcccattgcgggaagtggttcgttagtacgggcaaggacaacctacttaatgcgtggcgtaccccctatggagctagtatcttccagtcgaaggaaagttcaagtgtcctcagttgtgacatatccgtggatgacaagtatattgtgacaggctcaggagataagaaagccacagtttacgaggttatatactag

SEQ ID NO: 24727 - DNA, 2322 bp, Artificial Sequence
  Description of Artificial Sequence: Synthetic coding sequence
atgattcgggacctgtcgaagatgtacccccagacgcggcaccccgcaccacaccagccagctcaaccatttaagttcacgattagcgagtcttgcgacagaatcaaggaagagttccagttcctgcaagcccagtaccactcattaaagctcgaatgcgaaaaactggcctccgagaagacagaaatgcagagacactacgtcatgtactacgaaatgagttacggtctgaatattgagatgcacaagcaggcagaaattgtgaaacggcttaatgctatctgtgcccaggttatccctttcctatctcaagaacatcagcagcaagtggtgcaggctgtcgagcgcgctaagcaggtcacaatggccgagctgaacgccatcattgggcaacagctacaagctcagcacttgtctcatggccacgggctccctgtccctctcaccccccatcccagtggcctgcagccaccagcaatcccaccaatcggcagctcagccggtctcctcgccttatcctccgcactgggcggtcagagtcacctgcctataaaggacgaaaaaaaacatcacgacaacgatcatcaacgggaccgcgactcaatcaaatctagttctgtatctcctagtgccagtttccgcggagcagagaagcatcgcaactccgctgattattcgagcgagtcgaagaaacagaaaaccgaagagaaagaaattgcagcccgttacgacagcgacggcgaaaagagcgacgacaacttagtggtggatgtctccaatgaagatccaagcagcccccgtggctcacccgctcacagtcccagagaaaatgggttagacaagacccgcctactaaagaaggacgcacccatctcacctgccagcatagcatctagtagctccaccccatccagcaaaagtaaggagctatcccttaatgagaagagtaccacccctgtgtcaaaatctaatacacctacgccacggacggacgctcccacccccggatcaaatagcacccccggactgcgcccagtacctgggaagccccctggagtcgaccctcttgcctcttctctgcggactccaatggccgtgccatgtccctaccccacaccttttgggatagtgccacacgcaggaatgaacggcgagctaacttcgccaggcgctgcctacgcgggactgcacaacatctcaccgcaaatgtcagcggctgctgccgcagccgctgccgctgccgcttatgggcgatcccccgttgtcggtttcgacccacaccatcacatgagagttccagccatcccccctaacctgacgggcatccctggcggtaagccggcttactcttttcacgtgtctgctgacggccagatgcagccagtgccctttccccctgatgccctgattggacccggaatccccagacacgctcgtcagattaacactctgaaccatggcgaagtggtatgtgctgtcactatctcaaatccaaccagacacgtgtacaccggaggcaagggttgcgtgaaagtctgggacatctcacaccccggaaacaagtccccagtgagccaactggattgtttgaaccgagataattatatccgctcctgtagactgctgccagacggcagaacgctgattgtcgggggtgaagcctccacgctctctatttgggatctggctgctccaacaccaaggatcaaggcagagctgacatcctcagcgcctgcgtgctacgcactcgccatctctcccgacagtaaggtgtgtttttcgtgctgttccgacggaaatatcgctgtgtgggacctgcataaccagacactggtgcgacagttccaggggcacaccgacggcgcaagctgtatcgacattagcaacgacggtaccaaattgtggactggaggccttgataacacagtaaggtcctgggaccttcgcgaaggtagacagctgcagcagcatgatttcactagccagatcttctcgctggggtattgccctacaggagagtggcttgccgtgggcatggagaacagcaacgttgaagtattacacgtaactaagcctgataagtaccagctgcacttgcacgagagctgcgtcttgagccttaagttcgcccattgtgggaaatggttcgtgagtacgggcaaggacaaccttctcaatgcctggaggactccatacggggcatcaatatttcagtcaaaagaatcatctagcgtgctgtcgtgcgatatctctgtggacgataagtatattgttacgggttctggggacaaaaaagctacggtgtacgaagtgatatactag

SEQ ID NO: 24728 - DNA, 642 bp, Artificial Sequence
  Description of Artificial Sequence: Synthetic coding sequence
atgataagagacctgtcaaaaatgtatccccagactcggcatcccgctccccaccaacctgctcagcccttcaaatttaccatatcggaaagttgtgacaggatcaaagaagaattccagtttctgcaggctcaatatcactctctgaaattagagtgtgaaaagcttgcgagcgaaaagaccgagatgcagaggcactacgtgatgtactacgagatgtcttacggtttaaatatcgaaatgcacaagcaagcggagatcgtaaagcgcttgaacgccatttgcgctcaggtgatccctttcctctcccaggagcaccagcaacaggtggtgcaggctgtggagcgggcaaagcaggtgactatggctgaactgaacgctattataggtgagaaaaagaataaaagtgatacaccaggctcattaaagcagcagcagctgcaggcacagcacttgtctcatgggcatggcctgccagtcccactcacaccccacccctctgggctgcagccacctgcaattccacctatcggctcctctgcaggcctattggcgttgagctcagcgctgggagggcaatctcacttgcccataaaggatgagaagaagcaccacgacaatgaccaccagcgaggagaatag

SEQ ID NO: 24729 - DNA, 849 bp, Artificial Sequence
  Description of Artificial Sequence: Synthetic coding sequence
atgagcgacgtggaagagaataactttgagggcagagaaagtcggtcccagtccaaatctcccaccgggacgcctgctcgggtgaagtctgaatcccgatctggatctcgtagcccctctcgtgttagcaagcattccgaatcacatagcaggagtaggtccaagtcccgatccagaagtcgtaggcacagtcatcgaagatacacaagaagcagatcgcattcacactcccacagacgaagatccaggtctcggtcctatacacctgaatatcggagacggaggtctcggtctcattccccaatgtccaacagaaggaggcatactggtagcagggcaaatccagacccaaatacttgcctgggcgtgttcggtctgtcactctacaccactgagcgggatctgcgggaggtgttttcccggtacgggccactgagtggagtgaacgtcgtgtacgaccagagaacaggtcgctcaagaggctttgcttttgtttactttgagagaatcgacgattctaaagaggctatggagcgagctaatggcatggaattagatggccgacgcattcgcgtggactattccatcacaaagagggcccacaccccgacaccgggtatctacatgggccgacccacacactccggcggtggaggcggtggcggtggagggggtggcggtggtggaggcggtaggcggagggacagctactacgaccgcggttacgaccggggatacgatagatacgaagactatgattaccgttacagaagaaggtcaccctctccttattactcgagatataggagccgttctcgttcacggtcctactctccacgccgatactag

SEQ ID NO: 24730 - DNA, 543 bp, Artificial Sequence
  Description of Artificial Sequence: Synthetic coding sequence
atgtccaaccggaggagacataccggctcaagggccaatcctgatcctaatacgtgcttgggcgtttttggcctctcattgtacacaactgaaagggatctgagggaggtgttcagccgatacgggcctctgtcaggggttaacgtggtgtatgaccaacgcactggcagaagccgcggatttgccttcgtctatttcgaaaggatcgacgacagcaaggaagcaatggagagagcaaacggcatggaactggatggaagacggatccgtgtggattacagcatcaccaaacgtgcgcacactcccacccctggtatctacatgggcagacccacccatagcggaggaggcggagggggaggcggaggaggaggcggtggaggaggtggaagacgacgcgattcatactacgacagaggatatgacagggggtacgaccggtatgaggactatgattatagatatagacggtccccctctccttattactcccgatatcggtcccggtctaggagcaggtcatacagcccacgccgatattag

SEQ ID NO: 24731 - DNA, 546 bp, Artificial Sequence
  Description of Artificial Sequence: Synthetic coding sequence
atgtcaaatcgcaggaggcataccggctctcgtgccaatcccgaccccaacacatgtcttggcgtattcgggttgtctctttacaccaccgagagagatctaagggaggttttcagccgctacggccctctctcgggagtgaacgttgtctacgatcagagaactggcagaagtaggggctttgccttcgtgtacttcgaacgcattgatgattcaaaggaagcaatggagcgggctaatggtatggagttagatggccgaagaattagagtagactattctattactaaacgggctcacaccccaacccccggaatttacatggggcgacccacacactccggcggtgggggaggtggaggaggcggtggaggcggtggtgggggaggaagacgaagggactcttactatgaccgtggctatgatagggggtatgaccgttatgaggattacgactaccgctaccggagaagaagcccttctccctactactctcgctacaggagtaggtcgcgttctaggtcttattcccccagacggtattag

SEQ ID NO: 24732 - DNA, 2508 bp, Artificial Sequence
  Description of Artificial Sequence: Synthetic coding sequence
atggccgcatcagcagccgctgcatcggccgctgcggcatcagcggcatccggttcgcccggtcctggagagggcagtgctggtggagagaagcgatctacagcaccatcagcagctgcctctgcctcagcaagtgcggctgcgagctctccagccggtggcggagcggaagccctagaattgctggagcactgtggcgtgtgccgtgagcgcctccgcccagaacgcgaaccgaggctcctaccctgtcttcacagtgcatgtagtgcttgcctggggcctgcggctccagcagctgccaacagctccggggatggaggtgctgctggggacggcaccgtcgttgattgtcccgtttgcaagcagcagtgttttagcaaagatattgtggaaaactattttatgcgtgattccgggtctaaggcggcaactgacgcgcaagatgctaatcaatgttgcacatcttgcgaagacaatgctccggctaccagctattgtgtggaatgctcggagcctctttgcgaaacctgcgtcgaggcacaccaaagagtgaaatacaccaaagaccacaccgttaggagtacagggccagcgaaaagcagagatggggagcggactgtgtactgcaacgtgcacaaacatgagcctctcgtgctgttctgcgagtcttgcgatacgctgacctgtcgcgactgccagctcaatgcacataaagaccaccagtaccaattcctggaggatgccgtgagaaatcagcgtaagttgctagccagcctcgtgaagcggctgggcgacaagcacgcaacactgcagaagtccaccaaggaggtgcggtcgtccattcgccaggtttctgatgtgcaaaagagggtacaagtcgacgtcaaaatggctatcctgcagataatgaaagagctgaacaaaaggggacgggtgttggttaacgacgcccaaaaagtcacagaggggcagcaggagcgattggaaaggcaacattggacgatgaccaaaatccagaagcaccaggagcacattctacgatttgcttcatgggcgttagaatccgacaacaatactgcgctgctcctgagcaaaaagctcatctacttccagctgcatcgcgctctgaagatgattgtggacccagtggagccacatggagagatgaaatttcagtgggacctcaacgcctggacgaaaagtgcagaggcctttggcaagattgtggccgagagacccggtacaaattcgactggcccagcaccaatggcgcctcccagggcgcctgggccactatctaaacaagggagtgggtccagccaacccatggaggttcaagagggatatggttttggctccggtgacgatccatactcctccgccgaaccccatgtgagtggagtgaagcgatccagatcaggagagggtgaggtgtcaggtctgatgaggaaagttcctagggtttccctggaaagactggatttggatctgacagctgactcacagccacctgtgttcaaagttttccccggtagtaccaccgaagattacaatctcatcgtcattgagaggggggctgcggcagccgctactggtcagccaggaacagcccctgctggtaccccgggagcgccacctttagctgggatggccatcgtgaaggaggaggagaccgaggcggctatcggcgcaccccctaccgccacagagggaccggagactaaacccgtattgatggcactggcagagggtcccggagctgagggccctaggcttgccagtccctccggcagcacttccagtgggctggaggttgttgctcctgaagggaccagcgctccgggaggaggacctggcactctcgacgattctgctaccatttgcagagtgtgtcagaagcccggtgacctggttatgtgcaatcaatgtgagttttgttttcacttggattgccacctcccggctctccaggatgtgccaggtgaagagtggagctgttcactatgccatgtgttgcccgacttgaaggaggaagatgggtccctatcactagatggtgccgattccaccggcgtagtggcgaagctctccccggcaaatcaacgaaagtgtgaaagggtgttgctggccctgttttgtcacgagccctgccgtccactccaccagttggctaccgactcgaccttctctctggaccagccgggaggcacactggacttaaccttgattcgcgctcgactgcaggagaaactcagtcccccttattcatccccacaagagttcgcacaggacgtgggccgtatgtttaaacagttcaataaactcactgaagacaaagcagacgtgcagagtatcattggactgcagcgattttttgaaacgcgaatgaatgaagctttcggtgacactaaattttccgcagtgctggtggaacctcccccaatgagtcttcctggtgccggactctcctctcaggagctctcagggggtcccggagacggcccttag

SEQ ID NO: 24733 - DNA, 2262 bp, Artificial Sequence
  Description of Artificial Sequence: Synthetic coding sequence
atggcagcttcagccgcagcagcaagcgcagccgctgcaagcgccgcttcgggttcaccaggcccaggcgagggcagcgccggaggtgagaagaggagtactgctccctccgccgctgcatcggcatcagccagcgcagcagctagctcaccagccggagggggtgccgaagcacttgagctgctggaacattgtggcgtgtgtagggaacggctcagacctgagcgagaacccaggttgctgccttgcctccatagtgcctgctcagcatgtttgggaccagctgcaccggctgcagccaactcctcaggcgacggcggagcagccggtgatggaactggacctgctaagtccagagacggggagcgaaccgtgtactgtaacgtgcacaaacatgaacccctggtgctgttttgcgagagctgtgatactctcacctgtcgggattgccagttgaatgcacacaaggatcaccaatatcaattcttggaggacgccgtcaggaaccagcggaagctgctggcctccctggtaaagcgactgggggacaaacatgccacactgcagaagtctacaaaagaagttcgttcgagcatccgacaagtaagtgatgtgcaaaaacgcgtgcaagttgacgtgaagatggccattttgcagataatgaaagagttgaataagcggggacgagtgctggttaatgatgcgcagaaagtgacagaaggtcagcaggagagactcgagaggcagcactggaccatgaccaagattcaaaagcatcaggagcatatactgagattcgcgtcttgggctcttgagagtgacaataatacagccctccttttgtcgaaaaaacttatctatttccaactccatagggcccttaaaatgatcgtcgacccggtggagccacacggcgagatgaaatttcaatgggacctcaatgcgtggactaagtctgccgaagcatttggaaagattgtcgccgagcggcctggtaccaatagcactggacccgctccaatggcaccccctcgtgccccaggtcctctttctaaacagggcagcggtagcagtcagcccatggaggtccaggaagggtacgggttcgggagtggcgacgacccctatagctccgccgagcctcatgtgtctggtgtcaagagaagccggtcgggtgaaggcgaggtctcaggcctgatgagaaaagtccctagagttagtctggagaggctcgatttggacttgactgctgactcccagcctccagttttcaaggtcttccccggatccacgacagaggattacaatttgatcgtgatcgagcggggagccgctgcggcagccactggccagccagggaccgctccagctggaacaccaggagctccgcctctcgccggtatggccatcgtgaaggaggaggaaaccgaggccgctatcggtgcccctcccacagcaaccgagggacccgagacaaagcctgtactgatggcactcgctgaagggccaggagcagagggaccacgactggctagccctagtggcagtacctctagcgggcttgaggtggtcgccccagaaggcacatcggccccaggaggaggcccaggcacattggacgatagcgccacaatttgtagagtatgccagaaacccggagatctggtgatgtgcaaccagtgcgaattctgttttcatctggattgccatctgccagctctacaggacgtaccaggagaagagtggtcatgctccctgtgtcatgttctgccagacttgaaagaagaagacggcagcctatcacttgatggagctgactctacaggcgtggtagctaagctgtcacccgcaaaccagaggaagtgtgagcgggtgttacttgctctgttctgtcacgagccctgtagacccctgcaccaactggctaccgactccactttcagtcttgaccaaccaggcggtacactcgacctcactctcattagagccagacttcaggagaaactgagtccaccctattcaagtcctcaggagtttgctcaggatgtcggcaggatgtttaagcagtttaataagctcaccgaggacaaggccgacgtccagagtattatcgggctccagaggtttttcgaaacccgcatgaacgaggcatttggggatacaaaattctctgcggtactagttgaacccccacctatgtccctccctggtgccggtctaagttcccaggagctgtcaggcggaccaggggatggcccatag

SEQ ID NO: 24734 - DNA, 1503 bp, Artificial Sequence
  Description of Artificial Sequence: Synthetic coding sequence
atggaggtatctaccaacccaagtagcaacatcgacccgggagattacgtcgaaatgaacgattcaataacccatctgcctagcaaagtggtcattcaggatattacaatggaattgcactgccctctctgcaatgattggtttcgagaccctttgatgctgagttgcgggcataacttctgtgaggcatgtatacaggacttttggagactgcaggcaaaagaaacattttgcccagaatgtaaaatgttgtgtcagtataataactgcacctttaatcccgttctggacaagctagtggaaaagattaagaaactgcccctactgaaggggcatccccagtgcccggagcacggggaaaacctgaaattgttttctaagcccgatgggaagctaatatgtttccaatgtaaggacgccagactttcagtgggccagtcaaaggaatttttgcagatctcagacgctgttcacttcttcacggaagaattggcaattcagcaaggacagctcgagactacattgaaggagttgcaaactctgaggaatatgcagaaggaggctatcgctgcacataaagagaacaaactgcaccttcagcagcatgtgtctatggagttcctaaaactgcaccagttcctccacagtaaggagaaagatatcctcacagaactgcgggaggagggaaaggctctcaacgaggagatggagctcaacctgagtcagttacaggagcaatgccttttagccaaggatatgctggtaagtatccaggccaagactgagcagcagaatagttttgactttctgaaagatatcacaaccttactgcactctttggaacagggaatgaaggtcctggctactcgtgaactgattagtcgaaagctgaatctgggtcagtacaaaggccctatccagtatatggtctggcgagagatgcaggacaccttatgcccagggctatcgcccctcactctggatcctaaaaccgcacaccctaatctggtgttgtcaaaatcccagaccagcgtgtggcatggtgacatcaagaagataatgcctgacgatcccgaaagattcgacagtagcgtggctgtgctgggcagccgaggatttacttcagggaaatggtactgggaggtcgaggtcgccaagaaaacgaagtggacagtgggcgtcgtccgcgaatccattatcaggaagggaagctgccctctcacccccgagcagggattttggctcctgcgcttgaggaaccagaccgatctgaaagccttggatctcccttcattctccttaacactgacgaacaacctggataaggtggggatctacttggattacgagggtggtcagttgtcattctacaatgccaaaacaatgacccacatctatacctttagtaatacctttatggaaaagctgtacccatatttttgtccttgtctgaatgatggcggagagaacaaggagcctctgcacatcctgcatcctcaatag

SEQ ID NO: 24735 - DNA, 1026 bp, Artificial Sequence
  Description of Artificial Sequence: Synthetic coding sequence
atggaagaggagcttgcgatacagcagggccaacttgagacgacactaaaagagctacagaccctgagaaatatgcaaaaagaggcgatcgccgcacataaggaaaataaactccacctccagcagcacgttagcatggagtttctgaagctccatcaatttctacattccaaggaaaaggatattttaaccgaactgcgcgaggagggcaaggccctaaacgaagaaatggagctgaacctgtcccagctccaagagcagtgcctcctggccaaggacatgttggtatcaatccaggccaaaactgaacagcaaaattcctttgacttcttgaaggatatcaccacactcttgcattcattggaacaggggatgaaagtcttggcgacgagagagttgatctcaaggaagctgaacctagggcagtataaagggccaatccagtatatggtttggagagagatgcaggacacgctgtgcccaggtctgtcgcctctgaccctcgatcccaagacggctcatcccaatctggtactgagtaagtctcaaacttctgtttggcacggcgacatcaagaagataatgcctgatgaccccgaacgcttcgacagcagcgtggctgtcctcggatcccggggattcacatctggtaagtggtattgggaggtcgaggttgccaagaaaacaaaatggacagtaggcgtagttcgcgagagcataattcggaagggctcttgcccgctgacccccgagcagggcttctggctcctgagacttcgaaatcagaccgacttaaaggctcttgacctgccctcattctcactgacattgacgaataaccttgataaggtcgggatctacctggattatgaaggcggacagctgagcttttacaatgcgaagaccatgactcacatatacactttttccaatacattcatggaaaaactctacccttatttttgtccatgtctgaatgacggcggagagaacaaggagccgcttcacatcctccaccctcagtag

SEQ ID NO: 24736 - DNA, 891 bp, Artificial Sequence
  Description of Artificial Sequence: Synthetic coding sequence
atggaatttctgaagctccaccagttcctgcacagcaaagaaaaggatatcctgaccgagttaagagaagaagggaaagccttaaatgaagagatggagttgaatctctcccagctgcaggagcagtgtctgctggcgaaggatatgctggtgtcaatccaggccaaaactgaacagcagaacagctttgattttttgaaagatattactactttactgcatagcctagaacaaggcatgaaagtgctggccacgcgggagctgatctcccgaaaattgaatctggggcagtataagggccctattcagtatatggtctggcgggaaatgcaggataccctgtgccctgggctgagccctctaaccctggaccccaaaacagcacaccccaatctcgtgctttccaaaagtcaaactagtgtgtggcacggcgacattaagaagatcatgcccgacgatcctgagcggttcgattcatccgtcgccgtactcggaagtagagggtttacctccggcaagtggtattgggaggtggaggtggcaaaaaaaaccaagtggactgtgggagtagtccgtgagagcattattcgcaaaggcagctgcccattaactccagagcaggggttttggctccttagacttagaaatcagaccgatttgaaggctctggacttgccttcgttctccctaacactcaccaacaatctggataaggtggggatctacctagactacgaaggaggccagctgagcttctataacgccaagacaatgactcacatatacaccttttctaacacatttatggaaaagctgtacccgtacttctgtccctgtctgaacgatgggggtgaaaataaggaacccttacatattctgcacccccaatag

SEQ ID NO: 24737 - DNA, 840 bp, Artificial Sequence
  Description of Artificial Sequence: Synthetic coding sequence
atggagttcttgaaactgcatcagtttttgcatagtaaagaaaaggacatcctcacggagcttcgggaggaggggaaggctcttaatgaggagatggaactgaatctgtcccagctacaagaacagtgccttttagcgaaggacatgctagacatcacaacactcctgcactcactggagcaagggatgaaagtgttagctacccgggaactgatctcacgtaaacttaacctgggacaatacaaagggccaatacaatatatggtgtggagagagatgcaggacaccctttgcccgggactgagcccacttaccttggaccccaagacagctcatcctaacttggtgctttccaaatcacagacaagcgtttggcatggcgatattaaaaagattatgccagacgatccagagcgctttgattccagtgttgccgtccttggcagccggggttttacgagcggaaaatggtattgggaagttgaggtcgctaaaaagactaagtggaccgtgggagtcgtgcgcgagagcatcatcaggaagggttcgtgcccacttacccctgaacagggtttctggctcctccgcctgaggaatcagaccgacctgaaggccctggacctgccttccttttccctcacccttactaataatcttgacaaggtggggatttatctcgactacgagggaggacagttgtctttctacaacgccaaaaccatgacacacatctacactttttcaaacacctttatggagaagctatacccctacttctgcccctgtttaaacgatggcggtgagaacaaggagccactccacatcctgcatcctcagtag

SEQ ID NO: 24738 - DNA, 1503 bp, Artificial Sequence
  Description of Artificial Sequence: Synthetic coding sequence
atggaggtgtccacaaatccttcaagcaacatcgacccaggagattacgtggagatgaatgactccatcacacatctgccgtccaaggtagtgatccaggacatcacaatggaactgcactgccccttgtgcaacgattggtttcgcgatcccctaatgctatcttgcggacataatttctgtgaagcatgtattcaggacttttggcgcctccaagccaaagagaccttctgtcctgagtgtaaaatgctctgccagtataacaattgcacatttaacccagttttagataaactcgtggagaaaataaagaagctgccactgttgaaaggacaccctcagtgcccggaacacggggaaaatctgaagttgtttagcaaacccgacggaaaactgatttgcttccagtgtaaagatgccaggttgtcagtggggcagagcaaggaattcctgcagatctctgatgccgtgcacttctttactgaggaacttgccattcaacagggccaactggagactacattgaaagaactgcagacactgcgtaacatgcaaaaagaggctattgcagctcataaagaaaacaagctgcacttacaacaacatgtgtccatggaattcttgaagcttcatcagttcctgcactctaaagaaaaggatatactgacagagctgagggaagaagggaaagctctgaacgaggagatggagcttaacctctcacagctgcaggagcagtgcctgcttgccaaggacatgctggtatcgatccaggcaaagaccgaacagcaaaactccttcgacttcttgaaagatatcaccaccttgctccatagtctggagcaggggatgaaggtcctggcaacaagagagctgattagccgaaaactgaacttgggacagtataaaggacccattcagtacatggtttggcgcgagatgcaagataccctctgccccggtctgtcgcccctaacgctcgatccaaagacggctcatcccaacttggtgctgtctaagagccaaacctctgtgtggcacggcgatatcaaaaagatcatgcctgacgacccggaaagatttgatagtagcgtggccgtgcttggctcccgaggttttaccagtggcaagtggtactgggaagtggaggtggcaaaaaagacgaaatggaccgtgggcgtggtccgcgagtccattatacggaaggggagctgccctctgacacctgagcaaggattctggctgctgagactacgcaatcagacagatctaaaagccctggacctgccttcgtttagccttacattaacgaataacctggataaagtgggaatctatctggattatgaggggggacaactttcattttataacgcaaaaacaatgactcatatctacactttttctaacacctttatggagaaattatatccatatttttgcccctgcctgaacgatggcggagaaaataaagagcccttgcacattctccacccccaatag

SEQ ID NO: 24739 - DNA, 891 bp, Artificial Sequence
  Description of Artificial Sequence: Synthetic coding sequence
atggaattccttaagttgcaccaatttctacactcgaaagagaaagacatcctgactgaactgcgggaagaaggcaaagcccttaacgaagaaatggagctaaatctgtcacagttgcaggagcagtgcttgctggccaaggatatgcttgtctcaatccaggccaagacagaacagcagaacagtttcgactttctgaaggatattacaactctgctgcactctctggagcagggaatgaaggtccttgccacaagagagttgattagccgaaaactgaacctgggccagtacaagggtccaatccaatatatggtgtggcgggaaatgcaggacaccttgtgtcctggactgtcgccgttaaccttggaccccaaaacagcccaccccaatctggtgctctccaagagccagacatcagtgtggcacggtgatatcaagaagatcatgcccgacgaccctgagcggttcgacagttctgtagcagttcttgggtcaagagggtttacctccggcaaatggtattgggaggtagaagtcgcaaagaagaccaagtggacggttggggtggtaagggaatctattattcgaaaaggatcctgcccccttacacccgagcaggggttttggctcctccgacttcggaatcagacagatctcaaggccctggacctaccaagttttagtcttacgctaaccaacaatctggataaagtcggaatctaccttgattatgagggaggacaactcagcttttataacgccaaaacgatgacccacatctacactttttctaacaccttcatggaaaaactgtatccgtatttctgtccttgcctgaatgatggcggtgaaaacaaggagcccctgcacatattgcacccacagtag

SEQ ID NO: 24740 - DNA, 1494 bp, Artificial Sequence
  Description of Artificial Sequence: Synthetic coding sequence
atggagggtagcggtgagcagcctggaccacagccacaacacccgggagaccacaggattcgggatggggattttgtggtcctgaaaagggaggacgtgttcaaagccgtgcaggtacagcggagaaaaaaggtgaccttcgaaaaacagtggttctacctggacaacgtcataggccacagttatggaaccgctttcgaggtcacatccggcggatccttgcagcctaagaaaaagcgcgaagagccaaccgccgaaacaaaagaggcagggaccgataaccggaacattgtagacgatgggaaatcccaaaagctgacacaggacgatatcaaagccctcaaagataaaggaatcaagggtgaagagatcgttcagcagttgatcgagaactcaacaaccttcagggataaaaccgaatttgcacaagacaagtacattaagaaaaaaaagaagaagtacgaggccatcattaccgtcgtgaaaccatctactcggatcctgtcaatcatgtactacgcccgtgaacctggcaagattaatcacatgagatatgacacactcgcccagatgctgactcttggaaatataagagcaggcaataaaatgatcgtgatggaaacatgtgcaggccttgttctgggggcaatgatggagcggatgggcggatttggctctattatccagctttaccctggcggtggccctgtcagggccgcaactgcctgctttggtttcccaaaatcttttctctccgggttatatgagtttccactgaacaaagtagatagtttacttcatggtaccttctctgcaaagatgcttagctcggaacccaaggactccgctctggtggaagagtctaatggaactcttgaggaaaagcaggcgagtgagcaggagaacgaggactccatggctgaggctcctgaatccaatcaccctgaggaccaggagactatggagacgatctcccaggacccagaacataagggccctaaggaaagaggaagtaagaaggactatatccaggaaaaacagcgccgacaggaagaacaaaggaagcggcatttagaagctgccgcactcctgagcgaaagaaatgcggacggtctgatcgtggcctctagattccatcccacgcctctcctcttgagtctgctggattttgtcgcccctagcagacctttcgtggtctattgccagtataaggagccacttctggagtgctacactaagctgcgggaacgcggaggtgtgattaatctccgcctttccgagacttggttgcgaaactatcaggtattgccagaccggagccatcctaaactgcttatgtcgggaggcggagggtatctgttaagtggattcactgtggctatggataacctcaaggccgatacgtctcttaagtcaaacgcatcaactttggaatcccacgaaacagaggagcctgctgccaagaagagaaagtgtcccgaaagcgattcctag

SEQ ID NO: 24741 - DNA, 984 bp, Artificial Sequence
  Description of Artificial Sequence: Synthetic coding sequence
atgtactatgcaagagagccaggtaaaatcaaccacatgcgctatgatacacttgcgcaaatgctgactctaggaaatataagggctggaaacaaaatgatagtaatggaaacatgtgcaggccttgtgctcggcgcaatgatggagagaatgggaggcttcggaagtattatccagctttaccccggtggagggccagttcgagctgccaccgcttgcttcgggtttccgaagtcattcctgtctggcctgtacgagtttccgttgaacaaagttgattcgttactgcatggtaccttttcagccaaaatgctttcatctgagcccaaggacagtgcactggtcgaagagtcaaacgggaccctggaagagaagcaagccagtgagcaggaaaatgaagacagcatggctgaagcacctgagtcgaatcatcccgaagatcaagaaactatggaaactatcagccaggaccctgagcataaggggcctaaggaaaggggttcaaaaaaggattatattcaggaaaagcaacggagacaggaagagcaacgaaagcgacatctagaggcagccgctctcttaagcgagcggaatgcagatggtctgattgtggcctccagatttcaccctacccctctgcttctgtcactattagacttcgtggccccaagccgtccctttgtagtttattgccagtataaggagcccttactcgagtgttataccaagctgcgcgaacgaggaggcgtgatcaacttgaggctgagtgagacatggctgcggaactaccaggttttaccagatcggagtcaccccaaactgctgatgtcaggcggtggcggatatcttttaagcgggttcactgtcgccatggataacctgaaggccgacacctccctgaaatcgaacgcctcaacattagaatcacatgaaacggaggagccagcagcaaagaagcgcaagtgtcctgagagcgactcctag

SEQ ID NO: 24742 - DNA, 963 bp, Artificial Sequence
  Description of Artificial Sequence: Synthetic coding sequence
atgtcgttcgttgcttatgaagaactgataaaggagggcgatacagccatcctgtcgttgggtcacggggctatggtcgcagtgagagtgcagcgaggggctcaaacacagacccgccacggcgtgttgagacactctgtggacttaattgggaggcccttcggcagcaaggtcacatgcggaagaggaggttgggtgtatgtgcttcatccaactccagaactgtggacactcaatctgcctcaccggacccagatcctgtacagcacagatatcgctctgatcaccatgatgctcgaactgcgtcctggcagcgtagtttgtgagtccggcacaggttcggggagtgtatcgcatgcaataataagaacaatagctcctacaggccatcttcacacagtggaattccaccagcagcgtgctgaaaaggcacgggaggagtttcaggagcatcgtgtgggccgttgggttacagtgcgcacccaggacgtgtgcagatctgggttcggcgttagccacgtggctgatgcagttttcctggatattccaagcccctgggaggccgttggccacgcctgggacgcactgaaagtggaaggaggaagattttgcagtttttctccatgcattgagcaggttcagcggacctgtcaggccctggccgcacgtggttttagtgagcttagcaccctggaagtgttaccgcaggtgtataatgtccggactgtcagtcttccaccaccagatctcgggacaggcaccgatgggccagctgggagtgatacttccccgttccgctcgggcacccctatgaaggaggctgtggggcataccggatatctgactcttgccaggtcgtggggtgagcttacccagaatccgtgtccagcccttccgagcgcacgtaggccagggcaacctcgcaaccaaggcggagatcctgccctctggccgcctggctag

SEQ ID NO: 24743 - DNA, 870 bp, Artificial Sequence
  Description of Artificial Sequence: Synthetic coding sequence
atgtcctttgtggcctacgaggagttgattaaggagggagacacagctattctcagtctaggccacggggctatggtggcagtcagagtgcagcgcggtgcacaaactcagacacggcacggagtactgagacacagtgtcgaccttattggacggccttttgggagtaaggtaacttgcggaaggggaggatgggtatacgtcttgcatccgacacctgagctgtggacattgaacctcccccacagaactcagatattgtattctaccgacatagccctgattacgatgatgctcgaactccgaccagggagtgtcgtgtgcgagtcaggtaccggtagcgggagtgtgtcacatgccattatcagaaccattgcccctaccggacacttacacacggtggaatttcaccaacagagggccgagaaagccagagaagaatttcaggaacaccgagtgggcagatgggtcaccgtccgaactcaggatgtgtgccgatctggattcggcgtgtctcacgtggccgacgcagtctttctcgatatccccagcccgtgggaagccgtggggcatgcttgggatgccctgaaagtggaaggcggtagattctgttcctttagcccgtgcattgagcaagtccaacgtacatgccaggcattggccgcacgtggattttctgaactcagcaccctagaggtcctgcctcaagtttataacgtgaggaccgtctccctccctccacccgacctcggcaccggaaccgacgggccagctggaagcgacacctcaccattccggagcggcacaccaatgaaggaagccgtgggtcatactggttacttaacgtttgctacgaagacgcctgggtag

SEQ ID NO: 24744 - DNA, 1245 bp, Artificial Sequence
  Description of Artificial Sequence: Synthetic coding sequence
atgtccggcctggacggtggaaataagctgccactggctcagacaggcggactggctgccccagatcatgcctccggcgatcctgaccgggaccagtgccagggactgcgcgaggaaactgaagcgacacaagtgatggctaatacgggcggtgggtccttagagacggttgcagagggaggcgcatcacaggaccccgttgattgtggtcccgcacttcgagtgcccgtcgcaggctcgcgcggaggcgctgccactaaggctggtcaggaagacgccccaccaagcacaaagggactcgaagcagcgagcgcagccgaagcagcggactcctcccagaaaaacggctgccagctcggcgagcctcgcggaccagctgggcagaaggcactcgaggcctgtggggcaggaggacttggttcacagatgattcccggtaaaaaggccaaggaggtgactactaagaagcgggctatttccgccgctgtggaaaaagagggtgaagctggagcagccatggaggagaagaaagtcgtgcagaaggaaaaaaaggtcgctggcggagttaaagaggagacgcgcccaagagccccaaagataaacaattgcatggacagccttgaagccatcgaccaagagttgtctaatgtgaatgcacaagccgatcgcgcatttctgcaattagagcgcaagtttgggaggatgcgtagattgcatatgcagagaaggtcttttataatccagaatatccccggtttttgggtgacagcatttcgtaatcatcctcaactctctcccatgattagcgggcaggacgaggatatgcttcgctacatgattaatttggaggttgaagagctgaagcatccacgcgctggatgcaaatttaaattcatcttccagggcaatccctatttcagaaacgagggcctcgtgaaggagtatgaaaggcgcagctctgggagagtggtttcattaagcacccccatcagatggcacagaggccaagacccacaggctcatatacacaggaatcgcgaggggaatacaattccgagcttttttaactggttcagcgatcattcccttcttgagtttgaccggatcgcagaaatcattaagggggagctttggccgaatccactgcagtactatctcatgggcgaagggccaagaagggggattagaggaccccctcggcagcccgtagagagcgccaggtcctttcggttccagtccggttag

SEQ ID NO: 24745 - DNA, 1254 bp, Artificial Sequence
  Description of Artificial Sequence: Synthetic coding sequence
atgtcgggaagaagtcgagggcgtaagagctctcgagctaaaaaccgcggaaaaggccgtgctaaggccagggtccgtccagcccctgacgatgcacctagggaccccgatccctcacaatatcaaagcctgggcgaagacacccaggccgctcaggtacaagctggagcagggtggggtggcttagaggcagcggcaagtgctcagctgctgaggctgggcgaggaagcagcctgcaggcttccgctcgactgcggtctggcactacgggctcgggctgcaggcgaccacggacaagccgctgctagacccggtccgggtaaggccgcaagcttatctgagcgcctggcagcagacacagtttttgttggaaccgccggaacggtcggccgacccaagaatgccccaagggtgggcaatcgcagaggtcccgcagggaaaaaggctccagagacctgtagcacagcagggaggggaccacaggttattgcgggaggccgtcagaaaaaaggcgcagcgggagagaacacctctgtgtctgccggagaagagaaaaaagaggaacgggatgcaggatctgggcctcctgccaccgaaggttcaatggatacgctcgaaaacgtgcaattgaagttggagaatatgaacgctcaagcagatcgcgcttacctgagactcagcaggaagtttggtcagctaagactgcaacacctcgagcgaagaaatcatctgatccagaacatacctgggttctggggacaagcgttccagaaccatccccagcttgcttcgttcctgaactcgcaggagaaagaggttctgtcttacctgaactccctggaggtggaagagttgggtctggcaaggctcggctataaaataaagttctacttcgatcgcaacccatacttccagaacaaggtcctgatcaaggaatacgggtgtggcccatcaggtcaggtcgtgtctcgatctacccctattcaatggctgccgggacatgacctgcaatcactgtcacaaggcaatcccgaaaataaccgcagcttcttcggatggttcagtaatcactcatctattgaatcggataagatcgtcgaaattataaacgaagaactctggccgaatcccctgcagttctatttgttaagtgagggcgcaagggtagagaaagggaaggaaaaagagggcagacaaggaccaggtaaacagccgatggagaccacccagccaggggtaagccagagcaattag

SEQ ID NO: 24746 - DNA, 1233 bp, Artificial Sequence
  Description of Artificial Sequence: Synthetic coding sequence
atgtctttaccggagtccccacactcgcctgccacactggattacgccctagaagatccacatcagggtcagagatctagggagaagtccaaggccacagaggtgatggcagacatgttcgatgggaggctggagccaatcgtgtttccccctcctcggttgcctgaggaaggcgtggcccctcaagaccccgctgatggaggacacacattccacattctggttgatgccggtcgatcccacggcgctatcaaagccggacaggaggtcacccccccaccagccgagggtcttgaggccgcatcagctagcctaactactgatggaagcctgaagaacgggttccccggtgaagagacgcatggactcgggggtgaaaaggctctagagacctgcggcgctggacgctccgagtcagaggtcatcgcagaaggcaaggcggaagacgtgaagcccgaggagtgcgcaatgtttagcgcccctgtggatgagaaacctggaggcgaggagatggacgtggcggaagaaaaccgagctatcgacgaggtaaaccgagaagcaggtcctggccctggacctggacctctcaatgtcgggctccatctgaacccactggaatcaatccagctggaacttgatagcgtgaatgcagaagccgatagggctctactccaagttgaaagaagattcggccaaatccatgaatactacctggaacaacgaaacgatatcattagaaatataccaggattctgggtaaccgcttttcgacaccaccctcaacttagcgctatgattcgcggacaggacgcagagatgctgtcgtaccttaccaatctcgaggtcaaagaactgcgccaccctaggactggatgcaaatttaagttcttcttccagcgaaatccctatttccgcaataagttaatagtaaaggtgtatgaggtaagaagctttggccaggtggtcagcttcagtacactgataatgtggcgacgcggtcacggaccacaatctttcatacaccgaaatcgccacgtgatttgcagtttcttcacctggttttccgatcacagtctgcctgagtccgaccggattgcacagatcattaaggaggacctctggagtaatcctctgcagtactacctgctaggcgaagatgcccacagagcacggaggcggctcgtaagggaacccgtggagatccccagacctttcggattccaatgtgggtag

SEQ ID NO: 24747 - DNA, 2415 bp, Artificial Sequence
  Description of Artificial Sequence: Synthetic coding sequence
atggctgcccacagacccggacctctgaagcagcagaacaaagcgcacaaaggcggtcggcacagaggtcgcggatctgcgcagcgtgacggcaaggggagactggccctgaaaaccctctccaaaaaggtgcgcaaagaactctcccgcgttgatcagaggcaccgagcatcacagcttagaaaacagaagaaagaggccgtactggccgagaaacgacagctaggcggaaaggatggccctccccatcaagttctagtggtccccctacacagtaggatttccctgcccgaagctatgcagttattgcaggacagagataccgggaccgtccatctaaatgagctgggaaatacccagaatttcatgctgctgtgccccagattgaaacaccgttggttttttacctcggccaggcccggtgatttgcacgttgtgttggacatggccaaggtcgccgatactattctttttttgctggacccacttgaaggttgggatagcacaggcgattattgcctgtcctgccttttcgcacagggtcttcctacatacaccctggcggtgcaaggaatatcaggcttaccactgaagaaacagatagacacccggaagaaactttctaaggcagtagaaaaacgtttcccacacgacaagttgttgctgctagacacccaacaagaggctggtatgctgctgcgacaactggcaaaccagaagcaacagcatttagctttcagagacagaagggcgtatcttttcgcccatgcagtggacttcgttccatcagaagaaaacaacttggtgggtactctcaagatttccggatatgttcggggtcaaacactcaacgtcaacagactgcttcacatcgtcggctacggcgactttcagatgaaacagatcgacgcacccggagaccctttcccattgaatccacgaggcataaagccgcaaaaggaccctgacatggctatggaaatctgcgctactgacgccgtggacgatatggaggaaggacttaaggtgctgatgaaggccgaccccggtagacaagagtctctgcaagccgaggtcatccctgatcctatggagggcgagcagacctggccaactgaagaggagctctcagaggcaaaagactttctgaaagagtcatccaaggtggtgaagaaggtcccaaaggggacaagtagctaccaggctgaatggattctcgacggtggttcacagagtggaggtgagggcgatgaatatgagtacgacgacatggagcatgaggacttcatggaagaggagagccaggatgagtcctctgaggaggaggaagagtatgaaacaatgactatcggggaatccgttcatgacgacttgtatgacaagaaagtagacgaagaggctgaggccaagatgctcgaaaagtacaagcaggagagactggaagaaatgttccccgacgaggtggacaccccaagggacgtcgccgcacgaatcaggttccagaagtaccgtggactcaaatcttttcggacgtccccatgggaccctaaggaaaacctgccccaggattatgcccgaattttccagttccagaactttacaaacactcgcaagagcatttttaaagaagtggaggaaaaagaggtagagggagctgaggtcggatggtatgtaacattacacgtgagcgaggtaccagtgtccgtggtggagtgctttaggcagggcacccccctgatcgcctttagcttgctcccacacgagcagaaaatgtccgttctgaacatggtagttagacgcgatccaggcaacaccgagcccgtgaaggccaaagaggagcttatcttccattgcggcttcaggcgctttagagctagtcctctcttttctcagcacaccgccgcagacaaacacaaactgcagagatttctgaccgccgatatggcgctcgttgccacggtatacgctcccatcactttcccaccggcttcggtcttgctctttaagcagaagagcaatggaatgcactccctgatcgctaccggccacttaatgtcggtggacccagaccgcatggtgatcaaacgtgttgtgctctcggggcatcctttcaaaatctttaccaaaatggctgttgtgaggtacatgttctttaaccgagaggacgtattgtggtttaagcctgtcgagcttcgcacaaagtggggcaggcgcggacatatcaaggaaccactggggacccatggccatatgaaatgtagtttcgatgggaaacttaaatcccaggataccgttctaatgaatctctacaaaagagtctttcctaagtggacatacgacccttacgtgccggagccagtcccatggctgaagagtgaaatctcgagcaccgtgccacagggcggaatggagtag

SEQ ID NO: 24748 - DNA, 57 bp, Artificial Sequence
  Description of Artificial Sequence: Synthetic coding sequence
tgcaagcaatcatgcgtttcaattgcctcatgcgaggccgcagagttgaatctctag

SEQ ID NO: 24749 - DNA, 2319 bp, Artificial Sequence
  Description of Artificial Sequence: Synthetic coding sequence
atgaatcgacttaggaatgcaaagatctatgtcgaacgggcagtgaaacagaagaaaattttcactattcagggctgttatcccgtgattcgatgcttgttgagacgccgtggatgggttgaaaagaaaatggtacaccgctcaggacctactctcctccctccacagaaggatctggacagctccgccatgggagactccgacaccactgaggatgaagatgaggatgaggatgaagagttccagccctcacagcttttcgatttcgacgatctactgaagtttgatgacttggatggaacccatgccctgatggtggggctttgtctcaatctccgaaaccttccatggttcgatgaagtcgatgctaactctttttttcccaggtgttattgtttgggggctgaggatgataaaaaggcatttatagaagacttttggctaacagccgctcgcaacgtgctgaaactggtggttaagagcgaatggaagagttatccaattcaggccgtggaagaggaggcaagcggcgataagcaaccaaaaaagcaggaaaaaaacccagtgttagtttctcccgaattcgtcgacgaggctctgtgtgcatgtgaggagtatttaagtaatctggcccatatggacatcgataaggatctcgaggctccgctttatttgactccagagggctggtctctcttcctgcagcgctattaccaggtggtgcatgagggcgctgaactgaggcatctggatactcaggtacagcgctgcgaggatatcctccagcaactgcaagccgtggtgccccagattgatatggagggggaccgcaatatatggatagtgaagcctggagccaagtccagagggagaggcatcatgtgcatggatcacctggaagagatgcttaagcttgtgaatgggaatcctgtcgtgatgaaggacgggaagtgggttgtccagaaatacatagagagaccgctgctgatctttgggacaaagttcgacctgcggcaatggtttctggtgaccgattggaaccccctaactgtgtggttttacagagatagctacattaggttctccactcaaccatttagcctaaagaatctggataactccgtgcacctgtgcaataactctatccagaagcacctcgaaaattcctgtcatcggcatcccttgcttccacctgataatatgtggtcgagccagagattccaggcgcatttacaggaaatgggagcaccaaacgcatggtccaccatcatcgtgcctggcatgaaggatgcagtgatccatgccctgcagacatcgcaagatacagtccagtgcagaaaagcgtccttcgaactttacggggctgactttgtgttcggggaggatttccagccttggctgattgagatcaatgcttccccgacaatggctccctctacggccgttaccgctcggttgtgcgccggagttcaggcggacacactgagggtagtgatagacaggatgttggaccgcaactgtgatacaggggctttcgaattgatttataagcaaccggcagtggaagtaccccagtacgtgggcatccggcttctcgtcgagggctttaccatcaagaaacctatggcaatgtgtcacagacgaatgggagtgcgccctgctgtccccctcctcacccagagggggtcgggcgaagccagacatcactttcctagtcttcataccaaggcgcagcttccttcgccccacgtgcttagacaccaaggccaggtgttgcggagacaacattccaaactagttggaacgaaggcactaagcactactggcaaggctctgcgcacactgccaaccgcaaaggtgttcatctcattgccccctaacttagacttcaaggtcgccccaagcatcttgaagcccagaaaagcgccagccctgctttgcctgagaggccctcagcttgaggtcccatgttgtctgtgtcctttgaaaagcgaacaatttctagctcccgtggggagaagccggcctaaagcaaattctagaccggactgtgacaagcccagagccgaggcgtgtcctatgaagagactgtcacccttaaaacccctccctctggttggaacctttcagaggagacgcggactcggagacatgaagctcgggaaaccactccttcgatttcccacagcacttgtgctcgacccgacacccaataaaaagaagcaggtgaaatacctggggttggatagcatagcagtggggggatcccgcgtggatggagctcgaccttgcacgccagggtctacagccagagcctag

SEQ ID NO: 24750 - DNA, 723 bp, Artificial Sequence
  Description of Artificial Sequence: Synthetic coding sequence
atgttccagcggcttaacaaaatgttcgtgggtgaggtcagctcgtcctctaaccaggagcctgaattcaatgagaaggaggatgacgagtggattctcgtggactttatcgatacatgtacgggttttagtgcggaggaagaggaagaagaagaggacatttctgaggaatcccctaccgaacatcccagcgtgttttcgtgcctgccagccagtttagagtgcctcgcggacacttctgattcctgcttcctgcagtttgagtcctgccccatggaggaaagttggttcataaccccgccaccgtgcttcacagcaggtggattaacaaccatcaaggtcgagacatccccaatggaaaacttgctaattgaacatcctagtatgtccgtgtacgcagtacacaatagttgccctgggctgagcgaagctaccagagggaccgatgaactccactcccctagttcaccgcgagtggaagcccagaacgagatgggccagcacatacattgttacgtggctgcactagccgcacacactacttttttagagcagccgaaatcatttagacccagtcagtggatcaaggagcattctgagcgccagcccctgaacagaaacagcctgaggcgacagaatttgaccagggactgtcatccaagacaggtcaaacacaatggctgggttgtccatcagccttgtccgagacaatataactattag

SEQ ID NO: 24751 - DNA, 558 bp, Artificial Sequence
  Description of Artificial Sequence: Synthetic coding sequence
atgttccagaggttaaataagatgttcgttggagaggtcagcagtagttccaatcaagagcccgagttcaacgagaaggaagacgacgagtggatcctagtggattttattgacacctgtactggcttctccgccgaggaggaggaggaagaagaggacatctctgaagagtcccccaccgagcatccaagtgtgttctcatgtctgcccgctagtctagaatgtttggctgatacatccgatagttgcttcctccagttcgagagttgtcccatggaggagtcctggttcattacccccccaccatgcttcaccgccggaggccttacaactatcaaagtcgaaacgtccccgatggaaaatttgcttattgagcacccttcaatgagcgtgtatgctgtgcataacagctgccctggtctgtcagaggctacaagggggaccgatgaattgcacagtccctcaagcccacgttatagccaggattgccacccaaggcaggtgaagcacaatgggtgggtagtccaccaaccatgtccacggcagtacaactattag

SEQ ID NO: 24752 - DNA, 495 bp, Artificial Sequence
  Description of Artificial Sequence: Synthetic coding sequence
atgttccaaagactcaacaagatgtttgttggggaggtgtccagctcttcaaaccaggagcccgagtttaacgagaaggaagacgacgagtggatcttagttgacttcatcgacacttgcacaggctttagcgccgaggaggaagaggaggaggaggacatctctgaggagagtcctaccgagcatcctagcgtcttcagctgcctcccagcatccctggagtgccttgccgatactagtgattcttgctttctccagtttgagagctgtcccatggaggagtcctggtttatcacgcctcccccatgctttactgctggtgggctgaccacaattaaagttgaaacttcaccaatggagaatctcctgatcgagcacccctcaatgtcagtgtatgcggtacataactcctgccccggactgagcgaagcgacacgtgggaccgacgagctgcactcaccaagttctccccgtgctcgcaagtcttgcctatag

SEQ ID NO: 24753 - DNA, 663 bp, Artificial Sequence
  Description of Artificial Sequence: Synthetic coding sequence
atgttccagcgtctctcatcgcttttcttcagcacccccagcccaccagaggatcctgattgccccagagcctttgtttccgaggaagacgaggtggacggctggcttataatcgatctgcctgactcatacgcagctccaccctcaccgggtgctgcgcctgccccagcaggaaggcctccaccagccccaagcctcatggatgaaagctggttcgtgacacctcccgcatgcttcacagccgaagggcctggcctgggaccggctaggctccagtccagccctttggaagacctgctgattgagcatccaagtatgagtgtgtacgttaccggctctacgatcgtgctggagccaggatctccatctccactacccgacgcagcgctaccagatggggacctcagcgaaggcgaattaactcctgctcgcagggaacctagggccgctcgacacgccgctcctttgcccgctcgcgctgccctgctggagaaggcaggtcaggtccgtagattgcagagagcgaggcagagggccgagcgccacgccctcagcgccaaggcagtgcagcggcagaaccgggctcgtgagtcccgaccacgcagatctaagaaccaatccagttttatttatcagccatgccagcgacaatttaactattag

SEQ ID NO: 24754 - DNA, 663 bp, Artificial Sequence
  Description of Artificial Sequence: Synthetic coding sequence
atgttccagcgtctatcatccttattcttcagcactccatctccacccgaagaccctgactgtcccagggccttcgtatctgaggaggatgaagtagatgggtggctgatcatcgatttgcccgactcctatgccgcacccccaagtcctggagcagcccctgctcccgcaggccgtccccctcccgctccaagcctcatggacgagtcttggttcgtcactccaccggcttgctttacagctgaggggcctggtctgggcccagccagattgcaatcatcacctttggaagacttactgatagagcacccttcaatgtctgtctatgttacaggctctacaatcgtgttggagcctgggtctcctagccccctgccggacgccgcactgcctgatggtgacctctctgagggcgagcttactcccgctcggcgagagcctcgcgcagcgcgtcatgccgctcctctgcccgcaagggcagcactgcttgagaaggctggtcaggtcagacgactgcagagagccagacagcgtgctgagagacacgctctgtctgccaaggccgtgcaaagacagaacagggccagggagtccaggccccgacgatcaaaaaaccagagttcatttatttaccagccctgccagaggcagtttaactactag

SEQ ID NO: 24755 - DNA, 234 bp, Artificial Sequence
  Description of Artificial Sequence: Synthetic coding sequence
atgtttcagagactgtcatctttgttcttttccaccccgtcacccccagaagaccccgattgcccccgtgcgtttgtatccgaagaagacgaggtggacggctggcttattattgatcttccggactcttacgccgcacccccatcgccaggagcggctccagcgccagccggtaggcctccgccagccccatctctgatggatgaatcctggtttgtgaccccacctgcctag

SEQ ID NO: 24756 - DNA, 267 bp, Artificial Sequence
  Description of Artificial Sequence: Synthetic coding sequence
atgttccagcgactctccagcctgttttttagcaccccttctcccccagaggacccagactgtcctagagcatttgtatccgaagaagatgaggtggatggctggctgatcattgatttgcctgaagggccaggcctgggcccagcgcgtttacagtcaagccccctggaggacctgctaatcgaacatccgtcaatgtcagtgtacgtgacagggtcaaccatagtcttagaacctggttcacccagtccattgcctgacgcttag

SEQ ID NO: 24757 - DNA, 915 bp, Artificial Sequence
  Description of Artificial Sequence: Synthetic coding sequence
atggcaacctggaaatctccctgctttctgtactgcctgttcattctgggccctaggttgaccggccaaaacaactctgttgacctaacaaatgaggaaactactgattctacaaccagtaagataagtccctccgaggacactcagcaagaaaacggctcgatgttctccctgatcacttggaatatcgacggcctggacctcaataacctaagcgagagggcccgaggagtgtgtagctatttggcactctacagccctgacgttatcttcctccaagaggtcattccaccctactattcgtacctgaaaaagagatctagcaattatgagataatcaccggccatgaggagggctacttcaccgcaatcatgttaaagaagagccgagtcaaattgaaaagccaagaaatcatccctttcccctccacaaagatgatgcgaaacctgctctgcgtacacgtgaatgtgtctggaaacgaactgtgtttgatgacatcacaccttgaatccacacgcggtcacgcagcagaaaggatgaaccagctgaaaatggtgttaaaaaaaatgcaggaggcccctgagagtgccactgtgattttcgctggagatacaaatctgagagacagggaggtcacacgctgtgggggactcccaaacaatatcgtagatgtctgggagttccttgggaagccaaaacattgccagtacacatgggacactcagatgaattcaaatctggggataaccgccgcttgcaaactgagatttgataggatcttctttcgtgctgccgctgaagaggggcacatcatacctaggagtctcgacctgctgggcctcgaaaagcttgactgcggccgttttcccagtgaccattgggggttgctctgcaatcttgacataatactgtag

SEQ ID NO: 24758 - DNA, 1089 bp, Artificial Sequence
  Description of Artificial Sequence: Synthetic coding sequence
atggagctgggctcatgccttgaaggtggcagagaggctgccgaggaagagggggaacccgaagtgaaaaagcggaggctgctgtgcgtagaattcgctagcgttgccagctgtgacgctgctgttgcccagtgctttctggcagagaacgattgggagatggagcgcgctctgaatagttatttcgagcctccggtggaagaatccgccctggagagacgacctgaaaccatctctgagccaaaaacttatgtggatctcactaacgaagagactaccgatagcacgacttctaaaattagcccctcagaagacacccagcaggaaaatggatcaatgttctctctaataacctggaacatcgatggtcttgatctgaataacctcagcgaacgcgctaggggcgtctgctcctatttggcgttgtattctccggatgtgattttcttacaggaggtgatccctccctattacagctacctgaagaagagatcaagcaactacgaaataatcacaggccatgaggagggctatttcacagccattatgttaaagaaatcgcgggtgaagctgaagtcgcaggagatcattccatttcccagcacaaagatgatgaggaacttgttgtgtgtacacgtgaacgttagcggcaacgagctgtgcctcatgaccagccacctcgagtcaactcgtggtcatgctgctgaacggatgaaccagttaaagatggtccttaaaaaaatgcaagaggcaccagagtctgcgactgtaatattcgccggtgacaccaacctacgcgaccgagaagtgacgcgatgcggcggacttccgaataacattgtcgatgtgtgggaattcctagggaagcctaaacactgtcaatacacttgggatacccaaatgaattcgaatcttgggatcaccgccgcatgtaaattgcgtttcgacaggatttttttccgagccgctgcggaggagggccacataattcctaggtcactggacctgttggggctagagaaactggactgtggcagattccctagtgatcattggggactcctgtgtaacctggatatcatcctttag

SEQ ID NO: 24759 - DNA, 855 bp, Artificial Sequence
  Description of Artificial Sequence: Synthetic coding sequence
atggaacttgggagctgtcttgagggaggcagagaagctgcagaagaggaaggggagccggaagttaaaaagcgcaggctgctctgcgtggaatttgctagtgtcgcctcgtgtgatgcagccgtggcccagtgttttctggcagagaacgattgggaaatggagagggcactgaattcgtatttcgagccatattcacctgatgtgatcttcttgcaggaagtcatccctccctactacagctatcttaagaaaagaagctccaactacgaaatcataactgggcacgaggagggctacttcacagccatcatgctaaaaaagtcaagggtgaaactcaagtctcaggagattataccctttccaagtaccaaaatgatgagaaacctgctgtgtgtgcacgttaatgtgagtggtaacgaattatgcttgatgacatctcatcttgaatcgactcggggacacgcagccgaaagaatgaaccaattgaagatggtgctgaagaagatgcaagaggctcccgagtctgccaccgtaatattcgctggagacactaacttgagagaccgggaggtaaccagatgtggaggcctccctaataatattgtcgacgtctgggagttcctaggcaaaccaaagcattgtcagtacacttgggatacgcaaatgaactcaaacttggggataacggctgcttgtaagctgaggttcgatcgaatattcttccgggcagccgctgaagaggggcatatcatcccaagatcgcttgacttgctgggtctcgaaaaactcgactgcggccgattcccatccgaccactggggcttactctgcaatctcgacattatactgtag

SEQ ID NO: 24760 - DNA, 1179 bp, Artificial Sequence
  Description of Artificial Sequence: Synthetic coding sequence
atgcgggaacggcatgatacaggcgcttgtgcagagcctagggtggggcttctcttcaggctcaagggtcggtgccggggagggcgaaaaatggaactcggcagctgcctggaaggaggcagagaagctgccgaggaggagggagaacccgaagtgaaaaaacggagactgctatgcgtagagttcgcaagcgtcgcatcgtgcgacgcagccgtcgctcagtgcttcttagcagagaacgactgggagatggagagagcgctaaattcctattttgagcctccggtggaggaatctgcccttgagaggcgcccagaaacgatctccgaacctaaaacctatgtggacctcaccaacgaggagactaccgacagcactacatcaaaaatatccccaagtgaggatacacagcaagagaacgggtctatgttcagcctgatcacttggaatatagatggactagacctcaataaccttagtgagagagcgaggggcgtgtgttcctacctggcgctctatagccctgacgtaattttcttgcaggaagtaatacctccctattactcctacctgaagaaacgatcctctaattacgaaatcattacggggcatgaagaggggtatttcactgcaattatgttgaagaagtcaagagtcaagctgaagagtcaggaaattatacctttccctagtactaaaatgatgagaaaccttctttgcgtccacgtcaatgtgagcgggaatgaactctgcttaatgacaagccacctggagtctacacgcggtcatgctgctgagcgcatgaatcagctaaagatggtcctgaagaaaatgcaggaggctccagaatcggccaccgtcatcttcgcaggagacacaaacctgcgtgatagggaagtcactaggtgcggaggattgcctaacaatattgtggatgtctgggagttcctaggaaaacccaagcactgtcagtatacttgggacacgcagatgaacagcaatctcggtattacagctgcttgcaaactaaggttcgaccgtatattctttcgtgcagccgctgaggagggccacattatccccagatcattagatctgctgggcctggagaaactagactgtgggaggttcccaagtgaccactggggtctactctgcaacctggacatcatcctgtag

SEQ ID NO: 24761 - DNA, 1428 bp, Artificial Sequence
  Description of Artificial Sequence: Synthetic coding sequence
atgtctgactttgatgaattcgaaagacagctgaatgagaacaaacaggagcgtgataaggagaaccggcacagaaaaaggagtcacagtcgttcccggagcagagatcgcaagcgcagatcccgttccagggaccgacgcaatagggaccagcgaagtgcatcacgggaccggaggcgcagaagtaaaccactgacccgtggcgcaaaagaggaacacgggggattgatcagatcacccagacatgagaaaaagaaaaaggttcggaaatattgggacgtacctccaccagggttcgaacacatcacaccaatgcagtacaaggccatgcaagccgcaggtcagatccctgccactgccttgctgcctaccatgactcccgacggactcgccgttacccctacgcctgtccccgtggtgggcagtcagatgacccgccaagctcggaggctttatgttggcaatatcccattcggaattacagaggaggcaatgatggacttcttcaatgcccagatgaggctgggcggacttacccaagctcccggaaaccctgttctggccgtccagatcaatcaggacaagaatttcgcttttctggagtttcgatcggtggatgagaccacgcaggctatggccttcgatggcatcatcttccaaggccagtcattaaagataagacgaccgcacgactaccaacctcttcccggtatgagcgaaaatccctccgtctacgtgccaggggtggtttcaactgtcgtcccggattccgcccataaacttttcataggaggattgcccaactacctgaatgacgaccaggtaaaggagctcctgacttcgtttggccctctgaaagctttcaacttggttaaggattcggcaaccgggctgtccaagggctacgctttttgcgaatacgttgacataaacgtgaccgaccaggccatcgctggactgaatgggatgcagctaggagacaagaaactcctcgtgcaaagagcttccgttggcgcaaaaaatgctactcttgtctcacccccatctactatcaaccagactccagtgaccttgcaagtgcctggcctgatgagctcccaggttcagatgggtgggcatccaactgaggtgctctgtttgatgaatatggtgctgccagaggaacttctagacgacgaagaatatgaagaaatagtggaagacgtacgggacgagtgctccaagtatgggttggttaagagcatcgagataccccgaccagtagacggagttgaggtgcctggctgcggtaagatcttcgtggaattcactagcgtgttcgactgccagaaggctatgcagggcctcaccggccgtaaattcgccaaccgcgtggttgtgacaaaatattgtgacccggactcataccacagaagagacttctggtag

SEQ ID NO: 24762 - DNA, 3090 bp, Artificial Sequence
  Description of Artificial Sequence: Synthetic coding sequence
atggccgacaaaaccccagggggatctcagaaagcgagttcaaaaactcgttccagcgatgtgcattcttccggcagctctgatgcccacatggacgcctcaggaccatcagatagtgacatgcccagcaggacaagaccaaaatccccccgtaaacacaactataggaacgagagcgcccgagaatcactgtgtgactctccacaccaaaatttatcccgcccactgctcgagaataaactcaaggctttttcaataggcaagatgagcaccgccaagcgtaccctttccaagaaagagcaggaagagcttaagaaaaaggaagacgagaaggccgcagccgaaatatacgaagagttcctggccgctttcgaaggaagtgacgggaataaggtcaagactttcgtgagggggggagttgtgaatgctgccaaggaagagcatgaaacggacgaaaaacgcggaaaaatctacaagccctcctctcgcttcgcggaccagaaaaaccctcctaaccagtctagcaatgagcgccctcccagcctgctagtgattgaaacaaaaaaaccgccactgaaaaagggggagaaggagaaaaaaaagtccaacttagaactctttaaggaagaacttaaacagattcaggaggagcgcgatgagaggcacaagaccaaaggaagattgtccagattcgaaccaccacagtccgattccgacgggcagaggcgctctatggacgcgccaagcagacgaaaccgatcctccggcgttcttgatgactacgcaccaggaagccacgacgtaggggatccttcaaccaccaacctgtacctcggcaacattaatccccagatgaatgaagagatgctctgccaggagtttggcaggtttggacctctggcctccgtgaaaatcatgtggcctcgtaccgacgaggagcgcgcacgggaaagaaactgcgggttcgtcgcctttatgaatagacgtgatgccgagagagcgctcaaaaatcttaacggaaagatgatcatgtcatttgaaatgaaacttgggtggggaaaggccgtccctattccaccacatcctatctatattccaccatccatgatggagcacacactgcctcctccacccagcggtctcccatttaatgctcaacctagagagagattgaagaaccctaacgcaccgatgctgcctccacccaaaaataaggaagacttcgagaagaccttatctcaagccatcgttaaggtggttattcccaccgaacggaatttactcgctctgatacatagaatgattgagtttgtagtccgcgaaggccctatgtttgaagcaatgattatgaatcgagagattaataatccaatgttcagatttctgtttgagaaccagactcctgcccacgtctattaccgttggaaactgtacagcatcttacagggggattcccctaccaagtggcgtacagaggattttaggatgtttaagaatggatcattttggcgtccacctcctctgaacccctatctccatggtatgagcgaagaacaggaaactgaagcattcgtggaagaaccttcaaagaaaggggctctaaaagaagagcagcgagacaagctggaagagatactgagaggactgactccacggaagaacgatatcggtgacgccatggtgttttgtctcaacaatgccgaggcggctgaagagatcgtggactgcatcaccgaatcgttgtcaatcctgaagacacctctgcccaagaagatcgcaaggttgtacctcgtcagtgacgtactatataatagcagcgccaaagttgccaacgcttcttattataggaaattttttgaaacaaagctttgtcagatattttctgatctgaacgcaacataccgaactatccagggccacttgcagtctgagaacttcaagcagcgcgtcatgacttgctttcgtgcatgggaggactgggctatctaccctgagccatttctcatcaagttgcagaatatattcttaggcctggtgaatattattgaggaaaaagagactgaggacgtccccgacgatctggacggtgctccgatagaggaagaacttgatggcgctcccttggaggatgtggacggaatcccaattgacgccactcctattgatgacctggatggtgtcccaatcaaaagcctggacgacgacctggacggggtccctctggacgctactgaggactctaagaaaaacgagccaatcttcaaagtggctccatccaaatgggaagccgttgacgaaagcgagctcgaggcccaggccgtgaccacgtccaaatgggagctctttgatcagcacgaggagagtgaagaggaagagaaccaaaaccaggaggaggagagtgaggacgaggaagatacacaatcaagtaagagcgaagaacaccatttatactccaatcccattaaggaagagatgacagaaagcaagttctccaaatactctgagatgagtgaggagaagcgcgcaaagctccgggagattgagttgaaggtcatgaagttccaagacgaacttgagtccgggaaacggccaaaaaagcccggacagtccttccaggaacaggtggagcattatagagataagctgctgcagagagagaaagaaaaagaattggaacgagaacgggaacgcgacaaaaaggataaagagaagctggaatctaggtccaaagataagaaggagaaggacgagtgtacacctacccggaaagagcgtaagcgaaggcattccactagtccgagtccgagcagaagctcttctggacgacgtgtgaagtctcccagtcctaaatccgaacgaagcgaaaggtcagagcggtcccacaaggagagctctagaagtcgctcctcacataaggacagcccacgtgacgtctcaaaaaaagctaaaagaagtcctagcggaagtcgaacccccaaacggagcaggcgttctcggtcacggtcacctaaaaaatccggtaaaaagtctaggagccagtcccggtccccccaccgcagccacaagaaatcgaagaagaacaaacattag

SEQ ID NO: 24763 - DNA, 1863 bp, Artificial Sequence
  Description of Artificial Sequence: Synthetic coding sequence
atgcttctgtgttaccggcacctgaagaccaaacgcatattgaggcggaacctgctcgccctgatccacaggatgatagagtttgtagttcgcgaagggccaatgttcgaggctatgatcatgaatcgggagatcaacaatcccatgttcaggttcctttttgagaaccagaccccagcccatgtttactacaggtggaaactttactcaatcctgcagggggattcccctaccaaatggcgtacagaggattttaggatgttcaagaatggaagcttctggagaccccctcccctgaacccctacctgcacggcatgtccgaggaacaagaaacagaggcttttgtcgaggagcccagtaaaaagggagctctgaaggaagaacagcgggataaactggaggaaatcctgcgcggactgactccgcgtaagaatgacataggggatgccatggtgttctgcctaaataatgccgaggcagctgaggaaattgtggattgcatcaccgaaagcttgagcatccttaagacgcctctacctaaaaagattgcccgactatacctggtaagtgacgtgttgtataactcaagcgccaaggtggccaatgcatcttactacagaaaattcttcgaaaccaaactctgtcagattttcagcgatcttaacgcaacttatcgaaccattcaaggtcatctgcagtctgagaactttaagcagcgtgtgatgacttgtttccgagcctgggaggactgggctatctatcctgaacccttccttatcaaactgcaaaacattttcttgggactcgttaacatcatcgaggagaaggagacagaggacgtcccagatgacttggatggggcaccaatcgaagaggaattagatggtgctccacttgaagacgtggatgggatccctatcgatgcgaccccgatcgatgacctcgatggggtgcccatcaaatcacttgatgatgacctcgacggagtgcctcttgacgccacagaggattcgaaaaagaacgagcctatttttaaagtggcccctagtaagtgggaggccgtcgatgagtcagagctggaggctcaggctgttacaacttcgaaatgggagctctttgaccagcatgaggaatctgaggaggaggagaaccaaaaccaggaggaagagtcggaggacgaggaagatacacagagttctaagtcagaggagcaccacctctactccaatcccatcaaggaagaaatgactgagagtaagttcagtaagtacagcgagatgtcagaggaaaagcgtgcaaaattaagggagatcgagctcaaagtcatgaaatttcaagacgaattggagtccggtaaacgtccaaagaaaccaggccagtccttccaggagcaggtagagcactaccgggataagttgctgcagagagagaaggaaaaagagctggaacgagagcgagagagagacaaaaaagacaaggagaaacttgaatcaaggtccaaagacaaaaaggagaaggacgaatgtacccctactaggaaggagcgaaagcgcagacacagcacaagcccttcgccgtcccgaagttcctccggcaggcgcgttaagtctccctcgccaaagagtgagaggagcgaacgcagcgagaggtctcacaaggagtcatctcgctctaggagttcccacaaagacagccctcgcgacgtgtctaagaaagctaaacggtctcccagcggttctaggactccaaagcgaagtcgacgttcccgatctcggtcgcctaagaaatcagggaagaagtcacgttctcaaagcagaagtccacataggtctcataaaaaatctaaaaaaaacaaacattag

SEQ ID NO: 24764 - DNA, 3090 bp, Artificial Sequence
  Description of Artificial Sequence: Synthetic coding sequence
atggccgacaagacccctggaggtagtcagaaagcctccagcaaaacaaggtcaagcgacgtgcattcatccggttcctcagatgcacacatggacgcttcaggtccctccgacagcgacatgccctctcgaacccggccaaagtcccccagaaagcacaactacagaaacgaatcagccagggaatctctgtgcgacagcccccaccagaacctttcaagacctctgctggaaaataagctcaaggccttctcaattggaaagatgtccacagccaaacgcactttatcaaagaaagaacaagaagaactaaagaaaaaagaggatgaaaaagccgcagctgaaatttacgaggagttcttggcagcctttgaagggtccgacggtaacaaagtgaagaccttcgtgcggggaggagttgtcaacgccgcaaaagaggagcatgaaacagacgaaaaacgcggaaagatatacaagccgagctcccgtttcgctgaccagaagaatccaccaaatcaatcaagtaatgagcggccaccatccttgctagtaattgagactaagaagccaccccttaagaagggagaaaaagagaagaagaaaagtaatctggagctttttaaggaggagctaaagcagattcaggaggaacgagacgagaggcacaaaaccaagggacgattatcgagattcgagcctccccaaagcgatagcgacggacagcggaggtccatggacgcccctagtcgcaggaatcgctcctccggagtgctcgatgattatgccccaggcagtcacgatgtcggcgatccgtcaactaccaatctgtatctaggaaatataaacccgcaaatgaatgaggaaatgctgtgccaggaatttggtagattcggtcctctggcatcggtgaaaattatgtggcctcgcaccgatgaagagcgggcacgcgagaggaattgtggattcgtggccttcatgaatcgtagggatgcagaacgcgctttgaagaatctgaacggaaagatgatcatgagctttgaaatgaaactgggttgggggaaggcggtgccaatccctccgcatccaatctacattcctccaagcatgatggagcacacactgcctccgcctccttcagggcttccctttaatgcacagcctcgtgaacgactcaagaaccctaacgccccaatgctgccaccaccaaagaacaaggaggattttgaaaaaaccctcagtcaagcaattgtaaaggtcgttatcccaactgagcgcaatttgctggctctgattcaccgtatgattgaatttgtggtgagggaaggacctatgtttgaggccatgataatgaaccgggaaattaataatccaatgtttcgtttcctcttcgagaatcagacacccgcacacgtatactaccgctggaaactatactccatactgcagggagactctccgaccaaatggaggacagaagattttaggatgttcaagaatgggtcattctggcggcctccaccgctgaacccatatctgcacggtatgagtgaagaacaggagactgaggcattcgttgaggagccatcaaagaagggcgctctgaaagaagagcagcgcgacaaacttgaagaaatcctccggggactgacaccccgtaagaatgatataggggacgccatggtgttctgcctaaataatgctgaagctgcggaagaaattgtggactgcattaccgaatctctgagtattctgaagacccccctacccaaaaaaattgcacggctatacctggtctccgacgtgctgtacaattcttctgcgaaggtcgcaaacgctagctactaccgaaaattcttcgagaccaaactctgccagattttctctgacttgaatgctacatatcgaacgatccaagggcatctacagagcgaaaatttcaagcagcgcgtgatgacttgtttcagagcgtgggaggactgggccatctaccccgaaccgtttcttatcaagctgcagaatatttttctgggactcgtgaacattatagaggaaaaggaaacggaagatgttccagatgatctcgatggagccccaattgaggaagagttagacggtgccccactggaggatgttgacggcattccaatagacgcgacgccgatcgatgatctggacggggttccaattaagtccttagacgatgatctcgatggcgtaccactggacgcgacggaggatagtaaaaagaatgaacctattttcaaagtcgccccaagcaagtgggaggctgtcgacgagagtgagctcgaggcccaagccgttaccactagcaagtgggagctgttcgatcagcacgaggaaagcgaggaagaggagaaccagaaccaggaggaggagtcagaggatgaggaagatactcagtcaagtaagtccgaagaacaccatctgtacagtaatccaatcaaggaggagatgacggagtccaaattctccaagtattcggaaatgtcagaagagaagagggcaaaattgagagaaatcgaattgaaggtgatgaagttccaggacgaactagagagtggaaagcgacctaagaagccaggtcagagtttccaggagcaggtggagcattatcgcgacaagctgcttcagcgcgaaaaggaaaaggaactcgagagagagcgggaaagggacaaaaaagacaaagagaagctggaatctagaagtaaggataaaaaagaaaaagacgaatgtacacctaccaggaaggagaggaaacggagacactctacctctcctagcccatctagatcctctagtggacgacgtgtgaagagcccaagtcccaagtcagaaaggagtgagcggtctgagaggagccataaggaatccagcaggtcccgctctagtcacaaagatagcccacgagatgtgagtaagaaggccaagagatcacccagcgggagcaggacacctaagcgctcccgccgtagccgcagtcgcagccccaagaaatcaggaaagaagagtcgaagtcaaagccgatcaccccaccgatctcataagaaatccaaaaagaataagcattag

SEQ ID NO: 24765 - DNA, 3087 bp, Artificial Sequence
  Description of Artificial Sequence: Synthetic coding sequence
atggctgacaagacccctggtggctcacagaaagcgagctcaaaaacccggtcgagcgatgtgcactcgtctggatcctctgacgcccatatggatgccagcggtcctagtgactctgatatgccttcacgaacaaggcccaaaagcccgcgaaaacataattatcgcaacgaaagtgcacgggaatccctgtgtgatagtccccaccagaacctttcgcgtccacttctggaaaacaagttgaaagcgttctctattggaaaaatgagcacagctaaacgcaccctaagcaagaaagagcaggaggaactcaaaaagaaagaagacgagaaggcagctgccgagatctatgaagaattccttgcagcctttgaaggtagtgatggaaataaagtgaagacttttgttcggggaggggtggtcaacgccgctaaggaagagcacgaaactgacgagaagcgcggtaagatatacaaaccctcttcacgattcgcagatcagaagaatcctccaaatcagtcctctaatgaaagaccaccgtctctcttggtgatagagaccaagaagcctccactgaaaaaaggagagaaagagaagaaaaaaagcaacctcgaactgtttaaagaagagttgaagcagatacaggaggaacgggatgaacggcataagaccaagggaaggttaagtaggtttgaaccaccacagtccgattctgacgggcagcgcagatccatggatgctcctagcaggaggaatagatcttctgtgctggatgactacgctcccggatcacacgacgtgggagatcctagtacaacgaacctgtatcttggcaacatcaacccgcagatgaatgaggagatgctatgtcaggaattcggacgcttcgggccactagcaagcgtgaaaatcatgtggcctcggaccgatgaggagagggccagagagcggaattgtggcttcgtcgcgtttatgaataggcgcgacgcagagcgggctcttaaaaacctcaacggcaagatgatcatgtccttcgagatgaagctgggttgggggaaagccgtgccaatacctccccaccctatctatataccaccttcaatgatggagcacacgctgccgcctccaccctccggactcccatttaacgcccagcctcgcgagaggctcaaaaaccctaacgctcctatgctgccccctcctaaaaacaaagaagactttgaaaagacccttagccaggctatcgtaaaggtcgtcatccccaccgaacgcaacctgcttgcgttgattcacagaatgatcgaatttgtggttcgggagggaccgatgttcgaggccatgatcatgaaccgggaaataaacaacccgatgttccgcttccttttcgaaaatcagacccccgctcacgtttactataggtggaaattgtactctattctccaggccaactcccctacaaagtggagaactgaggactttaggatgttcaagaacggaagtttttggagaccacctcctctgaacccttatctgcacgggatgagtgaggaacaggaaactgaggctttcgtggaggagccatctaaaaaaggtgccctaaaggaagagcagagagacaagctggaggagatcctgagggggttgaccccacgcaagaatgatatcggggacgccatggtgttctgcttgaacaatgcagaggcagcggaggaaatcgtcgattgcataactgagtcattaagcatcctcaagacccccctaccgaaaaaaatcgccagactgtatctggtatcggacgttttgtacaactcaagcgctaaagttgctaatgcctcatactatagaaagttctttgagacgaagttgtgccagatcttctccgatctgaatgctacatatcggacaatccagggacacctccaaagcgagaatttcaaacagcgggtcatgacatgttttagggcctgggaggactgggccatctacccagagccattcctgataaagctccaaaatatcttcttgggcttagtcaacatcatcgaagagaaggagacagaagacgtgcctgatgacctggacggagctcctatcgaggaggagctggacggggctcctctggaggacgtcgatgggattcccatcgatgcaacccccatagacgatctcgatggggtgcctattaagtccctcgacgatgatctcgatggagttcccctggatgccactgaagattctaagaaaaacgagcctatattcaaagtggctccctctaaatgggaggcagttgatgagagcgagctcgaagctcaagccgtaacaacatctaaatgggagctcttcgatcagcacgaggaatccgaggaggaggagaaccagaaccaggaagaagaatccgaggacgaagaagacacacagtccagtaaaagcgaagagcatcacctgtactcgaatccaatcaaagaagagatgactgaatccaagtttagtaagtactccgaaatgagtgaggaaaagagggctaagttgcgggagatcgagttaaaagttatgaaattccaggacgagctcgaatccggaaagaggccaaagaaacccggacagtccttccaggaacaggtagagcattatcgagacaagctgctgcagcgggaaaaagagaaggagttggagcgagagagggagagagataagaaagacaaggagaaacttgagtcccggagtaaggacaaaaaagagaaagacgagtgcacccctactaggaaagagcggaaaaggaggcattccacaagtccctccccctctcgttctagtagcgggaggcgagttaaaagtccctctccaaagtccgagaggagtgagcgatcagaacggtcgcacaaagaaagctcccggagccgaagttcacacaaggactccccacgagatgtttcaaagaaagccaaaagatcaccctctggtagtaggactcctaagaggagccgtcggtcccgcagcaggtcccctaagaagagcgggaagaaaagccggtcccagtctaggagtcctcacaggtcacataaaaaatccaaaaaaaacaagcactag

SEQ ID NO: 24766 - DNA, 486 bp, Artificial Sequence
  Description of Artificial Sequence: Synthetic coding sequence
atggctgataagactccaggtggtagccaaaaggcaagctctaagactagatccagcgacgtccacagttcgggcagcagcgatgcacacatggacgctagtggcccatccgactcagacatgccaagcaggacacggcctaagtcaccacggaagcacaactatcggaatgagagtgcacgagaatctctttgcgactccccccaccaaaatttgagccggccactactggagaataagttaaaggcgttttcgataggcaagatgagtaccgctaagcggacgctgtccaaaaaggagcaggaggagctgaaaaagaaggaagacgagaaggcagctgccgaaatttacgaagagttcctcgctgctttcgaaggatcggacggtaataaagtgaagacctttgtgcggggaggtgtggtgaacgccgcaaaggaggagcacgaaacagatgaaaagaggggcaagatttacaagccttcctag

SEQ ID NO: 24767 - DNA, 3237 bp, Artificial Sequence
  Description of Artificial Sequence: Synthetic coding sequence
atgatgactagtgtgggcaccaatcgagcccgtgggaactgggaacaaccacagaatcagaaccagacacagcacaaacagcggcctcaagctactgccgagcagatcagacttgctcagatgattagcgatcataacgatgctgacttcgaggaaaaagttaaacagctgatcgacattaccggaaagaatcaggacgaatgcgtgatcgcattgcatgattgtaacggagatgttaaccgcgcaatcaatgtcctgctggagggcaacccagatacacactcctgggagatggtgggtaaaaaaaaaggcgtgtctggtcagaaggatggaggacaaaccgagtcaaacgaggaagggaaagaaaacagagacagagaccgggactacagcaggagaaggggcggacccccaaggagagggcgtggagcctcccggggtcgcgagtgtatgcacggggcattatcgaagccagccgtcgtccggggtcaggagaatgggctcgatggtaccaagagcgggggaccgtctgggcgtgggaccgaaaggggcagacgtggaagagggagggggaggggaggctccgggaggcgtggaggacgcttttcggcacagggcatgggaacttttaatcccgcagattatgccgaacctgcaaacacggatgataattatggcaactcctctgggaacacatggaacaatactggacattttgagcccgacgacggaacctccgcatggaggactgcaactgaagagtgggggaccgaggattggaatgaggacctgtctgaaaccaagatattcacggcttctaacgtttcatctgtccccctcccggctgagaacgtcaccataaccgctggccagcgtatcgacctggccgttctcctgggaaaaactccctctaccatggagaacgacagctcaaatctggaccccagccaggctcctagtctggcacaacccctggtgttctccaattcgaagcagacagcgatcagtcagcctgcaagcggcaatacgttctcccaccactccatggtgagtatgctgggaaaggggttcggggacgtaggtgaagccaaaggtggcagcactaccggctcccagttccttgaacaattcaagaccgctcaggcactggctcaattagcagctcagcattcacagtctggatctactacaacctcaagctgggatatgggtagcactacacagtcacccagtctcgtccagtatgacctcaagaatcctagtgactcagccgtgcactcacctttcactaagcgccaggctttcactcctagcagtacaatgatggaagtgttcctgcaggagaagtcccccgctgtagcaaccagtacagccgctcctcctcccccttctagccccctacctagcaagagcactagcgctccccagatgtcccctgggtcttcggacaatcagagttcttctccacaaccagcccagcagaaattgaagcaacagaagaagaaggcatccctaaccagcaagattcctgcactcgccgtcgagatgccgggatcagctgacattagtggattgaatctgcaattcggtgcactgcagttcgggtcagaacccgtgctgtctgattacgagtctacccctaccactagtgcctccagctcgcaggcccctagctcactgtatacctccactgcatctgagtcctcttccacaatctccagtaaccagtcgcaggaatctgggtatcagtccgggcctatccagtctaccacttacacatcgcagaataatgcacaaggtccattatatgagcagcgcagcactcagactagaagatacccgtcaagcatcagttccagtccgcagaaagacctgacccaggctaagaacgggttctccagcgtgcaagcaacccagcttcagaccacacagagtgtagagggcgctaccggctccgccgtaaaatcggacagcccttcaacctctagcattccacccttgaacgaaactgtctcggcggcatcacttctgaccaccacaaaccagcactcaagctcgctagggggactcagtcactctgaggaaataccaaacacaacaactacccagcactcttctaccctgtcaacccagcaaaataccttatcctctagcacttcttctggcagaacaagtacatccactttgctgcacacaagtgtggagtctgaggccaacctacacagttctagcagcacattttctactaccagtagtaccgtcagtgctccgcctcctgtagtcagtgtgtcatctagtctgaattccggcagttcactcggactaagtctggggagcaactccaccgtgacggccagtactcgatcgtctgtggcaaccactagcggcaaggcgccacctaatctgcccccaggagtgcctccactgttgccgaacccatatatcatggctcctggcctcctccacgcatacccgccacaggtctacggttacgatgacttacagatgttgcagacgagattccccctggattattattctattcccttcccaactccaaccactccccttaccggcagggacgggtccctcgctagcaatccgtacagcggcgacttaacaaaattcggcaggggtgacgcgagctccccagcgccagcaaccacacttgcgcagcctcagcaaaatcagacacagacacatcatacgactcagcagacctttttgaatcctgctctgccccctggctactcctatactagtctgccctattacacaggtgtgcccggtctgccaagcacctttcaatacgggcctgcggtgtttccagtcgcaccaacaagttcaaagcagcatggggtgaacgtgtctgtcaatgcctccgcgaccccattccaacaacctagcggttatggttcccatggatacaatacaggagtaagcgtgacctccagcaatacaggtgtccccgatatatctggatcggtctatagcaagactcaaagtttcgagaaacaggggtttcacagtgggacgcctgctgcctcattcaacctgcccagcgcacttggaagcggaggccctatcaatcccgctacagccgcagcttacccaccagcacctttcatgcacatacttaccccacatcagcaacctcatagccaaattctgcaccaccacctgcagcaggacgggcaggatattcttaactttgtggacgaccagcttggagaatag

SEQ ID NO: 24768 - DNA, 2952 bp, Artificial Sequence
  Description of Artificial Sequence: Synthetic coding sequence
atgatgacgagtgtaggcacaaaccgggctagaggaaactgggaacagccacagaatcagaaccagactcagcataaacagcgcccacaggcgaccgcagagcagatccgcctggctcagatgatttccgatcataatgatgctgatttcgaggaaaaagtaaagcagctgattgatattacaggaaagaatcaggacgagtgcgtcattgcgctgcacgactgtaatggcgatgttaacagggccattaacgtgctgttagagggtaacccggacactcactcatgggagatggtgggcaagaagaagggggtatcaggccagaaagacgggggtcagacggagtctaacgaagaggggaaagagaaccgcgaccgcgaccgcgactacagccgaaggaggggcggtccccctcgccgaggccgaggcgcatcacggggtagagaattcaggggacaggagaatggcctggatggtacgaaatccggagggccttccggcaggggcacagaaaggggacgcagggggagaggtcgtgggcgaggagggtccgggcgtagaggaggacggtttagcgctcagggcatgggcacattcaatcctgcggattatgcagaacccgcaaacaccgacgacaactacggcaatagcagtgggaacacttggaataacacaggacacttcgagccagatgatggtactagcgcatggaggaccgccacagaggagtggggtactgaagattggaatgaggacctttcggaaacaaagattttcacggctagtaacgtgagttcagtgcctctccctgccgaaaacgtgacgatcacagccggacaacggattgatctggccgtgctgcttgggaagactccctctactatggagaacgacagctcaaacctagacccctcacaggccccttcattggctcaacctctcgtgttttccaattccaagcagaccgccatttcgcagcctgcatctggcaacaccttttctcaccattccatggtatcaatgctgggtaagggctttggcgatgtgggggaggccaaaggaggctccaccactgggtcccagtttctggagcagtttaagaccgcacaggcactagctcagcttgcagcccaacatagtcaatccgggtccaccacaacaagttcctgggacatggggagcactacacaatcccctagcttagtccagtatgacctgaaaaatcctagtgattcagccgtgcatagccctttcactaaacgacaggcttttacgccatcctcaacaatgatggaagtgttccttcaagagaagtcccccgcagtcgcaacctccaccgctgccccaccccctcctagctccccactcccaagcaagagtacttcagctccacagatgagtccagggagcagtgataatcaaagcagttcaccacaacccgcacagcaaaagctaaaacagcagaagaagaaagcatctctgacgtcaaaaatccccgcactcgctgttgagatgccaggaagcgctgatatttccggtctgaatctgcagttcggagcactacagttcggatctgagcctgtgttgtctgactacgaatccacccctactacctccgcatccagcagtcaggccccatcctctctgtacacctctactgccagcgagtccagcagcacgattagctccaaccagtcccaagagtccggatatcagagcggaccgattcagagtactacatatacctcacagaacaatgcccagggccctctttacgaacaaagaagtacccaaacccgacgttacccaagctctatctcatcgtctcctcagaaagatctaactcaggcgaaaaacgggttttcttcagtccaggctactcagttacaaacaactcagagcgtggaaggagccactggctccgccgtgaaatcagatagtccctcgacctcctctatccccccactgaatgagactgttagcgctgctagtcttcttacgactactaaccagcactcttcctctctcgggggtctttcacactctgaagagatcccaaatacaacaactacacagcactcatctactctgtctacacagcagaacaccctgtccagctctacgtctagcggtcggactagcacatcaacattgcttcacacctctgtggaatcagaggctaatcttcactcgagctcctctacattttccacaacgtcttcaacagtgagcgctcccccaccagtagtttccgtttcttcttcactcaatagtggctcctccctagggctgtccctaggtagcaattcgacggtcaccgctagtacccggtcttccgtggcaacaacatccggcaaggcacctcccaacctgcctcctggcgtgcctcccctgctccctaatccctacattatggcgccagggctgctgcatgcatacccgcctcaagtgtacgggtatgatgaccttcagatgttgcaaacacggttccccctcgactattattcaattccgttcccgactcctactactcccctgactggcagggacggatccctggcatctaatccctattcgggtgatctcactaaattcgggcgaggggacgctagctccccggctcctgccaccaccctcgcccagcctcaacagaatcaaactcaaacacatcacaccacccagcagacatttttgaatccagcactgccacctggctacagttacacgtcgctaccatattataccggggtaccgggtttgccctctacattccagtacgggccagctgtgtttccggttgccccaacctctagtaagcagcatggagtcaacgtgtccgtgaatgcatccgctacgcctttccagcaaccttcaggctatggctctcatggctataacaccggcagaaagtatccaccaccttacaaacatttctggacagccgaatcttag

SEQ ID NO: 24769 - DNA, 3264 bp, Artificial Sequence
  Description of Artificial Sequence: Synthetic coding sequence
atgatgaccagcgtcgggaccaatagagccagggggaattgggaacaacctcagaatcagaatcaaacacaacataagcagaggccccaagccaccgctgagcaaattcgtctggcacagatgatctctgaccacaacgacgccgacttcgaggaaaaagtcaaacagctgattgatattacaggcaaaaatcaagacgaatgtgtgattgcactccatgattgcaacggagatgtaaaccgagctattaatgtgttgctggaaggcaaccctgacactcactcatgggaaatggtgggaaagaagaaaggtgtctccggacagaaagatggcggtcagactgaatcaaatgaggagggcaaggaaaaccgtgacagggacagggactatagtagacgtcggggaggcccacctcggagaggcagaggggcttccagagggagagagttcagaggccaggagaacggattggatggcaccaaatccggaggcccatccggtaggggcaccgagagaggccgtaggggacgtgggagaggtagggggggatcagggaggagaggcggtcgtttctccgctcaaggaatgggcaccttcaacccggctgactacgcagaaccggcaaacaccgacgataattatggaaacagttccgggaacacatggaataacaccggtcactttgagccagacgatgggaccagtgcctggcggactgccaccgaagaatggggcactgaggactggaacgaggatctgtctgagacaaagatctttacagcatctaacgtcagttccgtacccctcccagctgagaatgtcacgatcaccgccggtcagcgcatcgacttggccgtgctactcgggaagacacccagcacaatggagaatgactcctccaatttggatccatctcaggctccctcccttgcgcagccactggtcttctccaactctaaacagactgctataagccaacctgccagcggcaatacttttagccaccactccatggtctccatgctcggaaagggcttcggggacgtaggcgaagccaaagggggatccacaacgggaagccagttcttagaacagttcaagaccgctcaggcactggcacagttagcagcccagcattctcagagtggctcaacaaccacatcaagctgggacatgggctctacaacccagtctcctagtcttgtgcaatatgatctgaagaacccaagcgatagtgccgtgcattctcccttcacgaaacgccaagccttcaccccttcctcgactatgatggaagtatttctgcaagagaaatctcctgcggttgccaccagtacggccgctcctccaccccctagttccccgcttccctcaaagagcacttcagctccccaaatgagccctggtagcagtgacaatcagagctcgtctcctcagcctgcccaacagaagcttaaacagcagaaaaagaaagcatctctaaccagtaagattccagcactggctgtagaaatgccaggctccgccgacatttcaggattgaacctgcagttcggtgctctgcagtttggcagtgagcccgtgctgtctgactatgagagcacccctaccacttcagctagttccagccaggcccctagtagtctctacacatccacagctagcgagtcgagtagtactatctccagtaatcagtcacaggaaagcggctatcagagtggacctattcagagtaccacttacacatctcaaaataatgcccagggtcctttgtacgaacagagaagcacccagaccaggcggtacccgtcctctatctcctcaagccctcaaaaggacctcacccaggccaagaatggcttctcttccgtccaggctacacagctgcagacgacgcagtctgtcgagggtgcaaccggttctgctgtgaagtcagactccccaagtacgtcatcgattcccccattgaacgaaactgtctctgctgccagtctgttaacaacaacaaaccagcatagttcctctcttgggggactttcgcattccgaagaaatcccaaacaccacgaccacccagcacagctccaccctgagcacacagcagaatacgctgtcttctagtacaagcagcggaagaacctcgacctcaacactcctccacacttcagtcgagtccgaagccaatttgcactcgagcagtagcaccttttccacaactagtagcaccgtgtctgccccacccccagtcgtgagcgtgtctagttctctgaattctggtagcagtctgggcttatccttgggttctaactccacggtgacagccagcacgaggtcatctgtcgccactacctcagggaaggcgccacccaaccttcctcccggtgtgcccccactactgcctaacccttacataatggcaccaggccttctgcatgcctacccaccccaggtctacggatatgacgatctgcagatgctccagacgcggttccccttggattactactcaatcccattccccaccccaacaaccccactcacaggtagagatggatctttggcgagtaatccatacagtggcgaccttacaaaatttggcagaggcgatgcttccagccctgcacccgctacaaccctggcccaaccccagcaaaatcagacccagacacaccacacaactcaacagacgttcctgaatccagccttgcctccaggctactcctacactagcctgccctactatacgggcgttcctgggctcccctccacgtttcaatacggtcccgcagtttttcccgtggccccaacatccagcaaacagcatggggtgaatgtgtcagtcaatgccagtgcgaccccatttcagcaacccagcggttacggcagccatgggtacaacactggcgtttccgtgacttcgtccaacactggcgtgcccgatatcagcggttctgtttactcgaaaactcagcagtccttcgagaagcagggatttcacagtggcacccccgcagcttcattcaatttacctagcgcactcggttctggcggtcccattaatcccgctactgcagccgcttatcctcccgctccatttatgcacattctgactcctcaccaacagccacactcacaaatcctgcaccaccatctacaacaggacggacaaactggctccggccagagatcccagacatcgtcaattccccagaagccacagacgaataagagcgcctacaattcctattcttggggtgccaactag

SEQ ID NO: 24770 - DNA, 1053 bp, Artificial Sequence
  Description of Artificial Sequence: Synthetic coding sequence
atgatgacatctgtggggacaaatcgcgctcggggtaattgggaacagccccagaatcagaatcagacccaacataagcaacgaccgcaagccacagcggagcaaattcgtttggcgcaaatgatctcagatcataacgatgccgactttgaggaaaaagtgaaacagcttattgacatcacagggaaaaatcaggatgagtgtgtaattgctttacatgactgcaatggcgacgtgaatagggcaataaatgtcctgttagaaggaaacccggacacacacagttgggagatggtgggaaaaaagaagggggtaagcggacagaaagatggcggtcaaacagaatccaacgaggagggcaaggaaaaccgtgatcgagaccgggactattctcgacggagagggggaccacccaggcgcggtcgcggtgcttctaggggaagggagtgtatgcacggcgctctcagcaagcctgccgtggtgcgcggacaggaaaatggactggacggcactaaaagcggcggacccagtggcagaggtactgaacgcggaagacgcggaagaggccgaggccgaggaggaagcgggcgtcgcggagggagattttccgcccaagggatggggacgttcaaccccgcagattatgccgaacctgcaaacaccgacgataactacgggaactccagtggcaatacctggaataatacaggtcacttcgaacccgatgacggtaccagcgcttggaggacagccactgaagaatggggcaccgaggattggaacgaagacctctccgagaccaaaatttttacagcgagcaacgtgtcttccgttccattgcccgctgaaaacgtgacaatcaccgccggtcagaggatcgacttggcagtgctgctgggtaaaactccaagtaccatggagaatgactcttctaatctcgatccttcacaagcccctagcctcgcgcagcccttggtcttttctaatagcaaacagacagctatttcgcaacctgctagcggcaatacatttagccaccattcaatggtgtag

SEQ ID NO: 24771 - DNA, 843 bp, Artificial Sequence
  Description of Artificial Sequence: Synthetic coding sequence
atgatgaccagtgtgggtactaatcgcgctcgaggaaattgggagcagccccagaaccagaaccaaacacagcacaagcagcgcccacaggcaaccgccgagcagattcgcctggcgcagatgatatcagaccataatgatgcggactttgaagaaaaagtgaagcagctgattgatatcaccggtaagaatcaagacgaatgtgtcatcgcgctacatgattgtaacggcgacgtcaatagggctattaacgttctcctggagggcaatccggatacacacagttgggaaatggttggtaagaaaaaaggggtgtccggtcagaaagacggcggtcagacggagtcaaacgaggaaggtaaagagaatagagacagagacagggattactctcgccgtcgaggcggaccccctcgacgaggcagaggggcaagccggggtagagaatttcgtggacaggagaacggcctcgacgggacaaagtcagggggacctagtgggcgtggaacagaacgaggcaggagaggtcggggaaggggcagaggtggatcaggtagacgcggaggtagattttccgcccaaggaatgggcactttcaaccctgcagattacgccgaaccagccaatactgatgataactacggcaattcgagcggtaacacttggaacaacaccggccatttcgagccagatgatggcacttctgcctggcgcaccgctacagaggaatggggcactgaggattggaacgaggatctgagcgaaaccaagatctttaccgcaagcaatgtcagcagcgtacccctcccagccgagaatgtaacgatcacagctggacaatag

SEQ ID NO: 24772 - DNA, 1152 bp, Artificial Sequence
  Description of Artificial Sequence: Synthetic coding sequence
taggttgaatccgaagctaacttgcactcatccagtagcaccttttcaaccacatcaagcactgtgtccgcaccaccaccagtggtgtcagtcagttcatcactgaactcgggatcatcgcttggcttgtcgcttggcagcaactccactgttactgcgagcacacgctcctctgtagctacgacatctggaaaggcacctccaaacctccccccaggtgtacctcctctgctgccaaacccatatattatggcccctggcctgctgcatgcatacccaccccaggtatacggatacgacgatttgcaaatgttgcagacgcgcttcccactagactattactcaattccatttcccactcccaccactcccctcaccggccgagacggcagcctggcctctaacccctactccggtgatctcaccaaattcggaagaggcgatgcctcatcacccgctccagcaaccactctggctcaaccgcagcagaatcagacccagactcatcatacaacacagcaaactttcctgaaccccgcactcccaccaggatattcttacaccagtctcccatactacacgggggtccccggactgccatctaccttccagtacggccctgccgttttcccagtagcgcctaccagtagcaagcaacatggtgtgaacgtgagtgtgaacgcaagcgccactccgttccagcagccaagtgggtacggatcgcacggttataacaccggggtatctgtgacaagcagcaatacaggtgttcccgatatcagcgggtctgtttattcgaaaacacagcagtccttcgagaaacaaggctttcactctgggaccccagcagctagcttcaacctcccttcagccctgggtagcggcggacccattaaccccgcaactgccgcagcctaccctcctgctccatttatgcatatcctgactccccaccagcagcctcactcccagatcctccatcaccacctgcagcaggacgggcagctgccatacctgcaaatgattctttgttgccagagacaacaggaagagcagaccggctccgggcagagatcccagacgtctagtatccctcaaaagccccaaacgaataaatcagcatacaatagttatagctggggtgctaactag

SEQ ID NO: 24773 - DNA, 3264 bp, Artificial Sequence
  Description of Artificial Sequence: Synthetic coding sequence
atgatgacctcggttggaaccaatcgcgcacggggaaactgggaacagccacagaatcagaaccagactcagcacaagcaaagacctcaggcaacagcagaacagattaggttggcgcaaatgattagcgatcacaacgatgccgattttgaggaaaaggtgaagcagctcatcgacattactggcaaaaaccaagacgagtgtgtgattgcgctgcacgactgcaacggagacgtgaaccgagccataaacgtcctgctggaaggcaaccccgatacccactcatgggagatggtcggcaagaagaaaggtgtcagcggacagaaagatgggggacagaccgaaagtaatgaggagggcaaagagaaccgggatcgtgacagggactactctcgcagacggggtggtcccccaaggcgtggcaggggagcttccagaggccgagagtttagggggcaggaaaacggcctggacggaacgaagagtgggggaccatctgggagggggacagaaagggggaggcgaggacgtggtcgagggagaggtgggagcggtaggaggggcggacgctttagcgctcaggggatgggcacttttaacccagccgattacgcagagccagcaaacactgatgataactacggaaattctagcggaaacacatggaataacaccggacattttgaaccagacgacgggacttccgcctggaggaccgccactgaagagtggggaaccgaagactggaatgaagatcttagcgagacaaagatattcaccgcgtccaacgtctcatcagtaccactcccagccgagaacgtgactatcacagctggtcagcggatcgacctcgccgtgttgttaggtaagacaccgtccaccatggagaatgactcctccaacttagacccaagtcaggccccttcactcgcccagccacttgttttcagtaacagcaagcaaaccgctatctcccagcctgcgtctgggaatactttttcccaccattctatggtgagcatgctcggcaagggattcggtgacgtcggagaggctaagggtgggagtactaccggcagccaatttctggaacagtttaagaccgcacaagcactagcgcagctggctgcacagcattcccaatctgggtccaccaccacctccagttgggatatgggcagtaccacgcagtccccaagcctggtgcagtatgacctcaaaaatccttcagactccgcagtacatagcccgtttaccaaaaggcaggctttcacaccctcctccactatgatggaggtttttctccaggagaaatctccagcggtcgctacttcaaccgccgctccccctcccccttcgtctccactgccttcgaagtccacttcagcgcctcagatgtctccaggatcaagtgataaccaatcatcttctcctcagcctgcccagcagaaattaaaacagcagaagaagaaggcttcgttgacaagcaagatccccgcactggccgtcgagatgcctgggtcagctgatatctcggggttaaacttgcagtttggagcgttgcagttcggatctgaaccagtcttgtctgattatgaatctacccccacaacctcggcctcatccagccaagctccctcctccctttatacttcaactgccagcgaatcttcctcaacaatttctagcaaccagtcgcaggagagcgggtaccaatcaggtccaattcaatccaccacgtatacatcccaaaataatgcacagggccctctctatgaacaaagaagtacccagacgaggcgatatccctccagcatctcttcatcgcctcagaaggacctcacgcaggccaagaacggattttcgagcgttcaagctacccagttacagactacacagagcgtggagggcgctacgggaagcgccgttaaatcagattccccctcaactagtagcatacctcctctaaacgaaacagtgtcagccgctagcctgctcaccaccaccaatcagcactcaagttcactggggggtctcagccactccgaggaaattcctaacacgacaacaacccagcacagcagcacactgtccacccaacagaacacgctatctagcagtactagcagcgggaggacttctacaagtacactgctccatacctcggttgaatcagaggcaaacctccattcttcatcatcaactttttcaactactagctctaccgtgtctgcacctcccccagtcgtcagtgtaagctcgagcttgaatagtggttcatcgctggggctgtcactgggatccaactctactgtcacagcttctactagaagctccgtggctacaacctccggaaaagcccctcctaatctgccccctggggtacccccactccttcctaatccgtacatcatggctccagggctcctccatgcataccctcctcaggtttatggctatgacgatctgcaaatgcttcaaaccaggtttcctctggattactactctattcccttccccacccctacaactccactcacggggcgtgatggcagcctggcgtcaaacccatacagcggagacctgaccaaatttggcaggggtgacgccagctcaccagcacccgctactacgttggcgcagcctcagcagaaccaaacccaaactcaccacacaacccagcaaaccttcctcaaccccgcattgccacctggatactcttacacctctctcccatactatacgggagtacctgggctgccgtccacgtttcaatacggtccagccgtttttccagtggctcctacgagctctaagcagcatggtgtgaacgtaagtgttaatgcttccgccactccctttcagcagccttccggatacggatcccatggatacaataccggagtatccgtgacatcatcaaacactggggtgccggacatcagcggctccgtctactctaaaacacagcagagttttgagaagcaaggcttccactccggaacaccagcagcaagctttaatctgccctccgctttaggatctggcggtccaattaatccggctaccgcagccgcttatccccctgcaccctttatgcatattttgacgcctcatcaacagccacatagccagatcctacaccaccatttacagcaagacggccagactgggagcggtcaacgcagtcaaacctctagcatcccccagaaaccccagaccaacaaatctgcttacaactcctattcatggggtgctaactag

SEQ ID NO: 24774 - DNA, 1803 bp, Artificial Sequence
  Description of Artificial Sequence: Synthetic coding sequence
atgcccggtagcgcggatatctccggcctaaatctccagttcggcgctctacagttcggttcagaaccagttctgtctgactatgagagcacacctaccaccagcgctagttcctctcaagctccctcttctctgtacacctcaacagcatcagagtcctcaagcacaatctctagtaatcaaagtcaggagtccggatatcagagcgggccaatccaatcaaccacatatacaagtcagaacaacgctcaggggccactctatgagcagaggtctacccaaacacgcagatatccttcctccatatcaagttccccacaaaaggacctgacacaggccaagaacggctttagtagcgtgcaggctacgcaactgcagactactcagtcagttgaaggggcaacaggctcagcagtgaagtccgattcaccgtccacgagctcaattcctccactgaatgagacggttagcgcagctagcctgctgaccacgactaatcagcacagctctagtctgggcggtctgtcccatagtgaagagatccctaatacgactaccacccagcactccagtaccctgagcactcaacagaacactctgtcttccagtacaagttccgggagaacatcgacaagcactctgctccatacttccgttgagtctgaggcgaacctccacagctcatcttctacattctccactacaagttctactgtttccgcccctccacccgtcgtctcggtatcttcttctctcaactcaggttcaagcttggggcttagtctgggtagtaatagtacagtcactgcttccaccagaagctcggtggctactacttcaggcaaggcaccgccaaacctgccccctggcgtgcctccacttctgcctaatccctatatcatggccccaggactcttgcacgcctacccgcctcaggtgtatggatatgacgacttgcagatgctgcagacgcggttccccctcgactattacagtataccctttccaacgcctaccactccactgactggaagggacggctccctggccagcaacccctactcgggggacctgaccaagttcgggcgaggggacgcatccagccctgctccagctaccaccctcgcacagccacagcagaatcagacccagactcaccacactacacagcagaccttcctgaaccctgccctgcctccaggctatagttacacctcacttccctactacacaggcgtgccagggctgcccagcacctttcagtacgggcctgctgtattcccggttgctcccacctcctccaaacaacatggagttaacgtctcagtcaacgcatccgccacaccctttcagcagccctcgggatatgggtcgcatggctacaataccggtgtgtccgtcacaagctccaacacaggggtgcccgatatttcaggcagtgtctactctaagactcagcagagttttgaaaagcagggattccattccggcacccccgcagcttcctttaacctacctagtgccttgggaagcggtggaccgatcaatcctgcaaccgccgcagcatatcctcctgccccattcatgcacatcttgacaccacaccaacagcctcacagtcagatcctgcaccatcacctgcaacaggatggacagctgccctacctgcagatgattctctgctgccagcgacaacaggaagagcagaccgggagcggtcagcgctcacagacaagctctatccctcaaaagccgcagaccaacaaaagtgcctataattcttacagctggggagcaaattag

SEQ ID NO: 24775 - DNA, 1200 bp, Artificial Sequence
  Description of Artificial Sequence: Synthetic coding sequence
tgacagcatagctcgtcccttgggggactgtcacatagcgaggaaattcctaataccaccaccacgcaacactcttccacattaagcacccagcagaatacactcagttcctcaacttcctcaggcaggaccagcactagcaccctgttgcacacttcagttgaaagcgaggctaacctccacagtagttcctccacattctctaccacatcttccactgtttctgcccctcctccagtggtatcagtgtctagcagcctgaattctgggtcttctctgggtctctcgcttggctctaatagcactgtgactgcaagcacccgctctagcgtggctactacctccggtaaggccccacctaatctgcccccaggcgtgccacccttgctgccgaatccatacattatggcacccggactgttacatgcttacccaccacaagtgtatggctatgacgacctgcagatgctgcagactagatttcccctggactattacagtataccgtttcctacaccgaccacccccttgacggggcgtgatggatctttggcatcaaatccgtactccggggatttaacaaaattcggaaggggcgatgccagctctcccgcacccgcaacgacactggctcaaccgcagcagaaccagacacaaactcaccatacaactcaacagacatttctgaatcctgccctccctccaggatactcctatacgtccttgccctattacaccggggtacccggactcccatcaaccttccagtatgggccagcggtgtttcccgtcgcacccacatcatccaaacagcatggtgtaaatgtcagcgtgaacgccagcgctaccccatttcagcagccgtcaggatacgggtcacatgggtataataccggagtgtcagtaacatcttcaaacacaggcgtgccagacatttctggaagcgtgtactcaaaaacccagcagagctttgaaaagcagggatttcattctgggactccagccgcttcctttaatttgccttctgccctggggtcaggtgggccaatcaatccggctactgctgcggcttatccaccagcccctttcatgcacattctcacacctcaccaacagccccacagtcagatactacaccaccatctgcagcaggacggtcaggatattcttaactttgttgacgaccagctcggcgagtag

SEQ ID NO: 24776 - DNA, 798 bp, Artificial Sequence
  Description of Artificial Sequence: Synthetic coding sequence
atgatgaccagcgtcggtacaaaccgcgcaaggggaaattgggagcagcctcagaaccagaaccagacacagcacaagcagagaccacaggctacagccgagcaaatcaggctagctcagatgatttctgaccacaacgatgcagactttgaagagaaagtgaagcagttaattgacataactggtaaaaatcaggatgaatgcgtgatcgctttgcacgactgcaatggcgacgtcaaccgcgctatcaatgtgttgctggagggaaatcctgatacacatagctgggaaatggtcgggaagaaaaagggcgtgtctggccaaaaagacggcggacagacggagtcgaatgaagaagggaaggagaaccgtgaccgggatcgggactactcacggaggcgcggaggccctccacggagggggagggttcggggacaggaaaacgggctggacgggacaaaatccggcggaccctcgggaagagggactgagcgagggcgtcggggaagaggcaggggcagggggggatccgggagaaggggcggtagattcagtgcacaggggatgggcactttcaatcccgcagactatgcggaaccagccaacactgatgacaactatggaaactcaagtggaaatacctggaataacaccggacactttgaacccgacgacggcacttccgcatggcgcacagccaccgaggaatggggaaccgaagactggaatgaagatctgagcgaaaccaaaatttttacagcgtcaaacgtgagcagcgttcctcttccagccgaatag

SEQ ID NO: 24777 - DNA, 549 bp, Artificial Sequence
  Description of Artificial Sequence: Synthetic coding sequence
atgatgacctcggtcggcacaaaccgggcacggggtaattgggaacagccccagaatcagaaccagacccaacacaagcaaaggcctcaagctacagccgagcaaataagacttgcacagatgatttccgatcataacgacgccgactttgaggagaaggtgaagcagctgatcgacattaccggtaagaatcaggatgaatgtgttatagcattacatgattgtaacggagacgtcaaccgcgctatcaacgttctgttggaagggaacccagacacccatagctgggaaatggtgggaaagaaaaaaggggttagtgggcagaaggatggcggacagaccgagtccaatgaggagggcaaggagaatagggaccgcgatcgcgactattcccgcaggagagggggaccacctcgcagagggaggggagcttcccggggacgtgagtttagaggtcaggagaacggcctggacgggacaaaatcaggaggcccatccggcagaggaaccgagcggggacggagggggagaggcaggggcaggggttag

SEQ ID NO: 24778 - DNA, 705 bp, Artificial Sequence
  Description of Artificial Sequence: Synthetic coding sequence
atgatgacttctgtgggcacaaacagggctcgcggaaattgggaacagccccaaaatcaaaatcaaacgcagcacaagcagcgtccacaagctactgctgagcagatccgtctggcccaaatgatcagcgaccacaacgacgctgatttcgaggaaaaggtaaagcagctgattgatattactggcaagaatcaggacgagtgtgttatagccctgcacgattgtaatggcgatgttaatcgggcaatcaacgtgctgctggaaggaaatccagacacgcacagctgggaaatggtggggaaaaagaaaggcgtctcgggacaaaaagacggcggtcagacagagtctaacgaggagggcaaggagaatcgcgaccgtgatagggactacagcagacgcagaggcggaccgccacgcagaggacgaggtgcctcccgcggacgcgagtttcgaggccaagagaatggccttgacggtacaaagtcagggggtccttctggacgcggaactgagaggggacgcagaggtcgtggccgaggcaggggcggatccggaagaaggggtggccgattctcagctcagggaatgggaaccttcaatcctgctgactacgccgaaccagcaaacaccgatgacaattacggaaactcaagcgggaacacttggaataatacagggcacttcgagcccgatgacggcacgtag

SEQ ID NO: 24779 - DNA, 1989 bp, Artificial Sequence
  Description of Artificial Sequence: Synthetic coding sequence
atgcctgggagcgccgatatttcaggccttaacctccagttcggcgcactgcagttcggaagtgagccagtgctctccgactatgaatccacccccaccaccagtgcaagcagcagccaggctccctcttcactctatacatccactgcttcagagtcttcctctacaatcagttccaaccagagccaggagagtggataccaatctggacccatccaatctaccacctacacctcgcagaacaacgcccaagggcctctgtacgagcagaggtcaacacagacacgcagatacccctccagcatttcctcatccccgcagaaggatctgacgcaggctaaaaatggcttctcaagcgtccaggccacccagctgcagactactcagagcgtggagggggcaaccggatctgcagtaaaatccgattcaccatctacaagcagtattcctcccctcaatgagactgtgagtgcagcatccctcttgaccaccactaatcagcattccagtagcttggggggtctttcgcatagcgaggagatccccaatacaaccaccacccagcactcatctacattgtctacgcagcagaacacgctctcatcatccacctctagtgggaggaccagtacaagtactcttttgcacacgagcgtggagtccgaagcaaatttgcactcatcaagcagcacgtttagcaccacctcgtccacggtgagcgctccaccccctgtcgtgtctgtctcgagtagcctcaatagtgggtctagcttagggctgtcccttgggagtaacagcaccgtgacagcctccacacggtcctccgtggccacaacctctggcaaagcaccccctaacctgccccctggagtacccccactgctccctaatccgtatattatggcacctgggctcctgcacgcctatcctcctcaggtgtacggctatgacgatctccaaatgctccagacacgatttccattggactactatagtattccctttcctacccccactactcccctgactggaagggatgggtctctggcctctaatccttactctggcgacttaacaaaattcggccgtggcgacgctagttcaccagcccctgccaccacgctagcgcagcctcagcagaatcagacccagactcaccacactacccagcagaccttcctgaacccagctctgccacccggttattcatacacatcgctgccatactatacaggtgtgccgggactcccaagtacattccagtatggacctgcggtcttccccgtcgcaccaactagctcgaaacaacacggcgtcaatgtgtctgtgaacgccagcgcgactcctttccagcaacctagcggctacggctcacacggctataacaccggagtctcagtgacatccagtaacaccggggtcccagatatctctggctccgtgtacagtaaaacccaacaatctttcgaaaagcagggcttccattcagggactcctgcagcttctttcaacctaccatctgccctgggctcgggagggccaatcaatccagccactgctgcggcttatccgcctgcgcctttcatgcacattctgacaccgcaccagcagccccattctcaaatcctgcaccatcacctgcagcaggatggacagttgccttatctgcagatgatcttgtgctgccagagacagcaggaagagcaaaccggatccggtcagcggtcccaaacctccagtattccgcagaaacctcagaccaacaagtctgcatataatagttatagctggcctaccgaagccttgactttgttctcacgctcacacctgctccggggattgctgtccctcgaaactatggaaaccgcttctaagaggaaggaatgcggtgggttcccactgcccccaaccccaagtggccctcctcatgccagcgcctcttgcctgtcacatagttacacaatacccactctgctgtatgtgctttag

SEQ ID NO: 24780 - DNA, 1593 bp, Artificial Sequence
  Description of Artificial Sequence: Synthetic coding sequence
atggaagacgatagtttgtatttacggggagagtggcaatttaatcacttttccaagctgacttcaagcagaccggatgccgctttcgctgagattcaacggacaagcctgccggaaaagtctcctctgtcatgtgaaacccgggtggacctatgcgatgacctcgcccctgtagccaggcagctggcccctcgagaaaaactacctctgagctctcggcgacccgcagccgtgggcgctggtctgcagaacatgggtaatacctgttacgtgaacgctagtttgcagtgtttgacttacactccgccactcgccaattatatgctctccagagagcacagtcagacatgccaccggcacaaggggtgcatgctctgcactatgcaggcacatataacgagggccctgcacaacccaggccacgtgatacagccaagccaggccttggccgcaggctttcaccgcggtaagcaggaagatgcacacgagttcttgatgttcacggtggacgccatgaaaaaggcctgtttgcctggccacaaacaggtcgaccatcactctaaggataccacgctcatacaccagatcttcggtgggtactggcgcagccagatcaagtgcctgcactgtcatggcatcagcgacacatttgacccatatctggatattgcactcgatattcaggccgcacagtcagtccagcaggctttggagcagctggttaagccggaggagctgaatggcgagaatgcttatcattgtggagtgtgtttacagagggctccagcgtctaagaccttgactctgcacacctctgctaaagtgctgatactcgtgctaaaaaggttttcggacgtgactggaaacaaaatagccaagaacgtgcagtatcctgaatgccttgatatgcaaccctacatgtcacaacctaatacaggacccctggtttacgttctatacgccgtcctggtgcacgcaggttggtcttgccataatggacattacttctcctatgttaaggcacaagagggtcagtggtataagatggacgacgctgaggtcactgctagttccatcacctccgtgctgtctcagcaggcctacgtgctgttctatatccaaaaatccgagtgggaacgccattcagaatccgtgtcaagaggccgagaaccgagggccctgggggcagaggatacagatcggagggctactcagggcgagctgaagcgcgaccacccttgcctgcaagccccagaactggacgaacatctggttgaaagagccacacaggagagtactctggatcattggaaattcttgcaggagcaaaataaaacgaagccagagtttaacgtgaggaaagtggagggcactttacccccagatgtgctggtgattcatcagtccaagtacaagtgcggaatgaagaaccatcatcctgaacagcagagtagcctgcttaatctaagcagctccaccccgacccatcaggagagcatgaataccggcaccctggctagtcttcgcggacgggctcgccgaagcaagggtaaaaacaagcatagcaaacgggctttgctggtttgtcaatag

SEQ ID NO: 24781 - DNA, 1593 bp, Artificial Sequence
  Description of Artificial Sequence: Synthetic coding sequence
atggaagacgactccctgtatctccgtggcgagtggcaattcaaccattttagcaagttgactagttctcgcccagacgctgcttttgctgagattcaacgaacttcccttcctgagaaatcacctctcagctgcgaaactagagtagacctgtgtgacgatttggcccctgtcgcacggcagctggcgcctcgggaaaaactgcctctgtcttccagacggcctgcggctgtgggcgctggattgcagaacatgggcaacacatgctacgtcaatgcttccctgcaatgtttgacctatactcccccactggccaactacatgctgagtagggagcatagccagacatgccacaggcataagggctgcatgctttgtactatgcaagcccacattactagggccttgcataacccaggccatgtaatccagccttctcaagcattggcagccggatttcaccgcggtaagcaggaggatgcccacgagtttcttatgttcacagtcgacgctatgaaaaaagcctgcctccccggtcataaacaggtcgaccatcactccaaagacactactctcattcatcagatattcggcggttattggagatcccagattaagtgtctgcattgccacggcatctccgacacgttcgatccctacttggatatcgccctggatatccaagctgcacagtctgtccagcaggctctggaacaactggtgaaacctgaagagttgaatggcgaaaacgcataccattgcggggtatgccttcagcgcgctcccgctagcaagactctgaccctgcacacatccgccaaggtgctgatcctcgtgctcaaacggttttccgacgtgaccggaaacaaaatcgccaagaacgttcagtaccccgagtgtttggatatgcagccatacatgagtcagcccaatacagggcctctagtgtatgttctgtacgccgttctggtgcacgcaggatggtcgtgtcacaatggacactacttttcctatgtgaaagctcaagaagggcagtggtataaaatggacgacgcggaggtaacagcctctagtatcacctcagttctctctcagcaggcctatgttttattttacattcagaaatcagaatgggaacgccactccgagtctgtgagccgcggaagggagccacgtgctctaggagcggaagacacagaccggagagccacacaaggtgaactcaaacgggatcatccctgtctccaagccccagagctggacgaacatctggtcgaacgcgcaacgcaggagagcacactggatcactggaagtttctgcaggagcagaataagaccaaaccagagtttaatgtgcgcaaggtggagggtactctgcctccagacgtactggtgatccaccagtccaaatataagtgtggcatgaagaaccaccatcctgagcagcagtcaagcttgctgaacctttcttcatctacacccacacaccaggagagcatgaacaccgggacactggcgtctttgcgcggtcgggctcggcgtagtaaaggcaagaataaacactctaagcgcgcactgcttgtatgccagtag

SEQ ID NO: 24782 - DNA, 1593 bp, Artificial Sequence
  Description of Artificial Sequence: Synthetic coding sequence
atggaggacgatagtttgtacttgagaggagagtggcagtttaaccatttcagtaagttaacatcaagccgtcccgatgccgcatttgccgagattcaaaggactagcctacctgagaaaagccccctctcttgcgaaacacgggtagacctctgcgacgacctcgcaccagtcgccaggcaactcgcccctagagagaagctccctctcagttcacgcaggcctgcggcagtgggagccggactgcaaaacatgggtaatacgtgctacgtgaacgcaagcctccagtgtctgacatatacccctcccctggctaactatatgctcagtagggagcactcacagacatgccaccgacacaaaggctgcatgttgtgtacaatgcaggcgcatattacaagagcgctccacaatccgggtcacgtaatccagccgtcacaggccctcgctgccggatttcaccgtggtaagcaggaggacgctcacgaatttcttatgttcaccgttgacgcgatgaagaaggcatgtctccccggtcataagcaagtggaccaccacagtaaggacaccacactgatccatcagatatttggcggttactggcgaagtcagattaagtgcctgcactgccacggcattagcgacacgttcgacccctacctcgatatagccttggatattcaagccgctcaatccgtgcaacaggcacttgaacagcttgttaagcccgaagagcttaacggggaaaacgcctaccattgcggtgtctgcctccagcgggcacccgctagcaaaacacttacactacacacgtctgccaaggttctgatcctggtcctcaagagatttagcgatgtcaccggtaacaagatcgctaaaaacgttcagtatccagagtgtttagacatgcagccttatatgagccagcccaacactgggccactcgtgtacgtgctgtacgccgtgttagtccatgctggctggtcctgccataatgggcactacttctcatatgtgaaagcacaagagggacagtggtataagatggatgatgccgaggttactgcgtcctctatcacctccgtgctgagccagcaggcatacgttcttttttatatccagaagagcgagtgggagagacactctgagtctgtgagtcgtgggcgtgaaccgagagcattgggggcagaggataccgatcgccgagctacgcagggagagctgaagcgggaccatccttgtctgcaggctccagagttagacgagcacctcgtcgagcgcgctacccaggaaagtacacttgaccattggaagtttctccaagagcaaaataagacgaagcctgaattcaacgtccgcaaagtggagggaaccttaccaccggacgtcttagtcatccaccagtctaagtacaaatgcgggatgaagaatcaccatccagagcagcaaagctctctcctgaatctgagcagcagtacccctacacatcaagagtctatgaacacagggacgttggccagtctgcggggtagagcacgcagaagcaaagggaagaacaagcattctaaaagggctcttctagtttgccagtag

SEQ ID NO: 24783 - DNA, 1593 bp, Artificial Sequence
  Description of Artificial Sequence: Synthetic coding sequence
atggaggacgacagcctatacttgcgcggagagtggcaattcaatcatttcagcaaacttacctctagcagacctgatgccgcattcgccgagattcagcggacatccttgccagagaaatctcctctgtcctgcgaaacaagagtggacctgtgtgacgacctggctcctgttgcgcgacagcttgcccctagggaaaagctgccactgagttctagacgacctgccgcagtcggcgcaggactgcaaaacatgggaaatacttgctacgtgaacgccagtctgcagtgccttacctacaccccacctttggcaaattacatgctcagtcgcgaacacagccagacctgccatcggcacaaagggtgcatgctctgtaccatgcaagcacacatcacccgagcccttcacaacccaggacatgtcatccaaccttctcaggctcttgctgctggttttcacagggggaagcaggaggacgctcacgagtttttaatgttcaccgtcgatgccatgaaaaaggcctgtcttcccggacacaagcaggtagaccaccactccaaagatactactctgatacatcagatcttcggcggatattggcggtcccaaattaagtgtttgcattgccatggaatctccgatacctttgatccgtatttggatattgcactagatatccaggcagctcagagcgtccaacaggctctggaacagctggtcaagccagaggaactgaacggggagaacgcgtatcactgtggggtatgcctgcagcgcgcacctgcttccaaaacactaaccctccatacaagcgctaaagtgctgatcctcgtgctgaagcgttttagcgacgttactggaaacaaaattgcgaagaacgttcagtatccagagtgccttgatatgcagccttacatgtcacagccgaatacaggcccactggtctacgtcctctacgccgtgctggtgcacgccggttggtcgtgccacaatggccattatttcagttatgttaaagcccaggagggacagtggtacaaaatggacgacgccgaggtgacagcctcatccatcacttccgtgctgagccagcaggcatatgtgctgttctatatacagaagtcagagtgggagcgccacagcgaatctgtaagcagaggacgggagcccagagccctgggcgctgaggataccgataggcgggctacccagggagagctgaaacgggaccacccctgtttacaagcccctgagctggatgaacatctagtggaacgggctacgcaagagtccaccctggaccattggaagtttctacaggagcagaataaaaccaagccagagttcaatgtcaggaaggtggaaggaacgctccctcctgatgtgctcgtcatacaccagagtaagtataagtgcggcatgaagaaccaccatcctgaacagcaatccagcttgcttaatctgtcctcctctactccgacccatcaggaatccatgaatacaggcacattggcgtcactgcggggtagggctcgtcgttcaaaggggaagaataagcacagtaagcgagcccttctggtctgtcagtag

SEQ ID NO: 24784 - DNA, 1593 bp, Artificial Sequence
  Description of Artificial Sequence: Synthetic coding sequence
atggaagacgactcattgtacctcagaggagaatggcagtttaatcatttttccaaattgaccagttcccgtccggatgcagccttcgccgaaatccaacgaacttccctgccagaaaagagtcctttgtcctgtgagaccagggtggacctctgtgacgaccttgctcccgtcgcaaggcagttggcacccagagaaaagttacctctctccagccgccgtccagctgccgtaggtgctgggttacagaacatgggaaacacttgctacgtcaacgcgtcgttgcaatgcttgacctataccccccctcttgctaactatatgctgagccgcgaacatagtcagacttgccaccgtcacaagggctgcatgctgtgcaccatgcaggcccatatcactagagccctccacaacccgggtcacgtaattcagcccagtcaagctctcgctgccggattccataggggcaagcaggaagatgcccacgaatttctaatgtttacagtggacgcaatgaagaaagcctgtctccccggacacaaacaggtggaccaccattcgaaggacaccacattaatccaccagatctttggaggctattggaggtcccagattaagtgcctgcactgccacggaatttcggacacctttgacccctacttagacattgctcttgacatacaggctgcgcagtcagtacagcaggcgctggagcagctagtgaagcccgaggagttgaacggggaaaatgcttaccattgtggggtctgcctgcaacgtgccccagcttccaagactctgaccctgcacacgtctgcaaaagtgctgatccttgtcttgaaacggttcagtgacgtgactggaaataagatcgccaagaatgtccagtaccccgagtgcctggacatgcagccttacatgtctcagcccaatactggacctctagtctacgtcctctacgctgtgctggtgcacgccggatggagctgtcacaacgggcactatttctcgtacgtgaaagctcaagaaggacagtggtataagatggacgacgcagaagtcaccgcatcaagcataacatctgtgttatcgcagcaggcctatgtcttgttctacatccagaaatcagagtgggagcgacactccgagagtgtttcgcggggacgcgaacctagagccttgggagcggaagacacggatcgacgagcaacccagggcgaactgaaacgggatcatccatgtctgcaggctccagagcttgacgaacatcttgttgagagagccacccaagaaagtaccctggatcactggaagttcctccaggagcagaataagacaaaacctgagttcaatgtgaggaaggtcgagggaacacttccacctgacgtcctggttatacaccagtccaagtacaaatgtggaatgaagaaccaccaccccgaacagcaaagctcactcctgaatctctctagttccacgccaacccatcaggagagcatgaatactggaaccctcgcaagcctgcgcggacgtgctcgccgtagcaagggtaagaataaacactccaaacgcgctctgttggtttgccaatag

SEQ ID NO: 24785 - DNA, 1593 bp, Artificial Sequence
  Description of Artificial Sequence: Synthetic coding sequence
atggaggacgactctctttaccttcgaggcgaatggcaatttaaccacttttccaagttgacatccagtcgacctgatgcagccttcgcggagatacaaagaaccagcctgcccgagaagtctccactgtcctgtgagactcgggtggatctctgcgatgatctggccccagtggctcggcagttggccccacgcgagaagctgcctttgtcgtcgagacgccctgctgcggtgggagctgggctccagaatatgggaaatacgtgctacgtgaacgcatctcttcagtgtctgacgtacaccccacctctggccaactatatgctttcccgtgagcatagccaaacgtgccaccgacataaagggtgtatgttgtgtactatgcaggcccacataacccgcgctcttcacaatcccggtcatgtgattcagccctcccaggctctggcagcaggatttcaccgtggcaagcaagaagacgcccatgaatttctgatgttcactgtcgatgctatgaagaaagcatgccttcctggtcacaagcaggtagatcaccacagtaaagatacaacactaatccaccagatatttggcggttactggagaagccagatcaagtgtctgcactgtcacggaatttctgacacattcgatccatatctggacatcgccctggacattcaagccgctcaatccgtgcagcaggccttggaacagctggttaagcccgaggagttaaatggcgagaacgcctaccactgtggcgtttgtctacaaagggcccctgcatccaaaacactgacgctacacaccagtgccaaagtgctcatactggtgctaaaacggttttctgacgtaactggcaacaaaatcgctaagaacgtgcagtacccagagtgtctggatatgcagccgtatatgtcccagcctaatactgggcctctcgtctacgtgctttacgcagtcctggttcatgcaggctggtcgtgccataatggacattatttctcctatgtcaaagctcaagaagggcagtggtacaagatggacgacgctgaagttacagcttcaagcatcacgtctgtcctgtcccagcaggcctacgtgcttttttacatccaaaaaagcgagtgggagcgacactccgaaagcgttagtcgtgggagagagcccagagccctgggtgcagaagatacggataggcgggcaacccaaggcgaattgaagagagatcacccatgtctgcaagctcccgagctagacgaacacctggtggagagagccactcaggagtccacactggaccattggaaattcttgcaagagcaaaataagacaaaacctgaatttaacgtccgaaaagtggagggcactctgcctcccgacgtgctggtgattcatcaaagcaagtacaagtgcgggatgaagaatcatcatcctgagcagcagagtagcctactgaatctgagcagcagcacccccactcatcaggagtccatgaacaccggcaccctggccagtctgagggggcgagctcggcgtagcaagggaaaaaacaagcatagcaaaagggccctgcttgtgtgccagtag

SEQ ID NO: 24786 - DNA, 1593 bp, Artificial Sequence
  Description of Artificial Sequence: Synthetic coding sequence
atggaggacgatagcttatatctgcggggtgagtggcagtttaatcacttttccaagctgacctctagccgtccggatgcagcattcgccgagattcagagaacaagcctccccgagaagtcccccctctcgtgcgaaactcgcgttgacctgtgcgatgatttggcccctgtcgccagacagctggcgccacgggagaaactaccactgtcctctcgaagacccgctgcagtcggtgctggtttgcagaacatggggaacacatgttatgtgaacgcatccctgcaatgcctgacttatacgccccctctggccaactacatgttgagtagggagcactcccagacatgccaccggcataaaggatgcatgctctgcaccatgcaagctcacatcacgcgtgccctgcataatcccggacacgtcattcaaccttcccaggcactggccgctggatttcacagaggcaagcaggaagatgcccacgagtttttaatgttcacagtcgatgctatgaaaaaggcctgtctgcccggacataaacaggttgatcatcattccaaggataccacactgatccaccagatttttggcggatactggcgcagccaaatcaagtgcctacattgtcatggcatctcagacaccttcgatccttacctcgatattgccttggatatccaggcagcacagtccgtgcagcaagctctggaacagcttgtgaagccagaggagctgaatggtgagaacgcgtatcattgcggcgtgtgcctccagagggcccctgctagtaaaactttgacactacatacatccgctaaggttcttatactggtcttaaagaggttctcagatgttaccggcaacaagatcgcgaaaaacgttcagtacccagagtgccttgacatgcaaccgtacatgtcccagcccaataccggtcctttagtgtacgtgctctatgccgtcctggtgcacgccggatggagctgccacaatgggcactacttttcctatgtgaaagctcaagagggccagtggtataagatggacgacgccgaagttacggcttcttcgattacctctgtgctttctcagcaggcgtatgtcctcttctatatccagaagtccgagtgggagagacattctgaaagcgtttctcggggaagagaaccacgcgctctcggcgcagaggatactgatcgtcgcgcaactcaaggcgagctcaagagagaccacccttgcttacaggctcccgagctggatgaacatctcgttgagagagctactcaggagagcacgttggaccactggaagttcttgcaggagcaaaacaagactaagccagagttcaatgtgagaaaagtagaaggtaccctgccacctgatgtgctagtcatacatcagagcaagtataagtgtggcatgaaaaaccaccaccccgagcagcagtcctcattattaaatttgagtagttcaacccccacacaccaggagagtatgaatacgggtaccctggctagccttcgtgggcgtgcacgcagatctaagggcaaaaataaacactcaaaacgagcgctactggtctgtcaatag

SEQ ID NO: 24787 - DNA, 477 bp, Artificial Sequence
  Description of Artificial Sequence: Synthetic coding sequence
atgctgcttttcgcactgctgctggcgatggagttgcctctggtggccgcttccgccactatgcgcgcacagtggacttactcacttcgctgccacgactgtgctgtgatcaatgactttaattgccccaacatccgggtgtgcccatatcacattcgcagatgcatgaccatctccatccggatcaactctagggaactgttggtgtataagaactgtacaaacaactgtacctttgtgtatgcagctgagcagcctccagaggcccctggtaaaattttcaagaccaattctttttactgggtctgttgttgcaactccatggtatgcaacgcaggcggacctaccaacctggaacgcgacatgctgcctgacgaagtcaccgaagaggaactaccggagggcacggtgagactcggagtttcaaaactgctgctgagcttcgcttcaattattgtgtcaaacatcttaccctag

SEQ ID NO: 24788 - DNA, 1584 bp, Artificial Sequence
  Description of Artificial Sequence: Synthetic coding sequence
atggcagtacacagagtgaaagtgactttcaaagatgagcccggagagggatccggggtggccagatccttttacacagccatcgcgcaggcattcttatctaacgagaaactgccaaatctcgagtgtattcaaaatgcgaacaagggaacccacacttccctcatgcagaggctaagaaatcgcggagaacgggatagagaacgagagcgggaaagggagatgcggagaagcagcggactccgcgcaggatctagaagggatagggatagagatttcagacgacagctgagcatcgacacaaggcccttcagaccagcgagcgagggaaacccatcagatgaccccgagccactgcctgcccacagacaagcattgggagagcggctctaccccagggtgcaggccatgcagcctgcgttcgcttccaagataaccgggatgctcctcgaactgagtcccgcacagttgctcctgctgctagcatccgaagatagcctgcgcgcacgagtagacgaggccatggagttgattatcgctcacggaagagagaacggggctgatagtatcctcgatttgggccttgtagactcttccgagaaagtccaggaaaaccgcaaaaggcacggcagttcccgctccgttgttgacatggatctggacgacacagatgatggggatgacaatgcccctcttttttaccagcccggtaaaagagggttttacacaccccgacccggtaagaacacggaagcaagattgaattgcttccgaaacatcggcaggatccttggcctctgcttgctgcagaatgagctgtgccccataacattgaacaggcacgtcataaaggttctcctgggacggaaggtgaactggcacgattttgcgttttttgaccccgttatgtacgaaagcctgaggcagctgattttggctagtcagtcgagcgacgctgacgccgtgtttagcgcaatggatttggcttttgcaattgatctgtgtaaagaggagggcggtggccaggtcgaacttattcccaatggtgtgaacatccctgtgaccccccagaatgtgtatgagtacgtgcgaaaatacgctgaacacagaatgttggtggtggccgaacagccactccatgctatgcgaaaaggtctcttggacgtgctgccaaaaaactccctggaagacctgaccgccgaagattttcgcctcctggtgaacgggtgcggggaagtgaacgtgcagatgttgatcagcttcacaagtttcaacgacgaatccggcgagaatgcggagaagctcctgcaatttaaaagatggttctggtccatagtggagaagatgagcatgacagagcgccaagatttggtgtacttttggacaagcagcccctcactccccgctagcgaggaaggcttccagcccatgccatctattaccatcaggccccctgatgatcagcacttgcctaccgcaaacacgtgcattagcagactctacgtgcctctgtattcatccaaacaaattctcaaacagaaacttctcttggccatcaaaacgaaaaacttcggtttcgtctag

SEQ ID NO: 24789 - DNA, 8399 bp, Artificial Sequence
  Description of Artificial Sequence: Synthetic coding sequence
atgacatctatccactttgtggtgcaccccctgcctggaacggaggatcaactcaatgataggttaagggaagtttcagagaaactgaacaagtataatctcaactcccacccacccctcaatgtgcttgagcaggctactataaaacaatgcgttgtggggccaaaccacgccgcattcctgctagaagatgggagagtgtgccggatcggattttctgtgcagcccgaccgacttgagctgggcaagcctgataataatgatggctccaaattaaatagcaatagcggagccggacggacttcccgtcctggcagaacttcggacagtccttggtttctctcaggatcagaaacactggggaggctcgctgggaacacccttgggagccggtggagctcaggcgtgggcggatccgggggaggtagttccggcagaagctccgccggtgccagggactctcgacgccaaacacgtgtaattagaaccggaagagataggggcagcggtttgttggggtcccagccccagcctgtcattcccgctagcgttatacctgaggagctgataagccaggcccaggtggtgttgcagggaaaaagcaggtctgtgataattcgcgaattgcaaaggactaatctggacgttaacctcgccgttaataacctactgagcagagatgacgaggacggcgatgacggggatgacaccgcgagtgagagctacctaccaggagaggacctgatgagcctgctcgatgccgacattcacagtgcgcacccttcagtgattattgacgcggatgccatgttctctgaagatatttcttatttcggctacccctctttccgcagaagtagtctgtctcgtctagggtcgagtcgggtgctgttgctgcccctcgaaagggactctgagttactcagggagcgcgagtccgtgttgcgattgcgagagagacgctggttggatggggctagcttcgacaatgagcgaggatccacgtcaaaggagggagagccaaatttagacaaaaagaatacacctgttcagagcccggtctccctgggcgaggatcttcagtggtggcccgataaggacggcaccaagttcatttgcataggcgcattgtattctgagctcctggctgtttcttcaaaaggcgagctgtatcagtggaaatggtcagagagcgagccttatagaaacgctcagaatccttccttacatcatccccgtgccacatttctcggcctgactaacgaaaaaatcgtcctactctctgcgaacagcattcgtgccacagttgccacagagaataataaggttgctacctgggttgatgagactctatcatccgtagcttccaaattagagcacacagctcagacttacagcgaattgcaaggagaaagaatcgtctccttgcactgctgtgctctctacacctgcgcgcaactggaaaactccctctattggtggggcgtggtgccattctcccagcggaagaagatgttggaaaaagcacgcgcaaagaacaagaaacctaagtcatccgctggcattagctctatgccgaatatcactgtgggcacccaggtgtgcctgcggaataaccctctatatcacgcaggagccgtggctttctccatttctgctggcatccctaaggtgggcgtgctcatggagagcgtttggaatatgaatgactcctgcagattccaacttcgttcccccgaatccttaaagaatatggaaaaggcttccaagactactgaggccaaacctgaatcgaagcaagaacctgtgaagacagaaatgggtcctccaccaagcccggcaagcacgtgctctgatgctagttctatcgcttctagcgctagcatgccgtacaagcgcagacggagtacgcctgcccctaaggaagaagaaaaggtaaacgaggaacagtggtctctgagagaggtggtgtttgtcgaggatgtcaagaatgttccagttggcaaggtgctaaaggttgatggtgcttacgtggccgttaaatttcctggtacctcctccaacaccaactgccagaatagcagcggacccgatgccgatcctagttccctgctacaggattgtagactcctgcgaatcgacgaattgcaagtggtaaagaccggtggcacaccaaaggtgcccgactgtttccagagaacccctaaaaagctctgtataccagagaaaacagagattctcgctgtaaacgtggattctaagggggttcacgccgtgttaaagaccggcaactgggtaaggtactgcatctttgacttggcgaccggcaaagctgaacaggagaataattttccaacatcctccattgcctttctagggcagaatgagcgtaatgtggctatattcacagccggacaggaatcccctattatcctcagagacggtaacggaactatctacccaatggccaaggactgcatgggcggaattcgggatcctgattggctggatcttccgccaatcagtagcctaggcatgggcgttcatagcttaattaatcttcccgctaactccaccatcaagaagaaagcagccgtcatcatcatggccgtcgagaagcagacgttgatgcagcatattctaagatgtgattatgaggcttgccgccagtacctcatgaatctggagcaagccgtggtgttagagcagaatctacaaatgctgcagacgtttatttctcatagatgtgatgggaacaggaatatcctgcacgcatgcgtgtctgtgtgttttcccacaagcaacaaggaaacgaaggaggaggaagaagcagagaggagcgaaagaaacactttcgcggaaagactatctgctgttgaggccattgcgaatgccatctccgtggtgagcagcaatgggcctggtaaccgcgcaggcagctcatctagcagatcccttaggctgcgtgagatgatgcgacgcagcctgagagctgcaggcctgggtcggcatgaagccggtgcatcatcctcagatcatcaggaccccgtatcacctcccattgctccaccttcctgggttccagatcccccagctatggatccagacggggacatcgattttatacttgctccagccgtgggtagtctaacgactgccgcaactgggactggtcagggcccttccacctccacaattccaggtccctccacagagccctccgtggtcgaaagcaaagatcgcaaagccaatgcccactttatactgaaactgctgtgcgatagcgttgtgcttcagccatatctgagagagctgctttcagcgaaagacgccagaggtatgactcctttcatgtccgctgtgtcagggcgtgcttatccagccgctatcacaattctggagaccgcccagaagatcgcaaaggcagaaatctcatcctcagagaaagaggaagacgtatttatgggaatggtatgcccttctgggaccaatccagatgacagccccttatatgtgctatgctgcaacgacacctgcagcttcacttggacaggcgctgaacatatcaatcaggacattttcgaatgccgtacatgcgggctgcttgaatccctgtgctgttgcaccgaatgtgccagagtatgccacaaggggcatgattgcaaactgaaacggacttcccctactgcgtactgcgattgctgggaaaagtgtaagtgcaaaactctgatcgcagggcagaagtcagccaggcttgacctgctttaccgcctcctcacggcaactaacttggtaactctcccaaactcacgcggagaacacctgttactctttctggttcagaccgtggccaggcagactgtggaacattgccagtatcgccctcctaggataagagaggacaggaatcgcaaaactgctagtcctgaggatagcgatatgcccgatcatgacctcgagcctccaagattcgcccagctggccctagagagagtgctgcaagactggaacgcgctcaaaagcatgatcatgttcggttctcaggaaaacaaggaccctcttagcgcatcctccaggataggacacctcctgcccgaagaacaggtgtacttgaaccagcagagtggaacgattagacttgattgttttactcactgcctgatcgttaagtgtactgctgatatccttttgctggatactttgttggggaccttggtgaaggagctccaaaataaatatacccccggacgcagagaggaagccattgccgtcaccatgcggttcttgcggagtgtcgcacgagtgttcgtcatcttgagcgttgagatggcctcaagcaaaaaaaaaaataacttcattccacagcctatcggtaaatgcaagcgcgtgtttcaggcacttttgccttacgccgtggaagagctctgtaacgtcgcagaaagcctcattgtgccggttcgaatgggaattgctcgtcctactgcaccattcaccttggcgtctacctccatcgatgcgatgcagggatccgaagagctgttcagcgtggagccattgccccctcgcccaagctcagatcagtctagttcttctagtcagtcacagagttcttacatcattaggaatcctcaacagcgacgaattagccagtcacaacccgttagaggacgcgacgaagagcaagatgatatcgtgagtgctgatgttgaagaggtggaagtggttgagggcgttgcaggcgaggaagatcaccacgacgaacaagaggaacatggggaagaaaatgctgaggctgaggggcagcatgacgagcatgacgaggatgggagcgatatggagttagacctactggctgcggctgagacagaatccgattctgaaagcaatcacagtaaccaggataacgcaagcggcagaagatccgtagtgactgccgcaacagccggatctgaggccggagcctctagcgttccagctttcttttctgaagatgactcacagagcaacgatagcagcgattccgacagttcctcatcacagagtgatgacatcgaacaggaaaccttcatgcttgatgagccactagaaagaaccacgaacagctcccatgctaatggggcagcgcaggcccctcggtccatgcagtgggctgtccggaacacccagcaccagcgggctgccagtacggccccatcttcaacatcaacccctgcagctagctcagcagggttgatctatatcgatccttcaaatctaaggagatctggcacaatcagtacttccgctgctgccgctgccgctgccctggaagcctccaatgcctcgagctatctgacctctgcttcttcactcgcacgtgcctactcaatcgtaatcaggcagatctccgacctaatggggctgattccaaaatacaaccatttggtttactcccagattcctgcagcagtcaagctcacctatcaagatgccgtcaacctgcagaattacgtcgaagaaaaactcatccccacttggaactggatggtgagtattatggatagcacagaggctcagttgcgttacgggagtgccctggccagtgcgggagaccctggccatcccaaccatccacttcacgcctcacaaaactccgccagacgtgagaggatgaccgccagagaagaagcctctctgcgcaccctggaaggtcgcagacgtgccactcttctcagtgcaaggcagggaatgatgtcggctcgtggagacttcctgaactacgccctttcattgatgcggtctcacaacgatgagcactccgatgtgctgcccgtactagatgtgtgttcactgaagcacgtcgcatatgtgtttcaagctcttatatactggatcaaagccatgaatcagcagaccactctggacacacctcagctggagcgcaagcggactcgggaactgctggagctgggtattgataatgaggactcagaacacgagaacgatgacgatacaaaccagtctgccactctgaacgataaagacgacgacagcctgccagccgagactggtcaaaatcatccctttttccggagatctgattctatgacctttctgggctgtataccacctaacccatttgaggtcccgctggccgaggccatcccgctggcagaccaaccgcatctgttgcaacccaatgccaggaaagaggaccttttcggcagaccttcacaggggctctatagctcctctgccagtagcggtaaatgtctgatggaagtgactgttgacagaaattgcttggaggttcttccaactaaaatgtcatacgcagctaatctcaaaaatgtgatgaacatgcagaaccggcagaagaaagagggcgaggaacagcctgtccttcccgaggaaaccgaatccagcaaacccggacccagtgcacatgatctcgcagcccagctaaagtccagcctcctggcagagatcggcctgaccgagtcagaaggcccaccacttacctccttcaggccccagtgctctttcatgggaatggtcattagccatgatatgctcctcggtcgatggaggctttccctggaactgttcggccgagtcttcatggaggatgtgggagcagagcctggaagcattcttacagagctgggcggattcgaagtgaaagaatccaagttcaggcgggagatggagaagctgaggaaccaacagagtagggatctatccttagaagttgatagggaccgggatctgctcattcagcagacaatgcggcagctgaataaccactttggcagacggtgcgcaaccactccaatggcggtgcaccgggttaaggtcaccttcaaggacgagcctggagaaggatccggagtggccaggagtttctataccgccatcgctcaggcctttctgtcaaatgaaaaactccctaacttagaatgcatccagaacgcaaataaaggaacgcacacgtcactgatgcaaagattgagaaatcggggtgaaagggacagggaacgcgagcgcgagcgggagatgaggcgaagcagcggcttacgagcaggcagcagacgcgatagagacagggacttccgacgccagctctcaattgacacgcgccctttcaggcccgcttccgaaggcaacccttccgacgaccccgaacccttgcccgcacaccggcaggcactgggagaacggctgtaccctcgggtgcaggctatgcagcctgccttcgcgtctaagatcactggtatgttgctggagctctcccccgcacagttgctgcttctgctcgcatcagaggatagtttacgggctcgtgtggacgaggctatggaactcatcattgctcatggaagggaaaacggtgccgacagcattctcgacctcggcctagtggactcctcagagaaggtgcagcaggaaaaccgcaagagacacgggtcaagccgctcagttgtggacatggatctggatgacacagacgatggcgacgataacgcacctttattttaccaacctggaaagcgtgggttttacactcctcggccaggaaaaaataccgaagcgcgtctgaactgttttcgcaacattggaagaattctcgggttgtgtctactacagaatgagctctgccctataacattaaatcgccacgtgatcaaggtgctattgggtagaaaagtaaattggcacgattttgcgttttttgacccagtcatgtacgagtcactccggcagttgatcctcgcctctcagtcctcagatgcagatgccgtattctcagcgatggacctagcctttgccattgatctttgtaaggaggaggggggtggccaggttgagctgattccaaacggagtgaatatccccgtcacaccgcagaacgtgtatgaatatgtacgcaagtacgccgaacatcggatgctcgtagtcgctgaacagcctttgcacgctatgcggaaaggactccttgatgtattgccgaagaatagtcttgaggatcttacggcagaagatttccgtcttctcgttaatgggtgtggggaagtcaatgttcagatgctgattagcttcacaagctttaatgacgaatccggggagaatgcagagaagttgttgcagttcaagcgatggttttggagcatcgtggaaaagatgagcatgacagagagacaggatctcgtgtatttctggacaagctccccgtccctgcccgcttccgaggaaggcttccagccaatgcccagcattaccattagaccccctgacgatcaacatctacctactgccaacacctgcatctctagactgtacgttccactttactctagtaaacagattctgaagcagaagctcctgctagctatcaagaccaagaattttggtttcgtgta

SEQ ID NO: 24790 - DNA, 8378 bp, Artificial Sequence
  Description of Artificial Sequence: Synthetic coding sequence
atgacctcaatccatttcgtcgtgcatcctttacccggtaccgaggaccagttaaatgatcgtctgagggaagtctcagaaaagctgaataagtacaatctcaacagtcatcctccactgaatgtcctggaacaggcaaccattaagcagtgtgtggttggtcccaaccatgccgcttttttgttggaggatggaagagtgtgtcgtattggctttagtgtccagccagacagactggaattagggaagcccgacaataacgatggatccaagctgaactctaattctggggctggaaggaccagccgaccagggcgaacgtcagattcaccttggtttttaagtggttccgagacgttgggaaggcttgccggaaatactctcggtagccgatggtcttctggggttgggggtagcgggggagggtcctctgggagatcctctgcaggggcaagagacagtaggagacagacaagagtcatcagaactggcagggatagagggtctggactgttaggctcccaaccgcaaccggtcatccccgcatctgttatccctgaagagctgatctcacaggcccaggttgttctccaagggaaatcacgctccgtcataataagggagctccaaagaacaaacctggatgtgaacctggccgtgaataatttactctctcgggacgacgaagatggtgatgatggcgatgacactgctagcgagtcatacctgcccggagaggacctcatgagcctcctggacgccgatattcacagtgcccatcctagcgtaattatcgacgcagatgccatgtttagcgaagatatctcctacttcggatatcccagcttccgacgttcttctctatcgcggcttgggagcagtcgggaaagagatagcgagctgctgagggaaagggagagtgtcttgcggctcagagagagacgctggcttgacggcgcttcctttgataatgagcgcggaagtaccagcaaggaaggcgagcctaacttggataaaaaaaacactccagtgcagtcacctgtttccttaggagaggacttacagtggtggcctgacaaagacgggacaaagtttatctgtataggagccctctattccgagctcctcgcagtgagttctaaaggcgaactgtatcagtggaagtggagcgagagcgaaccttaccgaaacgcgcagaatcccagtctgcatcaccctcgcgctacatttctcggcctgacgaatgagaaaatcgtcctgttgtccgcgaacagtatccgtgccacggtggcaaccgaaaacaacaaggtggccacctgggtcgatgaaactctttccagcgtcgctagtaagcttgagcacaccgctcagacctacagtgaactccagggagagagaatcgtttcccttcattgttgtgccctgtatacatgtgcccaactggagaatagtctgtattggtggggcgtggtgccattctcccagcgaaaaaagatgctggaaaaggcaagggcgaaaaacaagaaacccaaaagctccgcgggaattagctctatgccaaacatcacggtaggaacccaggtgtgtttgcggaacaatccgctttaccacgcaggagctgtggcattctcaatctcagccggaattccgaaggtaggcgtacttatggagagcgtatggaacatgaatgatagttgccggtttcaactccgatcgcctgagagcctcaaaaatatggagaaggccagcaagactactgaagccaaacctgaaagcaagcaggaacctgttaagaccgagatggggccacctcctagtccagccagtacgtgttccgacgcatcttccatcgcctcaagtgcatcaatgccctacaagaggcggcgaagtacgcccgcacctaaggaggaggaaaaagtgaatgaggagcaatggagtttgagagaagtcgtgtttgtggaggatgtgaagaacgttcccgtcggcaaagtactgaaagtcgacggcgcttacgttgcagtgaaattccctggcactagcagtaatactaattgccaaaattcgagtgggcctgacgcggaccctagtagtttgctgcaggactgccggctgctacgcatcgacgaacttcaagtggtgaagaccggagggactccaaaagtgccagactgtttccagaggacgcctaagaagctgtgtatccccgagaaaacggagattctcgctgtaaatgttgactctaaaggtgtgcatgccgtgttgaagacaggaaattgggtacgctactgcatcttcgaccttgctacgggcaaggccgaacaggagaacaatttcccaacatcctctattgcctttttgggacagaatgagaggaacgtcgccatctttacggccggacaggagtctcctatcatcctgagagatggaaatgggacgatatatcctatggctaaagactgcatggggggtattcgggatcctgattggctggatctcccaccaatatcatccctcggcatgggcgtgcatagcttgataaatcttcctgccaattctacaatcaaaaagaaagccgctgtgataatcatggcggttgagaagcaaaccctcatgcagcatatactgcgctgtgattacgaagcctgcagacagtatctgatgaatttggagcaagccgtggtgcttgagcagaatcttcagatgctccaaaccttcatatctcacaggtgcgacggaaatcgaaatatactccatgcttgtgtcagtgtctgctttccaactagcaacaaagagactaaggaggaggaggaggcggaacggtcggaaaggaatacctttgctgaacggctgagcgccgtggaggcgatagctaatgctatctctgtggtgagcagtaacggtccaggtaaccgggctggatcctcctctagtcgcagtcttcggctgcgcgaaatgatgagaaggagtctacgcgctgcagggctgggcagacacgaagccggagcgtcttcctctgatcaccaggacccagtttctccccctatcgctcccccaagctgggtgcccgatccgccagcaatggaccctgacggagatatcgactttatcctggctccggcagtgggctcactcaccactgctgccacaggtacgggtcagggaccatcaacgtccaccattcctggacctagcaccgaaccctccgtcgttgaaagcaaggaccgcaaggcaaacgcccattttatcttaaagctgctttgcgactcagtggtacttcaaccctatctgcgcgagctgctctcagcgaaggatgctagaggcatgacaccatttatgtctgctgtttcaggccgtgcctatccagccgcaataacgattctggaaactgcccaaaagatcgcgaaagcagagatctcaagcagcgagaaagaggaagatgtctttatgggcatggtgtgcccatccggcacaaaccctgacgactctcccctatatgtgctctgttgcaatgacacatgctcctttacctggacgggcgcagaacacatcaatcaggacatttttgaatgtcgcacctgtggtctgctcgagtcgctatgttgctgtaccgagtgcgccagggtctgtcacaagggtcacgactgcaagttaaaaaggacatcccccactgcatactgcgattgctgggaaaagtgcaagtgtaaaactcttatagctgggcagaagtccgccagactcgatctcctgtaccgattactgaccgctacaaatttggttactctgccgaacagccgcggagagcatctgctcctattcctcgtgcaaacagttgcgagacaaactgtcgaacactgccagtaccgacctccacggattagagaagaccggaacaggaaaaccgcttcgcccgaggattctgatatgcccgatcacgatctggaacctcccagatttgctcagcttgccctggaaagagttttgcaggactggaatgccttgaaatcaatgatcatgtttggcagtcaggagaataaagaccccttgtccgccagtagccgcattggccacttacttccggaggagcaggtctatctaaatcagcagtctgggacaattcgcttggattgctttacccactgcctgatcgtcaaatgcaccgcggatatcttactcctggatacactacttggaactctggtcaaggaactgcagaataagtatactcccggacgccgtgaggaggccattgccgtgaccatgaggtttctgaggagcgtcgcaagagtttttgtcatactgtccgtggagatggcttcatctaaaaagaagaacaacttcatccctcagccgataggcaagtgcaaacgagtgtttcaggctctgctaccatatgccgttgaagagctgtgcaacgtggctgaatcattaatcgtcccagtacgcatgggtattgcacgcccaaccgccccatttactctagcctccaccagtatcgatgcaatgcaggggagcgaagagttgtttagcgtcgagcccctgccaccacgcccatcgagtgaccaaagcagcagctcttcccagtcccaaagttcttatataattaggaatccgcaacagaggcggatctctcaaagtcagccagtccggggtagggacgaagagcaggacgacatagtatcggcagatgtcgaggaggtcgaggtggtggagggggtggccggagaggaagatcatcatgatgagcaggaagaacacggcgaggaaaatgctgaggcggagggtcagcacgacgaacatgacgaagacgggtccgatatggaactagatctgttggcagcagccgaaactgaatccgacagtgagtctaaccactctaaccaggacaacgctagcgggcgaagaagcgttgtgacagctgcaactgccggtagtgaggccggagcctcatcagtgcccgcattcttcagtgaagacgacagccaatctaatgatagctctgattctgactctagttccagtcaatccgatgacattgaacaagagactttcatgcttgatgagcccctcgaaaggacaaccaacagttcgcacgccaacggggctgcccaggcccctaggtccatgcagtgggccgtgcgcaatactcaacatcaacgggcagcaagcacagcgccatcctcaacctccaccccagcagccagcagtgcaggcttgatatacatagaccctagcaatttgaggaggagtggaaccatatctacatccgcagccgcagctgcggcagcgctagaggcctccaacgcatcatcatacttaaccagcgcaagctctttggcacgggcatattcgatcgtgattcggcagatctccgacctcatgggcctgattcctaagtacaatcatctggtgtatagccagatccctgccgcagtcaaattaacctaccaggacgcagtgaacttacagaactacgtggaggaaaagctaatccccacatggaactggatggtgagcatcatggacagcaccgaggcccagttaagatatggaagcgccttggcaagcgcgggtgatcctggccacccaaaccaccccctgcacgcctcccagaactccgcacggagggagcgtatgaccgccagagaagaggcgagcctgaggacattggaaggacggagaagggctacactactgagtgcccgacaagggatgatgagtgcacgtggggatttcctgaactatgcgctgtcactgatgcgctctcacaacgatgaacactccgatgtactgccggtgcttgatgtgtgctcactgaaacacgtcgcatacgtcttccaggccctaatctattggattaaggctatgaatcaacaaactaccctagacacgccccagttggagcgaaagcgcaccagagagcttcttgaacttggaatcgacaacgaggattccgaacatgagaacgacgatgacaccaatcagtcagcgaccttgaatgacaaggacgatgacagtctccctgctgaaacgggccaaaatcatcctttcttcaggcggtcagacagcatgacatttttaggatgcattcctcccaaccctttcgaagttcccctggcagaggctattccactggcagatcagccccatctgttgcagcctaacgcacggaaagaggacctgttcggtagaccctcccaaggactgtattcatcctcagccagtagcggtaaatgcctgatggaagtaactgttgatagaaattgtctcgaggtcctgcccacaaagatgtcgtacgccgctaaccttaaaaacgtgatgaatatgcagaaccgacagaagaaggagggtgaggaacagcccgtgctgcccgaggaaactgaatcttcaaaacctggccctagcgcccatgacctcgcggctcagttgaaaagctctctgctggcggagattggtctgaccgaaagtgagggtccaccgctcacatcgttccggccacagtgtagctttatgggcatggtgatttcccatgatatgctgctgggcaggtggcgtctatcacttgagcttttcggaagagtgtttatggaggacgtgggtgcagagcctggatcgatcctgactgagctggggggtttcgaggtgaaggaatctaagttccgaagggagatggaaaagctgagaaatcaacagtcaagggacctgtcgctcgaagtcgaccgggatcgggacctcttgattcagcagacgatgagacagttgaacaaccactttggacgcaggtgcgccaccacccctatggccgtccacagggtgaaagtgacattcaaggacgagccgggtgaggggtccggggtagcccgtagtttctacaccgccatcgcacaggcgtttttgtcaaatgagaaactccccaacctggagtgtattcagaatgcaaataagggcacccacacctcgctaatgcagcggctcagaaaccggggtgaacgcgacagagagcgcgagagggagcgtgagatgagacgatcctctgggcttcgcgctgggagtcgaagagaccgggacagagactttagacggcagcttagcatagacacacggccattccgtcctgcctctgaaggtaacccttcggatgaccctgagccactgcctgcccatcgccaagccctgggggagagattgtatccaagggttcaggccatgcagccagcatttgcctctaaaatcactggcatgttgctggaactgtccccagcacagttgctcttactactggctagcgaggattcactccgcgcaagagtggatgaagccatggaactgatcattgctcacgggagggagaatggcgcagattctatcctggacttgggattagtagattcttctgagaaagtccaggagaatagaaagcgccacggatcttcccggtctgttgtagacatggatttagacgacacagacgatggcgacgataatgcccctctgttttatcagcccggtaagagaggattctacacaccacgtccgggtaagaacactgaggcaagactgaactgtttcagaaacatcggtagaatcttaggcctgtgcttgctgcaaaacgaactgtgtcctataacactgaaccgccacgttatcaaagttctgcttggcagaaaggttaactggcacgattttgcattcttcgaccctgtgatgtatgagtcactccggcagctcatcctggctagtcagagctccgacgcagacgccgtattcagcgccatggaccttgcgtttgccattgacctctgcaaggaagagggaggcggacaggttgagctgattcctaacggggttaatatccccgttacaccacagaacgtgtacgagtacgtcagaaaatacgctgagcatagaatgctcgtcgtggcggagcagcccctccacgcgatgcgcaagggcctgctggatgtgcttcccaaaaacagcttggaagacctcaccgcggaagatttcagattactcgtgaatgggtgtggagaggtgaacgtgcagatgctgatcagctttacatcgttcaatgatgagtctggggagaacgccgaaaaactgctccagtttaaaagatggttctggtcaatcgtcgagaagatgagtatgacggagcggcaggacctggtatacttctggacgtcatctccttctctgcctgccagcgaggagggtttccagccaatgcctagtattacgattaggccccctgacgatcagcacctgcccacagcgaatacatgtatctctcgtctctatgtgcccctgtactcatctaagcagattctgaaacagaagcttctgcttgcaatcaaaactaaaaatttcggatttgtgta

SEQ ID NO: 24791 - DNA, 1593 bp, Artificial Sequence
  Description of Artificial Sequence: Synthetic coding sequence
atggaagacgattcactgtatctgggtggagagtggcagttcaaccatttttctaaacttaccagctcacgccctgatgccgcatttgctgagatccagcgtaccagcctgccggagaagtctcccctgtcctccgaggcgagggtggacctctgcgatgacctggcacctgtggcacgccagctggcccctcgcaagaaactgccactatcctcaagacgcccagcagccgtgggagccggtctgcagaatatgggaaatacctgttacgagaatgcgagcctgcagtgcttgacatatactcctccactcgctaactacatgctcagcagggaacactcccagacctgtcaaagacctaagtgctgcatgctctgtaccatgcaggctcatatcacttgggcactccactcacctggccacgtgatccagccttcacaggctctagctgcaggattccatagaggaaaacaagaagacgcccatgaattcctgatgttcaccgtggacgcaatgaaaaaggcatgtctccccggtcataagcaagttgatcatcactctaaggacacaactttgatccatcagatcttcgggggatgctggcggtcacaaataaagtgtctgcactgtcatggcatcagcgacaccttcgacccttatttggatatcgccctcgatattcaggccgcacagagtgtgaagcaagctctcgagcagcttgtaaaacctgaagaactgaacggggagaacgcttatcattgtggcctgtgtctacaaagggctccagctagcaaaacgcttacgctgcacacaagcgcaaaggtgctgatccttgtgttaaaacgcttcagcgatgtgaccggtaacaaactggccaaaaatgtacagtatcccgaatgtttagacatgcagccctacatgtcccaacagaacactgggcctttagtctacgtgctgtacgctgttttggtccatgcgggttggtcctgccacgatggccattacttttcatacgtgaaagctcaggaggggcagtggtacaaaatggatgatgccaaggttacagcatgtagtatcacaagtgtattgagtcagcaggcctacgtcctcttctatatacaaaagagcgagtgggagcgacattctgaatccgtgagtcgcggacgagagcctcgcgcattgggagcagaagatacggaccgacgcgcaacacagggggagctgaagcgggaccacccatgcttacaggccccagagctagacgaaaggctcgtggagcgagcaactcaggagagcacacttgaccactggaaatttccacaagagcagaacaaaactaaaccagaatttaatgttcggaaagttgaaggtaccctcccacccaatgttttggtaatccaccagtcaaagtacaagtgtgggatgaaaaatcaccatcccgaacagcagagcagcttactcaatttatcgtcaaccacgcggactgaccaggagtctgtcaataccggaaccttggctagtctacagggaagaacacggaggagcaagggaaagaataaacactcgaaaagagcgctcctggtatgccagtag

SEQ ID NO: 24792 - DNA, 2940 bp, Artificial Sequence
  Description of Artificial Sequence: Synthetic coding sequence
atgtcccctctaaagatacacggacccatcaggattcgctcaatgcagactggcattacgaaatggaaggagggatcattcgagattgtagagaaagaaaataaagtatctctggtagtgcattacaacacaggcggaatccccagaattttccaactgagtcacaacatcaagaatgtagtcttgcgccctagcggggcaaagcagagcagacttatgctgacgctccaggacaattcattcttgagcatcgacaaagtccccagtaaagatgccgaagaaatgcgcctctttctagatgccgtacatcagaatagacttcccgctgcaatgaaaccgtcacaggggtccggcagttttggggctatcctggggagcagaactagtcaaaaagaaacttcaagacagttgtcttattcagacaatcaggctagcgccaaacggggttccttggaaaccaaagatgacattccgttcagaaaggttcttgggaatccgggtagaggtagcatcaagacagtggcgggatccggaatcgcccgaacaattccaagccttacttccacttccacaccgcttcgaagcggacttcttgaaaacagaacagaaaaaaggaagcggatgatatcaaccggaagtgaattgaacgaagattatcccaaggaaaatgacagctcttccaacaataaagctatgaccgacccttctcgcaagtacctgacctcctcgcgggaaaagcagttgagtctgaaacagtcagaggaaaacaggacctccggtctcttgcccctgcagtcctctagcttttacggctccagggcaggcagcaaggagcatagtagcggcggaactaacttagatcggaccaatgtttccagccagacaccctcagctaaacgttccctgggtttcctcccacagcctgttcctctcagcgtgaagaagctaagatgtaatcaggactacaccgggtggaacaaacctcgtgtacctttgagcagccatcagcagcagcagcttcagggcttttctaacttgggaaacacatgttacatgaatgccatactccagagcctcttttctttgcaatctttcgcgaatgacctcctgaagcaggggatcccctggaagaagataccgttgaacgctctcatcaggcgatttgcacacctacttgtgaaaaaagatatctgcaactccgaaaccaaaaaggatctgctgaaaaaagtcaagaatgcaataagtgcaaccgccgaacgcttcagcgggtatatgcagaacgatgctcatgagtttctgtcccagtgtcttgatcagctgaaagaggacatggagaaattaaataaaacctggaaaactgaaccagtatcgggcgaggagaacagcccagacatctccgcaaccagggcatatacctgtccggtcatcacaaacctcgagtttgaggttcaacactcaatcatctgtaaagcttgcggggaaatcatccccaagagggaacagttcaacgatctgagtatcgacttgcccaggagaaagaaaccattaccacctcgaagcattcaggacagcctggacctttttttccgcgctgaagagttagaatattcctgcgagaagtgtgggggtaagtgcgccttagtccgtcacaagtttaatcgcctcccacgcgtcttgatcctgcacctgaagcggtacagcttcaacgtggctctgagcttgaacaataaaatcggacagcaggtgataatccccaggtatctcaccctatcatctcattgcactgagaacaccaagcctccatttaccctcggctggtccgcccatatggcaatttctagacccctaaaggctagtcagatggtgaacagttgcattacatcaccctcgactccctccaagaaatttactttcaaatcaaagagtagcttagccctgtgtctggattccgacagtgaggatgagctgaagagatcggtggcactatcacagcgattatgtgagatgcttgggaacgagcaacagcaagaagacctggagaaagattctaagctgtgccctatcgagccagacaaaagcgagttggagaattctggattcgatcgcatgtctgaagaagagctgctggcagctgttctggaaataagcaagcgagatgccagcccctctttaagccatgaagatgatgataagcctacatcaagtcctgacactggatttgccgaggatgacatacaagaaatgccggagaaccctgacacgatggagaccgagaaacctaaaaccatcaccgagctggatccagcgtcctttacagaaattaccaaggattgcgatgaaaacaaggaaaataagaccccggagggctctcagggggaggtggactggctacagcaatacgatatggagcgcgagagagaggagcaggagctgcagcaggctcttgcccagtctctccaggagcaggaagcatgggagcagaaagaagacgacgatctgaagcgtgcaaccgagctgtcactgcaggaattcaataattcttttgttgatgcactggggtccgatgaagacagtgggaatgaggacgtgtttgacatggagtacactgaggcagaggcagaagaacttaaacggaatgcggagactgggaatcttcctcactcttatcggctgataagcgttgtttcacatattggctctacatcgtcaagcggccattacatctcagatgtatatgatataaaaaagcaggcctggttcacttataacgacctcgaagtttctaagatccaagaagccgctgttcagagcgatcgggacagaagcggatacatatttttctatatgcacaaggagatctttgacgagctcctggagactgaaaagaattctcagtcactatccaccgaggtcggaaagacaaccaggcaggccctgtag

SEQ ID NO: 24793 - DNA, 2940 bp, Artificial Sequence
  Description of Artificial Sequence: Synthetic coding sequence
atgtccccattgaaaattcacgggcctatcaggatccgttccatgcagaccggcatcacgaaatggaaggaaggatcatttgagatcgtggagaaggagaataaggtatctcttgtggtgcactataacacaggcggaatcccgcgtatcttccagctctcccataacatcaaaaatgttgtgttgaggccctcaggcgctaaacagtctcgtctcatgctgacgctgcaggacaatagtttcctgagcatcgataaggtgccttctaaggacgcagaggaaatgaggctgttcctcgatgcagtgcaccagaatcgcctcccagccgctatgaagccctcgcagggttctggatcttttggggcaatcttggggtcaagaacctctcaaaaggagacaagtcgacagctcagttactccgataaccaggcaagcgcaaagaggggatcactggagactaaggacgatattccctttcgtaaagtactggggaatcctgggagggggagcataaagaccgtcgccggatcaggaatagccaggacgatcccatcattgactagtacctcgacaccccttagatccgggctgctggaaaatagaaccgagaaaagaaaacgcatgataagtacaggatccgaactcaatgaggattaccccaaagaaaatgacagctccagtaacaataaggcgatgacagaccccagtcggaagtacctgacctcctcccgcgagaaacagctgtcactgaagcagagcgaggaaaatcgaaccagcggcctgcttcccttgcagtcatccagcttttacggttccagagccggatctaaggagcactcctctggcggaactaacttggatcggaccaacgtaagctcccaaacacctagcgctaagcgttcgctagggtttctgccccagcctgttcccctatcagttaagaaacttaggtgtaaccaggattatactgggtggaataaacctcgtgttccccttagctctcatcagcaacagcagctgcaaggctttagtaaccttgggaacacttgttacatgaatgccatactgcagtcactattctccctccagtcattcgctaatgatttattgaagcagggaatcccatggaagaagattccgcttaatgccctgattcggcgttttgcccatctcttagtgaagaaagatatttgcaactccgagaccaagaaggacctgctcaagaaagttaagaatgccatatccgccacagctgaaaggtttagcgggtacatgcaaaatgatgcgcacgagttcctttcacagtgcctggaccaattgaaggaggacatggagaagctcaacaaaacatggaagaccgagcccgtaagcggagaagagaacagccccgatatctcagccactcgcgcatacacatgcccagtgataacaaatttagagtttgaggtgcaacattctattatttgcaaggcctgcggtgagatcatcccaaagcgggaacaatttaatgatctgagtatcgatctcccaaggagaaagaagcccctgcctccaagaagcattcaggacagtctagatctgttctttcgcgcagaggaacttgagtatagctgcgagaaatgcgggggtaagtgtgctctcgtcaggcacaagttcaaccgtttaccgagggttcttattttgcacttgaagagatactctttcaatgtcgcgttgtctctgaacaataagatcggccaacaggtgatcataccccgttatctaaccctttctagtcactgtacagagaacaccaagccaccctttacactcggctggagcgcgcacatggctataagcagaccccttaaagcctcacaaatggtcaactcatgcattacctccccaagtacgccaagcaaaaagttcacctttaaaagtaaatcctcactagcactgtgtctggactcagactctgaggacgagctgaagaggtccgtcgccctctctcaaaggctgtgtgagatgctcggaaatgagcaacagcaagaagatctggagaaggactccaagctgtgtccgattgaacctgacaagtcagaactcgagaattctgggtttgacagaatgtcggaggaagagcttctcgccgctgtgctggagatctccaaaagagacgcaagcccctccctgagccacgaggacgacgataaaccaacatcctctcctgacacgggatttgcggaagatgacatccaggagatgcccgaaaaccctgacacgatggagactgagaagcccaagactatcacagaattggacccggcttcttttacagagattacaaaggattgcgatgagaacaaggagaacaagacgccagaggggagtcaaggtgaggtcgactggctgcaacagtatgatatggagagagaaagagaggaacaggagctgcagcaagctttagctcagagccttcaggagcaggaagcctgggaacagaaggaggacgacgatctgaaaagggctaccgagctgagcctgcaggagtttaacaatagcttcgtagacgcgctgggttctgacgaggacagcgggaatgaggacgttttcgatatggaatataccgaggcagaagccgaggaactaaaacgtaacgccgagactggcaatctacctcatagctaccgcctgatcagcgtggtgagccatatcgggtcaacctcctccagtggtcactacatcagtgatgtatatgatattaagaagcaggcttggttcacctacaatgatctggaggtctctaagatacaagaagccgctgtgcagtcagaccgcgatcgttctggatatatctttttttatatgcacaaggagatctttgatgagctgctggagacagaaaaaaacagtcagtcactaagcaccgaagtggggaaaaccaccagacaggctctttag

SEQ ID NO: 24794 - DNA, 2940 bp, Artificial Sequence
  Description of Artificial Sequence: Synthetic coding sequence
atgtcccccctgaagattcacggtcccataagaattcgttctatgcagacaggtatcactaagtggaaggaaggaagttttgaaattgtggaaaaggaaaataaagtcagtctcgtggtgcattacaacaccggcggaatcccccgtatctttcagctgagtcataacataaagaatgtcgttctccgtccctccggagcaaagcagagccggttaatgctgaccttgcaggataattccttcctctcaatagacaaggtccctagcaaggatgctgaggaaatgcggcttttcctcgacgcggtgcaccagaataggctcccagcggcaatgaaaccttcacaaggaagtggctccttcggcgcaattctaggcagtagaacctcccagaaggaaacaagtaggcagctctcttacagcgacaaccaggcttcggccaaaagaggatcactggagaccaaggatgacataccgtttcggaaagtgctgggcaaccccggaaggggttcaattaaaacagtcgccggatctggaatcgctaggaccatcccaagcttgacatccacgagcacacctcttcggagtgggctgttagagaataggacagagaagcggaagcgtatgatctccaccggatcagagctcaatgaagattaccccaaagagaatgactctagcagcaataacaaagccatgacagacccctcgagaaaatacctaacaagttctcgtgagaagcagctgagcctcaagcaatccgaagaaaatagaacatctggcctcttgcctcttcagagttcatcattctacgggtctagggccggatccaaagagcactcatcgggaggaaccaacctggataggaccaatgtgagctctcagaccccaagcgcgaagcggtctctcggatttctaccccagccggtgcccttgtcagtgaaaaagcttcgctgcaaccaggactacacaggttggaataagcctcgagtgcctctgtcgtctcatcagcagcaacagctccagggtttttcaaacctagggaacacttgttacatgaacgctattctgcagtcgctgttctctctccagagcttcgctaatgacctgctgaaacaaggtatcccctggaagaagataccgctcaacgcgctgatacgcaggttcgcccatctgctggtgaagaaggacatttgtaactcagaaactaagaaagatctactgaagaaggtgaagaacgcaatttccgccactgcagagcgtttcagcggctatatgcagaatgatgcacatgagttcctgagtcagtgtcttgaccagctcaaagaggatatggagaaactgaataagacttggaagaccgaaccggtgtccggcgaggaaaacagccctgatatcagtgctactcgtgcctatacctgccctgtgattaccaacctcgagtttgaagtgcagcactccattatatgtaaggcttgtggggagattattccaaagagggaacagttcaatgacctcagtatagacctaccgcgacgcaagaaaccactacccccaaggagcattcaagactctctggacctgtttttcagagctgaggaactcgaatacagttgcgagaagtgtggtggtaagtgcgccctggtccggcacaagttcaacaggttacccagagtgctcatccttcaccttaagcgctatagtttcaatgttgcactcagtctgaacaataagataggccagcaggtaattatccctagatacctgacgttatcatcccattgtactgagaacacgaagcccccatttaccctgggttggtccgcccacatggctatctcacgcccactgaaagctagccagatggtgaacagttgcatcacctcaccaagtaccccttccaagaagttcacatttaagtcaaaaagcagcctcgccctgtgtctggactctgacagcgaagatgagcttaagcgcagcgttgccctcagtcagagattatgcgagatgctcggcaacgaacagcagcaggaggatcttgagaaagattctaagttgtgcccgattgaaccagacaagtccgagctggagaattccggtttcgatcgcatgagtgaagaagaactgctggctgccgtgctggaaatctcaaaaagagacgcctctccctcactgagtcatgaagacgatgataaaccgaccagctcccccgatactggattcgcagaagacgatatccaagagatgcccgaaaaccccgacacgatggaaaccgaaaagccaaagaccataaccgaactggatcctgcctcattcactgagatcactaaggactgcgatgaaaataaggaaaataaaactcctgagggaagccagggagaggtagactggctccagcagtacgatatggagagggagcgtgaggagcaggagctgcagcaagcactggctcagtctctgcaggaacaggaggcctgggaacaaaaggaggatgacgaccttaaacgcgctaccgaactctctctgcaggagttcaacaattcatttgtagacgcattgggatcggacgaggactccgggaatgaggatgtcttcgatatggagtacactgaggcagaagcagaggagctgaaacgtaatgccgagacaggtaaccttccccacagctatcgactgatatcagtggttagccatatcggatccacttcctccagcggccactacatatctgacgtgtatgacatcaagaagcaggcatggtttacatataacgaccttgaggtgagcaaaattcaggaggccgctgtgcagtccgatagggatcggtccggctacattttcttctacatgcacaaggagattttcgacgaattgctcgaaacagaaaagaattcccagagtctcagcaccgaggtggggaagaccacaaggcaggctttgtag

SEQ ID NO: 24795 - DNA, 462 bp, Artificial Sequence
  Description of Artificial Sequence: Synthetic coding sequence
atggcagagctcccccataggatcattaaggagacacaaagacttctggctgagcctgtgcccggtatcaaagctgagccagacgagtccaatgcccgttacttccacgtggtgatcgccggagaaagcaaagactctcctttcgaaggtgggaccttcaaaagggagctcctcctagccgaggagtatcctatggctgcacccaaagttagattcatgacaaagatttaccatcctaacgttgataaactggagagaatcagtcttgatatcttgaaagacaagtggtctcccgctctccaaattcgtacagtcctgctaagcatccaggcgttactcaatgccccaaacccagatgaccccctagcaaacgacgtcgttgagcagtggaagacaaacgaggcccaggccattgagacagcacgcgcatggaccaggctttacgccatgaattcaatttag

SEQ ID NO: 24796 - DNA, 1350 bp, Artificial Sequence
  Description of Artificial Sequence: Synthetic coding sequence
atggctgacggagaggagccaatggcggttgatggaggatgtggagatactggcgactgggaaggccgttggaaccacgttaaaaagtttcttgaacgctccggcccatttacacaccctgatttcgagccttccaccgagtctttacagtttctgctggacacttgcaaggtcctggtcattggagccggaggactgggttgcgagctgctgaagaatctagcactgagcggtttccgccagatacatgtgatcgacatggacaccatcgacgtgtctaatcttaaccggcagttccttttccgacctaaagatatcggtcggcctaaggccgaggtcgctgctgagttcctcaatgatcgggttcccaattgtaatgtggtcccacactttaacaaaattcaagatttcaacgacacattctatcggcagtttcatataatcgtatgtgggttggatagcataattgcccgacggtggatcaatggaatgctgattagtctcctgaattatgaggatggagtgctcgacccaagttctattgtgccactcattgatggcggtaccgaggggtttaaaggcaacgcgagggttattttgccaggtatgactgcatgtatcgagtgtaccttagaactttacccccctcaagttaatttcccaatgtgtaccattgctagcatgcccaggctacccgagcattgtatcgaatatgtgaggatgctgcagtggcctaaagaacagcccttcggagagggtgtgccactggacggcgatgatcccgagcatatccaatggattttccagaaaagtctggagcgcgcttctcaatacaatatccgtggtgtaacttatcgccttacacaaggagttgtgaagagaataattccagccgttgcgtccaccaatgctgtcattgccgctgtctgtgctacagaggtcttcaaaattgcaactagcgcctatatcccactcaacaactatctcgtgtttaatgatgtggacgggctctacacctacacctttgaagctgagaggaaggaaaactgtccagcctgcagccagctgccccagaacatccaatttagcccaagcgccaagctgcaggaggtcctagactatctgactaattccgcatcacttcagatgaaatcaccagccattactgccactctggaggggaagaatcgcaccctatatttgcaatccgtaacgagcatcgaagagcgtacccgcccaaacctgagtaagaccctgaaagagctgggcttggtcgacgggcaggagctggccgtggccgatgtgaccactccacagacagtcttatttaagctacattttacgtcatag

SEQ ID NO: 24797 - DNA, 1392 bp, Artificial Sequence
  Description of Artificial Sequence: Synthetic coding sequence
atggctgacggagaggagccagaaaaaaagaggcggaggatagaggagttgctggccgaaaaaatggccgtggatggaggatgtggggacaccggcgactgggagggccgatggaatcacgtgaaaaagtttctcgaacgctccggcccatttacccatcccgatttcgaaccttcgaccgagtctctgcaattcttactggacacctgcaaagtcctggtgatcggggcaggcggtctgggatgtgagctgcttaagaatctggcactctctggctttcggcagattcacgtgatcgatatggacactatagatgtcagcaaccttaacaggcagttcctgttccggcctaaggacataggcaggccaaaggcagaagtcgcggctgagttcttaaatgaccgtgtgccaaattgcaacgttgtgccgcactttaacaaaattcaggactttaatgacaccttttacagacagttccacatcatcgtttgtgggcttgacagcatcattgcgaggcgatggattaatggtatgctgatatccctcctgaactacgaggacggggtgttggatccttcaagtatagtccccctcatcgacggaggtacagaagggttcaaaggtaacgcgagagtgatacttcccggaatgactgcctgtatcgaatgcacactggaattgtacccaccccaggtgaatttcccaatgtgtacaatcgcgagtatgccgcgactgcctgagcattgtattgagtatgtgcgcatgctgcaatggcccaaggaacaaccctttggcgagggagtgcccctcgatggcgatgatccagagcacatccagtggatctttcagaagtcgctcgaaagagcatctcagtataatatcaggggcgtgacttatagactgacacaaggagtggtcaagaggattattccagctgttgccagcactaatgccgtgatcgctgctgtgtgcgccactgaagtcttcaagatagctacttccgcctatataccgctgaacaattatctggtgtttaacgacgtcgatgggctctatacttacacgtttgaggcggagcgaaaagagaactgcccagcttgcagccagttaccccagaatattcaattcagcccttcggccaagctccaagaggtgctggattatctgactaacagtgccagcttgcagatgaagtccccagccatcactgcaacgctggagggaaagaataggaccctctaccttcagtctgttacatcaatcgaagaaaggaccagacccaatctctccaagacgttaaaggagctgggcctggtggatggtcaagagctcgcagtcgctgatgttaccacgccacaaaccgtgctttttaagctgcacttcacatcctag

SEQ ID NO: 24798 - DNA, 861 bp, Artificial Sequence
  Description of Artificial Sequence: Synthetic coding sequence
atgctgatctccctcttaaactacgaagatggagttctggacccctcatccattgtgccattaattgatggcggtactgagggatttaagggcaacgcacgagtgattctgcctggcatgacagcttgcatagagtgtacattggagctctacccaccccaggtgaatttccctatgtgtacgattgcctcaatgcctcggctccctgagcactgtatcgagtacgtgcggatgctgcagtggcccaaggagcagcctttcggcgagggcgtccccctagacggcgatgaccccgagcacattcagtggatctttcagaagtccctggagcgcgctagccagtacaacatacgaggcgttacttatcggctgacccagggtgtggtgaaacggattattccagccgtggccagcacaaacgctgtgatagccgctgtttgtgccactgaggtgttcaagatcgccactagtgcatatatacccctgaacaactatctggtgtttaacgacgtggacggtctgtacacctacacctttgaggcggaacgtaaagaaaactgccctgcctgttcccagttacctcagaacattcagtttagccccagcgctaaactgcaagaagtactcgactatctcaccaactcagcgtccctccagatgaaatctccggctatcacagcaactctggaaggcaaaaaccgtactctgtacctacaaagcgtcacttcaatcgaagagcgcacccggcctaacctgtctaagactctgaaggaattggggctcgtggacggccaggaattagccgtggccgacgtgacgacgccacagacagttctgttcaaactgcattttacaagttag

SEQ ID NO: 24799 - DNA, 2409 bp, Artificial Sequence
  Description of Artificial Sequence: Synthetic coding sequence
atgtggatccaggtgcggaccattgatggaagcaaaacatgcacaatcgaggacgtatccagaaaagccaccatcgaggaactacgcgaaagggtgtgggccctttttgacgtgcgacccgagtgtcaaaggctgttttatcgaggcaagcagctagaaaatggctacaccctatttgattatgatgtcggactcaacgacatcatacagttgttggtgcgacccgatccagaccatctcccaggaactagtacacaaatagaagccaaaccctgctcgaatagtccccctaaggtgaaaaaggctccccgagtcgggccatcaaatcagccaagcacttccgccagggctagactcattgatcccggatttggaatatataaagtgaatgaactggtggacgcaagggacgtcgggctaggggcatggtttgaggcacacatccatagtgtgaccagagcatccgacggccaaagtcgcggaaaaaccccccttaagaacgggagctcttgcaagaggactaacgggaacatcaagcataagagtaaggagaacacgaacaagctggacagcgtaccctccacctccaatagcgactgcgtcgccgctgatgaagatgttatttatcatatccaatacgatgagtacccggaatctggcaccctggaaatgaacgttaaagatcttcggccacgagcacgaacaattctcaagtggaacgagctgaatgtgggagacgttgtcatggtgaattataacgtggaatcaccagggcagcggggattctggttcgatgctgagatcacaactctgaaaaccataagcagaacaaaaaaggagctacgcgtgaagatctttctcggcggatctgaaggcactctgaacgactgtaaaatcatctccgtggacgagatctttaagatcgagcgccctggggctcatcccctgtccttcgccgatggaaagtttctgcgcaggaatgatcctgagtgcgacctctgtggtggcgatccggaaaagaagtgtcactcttgctcatgccgtgtatgcggcggaaagcatgagcccaacatgcagctgctttgtgatgagtgcaacgttgcttatcacatctattgtcttaatccccctctcgataaagtgccagaagaggagtattggtactgtccgtcttgtaagactgattcatccgaagtggttaaggccggtgagaggcttaaaatgtccaaaaagaaagcaaaaatgccatccgcttctacagagtctaggcgtgattgggggcgtggcatggcatgcgtcggcagaacccgcgaatgcaccatcgtgcccagtaatcattacggtccaattcccggtattcctgtagggtcaacctggcgctttcgcgtgcaggtgtcagaggccggtgtccaccgccctcacgttggaggtatccatggcagatccaacgatggcgcttacagcctcgtacttgccggaggcttcgccgatgaggtggaccgcggagacgagtttacttacacaggctccggcggaaaaaacctggccggaaataaacgtattggcgctccttccgcagatcaaacccttacaaacatgaatcgggctctggccctcaactgcgacgcaccactggatgacaagattggggcagaaagtaggaactggcgcgctggcaaacctgtcagggtcatccgttccttcaaaggcagaaaaatatccaaatacgcgccagaagaaggaaaccggtatgacggaatctacaaagtggtgaaatattggcctgaaatctcgtcttcacacggcttccttgtgtggcgctatcttctacgtcgggatgatgtcgagccggcaccatggacaagcgagggcatcgaaagaagtcgcagattgtgcctcagactgcagtatccagctggctacccttccgataaggagggcaaaaaacctaagggtcaatccaagaagcagcctagcgggacgaccaagagaccgatatctgatgacgactgtccttccgcctctaaggtgtacaaagcttctgactcagccgaggccattgaggcttttcagttaacgcctcagcagcagcatctgatcagagaggactgccagaatcagaagttgtgggatgaggtgctgagtcacctggtagaaggccctaactttctgaagaagctagagcagagcttcatgtgcgtctgttgccaggagttggtttatcagcctgttactaccgaatgcttccataatgtgtgcaaagactgcctccagaggtcattcaaggctcaggtgttctcctgtccggcatgtagacacgatcttgggcagaactatattatgataccaaacgaaatactgcagacccttctcgacttgttcttccccggttatagcaaaggccgttag

SEQ ID NO: 24800 - DNA, 411 bp, Artificial Sequence
  Description of Artificial Sequence: Synthetic coding sequence
atgtggattcaggttcgtactattgacggatctaagacatgtacaattgaagatgtgtccagaaaagccacaattgaggagcttagggaacgcgtatgggctctgtttgacgtgaggccagaatgccaacgcctgttttatcgcggtaaacagctggagaacggatataccctctttgattacgatgtgggcctgaatgacatcattcagctcctggttaggcccgatcccgaccatttgcccggtacaagcacccagatagaagccaagccatgttctaattctccacccaaagtgaagaaagcccctcgggtcggcccaagcaaccagccttctactagtgccagagcccgtttaatcgatcctggcttcggtatctacaaagggctggcattaagccctcgcctgtag

SEQ ID NO: 24801 - DNA, 339 bp, Artificial Sequence
  Description of Artificial Sequence: Synthetic coding sequence
atgaacgtgaaagatctcaggcccagagcgaggacaatcttaaagtggaacgaattaaatgttggagacgttgtcatggtgaattataatgtcgaaagtcccggacaacgtggattttggtttgatgctgaaatcacaacactgaaaacaatttccagaaccaaaaaggagctgagggtcaagatcttccttggaggttccgaaggaacactgaatgactgcaagatcattagcgtcgacgagatctttaagattgaaaggcctggcgctcaccccttgtcatttgcggatggcaaatttctcaggcgcaacgatcccgagtgcgatctctgcggctag

SEQ ID NO: 24802 - DNA, 897 bp, Artificial Sequence
  Description of Artificial Sequence: Synthetic coding sequence
atggggcctaaggacagtgctaagtgcctgcatcggggaccacagcctagccattgggcagccggtgacggtccaacacaagagcggtgcggccctcgcagcctgggctcaccagttctagggcttgatacctgtcgggcatgggatcacgtagacggacagatcttgggccagctgcgacctctcactgaagaggaagaggaagagggtgcaggggctaccctatctcggggacccgcattcccaggaatgggctcagaagagttgaggctggccagcttctacgattggccgctgaccgccgaagtccctcccgaactgttggccgctgcagggttctttcacaccggacaccaagacaaggtccgatgctttttctgctacggcggactacagtcctggaaacgaggcgacgacccctggacggaacatgcaaagtggtttccttcctgccagtttctcctgcggtcgaagggccgagactttgtgcactcagtccaggaaactcacagccagttactgggtagctgggacccgtgggaggagccagaggatgctgcacccgtcgcaccctctgtgcccgcttccggatatcctgagctccctacaccccgaagggaagtacagagcgagtccgcccaggagcctggaggcgtaagtcctgccgaggctcagagggcctggtgggttctggagccccctggagctcgggatgttgaggctcagctgcgcagactgcaggaggagagaacctgcaaggtgtgtctcgatcgggcagttagtatagtgttcgtgccgtgtggtcatttggtatgtgctgagtgtgcccctggactacaactgtgccctatttgcagggctcctgttcgttcccgcgtgcgcacattcctctcttag

SEQ ID NO: 24803 - DNA, 1464 bp, Artificial Sequence
  Description of Artificial Sequence: Synthetic coding sequence
atggttatcaacttatgcctgccacaatttaggcccaggatccactgcaacaaaatctcagccgacggttatgaagtggagaaccttattagcgaagatctgacaaagcggtctcatgggttcaggaccgagtatttcatcaaaccccctgtttacgttacggtaagctttccctttaatgtggagatttgccgcattaacattgaccttaccgccggaggagggcaaaacgtgaccggacttgaaatgtacacatccgcctcttctagtagggttagctggaatactccccagtgtcgaacccttgggcctgcagagcctagtgtcccagataaggaagcttttacactcgtcgggaaagtgcttctcaaaaaccaaagccaggtggtgttctcccataggggattcaaggctcggccacccttcggagccatggaagccaccttgccctcccccgcagtggtggcccaggaactttggaataagggagcactgtcactatcacacgttgcccacttgagaatctgtatcacgcacgtgactggtggcggaatcccgtgtatcaagagactggaagtttggggtcagcctgcgaaaacctgttctcaggaagtaatcgacagcatcttgctggtaacaagtgagaaccttccccaagatgtcgccctgcaggcgccagctctcccaatggaatctgactgcgatcctggcgaccagcctgagtcgcagcaagctcctagcagcctccaaaagttggcggagatcatccaggatgtgccagaagaatttcttgacccaatcacactggagatcatgccctgtcctatgctcctgccctctggaaaagttattgaccagagcaccttggaaaaatgcaacagatccgaagccacatggggacgagtcccttctgacccttttactggagtcgcttttactccacactctcagccattaccacatccttccctgaaggcccgtatcgaccacttcctgttacagcacagcattccgggttgtcacctactcggaagggctcagacagcactcgctgttatacctagcagtatcgttctaccgtctcagaaaaggaagattgaacaagccgagcacgtgcctgattctaatttcggtgtgaacgcctcatgcttttctgctacatctcctctcgtgctgcctacaacaagtgaacatacggccaagaagatgaaagccaccaatgaaccatctctgacacacatggattgttcaaccgaacagcccggaagcatactggggcctgaatgcgccagttgtaaaagagtgtttagcccttatttcaagaaagagccagtctatcagcttccatgtggccatcttctgtgcaggccctgcctcggcgaaaaacagcgatcgctgccaatgacctgtaccgcttgccaacgcccagtggcttctcaggacgtgctccgcgtgcacttttag

SEQ ID NO: 24804 - DNA, 267 bp, Artificial Sequence
  Description of Artificial Sequence: Synthetic coding sequence
atggtcatcaacctgtgcctgcctcaatttcggccaagaatccactgtaacaaaatcagtgccgatggatatgaggtggagaatctgatatcagaggacctaactaagcggagccatgggtttcgcacagaatatttcataaagcctcctgtatacgtgacagtgtcctttccgttcaacgtggaaatatgtcgcatcaatatcgaccttaccgcaggcggtgggcagaatgtcaccggcctggagatgtatacttctgcctcatag

SEQ ID NO: 24805 - DNA, 1605 bp, Artificial Sequence
  Description of Artificial Sequence: Synthetic coding sequence
atggccaggggcttgcaggtaccactgcctaggttggccactggcctgctgcttctgctgtccgtccagccatgggccgaaagcggcaaggtgctggtggtccccactgacgggtcaccttggctgagcatgcgggaggccctgagagaactccatgcgagaggacaccaagcggtggtgcttaccccagaggtgaacatgcacattaaagaggagaagttctttacattaacagcctatgcagttccttggactcagaaggaatttgatcgggtaacactggggtacacccagggttttttcgagactgagcacttgctgaaacgctattcccgaagtatggctataatgaacaacgtaagtttggcactgcaccggtgctgtgtggagttgctgcacaatgaggccctcatcagacacttgaacgcaacaagtttcgacgtggtcctgacagaccccgtcaacctttgcggagcagtccttgccaagtatctgagtatcccagcagtcttcttttggcgttacatcccgtgtgatctcgacttcaagggaacacagtgtcctaatcccagttcctatatccccaaactgctcaccactaattccgaccatatgacttttctccagcgagtgaaaaacatgttgtaccctctggccctgtcttatatttgccacactttcagtgctccgtatgcaagtctagcttcagagttattccaacgagaagtcagtgtggtggacctggtaagctacgccagtgtctggctcttcagaggcgatttcgtgatggattaccctagaccgatcatgcccaatatggtgtttatcggcggtatcaattgtgcaaatgggaagcctctgtcccaggagtttgaggcttacataaacgcttctggcgaacatggtattgtcgtgttctctctcggatcgatggttagcgaaataccggagaagaaagcgatggcaattgctgatgctttgggcaaaatccctcagaccgtgctgtggcgctatactgggacgcgcccatctaacctcgcgaataacaccattctggtaaagtggctcccacagaatgaccttctgggccatccaatgacacgggcattcataacacacgccggatctcatggggtgtatgaaagtatttgtaatggcgtgccaatggtgatgatgcctctctttggagatcagatggacaatgccaagagaatggagaccaaaggcgctggagtgaccctcaacgtactcgagatgaccagtgaggacctcgagaacgctctgaaagctgtgatcaacgataaaagttataaagagaacatcatgcgtctgtctagcctgcacaaagacaggccggtggagccactggacctggccgttttttgggtggagtttgtgatgcggcacaagggcgcaccccacctgcgacctgccgctcacgaccttacctggtaccagtatcactctctagacgttattggtttcctcctcgccgtggtcttaaccgtggccttcatcacatttaagtgttgtgcctacggatatcgcaagtgtctgggaaagaaaggacgggtgaagaaggcgcacaagagcaagacgcattag

SEQ ID NO: 24806 - DNA, 1596 bp, Artificial Sequence
  Description of Artificial Sequence: Synthetic coding sequence
atgatggacggcaggttactcgaacatcctcacgctcagttcggcggatctctcgggggagtcgtcgggtttccctatcccctcggacatcaccatgtttatgaactagcaggacaccagttgcaatcggctgccgctgctgcatccgtgcctttttccatcgacgggctattagggggatcgtgcgccgcagcagcttccgtggtaaaccctacacctctgctacctgcggcatgtggagtgggaggcgacggacaacctttcaagctctctgacagtggtgacccagacaaggaaagtcccggatgtaaaaggaggcggaccagaactaactttacaggatggcagctggaggagctggaaaaagcctttaacgagtcacactacccggatgtctttatgagggaagctctcgcactacgccttgacttggtggaaagcagagtgcaggtctggttccagaatcggcgagccaagtggaggaagaaggagaataccaaaaaaggtcctgggagacccgcacataattcacacccaacgacgtgcagtggtgaacctatggaccctgaagagattgccaggaaagagcttgaaaagatggaaaagaagaagcgcaagcacgagaagaagcttcttaagtctcagggaaggcatctacattctccgggtggcttatctctgcactctgcacccagctccgatagtgattctggtgggggaggccttagcccagaaccccctgaaccaccccctccagctgcaaagggcccaggcgcacatgcatcaggcgcagccggtactgccccagccccacccggtgagcccccagcccctggcacttgtgatcccgctttttatccatcccaaagatccggcgcagggcctcagcctcgccctggcaggccagccgataaggatgccgcatcctgcggtcctggcgcagcagtggcagcagtcgagaggggcgcagccggactccccaaggcaagccctttcagcgttgagtctttactgagcgacagcccacctcggaggaaggctgcctccaacgctgctgcagctgcagccgcaggcctggacttcgctcccggtctgccttgtgctcctagaactcttatcggaaagggtcattttttgctatatcccatcacacagcccctggggtttctggtaccccaggcagctctgaaggggggagctgggctggaaccagccccaaaggatgccccacccgctcctgcagtgcctcctgccccacctgctcaggccagctttggggcattttctgggcctggaggcgctcctgattccgcctttgcgaggcgctctccagatgctgtcgctagtcctggcgcacccgctcctgctcccgctcccttccgagacctagctagcgctgccgctacagaaggtggaggcggtgattgcgccgacgcgggaactgcaggtcccgcacctccgcctccagctccgtcgccgcgaccagggcctaggcccccatcacctgccgaagaacctgccacttgcggggtgcccgagccaggggcagcagctgggccttccccgcctgagggagaagagctggatatggattag

SEQ ID NO: 24807 - DNA, 255 bp, Artificial Sequence
  Description of Artificial Sequence: Synthetic coding sequence
atggcgctctcatcccaaatctgggcggcttgcttactgctacttctcctgcttgcttcactgacatctggctccgtgtttcctcagcaaaccggacagctggcagaattgcagccccaggaccgtgctggcgctagagccagctggatgcctatgtttcaaaggaggaggcgcagagatacccacttcccaatctgcatcttttgttgcggctgctgccatcgaagcaaatgcgggatgtgctgcaaaacttag

SEQ ID NO: 24808 - DNA, 840 bp, Artificial Sequence
  Description of Artificial Sequence: Synthetic coding sequence
atggacatgctcgaccctggtctggacccggcagcctccgcaacagccgctgccgctgctagtcacgacaaagggccagaagcagaggaaggggtggaacttcaggagggcggtgatggaccaggggctgaagagcaaaccgccgtggccattacttctgttcagcaggctgcctttggagatcacaatatccagtaccagtttcgcacagagaccaacggcggacaggccgtgatccagaacccgttctccaacggcggaagccctgcagccgaagccgttagcggcgaggcaaggtttgcttattttcccgcaagctctgtgggcgatacaactgctgtgagtgtccaaaccaccgatcagagcctgcaagctgggggacagttctatgtgatgatgacacctcaggacgtcttgcagactggcacccagcgcacgatagcccctaggacccatccttattccccgaagatcgacgggactagaacccccagagatgagcgtcgtcgcgctcagcataacgaggtggagcgtcgcagacgggataagattaataactggatcgtgcagttgtccaagatcattccagactgtaacgccgacaactctaagacgggtgcctctaagggcggaatcctttctaaggcctgcgattacattagagaactcagacaaacaaaccagagaatgcaggaaacctttaaggaggcggaacgtctgcagatggataatgagctactgagacaacagattgaagaactcaaaaacgagaatgctctgctgagagctcagttgcaacaacacaacttggaaatggtcggcgaggggacccggcagtag

SEQ ID NO: 24809 - DNA, 648 bp, Artificial Sequence
  Description of Artificial Sequence: Synthetic coding sequence
atggacatgctcgaccctgggctggacccagcagcatctgccacagctgctgccgctgcttctcacgataagggaccagaagcagaagaaggggtggagttgcaggagggcggagacggccctggggctgaggaacaaacagcggtcgctattacgtccgtccagcaggccgcttttggtgatcacaatattcaataccagtttcgcactgagacaaacggcggtcagacggggactcagaggacgatcgccccacggacccatccgtactccccgaaaattgatggcacgagaactcccagggacgaacgccgtcgagcccaacataatgaggtggagagaaggcgtagggacaagattaacaattggatagttcagttgtcaaaaatcatccccgactgcaatgcggacaattctaagacaggcgctagtaagggtggaattctgtcaaaagcttgtgactatattagagaattgcggcagacgaatcagagaatgcaggagactttcaaggaggcggagcgtcttcaaatggacaacgaacttctgcgacaacagatagaggaactcaaaaatgagaatgccctgctccgcgctcaacttcagcagcacaatctcgaaatggtcggtgagggtactaggcagtag

SEQ ID NO: 24810 - DNA, 6815 bp, Artificial Sequence
  Description of Artificial Sequence: Synthetic coding sequence
atgggggtgcccaaacgaaaagcctcgggcggacaggacggagcagcttctagcgcaggggctgccaagcgggctagaaaggaggagctgaccggggtgagattcaaggctcagctgaaggaccctcaagggcctggccctgggctggaggctttcgtgtctgctgctaagaagctgccacgtgaggacgtgtatgacgttgtggagggctacatcaaaatttcagtagaatgtgtggagatctttcagctcctgagcggagagaagagacccgaatccgagacgatgctgatttttcaagtgttcgaagctattctgttacgtaccgcgagcgatctatcacatttccacgtggtcggtactaacattgtgaaaaagctgatgaataatcatatgaagctaatatgcgagtccctgtacgcctctggctatcggctcgcgagggcttgtctatcactgatgaccgctatggtcacacaaggcccagaagcagcgagagacgtgtgcagtcactttgacctgaacaaaaagaccctatatactctggttacgaagcgcgatagtaagggcgtctatgatgtgcggcaggcttacgtgcagtttgcgttgagttttctgattgccggagatgattcaactatcgtgcaggtgctcgaggtcaaggagtttattccctgcatctttagcagcggaattaaggaagatagaatttcaacaattaacatcttgctctccacgctgaaaacaaaggtggtccataacaagaatataacaaagacccagaaagtgcgcttctttaccgggcaactcttgaaccacattgccagcctgtacaactggaacgggattacagatgtgaacccagagaacgtgaaggtgagcgccgaagaagcagggaaaaccatggttagggagctggtgcacaattttttgatggatttgtgttgctccttgaagcatggaatcaatttctacgacgcatcattaggaacctttggcagaggagggaatcttactctccttcacttccttctgggtctgaagacagccgcagacgacgatctagtcgccgatttggtggttaacattctgaaagtgtgcccggacctcctgaacaaatacttcaaggaagtcacctttagcttcatacccagagccaaaagcacatggttgaataacatcaaactactcaataagatctacgaggcacaacccgagatatcacgtgctttccagaccagagaatttattcctcttcctcgactgcttgctatggttatggtcacgactgtccccctagtctgtaacaaaagcatgttcacacaagccctgaacctcgatagtacttcggttcgacacaccgccctttccctgatttccgtcatcctcaagcgggctcttaagacggttgatcactgcctcaataaggaagtgtggcaagaatcgggtgtttatactgcagtcatgatggaggagtttgtgcaactgttccgcgaagctctgtcaaaaatactgcccgatttgaataccgtcgtttgggtctggcagtctctaaagaagcaggagacaaagcaggacgacaagaaaggacagaaacggagcgacgggccacctgcggcttgtgatgcccaccaatgtgatgacgctgagaccatattgctcaaagctgtgctgctccaagttatctgtctctatcaaaaagtcgttcctcacgtggttatgcaatataatttcgacttctcaaagctactcaaaggcgtgatttcagaacagggcctcagggaggaggtccctcctatactacagcaccatatgctaaaggtggccctggaactacccgcatctaagtttctgtggctgaaagcgcaggaaggtccagacgccgagataattggtggtgaaaggagcgtattctaccttctgatgaaaatgtttgtaacatccagccacttacagctgaagtccctgaccaaattgcttattatgaagattctacgcgatactggtgtttttgagcatacatggaaagaattggagctgtggttagaacatctagagaataccatggaagaggacaaggaaactgtgattcagttcctggagagaattctgttgacgctcgtagctaacccttacagttacaccgataaagcctcggacttcgtgcaggaggcgagcatgctgcaggctacgatgaccaagcaggaagccgacgatatgtcgattccaatcagtcacatcgatgatgtgctcgacatggtagacgtgctcgtggagggtagtgaggggctagacgaggaaatcggtttcaccctgtcagaagatatgatacttcttacttttccattctccgctgtcgtgcctgcggcactagaggccagaaataagcttctgttagggaccggaaatgaagctgctgagaacgtcgtcacatatcttaccgctgtgcttaccgacttgctccatacacagagggatccgctggccctgtgtctcttactgcaggcatatgacaaactggaacccccatgtctggtcccttgttgccagcagcttagcaggttcaacaggtactattcattatggatccccgaacaggcccgtgaagcttggctgttacaggctcagggaagtcctagtccacccgcacttccccttgcatccagttttactgccctgcttcaagcggcatacgagagtcaggctcttcgcgatgagcacatccaggtgcagctccaggcgacaatgcctcatttgtctatgcagcaggtcctgttagctgcgaagcaggtcctgctgtacctgaggtctaccgtggagaacttcggccaattgggcagaagtgtgggcccaccactgctgcagctgttcctggacttgttgagacggctggtggtgcactgcgagcagctcgacgcccagaatcagcagaggtgcgaagctgctcgggctgaggctgacctattcttagatatggagtccgttgcaagcttagaactggctaacgatcagaccttggaggaagtgctcgtggcaatcctgaggcatccgactctcgaaggatggttcctagccctggagcagcaggctttgcccccacatacgctctctcctgtactcgtcaagctcctggcaactcacttctccgccggtgtcctgcagctcttagctgcctcagcccctattctgcagaatatcggccaactcgggctgctcgcccgatacagcgaagcgatcacacagtccgtgctgaaagagctgcagaacagacgtgcagggccagctacatctccgccaaagacccctccccagttagaggccctgcaagagctgcatccttacatggagggtgcacagttgagagaggtcacattggcacttctgtccctccctgagacacacctggtgacccaacagccgaccaagagccccggtaaggagaggcatctcaacgcccttgggaaaacactggtgcaactcctgacctgctcaccacaggatcagctgcagagcggcgagctgctttggtcttcggagtatgttcgcggactgggcgcactgctgcctaccctggctgtcgatgaactggacacagtgctcctgcacactctccagcgcgatccggttcttgccccagctgtcggggctgacctgctggattactgtctagcaagacgtacacaggctgccctgtctatagcggcattgcttctgcaggagagctgtacccacctcttgtggttcgaacagtggtgcctgcaggcgggtcccggactgggtctgcaaggagacctggacgatttcctccctctgatccacgtgtacctgcagtgtcgcacccggagccatttcacgagacccgctggcgtcagttcagctgtgataccagtgctccgcaaaacgctgtggcgccaactccagtccagactgctttcgaccgatagtccgcctgcaagtgggttgtatcaggagatcttggcacaattggtaccctttgccagagcaaaagatctctccgtgctcatggacagactgccctccctattgcacactccaagtagtcataaacggtggatcgtcgctgatagcatctccgccgcacttgagggatccgcagaggagctctgtgcgtggaggcgtactttactagaatcctgcgtgaaatggctcattgtcagtttttctggaggacagcaagacgacgataacacgcagaaccaagagaaagaaatgttgctccgccttaacgctctgttacacgcacttaatgaggtggaccccggtgattggcagaaattcgtgaaaaaagggctcaagttcaggtaccaggatcacaccttcctgaagatgctgctgacagctgtgcagttattatactcacccgagtcttctgttcgtaccaaactgatccagttaccagtagtctatgtgatgctgatgcagcactcactgtttctgcccacactcctgacctccgatggcgaagagagtccggactctcaagtgaaagaggcattagtagacttgatgctcaccgtcgtagagatgtgtcctagcgtttgtgaatccagccactttgcagtgttactgggggcatacggtgcgactctcagtgtgcttgatcaaaaaatcttgttgctcttgcgggcttacgaacagaataagctaagtttaatcaactttagagtgcttttgtgggggcctgcagccgttgagcaccacaagacctgcagaagtctaggtaggtctctgtggcagcagccttccgtgggggacatcttacggcttctagatagggaccgcatgatgcagaccattttacattttccccagaaccggagactcctgccacccgaggacacccaggagctcattttcaaagataaatcgcgggtcgacctggatgggttgtacgatccctgcttcttgcttcaactgttcagcgagctgactcgccctgaatttgtcgtcgattgccggaaattcttggattctaatgcacttggtctgactgtcacagcattaagcagttacgatccccagatgagggccatcgcttaccatgtattggcagcctattacagtcacctcgagggcgctcgttttcaggagcagtcacagctgctctacttgttggatgtagtgcggaatggaatcagaacacaggatatgcgtctgactttcaccctcgctctcttcattgcaaaggctgccctgcaaatcttgaagcctgaagagcacatgtatctgaaagtgtcaaattttctcctgagccatgagtatctgaatatggacaaggtccctggtttctaccagttcttctattcttccgattttgagcagaagacagagcagaagtgggtcttcggggttctgcgccagggaatcagagacaagcagtgttatgagttgtgcgccaggagggggatatttcatataattctgagcttcttccactcccctttgtgtgatgaagcggcacagaattggatattggaaatactgcagaatgccgctcaagtggctagaagcgcatacgagatcatccgggattactctctcctgacatggatcctgcacatcttggaatccaagtttctcgaaaccccactgctctccaacgtgattagcctgctgcacacactgtgggtaacgaatctgggagacaaagcagttgagtgggaatctcagagactgtgtcaacctagttctcaggagcctgctaaaagactggcactgcatctcgtaaacgaatttctttatgtgctgattgtgttaatgaagcacctgcggcctaccctcgccccagtgcagttgacaaatttttttggcacattggactcagtcctgaggtaccgggctactgtaattcaagccttcagggacatgaatcgcttcacagtgaatgagaccgtcctatctaccaaggatgtgctcgtgctacttcacaagtggagtctcattgaacgtgaccttaaattacaagaggacttacgagccgcaattgagaaggcacaggctagagagctgatgaagatgttaaaggacaagaacaagcccgttatgccagccagagctaaaggacctaggggacgcaagagaagaccaggagaagccgaggaaatggctgacccggaactgatggctagcactctagagacctgtaaggggctcctgaggtccatcctgacttattggagacctgtgatccctggaccagatcccacacaggagccggtggattcagccagccccgagtctgacgcacccggtccagtttacgccgctgcaagtctcgccgtgtcctgggtcctgcggagtgtggctgagcatcccctcagccgcgctgaggctgccggtctcatcggctggctcaagtcccatatcctgccgcacccggtggtggtggctgatcttctaaaggactccgcggtgagatcctccatatttcgcctgtactctagattatgcggcgctgagggcttagcaggcccagtgcaggaggttgcatgcttgtttaatactgtgatgctccaactcgtagcagctcagggcagggcgggatctccctttcaccctgctatggaggccttgagcttgtcatcgttgtctgagaaggatgaagcaacacaggccagtgcagcgttcctggtatctttatacatcaaggatatctggctaggggcacagcggcctgacactttgctcacccacgtgcgcatggtgtgcgaggcagcagacgacgcaccctcctcagaagaggaggctatcgtcgtgctttgcaaggatgccgcatctgccgcttccgacgctta

SEQ ID NO: 24811 - DNA, 4575 bp, Artificial Sequence
  Description of Artificial Sequence: Synthetic coding sequence
atggccgctgtgtatagtggcatttctctgaaactgaagagcaagactacatcttgggaggataagctcaagctggcgcacttcgcgtggatctctcaccaatgcttccttccgaacaaggaacaggtcctcctggactgggcgaggcagtcactcgtagctttctacaagaaaaagctggagttgaaggaggatattgtggaacgcttatggatctatatagataacattctgcattcacgaaaattgcagaacctgctcaagaatggtaaaactattaatctgcagataagtcttgtgaagatcataaacgaaagggtagcggaattctcgttgtctgggtctcagcgaaacatatgtgctgtactgcggtgttgccagggaattctgtcgacaccagctctcgctgtcatctacactgcaaaacaggaactcatggtggctctgctgagccagctttgctggagcgcctgccgccagcccgagggtgcggttgtggctcagttgttcgaagttatccacctggccttaggccactatctccttatcctccagcagcaagtaaatccacggagggcttttggcgacgtgacagcccatctgctacagccgtgcttggtgctccggcacctgctgtctggcggtacttggacacaggccggacaggggcaactgagacaagtcctgagtagagacattagatcacaaattgaggccatgttccgcggaggcatattccagccagaactcctctcatcctacaaagaagggctgcttgatcaacagcagggcgatgttaaaaccggggcaatgaaaaacttgctggcgccaatggataccgtgctcaaccgtttagtagacgctggctactgcgctgccagccttcacacatctgtggtcgctaactctgttgcactgctttacaagctttttctcgactcctattttaaggagggcaaccagcttctttgcttccaggtattgccccgtctcttcgggtgcctgaaaattagccatctacaagaagaacaatccaaggctctttcaacaagcgattggaccactgaacttctggtggtggaacagttactgaactcagtcgcgaacaacaatatctataatattgccgctgatcgcattagacacgaggaggctcagttcagattttacagacacgtggctgagctgctgatcaatcacgctcaggccccaatccccgcttggttcaggtgcctaaaaaccctcatctcgctcaaccacctgatactcgaacctgacctggatgacctactagcgtccgcctggattgacgcagaagtgaccgaattccgcaccaagaaagcccaggaggccctgatccgtacagttttccagacctacgcaaaactgagacaggtacctcgtctcttcgaggaggtcctgggtgtgatctgcaggcccgctgcagaggccctgcgacagcctgtattggcaagcggacccagcaccgtactatcggcgtgcctcctggaactgccacccagtcagatactggatacatggtcattagtgttagaaaaatttcagtccctcgtactgccctatctgcagagcgatgcagatatggcactaaagtccttatcactgtccctcttgctccactgcatcatgtttaacatgcgctctctggactcatccacccctctccctatcgtgcgccgaacacagtgtatgatggagcggatgatgcgcgaacttgtgcagcccttgctggctctgctgcccgacactccagggccagagcctgaactttggctccagaaggtcagtgattctgtactgctcctgagctacacttgggcccaggtcgatgcgatgttttcattgaattgcagccaataccacagtatgtctggacccctgatcggagtggcgctagagatttccaacttgccttctctgctgcctggtgtaaagacccaacactggaagaagatagagaagtttacagcgcagttcagctcactcgggacttactgtctcgaacagctgtacctacagaagatgaagaggacactgatgcagactagcttccggagcgagggtgcgatccagtcactgagatgcgacgcggcatttattatagggagcggcaggaagagcttaaatcagcgaacgactgcaagctgggatgggcaggtaggcatggtgtctggattgacgtatccagtggcacactggcacttgatagtgtctaacctaactatcctgataagctatctctgtcccgacgatgttggatatctggccagcgtgttacttcggaccttgccgatgggcaaggcccaggaagtcagcatcgacgaagaagcatatataacactagagaagatcagtaaggcattcctgcacagcccactgttccctgaaatgcagagccttcactctgcatttctcacttgtgttactactagttgctcatccatattatgcagcggcgcacagcgcgatagtgggttggtatctcagcagctgccctggctgttcgagaaagatcacatggtcgtgggccattgggagaataggttcgcaaaagcagggcctgagggaattgagccacgcggagagatcgctcagaacctccttagtttagtcaaatctgatttcccgatccagctggagggggaacagctcgagtcaattctcggtctcctggaggtgatttccgccctacaacttgactcactccttcctccttaccatgtccattattttttggtgttactatcaatggccgtcactaaacttggatgttcatgtagctcgtccctggcacttaaattcctcaccacctgctatcagttgctggggtatctacaaaaggggaaatccgccagaagcgtgttcaagattatgtacggatccgatatcttcgaggtcgtgctgacctccttatttcgtgcttccagtagatttcttattgaaatggacgatcctgcatggctggaatttttgcaggtcataggcacattccttgaggagctaatgcagatgttgattcagatgaaactctctctcgtgctgaacttccggaagataacagcatttctgtccagctctaagccctatactgaggcggcttcttcgaagcaacttgagaaccaaaacccccaagggagacaattacttctggtttctctgactcggctctgtcatgttttggggcctttcctgaaggaacagaaactgggccaagaggccccagccgctctgagtgaactactccagcaggtcgtgctgcagacaggagccgttctccagctctgctccgttcccggtgccagaggctggagactccccagtgtcctgatctcctccgtttcaacactactcgaagccgatctgggtcagcattgtcgagacgggggagccgatatctctcagggtagcgacagaaccctcctgtctcatgtggccctctaccagggcgtgtactcccagattctcctcgaactgcccgctctcgccggacatgatcaatcttttcaggcagctctgcagttcctgacactgtttttcctcgccccagaactgcatccaaagaaggactctgtgtttacgagcatgttccactccgtccggagggttctcgcagaccctgaaatacccgtgcaggtgacacaggacatcgagccgcatctaggagcattattcactcaaatgctggaggtcggcacaactgaagacctgaggctcgtcatgcaatgtatccttcagggccttgacgtgtcaaatatgtggaaagccgacgtacaggccgtagtctctgccgttacactgctgcgactcttgttaaactgcccgctttctggagagaaggcttcactgctttggagggcatgtccacagatcgtcaccgccttgaccctgctgaacagagaggcctctcaagagcagccagtgtccctcactgttgtaggaccagtgttggatgttttggccgcactcctgcggcaaggggaagaagccatcggcaacccgcaccacgtgtctttggctttctctattctgttgaccgtccccctcgatcacctgaagcccctggagtacggctcagtgttcccgcgtctgcacaacgtgctcttttccatcctgcaatgccaccccaaagtgatgctaaaagccatcccaagttttctcaattcatttaaccgactggtattctcagtgatgcgggaaggccgtcagaaggacaaaggaagcatcgacgatttgcccactgtgctcaagtgtgcccgactggtggagcgcatgtattcacacattgccgctcgtgcggaggaattcgccgtattcagtccctttatggtcgctcagtatgtgctcgaagtccagaaagtgacgctttatccagccgttaagagtctcctgcaggagggcatctatctcattctcgatctgtgtatcgaaccagacgtccagttcctccgagcatcccttcaaccagggatgagggatatattcaaggagctgtataacgactacctgaaataccataaggcaaaacatgagggggagaagcggtacacagcctag

SEQ ID NO: 24812 - DNA, 255 bp, Artificial Sequence
  Description of Artificial Sequence: Synthetic coding sequence
atgctcaaggctataccttccttccttaactcttttaaccggctggtgttttccgtgatgagggagggccgacaaaaggacaagggctcaattgatgacctgcccacggttttgaagtgtgcacggctggtagagcggatgtactcgcatatcgccgcacgggctgaggaatttgcagtgttttcccccttcatggtggcgcagtacgtcctcgaagttcagaaggtgaccctctatccagccgtgaaaagctag

SEQ ID NO: 24813 - DNA, 1812 bp, Artificial Sequence
  Description of Artificial Sequence: Synthetic coding sequence
atgaagggcgattttcgaaaaaaaaaatctgaagctcgtactcctctcgagcaggagatcttcaacctattgcacaaaaataaacaaccggtgaccgacccgctcctcaccccagtggaaaaggccagcttaagagcaatgtcactagaggaggctaaaatgaggagggcagagcttcagagggccagggctctgcagtcatactacgaggcaaaagcaaggcgggagaagaagataaagagcaaaaaataccacaaggtagttaagaagggcaaggctaagaaagcgctcaaggaatttgagcagctacgcaaagtgaatccggcagcagccctggaggagttagagaaaatagaaaaggcgcgaatgatggagagaatgagtctcaagcaccaaaacagcgggaagtgggccaaaagtaaggccattatggcaaaatatgatctcgaggccagacaggcaatgcaggagcagcttagcaagaacaaggagctgacccagaaattacaggtggcatccgaatcagaagaagaagaaggcggtaccgaggacgtcgaggaactgctagtcccagatgttgtcaatgaggtgcagatgaacgccgacgggcctaatccttggatgctgaggtcctgcacatccgacaccaaagaggctgccacccaggaggaccccgaacagctgcccgaactggaagcacacggggtctcagagagtgagggggaggagcggccagtagcagaagaggagatacttttgagggaatttgaggagcggagatcccttagaaagcgcagcgagctgtctcaagatgccgagcctgctggtagccaggaaaccaaagacagcggaagccaagaggtcttaagcgaacttcgcgtccttagccagaaattgaaagagaatcaccaaagtcgcaagcagaaagcttccagtgaggggaccattcctcaggtgcagagggaggaaccagcgcctgaggaggaggagcctctcttgctgcagagacctgaaagggtacagacgctcgaagaacttgaagagctggggaaagaggaatgttttcagaataaagaacttcctagacctgtgcttgaaggacagcaatcagagcgcaccccgaacaatcgccctgacgcaccgaaagaaaagaagaagaaagagcagatgattgatctgcaaaacttactgacaacgcagagtcctagcgtgaagagtctggcggtgcccaccatagaggagctggaggatgaagaagaacggaaccatcgacagatgatcaaggaggctttcgcaggagacgatgtcattcgtgattttctgaaagagaagcgtgaggccgtggaagcgtctaagccaaaagacgttgatctgaccttgcccggatggggggagtgggggggtgtcggcttaaagccaagcgcgaagaaaaggcgtaggttcctcatcaaggcccctgaaggccctccgaggaaggacaaaaacctgcctaatgtgattataaatgagaagcggaatatccatgctgccgcacaccaggttcgcgtgctcccatacccatttacgcaccattggcagttcgaaagaaccatccagacacccatcggctcaacttggaacacccaacgggctttccaaaaactgacaacccctaaggtcgtcactaagccgggacacattattaatcccatcaaggcagaggacgtcggttacagatccagctctcggtcggatctgtccgtcatacagagaaatccaaaaaggattaccaccaggcacaagaagcagctgaagaagtgttcggtagattag

SEQ ID NO: 24814 - DNA, 2154 bp, Artificial Sequence
  Description of Artificial Sequence: Synthetic coding sequence
atgaggggcaccatgatggagcgggagtctatcaaaagcttctggaaacagtctgtccccttaatggagagaattgggagcggggaaaaactggtcctggctgacctgttggaacctgttaaaacctcttccagtttggccactgtcaagaagcagttgtcccgagtgaaatcaaagaagaccgtggagctgccactcaataaggaggagatagaacggatccatcgcgaggtcgcattcaacaagactgcccaggtgcttagtaagtgggaccctgttgtgttgaagaataggcaggcagaacagctggtctttcccctggaaaaggaggagccggcaattgcaccaatcgagcatgtgttgtccgggtggaaagcacggactccactggaacaggagatcttcaacctgcttcataaaaataaacagcccgtgactgacccactgctgacacctgttgaaaaggcatctctgcgggctatgtctctggaggaagcaaagatgcgtcgggctgaattgcagagagccagggctcttcagagttattacgaggcaaaagcacgtcgagagaagaaaatcaagtccaaaaagtatcacaaagtagtgaaaaagggtaaagcgaagaaagccttgaaggagtttgaacagctacggaaggtcaatcctgccgctgcactcgaggaactggaaaaaatcgagaaggcaaggatgatggagagaatgagtttgaaacatcaaaactcagggaaatgggctaaatctaaggccattatggcaaagtacgacctcgaggctaggcaggccatgcaggagcagttgtcaaaaaacaaggagcttacccagaagctgcaggtagcctccgaatctgaggaggaagaggggggaacggaggatgtggaagaactgctggtgcccgatgtggtcaacgaggtacagatgaatgccgatggcccaaacccctggatgttgcggagctgcacttccgacaccaaggaggccgcaacccaggaggatccagagcagctacccgagctggaagcccacggagttagtgagtctgagggcgaagagcggcctgtggctgaggaagaaattttgctgcgcgagtttgaagaaagacgctccctcaggaaacgttcagagctctcccaagacgctgagccagccggatctcaggagactaaagactccgggtcacaagaggtactatcagagctaagagtgttatcacagaaactgaaggaaaaccaccaatcccgaaagcagaaagccagcagcgagggtactatcccgcaggtgcagcgcgaggaacccgcacccgaggaagaggaaccattgctgctgcagcggcctgaacgagttcagactctggaggagctggaggagctcggcaaggaagaatgtttccagaacaaagagctcccaaggccagtgttggaaggccagcagtctgaaagaacacccaacaataggccagatgccccaaaagagaaaaagaaaaaggagcagatgatcgacctacagaatttgttaactacacagtcaccaagtgtcaaatcattagctgtcccaacaatagaggaattggaggatgaggaagagaggaaccacagacagatgattaaagaggcgttcgcaggtgacgacgtgatccgcgatttcctgaaagaaaagcgcgaggccgttgaggccagcaaacctaaagatgtagacctcactctgccagggtggggcgaatgggggggagtgggcctaaagccttccgctaaaaagcggcgacgctttttaataaaggccccagagggcccaccacggaaggataagaatcttcctaacgtgattattaatgagaagcggaatattcacgccgcagctcaccaagtccgcgtgctgccgtaccccttcacgcaccactggcagtttgaacgaaccattcagactccaattggaagtacttggaacacacaaagggcattccagaaattgactactccaaaagtggttacaaagccaggtcatatcattaacccaataaaagcggaggacgttggctaccgatcttcatcccgtagcgatttaagcgtgattcaaaggaaccctaagaggatcactacaaggcacaaaaaacagctgaagaaatgtagcgtggactag

SEQ ID NO: 24815 - DNA, 2316 bp, Artificial Sequence
  Description of Artificial Sequence: Synthetic coding sequence
atgactgccaaccggctagcagagtcactccttgctctatcacaacaggaggagctcgcagacctccctaaagattacctcctgtccgagtcagaggacgagggcgataacgatggcgaacgaaagcaccaaaaactgctggaagccatctcatcactggacggcaaaaatcgtcgtaagttggcagaacggtccgaggccagtttgaaggttagcgagtttaacgtctcatctgagggtagtggcgagaagctagtgctggccgacctgttggaaccagtaaagacttcatcttcactcgcaacagttaagaagcagctttctcgggtgaagtctaagaagactgtggaactgccgctcaacaaggaagagatcgagagaatccatagggaagtggctttcaacaaaactgcccaggtactgtccaagtgggaccctgttgtgttaaagaataggcaagcagaacagcttgtgttccccttagagaaagaggaacccgcaattgcgccaattgagcatgtgctgagcggctggaaggcaaggacccctctggaacaggagattttcaacctgttacataaaaacaaacagccagtaaccgacccactgctgacacctgtggagaaagcttcactgcgcgcaatgagcctcgaggaggccaagatgagacgcgctgagctgcagagggctcgtgccttacagtcctactatgaggcgaaggccaggcgagagaagaagatcaaatctaaaaaataccataaggttgtaaaaaaaggcaaggctaagaaggcgctcaaggaattcgagcaactgaggaaggtaaaccccgctgccgcactcgaggagctggagaagatcgagaaagccagaatgatggaaaggatgtccctgaaacaccagaactcgggcaaatgggccaagtccaaggccattatggcgaagtatgatttggaagcacgtcaggccatgcaagaacaactcagcaagaacaaggaactcacgcaaaaacttcaggtagcaagtgagtccgaagaggaggaaggaggtacagaagacgtggaagagctacttgtgccagacgtagtaaatgaggtgcagatgaatgccgacggcccaaatccatggatgcttcgcagctgcacaagtgatacaaaggaggccgctactcaggaggatcctgagcagctgccagagcttgaagctcatggcgtttcggagtcagagggtgaagaaagacctgtggccgaagaggagatcctcctgcgggagttcgaggaacgacggagcctgagaaagcgcagcgaactgtcccaggacgccgaaccagccggaagtcaagaaacaaaggattccggaagccaggaggtgctgagtgaactacgcgtcctgagtcagaagttaaaagagaatcaccaaagtcgaaagcaaaaagcttcttcagaaggcacaatcccccaggtgcaacgtgaagagccagcacccgaggaggaggagcctttattactgcaaaggcccgagagagtccagactctggaagaactggaagagctcgggaaagaagaatgctttcagaataaagaactccctagaccggttctggaaggccaacagtctgaaagaacgccaaacaatcgccctgacgcaccaaaggagaaaaagaaaaaggaacaaatgatcgatctgcaaaacctgctgaccactcagtccccgtcagttaagtccttggcggttcctacaattgaggaactggaggacgaagaggaacgtaaccaccggcaaatgattaaggaggcattcgccggagatgacgtgatcagagacttcctgaaggaaaagcgcgaggctgtagaagcatctaagccaaaagacgttgacctgaccctgcccggatggggggaatgggggggagtcggcctgaaaccttccgctaagaaacgacgtcgtttcctgataaaggcaccagagggaccacctcgcaaggacaagaacctccccaatgtcatcattaacgaaaagcgcaatatccacgccgctgctcatcaggtcagagtgctgccatacccctttactcaccattggcagttcgagcgaactatccagacgcctatcggtagtacttggaacacacagcgcgcattccaaaagttgacaacacctaaagtggtcacgaagccaggccatatcatcaaccccattaaagccgaggatgtgggctatagaagctcatctcggagcgatttaagcgtcatccagcgaaacccaaaaaggattaccacacgccacaagaagcagctgaagaaatgcagcgtggactag

SEQ ID NO: 24816 - DNA, 2160 bp, Artificial Sequence
  Description of Artificial Sequence: Synthetic coding sequence
atgaccgctaatagactggctgagagccttttagctctctcccagcaggaggaattagcggacctccctaaggattatctcctttcagagtctgaggatgagggagataatgatggcgagaggaaacatcagaagcttctggaggctatctccagccttgacggaaagaatcggaggaagcttgctgaaagatccgaggcgtcactgaaggtcagcgaatttaacgtgtctagcgagggcagcggcgaaaaactggtcctggccgacctgctggaacctgtgaagacaagtagcagcctggccacagtgaagaagcagctgagcagggtgaagtccaagaagacagtggaactgcctctgaataaagaagaaatagagagagcccgaacgcctctggagcaggagattttcaatcttttgcataagaataaacagccagtgacagatccactcttgacaccggttgaaaaagcgtcccttagggcgatgtcgctggaggaggccaaaatgaggagagcagagctacagcgcgctagggcgctgcaatcttactacgaagccaaagcgaggagggaaaaaaagatcaagtctaagaaataccataaggttgttaagaaaggcaaggcgaagaaggcactgaaggaatttgagcaactcagaaaagtgaatcctgccgctgccctcgaagagctggaaaaaatcgagaaggcccgaatgatggagaggatgtcacttaaacatcagaactccgggaaatgggcaaagagcaaagccatcatggctaaatatgatttagaagccaggcaggcaatgcaagaacaactatcaaagaacaaggaattgacacagaagctacaggtggcatccgaatctgaggaggaagaaggcggaacggaagacgtcgaggaattactcgtgccagacgtggttaatgaagtacaaatgaacgcggacgggcctaacccctggatgctccggtcttgtacctccgacacaaaggaggccgcaacacaggaagaccctgaacagctcccggagctcgaagcacacggagtttccgaaagtgaaggagaggaacgaccagtggcagaggaggaaattcttctccgggaatttgaggagcgtagaagtcttcgaaagaggtccgagctgtcgcaggacgctgaaccagcaggctctcaggagaccaaagacagtggctcccaagaagtcctttcagaattgagagtgttgagccagaagttaaaggagaaccatcagtcccgcaaacagaaggcttccagtgaaggcacgatccctcaggttcagcgcgaagaacccgctccggaagaagaagagcctctactcctgcagcggcctgaaagagttcaaacactggaggagttagaggagctcggaaaggaagagtgtttccagaataaggaactgccccgaccggtccttgagggtcagcagtctgaaaggacacctaataaccgtcctgacgcccctaaggaaaaaaagaaaaaggaacagatgatcgacctccagaatctgctgactacacagtctccatcagtgaagtctctcgccgttcccacaattgaggagctggaggatgaggaggagagaaatcacagacagatgattaaggaggccttcgcgggagacgacgtgatcagagatttcctgaaggaaaaacgcgaagcagtggaagccagtaaaccaaaggacgtggatcttactttgccaggatggggagaatggggcggagttggattaaagccatccgctaaaaagcggagacgcttcctcattaaggctccagagggaccgccacgtaaagacaagaacctccccaacgttataatcaatgagaagagaaatatccatgccgcagcccaccaggttcgggtgctcccctacccgttcacacatcactggcaattcgaacgaactatacagacgcctattgggtcaacctggaatactcagcgtgccttccaaaaattgactacgcctaaggttgtgacaaaaccgggtcacattattaacccaataaaggctgaggatgtgggctaccgctctagttcccggagcgatctgtccgtgattcaaagaaaccctaagcgcattactaccaggcacaagaagcagctcaaaaaatgttcagtagattag

SEQ ID NO: 24817 - DNA, 963 bp, Artificial Sequence
  Description of Artificial Sequence: Synthetic coding sequence
atgaagggcgactttcgcaaaaaaaaatctgaggcaagaactccccttgagcaggagatctttaatctgcttcataaaaataagcaaccggttactgaccccctcctcaccccagtagagaaggcctccctacgggcaatgagtcttgaggaagcaaaaatgcgtagagcagagctacagcgcgctagggccctgcagagttattatgaggccaaggccagacgggagaagaagatcaagagtaagaagtaccacaaggtcgtgaagaaggggaaagccaaaaaagcattaaaggagtttgaacagctgagaaaggtcaatccagcagcagcactggaggagctcgaaaagatcgagaaagcccgaatgatggagcgaatgagtctcaaacatcagaactctgggaagtgggcgaagagcaaggcaattatggcgaagtatgatctggaagctagacaggctatgcaggagcagttgtctaagaataaggaactgacgcaaaagctgcaggtcgccagtgaatcagaggaggaggaggggggaactgaggatgttgaagagttgttggtacccgacgtggtgaatgaggtgcagatgaacgctgatggtccaaatccctggatgttgagatcatgtacctctgacactaaagaagcggctacacaggaggatccagaacagttgcccgagttggaggcccatggtgtttccgagagtgaaggagaggaacgaccagtagccgaggaagagattctgctccgcgagtttgaagagcgcaggtccctgaggaagaggagcgagctatctcaagatgctgagccagccggttcccaggagacaaaggactcgggcagccaggaggttctctccgagttgcgggtgctatcacagaagctcaaggagaatcatcaatcccgcaagcaaaaggctagttctgaagggaccattcctcaggtgcagtag

SEQ ID NO: 24818 - DNA, 2301 bp, Artificial Sequence
  Description of Artificial Sequence: Synthetic coding sequence
atgaatgtcaatcaggttgctgagaatctggccttgtcacatcaggaggaactcgtggatctgccaaaaaactatcctctgagtgaaaacgaagatgaaggcgatagcgatggagagagaaagcaccagaagcttctcgaggccatcataagcctggatggcaagaaccgcagaaagctcgccgaaaggtctgaagcctcccttaaggtttctgaattcagcgtgagtagcgaaggctctggtgaaaagttagggctggctgacctgctggagccagtgaagacgtcgagctcactggcaaccgtcaaaaagcagctgaatcgggttaagtcaaagaaagttgtggaactgccactgaataaagaaaagatcgaacagattcaccgggaggtagcgttctcaaagacctcacaggtactgtccaagtgggaccccattatcctgaaaaaccaacaggccgaacagttggtgttcccactaggaaaagagcagcccgcaatcgcacctattgaacacgccctgagcggatggaaggcacggactcctctggagcaggagatcttcaacctgctgcataagaataaacagccagtgaccgatcccctattgaccccgatggagaaagctagcctgcaggccatgagtctagaggaagccaaaatgcatcgcgctgaacttcagcgcgcacgggcactgcagagctattatgaggctaaggcaaggaaagaaaagaaaatcaaatcgaaaaaataccataaagtagttaagaaggggaaagccaagaaggcgcttaaggagtttgagcagctgcagaaagtgaaccccacagttgccctcgaggagatggaaaaaattgaaaacgcccgtatgatggagcggatgtctctgaagcaccagaatagcggcaaatgggctaagtccaaggccattatggcgaagtatgatctggaagccaggcaggctatgcaggagcaattagcgaagaacaaagagctcacgcagaagctgcaggtggcatctgagtctgaagaggaggaaggtggaacggaagtcgaggagctcctggtgccccacgtggccaacgaggtacagatgaatgtggacggcccaaatccatggatgttcaggagctgcacctcagacacaaaagaagctgctacgcaggaagatcccgaacaagtgcccgaacttgcagcacacgaggtgtctgcatcagaggctgaggaacgccctgttgccgaggaagagatcctcctgagggagttcgaagagagacaatcactgaggaagcgatccgaactgaatcaggatgctgagccagcgtcaagccaggagacaaaggatagtagctctcaggaggtgctgtcagaactcagggccctgtcacaaaaactcaaagaaaaacatcagagcagaaagcagaaagcaagctccgaagggacagtgcctcaggttcagagagaggagcccgcaccagaagaggccgagccccttctgctgcagcggtccgagagagtacagactttggaggagttagaggagctgggcaaggaagactgctttcagaacaaggaactcccacgccctgtcctggaaggacagcagtccgaacgcactcctaataaccgaccggatgccccaaaagagaaaaaagaaaaagagcagctcattaatctccagaatttcctcacaacacagagtccttctgtgcgtagtctagcagtgccaaccattatcgaggagcttgaagatgaggaggagagagaccagagacagatgattaaggaggcctttgcaggcgacgacgttattagagacttcttaaaggaaaagagggaggcagtggaagcttccaaaccaaaggatgtggatcttactttaccaggatggggggagtgggggggtgtgggcctgaaacccagcgcaaagaaacgccgacagtttctgattaaagctcctgagggtccaccgagaaaagacaagaatctgcccaatgtgattataagcgaaaagagaaacattcatgccgctgcgcaccaagtgcaggtgctgccctacccctttacgcaccaccgacagttcgaaagaacaattcagacaccaatcggaagcacctggaacactcagcgagcctttcaaaagctgacaaccccgaaggttgtgacgaaacctgggcatatcattaaacccatcaaagcagaagacgttggatatcagtcctcatccaggtccgatctccctgttatacagcgcaatccaaagaggatcacgacgcggcataataaggaggagaaattatag

SEQ ID NO: 24819 - DNA, 1557 bp, Artificial Sequence
  Description of Artificial Sequence: Synthetic coding sequence
atggctggttacaagcccgttgccatacagacctacccaattctcggagaaaagattacccaagataccctgtattggaacaactacaagacccctgtgcagattaaggaattcggcgctgtgagcaaggtggattttagcccccagcccccatataattacgctgtcacagctagctctagaattcatatctatggaaggtacagtcaggagcctatcaaaacattttctaggttcaaggatacagcgtattgtgccacttttaggcaggacggtagactcttggtcgcaggatccgaggacggtggcgttcagctttttgatatttcaggcagggccccacttaggcagttcgaaggccatactaaggcggttcatacagtggatttcacagccgacaaataccacgtcgttagcggcgcagatgattacacagtcaagctctgggatataccaaattctaaagagatactgacctttaaggagcacagcgactacgttcggtgcggttgtgcgtccaagcttaacccagatctctttattaccggaagttatgaccacactgtcaagatgtttgacgctcgaacctccgagagtgtcctgagtgtggagcatggacaaccggtagaatccgtgttgctattccccagtggtggcctgctggtgtccgccggaggcaggtatgtaaaagtgtgggatatgctcaagggaggtcagcttcttgttagcctgaagaaccaccataagactgtgacatgcctctgcctatcttcgtccggacaacgcttacttagtgggtccttggatcgcaaggttaaagtgtattcaacaacctcctacaaggtggtccatagtttcgactacgcggcttccattcttagtctggcgctggcccacgaagatgagacaatcgtggtcggcatgaccaacggtattctgagtgtgaagcaccgcaagtccgaagccaaaaaggagagtctaccacgaagaaggcgcccagcttaccggactttcatcaaaggcaagaactacatgaagcaacgagatgacatactcataaaccgtccagccaaaaagcacctggaactgtatgaccgggatctaaagcacttccgaattagtaaagcccttgacagggtgttggatcctacatgtacgattaaaacccccgagataacggtgtcaatcatcaaagagctgaaccgcagaggcgtcctggctaatgccctggccggtagggacgagaaggagatcagccacgtgctcaacttcctgattcggaacctgtcccagcccagattcgcccctgtgctgattaatgccgcagaaatcattatagatatctatctgcctgttataggccagtctccagtcgtggataaaaaattcctgcttctccagggcctagtagagaaagagattgactatcaaagggagttgttggagactctaggcatgatggatatgttgtttgctacaatgcggagaaaggagggcacgagcgtccttgaacatacatcagacggtttcccagaaaacaagaagattgagagctag

SEQ ID NO: 24820 - DNA, 1500 bp, Artificial Sequence
  Description of Artificial Sequence: Synthetic coding sequence
atggccggatacaagccagtggcaattcagacgtatcctatcctgggtgaaaagatcactcaagatacactgtactggaataactacaaaccaccatacaattatgctgtgaccgcgtcctctcggatccacatttatggtcgatactcccaggagccaatcaagacattctctcgttttaaagatactgcatattgtgcaaccttccgccaagacggcagactgcttgttgcaggatccgaggacggaggggtgcaactgtttgatatctctggtagagcacccctgcggcaattcgaaggacataccaaggcggtgcatacagtggacttcaccgctgataaataccatgtggtgtcaggggctgacgattatacggttaaattatgggacatacctaattcaaaggagattctgacattcaaggaacacagcgactacgtgcgctgtggctgtgcctctaaactgaatcccgatctgtttattaccgggtcctatgatcacacagtgaagatgttcgatgcgaggactagcgaaagtgtgctatctgtagaacacggacaacccgttgagagcgtcctactgttccccagcgggggtcttcttgtgtctgcaggcggacggtatgtcaaggtttgggatatgctgaaaggagggcaattgttggtatcccttaaaaaccatcacaagacggtgacctgtctgtgcctctccagctctggacagagactcctctccggcagtcttgatcggaaagtgaaggtgtacagcactacctcttataaggtggtgcattcattcgactacgccgcaagtattctgtcgctcgcgctagcccatgaggatgaaaccattgtcgtgggaatgaccaacgggatcctttcggtgaaacataggaaaagcgaggcgaaaaaagaaagcctccctcgccgacggaggccagcctaccgaacatttataaagggcaaaaattacatgaagcagagggatgacatcctaataaaccgtccagccaagaagcatctcgagctgtatgatcgcgatctgaaacattttagaatttccaaggccctagaccgggtcttggacccaacttgtactattaagacacccgagatcactgtcagcattatcaaggaactgaaccggcgaggtgtcctagcaaacgccttggctggaagagacgaaaaggagattagccacgtgttgaactttctgatcaggaatctgtctcaaccacgcttcgcccctgtactgatcaacgcagcggagattattattgatatctatttacctgtcattggacagtccccagttgtggataagaagtttctgttgctgcaagggctggtggagaaggagatcgattaccagagagaattgctcgagacactgggaatgatggatatgctattcgcaactatgcgcaggaaagagggcacctccgttttggagcacacctccgacgggtttcccgagaacaagaaaattgagagctag

SEQ ID NO: 24821 - DNA, 24 bp, Artificial Sequence
  Description of Artificial Sequence: Synthetic coding sequence
atggcaggatataagcctgtgtag

SEQ ID NO: 24822 - DNA, 1638 bp, Artificial Sequence
  Description of Artificial Sequence: Synthetic coding sequence
taggttatattcgccagacgatccgtgagatgcgtttgcagacggctgctggaaggaccatgtgatttctatgcatccgccgcagagctttgcagagttggctcctggcattcccctatcaattgtccttgggtggaggtctcccgcaggactctgtggggaagcgtcgaaactcccgtgcagatcaaagagtttggggcagtttccaaagtagatttttcaccacagcctccttacaattacgcagtgacagctagtagccgcattcatatctacggacggtattctcaggaacccatcaagactttttcacgcttcaaggacaccgcatattgcgcgacatttcgtcaggacgggcgactgctggtcgctgggtcagaggacggcggagtgcaattgtttgacatcagcggacgtgctcctctgagacagtttgaaggacacactaaggctgtgcatacagtggattttacagccgacaagtaccacgtggtctcaggagctgacgactataccgtgaaactttgggacattcccaacagtaaagagatcctgaccttcaaagagcactctgactacgtccgatgtggatgcgcctctaagctcaatcctgacttgttcatcacaggctcatatgaccacactgtgaaaatgtttgatgctcgaacatcagagtcggtgttgtcagttgagcacggccagccagtggaatccgtgctattgttcccttctggaggactgttagtcagtgctggaggccgatatgtgaaggtgtgggacatgctgaaaggaggtcagcttctggtaagccttaaaaaccaccacaagaccgtcacctgtttgtgtttgagctcctccgggcagaggctattgtcaggatcacttgacaggaaagtgaaagtgtactcaaccacgagctacaaagtggtacactctttcgattatgcagcctctatcctgtcgctcgcgctggcccatgaagatgaaaccattgtggtgggtatgacgaatggcattctgtccgtgaagcaccgcaagtcagaggccaagaaggagagtctgcccaggcggaggcggcctgcctatcggacctttattaaagggaagaactatatgaagcagcgtgatgacattctgattaataggcctgcgaagaagcatctggagctttacgatagggacctgaaacactttcgtatctcaaaagcactggatcgagtcctggatccaacctgcaccattaaaacaccggagattacggtgtcaattataaaggaactgaatcgcagaggtgtgctggcaaacgccttggcaggaagagatgaaaaagaaataagccacgtgctgaattttttgattcgcaatctgtcacagccaagattcgcccctgttctgatcaacgctgctgaaattattattgacatctatctcccagtaatcggccagagtccggtggtcgacaagaaatttctgcttctgcaggggttagttgagaaggaaattgactaccagagggaactgttggagactctggggatgatggatatgctgttcgctactatgaggcgaaaggagggcacttcagtgctggagcacacgagtgacggcttcccagaaaacaagaaaattgaatcctag

SEQ ID NO: 24823 - DNA, 198 bp, Artificial Sequence
  Description of Artificial Sequence: Synthetic coding sequence
atggccggttataaacctgttgctatccagacatacccaattctaggagagaaaatcacccaggacacgctgtactggaataactataaaacccctgtccagattaaggaattcggagctgtgagtaaggtcgatttctcaccccagcctccttacaactatgcagttacagctagcagccggatacatatctactag

SEQ ID NO: 24824 - DNA, 987 bp, Artificial Sequence
  Description of Artificial Sequence: Synthetic coding sequence
atgttcgacgcacgaacaagcgagtctgtgctgtctgttgagcatggtcaacccgtggagagtgtgctactcttcccttctggaggcctgttggtaagcgcaggcggacgctatgttaaggtgtgggatatgctgaagggagggcagctactggtaagcctcaagaatcatcacaagaccgtcacatgcctctgcttatcttcatccggacagcggttgttgagtggatcgttagaccgcaaggtaaaggtctattcgaccacttcttacaaggtggtccactcgtttgattacgcggcatccatactgtctctggcactcgcccacgaagatgagacgattgtggtgggcatgaccaacgggatcttgtccgtgaagcatagaaaaagtgaggccaaaaaagagagtctcccacggaggcgccgtccagcgtaccgaacattcataaaaggtaaaaattacatgaagcagcgggatgacatcctcattaaccgccctgctaagaagcacttggagttatacgatcgagacctaaagcacttcagaatctctaaggcactggatcgggtcctagatcccacctgcaccattaagacccctgagattaccgtgtctatcatcaaagagctgaatcgcaggggggtgctggcaaacgcgctggcgggtcgggacgagaaggaaatcagccacgtactgaattttttgataaggaacctgtcacagcccagatttgcaccagtgctgattaatgctgcagagatcattatcgacatctacctgccagtgattgggcaatcacctgtagtggataaaaagttcctgctgctccagggccttgtagaaaaggaaatcgactatcagcgcgaactgttggaaacacttggaatgatggacatgctctttgccactatgcgtcggaaggaaggtacatccgtgcttgagcacacttccgacggttttccggaaaataaaaaaattgaatcctag

SEQ ID NO: 24825 - DNA, 750 bp, Artificial Sequence
  Description of Artificial Sequence: Synthetic coding sequence
atgaagatcaccagacagaaacacgccaaaaagcatctgggtttttttcgcaacaattttggcgtgagggaaccttatcagattctgttggacggaacattttgtcaggcggctctgaggggaaggatccagctccgggaacagcttcccagatatttaatgggagagacccaactgtgcaccactagatgtgtcttaaaagaattggaaaccttgggcaaagacctctacggcgctaaactaatcgcccagaagtgtcaggtccgaaattgtcctcacttcaaaaacgccgtgtccggaagcgaatgtttgctgtctatggtggaagaaggcaatccacaccattactttgttgcgacacaggaccaaaatctgtctgtcaaagtcaaaaaaaagccaggcgtgccactgatgttcataatccagaatactatggtgctggacaagcctagtcccaaaacaattgcttttgtaaaggcagtagaaagcgggcaactggtgagcgtccatgagaaagagagcattaaacacctgaaggaggaacagggcctcgtcaaaaataccgagcaaagcagaaggaaaaagcggaaaaagatctctgggcctaaccccctttcttgtcttaagaaaaaaaagaaggcgcctgacactcagagttccgccagcgagaaaaaaagaaagagaaagcgcattcggaacaggtccaacccgaaggtgttgagcgagaagcagaatgctgagggcgagtag

SEQ ID NO: 24826 - DNA, 438 bp, Artificial Sequence
  Description of Artificial Sequence: Synthetic coding sequence
atgaaaattactaggcagaaacatgcaaaaaaacacctcggtttcttcaggaataatttcggagtaagagagccttaccagatcctgctcgacggaacattctgccaggccgcattaagaggcagaattcagctgcgtgaacagttgcccaggtacctcatgggcgagacccagctgtgcacaacaagatgcgtgcttaaggaactggaaactcttggcaaggatctgtacggagcaaagctgattgcacagaagtgtcaggtcaggaattgtccccattttaagaatgctgtgagcggctcggaatgtctcttaagcatggtggaagaggggaaccctcaccattattttgtcgctactcagtatattccgagaatgtacacattctgcacaaattacggaggccagcagtacgtgattgatgccctcattggctag

SEQ ID NO: 24827 - DNA, 1794 bp, Artificial Sequence
  Description of Artificial Sequence: Synthetic coding sequence
atggcggaaattatacaggagcgaatcgaagatcgtctcccagaactcgagcagctggagcgaatcggtttatttagccatgccgagataaaggctataatcaagaaggcgtcagacctggagtacaagatccagcgcaggaccttgttcaaggaggactttatcaactatgtgcagtacgagataaacctgcttgaacttattcagagacggagaaccagaatcggctactcctttaagaaggatgagatcgaaaactctatcgtgcatcgggtgcaaggcgtgtttcagcgcgcttctgcgaagtggaaggatgatgtgcagctctggctctcatacgttgccttctgtaagaaatgggccacaaaaacccgtttaagtaaagtgttcagtgctatgttagcaattcactccaacaagcccgcactatggataatggcagcgaagtgggaaatggaggatcgcctgtcaagcgagtctgcgaggcagctgtttctccgagccctgaggttccatccagagtgtccgaaactctacaaagaatatttcagaatggagttaatgcacgcggaaaagctgagaaaggagaaagaagaatttgaaaaagcgagcatggacgtcgagaatccagactatagtgaggaaattcttaagggtgagcttgcttggattatctataagaactctgtgagcatcatcaagggagcggaatttcatgtctcgctgctttctattgcgcagttatttgattttgccaaggatttacagaaagagatctacgatgacctacaggcacttcacaccgacgaccctctcacctgggactacgtagcaaggagggaactggagattgaatcacaaaccgaggagcagcccaccactaaacaagcgaaggccgttgaggtcggacgaaaggaggagcgttgttgtgctgtctacgaagaggccgtgaagacgctcccaacagaagccatgtggaagtgctacattactttttgcctggagcggttcaccaaaaagtctaattccggtttcctaaggggaaaaagactggaaagaaccatgactgtattccggaaagcccatgaactaaaactcttatcggagtgccaatacaagcagctgagcgtatctctgctttgctataatttcctacgcgaagctctcgaagtagcggtcgcgggaaccgagctattcagagatagcggaaccatgtggcaactgaagcttcaggtgttaatagaaagtaaatctcccgacattgccatgttatttgaggaggcattcgttcacctcaagccacaggtttgtctgccgctttggatcagttgggccgaatggtccgaaggcgcaaagtctcaagaagataccgaggcggtgttcaagaaagccctattggccgtcattggagccgatagtgtaacccttaaaaacaagtatctagactgggcatatcgcagtggtggctataaaaaggccagggccgtgtttaaaagtctgcaggaaagtcgtcctttttctgttgatttctttcgcaagatgatccagttcgagaaggagcaagagagctgtaacatggccaatattcgtgaatactacgaacgggctctgcgagagttcggatccgccgattccgacctttggatggactatatgaaggaggagctgaaccaccccctcggtcggcctgaaaattgtggacagatttactggcgcgctatgaaaatgctgcagggcgaatccgccgaagcctttgtggcgaaacacgccatgcaccaaacagggcacctctag

SEQ ID NO: 24828 - DNA, 1425 bp, Artificial Sequence
  Description of Artificial Sequence: Synthetic coding sequence
atgataagcttctgccccgactgtggtaaaagcatccaggctgcctttaagttttgcccatactgtgggaacagcctcccggtggaagagcatgtaggctctcagaccttcgtgaatccacatgtcagcagttttcaaggtagcaaaaggggattaaacagttctttcgagacttctccaaagaaagttaaatggtctagcaccgtgacatctccacgcctgagcctattctccgacggcgacagctctgaatccgaggacactctgtcaagcagcgagcgcagcaaagggagtggatccagaccgcctacccctaagagttctccacaaaaaactcgtaagtcaccacaggtgacacgtgggtcccctcaaaaaacaagctgctctcctcagaaaactcgccagtccccacaaaccctgaaaagatcgcgagtgactaccagtctggaggccctgcctactggtacagtcttgactgacaagtccggcaggcaatggaaactgaaatcattccaaacacgggacaaccaaggtatcctgtatgaggcagcacctacatctaccctgacctgcgactccggccctcagaagcagaagttctcacttaagctcgatgcaaaggatggaaggctgttcaatgagcaaaattttttccagagggctgcaaagcctctccaggtgaataagtggaaaaagctctactcaacaccactcttggctattcccacttgcatggggttcggggttcaccaggacaaatacagattcctagtgttaccgtccctcggaaggtctctgcagtcggcactcgatgtctcgcccaaacatgtccttagcgagagatcggtcctgcaggtcgcatgtagactgctggacgctcttgaattcctgcatgagaacgagtacgtgcatggcaacgtgactgcagagaatattttcgtcgatcctgaggaccaatcacaagttacattggcaggctatgggtttgcctttcgatattgtccttctggaaaacatgtggcctatgtggagggctcccgctctccacatgagggagacctggaattcattagcatggacctgcataagggctgtggaccttcaaggcgcagcgacctccaatctctgggttattgtatgctcaagtggctctacggcttcctgccttggacaaattgcctgcctaatactgaggatataatgaagcaaaagcagaagttcgtggacaaacctggtccctttgttggaccttgtggccactggatccgcccatccgaaactctgcagaaatacctgaaggtagtcatggcgttgacctacgaagaaaagcccccatacgccatgcttcgcaacaacctggaggctctactgcaagatctgcgcgtctctccttatgatcctattggccttcccatggtcccgtag

SEQ ID NO: 24829 - DNA, 1275 bp, Artificial Sequence
  Description of Artificial Sequence: Synthetic coding sequence
atgatttccttttgccccgactgcggtaaatcaatacaggccgcatttaagttctgtccgtactgcggaaactcattgcctgttgaagaacatgttggaagtcagaccttcgtgaacccccacgtgtcaagtttccaggggtccggcagcagaccacccacgcccaaatcctctccccagaaaacgagaaagtctccccaggtgacccgagggtctccacagaaaactagttgctccccacaaaagacccgacagagcccccagactctcaaacgctcacgcgtgaccactagcctcgaagccctgccaacgggcactgtcctcactgacaagagcgggcgacaatggaagctgaagtctttccagacccgcgacaatcaggggattttatatgaagctgctcccacttcaaccttaacttgtgacagtgggccacaaaaacaaaagttttcattaaaattggacgctaaggacggcagactgtttaatgaacaaaatttcttccagcgggctgcaaagccactgcaggtgaataagtggaagaagctatactcaactcccctgctggctattcctacatgtatgggctttggcgtacatcaggacaaataccggtttcttgttctcccaagcctcggtcgttcccttcagtctgccctggacgttagtcctaaacacgtgctgtccgaaaggtcggtgcttcaggtggcctgccgtttacttgacgcccttgagtttttacacgagaatgagtatgtgcacgggaatgtcacagccgaaaacattttcgtagaccctgaagaccaaagtcaggtgacactcgcgggatatggcttcgctttccgatactgtccctctggcaaacacgtggcttatgtggagggctccaggagtccccacgagggcgatctggagttcattagcatggaccttcataagggctgtggcccatcaaggcggagcgacctgcagtccctaggatattgcatgctcaagtggctttatggtttcctgccttggacaaactgcctccctaacactgaagatatcatgaagcagaaacaaaagttcgtcgataagcccggaccttttgtaggaccctgtggccactggattcgcccaagcgaaaccctgcagaaatacctcaaagtggtgatggcgctgacttatgaagaaaaaccaccctatgcaatgctgcggaacaatctcgaggcactgctgcaggatctcagagtgtcaccctacgatccaattggactaccaatggtcccatag

SEQ ID NO: 24830 - DNA, 855 bp, Artificial Sequence
  Description of Artificial Sequence: Synthetic coding sequence
atgatatcattttgccccgattgtggaaaaagcattcaggccgcattcaaattttgtccgtactgcggtaacagtttacctgtcgaagagcacgtgggatcgcaaacgttcgtgaatcctcacgtgtccagcttccaaggtagcaagcgtgggctgaattcctcctttgagacctccccaaaaaaggttaagtggtcttctacggtgacctccccccgattgagtctctttagcgatggagactcgtccgagtcagaggacacactaagcagttctgaacgctctaaggggagcggtagcaggccacccacaccaaaatcttctccccagaagactcgaaagagcccacaggtgacaagaggctcgcctcaaaaaaccagttgttcgccccagaagacccggcagtccccccagaccctgaaacggagccgagtcactaccagcctggaagccctgccaaccggcacagttttgacagacaagtctggacggcagtggaaattgaagtccttccaaactagggacaaccagggcatactgtacgaggccgcacctacaagcaccctgacatgtgacagtggtccacagaagcagaagttttcactcaagctaagtacctccgggaggagttgcactagaccacactgctggcctagcctgccggcatgggttagcgtgttcacccgcactaacacaggttcctggtgctacccagcctggggtggtgccttctcgcgtccttggatgagtgcccagtctatgtgctgtcagcggggtctgtgttgccgctggccagctgggtgttggatgccctggagctcatccatgcgaatgtccatgttcatggaaatgtag

SEQ ID NO: 24831 - DNA, 732 bp, Artificial Sequence
  Description of Artificial Sequence: Synthetic coding sequence
atgaagttgcatccaccacccccatctcctgtgacgcaggaccataggtctaagtcatcgcactctaattggtttctggtcctcccttcattggggcgaagtctgcagtccgccttggatgttagccccaaacacgtgttatcggagcggtcagtgttgcaggtcgcatgccgtctgctggatgcactggagtttctccatgagaacgagtatgttcacggcaacgttaccgcagaaaacatctttgtcgacccggaagaccagagccaggttaccctagcgggttatggcttcgcctttcgctactgcccctccgggaaacatgtggcttacgtcgaaggaagccgctccccacacgaaggcgacctggaatttatttccatggatctgcacaagggatgtgggccttccagaagaagtgatctgcagtccctgggctactgcatgttgaagtggctgtatggatttctgccttggacgaactgcctgccaaacacagaagatataatgaaacagaagcagaaatttgtggataaaccagggcctttcgtggggccatgcggtcactggatcaggcctagcgaaacactccagaaatacctcaaagtcgtgatggctctgacctatgaagaaaagccaccatatgccatgctacgcaacaatttagaggcactcctccaggatctgagagtaagcccctacgacccaatcggactgccaatggtgccttag

SEQ ID NO: 24832 - DNA, 645 bp, Artificial Sequence
  Description of Artificial Sequence: Synthetic coding sequence
atgagtcccaagccccgtgccagcgggccaccagctaaagctaaagaagccggtaagcggaaatcgagcagccagccatcaccctccgaccccaagaaaaaaacaactaaggtggcaaaaaagggcaaagctgtgcgcagagggaggcgcggaaagaaaggggcagctacaaaaatggccgcagtaaccgcgccagaagcggaatccggaccagcggctccagggccatccgaccagcccagccaggagctccctcagcacgaactgccacctgaggaaccagtgagcgaggtcgaggaacctctgtcgcaggagtcgcaggtggaagagcccctgtcgcaggaatctgaggtcgaagaaccccttagtcaggagtctcaggttgaagagcccctaagccaagaatccgaggtcgaagaaccgttatcccaggaatctcaggtagaggagccgctgtcgcaggagtctgaggtcgaagagccactatctcaggagtctcaagtagaagagcctttatctcaggagagtgagatggaagaaccactgtcacaggaatcacaggtcgaggaacctctcagtcaagagtccgagatggaggagccccttagccaggagtctgagatggaggaactgccatcggtgtag

SEQ ID NO: 24833 - DNA, 561 bp, Artificial Sequence
  Description of Artificial Sequence: Synthetic coding sequence
atgagccccaagcccagggccagtggccctcccgcaaaggccaaggaagccggtaaaagaaagagcagctcacagccctctccgtccgatcctaagaagaaaaccactaaggtcgctaagaaaggaaaagccgtgcgcagagggaggcggggtaagaagggagccgctaccaagatggcagcagttacagcgcctgaagcagagtcagggcctgcagcccctggacccagcgaccagccaagtcaggagttgccgcaacacgagttgcctcctgaggaaccagtttccgagggaacacagcacgatcctctgagccaggaatccgagctcgaagaaccactctcacaggagtccgaagtggaggaacctctgtcccaggagagccaagtagaggaacctctgtctcaggagtccgaagttgaggagccgctcagccaggaatcccaagtggaggagcctttaagccaggaatctgagatggaggaacccctatctcaggaatcccaggtcgaggaaccactgagtcaggagagtgaaatggaggagctcccaagcgtgtag

SEQ ID NO: 24834 - DNA, 651 bp, Artificial Sequence
  Description of Artificial Sequence: Synthetic coding sequence
atgtcacccaagccaagagcttccggtccccctgccaaagccaaggaagcagggaagaggaaatctagctctcagccaagcccgtccgatccgaagaagaaaaccaccaaagtggcgaagaaggggaaggcggtgcggaggggcaggagaggaaagaagggggcagccactaaaatggcggctgtaactgccccagaggccgagtcgggcccagccgcacctgggccaagcgatcagccctcccaagagctgcctcagcacgagttgccacctgaagaacctgtcagtgagggcactcaacatgaccccctgtcccaggagtccgaacttgaggaaccactatcacaagagagtgaggtggaggagccgctcagccaggagagccaagtcgaagagccgctgagccaggaatctgaagtcgaggagcctctttcccaagagagccaggtggaagagcccctgtcacaggagtcagaggttgaagaacccctgagtcaagagagccaggtggaggaacccctctcccaggagagcgagatggaggagcccctcagtcaggagagccaagtcgaagagccattaagccaagaaagtgagatggaggaacctctgagccaggagtccgagatggaggagctgccatccgtctag

SEQ ID NO: 24835 - DNA, 561 bp, Artificial Sequence
  Description of Artificial Sequence: Synthetic coding sequence
atgtcccccaagccaagagcatctggaccacctgcaaaggcaaaggaggccggaaagcgaaaaagtagctcacagccgtctccctcagatccgaagaaaaagaccactaaggtagcaaaaaagggcaaggccgtacgacgagggagaagaggaaaaaagggcgctgcaaccaaaatggctgctgtgaccgctcctgaagctgagagcgggccagctgctccagggccaagcgaccagccgtctcaggagctgccacagcacgagctacctcctgaggaacctgtaagcgaagggacccaacacgatccactgtcacaagagagtgagctcgaggaaccactctcgcaggaatcagaagttgaagaacctctctctcaggaatcacaggtggaggaacctttaagtcaggagagcgaggtggaggagcccctgtcacaggagtctcaggtggaagagcccctctcccaggagtctgaggtggaggagcctctctctcaggaaagcgaggtagaggaaccattgtcacaggagagcgagatggaagagctacccagtgtgtag

SEQ ID NO: 24836 - DNA, 777 bp, Artificial Sequence
  Description of Artificial Sequence: Synthetic coding sequence
atgcggttgtcatcctctccaccacggggacctcagcagctcagctcctttggcagtgtcgactggttatctcagtcctcatgttcaggccctacccatacgcctaggccagcagacttctcacttggaagcctccctggacctggacagactagcggggcacgcgagccaccccaggctgtatcgattaaggaagcggctggctctagtaacctgcctgccccagagcggacgatggccggattatccaaggaaccaaataccctgcgtgcgcctagggtgaggaccgcctttacaatggaacaggtgagaacactcgagggcgtcttccaacaccaccagtacctgagcccactggaaagaaagcggttagcccgtgaaatgcaactgtcggaagtgcagatcaagacctggttccagaacagaaggatgaagcataagcgtcagatgcaagacccacagctccatagtccttttagcgggtccttgcatgcaccacccgctttttatagcacgagttctggacttgccaatggactgcagctcctgtgtccttgggctccgttatccggaccccaggcactgatgctccctcctgggagcttctggggattatgccaagtggcacaggaagctctcgcctccgcaggagcttcctgctgtggccagcccctagcttcccacccccctactcctgggcgaccaagcctgggcccagctctcagcactgggccacggggtctctgtgccatgccacagaccggcgatgccttttag

SEQ ID NO: 24837 - DNA, 561 bp, Artificial Sequence
  Description of Artificial Sequence: Synthetic coding sequence
atgttcggaaaaccggacaaaatggacgtgcgttgccactccgacgcagaggccgctagggtgagcaaaaatgcccataaggagtcccgagagagcaagggagccgagggaaatctgcccgctgccttcctgaaggaacctcaaggggctttctccgcctccggagccgctgaggattgcaacaaatccaagtccaattcagcagctgatccagactactgccgtcgtatcctggtaagagatgccaaaggctcaatccgtgaaattattctcccaaaagggttagatttggatcgtcccaaaaggacccggacctcgttcactgctgagcaactgtacagattggaaatggagttccagcgttgtcagtacgtggtgggaagggagaggactgaactcgctcggcagctgaatttatctgaaacgcaagcaaacagtgaagaaaataatgaacggttcaagaggggcattaagaagcagaagaagaagcgcaagaaagaaccagctaacgatgagtcacgcaggggtgattcaggaggaagaggttggcagccactgtag

SEQ ID NO: 24838 - DNA, 1005 bp, Artificial Sequence
  Description of Artificial Sequence: Synthetic coding sequence
atgttcggaaagcccgataagatggatgtgcggtgtcatagcgacgcagaggcagcccgagtgagcaagaacgcacacaaagagtcacgagagtccaaaggggcagagggcaatctgcccgcagcgttcctgaaagagccgcagggagcatttagcgcctcgggagctgcggaggactgcaacaagtccaagtctaattcagcagccgaccccgattactgtaggcggattctggtgcgggacgcaaaagggtccattagagagatcatcctccccaagggcctggatttggatagaccaaagcgtacccggacaagttttaccgctgagcaactgtacagactggaaatggagttccagcgctgtcagtacgtagtggggagggagcgaacagagttggccaggcaactgaatctgagtgaaacgcaggtgaaagtgtggtttcagaaccgtagaactaaacagaaaaaggatcaaggcaaagatagcgaacttcgtagtgtggtctcggaaaccgctgccacctgctctgttctccggctcttggagcagggcaggttactatcccctcctggcctgcctgccctgttacccccttgtgctaccggggctcttgggtctgcacttcgcggtccatcgctgccagcactgggcgcaggggcagctgcaggctcagctgctgctgctgctgccgcagctccagggcctgccggtgcggcttctccacatccccctgccgtgggaggcgcacccggtccgggtcccgcaggaccaggcggtttgcatgccggagcacctgccgctgggcattccctcttcagcctgcctgtccctagccttttgggctcagtggcaagcagactttcctccgcccctctgaccatggccggatccctcgcgggaaacttgcaggaactgtcagccaggtatctatcttcttctgcttttgagccctactctcgtacaaataacaaggaaggggctgaaaagaaggctctcgactag

SEQ ID NO: 24839 - DNA, 711 bp, Artificial Sequence
  Description of Artificial Sequence: Synthetic coding sequence
atgaccgctgaatttctgagtttattatgtttggggctttgcctgggttatgaagatgagaagaaaaacgagaagcccccaaaaccaagcttacacgcctggcctagcagcgtggtcgaagctgagtcgaacgtcaccctgaagtgccaggcccacagtcaaaatgtgacattcgtcctcagaaaagttaatgactccggatataagcaggaacagtcatctgctgagaatgaagcagaatttccattcaccgatctgaagcctaaggatgcaggtcgctacttctgcgcatataaaaccacggcatcccatgagtggagcgagtcaagtgaacatttgcaactggttgttaccgacaagcacgatgagctcgaggccccatcaatgaagacagacactaggaccattttcgttgcaatttttagttgcatcagtatcctactgctcttcctgtccgttttcattatctacagatgcagtcagcattcatctagtagcgaggaatcaaccaaaagaacctcccactctaaactgccagaacaggaagcggctgaagccgatctatcaaacatggagagagtgagtctctctacagcggatccgcagggcgtgacctacgccgaactgtccacgtcggccctgagcgaagcggcttccgacactacccaagagcccccaggaagtcacgagtacgcggcacttaaggtgtag

SEQ ID NO: 24840 - DNA, 447 bp, Artificial Sequence
  Description of Artificial Sequence: Synthetic coding sequence
atgaggaaacgcatgggccctacgcggctgcctcgcctcgaatgcagtggcgctattaccgcacactgctctctagacctgccgggacccgacaagcatgacgagttggaggccccttctatgaagacagacacccgtaccatctttgtcgccattttctcctgcatctctatactgttactgtttttgtcagtgttcattatctaccgatgcagccagcactcatcctccagcgaagaaagtacaaagcgtacaagccatagtaaactgcctgagcaagaggccgctgaggccgacctttccaatatggagcgtgtatccctgagtaccgctgatccccagggagtgacatacgccgagctgtctacgagtgcgttatcagaggcagcatctgacactactcaagagcccccaggttctcacgagtatgctgccctgaaggtttag

SEQ ID NO: 24841 - DNA, 618 bp, Artificial Sequence
  Description of Artificial Sequence: Synthetic coding sequence
atgaccgccgagtttttgagcctcctctgcctggggctgtgcctgggatatgaggatgaaaaaaagaatgaaaagcccccaaagccaagcctgcatgcctggccttcctctgtggttgaggcagaaagcaacgttactctgaaatgccaggcacattcccagaatgttacttttgtattaaggaaggtcaacgatagcggttataagcaggaacagagcagtgcagaaaacgaggccgaattccctttcaccgacctcaaacctaaagatgccggaaggtacttttgcgcttataagacaacagcgtcacatgaatggtcggagagctctgaacacttgcagctggttgtaaccgataaacacgatgagctcgaggcgccttctatgaagactgggagctccagcgaggagtccacaaaacgcacttcacacagcaagctgcccgaacaggaagccgcagaagctgacttatccaatatggagcgggttagtctgtcgaccgccgatcctcagggggtgacttatgcggagcttagcactagcgcccttagcgaagctgcctcggacacgacccaagaaccacccggatcgcacgagtatgcagctctcaaggtctag

SEQ ID NO: 24842 - DNA, 432 bp, Artificial Sequence
  Description of Artificial Sequence: Synthetic coding sequence
atgacggctgagttcctttctttgctgtgcctgggactatgtcttggctatgaggatgaaaagaagaatgaaaaaccccctaagccctctctccatgcgtggccgtcatctgtggtagaagcagaaagcaatgttacgctaaagtgccaggcgcattcacagaatgtaacatttgttctgcggaaagtgaacgactcaggctataaacaggaacagagttcagctgagaatgaagcagagtttccattcactgacctaaagcccaaagatgcagggaggtatttttgtgcgtacaaaacaactgcgtcccacgaatggagcgagagttccgaacacctgcagctggtggtaactgataaacacgatgaactagaagccccttccatgaagaccgtggctcatgtttgtaatacacgcacattaggacgctag

SEQ ID NO: 24843 - DNA, 1272 bp, Artificial Sequence
  Description of Artificial Sequence: Synthetic coding sequence
atggcacagctccagacacgattttacaccgataacaaaaagtacgcggtggacgacgtgccattttctatacctgctgctagtgaaatcgcagatctttccaatatcatcaataagctgcttaaggataaaaatgagttccacaagcatgttgaatttgacttccttatcaaggggcagttccttagaatgccactcgataaacacatggaaatggagaatatttccagcgaagaggtggttgagatcgagtatgtcgagaaatacactgcacctcagcccgagcagtgtatgttccatgatgattggatctcatctattaagggtgctgaagagtggatactgacaggctcatacgacaagacttcccgtatctggagcctggagggtaagtctattatgaccatagttggccataccgacgtggtgaaagatgtggcgtgggtgaaaaaagactctctcagctgtttgctgctttcagcttccatggaccagacaatcctgttatgggaatggaatgttgaaaggaacaaagtcaaggctttgcattgctgcaggggacacgcagggtcagtggactccatcgcagtggacggtagtgggactaaattctgcagcggctcatgggacaagatgcttaaaatctggagcaccgtccccaccgatgaggaggatgaaatggaagagtctacaaatcggccacgaaaaaaacagaaaacggagcagcttggactcaccagaactcccatagtaaccttgtctggacatatggaagcggttagcagcgtcctgtggtctgatgctgaagaaatatgcagtgctagctgggaccacactatacgtgtgtgggatgtggaaagtggttccctcaaatcaactttgacaggaaataaggttttcaattgtatcagctacagccccctttgcaagagactggccagcggatcaacagaccgccacattagactttgggacccaagaacaaaggacggaagtcttgtgtctctgtctctgacctctcataccggctgggtgacgagcgtcaaatggagcccaacacacgaacagcagctcatttcaggctccctggacaatatagtgaaactgtgggacaccagaagttgcaaagcccctctatatgacttggctgcccacgaggacaaggttctctcggtagactggacagatactggcctgctgttatccgggggagcagacaataagttgtattcttatcgttattcgcccacgacctcccacgtcggtgcttag

SEQ ID NO: 24844 - DNA, 2034 bp, Artificial Sequence
  Description of Artificial Sequence: Synthetic coding sequence
atggccgctggaggcggaggttcctgcgacccacttgcacctgcaggcgttccatgcgctttcagccctcacagccaagcttacttcgctctggctagtacagatgggcatctaagggtatgggaaaccgccaacaacagactgcaccaagagtatgtgccttccgcccacctatctggaacttgtacctgcctggcatgggccccagcacgtttgcaggctaaggagagtcctcagaggaaaaaaagaaagtccgaagcagtgggtatgtctaaccagaccgacttgctcgcactggggacagcagtggggagcatactcctgtacagcacggtaaagggagagctacactccaagttgattagtggtggacacgacaaccgggttaattgtatccaatggcatcaggactctggctgcctgtactcctgtagcgatgataaacatatcgtggagtggaatgtgcagacctgtaaggtgaaatgtaaatggaagggcgataacagctccgtttcctccctgtgtatctccccagatggcaaaatgctactcagcgcgggaaggacgatcaagctttgggttctcgagactaaggaggtgtaccgccactttaccgggcacgctacgccagttagttctctgatgttcaccaccattaggccacccaatgagtcccagccttttgacggcattacgggactgtattttctttccggagcggtgcacgataggttgctgaatgtatggcaggtgcgatcagagaacaaggagaaatccgcagtgatgtctttcacggtgacggacgaacccgtctatatcgacctgacgctgagtgagaataaagaggagccagtcaagctagcagtcgtgtgtcgggatggtcaggtgcatctgtttgagcatatcctgaatgggtactgcaagaagccgttgacttcaaattgtacaatccagatcgcaactccgggaaagggaaaaaagtctaccccaaagcccatccctatcctggctgctgggttctgtagcgacaaaatgagcctgctcctagtctacggcagctggtttcagccaaccatagaaagagtggccctgaacagccgcgaaccgcatatgtgcctagtacgcgacatttcgaactgttgggcacctaaagtggaaaccgctataacaaaggtgcggaccccagtgatgaatagtgaggctaaggtactggttcctggtattcccggacatcatgcagctataaaacccgctcccccacaaacagagcaggttgagagtaaaagaaagagtgggggaaacgaggttagcatagaggagcggttgggcgcaatggacattgacacccataagaagggcaaggaggacttgcaaacaaacagcttccccgtcctgctgacccaaggtcttgagtctaatgactttgagatgctgaataaggttctgcaaactagaaatgtgaatctgatcaagaaaactgtgctgcgaatgcctttgcatacaatcattcctttacttcaggaactgacaaagaggcttcagggccacccaaattctgctgtgcttatggtacaatggctaaaatgtgtactcaccgtccatgcctcttatctcagcacattgccagatctggtcccccagctcggtacactctatcaactgatggagagtagagtcaaaacattccagaagctgtctcacctgcatggaaagctgatactactcattactcaggtcactgcatctgaaaaaaccaaaggggctacgagccctggtcagaaagctaaactggtgtatgaagaggagagcagtgaagaggaatccgacgacgagattgcagataaagactccgaggacaactgggacgaagatgaggaggaaagcgaaagtgagaaggacgaggacgtggaagaagaggacgaagacgccgaaggcaaggacgaagagaatggcgaagaccgggacaccgctagcgaaaaagaactgaacggagattctgatctggaccccgagaacgagtctgaggaagaatag

SEQ ID NO: 24845 - DNA, 1005 bp, Artificial Sequence
  Description of Artificial Sequence: Synthetic coding sequence
atggccactgaggaaaagaaaccagagacagaggccgctagagcccaaccaacgccatcatcctccgctacacagtctaaacctaccccagtgaagcccaattacgctttgaagttcaccttagctggccatacaaaggcggtgtcttcggtgaaattctctcccaatggggagtggctggcgagcagttcagcggacaagttaatcaaaatatggggcgcttatgatggtaagtttgagaagacgattagtggacataagcttggtatttcggacgtggcctggtcaagcgatagcaacctgctggtctctgcttccgatgacaagacactgaaaatctgggatgtaagcagcggcaagtgtctcaagaccctcaagggacatagcaattacgtgttctgctgtaacttcaatccccagagcaatttgatcgtttctggctcattcgacgaatctgtgcggatttgggacgttaaaactgggaaatgtctcaagacactcccagcccactcggacccggtgtctgccgtacatttcaacagggatggatctctgatagtttcatcctcatatgacggactgtgcagaatctgggatacagctagcggccaatgcctgaagaccctcatcgacgacgacaatccaccggtttcattcgtcaaattcagcccgaatgggaagtacatcctggccgctacactagataacaccctcaagttgtgggactattcgaaaggtaaatgcctcaagacgtatacaggacacaaaaacgaaaaatattgtatcttcgctaacttttccgtgactgggggaaagtggatcgtcagcggtagcgaagacaatttggtgtacatttggaacctgcagacgaaggagatcgtccagaaattgcaagggcacaccgatgttgtcatctctaccgcatgtcaccccacagagaatataatagcctcagccgctctggagaatgacaagaccatcaaactgtggaagagcgactgctag

SEQ ID NO: 24846 - DNA, 1005 bp, Artificial Sequence
  Description of Artificial Sequence: Synthetic coding sequence
atggctacagaggaaaaaaaacccgagactgaagctgccagggctcagccgacgccaagtagtagtgcaacacaaagcaagcccacccccgtcaaacccaactacgccttaaaattcaccctggccggtcacacaaaggctgtttcctctgtgaagttctcccccaacggagaatggctcgcatcttcctcggcagacaaactcatcaagatatggggcgcttacgacgggaaattcgagaagactatatctgggcacaagctggggatttctgatgtagcttggtccagtgacagcaacttgttagtgtctgcgtccgatgataaaacactgaaaatctgggatgtcagctcaggcaagtgcctcaagactttgaaaggacactccaattatgtgttttgctgcaactttaatccacagagcaatctcattgtgagtggtagcttcgacgaaagtgttcgtatctgggacgttaaaactggaaaatgcttgaaaaccttgcctgcccattctgatcccgtctccgctgtgcactttaaccgcgacggttcactcatagtgagctcatcttacgacggcttgtgcagaatatgggacacagcctcggggcagtgtctgaaaacactcatcgatgacgacaatccaccggtgtcattcgtaaagtttagtcccaacggcaaatatattctggccgctacgttagacaatactctcaagctgtgggattatagcaaggggaagtgcctgaagacatacacgggacataaaaatgagaagtactgtattttcgccaatttctccgtgacaggtgggaagtggatcgtttcagggtcggaggacaatctggtatatatatggaatctgcagacaaaggagatagtacagaaattgcagggtcacacggacgtggtgatctccaccgcctgtcacccaacagagaatatcattgctagcgcagctctcgagaatgacaaaaccattaaactgtggaagtccgattgctag

SEQ ID NO: 24847 - DNA, 1158 bp, Artificial Sequence
  Description of Artificial Sequence: Synthetic coding sequence
atggcagccgcagcggcaaggtggaaccacgtgtgggtggggacagaaacaggcatccttaagggcgtgaacctccagagaaagcaggccgctaattttacagccggtggccagccaaggcgggaagaggcggtgtcagcgctctgctggggtacaggcggagaaactcagatgctcgttggttgcgccgaccgaactgtgaagcatttttcaaccgaagatggcatcttccaggggcagcgtcattgccccggaggggaaggaatgtttcgagggctcgcccaggctgacgggactctcattacgtgtgtggactcagggatactgcgggtttggcatgacaaagacaaggatacaagttctgacccactgctcgaacttcgagtcgggccaggcgtttgccgaatgcggcaggacccagcccatccacatgtggtggccacaggcggtaaggagaacgccctcaaaatctgggacctccaggggtcagaagagcctgttttcagggccaagaatgtgcgcaatgattggctggacctgagagtccctatatgggatcaggacatccagttcctcccaggatcgcagaaactggtcacgtgcacaggctaccaccaggtgagggtctacgaccccgcatcgccccagcggagaccggtgctggagactacatacggtgaataccccctcacggcaatgactctgactcccggagggaatagcgtgatcgtggggaatacgcatgggcaactggccgaaatcgatctacgtcaggggagattgctagggtgcctgaaaggacttgctggctccgtcagagggctgcaatgccacccgtctaagcccttgcttgcatcctgtggactggacagggtgcttcggattcacaggattcaaaatccaaggggccttgaacataaggtctatctgaagtctcaattgaattgcttactgctgagcggacgggataattgggaagatgaaccacaagaaccacaggagcccaacaaggtgccgctcgaagacacagagactgatgaactgtgggcatcccttgaagctgcagcgaagcgtaagcttagcggcttggagcagcctcagggggcactgcagactcgaaggagaaaaaagaaacggcctggatccacctcaccttag

SEQ ID NO: 24848 - DNA, 1101 bp, Artificial Sequence
  Description of Artificial Sequence: Synthetic coding sequence
atggccgctgccgctgcccgatggaaccacgtgtgggttgggacagagaccggtatactcaagggcgtaaaccttcagcggaagcaagccgcaaacttcaccgccggtggacagcctagacgcgaagaggctgtgtccgcactgtgctgggggactggcggagagacccagatgctcgtgggctgtgctgacagaacggtaaaacacttctctaccgaggacgggatttttcagggacagcggcactgtcctgggggagaagggatgttccgtggcttagctcaggctgacggcaccctcatcacttgtgtcgatagcgggatcctaagggtctggcacgataaggacaaagacaccagttcagaccctctgcttgagctccgtgtaggaccaggtgtgtgtcgcatgcgccaggatccagcccatccccacgtagtggcaaccggcggaaaagaaaatgcccttaagatctgggacttgcagggctccgaggagccagtgttccgggctaagaacgttcgcaatgactggctggatctgcgtgtgcctatctgggaccaggatatccagtttttgcccggttcccagaaactggtcacatgtactggctaccatcaagtccgggtgtacgacccagcctcgccccaaaggcggccagtgctggaaactacctacggagagtatccgctgacagccatgactctcacgcccggagggaactccgtcattgtaggcaatactcacggccagctcgctgaaattgatctccgacaaggccgactgctcgggtgtctgaaaggcttagccggtagtgtgcgcggactgcagtgtcatcccagcaagccgctgttggcctcatgtgggcttgaccgggtgctgaggatacacaggatccagaatcctagaggcttggagcacaaggacgagccccaggaaccacaggagcctaacaaggtacccttggaagacacggaaacagacgaactatgggctagcctggaggcggcagctaagagaaaactctctggcctggaacagcctcagggagcccttcagactaggagaagaaaaaaaaagaggcccggatcaactagtccatag

SEQ ID NO: 24849 - DNA, 1158 bp, Artificial Sequence
  Description of Artificial Sequence: Synthetic coding sequence
atggccgctgccgctgcacgttggaatcacgtgtgggtgggcacagaaactggaattctgaagggagtgaacctccagaggaaacaggctgccaatttcacagccggtggacagcctcgcagagaggaggctgtgagtgcgttatgctggggaacaggcggtgaaacccagatgttggtgggctgtgcagataggacagtaaaacattttagtacagaagacggtattttccagggacagaggcactgtccaggaggggaaggcatgttccgtgggctggctcaggctgatggaaccctgatcacctgcgttgacagcggtatcctcagagtttggcacgataaggacaaagatacaagttcagacccccttcttgaactcagggtggggccaggcgtttgtagaatgaggcaggaccccgcacatccccacgtagtggccaccgggggaaaggaaaacgcgcttaagatctgggatctgcaaggttctgaggaaccggttttcagagcaaagaacgtgaggaatgactggctggatctccgggtccccatctgggaccaggatattcagtttttgcccggttctcagaagttggttacatgcacagggtaccatcaggtccgggtttacgaccccgcttcaccacagcgacggcctgtacttgagactacttacggcgagtatcctctgaccgccatgacactgacacccggaggcaactccgttatagtgggaaacacgcacgggcaacttgccgaaatagacctgcggcagggtaggctgctgggctgcctgaagggactggctggctctgtcagagggctgcagtgccacccgtctaagccactcctggcctcctgcggacttgaccgagtgctgaggatccaccgcattcagaatccacgcggactcgaacacaaggtgtacctgaagtcacaacttaactgcttgctcctgagcggtagagataattgggaggatgagccccaggaaccgcaggagcctaacaaagttcccctggaggacacggagactgacgagctgtgggcgtctctggaagccgcagccaagaggaagctgtcaggactggagcagcctcaaggagctctgcagacgaggcggaggaagaaaaaacggcctggttctacatctccttag

SEQ ID NO: 24850 - DNA, 1158 bp, Artificial Sequence
  Description of Artificial Sequence: Synthetic coding sequence
atggcggctgctgctgccagatggaatcatgtgtgggttgggaccgaaaccggcattctgaaaggagtcaatcttcagaggaagcaggctgccaacttcaccgccggtggacaacctagacgggaagaggcagtaagcgcgctctgctgggggaccgggggagagactcagatgcttgtcgggtgtgctgacaggactgtaaaacatttcagtactgaggatggcatcttccagggccagcggcattgccccggtggcgaagggatgtttagaggtctggcccaagcagacggtacgctgataacttgcgtggattctggaattttaagagtctggcacgataaagataaagatacaagttcagacccattactggaactgcgagtcggtcccggtgtctgccgaatgagacaggaccccgctcatccacatgtggtagccactggaggaaaagagaacgctttaaagatctgggacctgcagggttcagaggagcccgtgtttagggcgaaaaacgtgcggaacgactggctcgacctccgtgtgccgatttgggaccaggatattcagttcctgccagggagtcagaagctggtgacatgtactggttaccaccaggttagagtttacgacccagcgtctccccagcgtcgccctgtgctagagaccacttatggggaatatcccttgacggcaatgactcttacgccaggcggaaatagtgtcatcgttggcaacactcacggacaactggcggaaatagacctacggcagggacggctgctgggctgtctaaagggcctggcaggatccgtgaggggactccagtgccatccatccaaacctcttttggccagttgtggcctcgaccgggtactgcgcatccacagaattcaaaaccccagaggattggagcataaggtttacctgaagtcacagctgaactgcctcttactgagcggcagagataactgggaagacgagccccaggagcctcaggagcctaacaaagtacccctggaggacactgaaactgatgagttgtgggcttccctcgaggctgccgcaaagcgcaaactaagcggactggagcaaccacagggagctcttcagactcggaggcgcaagaagaagcgaccaggctctacatccccatag

SEQ ID NO: 24851 - DNA, 117 bp, Artificial Sequence
  Description of Artificial Sequence: Synthetic coding sequence
tgatgggcctcattggaggccgcagctaaacgtaagctgtccgggttagaacagcctcaaggtgcactgcagacaagacgcaggaagaaaaagcgacctggctccacctccccgtag

SEQ ID NO: 24852 - DNA, 174 bp, Artificial Sequence
  Description of Artificial Sequence: Synthetic coding sequence
atggcagccgctgcagccaggtggaatcatgtgtgggtggggacggagacagggattctcaagggggtgaacctgcagcgtaagcaggccgctaacttcaccgcagggggtcagcccaggcgcgaagaggccgtcagtgccctatgctggggcactggaggcgagacccagtag

SEQ ID NO: 24853 - DNA, 2493 bp, Artificial Sequence
  Description of Artificial Sequence: Synthetic coding sequence
atggtggaggaagagaacatcagggtggttagatgcgggggaagcgagttaaattttagacgagcggtcttttccgccgatagcaagtatattttttgtgtttcaggtgacttcgtcaaggtttactcgactgtcacagaagagtgcgtgcacatattgcatggccaccggaacttggtaacgggaatccagctcaaccccaataatcacctccagctctattcttgctctctagatggaaccatcaagctctgggactacattgatggtattcttatcaaaacctttattgtggggtgcaaacttcacgccctgttcacgcttgcccaagcagaagactccgtgttcgttatcgtcaataaggaaaaaccagacatcttccagctcgttagcgtgaaactgccgaagagcagctctcaggaggtggaagccaaggaattgagttttgtgcttgactatatcaatcagagtccgaaatgcattgcctttgggaacgaaggcgtgtatgtggctgcggtacgtgagttctacctgagtgtttactttttcaagaagaaaaccacaagcagatttactctttcaagttcacgcaacaagaagcacgcaaagaacaactttacttgtgtcgcctgccacccgacggaggattgtattgcaagtggtcacatggacggtaaaataagactttggcggaacttttatgacgacaagaaatacacatacacctgcctccattggcatcacgacatggtgatggacctcgcctttagtgtgaccggcacgagtctgctcagtgggggaagagaatctgtgctcgtcgagtggcgcgacgccaccgaaaaaaataaggagtttttacccaggctgggggctaccatcgagcacatttcagtgtcaccggcaggggatctgttttgtacttctcactcggacaacaagattataatcatccacagaaatctcgaagcaagcgccgtcatccaggggctggttaaggacaggagcattttcaccgggttgatgatcgacccgcgaaccaaggcccttgtgcttaacggaaaacctggacacctgcagttctactccctgcagtctgacaaacagctgtacaatcttgacatcatccaacaagaatatatcaatgattacggtttgattcagatagaattgacaaaagccgctttcggctgctttggaaattggctcgccaccgtcgagcagcgacaggagaaggaaaccgagctcgagcttcagatgaagctgtggatgtacaataagaagactcaagggttcatactgaatacaaagataaatatgccacacgaagactgcatcactgccctctgtttttgcaacgctgagaaatcagagcagcctacactggtgacggcttctaaggatggctattttaaggtttggatcctgaccgacgactccgacatttataaaaaggccgttggctggacctgcgattttgtcgggtcttatcataaataccaagctaccaattgctgctttagtgaggatgggtcccttctcgccgtatccttcgaagagattgtgacaatttgggacagcgtcacatgggagttaaaatgtacgttctgccagagggccggaaagatacgccacctgtgcttcggccgattgacctgctcaaagtaccttctgggcgctaccgaaaatggtatcctgtgctgttggaatctgctgagttgcgctctcgaatggaatgccaaattaaacgtgcgcgtgatggagccggacccgaactctgagaatatcgcagctatctcccagtccagcgttggttctgatttgtttgtattcaagccaagcgaacctagacccctctacattcaaaaagggattagcagggaaaaggtccagtggggtgtattcgtaccacgcgacgtgccagaatcctttacctccgaagcgtatcagtggctaaatagatctcagttctacttcttgactaagtcccagagcctgctgacctttagtaccaagagccccgaggagaagctgactccgacgtctaaacagctgctggcagaagagtcactgccaactactcccttttactttattctcgggaagcacaggcagcagcaggatgagaagctgaacgaaacgctggagaacgagctagtccagctgcccctcaccgaaaacatcccagccatctctgagctcctccacacgcctgcacatgtcctcccatcggctgcctttctgtgctccatgtttgtgaattcccttctactttcaaaagaaaccaaaagtgcaaaagaaatacccgaggacgtcgatatggaagaagagaaggagtctgaggatagcgacgaggagaatgacttcaccgaaaaggttcaagatacatctaacacaggcttaggagaggacataattcaccagctgtccaaatccgaggaaaaggaactgcgcaaatttagaaaaatcgattatagttggatagccgctctctag

SEQ ID NO: 24854 - DNA, 1155 bp, Artificial Sequence
  Description of Artificial Sequence: Synthetic coding sequence
atggtaaagcttattcacactctggcggaccatggcgacgatgttaattgttgtgcttttagcttctcccttctggccacgtgcagcttagataagaccatccgattatactccctaagagattttaccgagctcccccactccccactcaaatttcatacatatgctgttcattgctgttgcttctccccctctggtcacattcttgctagttgttccaccgatggaacaacagttctctggaacacggagaacggacaaatgctggctgtgatggaacaaccaagcggaagccctgtcagagtttgccagttctctcccgattcaacttgtctggcaagtggagccgcagatgggactgttgtattatggaatgcccagtcttacaaactgtatagatgtggtagtgtgaaggacgggtccctggccgcatgtgccttctcacccaacggaagtttcttcgtaacagggtcatcatgcggtgatctcacggtctgggatgataagatgcggtgtccccacagcgagaaggcccacgacctcggtatcacttgctgcgacttcagcagccagcccgtatccgatggagaacaggggctccagtttttccgtttggccagctgcggccaggactgtcaagtgaaaatctggatagtctccttcactcatatactggctaggcgcaccgaacaccagttaaaacaattcaccgaagattggtcagaagaggatgtgtccacgtggttatgtgctcaggatctgaaagacctcgtcggcatttttaagatgaacaatattgacggcaaggaactgcttaatttaactaaagaaagcctcgcagatgatcttaaaatcgaaagtctggggcttagatctaaggtgttgaggaaaatcgaggaactgcggacaaaggtcaaaagtctgagctcaggcatcccagatgaatttatctgtccaattactcgagaacttatgaaggatccagtgatagcgtcagacgggtactcctacgagaaggaagcgatggagaattggataagcaagaagaaacggacttcaccaatgactaatctggtgcttccaagtgcagtcttaactcccaataggacccttaagatggctatcaaccggtggctcgaaacacaccagaagtag

SEQ ID NO: 24855 - DNA, 1431 bp, Artificial Sequence
  Description of Artificial Sequence: Synthetic coding sequence
atggtgaaactgatccacacgttggcggatcacggggatgatgttaattgctgcgctttcagcttcagtctccttgcgacatgtagcttggacaaaactattcgcctgtactcattgcgtgatttcacagagctgccgcacagtcccctgaaatttcatacgtacgccgtgcattgctgttgttttagcccatccggtcacatcttggcaagctgtagcactgacgggacaacagtgctatggaacaccgagaacggccagatgctagctgtgatggagcaacctagcgggtcccccgtgagagtctgtcaattttccccagatagcacctgccttgcgagcggagccgcagacgggactgtggtcctttggaatgcacagtcctataagctgtacaggtgtgggtcagtcaaagatggcagcctcgcagcctgcgcattctcgccaaacggctcgtttttcgttaccggctcttcctgcggggatctcaccgtttgggatgacaagatgaggtgcccccactccgaaaaggctcacgacctggggatcacatgctgtgacttttcttctcaaccagtgtccgatggagagcagggcctgcagttcttccggctggccagttgcggccaggactgtcaagtcaaaatctggatcgtcagctttactcatatcctgggattcgagttgaaatacaagtccaccctctccggccattgcgctcctgtgctggcctgcgccttcagtcatgacggccagatgttggtatctggatcagtcgacaaaagcgtgattgtctatgacacaaatacagagaacatcctgcataccctgactcagcatacgcggtacgtgaccacttgcgcatttgcacccaacaccctgctcctggccaccggcagcatggataagacagtcaacatctggcaatttgacctcgagacactctgtcaagcccgtaggaccgaacaccaactcaaacagttcaccgaggactggagcgaggaagatgtgtctacctggttgtgcgcccaggatctcaaagatttggtgggaatctttaagatgaataatatcgacgggaaggaactcctgaacctgaccaaggaatcgcttgcagacgatttgaaaatagaatccctcggcctcagaagtaaggtgttacgtaagatagaggagctaagaacgaaagtcaagagccttagctctggcatcccagatgagtttatctgtcctattactcgggagttgatgaaagaccctgtcattgcctctgatgggtacagctatgagaaagaagccatggagaattggatttccaaaaagaagcggacatctcccatgactaacttggtcttgccctctgccgtccttactcccaatagaaccctgaaaatggccattaaccgctggctggagacccaccagaaatag

SEQ ID NO: 24856 - DNA, 1431 bp, Artificial Sequence
  Description of Artificial Sequence: Synthetic coding sequence
atggtcaagctcattcatactctcgccgatcatggcgatgatgtcaactgttgcgccttcagtttttccctgttggctacttgcagcttggacaagaccatacgattgtactcattacgtgattttacagaactgccccacagccctctcaaattccacacatacgccgtgcattgttgttgctttagtccttcaggccacatcttagcttcctgctccacggacggcacaactgtgttgtggaatactgaaaacggccaaatgctggctgtaatggagcagccttctggctcaccagtgagggtgtgtcagttctctccagactccacatgtctggcctctggagctgccgacggaacggtggtgctgtggaacgctcagagctataaattgtacagatgtggctctgtaaaagacggatctctcgcagcgtgtgcattttcaccaaatggttccttcttcgtgaccgggtcatcctgtggagatctgaccgtgtgggacgataaaatgcgctgtccgcacagcgaaaaggctcatgacctcggaattacctgctgcgatttctccagccagcccgtgagtgacggcgaacaggggctgcaatttttccgcttggcctcctgcgggcaggattgtcaggtcaaaatatggatcgtctccttcacacacatcctgggatttgaactgaaatataaatctacactctctgggcattgtgcccctgtcctggcctgcgcgttcagccatgacggacaaatgcttgtctctgggtctgtggacaagagcgtgatcgtttacgatactaataccgaaaacatccttcacaccttaacacaacacactagatacgtaaccacttgcgcctttgctccaaacaccctgcttctggccaccggcagcatggataagaccgtaaatatctggcagttcgatctggagaccctttgtcaagcccgacggacagaacatcagttgaagcagtttaccgaagactggtctgaggaagatgttagcacctggctgtgcgcacaggatctgaaagacctggtggggatctttaagatgaataatatcgacggcaaagagctgctgaacctgaccaaggaatcactggcggatgacctcaagatcgaatcattagggctgcggtccaaggtcctccgaaagatcgaagagctgcggactaaggtcaaatctctgtcctcaggaattcccgatgagtttatatgccctataactcgcgaattaatgaaggatcccgtgattgcatctgacggatatagttacgagaaggaagctatggagaattggattagcaagaaaaaacgaacttcaccaatgaccaacttggtcctccctagcgccgtgcttactccgaaccggacactaaagatggctataaaccggtggctggagacgcatcagaagtag

SEQ ID NO: 24857 - DNA, 1431 bp, Artificial Sequence
  Description of Artificial Sequence: Synthetic coding sequence
atggtaaagttgattcacacactggcggaccacggggacgatgtgaactgttgcgcctttagcttctcactactggcaacgtgtagcctggataagacgatacgattatacagccttcgagatttcacagaactccctcattcgcccttaaaattccacacttatgcagtccactgttgctgtttctccccaagtggacacatcctggcctcctgtagtacagacggcacaactgttctgtggaatacagagaatggccagatgctggccgttatggagcagcccagcggcagtcccgtgcgggtgtgtcagttcagtccagactccacatgcctcgcatccggcgctgccgacggcaccgtcgtactgtggaatgcacagagctataagctgtatcgctgcggctctgttaaagatggaagcttggccgcttgcgccttttctcctaacgggagcttctttgtgaccggcagctcctgcggggatctcacagtgtgggacgacaagatgcggtgtccccactctgaaaaagctcacgatctcggaattacttgctgcgattttagtagccagcctgtgagtgatggcgaacaggggctgcaattttttcgcctggcttcttgtggccaagattgccaggtgaagatttggatcgttagctttacacatattctgggctttgaactgaagtataagagcaccctatccgggcactgcgctcctgtgcttgcctgcgccttcagtcatgacggacagatgctggtgagcggatcagttgataagtccgtgatcgtctatgacactaataccgaaaatattctccacacgctcacacaacatacccggtatgtcacaacctgcgctttcgctcccaacactctgctcctcgccactggtagcatggacaagaccgttaacatctggcagttcgacctcgaaaccctctgccaagcacgcagaactgaacatcagctgaagcagttcacagaagattggtccgaagaggacgtgtccacatggctctgcgcccaggacctgaaggacctggtgggaatctttaagatgaacaatatcgatgggaaggaactactgaacttgacgaaggagagcctggccgatgacttgaagatcgaaagtctgggcctccgcagcaaggttttgcggaaaatcgaggaacttcgtaccaaagtgaagagcctaagttctggcattccagacgagtttatctgccccattacacgggagctgatgaaggaccctgtgatagccagtgatggctactcatatgagaaggaagccatggagaactggatttcaaagaaaaaaaggacttcccccatgacaaatttggtcctgcctagtgcagtcctcaccccgaatcgaacacttaaaatggccataaaccgttggctggagacacaccaaaaatag

SEQ ID NO: 24858 - DNA, 2385 bp, Artificial Sequence
  Description of Artificial Sequence: Synthetic coding sequence
atggaaggctcactggctggtagcctggcagcaccggataggccccaaggtccagagcgcctgcctggtccggctccacgggagaatatagaaggcggtgccgaagcagccgaaggagaagggggaatctttaggagcacccggtatctgccggtgacgaaggagggtcctcgcgacattctggatgggagaggtggcataagtgtggcaaacttcgaccctggaacgttcagccttatgcgttgcgatttctgcggcgctggctttgacacacgagctggtctgtcaagtcacgcgagggcacatttgcgcgactttgggatcaccaactgggaactgaccgtgagtcccatcaatatccttcaggagctactcgcaactagcgctgccgagcagccgcctagtccgctcggacgtgagccgggtggcccaccagggagttttctgactagccggagaccaagactgccacttaccgtcccttttcctccaacatgggctgaagatcccggacctgcctatggagacgcctccggaccagagccggctcgtgatatccgttgcgaattttgcggagaattctttgagaatcgtaagggtctctcttcccacgcacgatcccacttgcgtcaaatgggagtgacagaatggtacgttaatggctccccgattgacacactcagagaaatactgaaaaggcgcacccagagcagacccggaggtcccccaaaccctcctgggcctagccctaaggccctggctaaaatgatgggaggggcagggccagggtcttcgctcgaggccaggtctcccagtgacttacatattagtcctctggccaagaagctgcctcctccccctggcagtcccctgggccatagtccgacagccagcccaccacccactgcgaggaaaatgttcccaggactcgctgctcctagcctgcctaaaaagcttaagccagagcagatcagagtggagattaaacgggagatgctgcccggagcgctacacggtgagctccatcccagcgaaggcccatggggggctcccagagaagacatgacgcctttaaatctgtcgtcccgcgctgagccagtccgagatatcagatgcgagttctgcggtgaattctttgaaaaccgtaaggggctctcttcccacgctaggtcccatctgagacagatgggcgtaacagaatggtcagtgaacggctcacccatcgacaccctgagagaaattttgaaaaaaaaatcaaagccttgtcttattaaaaaagagccaccagccggagatcttgcccctgccctcgccgaggacgggcctcccactgttgccccagggccagtgcaatctcctctgccactctcacctcttgcagggcgacccggaaagcccggtgcaggtcctgcccaggtcccaagagaacttagtctgacccccatcaccggcgctaaaccttcggcaactggatacctgggaagtgtcgccgcaaagcgccctctccaggaggatcgcttgttgcctgcagaggtcaaggcaaagacctatatccagacagaactccctttcaaagcgaagaccctacacgagaagacttcccactcaagcaccgaagcctgctgcgaactgtgtggtctatactttgagaacagaaaagccctggccagccatgcaagggctcatctcagacagtttggcgtaactgagtggtgcgtcaatggtagccccattgagacactgtcagaatggattaaacaccggccacagaaggtgggggcttatcggagttacattcagggcggtcggcctttcacaaagaagttcaggtccgctggacatggacgggatagtgataaaaggccatccttaggtttggctcctgggggtttggccgtggtaggcaggtcagcaggcggtgagccaggccctgaagcaggcagagccgctgatggcggagaacgacccctcgccgctagccccccaggaaccgtgaaggcggaggagcatcagcgccaaaatattaacaagtttgagcggcgacaggcaaggccacctgatgcaagtgccgctcgaggtggagaggatacgaacgatctccagcaaaagcttgaagaggtgcgccaacccccacctagggttcgtcccgttccaagcctggtgccacgtcctccccagacctctcttgtgaagttcgtggggaatatatacacacttaaatgtaggttctgcgaggtcgagtttcagggtcctctaagcatccaagaggagtgggtgcgtcacctgcaaagacatattctggaaatgaacttctccaaggctgacccgcctcccgaggagtcacaggctccccaggcacagacagccgcagccgaagcaccatag

SEQ ID NO: 24859 - DNA, 4955 bp, Artificial Sequence
  Description of Artificial Sequence: Synthetic coding sequence
atggagggatcccttgcaggctccctagccgcaccggatagaccccagggaccagagcggcttcccggacctgctccgagggagaacatcgaaggtggtgcagaagcagcagagggtgagggcggaattttccggtccactcgttatttgcccgtgacgaaggagggccctcgcgatatacttgacggcagaggcggtataagcgggacaccggacggtcggggaccttgggagcacccactcgtccaagaagctggcgaaggcatcttatcagagaggcggtttgaggactcagtgattgtgcggacaatgaaaccacacgcagagctcgaaggcagtaggagattccttcaccaccggggtgaacctcgactactggaaaagcatgcccaaggtcggccacggtttgactggcttcaagacgaagacgagcagggcagtccccaggatgccggtttacatttagatctccccgcacagccaccacctctggctccgttcagaagagtgttcgtccccgtcgaggacacgcctaagacgctcgacatggccgtcgttgggggtagggaggatctggaggatctcgaaggtcttgcccagccctcagagtgggggctccccacctctgcctctgaagtcgccacgcaaacctggactgtcaactccgaagcatcagttgaaagacttcagcccctgctgcctccgatcaggactgggccttatctgtgtgagctgctggaagaggtggcggagggcgtagcatcccctgatgaagacgaggacgaggaacccgcagtgttcccgtgtatcgaatgttccatttatttcaagcagaaggagcatcttctcgaacatatgagtcagcaccgtagagcaccgggtcaagagccccctgcagatcttgcgcctctggcctgtggtgaatgtggatgggccttcgcagaccccacagccctggaacagcaccgccaactgcatcaagccagtcgggagaaaatcatagaggagattcagaagctgaagcaggtaccaggagatgaagggagggaagctaggctacagtgccccaaatgtgtctttggcactaactctagcagggcctacgtgcagcacgccaagttgcacatgcgggagcctccgggacagaccacaaaggagccgttcggcggttcctcaggcgctggttctccgagtcccgaagccagtgcccttctgtaccagccctacggcgctgcagttgggttgtcagcatgtgtgttctgtggattccccgcaccatccgagtccctgctcagagagcatgtcaggctagtgcatgcccacccacactgggaagaggacggcgaagcctatgaggaggaccccgcttctcagcctggtacctctcaggacgcacacgcctgctttcctgacactgccgtggactattttggcaaggctgaacctagcctggctccaatgtggcgggagaatccagctggctatgacccctcgctggcctttgggccagggtgtcagcagctaagcatccgtgactttcctctgtccaagcctctcctgcatggcaccggacaacgtcccttaggccgtctcgcctttccatcaacccttgcttccactccatatagcctccaactcggacgaaacaaatctacagtccatcctcaagggctgggcgagcgcaggagaccgtggtctgaggaggaggaggaagaagaggaagaagaggacgtggtgctgacaagtgaaatggacttttcaccagagaacggcgtgtttagccccttggcaacaccgtcactgattccacaagccgctctcgaactaaaacaagcttttcgagaggctctacaggctgtcgaagccacccagggccagcagcagcagctcagaggcatggtgccaatcgtcctcgtggccaagctcggccctcaggtgatggcggctgccagggtcccccctcgactgcaacccgaagaactggggctagcaggcgcacatcccctagatttcttgctcctggacgcccctcttggtggtccgctagggttggacaccctgctggatggagatccagccatggccttgaagcacgaagagagaaagtgcccatattgtccagatcgcttccataatggaataggcctggctaatcatgtgcggggacatctgaatcgcgtgggcgtcagctacaacgtcagacactttatcagcgcagaggaagttaaagccatcgagcgccgtttttctttccagaagaagaagaagaaggtagcaaactttgacccgggtaccttcagtttgatgagatgtgatttctgtggcgctggcttcgataccagggccggactgagcagccacgcacgtgctcatttgagggatttcggtataaccaattgggagttgacagtgtctcccataaatatactgcaggagctgctggctactagtgcagccgagcagccaccttctcccctgggaagggaaccgggaggacctccaggtagcttcctgacatctcgcaggccacgactccctctgaccgtgccattcccacccacatgggcggaggaccccggaccagcttacggcgatgcgcagagcctgacaacttgcgaggtgtgtggcgcatgcttcgagacaaggaaaggactgtcatcccacgctcgatcacacctccgtcagctcggagtggcagagtctgagagttccggggcaccgatagatctgttatacgaactagtgaagcaaaaaggtctcccagatgctcacctaggtctccctcctggactggcgaaaaagagttcctcgctgaaggaggtagtcgcaggcgcaccaaggcccggactgctctctttagcgaaaccactggacgctcccgcagtgaacaaggcaataaagtctccgccaggattttcagctaagggattgggacatccacctagtagtccattgttaaaaaaaactccgctcgcattggccggttcacctacccccaagaaccctgaagataagagccctcagctttcgctgagcccacgacctgcatcaccaaaggctcagtggccccaatctgaggacgagggacccctgaatctgacatcagggcctgaaccggctcgcgacatcaggtgcgagttctgcggagagttttttgagaaccgcaaaggactgtcctcacacgccaggtctcacctccgccagatgggggtgactgaatggtacgtcaatggaagcccgatcgacactctcagggaaatcctaaaacgaaggacgcagtctaggccagggggtccgccaaatccgcctgggccaagcccaaaggctctggctaagatgatgggtggcgctgggcctgggagctctctggaggcacggagcccttcagatctacacattagtccgttagccaagaagctgccaccgcctcccggttctcccctgggccattcccccactgcaagtccccctccaactgcccgtaaaatgtttcctgggttagccgctccctccctccccaagaagctgaaacccgaacaaattcgcgtggaaattaagcgggaaatgcttcctggagcactgcacggcgaactgcatccctcagagggaccgtggggcgcaccccgagaagatatgaccccgctaaaccttagcagtagggcggaaccagtgagggatattcgatgtgaattctgtggcgagtttttcgaaaaccgaaaaggtctgtctagccatgccagaagccacctacgtcagatgggcgtcacggaatggtcggtaaacggcagtcctattgacacacttagggagatactaaaaaaaaagtctaagccatgtttgatcaagaaggagccccctgctggcgacctggctcccgcacttgccgaggatggacctcctacggtagccccaggaccagtgcagtccccacttccattgagcccactcgctggtaggcccggaaaaccaggcgcaggacctgcccaagttcccagagaactctccctaactccgattaccggggctaagccttccgcgacagggtatcttgggtccgttgctgccaagaggccattgcaggaggaccgcctgctgcctgcagaggtgaaagcaaaaacatacatccagacagaattacctttcaaagcaaagaccctgcatgagaagacgtctcatagttctacggaggcgtgctgcgagctgtgtggtctgtacttcgagaaccggaaggctctcgcttcccatgcacgcgctcatctgcggcaattcggcgtgactgagtggtgtgttaacggctctcctatagagaccctatcagagtggatcaaacacaggccacagaaagtaggcgcataccggagctatatccagggaggcagaccttttacaaagaagttccgctctgccggacacggcagggatagcgacaaaaggccaagtctggggctggcacccggaggcttagctgtagtgggaagaagtgccggtggcgaacctggtcctgaggccggaagggcagccgacggcggtgaaaggccattggccgcttctcccccaggcacagttaaggccgaggaacaccagcgccagaacatcaacaaatttgaacgacggcaggccagaccacccgacgcaagcgctgctcgaggcggagaggacaccaacgacttgcaacagaagctcgaggaagtgcgccagcctccacccagggtccggccagtccccagccttgtcccaagacccccacagacatctcttgtcaaattcgtgggtaatatctacactctgaagtgtagattttgcgaagtcgagttccaaggtccgctcagcatccaggaggaatgggtacgccacctgcaacggcatatactggaaatgaacttctccaaggctgacccgcctccagaagaaagccaggcaccacaagcacagacagcagctgctgaggccccata

SEQ ID NO: 24860 - DNA, 2508 bp, Artificial Sequence
  Description of Artificial Sequence: Synthetic coding sequence
atggtggccatggatctagggtctccttccctcccaaagaaaagtctgcctgtgcccggagctctcgagcaggtggcctcgcgactgagttctaaggtggcggcagaggtccctcacggcagtaaacaagaactccaggatctgaaggctcaatctctgactacttgcgaagtatgcggagcttgctttgaaacaagaaagggactgtcctcccacgccagaagccatttaagacagctcggagtggcagagtcagaaagctctggagcgcctatagatcttttatatgagctcgtgaaacagaaaggtctgccagacgcccaccttgggctgccacccggtctggctaaaaagtcatctagccttaaagaggttgtggccggtgcacctaggcccggtttattatccctcgccaaaccgctggatgccccagctgtaaataaggcaatcaaatcacctccaggcttttctgctaaagggcttgggcatcccccttcctcacccctgcttaagaagacacctctggccctggccggatcacctacacctaaaaaccccgaggacaaaagcccccagctgtctctgtctcctcggcctgcgtcccctaaggcacagtggccccaatcagaggatgagggcccactcaatctgaccagtggccctgaaccggctagggatatccgctgcgagttttgtggcgagtttttcgaaaatagaaaggggctttcatctcacgcaagaagccacctgcggcagatgggggtgaccgaatggtacgttaacgggtcacctattgatacccttcgcgagattctcaagcggcgtacgcagtcccgcccaggcggtcctccgaaccctcccggtccctcaccaaaggcactcgcaaagatgatgggcggtgcaggtcccggttcatcattggaggcccgtagcccctctgacctgcacatctcgcccctggcaaagaagctgcctccccctcccggtagtccccttgggcactccccgactgcctctccccctcctactgctagaaagatgttcccgggactggccgctcccagcctgccaaagaagctcaaacctgagcaaattcgagttgaaataaagagggaaatgcttcctggcgctctgcacggagagctccacccttctgagggtccttggggagcgcctagagaggacatgacccctctgaacctgagttccagggccgagcccgttcgggacatacggtgtgagttctgtggggagttctttgagaacaggaagggcctaagctcacatgcacggtcacaccttagacaaatgggagtaaccgagtggtctgtgaacggtagtccaattgatacattacgcgagatcctgaagaagaagtctaagccgtgcttgattaaaaaagaaccgcctgccggagatttggctcctgctctggcagaagatggaccacctactgttgcccctggacctgtgcaatcgcctctgccactcagtccactagcaggcaggcctgggaagcctggcgcaggacctgcccaggtccctcgcgaactctcactcacccctatcactggcgcaaaaccaagcgcaaccgggtatctgggaagtgtggcggcaaaacggccattgcaggaggatagacttctgccggcagaggtgaaggcaaaaacctatattcaaactgaattacctttcaaggccaagacactgcacgaaaagaccagtcatagcagcactgaggcatgctgcgagctgtgcggactgtactttgagaatagaaaagctctggcctcccatgccagagcccatctccgccagtttggagtgaccgaatggtgtgtgaatggatcacctattgagactctctctgaatggattaaacatcggccacagaaggtgggcgcttatcgttcatatatccagggaggacgacccttcaccaagaaattcagatccgccggacatgggcgtgacagcgataagcggccttcactgggcttagcacccggaggcttggctgttgttggccgatctgccggaggggaaccgggaccggaggcaggcagagcagctgacgggggagaaaggccgttggctgccagcccaccaggaaccgttaaagcagaagaacatcaacggcaaaacatcaacaaatttgaacgtcggcaggctcgaccacctgatgcttccgctgctcgcggaggggaggacaccaatgatctccaacagaagctggaggaggtccgacagcctccacctcgcgtacggccagtaccctctctggtcccacgccctccccagacaagcctggtgaaatttgtgggaaacatctacacattgaagtgccgcttctgtgaggtggagttccaggggcctctcagcatacaagaagaatgggttcggcatttgcagaggcatatcctggagatgaacttcagcaaagccgatccccctcccgaagagtcacaagccccacaagcacaaaccgccgcagcagaggcaccatag

SEQ ID NO: 24861 - DNA, 2898 bp, Artificial Sequence
  Description of Artificial Sequence: Synthetic coding sequence
atggaccttggatctccgagcttgccgaagaagtccctgccagtgcctggcgctctggagcaagtggcgagccgcctgtcaagcaaggtggctgccgaagtcccccatggctcgaagcaggaactgcaggatctgaaagcccagtctctaaccacctgtgaagtttgcggcgcatgctttgagaccagaaaaggcttgagttcacatgctcgcagccacttgcgccagcttggagtagctgaatcagagtcttcgggagcgccaattgatctgctctatgagctggtcaagcaaaagggtttgccggatgcccaccttggactccctccaggtctcgctaaaaagtcttcgagccttaaggaagttgttgccggagcgccaagaccgggtttattaagccttgccaagcccctggatgcccctgccgtgaataaagctatcaagtcccccccaggattctctgcgaagggccttggacatcctcctagctcccccttacttaaaaagaccccactggctttagccggaagcccaacacccaaaaatccagaggacaagtcacctcagctgtctttatcccccagacctgcctctcctaaagcccagtggccacagtctgaagacgagggccctctaaaccttacactagacagcgatggcggacgggaactcgactgtcagctgtgcggagcatggttcgaaaccaggaaaggcctttccagtcatgctagggcccacctgcggcatctgggggtgtctgatccagacgccaaaggaagtcccatcgacgtcctccacggcttgattaggcgcgacggggtccaaatacgcctgcctcctcgtcgtggcgcactcgcccatcctggaagacccccacctacctcagctgcgctgagtctgctgccacctccaccacctgcaaaaaaagcaaaactgaaggcagccggtatggcaagcccatgggggaagcaggatctgtcagctgccgcagcagcgggaattttctgggcatccgatgttgagccgagccccctgaatcttagctccggcccagaacccgcacgggatattaggtgcgaattctgtggcgagttcttcgagaaccgcaagggcctctcttctcacgctcgcagtcacctgcgacagatgggagtgactgagtggtatgttaacggaagtccgatcgacacactgcgggagatactgaagaggagaacacagagccgccctgggggaccgcctaatccacccggtccgtcccccaaggccctggctaaaatgatgggaggggctggaccaggctccagcctggaagcccgatctccatcggatctgcatataagtccattggccaaaaaactcccacctcccccagggagccccttagggcactccccgactgcctcgccacctccaaccgcccgaaaaatgtttcccggactcgccgctccttcactccccaaaaagctcaaacccgaacagatccgcgttgaaattaaaagagaaatgctgccaggcgctctccacggagagcttcatccaagcgaagggccatggggggcacctcgcgaggatatgacccccctgaacctgtctagcagggcagagcctgtgcgcgatatccggtgcgaattttgtggggaatttttcgagaacaggaagggcttgtcctcacacgcgagaagtcacctccggcagatgggagtgacagaatggagtgttaatggcagcccgatcgatacacttagagaaatccttaagaagaagtcaaagccctgtctcattaaaaaagagcctccggcaggcgatcttgctccagccttggccgaggacgggcctcccacagtcgcccctggccctgtgcaatctcctctccctctttctccactggccggaagaccaggcaaacctggcgctggaccagcccaagtgccacgagagctgagtctcactcccataacaggcgctaaacccagcgccaccggataccttggttccgtggcggctaagcggcctttgcaggaagacagactgttaccggctgaggtgaaggctaaaacctacatacaaactgaactgccgttcaaagcaaagacactgcatgagaaaacttctcacagcagcaccgaagcatgttgtgagttgtgtgggctgtactttgaaaatcggaaggctcttgcgtctcacgcccgagcccacctacgacagtttggggtgaccgagtggtgtgttaacggatcccccatcgagactctgagtgagtggattaaacaccgtccccaaaaggttggtgcctatcgttcgtacatccagggtggcaggcctttcacaaagaagtttaggtctgccggtcatgggagagattctgacaagcgaccatccttgggattagctccagggggactggccgtggtcgggagaagtgctggcggagagccgggacccgaggccggacgggctgcagacggcggtgaacggccactggccgcttctccacccggaactgtgaaggctgaggaacatcaaagacaaaatatcaacaaatttgaacgcaggcaagccaggcctcctgacgcttcagccgctaggggcggagaagacactaacgatcttcagcagaaactggaagaagtacgccagccccctcctcgcgtccgacccgtgccatccctcgttcctaggccgcctcagacatctctggtaaaatttgtgggcaatatatacacccttaagtgtagattctgcgaggtcgagttccagggaccgctgtctattcaagaggaatgggtgcgccatttacaaaggcatatccttgaaatgaacttttcgaaggcagatccacctccagaggaatctcaggctcctcaagcacaaactgcagctgccgaggccccttag

SEQ ID NO: 24862 - DNA, 846 bp, Artificial Sequence
  Description of Artificial Sequence: Synthetic coding sequence
atggcgtctaggggacggcgtccggagcacgggggtccacctgaactgttctatgacgagaccgaggccaggaagtacgttcgcaactcccggatgattgacatacagactcgaatggcaggccgagcgttggaactcttatacctccctgagaacaaaccctgctacctcctagatatcggatgtggcacgggtctctccggatcctatctcagcgacgagggacattattgggtgggtctggatatctctcccgctatgctcgatgaggcggtggatagagaaattgagggtgacctgcttctgggtgacatgggccagggcataccattcaagccaggcacgttcgacggctgtatcagtattagcgccgtacagtggctgtgcaacgctaataaaaagtctgaaaaccctgccaagcgattatactgtttctttgcatctcttttttcagtcctcgtgcgtggttcacgggctgtgctgcagctttaccctgagaattccgagcagctggagttaattaccacccaagccaccaaggccggattctctggcggtatggtagtcgattatcctaactccgctaaggctaagaagttctatctctgcctattctctggaccgagcactttcatcccagaaggactgagtgaaaaccaggatgaggtggagcccagggagtctgtcttcacaaatgaacggttccccctgcggatgtccaggaggggcatggtcaggaaatctcgggcttgggtactcgaaaagaaggaaaggcaccgacgtcagggaagggaggttcgacccgatacccagtacaccggaaggaagcgtaagcccaggttttag

SEQ ID NO: 24863 - DNA, 372 bp, Artificial Sequence
  Description of Artificial Sequence: Synthetic coding sequence
atggctgaccctcaatcttgttttatgacaaggcagaagcccggaaacacatttgccagcgagggctcactgaacactgcgggacgccctggggtcggaaagagacaggtggcaccagtagctggggttgccagaaaagggaggcgcatctgggggtcgaggatgattgacatccaaacccggatggcgggaagggctctcgagcttctctacctgcctgagaataagccctgctacctgttggacatcggctgcggaaccggattgtccgggtcatatctgtccgatgagggacactattgggtcggactagatatctccccggcaatgcttggccctgggattccttcctgcccggcagccgtaccatag

SEQ ID NO: 24864 - DNA, 897 bp, Artificial Sequence
  Description of Artificial Sequence: Synthetic coding sequence
atggcctcccggggacggcgtcccgaacatggtgggcctccagagttgttctatgacgagaccgaagcccgaaagtacgtccggaactctcgcatgattgatatccagactagaatggcgggacgggctctagagctcctttacttgcccgaaaataagccctgctatcttctggacattgggtgtggcacaggactttcgggatcctacctgtctgacgaaggacattactgggttggacttgacatttctccggcaatgctcgatgaggctgtcgatcgagaaatagaaggtgatctcctgctgggggatatgggccaaggaataccatttaagcccggtacttttgatggatgcatcagcatctcagctgtgcagtggttatgcaacgccaacaagaaatcagagaatcctgcaaaaagactgtactgtttctttgcatctttgtttagcgttctggtgaggggctcccgcgcagtcttgcagttgtaccctgagaatagcgagcagctggagctaatcaccacccaagccacgaaggcaggcttctccgggggtatggtggtggattaccctaactccgccaaggcgaagaagttttatctctgcctgtttagcggccctagtacttttattcccgaggggctgagtgaaaaccaagatgaagttgaacctagagagagcgtcttcaccaacgaacgcgaaggcggagcatttgaacggcgtggtatcagaggacaccagacccgcagattcccccttcgcatgtccagacgcggtatggtgcgcaagtcgagagcttgggtactggaaaagaaggaaagacaccgcaggcagggcagggaggtgagacctgacacacagtatactgggagaaagagaaaacctagattctag

SEQ ID NO: 24865 - DNA, 1131 bp, Artificial Sequence
  Description of Artificial Sequence: Synthetic coding sequence
atggcagactattggaaatcacaacccaagaaattttgcgattattgcaagtgctggattgctgacaaccgaccaagtgtagagttccatgaaagggggaagaatcacaaggaaaacgtcgctaaacggatcagtgaaattaagcaaaaaagtctcgacaaggcaaaagaggaggagaaggcttccaaagaatttgcggctatggaggcggctgctttgaaggcctaccaagaagacttaaagagactgggcctggagtccgaaatattggaaccctctatcacacccgtcacaagcactatccccccaactagcacaagtaaccagcagaaggagaagaaagagaagaaaaaacgtaaaaaggacccttcaaaaggcaggtgggtagagggcatcacatcagagggctatcattattactatgacctcatttcaggggcaagccagtgggaaaaacctgaaggcttccaaggcgacctgaagaaaacagccgtgaaaacagtctgggtcgagggactatcggaagatggctttacctattattataataccgaaacgggcgagagcagatgggagaagcccgatgactttatcccacataccagtgacttgccatcatcaaaagttaatgaaaatagtcttggtacactggatgagagtaagtccagcgattcacactctgattccgacggagaacaggaggccgaggaagggggagtgagtactgagactgagaaaccgaagattaagtttaaagaaaaaaataaaaacagtgacggtggctctgatccagagacacagaaagaaaaatcgatccagaaacaaaatagcttgggctccaatgaggaaaagagcaagacactgaagaaatcgaacccttacggagagtggcaggagatcaagcaggaagtcgagtcacacgaggaggtggacctcgagctgccgagcacagagaacgaatacgtgagtaccagtgaggccgacggcggtggggagcccaaggtcgtattcaaagagaaaactgtgaccagcctcggggttatggctgacggtgtcgcgccagtatttaagaaacgtcgcacagagaacggcaagagcaggaatcttcggcaaaggggagatgaccagtag

SEQ ID NO: 24866 - DNA, 1068 bp, Artificial Sequence
  Description of Artificial Sequence: Synthetic coding sequence
atggccgattactggaagagccagcccaagaagttttgtgactattgtaaatgctggattgctgacaaccggcctatcaagcagaaatcccttgacaaggcaaaagaagaggaaaaggcatcaaaagagtttgcggctatggaagccgctgctttaaaagcatatcaggaagacctcaaaaggcttggactggagagtgaaatactggaacccagcattacccctgtaacatcaactattccacctacctcaacctcaaaccagcaaaaagaaaaaaaggagaagaagaagcggaagaaggaccccagcaaggggagatgggtagaggggataacttccgaaggctatcattattattacgacttaatcagcggggcaagtcagtgggaaaaacccgagggcttccagggcgaccttaagaaaaccgctgttaagacagtctgggttgagggcctgtccgaggacgggttcacttactattacaacacggaaacaggcgagagccgctgggagaagccggatgattttattcctcacaccagtgatctaccctcctctaaagtcaatgaaaactccctcggtacacttgatgagtctaagtcatctgattcacactcagatagtgacggcgagcaggaggccgaagaaggaggagtatcaacggagacagagaagccaaagatcaagttcaaagagaagaacaagaactccgacggagggtctgatccagagacccagaaggagaagtcaatccagaagcaaaattcactcggcagcaacgaggagaagtcaaagacccttaagaagagtaatccatatggagaatggcaggaaattaaacaggaggtcgagagtcatgaggaagttgatctggagttacccagcacggagaatgagtacgtttcgacctcagaggcggatggcggaggcgagcctaaggtcgtgtttaaggagaaaacagttaccagccttggggtgatggctgacggtgttgcacctgtgtttaagaagcgcaggacagagaacggtaagagcaggaatctgaggcagcgaggtgacgatcagtag

SEQ ID NO: 24867 - DNA, 354 bp, Artificial Sequence
  Description of Artificial Sequence: Synthetic coding sequence
atgtccttaactagtgatgcctcctcgcctcggagctatgtgtctccgcgaatatctacgccacagaccaatacagtgcctatcaagcccctgatctctacccctcctgtctcaagtcagcccaaggtgagcacacccgtggtcaaacaggggccagtgtctcaaagcgctactcagcagccggtaacagctgataagagtaaggtcatgaatctctcactacttgaggtgttttcagctcaggtggccagagaagttcaccacctcgtccccattatcctccttatcgtggtgatgcaccagatgcagcagttgtaccatcgaatcttgctgccagaccctcgcgtgcactag

SEQ ID NO: 24868 - DNA, 1635 bp, Artificial Sequence
  Description of Artificial Sequence: Synthetic coding sequence
atggtcatgtacgccaggaagcagcagcgcctgagcgacggctgccacgataggagaggcgattcccagccatatcaggcactgaagtatagctctaaaagtcatcctagcagcggcgaccaccggcacgagaaaatgcgggacgctggcgacccgtcgccccctaataagatgctacggcgttcagacagccccgagaataaatacagcgatagcaccggccatagcaaagccaagaatgtgcacacacatcgcgtgcgagagcgagacggtggaacctcctattccccgcaagaaaattcccataaccattcggctttacatagctccaattctcatagttccaatccctctaacaacccatctaagacctctgatgccccttacgatagcgctgatgactggtcagaacatatatcttcatctggcaaaaaatactactacaactgccgcaccgaggttagtcaatgggagaagcctaaggaatggctggagagagagcagcgtcagaaagaagcaaataaaatggccgtgaactcattccctaaggaccgggactaccgcagggaggtaatgcaagctacggcaacttctggatttgcttctggcaagtcaacctccggagataaacctgtctctcattcttgcactaccccttctacttcatccgcgtcggggttgaacccgacaagtgcgccacctacatctgcctccgcagtgcctgtaagtccagtaccacaatctcccatcccccctctactgcaggaccccaacctgctgagacagctgctacccgctttgcaggctactctacagcttaacaatagtaacgtggacatctccaaaattaacgaagttctgacagcagctgtgacacaggctagtttacagtccatcatccacaaattcctgaccgccggtcctagcgcattcaatatcacaagcctcataagccaggctgcccagctcagcacgcaggcacagccctccaaccaatctcccatgagcctgactagcgatgccagctcccccagaagctacgtgagtccgaggatctcaaccccccagaccaacactgtgcccatcaagcccttgatttctacgcctccagtttcaagtcagcccaaagttagcacaccggttgtgaaacagggacccgtgtcacagtctgctactcagcaacctgtgactgcagacaagcaacaagggcacgagcctgttagtccaaggagtctgcagaggagcagttctcagcgaagtcccagtcccggacctaaccacacctcaaattccagtaatgctagcaatgcaacagtggtcccacagaactctagtgctaggtccacctgttcattaactcccgctctggctgctcatttttccgaaaatctgatcaagcatgttcaggggtggcccgctgaccacgccgagaagcaagcgtctagattgcgggaagaagcacataacatgggcacgattcatatgtctgaaatttgtactgagctgaagaacttgagatctttggttcgcgtttgtgagattcaggcaacactaagagagcaaaggatcctgttcctgcgccagcagattaaggaactagagaagctgaagaaccaaaatagctttatggtctag

SEQ ID NO: 24869 - DNA, 1944 bp, Artificial Sequence
  Description of Artificial Sequence: Synthetic coding sequence
atggtgatgtatgctagaaagcaacagcggctcagcgacggctgtcacgatcgtcgcggagactcacagccctatcaggccctgaaatacagctcaaaatcccacccatcctcaggggatcatcgccacgaaaaaatgcgggacgcaggggacccttccccccctaacaaaatgctgcggaggtctgacagtcctgagaacaagtatagcgattccaccggccactctaaggcaaaaaacgtgcacacccacagagtgagggagcgggatggaggcacatcctacagtcctcaagagaattctcacaatcattccgccctgcactcctcaaatagccacagttccaatcctagtaataatcctagcaaaacctcagatgcaccttacgacagtgctgacgattggtccgaacacatctcctcttcgggcaaaaagtactactataattgccgaaccgaggtcagtcagtgggagaagcccaaggagtggctggagagggagcaaagacagaaggaggcgaacaagatggctgtgaactcattcccaaaggatcgtgactatagacgggaagtgatgcaggcaaccgcaacgtcgggcttcgcctccggaatggaagataagcactcctccgatgcatcctcactgttaccgcagaacatcctgtctcagacatcacgccacaacgacagggactacaggctgcccagagccgaaacccactcgtcctccacccccgtgcaacaccccatcaagccagttgtccaccctacggcaaccccatccactgtgcctagctcgccatttactttgcaatcggatcaccagccaaaaaaatcgtttgacgcaaatggcgctagtacactgagtaagctccccacgcctacaagctccgttcctgcccagaagacagagaggaaggagtccacctccggcgacaagccggtatcccattcctgcactacgccttccacctcttcagcctcgggactgaatccgaccagtgcgccaccgaccagcgcctcagccgtgccagtgtcccctgtaccacagtccccaataccacctctcctacaagacccaaacctcctgaggcagctgcttccggctctacaggccaccttacagctgaataatagtaacgtagatatttctaagattaacgaggtgttaacagctgctgtcacccaggcgtcgcttcagtctatcatccataagttcctcaccgctggcccatcagcattcaacattaccagcctcatctcacaagccgcacagctctcaacacaagcccagccctcaaaccagagcccaatgtccctgacctcagacgcgtcatccccacggtcctatgtaagcccacgcattagtactcctcagactaatacagtcccgattaagcctctgatttcaaccccccctgtgtctagccaaccaaaggtgtccaccccggtggtgaagcagggcccagtgagccagtcggccactcagcaacccgtgactgccgacaagcagcaaggccacgaacctgtttccccgagatccctgcagagatcgagttcccaacggtctccaagtcctggaccaaatcatacatccaactccagcaacgcctcaaatgcgacagtggtaccacagaattcgtctgccaggagtacctgttctctgacacccgctctcgccgctcatttcagcgagaatctcatcaagcatgttcaaggttggcctgcagatcatgctgaaaaacaggctagtcgtttgcgcgaggaagcacataatatggggacaatccatatgagcgaaatctgtaccgagctgaaaaatctcagatctctggtgcgcgtttgtgagatccaggccaccttgagggaacagaggattttattcctccggcagcagatcaaggagcttgaaaagctgaaaaaccagaattcattcatggtttag

SEQ ID NO: 24870 - DNA, 1809 bp, Artificial Sequence
  Description of Artificial Sequence: Synthetic coding sequence
atgagggacgccggagacccgtcaccgcctaataaaatgctgcgaagatctgatagtcccgaaaataaatacagcgactccaccggtcactccaaggccaagaacgtgcatacacatagagtgcgcgaacgcgatggcggtacctcttacagccctcaggagaacagtcacaaccactcagctctccattcatctaattcacactcttcaaatccaagcaacaacccctccaagacttctgacgccccttacgattctgcggacgattggtctgaacatatcagctccagcggcaagaagtactactacaattgtagaacggaggtttcacagtgggagaaaccaaaggagtggcttgaacgggagcagcgccaaaaagaagcaaataaaatggccgtaaactcttttccaaaggaccgcgactatcgccgtgaggttatgcaggccaccgccacctcagggtttgccagcggaatggaggacaaacattcctccgatgcgagcagcctgcttccgcagaacatattgtctcagacaagcagacataatgaccgcgattacagactgcctcgagctgaaacccactcctcttctacccccgttcaacatcccatcaagcccgtagtccacccaaccgctacgccttctacagtgccatctagccccttcacattgcagtccgaccaccagccaaaaaagtctttcgacgctaatggtgcaagtacactgtctaagctcccgactcctaccagcagtgtcccggctcagaagactgaacgtaaagaatcaactagcggtgacaaacccgtgtctcattcatgcacgacaccatccacctcctctgccagtggccttaatcccacttccgccccaccgacaagcgcgagtgctgtgcctgtgtcgcctgtcccccagagcccaataccacctctgttgcaagacccaaacctacttcggcaactgctgccggctttacaggccaccttgcagcttaacaacagtaatgtcgacatttctaaaatcaacgaggttctgaccgccgcagtgacccaggcgtccctgcagtccatcatccataagtttttaacagccggtcctagtgcgttcaatataacctctcttatctctcaggccgctcagctcagcacccaggcccagcctagcaaccaaagcccaatgtccctgacctctgatgcaagttcacccagaagttatgtgtccccccgtatctctaccccccagaccaacacagttccaatcaagcctctcatcagcactccacctgtctcgagccagcccaaggtttcaacgccagttgtgaagcagggcccagtaagccagagcgccacccagcagccggtgacagctgacaagcaacagggccatgagccggtgtcccccaggagtctgcagcgctcttcatcccagcgtagccctagtcccggaccaaatcatacaagcaatagctcgaacgctagtaatgccactgtggtgccacagaattccagcgcccgatcaacatgttctcttacgcccgcactggccgcacatttttctgagaatctgatcaagcacgtccaggggtggccagccgatcacgctgagaagcaggcatctaggctgcgggaggaggcgcacaatatgggtactattcacatgagcgagatctgtactgaactgaaaaacttgcgctcccttgttagagtgtgcgagatacaggcaactctgcgtgaacagcgcattctgtttcttaggcaacaaattaaggagcttgagaagcttaaaaatcagaacagcttcatggtgtag

SEQ ID NO: 24871 - DNA, 702 bp, Artificial Sequence
  Description of Artificial Sequence: Synthetic coding sequence
atgagagatgcgggagaccctagtccaccgaacaaaatgctccgaaggtctgactcacctgaaaacaaatatagcgattcaacaggccactccaaagctaagaacgtgcacacacatcgggttagggaaagggacggtggcacttcatatagcccacaggaaaattcacacaaccatagcgctctgcattctagcaatagccactcctccaacccaagcaataatccaagcaaaacctctgacgcgccatacgattcagctgatgactggagcgagcatatctcgagcagcgggaaaaaatattattacaactgcaggactgaggtaagccagtgggagaaaccaaaagaatggctggagagggaacagcgccagaaggaagctaacaaaatggcagttaactccttcccaaaggatcgggattataggagagaggttatgcaagccacagctacgagcgggttcgcctccggcatggaggacaaacattcgtccgacgcttcttccctcttgcctcagaacatcttgtcccagacttctagacacaacgacagagattaccgacttccacgggctgaaacccacagctcttccactccagtgcagcaccctatcaaacctgtggttcacccaacggccaccccctcaaccgtcccaagcagtccatttaccctgcagtccgatcaccagccgaagaagtag

SEQ ID NO: 24872 - DNA, 615 bp, Artificial Sequence
  Description of Artificial Sequence: Synthetic coding sequence
atgcgtgacgcaggagacccgagtcctccaaacaaaatgcttcgtaggagcgacagcccagagaacaagtactcagactctaccggccactccaaggcaaagaacgtgcacacacacagagtgagggagcgagatggcggtacgtcttactctccgcaggagaatagccacaatcactctgctctccactcgagcaactcccacagcagcaatccgtccaataacccaagcaaaacgtctgatgccccatatgatagtgccgacgactggtccgagcacatttcaagctcaggaaaaaagtactattacaattgccgcacagaagtaagccagtgggaaaagccgaaggagtggctcgagcgcgaacagcgccagaaagaggccaataaaatggctgtaaatagcttccccaaagaccgcgactaccgcagggaggtcatgcaggccacagctacatctgggtttgcttctgggatggaggacaagcactcttcagatgccagtagcctgctcccccagaacatcctgagccaaacttcgcggcacaacgatagggactacagactgcctagggccgagacgcacagttcttccactcccgtgcagcacccttag

SEQ ID NO: 24873 - DNA, 1044 bp, Artificial Sequence
  Description of Artificial Sequence: Synthetic coding sequence
atgagagatgctggggaccccagtcctcccaacaagatgctgcggcgatctgattcacctgagaacaagtatagtgacagcaccggccacagtaaggcaaagaacgtgcacactcaccgggtgagggagcgggacggtggcactagctactctcctcaggaaaactcccataaccactctgctctccatagctctaatagccactcctccaatccctcaaataaccctagcaaaacctccgatgccccttatgactcagctgacgattggtctgaacacatctccagttcagggaaaaaatactactacaattgccgaactgaagtaagtcaatgggagaaaccaaaagagtggttggagagagagcagaggcagaaggaggctaataagatggctgtaaactcattccccaaggaccgggattaccgccgagaagtgatgcaagctactgcgacctcaggtttcgctagcggtatggaggacaagcattccagtgatgcctccagtttgctgccccagaatatactgtcacagactagcagacataacgacagggactaccggctgcctcgtgcggagacccacagcagctcgacgcccgtacagcacccaattaagccagtggttcaccccaccgcaacacccagcacagtgccttccagccccttcaccttacagagcgatcaccagccaaaaaaatcctttgatgctaatggggcttcgactctcagcaagctgcccacacccacatcttcagtgcctgcccagaagacagaacggaaggagagtactagtggagacaagcccgtgagtcattcctgcaccacccccagcaccagcagcgcgtccggcctcaaccccacctcagcccctcccacctcagcctccgctgtgccggtgagccctgtgcctcaaagccctatcccccctttgcttcaagatcctaacctgctcaggcagctgctgccagcattgcaggcaaccttgcagctcaataacagcaacgtggatattagtaagattaatgaagtactcacagcatag

SEQ ID NO: 24874 - DNA, 1311 bp, Artificial Sequence
  Description of Artificial Sequence: Synthetic coding sequence
atgagagacgctggcgacccttctccacccaacaaaatgctacggagatcggacagtcctgagaataaatacagtgacagcaccggccacagtaaagcgaagaatgtgcatacacaccgtgtgagggagcgggacgggggaacaagctactcacctcaggagaactctcataaccactccgccctgcactcctcaaactcccatagctccaaccccagtaataacccaagtaaaacaagtgatgccccatatgattccgccgacgattggtcagagcacataagtagcagcgggaagaagtattactataactgtaggactgaggtgtcccagtgggaaaaaccgaaagagtggctggaaagagaacagaggcagaaggaagccaacaaaatggcagtaaattcttttcctaaggacagagactatcgaagagaggtaatgcaggctactgctacctctggcttcgcctcaggcatggaggataaacatagttctgacgcatccagcctactgcctcaaaatattctgtctcagaccagcaggcacaacgacagggattatagacttccacgcgcagagactcattcatccagcacacctgtccagcatcctatcaaacctgtggtccatcccacggccacacctagcacagtccccagtagtccctttacactacaatccgaccaccagcccaagaagtcctttgacgctaatggagcctccaccctctctaaattgccaacccccacttcttctgtgcccgcacagaaaacagagcggaaggagtcgacatcaggggacaaacctgtctcgcactcttgtacaaccccctctacatcaagtgccagcggactaaatccaacctcggcacccccaacctcggcatccgcggtgcccgtctcacctgttccacaaagtccaatccccccactcttgcaggatcctaacctcctccggcagctcctccccgcactccaggccacactgcagctcaataactcgaacgtggacatctccaagatcaacgaggtgctgactgcggctgtaacccaggcatccctgcagagtatcattcataaatttcttaccgccggacccagtgcctttaatatcacatcactaatttcacaggctgcacagctgtctacacaagatatccctctgcatgaggggattcagatggaaagggacacccaccggtccaagtgggaagtcaagggctcactgtgccagaaagccgacaaacagcaggaatgcctggtctggaatgggagtatcatggtgcagcgactcctgcaaccatccggctag

SEQ ID NO: 24875 - DNA, 522 bp, Artificial Sequence
  Description of Artificial Sequence: Synthetic coding sequence
atgcgtgatgctggcgacccgagcccccctaacaagatgcttcgtaggagcgattcccctgaaaacaagtatagtgattccactggacattccaaagctaagaatgtccatacacatcgggtgagagagagagacggtggaacatcgtactcccctcaggaaaatagtcataatcactctgctctgcactcttctaatagccacagtagtaacccctccaacaacccatctaaaacaagcgacgctccttatgattctgcagacgattggagtgagcacatctcctcatccgggaaaaagtactattataattgcagaactgaggtcagtcaatgggagaaacctaaggagtggctcgagcgggagcagcgtcagaaagaggccaacaagatggccgtgaattctttcccaaaggatcgcgattatagacgggaggttatgcaggctaccgcaacatccgggttcgcttctgggatggaagataagcatagctcggacgcgagctcactgctacctcaatag

SEQ ID NO: 24876 - DNA, 180 bp, Artificial Sequence
  Description of Artificial Sequence: Synthetic coding sequence
atgcgtgacgctggggacccctcaccaccgaataagatgctccggaggtcagactctcctgaaaataagtatagcgattcaaccggccacagcaaagcgaagaatgttcatactcatagggtgcgggagagagatggaggcacctcctacagcccacaagaaaactcacataatcactag

SEQ ID NO: 24877 - DNA, 111 bp, Artificial Sequence
  Description of Artificial Sequence: Synthetic coding sequence
atgcgcgacgcgggtgacccctctcccccaaacaagatgctacgccgtagcgattccccagaaaataagtattccgactctaccggacactctaaggcgaagaatgtatag

SEQ ID NO: 24878 - DNA, 906 bp, Artificial Sequence
  Description of Artificial Sequence: Synthetic coding sequence
atgcgagacgccggagatccttctcctcccaacaagatgctccggaggagtgatagtccagaaaataaatactcggattctaccggccatagcaaagccaaaaatgtccacacccacagagtgcgcgaacgggatggaggaacatcttacagtcctcaggagaactcccataaccactctgcattgcatagttccaattctcactcttcgaatcctagtaacaatccaagtaagacctcagacgccccttacgattctgccgacgactggtccgagcatataagtagttctgggaaaaaatactactacaattgcagaacggaggtgtcacagtgggaaaagcctaaggagtggttggagcgggagcagagacagaaggaagcgaataaaatggcggtcaattcctttcccaaggacagagattaccggcgtgaagtcatgcaagcaacagcaacaagcggctttgcttccggcatggaagacaaacattctagcgacgcctcgagcctcctgccgcagaatatattatcccaaaccagtaggcataatgatagggattaccgcctgcccagagctgaaacccacagtagtagcaccccagttcagcacccgataaagccagtcgtccaccccaccgcaacaccgagcacagtgcctagttcccccttcacactgcaatctgatcatcagccaaagaagagctttgatgccaacggcgcttcaacactgagcaagctcccaacccctacaagttccgtaccagcccagaagacagaaagaaaggagagtacctcaggtgataaacccgtgtcccatagttgtactacaccctccacatcttccgcctcggggctgaaccccacctccgccccacctaccagcgcgtccggacctaagtctagttag

SEQ ID NO: 24879 - DNA, 5469 bp, Artificial Sequence
  Description of Artificial Sequence: Synthetic coding sequence
atgtaccctaactgggggagatacgggggatcatcacattacccacccccaccagtccctcctccacccccagtggcactacctgaggcatctcctgggcctggctacagctcgagtaccacacctgcggctccatctagctccggttttatgtcgttcagggagcagcacttagcacaactgcagcagctccagcaaatgcatcagaagcaaatgcaatgcgtgttacagccccatcatctcccaccgcctcctctgccaccacctccagtgatgcccggaggaggctatggagattggcagccgccaccaccgccaatgccaccccctcccggtcccgcactcagctatcaaaagcaacaacagtataagcaccaaatgctacaccaccagcgcgatggcccaccaggcctagttcctatggagcttgagtcccctcctgaatcgcctcctgtgccacctgggagttacatgcccccatctcaatcctatatgccgccaccccagcctccaccaagttactaccccccaacctcatcccagccttatcttcctcctgcccagccgagtccttcccagtcaccccctagccaaagttacctggcgcctaccccctcatacagctctagttcatctagttcccaatcttacctttcacacagtcagtcgtatctaccaagttctcaagcttcaccttctagaccttcccaggggcatagcaaatcccaactactggctccccctccacccagtgcccctcccggaaataagactacagtccagcaggaaccacttgagtcaggagcaaaaaacaagtctactgaacagcagcaggcggctcccgagcccgatccctctacaatgactcctcaggagcaacagcaatactggtaccggcaacatttgctcagcctgcagcagcggaccaaggtgcatttacctggccacaaaaagggaccggtagtcgccaaagacactccagaaccagtgaaagaggaagtgacggtcccagccaccagtcaagtgccggaatctcctagcagtgaggagccccctctcccaccgcctaacgaggaggtgccgcctccacttccccctgaagagccccagagtgaggatcccgaagaagatgccagactcaagcaattgcaagccgcagccgctcactggcagcagcatcagcagcatcgcgtgggtttccagtaccagggcattatgcagaagcatacccagcttcagcagatcctgcagcagtaccaacaaatcatccaaccacccccacatattcaggcgacgacccctccaccaggtattcctccgccaggtgttccccaaggcattcctccccagctgactgctgctcctgttccacccgcatccagcagccagagttcgcaggtcccagaaaagccccgtccggcactcctgccaaccccagtctcctttggttccgcaccaccaaccacataccacccccctctccaaagcgcaggtccgtctgagcaggtgaacagtaaagcaccacttagtaagagtgcacttccctacagctccttcagttcggatcagggattaggcgaatcttcagctgctccttcacaacctatcacagccgtgaaggacatgcccgtaaggtctgggggacttctgccagatccccctcggtcgtcctatctggagtctccacgtgggccacggtttgatggcccacgaagatttgaagacttgggatcgaggtgcgaaggacctcgtcccaaagggcctagatttgaaggtaatagacctgatggaccccgaccgagatatgagggacacccggcagaaggcacaaaatcgaagtggggaatgataccgcgtggcccagcttctcagttttacatcacaccctcaacaagtctttctccccgacagtcaggccctcaatggaagggaccaaaacctgcctttgggcagcagcaccagcagcaacctaaaagccaggcagaacctttgtccggaaacaaggaacccctggccgacacttcatctaaccagcaaaagaatttcaagatgcagagcgctgctttcagcatcgcggcagatgtcaaagacgtcaaggcagcacagtcaaatgaaaatctctccgacagccagcaggagcctccgaagagcgaagtgtccgagggaccagtcgagccctccaattgggatcagaatgtacagagtatggaaacacagatagataaggctcaagccgtgacccagccagtacccttagccaacaagcccgttcccgcacagagtacattcccctctaaaactggcggtatggaaggaggtactgccgtggcaacctccagtcttacagctgacaatgatttcaaaccagttggaatcggcctcccgcatagtgagaacaaccaagacaaaggcctgcccaggcctgacaacagagacaaccgcctggaggggaacagaggtaactcgagcagctataggggtccgggacagagccgaatggaggacaccagggataagggactggttaaccgaggtcgcggtcaggccatttcccgcggacctgggctggtcaaacaggaggattttagggacaagatgatggggagacgggaggacagcagagagaagatgaatcggggtgagggttctagggaccggggtctggtgagaccagggtcatctcgtgagaaagtccccggtggccttcagggcagccaagatcgcggagcagccggatcccgggagagggggccacccagaagggctggatcacaggagagggggccactccgcagagccggtagcagagaacgtatccctccacggcgtgccggatcccgcgagcgcggaccccctcgcggaccgggatcacgcgagaggggtttgggcagaagtgactttgggagggatagggggccttttaggcccgagcctggtgacggaggggaaaaaatgtatccatatcaccgcgacgaacctccaagggccccttggaatcatggagaggagcggggacacgaagaatttcctctggatggacggaacgcacctatggagcgggagcgacttgacgactgggaccgcgagagatattggagggagtgtgagcgtgattatcaagatgataccctcgaactctataaccgtgaggatcggttcagcgccccaccctctagaagtcacgacggcgataggagggggccatggtgggacgactgggaaagagatcaggacatggacgaagactacaatcgcgaaatggagagggatatggatcgtgacgtggacagaataagccggccaatggacatgtacgatagatctctcgataacgaatgggatagggactacggtaggccccttgacgaacaggagtctcagttccgagagcgagacattcctagcttgccccctctgcctcccttgccccctctccctcctctggaccgatacagggacgatcggtggagggaggaacggaaccgcgaacatggatatgacagggatttcagggatcggggagaactgagaatccgggaataccctgagcggggagacacctggcgcgaaaaaagagattacgtgcctgaccgcatggattgggagcgtgagcgcctttctgatagatggtaccccagtgatgtcgatcggcacagcccaatggccgagcatatgccaagctcacaccatagttcggaaatgatgggcagtgacgctagcttggatagtgatcagggcctgggcggagtgatggttttatctcagcgtcaacatgagataatcctgaaagccgcacaagagcttaagatgctccgggagcaaaaggagcaactgcagaagatgaaggatttcgggagcgagcctcagatggccgatcacctccctccccaggagtccagattgcagaataccagtagtcgcccagggatgtacccccctccaggatcataccgaccaccacccccaatggggaaacctccgggtagcatcgtgcgcccttcggccccacctgccagatcttccgtcccagttaccagaccgccagtgccaatcccaccacccccaccacctccacctctgccaccaccaccgccagtcataaagcctcagacgtccgcagttgagcaggagaggtgggatgaggattcattttacggcctctgggacacgaacgatgagcagggcctcaattctgagtttaaatccgaaaccgctgccataccttcagctccagtgctgcccccaccccctgttcatagttccattcccccaccagggccagtaccaatggggatgcctcctatgtctaagcccccaccagtccaacagaccgtggactatggacacgggagggacatttcaactaataaagttgagcagatcccgtatggggagcgcatcaccttgagacccgacccactgcctgagcgcagcacctttgagacagagcatgcagggcaacgtgatcgatacgaccgggagcgggaccgcgagccgtactttgacagacagtccaacgtcatcgctgatcatagagactttaaaagagacagggaaacccacagagatcgggatagagaccgaggcgtgatcgattacgacagggacagattcgaccgcgaacggagacctagagatgacagagcccagtcctaccgggataagaaggaccacagctccagccgaaggggtggcttcgaccgcccttcctatgaccggaaatccgataggcctgtttacgaaggtccctcgatgttcggcggtgagcggaggacataccctgaggaacggatgcccctccctgccccatccctctctcaccaaccaccaccagctccccgagtcgaaaagaaaccagagtctaaaaatgtggatgacattctgaaacccccaggcagggagtcgcgccctgaaaggatcgttgtcattatgagaggcctgccgggatctggcaaaacccacgtcgctaaactgataagagtgatggagtacgaatacgaggctgaaatggaggagacctacagaacaagcatgttcaagacgttcaagaagacactggacgacggcttctttccttttataatcctcgatgctattaacgaccgggtccgtcactttgaccagttttggtcagccgctaagacaaagggcttcgaggtgtatctcgctgagatgagtgctgacaatcagacctgtggcaagcgcaatatccacgggagaaagcttaaagaaatcaataagatggccgatcactgggaaaccgcacctaggcatatgatgagactcgacatccggagccttttacaggacgcagctattgaggaagtagagatggaggattttgatgctaatatagaggagcagaaagaagaaaaaaaggacgctgaggaagaagagtcggagttagttggagatcggccaacaacactgaatagcgtgtccctactgaagtttctaaaaaaagtatac

SEQ ID NO: 24880 - DNA, 6440 bp, Artificial Sequence
  Description of Artificial Sequence: Synthetic coding sequence
atgtacccaaattggggtcggtacgggggatcctcccattatccacctccgcctgtcccaccacccccacctgtggcactgccagaggcatcacctgggcctggctactctagttcgaccactcctgccgcacctagctcttctggattcatgtcctttagagaacaacatttggctcagctgcaacaattgcaacagatgcaccagaaacagatgcagtgtgtcttacagcctcaccaccttccgcctcctccccttccgccaccaccggtcatgcctgggggaggttacggggactggcagcctccaccgccacctatgcccccacctccaggccctgccctaagctaccaaaagcagcaacagtacaagcatcaaatgctgcaccaccagcgagacgggccacctggccttgttcccatggagctcgagtctccacctgaaagtccacctgtgccacctggatcctatatgccgccatcccagtcttatatgccaccgcctcagcccccaccttcttattatccccctacctcctctcagccttatctgcctccagcgcaaccctccccttcccagagcccgccaagccaatcttacctagctcctacacctagctactcttcttcatcctcatctagccagtcatacctgtcacactctcaatcttatctgccttcatcgcaggcatctcctagcaggccctcccagggtcatagcaagtctcagctgcttgcgccacctcccccatccgcacctcctggcaataagaccactgtccagcaggagcctttggaatctggagccaagaataagtctacggaacagcaacaggccgcaccagagccagacccctccacaatgacaccgcaagaacagcagcaatactggtatagacagcacttgctgtctctgcagcagaggacaaaggtccacctgccaggccacaagaaaggcccagtcgtggccaaggatacacccgaaccagtgaaggaggaggttacagtgccagcaacgtcacaagtgccagagagcccatctagtgaagagccgccactgccgcctcccaatgaggaggttccaccccctctcccacccgaggaaccacagtccgaagatcctgaagaggatgctcgccttaagcagcttcaggcagccgctgcacattggcagcagcaccagcagcaccgagtcggcttccagtaccagggcattatgcagaagcacacgcagctgcagcagatccttcagcagtatcagcagatcatccaaccacccccacacatccagacgatgtctgtcgatatgcaactgcggcactacgaaatgcagcagcaacagttccagcacctttatcaggaatgggagagggagtttcagctgtgggaggagcagctacactcctatccacacaaggaccaactgcaggagtacgagaagcaatggaaaacttggcagggtcacatgaaggctacccagagctacctccaggaaaaggtgaattcgttccagaatatgaaaaaccagtacatgggaaatatgagcatgcctccccctttcgtcccatattctcaaatgcctccacctctccctacaatgccccctcctgtcctccccccaagcctgcccccaccagtcatgccacccgctctccccgctacggtgcccccaccagggatgcccccacccgtcatgccccctagtctcccaacgagtgtaccccctccaggcatgccaccctcactgtcgagcgccggtccacctcctgtactcccaccccctagcctgagcagcgcgggtcctccacctgtactgccccctccttcactatcctctactgcaccaccccctgtcatgcctctgcctcctctatcctcagccacaccgccacctggcattcctccccctggagtgccacaaggtatacctccgcagcttacagccgctcctgtgccgccagcctcaagcagccagtcaagccaggtcccagaaaagccaagaccagctctcctccctaccccagttagctttggttctgccccaccaaccacataccaccctcctcttcaatctgcaggcccatctgaacaggtaaactcgaaggcccctctgtccaaatctgctctcccttactcctccttttcttccgaccagggactcggggagagttctgcagcaccatcgcagcccatcaccgcggttaaagatatgcccgttcggtccggtggcttactgcctgatccaccacggtcttcttacctggagtcacctcggggtccacgattcgatggccctcgcagattcgaggatctggggtccaggtgtgagggccctcgcccaaagggaccgcgtttcgaggggaaccggccagacggccctagacccaggtacgaggggcaccctgctgaagggacaaagagtaaatggggaatgattccgcgagggccagcatcccaattttatattaccccctccacttccctgagccccagacagtctgggccacaatggaaggggcctaagccagcctttgggcagcaacaccaacagcagccgaagagccaggccgaaccactctctgggaacaaagaacctctagctgatacgtctagtaaccagcaaaagaattttaaaatgcagtccgccgcattctctatcgccgcagacgtgaaagatgtaaaagccgcacagagtaatgagaacctatctgacagccagcaggaaccccctaagtccgaagtgtccgaaggacccgtcgaaccgagcaattgggatcagaatgtgcagtctatggaaacccaaatcgacaaagcacaggcagtgacccaacctgtccccctcgctaacaaaccagtgcccgctcaatcaacattcccatccaagactggaggaatggaaggcggaaccgcagtcgccacctcaagcctgacagccgacaatgacttcaagcccgtgggaatcggcttacctcactccgaaaataatcaggacaagggcctgccacggccagataatcgcgataaccgtctggagggcaacagaggaaattccagttcttatcggggtcctgggcagtctagaatggaggacacacgagacaagggcctcgtgaatagaggcagaggacaggccatcagtaggggccctggcctcgtaaaacaggaagactttcgggacaagatgatggggcgacgcgaggatagcagggaaaaaatgaacaggggtgagggaagcagagacaggggcctcgttcgtcccggaagctccagggagaaggtgcctggcggactgcagggctctcaggatcgaggagccgctggcagccgcgaacgcggacctccgaggagggccggaagccaagagcggggtcctctgcgaagggccggatcccgcgagcggattcctccaaggcgagcaggttcaagggaaaggggacccccacggggaccgggatcccgtgagaggggactcggccgttcagatttcggtagagatagaggccctttcagaccagagcctggggacggcggtgaaaagatgtacccctatcacagagatgaacccccacgcgcaccctggaaccacggtgaggaacgcggacacgaggaatttccgctggatggaagaaatgcccctatggaacgggaacgcttggacgactgggatagggaacggtattggcgcgagtgtgagagggactatcaggatgacactctggagctctataatagggaggaccgattttccgctccccctagcagatcacatgacggtgacaggaggggaccatggtgggatgactgggagagagatcaggacatggatgaggactacaatcgcgaaatggaaagagacatggatagggacgtcgataggatcagtcgcccaatggacatgtacgatagatcactggataacgaatgggatcgcgactatggtaggcctctggacgaacaagaatcgcagttccgggaaagagacatcccaagcctccctccgctaccacccttaccccctctgcccccactggataggtaccgggatgataggtggcgagaggaaaggaatcgtgaacacggatacgatagggattttagggatagaggcgaactccggattcgcgagtacccagaacggggagacacttggcgcgagaagagggactacgttcccgaccgcatggactgggagagagaacgtctgtctgatcgttggtacccaagtgacgtcgacaggcacagccctatggccgaacatatgccttcaagtcaccattcctccgaaatgatgggctcagacgcatccttggatagtgatcaaggcttgggcggagtgatggtcctgtctcagcgacaacacgagatcatcttaaaggcagctcaagaacttaaaatgctgcgcgaacaaaaggagcaattgcaaaagatgaaagattttggaagcgaaccgcagatggctgaccacctccccccacaggaatcacgcctccaaaatacttcctcccgccctgggatgtacccccctccaggatcctacaggcccccacctcctatgggcaaaccacccggatccatcgtgcgtccgtcagcaccaccagccaggtccagcgtccccgttactagaccaccagtgcctattccccctccaccgccaccaccacccctgcctccccctcctccggtgattaagccgcagacttctgcggtcgagcaggagcgatgggacgaggattctttttatggcctctgggataccaatgatgagcagggactgaattctgaattcaagagcgaaaccgctgccatacccagcgcacctgtgttgccacctccacctgtgcacagcagtatcccaccccctggtcccgtgccaatggggatgcccccaatgagtaagccgccacccgtgcagcagaccgtcgattatggacacggccgagatatcagcacaaacaaggtggaacagattccttacggagaacgtatcaccctaaggccagatccacttccagagcgtagtacctttgaaacagagcacgctggccagcgggaccggtatgatcgggagcgggatcgtgaaccatacttcgatcggcagagcaacgtaatcgccgaccatagggattttaaacgcgaccgcgaaacccaccgcgatcgtgatcgagacaggggcgtgattgattacgaccgggacagattcgatcgcgaacggcgaccacgagatgatagagctcagtcataccgggataaaaaagaccacagtagcagccggcgagggggattcgatcgtcccagctatgatcggaagtctgaccggcctgtgtatgagggtccctctatgtttggaggggagaggcgcacctaccccgaagagcgaatgccactgccagcaccttctctgtcgcaccaaccaccccctgctccaagggtcgagaaaaagcctgaaagcaaaaatgtggatgatatacttaaaccacctgggagggagagcaggccagaaaggattgtcgtgattatgaggggcttgcccggatcaggcaaaactcacgtggccaagctgatccgcgataaggaggtggagtttggaggcccagccccacgcgtcttatcactggacgactatttcattactgaggtggaaaaagaagaaaaggatccagactccggcaaaaaggtgaagaagaaggtaatggagtatgagtatgaggctgagatggaggagacctatcggacctccatgttcaagactttcaaaaaaacgctggatgacggtttcttcccatttataattctggacgccattaacgatagggtgaggcatttcgaccagttttggtcagccgctaaaactaaaggctttgaagtatatctggccgagatgagtgcagacaatcagacctgcgggaagcgcaatattcatgggagaaagctgaaagagattaataagatggccgaccactgggagactgcaccaagacatatgatgaggttggacatccggtcactgcttcaggatgctgcaattgaggaggtggaaatggaagacttcgatgctaatattgaggaacagaaagaggagaaaaaagacgcagaggaagaggaaagtgagctcggctacattccaaagagtaagtgggagatggacacgagcgaagctaaacttgacaagttggatggcctccggactggcactaaacggaagagagactgggaagccattgcctctcggatggaggactatctgcagcttccagacgattacgacaccagggcctcagagcctggtaaaaaaagggtacgctgggcagacctagaggagaagaaggacgcagacaggaaaagggcaatcggctttgtggtggggcaaacagactgggaaaaaattactgatgagagcggccatctggccgagaaggcactaaatcgtaccaaatacatcta

SEQ ID NO: 24881 - DNA, 5564 bp, Artificial Sequence
  Description of Artificial Sequence: Synthetic coding sequence
atgactccccaggaacaacagcagtattggtataggcaacacctcctgtccttgcagcaaaggactaaagtgcacctccccggacacaagaagggaccagtcgtggcgaaggacacgccagaaccagtgaaagaggaagtgacagtgccagccacttctcaggtgcctgaatctccctcttccgaggagccccctctgccacctcccaacgaggaagtccctccaccattaccgccagaggagccccagtccgaagacccagaggaagatgcgagattgaaacagcttcaagccgctgccgcacactggcaacagcaccagcaacatcgagttggctttcagtaccagggcatcatgcagaagcacacgcaactgcagcagattcttcaacagtaccaacagataattcaacctcccccacatattcaaacaatgagtgtggacatgcagctgcgccattacgaaatgcagcagcagcagttccaacatctgtatcaggagtgggaaagagagtttcagctctgggaggagcaactgcactcttatccacacaaggatcagttacaggagtacgagaagcagtggaagacgtggcagggacacatgaaggccacacagtcctacctgcaggagaaagtgaatagctttcaaaacatgaaaaatcaatatatgggcaacatgagtatgccaccccctttcgtgccgtacagccagatgccacctccgctccctacaatgccccctccagtcctgccgccttccttgcccccaccagtcatgccacccgctctgcccgctacagttcctccacctggaatgcctcccccagtcatgccccctagcctgcccacttcagtacctccgcctgggatgcccccatcactctccagtgccggtccaccccctgttctgccccctccctccctctcatcggctggaccgccacctgtcctgccaccacctagcttatctagcacagcccctcctcccgtaatgcccctccctccactgtcgagcgccacacccccacctggaataccgccacccggtgtgcctcagggcattccacctcagctgacagctgccccagtcccacctgctagctcatcccaaagctctcaggtgcctgagaaacctcggccagctctccttcctacccctgtctcatttggctccgcaccaccgaccacttatcacccaccgctacaatctgcaggtccttcagagcaagtcaatagcaaagccccactgagtaaaagtgcgttaccttactcgtctttctcttctgaccagggactgggagaatcatcagcagcgccttcccagcctatcaccgcagtgaaggatatgcccgttcgaagcggaggcctgctgcctgatccaccacgaagctcctacttggagagcccacgcggtcccagattcgatgggcctcggagatttgaggatttgggcagtcggtgtgaaggaccccgtccgaaaggcccaagatttgaggggaaccggccagacgggccacgcccacgttacgaaggccatccggcagaaggaacaaaaagcaagtgggggatgataccccgagggcctgcatctcagttctacattacaccatctacctcgctttcccccaggcaatcgggacctcagtggaagggacctaagccggcattcggccagcagcatcagcagcagccaaagagccaggccgagcccttgagcgggaataaggaaccgctcgctgacacgtctagtaaccagcagaaaaattttaaaatgcaatccgccgctttttcaatagcggcagatgtaaaagacgtaaaggcagcgcagtcaaatgagaacctttcagacagtcaacaagagccacctaagagcgaagtctccgagggccctgtagaacccagtaattgggaccagaacgtacagtcgatggaaacccagattgataaggctcaagcagtgacacagcccgtgccactggccaataagccagttcccgcacagagcaccttcccaagtaagactggaggcatggaaggtggcacggcggtagcaacgagttctctcaccgctgataacgatttcaaaccagtcgggataggactgccacattccgagaataatcaagacaaggggctgcctaggcctgataatcgggataataggctggaaggaaacaggggcaatagctccagttaccgtgggccaggacaatcgcgaatggaggacactcgggacaaaggcctggtgaaccggggtcgcggacaggcaatcagcaggggacctgggctcgtgaagcaggaggacttccgagacaaaatgatggggagaagggaggattcacgggagaaaatgaatcggggtgaaggctcacgagatcggggactggtccgaccagggagttccagagaaaaggtaccagggggtctacaagggtcacaggacaggggggcagctggatccagggaaagaggtcctccacgcagagctgggtcacaagaaagaggacccctgcggagggccggaagccgggaaaggatccccccacgtagggccggaagtcgggaacgaggcccacctagaggacccggatcacgagaaaggggtctgggccgttctgactttggcagggatagaggcccattcaggcctgagccaggtgacgggggtgagaagatgtacccctatcaccgcgatgagccaccaagagcaccttggaaccatggagaagagcgcggtcatgaggagttccccctggatggtcgaaatgctccgatggaaagggagcgtctggatgactgggatcgggagcgttattggagggaatgcgagagggattaccaggacgataccttggagctgtataaccgcgaagaccgcttcagcgccccaccgagccgctctcatgacggggatcgaagagggccatggtgggacgactgggagcgcgatcaggatatggacgaagattacaacagggagatggagcgcgatatggatcgggacgtggatcgcatcagtcgaccaatggacatgtacgatagaagcctagataatgagtgggaccgtgactatggtagaccactggatgagcaggagtcccaattcagggagagagatatcccttctctccctcctctgccaccactgcccccattgcctcccctcgacagatatagagatgatcgatggcgggaggagagaaatcgcgaacatggatacgacagggactttcgagaccggggtgaactccggatcagagagtaccctgagcgcggtgacacctggcgagagaagcgggactacgttccggaccggatggactgggagagagaaagactaagtgatcgctggtatcctagcgacgtggatcgacattctccaatggccgagcatatgccatcaagtcaccatagctcggaaatgatgggctctgatgcatctctcgatagcgaccagggactgggcggagtgatggtcctctcccagagacagcacgagatcatcctgaaggctgcacaggagctcaagatgctgcgcgaacagaaggagcagctgcagaagatgaaagacttcgggtcggagccccagatggccgatcatctgccacctcaggagtctcgcctgcagaacacgagctcaaggcccggtatgtatcctccccctggcagctacaggcctcccccaccgatggggaagccaccgggaagcatcgtacgccctagtgccccaccagcgcgatcctccgtccctgtgacgcgaccaccagtgcctatccctccccctcccccaccaccccctttgccacctccaccccctgttatcaagccccagacatctgccgtggaacaggagaggtgggatgaggactcattttatggcctctgggataccaacgacgaacagggcctgaattccgaatttaagtccgagaccgccgctataccaagcgcaccggtcttacctcctccgccagtgcactcaagcataccccctcctgggccagtgccgatgggcatgccccctatgtcgaagcctccacctgtacaacagactgtcgattacggacacggtagagacattagcaccaataaggtagagcagatcccatacggcgagagaatcacactcagaccagacccattaccggagagatcaaccttcgaaacggagcacgcaggccaacgggacaggtatgatagagaacgtgatagagagccctactttgatcgtcagagcaatgtgattgctgatcaccgagactttaagcgcgatcgggagactcaccgtgaccgggatcgcgacagaggcgtgatcgattacgaccgggatcgatttgatagggaacgtaggcccagagatgatcgcgctcagagctaccgcgataaaaaagaccacagttcctctcgaagggggggattcgaccggccaagctatgaccgaaagtcagaccggcctgtttatgagggacccagtatgtttggcggagagcgaaggacttatcctgaggaacgaatgcccctccccgcaccatccctgtcacaccagcccccaccagcaccaagggtggagaaaaagcccgagagcaaaaacgttgatgatattcttaagcccccaggacgagagtcacgaccggagaggatcgttgtgatcatgcgcggtctgcctgggtccggcaaaacccacgtcgcgaaactaatccgcgacaaggaggttgaattcggtgggccagcaccaagagttttgagcttggatgactattttatcaccgaagtggagaaggaggagaaggatccagactcaggcaaaaaagtgaagaaaaaggtcatggaatacgagtatgaggcagagatggaggagacctaccggacctctatgttcaaaaccttcaagaagacacttgacgacggcttcttccctttcattatactcgatgctataaacgatcgggtacgacactttgatcagttctggagcgccgcaaaaactaaggggttcgaggtttaccttgctgaaatgtcagccgacaaccaaacttgtggtaaacgcaatatccacggacgaaagttaaaagagataaataaaatggccgaccactgggaaaccgccccacgccacatgatgaggcttgacatccgctctcttctgcaagacgcagcaatcgaggaggtggagatggaggactttgatgctaatatagaagagcagaaagaggagaaaaaggatgccgaggaggaagaatccgagctgggatatatcccgaagtcaaagtgggaaatggacacatctgaggccaaattagacaaactggatggtctacgcaccggtacaaaacgcaagcgggattgggaagccatcgcgtcccgaatggaagactatcttcagctcccagacgactatgacacacgggctagcgaaccccctcgcccacgcggagccagcctatgcgtcaccctgctccctcgcttttcaagctgttttgttagtactgcacttgtttttttcaaggtgctgcagtgtccccaagaggtgttggagagctgctgtactcaggccagacgcta

SEQ ID NO: 24882 - DNA, 2184 bp, Artificial Sequence
  Description of Artificial Sequence: Synthetic coding sequence
atggcggcagatagccgggaagaaaaagatggcgaattgaatgttctggacgatattctcacagaggtccccgaacaggacgacgaactgtataaccccgaaagcgaacaagataagaacgagaagaagggctctaagcggaaatctgatcggatggagagcaccgacaccaaaagacagaaacccagcgtccatagcagacagctcgtcagtaaacccctgtcttcaagcgtgtcaaacaacaaacggattgtgagtaccaaggggaagtccgccactgagtacaagaacgaggagtatcagagatcggagagaaacaagagactggatgctgataggaaaatcaggctgagttcctccgcatcacgggaaccctataaaaaccaacctgagaagacctgtgtcagaaaacgggaccccgagcgaagagccaaaagccccacacctgatggctctgagcgcatcggtctggaagtggaccgtcgcgctagtcggagctcccaaagtagcaaggaagaagtgaactccgaggagtatgggagcgaccatgaaactggctcatccggcagtagcgacgaacagggcaacaacaccgaaaatgaagaagagggcgttgaagaggatgtggaggaagatgaagaggtggaggaagacgctgaagaggacgaggaggttgacgaagacggagaggaggaagaggaggaggaagaggaggaggaagaagaggaggaggaagaggaagaggaatacgagcaagacgagagagaccagaaagaggagggcaacgattatgacactcggagtgaagcaagtgactccggaagtgaaagtgtctcttttactgatggaagtgtccggagcggatcggggactgacgggagcgatgagaaaaaaaaagaacgaaaacgagctcggggtatctctccaatagtcttcgacagaagcggatctagtgccagtgaatcttacgctggcagcgaaaaaaagcacgaaaagttgtcttcttctgtaagagctgtccgaaaagaccagaccagcaagctgaaatacgtacttcaagatgcccgattttttctcatcaagagtaacaaccatgagaacgtttcccttgctaaggccaaaggggtgtggagtacgctgcccgtgaatgaaaaaaaactgaatttggcctttcgctcagcccgttccgttattttaattttttcggttagagagtccgggaagtttcagggattcgcgaggctctcttctgagtcacaccacggcggatcaccaattcactgggtcctccccgctggcatgtcggctaaaatgctcggcggagtgtttaagatcgactggatttgtagacgtgaattaccattcaccaagagtgcccacctgacaaacccctggaatgagcacaagcctgtcaagataggcagagacgggcaagagatagagctcgaatgtggtacccagttgtgtctcctgttcccacctgatgaaagcatcgacctgtaccaggtgatccacaagatgcgacacaaacggaggatgcacagtcagccacgctcccgcggacgcccaagcaggagggagcctgtgcgcgacgtgggtaggcgcagaccagaagactacgatattcacaatagcagaaagaaacctagaatcgactatccccctgagttccaccagcggccaggatatcttaaagacccgaggtatcaggaggtcgacaggaggttcagtggagtgcgacgcgatgtgttcctgaacggctcttataacgattacgtccgtgaatttcacaatatgggtccgcctcctccctggcaggggatgcccccatacccaggaatggaacagcctcctcatcacccctactatcagcaccatgccccacctccacaggctcatcctccatattccgggcatcatcctgtcccacacgaagctagatatagagataagagggtgcatgactacgacatgcgcgtggacgattttttgcgccgaacacaggcagtggtctctggtaggaggagtcggcctagagagagggatcgcgaaagagaacgagataggcctagggataatcgcagagatcgggaaagagatcggggacgggacagggaacgggaaagagagcgactctgtgatcgagacagagacagaggagaaagagggcgatatcgccgttag

SEQ ID NO: 24883 - DNA, 2130 bp, Artificial Sequence
  Description of Artificial Sequence: Synthetic coding sequence
atggcggctgattcccgtgaggaaaaggatggggaactaaacgtccttgatgatatcctaacggaagtgcctgagcaggatgacgagctctataaccctgagtccgagcaagataagaacgagaagaagggatccaaacggaagagtgacaggatggaatccacagacacaaaaaggcagaaaccttccgtgcactctcgtcagctggtctccaaaccattgtccagctcggtttccaacaacaaacgcattgtctctacaaaaggcaagagtgccaccgagtataagaatgaggagtaccagcgcagcgagcgaaacaaacggctcgacgccgaccgcaagatccgcctgagcagttctgcatcacgggaaccttataagaatcaaccggagaaaacctgcgtgcggaagcgtgacccagaacggagagctaagtcgcccactcccgacggctctgaacggataggactagaggtagatagacgcgcatccaggtcctcccagagcagcaaggaagaagtgaacagtgaggagtacgggtcagaccatgaaaccggttctagcgggtctagcgacgaacaggggaataatacagagaacgaggaagagggagttgaggaggatgttgaggaagacgaggaggttgaggaggacgccgaagaggatgaggaagtggacgaggacggggaagaggaggaagaggaggaagaggaagaagaggaggaagaggaggaggaggaggaagaatatgagcaggacgagagggaccagaaagaagaaggaaatgattatgacacccgctctgaggcttcagattcggggtcggagagtgtctcttttacagatggttctgtgaggtcaggctctggaacggacggatcagatgagaagaaaaaggagcgcaagcgcgctcgaggcatctctcccatcgtcttcgaccggtcaggatcatcagcgagtgaaagctacgctgatcagaccagtaagctcaagtatgttctgcaggatgctcgcttttttctgattaagtctaataatcacgagaatgtctccctagcaaaagccaaaggtgtctggtctaccctaccagtgaacgagaagaagctgaacctggcgtttagatctgcaaggtctgtcatcctcattttctctgtgcgagagtccggcaaattccagggttttgcaagactcagctccgagtcccatcacggcggatcaccaatacactgggtgctgccagctgggatgtctgctaagatgctgggtggcgtcttcaagatcgattggatttgcaggcgggagcttccatttacaaaaagcgctcatctgaccaacccatggaacgaacataagcccgtgaaaattggcagggatggccaggagattgagctggaatgtggcacgcagttatgccttttgttcccccctgacgagtccatcgacttataccaggtgattcacaaaatgcgccacaagagacggatgcacagtcagcctaggtccaggggcagaccgtccagacgagagccggttcgtgatgtgggaagaagacgcccagaagattatgatatccacaactctcgaaagaagcctagaattgactacccaccagaattccatcagagacccggttacctgaaggaccctaggtatcaggaagtggatcgacgcttcagcggtgtgcggagagacgtcttcctcaatggaagctataatgattatgttagggagttccacaacatggggcctccgcctccttggcaggggatgcccccataccctggcatggagcaaccccctcatcatccctactaccagcaccatgcacccccaccacaggcccaccctccatattctggacaccaccctgtgcctcacgaggctcggtaccgtgacaagagagttcacgactacgacatgcgagtcgacgatttcttgcgtcgcacacaggctgttgtgtcgggacgcagaagtagaccgagggagcgcgatcgcgaacgcgagcgggatcgcccacgtgataatcgtcgggatagggagcgggaccgcggtagagaccgcgagcgagagagggagaggctgtgcgacagggaccgggatcgcggagaacggggacggtaccggagatag

SEQ ID NO: 24884 - DNA, 2130 bp, Artificial Sequence
  Description of Artificial Sequence: Synthetic coding sequence
atggctgccgattctcgggaggaaaaagatggagagctgaatgtgctggacgacatactcacagaggtgcctgagcaggacgatgagctttacaatcctgaatcagagcaggataaaaacgagaagaaaggttctaaacgcaaaagcgacagaatggagagtaccgacacaaagaggcaaaaaccatctgtacacagccgacaattggtgtcaaagcccctcagcagttcagtatcaaacaataaaagaatcgtgtcaacaaagggcaaatccgctactgaatacaaaaatgaggagtaccagcgcagcgagaggaacaaaaggctggacgcggacagaaagatacgactaagcagcagcgcttctcgcgaaccttacaagaaccagcctgaaaagacttgtgtgcgcaaacgcgacccagaacgcagggctaaatctcccacgcctgacggcagcgagcggataggccttgaagtcgaccggagagcctccagatcaagccaatcaagcaaagaggaggtgaatagtgaagagtatggctccgatcatgaaaccggcagttccgggtcttcagatgaacaggggaataatacagaaaacgaagaagagggcgtggaggaagatgtcgaggaagacgaagaggtcgaggaggatgccgaagaggacgaggaggtggacgaggacggcgaggaggaggaggaagaggaggaagaggaggaggaagaggaggaggaggaagaggaagaatatgagcaggacgaaagggatcagaaggaggaaggcaatgattatgatactcggtctgaagctagcgacagtggtagtgagtccgtctcatttacagatggctccgtgcgaagcggatctgggaccgacggctccgacgaaaagaagaaggagaggaagcgcgcaaggggcatttcaccaatcgtctttgatcggtctggtagtagtgcctccgagagctacgctgatcagacctccaaactaaagtatgtccttcaggacgccagattctttcttatcaagtcaaataaccacgaaaacgtgtcactcgcgaaggctaagggggtctggagtacattgcctgtcaacgagaagaagcttaatcttgccttccgctctgccaggagcgttatactgattttctcagtgagagagagtggtaaatttcaggggttcgcgcgtctttctagcgagagccaccatggaggtagccccatccactgggtactgcctgcaggaatgtctgctaagatgctcggaggcgttttcaaaatcgattggatctgtagaagggagctacctttcacgaagtcagcccatctgactaacccctggaatgagcacaagccagtcaaaatcggcagagatggacaggaaatcgaactggagtgtggcacccagctgtgtttgctgttcccccctgatgagtcaattgacctgtatcaggtaattcataagatgcggcacaaacgcaggatgcattcccagccacggtccagaggaaggccctcgcgccgtgagccagttagggatgttgggaggagaaggccagaggattacgacattcataactcccgcaagaaaccaaggatcgactatcctcccgaattccaccaaagaccgggttacctaaaagatcctaggtatcaggaagtcgacagaaggttcagcggtgtgagaagagacgtttttctgaacggcagttataatgattatgtgagggagttccacaacatggggcctcctcctccatggcagggcatgcccccataccctggaatggagcagccaccccatcacccctactatcaacatcatgcaccacctccccaggctcaccccccatactcagggcaccaccctgttcctcacgaggctcggtaccgcgacaaacgcgtgcatgactatgatatgcgggtggatgattttctacgacgaacacaggcggttgtgagcggccgtcgcagtagacccagggagcgggaccgggagagagaacgcgaccgacctagagataaccgcagggatcgggagcgagatcgcggtagggatcgcgagcgagagcgggagcggttgtgtgatcgagaccgtgaccggggagaacgcggacgttatcggcgttag

SEQ ID NO: 24885 - DNA, 2184 bp, Artificial Sequence
  Description of Artificial Sequence: Synthetic coding sequence
atggctgccgacagccgggaggaaaaagacggagagctgaatgtgctggatgatattcttaccgaggtacccgaacaggacgacgaattgtacaacccagaaagtgagcaagataagaacgagaagaagggcagtaaaagaaaaagcgacaggatggaatcgaccgacactaagaggcagaaaccatccgtgcactctcggcaacttgtgagcaaaccattgtcatcatcagtctccaataacaaacgcattgtgtccactaaaggtaagagcgccacggaatacaagaacgaggaatatcagagatctgaacgcaataaacggctggacgctgatcgaaagatcagactgagctcgtctgccagtcgagagccatataagaatcaacccgagaagacgtgcgtgcgaaaaagggaccccgagcgaagggcaaaatcgccaacacctgacggctctgaacggatcggtctggaggttgataggagagccagccgctctagccagagctctaaagaggaagttaattcggaagagtacggtagcgatcacgaaaccggctctagtgggtcttccgacgaacaaggcaacaataccgaaaacgaagaggaaggcgtggaagaagatgtcgaagaggatgaggaggttgaggaagatgctgaggaagacgaggaagtggatgaagacggcgaggaggaggaagaagaagaggaggaggaggaagaggaagaagaggaggaagaggaggagtatgagcaggacgagcgagaccagaaagaagagggcaacgactatgatactaggtctgaggctagcgattccggctccgagtctgtgtcgtttaccgatggctccgtcagatcggggagcggcaccgacgggagtgacgagaagaagaaggagaggaagagagcccgagggatcagccccattgtgttcgacaggtcgggtagctcagcctcagagtcctatgctggcagtgagaaaaagcatgaaaaactgtccagctctgtgcgtgcagtacgaaaagaccagacgagtaaacttaagtacgttttgcaagatgcaaggttcttcctgattaaatccaacaatcacgagaatgtgtctctggcaaaggccaagggggtgtggtcgacgttgcccgtgaacgaaaagaaactcaatctagcctttcgctcggctcggagtgttatcctgatcttttccgtgcgagaatctggtaagtttcagggttttgccagactgagttccgagtcacaccacgggggttcaccaatccattgggtgttgcctgccggaatgagcgcaaaaatgctgggaggagtattcaagatcgactggatttgccggcgagagctcccgttcacaaaaagtgcacacctgacaaacccctggaacgagcacaagccggtaaagatcggtcgcgatggacaagagatagaactggaatgcggcacacaattgtgtctcctgtttcctcctgacgagagtatagacctatatcaggtgatacacaaaatgcggcacaaacggaggatgcactctcagcctcgcagtaggggccgaccctcccgtcgagaacctgtgagagatgtcggcagaagacgcccagaagactatgatatccataattccaggaaaaagcctcgaatagactaccccccagaatttcaccagcgcccagggtatttaaaggatcctcggtaccaggaggtcgaccggcgtttttctggggttcgacgtgacgtgtttctgaatggctcgtataatgattacgtcagggaatttcataatatgggaccaccccctccctggcagggcatgcctccgtacccaggtatggaacaaccaccgcatcacccatattatcaacatcacgcacccccaccgcaggcacatcctccatactcagggcatcatcccgtgcctcacgaagcccgttatcgtgacaaacgtgttcacgactacgatatgagagtcgatgattttctccgacggactcaggctgttgttagtggacgcaggtccagacccagagaaagagatagggagcgcgaacgagacagacccagggataaccggagagatagagaacgtgatcggggaagagatagggaaagagaaagggaacgcctctgcgatagagacagggatcgaggggagagaggacggtacaggagatag

SEQ ID NO: 24886 - DNA, 1992 bp, Artificial Sequence
  Description of Artificial Sequence: Synthetic coding sequence
atgttcttgaaagctggcagagggaataaggttcctcctgtccgagtatatggcccagactgcgtcgtcctcatggaaccccctctgtccaaacggaatcctcccgcactcagactggccgatctggccacagcccaggtacagccgttacaaaacatgacaggatttcctgccttggcaggtccaccagcccattctcagctgagagccgctgtcgcccacctacgcctccgggacctcggtgccgatcctggggtggctacgaccccactgggcccagagcacatggcccaggctagcactcttgggctgtctcctccatctcaggccttccccgcacacccagaagccccagcagctgctgccagagctgccgcattggttgcccaccccggagccggaagttacccatgcggaggcggttcatccggggctcagccatccgcccctcctccacccgcacccccactaccacctacccccagtcctcctccccctccccctcctccccctcccccagcactttctggctacacgaccacgaactcggggggaggaggctcatcgggcaaggggcactccagagacttcgtgctgcgacgagacttgtccgccaccgcaccagccgcagcgatgcacggggcaccccttggaggggagcagagatctggcacgggctcaccccagcatcccgctccccctccacacagcgcagggatgtttatttccgcttcgggcacatatgccggacctgatggcagtggaggaccggctctgttcccagcactgcacgatacacctggcgctcctgggggacaccctcatccattgaatgggcagatgagactcgggctggctgccgctgctgccgctgcagctgcagagctctacgggagagcggaacccccattcgccccacggtccggagatgcacattatggtgccgttgccgctgcagcagccgcagctcttcatgggtacggtgccgttaacctgaatctgaatcttgcggctgctgctgctgccgctgcagcagggcctggtccgcatctgcagcaccacgcgcctcccccagccccacctccccctcctgccccagcccagcatccgcaccagcatcacccgcatctgcccggagcagcgggagcatttctcagatacatgcgtcagcccatcaaacaggaactaatatgtaagtggattgaccccgacgaactcgcaggtctgcctccaccccctccacctccgccacccccaccgccacctcctccagctggtggcgcaaaaccttgcagcaagacttttggcaccatgcacgaattggtaaatcacgtgaccgttgagcatgtgggcggaccagaacagtcctcccatgtgtgcttctgggaagactgtccaagagagggcaagcccttcaaagctaaatacaaattgattaatcacattagagtccatactggggagaaaccctttccttgtcctttccctggctgtggcaaagtgtttgctcgttctgaaaatttgaaaatacataagcggacacacactggcgagaagccttttaaatgcgaattcgatggctgcgatcggaagtttgcgaactcttctgacaggaagaaacacagccatgttcataccagcgacaaaccttactactgcaaaatccgaggatgcgacaaatcttacacccaccccagctcactccgtaaacatatgaaaatccattgcaagagccccccacctagccctgggccattagggtatagctctgtgggcacacctgtaggggcaccgctttcacccgttctcgacccagctcggtctcactccagcacactcagcccccaggtgaccaatctaaacgaatggtatgtctgccaggcctcaggcgcaccctcccacctccatactccgtcctctaacgggactacctctgaaacggaggatgaagaaatctatggtaaccctgaggtggtccggacaatccattag

SEQ ID NO: 24887 - DNA, 654 bp, Artificial Sequence
  Description of Artificial Sequence: Synthetic coding sequence
gctgcagcagccttacacggatacggggcagtgaacctgaatctgaatttagctgccgcagctgctgcagcgcatccacaccagcatcatccacacttgccaggcgcagcaggcgctttcctgcggtatatgcgacagccaataaagcaggagttaatctgcaagtggatagatcccgatgagcttgctgggagagcgaagccctgctccaagactttcggcactatgcacgagttagtcaaccacgtcaccgtcgaacatgtgggcggtccggagcaatcgtcccacgtgtgcttctgggaggattgccccagagagggcaagccatttaaagctaagtacaaacttatcaatcacatcagagtacacaccggcgaaaagccattcccgtgtccctttccagggtgtggcaaggtctttgccagatctgagaacctgaagatccacaaaagaactcatactggggaaaaacctttcaaatgcgaatttgacggctgcgatagaaagtttgccaattcctctgacagaaagaaacattctcacgtgcacacctcagacaagccgtactattgcaagatcagaggttgtgacaagtcatacacccatccctcaagcctgaggaaacatatgaaaatccactgcaaaagcccctag

SEQ ID NO: 24888 - DNA, 3696 bp, Artificial Sequence
  Description of Artificial Sequence: Synthetic coding sequence
atgtgcaagtgctgcaatctcttttccccgaaccagagcgagcttctctcccatgttagtgaaaagcacatggaagaaggggtcaacgtggacgaaatcattataccacttaggccacttagtacgcccgaacctccaaattcatccaagaccggtgatgagtttttggtgatgaagcgcaagaggggcagacccaaagggagcactaagaaaagctccactgaagaggagctggcagaaaacatcgtaagtccgacagaggactctccgcttgcccctgaggaaggtaactctctgcccccttcttcacttgaatgtagcaagtgctgcagaaagttctcaaatacccgacagctacgtaagcacatatgtatcattgtgctgaatctgggagaggaggaaggggaggccggaaatgagtctgacctggagttggagaagaagtgtaaggaggacgaccgagaaaaggcgtccaaacgtccgaggagccaaaagacagaaaaggtccaaaagatcagcgggaaggaggccagacagctgtctggcgctaaaaagcctattatctctgtagtgctcacggcccatgaagcgatacccggagcaacaaagatcgtgccagtcgaagctggccctcccgagacaggcgcaacaaactccgagacaaccagcgccgatctggtgccacggcgtggctatcaggagtacgccattcagcaaacgccatacgagcagccaatgaagtcctcacgactgggtccaactcagttaaaaatcttcacctgtgagtactgcaacaaggtttttaaattcaaacattccctccaggcccatcttaggatccacaccaacgaaaagccttacaagtgtccacagtgctcttatgccagcgctattaaggccaatcttaatgtgcatcttaggaagcatactggggagaagttcgcgtgtgattactgctcatttacctgcctatccaaaggacacctaaaggttcacatcgagagggtgcataaaaaaattaagcagcactgcagattttgtaaaaagaaatatagtgacgttaaaaacctcatcaaacatatccgtgacgcccatgacccacaagataaaaaggtaaaggaggctctcgatgagctatgcctcatgacgcgcgaaggaaagaggcaactgctgtatgactgtcacatttgtgaaaggaaatttaaaaacgagctcgaccgtgaccggcacatgctcgttcatggagacaagtggccctttgcctgtgagttatgtgggcatggagctacaaagtaccaggcactggagctccatgtgcggaagcacccctttgtgtatgtttgcgccgtgtgccgcaaaaagttcgtaagctctattagactgagaactcacatcaaagaggtgcacggtgcagcccaggaagccctagtgtttaccagcagcattaatcagtccttttgtctgcttgagccaggaggggatatacagcaggaggcactgggagaccagctgcagctggtggaggaagagtttgctcttcagggagtgaacgcgctcaaagaggaagcatgccccggagatacccagctggaagagggacgaaaggagccggaagcacccggagagatgccagctccagcagtacacctggcgtccccccaggccgagtcaacagcccttccgccatgcgagcttgagacgaccgtggtctcatcttccgaccttcattcgcaggaagtcgtctctgatgactttctgctaaagaatgacacctcttctgccgaagctcatgcggcacctgaaaagccaccagacatgcaacaccgatccagtgtgcagacccagggggaagtcataactctcctgttgagcaaggcgcagagcgctggctccgatcaggaaagtcacggcgctcagtctcccctgggggagggccaaaacatggccgtgctatcggccggagatccagaccccagtagatgtctgagatccaaccccgctgaggccagtgacctattaccgccagtagctgggggtggagacacaataacacaccaaccagatagctgcaaagcagcccctgaacatagatccggcatcacagcctttatgaaagtgctcaactccctgcaaaaaaagcagatgaacacttctctgtgcgagcgaatcaggaaagtgtatggcgacctggaatgtgagtactgtggtaaactcttttggtaccaggtgcactttgatatgcatgtgcggacgcatacccgagaacatttgtactactgttctcagtgtcactatagctccatcaccaaaaattgtctgaagcgccacgttatccaaaaacattccaacatactgctgaagtgtcctacagacggctgcgattattcgacacccgacaaatacaagcttcaggcacacctgaaagtgcacaccgccctagacaaaaggagttactcatgtcctgtgtgcgagaaatcttttagcgaagatagattaatcaaatcccacatcaagaccaaccatcctgaggtgtcaatgtctaccatctcggaagtgctggggagacgcgtgcaactcaagggactgatcggcaagcgagccatgaagtgtccctattgtgatttttacttcatgaagaacggttctgatctccagcgccatatttgggcccacgagggagttaaaccgttcaaatgttccctttgcgaatatgccacaagatctaaatctaatctcaaagcccatatgaatcgccacagcacagaaaaaacacacctttgcgatatgtgcgggaaaaaattcaagtctaagggcaccctcaaatctcataagctcctccatactgctgatggaaagcagttcaagtgcacagtatgcgattacacagccgcacagaagccacagttattgcgacacatggagcagcacgtgagcttcaagcccttccgatgtgcccactgccattattcctgtaatatttcaggctcccttaaaagacattacaataggaagcatccgaacgaggagtatgcaaacgtagggacaggcgagctcgccgcagaagtgttgattcagcagggaggcctgaaatgtcccgtctgtagttttgtgtacggtaccaaatgggagttcaataggcaccttaaaaataagcacggccttaaggtggtcgagatcgatggcgatcctaaatgggagacggccactgaagctccagaggaaccatccacgcagtaccttcacattaccgaagcagaggaagacgtccagggtactcaggcagccgtggccgctctccaagacctccgatatacttccgagagcggggaccgactggatccaaccgccgtgaatattttgcagcagattattgagctaggagcagaaacccatgatgctacagccctcgctagtgtggtggccatggcaccaggaacagtgacagtggtgaaacaagtgacggaagaggagccatccagcaaccacacagttatgatacaggagacagttcagcaagccagcgtagagctggccgagcagcaccacctggtggttagttccgatgacgtggagggcattgaaaccgtgacggtgtatacccagggaggggaagcctcggagttcattgtctatgtgcaagaagccatgcagcctgtggaggaacaggccgttgagcagcctgctcaggaactttag

SEQ ID NO: 24889 - DNA, 1935 bp, Artificial Sequence
  Description of Artificial Sequence: Synthetic coding sequence
atggcaaagcctagccattctagctacgtgttgcagcagctgaataatcagagggaatggggctttctttgtgattgttgtatcgctattgacgacatctatttccaagcacataaggccgtactggccgcatgcagctcttactttcggatgttctttatgaatcaccaacactctaccgcccagctgaatctctccaacatgaagatatctgctgagtgttttgacctgatactccagttcatgtacctgggcaaaatcatgactgcgccatcttcatttgagcaatttaaggttgctatgaactatctgcagctctataatgtgcccgactgtctggaggatatccaggatgctgattgtagcagttcaaagtgttcttctagtgcgtcgtctaaacagaactcgaagatgatttttggtgtcagaatgtatgaagacaccgttgcgagaaacggtaacgaggcaaaccggtggtgcgctgagccaagcagcactgtaaacaccccacacaatcgggaagccgacgaagagtctctccaattaggcaacttccctgaacccctgttcgatgtgtgtaaaaaaagtagcgtgagcaagctcagtactcccaaggagagagtgtccaggaggttcggtagatctttcacatgtgacagctgcggatttggcttttcatgtgaaaaactactcgatgaacatgtactcacctgtacgaatagacatctatatcaaaatacaagatcctatcacaggatcgtagatattcgggacgggaaggattccaacataaaggctgaatttggggagaaggacagtagcaaaaccttttcggcccagacagataaatatagaggcgatacaagtcaggccgctgacgattctgccagcaccaccggttctcgcaagtcctcaacggtcgagtcggagattgctagtgaagagaagtctagggccgcagaaaggaagcgtattattattaagatggagccggaggacatccccactgatgaactgaaggacttcaatatcattaaagtcaccgacaaggattgtaatgagagcaccgacaatgatgagcttgaagatgaacctgaggagcccttttacaggtactacgtggaagaagatgtcagcatcaaaaagtcagggaggaaaacacttaagccccgtatgtctgtaagcgctgacgagaggggcggactggagaatatgcggccaccaaataatagttcgcctgtgcaggaggacgctgagaatgccagctgtgaactttgcggacttacaatcacagaggaagatctgagctcgcactacctcgccaaacacattgagaatatttgcgcttgtggtaagtgtggccagatcctggtcaagggcaggcagcttcaagaacacgcacagcgctgtggggagccccaggatctgacaatgaatgggttgggaaacacggaggagaagatggacctggaagagaatccggacgagcagagcgaaatccgggacatgttcgtggagatgctagacgatttcagggataatcactatcaaatcaactcaattcagaagaagcagctgttcaagcactccgcttgtccctttcggtgccccaattgtggccaaaggttcgagaccgagaacctcgtggtggagcacatgagttcctgcctggatcaggatatgttcaagtctgctataatggaggaaaacgagagggaccaccgcaggaagcacttctgtaatttgtgcggcaagggcttttaccagaggtgtcacctccgcgagcattacacagtccataccaaggagaagcagtttgtatgtcagacctgtggtaaacagtttctgagggagaggcagcttcggcttcataacgacatgcacaaaggcatggcatccggagagattgggcctagcaagcctgtcgagaaatag

SEQ ID NO: 24890 - DNA, 2142 bp, Artificial Sequence
  Description of Artificial Sequence: Synthetic coding sequence
atggcaaagccgtcccactcttcttatgtgctgcagcaattaaacaatcagagggaatggggatttctgtgcgactgttgtatcgctattgacgatatatactttcaggcccataaggctgttctggctgcttgtagcagctatttccgaatgttttttatgaaccatcagcattctaccgcacaacttaacctgagcaatatgaagatctccgcagagtgttttgaccttatcctgcaattcatgtatttaggcaaaatcatgactgctccatctagtttcgagcagtttaaggtcgctatgaactacctgcagctttataacgtgcccgactgcctggaggatattcaggacgccgactgtagttcttcaaaatgctcgagctcagcctcctcaaaacaaaatagtaagatgatcttcggggttcggatgtacgaagacactgtggccaggaatggtaatgaagctaacagatggtgcgccgaaccgagctcaaccgtgaatactccgcacaaccgcgaagccgatgaggaatccctacaactgggaaacttccctgagccgctgttcgatgtatgtaaaaaaagttctgttagcaagctgtccaccccaaaggagcgggtgagccgcagattcggacgatcattcacttgcgattcctgcggatttggcttttcatgcgagaagctgttagacgaacacgtgctgacatgcacaaataggcacctgtaccaaaacaccagatcttatcaccgcatcgtggatattcgcgatggtaaggacagcaacatcaaggcagagtttggcgaaaaggattcaagcaaaactttcagcgctcaaactgataagtataggggagatacatcccaggctgccgacgactctgcttcaaccaccggctctcggaaatcatctaccgtggagagtgagatcgccagcgaggagaaaagtagagccgctgagagaaagcgtattatcataaaaatggagcccgaggatattcccacagatgaattgaaagattttaacattatcaaggtaacggacaaagattgtaacgaatccaccgataacgacgagttagaggatgagccagaggaaccattctaccgctattacgtcgaagaagatgttagcattaagaaatccgggaggaagaccctcaagccacgaatgtctgtctccgccgatgaaaggggcggtcttgaaaacatgagaccccctaacaattcttctcccgtgcaggaagacgctgaaaatgcatcttgtgagttatgcgggctgaccattaccgaagaagatctcagttcgcactacttagccaagcacatcgaaaatatttgtgcctgcggcaagtgtggccagatcctagtgaaaggcaggcagttacaggagcacgctcagcgttgcggagaaccccaggaccttaccatgaatggactgggtaatacagaagagaaaatggacttggaggagaaccccgatgaacaatccgagattcgggacatgttcgtggagatgctcgatgattttcgcgacaaccactatcagataaactctatccagaaaaagcagctgttcaaacacagcgcctgcccctttaggtgtcctaattgtggtcagaggttcgagaccgagaatttggttgtggagcatatgagcagctgtttggaccaagatatgttcaaaagcgcgattatggaggagaacgaaagagatcacagacgcaaacacttctgcaacctgtgcgggaaaggattctatcaacgatgtcatttgagagaacactacaccgtccacacaaaggagaagcaattcgtgtgtcaaacctgtggcaaacagtttcttagagagaggcagcttaggcttcataatgatatgcacaagggaatggccaggtacgtatgttccatttgtgatcaaggcaactttagaaaacatgatcatgttcgccacatgatcagtcatttatccgctggtgagacaatttgccaggtctgctttcagatcttccccaataacgagcagttagagcagcacatggatgtccacctgtatacatgtgggatctgtggcgctaagtttaacctccgaaaggacatgagatcacactacaacgctaagcacctcaaaagaacctag

SEQ ID NO: 24891 - DNA, 468 bp, Artificial Sequence
  Description of Artificial Sequence: Synthetic coding sequence
atggccaagccctcacacagctcgtatgtacttcagcagctcaataaccaaagggagtggggcttcctctgtgactgttgtatcgctatcgatgatatttattttcaggcacacaaagccgtgctggctgcctgctcatcctatttccggatgttcttcatgaaccaccaacactccacagcacagctgaacctgagcaacatgaagatctccgcagagtgttttgacctcatcctacaattcatgtatcttggcaagattatgaccgccccatctagtttcgagcagttcaaggtggccatgaattacctgcagctgtacaatgttcctgactgtctagaagatatacaggatgccgattgctcttcaagtaagtgttctagtagtgcaagtagcaagcagaatagtaagatgatttttggagtgcgaatgtatgaagacaccgtggcacgaaacggtaacgaatag

SEQ ID NO: 24892 - DNA, 2142 bp, Artificial Sequence
  Description of Artificial Sequence: Synthetic coding sequence
atggccaaaccctcccactcgagttatgtcttgcagcagctcaataatcagagggaatgggggtttctgtgcgattgctgtatcgctattgatgacatttatttccaggcacacaaggcggtcctggccgcatgctccagctacttcagaatgtttttcatgaaccatcaacactccacggctcaactgaatctgtcaaatatgaagatcagtgcggaatgcttcgatctcatcctgcagtttatgtatttggggaagatcatgaccgcacccagtagcttcgagcagttcaaagtagccatgaattatttacagctgtacaacgtccctgattgtctggaggacatccaggatgccgattgctctagctctaaatgctccagttctgcttctagcaagcagaacagcaaaatgattttcggagtacggatgtatgaggatacagtggcgaggaatgggaatgaggcaaacagatggtgcgcagagccgtcctcaactgttaatacccctcataaccgagaggcagacgaggagtctttgcagttggggaatttcccagaacctctgttcgacgtttgcaagaagtcgagcgtgtcgaaattgtccactcccaaagaaagagtgtctcggcgatttggtcgctcatttacctgtgactcctgcgggtttggatttagttgtgagaagcttcttgacgagcatgtgctgacttgtactaaccggcacctgtaccaaaacactcggagttaccacagaatagttgatatcagagatgggaaagactctaacatcaaagccgaattcggagaaaaggattcatcaaagactttctccgcgcagaccgacaagtaccgtggcgataccagccaggcagcagatgacagtgcctccacaacaggctctcgtaagagttctacggtggagagcgagattgccagcgaggagaaaagccgggctgccgagagaaagcggataataatcaagatggaacctgaggacatccccacagatgaactcaaggatttcaacattattaaggttaccgacaaagactgtaacgaatcgaccgacaatgacgagttggaggatgagcccgaagagcctttctaccgatactatgtggaagaggacgtgtcgatcaaaaaaagtggaaggaaaacattgaaacccaggatgtctgtcagcgcagatgagcggggtggactggaaaatatgagacctcccaacaacagttctccagtacaagaggacgcagaaaatgctagctgtgagctgtgcggtttgacaatcaccgaggaagacctctcttctcactacttagccaaacacatcgaaaacatctgcgcgtgtgggaagtgtgggcagatactagtgaaggggcgtcagttacaggagcatgcacaacgctgtggcgaaccacaagatctgacaatgaacggcctggggaatacagaagagaagatggatttggaagagaaccccgacgagcagagcgaaataagggacatgttcgtagaaatgctggacgattttcgcgataaccattatcaaattaacagtattcagaaaaaacaactgtttaaacacagcgcatgtccctttcggtgccccaactgtggccaacgcttcgagactgagaatctcgttgttgagcatatgtcatcatgcttggaccaggatatgttcaagtccgccatcatggaagagaacgaaagagaccaccgccgtaaacacttttgcaacctttgcggcaagggtttttaccagaggtgtcatttgagggagcactatacagtgcataccaaggagaaacagtttgtttgtcaaacatgcgggaaacagtttctgagggagcggcagctccggttgcataatgatatgcataagggcatggcgcgatacgtttgcagtatttgtgaccagggtaattttaggaagcacgaccacgttagacatatgatatcacatctctcagctggagaaaccatttgccaggtatgcttccaaatctttcctaacaacgagcagttagagcagcacatggatgtgcacctgtatacctgtgggatttgcggagcaaaattcaatctgaggaaggatatgcgcagccactacaacgccaagcacttgaaacggacctag

SEQ ID NO: 24893 - DNA, 105 bp, Artificial Sequence
  Description of Artificial Sequence: Synthetic coding sequence
atggcgaagccgtcccactcaagctatgtgctgcaacaactcaacaaccagagggagtggggatttctatgcgactgctgtatcgccattgacgacatctattag

SEQ ID NO: 24894 - DNA, 393 bp, Artificial Sequence
  Description of Artificial Sequence: Synthetic coding sequence
atggccaaaccctctcactcatcatatgttctgcagcaactgaataaccagagagagtgggggtttctctgcgactgctgtatcgctatagacgacatctacttccaagctcacaaggccgtgcttgcagcctgtagctcatattttaggatgttttttatgaaccatcaacattccacggcgcagttaaacctctccaatatgaagatctccgcagagtgcttcgacctgatcctgcagttcatgtacctcggtaagatcatgacagccccaagctctttcgagcaattcaaggtggccatgaactacttacaactgtataacgtgccagactgtctggaagatatccaggatgcagactgctcttcttcaaagtgctctagttctgcttag

SEQ ID NO: 24895 - DNA, 1740 bp, Artificial Sequence
  Description of Artificial Sequence: Synthetic coding sequence
atgaccaggctggagaggtcatctcatcggacagtcatttgtaaggtcccaggagaacttgtggccagggagggtaaatgcgccagtagggcaagggaatccgagatcccgagcgaggagggatactgcgattttaatagcagaccaaatgaaaattcttattgctaccagctgttgcgacagctcaatgaacagcggaagaagggcatcctctgtgatgtcagcatcgtcgtgtcaggcaagatctttaaggcacacaagaacatattggtcgcgggatcacgcttttttaagaccctgtattgtttctctaataaagagtcccccaaccagaataacacgactcatctagacattgcggctgtgcaaggcttttctgtgatactcgattttctctatagcggaaatctcgtcttaacaagccagaatgccatagaggtgatgaccgtagcgtcctacctgcaaatgtccgaagttgtccagacctgtcgcaatttcatcaaagatgcactgaacatcagcattaaatccgaagcacccgaatccgttgtagtcgactataacaatagaaaaccggtgaatcgcgacggcctgtccagcagccgtgaccaaaagatcgcttcattctgggccaccaggaatctgacaaacctggcctcaaatgttaagatagagaatgatggatgtaacgtggatgaagggcagattgaaaattaccagatgaatgactcatcctgggtccaggatggctcccctgaaatggcagagaacgaatcagaaggccaaaccaaagtgttcatatggaataacatgggctcccaaggtatccaggagaccggcaagactcgacgcaagaatcagaccaccaagcgcttcatctacaacatcccacccaataatgaaacgaatctggaagactgtagtgtgatgcaaccaccggtcgcttatccggaggaaaataccctgttgatcaaggaagaaccagatctagacggagctctgttaagtggcccagacggagatagaaatgtcaacgccaacctattggctgaagccggaacatcacaggacggcggagatgccggtacttcccacgacttcaaatacggtctaatgcccggaccgtcaaacgattttaagtatgggctgattcccggaacctctaatgacttcaaatacgggctcattcctggagcctccaacgactttaaatatgggttgctgcccgagagctggccaaagcaggagacctgggaaaatggagaatcttctttaataatgaataaactcaaatgccctcattgttcctacgttgcaaagtaccggcgaacacttaagcgtcacttgcttatccacactggggtgcgctctttcagttgcgacatctgtggaaagctcttcacccgtagggagcatgttaagcgacactcccttgtgcataagaaagacaaaaagtataagtgcatggtctgtaaaaaaatctttatgctagctgccagcgttggaatccgccatggctccaggagatatggcgtttgcgtcgactgtgctgacaagtcccagccgggaggtcaggaaggcgtggatcagggacaagacactgagtttccaagggatgaagaatacgaagagaatgaagtcggagaggccgatgaggaactagtggatgatggtgaggatcagaacgatccctctcgctgggatgagtctggagaggtttgcatgtccctggatgattag

SEQ ID NO: 24896 - DNA, 2616 bp, Artificial Sequence
  Description of Artificial Sequence: Synthetic coding sequence
atgtcgttttccgagatgaaccgtaggacgctggcattccggggaggaggtttggtgacggcctctggcggaggctcaacgaataacaacgcaggaggcgaggcatcagcgtggccaccgcagccccagccaaggcaaccgcctcctcctgcaccccctgccctgcagccacccaacggcaggggagcggatgaagaggtggagctggagggcctggagcctcaggatctcgaagcaagcgctggcccagccgctggagcggctgaggaagcgaaagagctgctgctccctcaggacgctggcggacccacctctttgggtggaggagcaggcggaccccttctggcagaacgcaaccggagaaccttggcttttaggggaggagggggagggggactcggaaacaatgggtcaagcagagggcgtccagagaccagcgtctggcctctgaggcatttcaatggtcgcggtcctgccactgtcgatctggaactggatgccttagaaggaaaggagctcatgcaggatggggcaagcctttctgattccacggaagatgaagaagagggggcttctttgggcgacggaagtggcgcagagggcggatcttgcagtagttcccgccgttccggaggcgatggtggggatgaagttgaagggagtggagtcggggctggggaaggggagaccgttcaacacttcccgctggcacgtcccaaatcccttatgcagaagctacagtgttcttttcagacaagctggctgaaggattttccatggttgcgttatagcaaagacactgggctcatgagctgtgggtggtgccaaaagacccccgctgacggaggcagcgtggacctcccccctgttgggcatgatgaactgagtcgcggtactcgcaattacaaaaaaactctcctgctccgacatcacgtatccaccgagcataaacttcacgaagccaatgcccaggagtccgaaattccatctgaggagggctactgtgacttcaacagccggccaaacgagaattcgtactgttaccaactactgagacaactgaatgaacagaggaaaaaggggatcctgtgcgacgtctctattgtggtcagtggtaagatcttcaaagctcataagaacatcctcgtggccggaagcaggttctttaaaacgctgtattgcttttcaaacaaggaatcaccgaatcaaaacaacaccacacatctcgacatcgcagctgtgcaaggattctccgttatcttggactttttgtacagtggaaaccttgttctgacttcgcaaaatgcaatcgaagtaatgacggtcgcatcatacctccagatgtcagaagtggtacaaacttgcagaaatttcattaaagatgccctgaatataagcatcaaatccgaggcgcctgagtccgtggttgtcgattataacaaccggaagccggtgaatagggatgggctgagctcgtcaagagatcagaagattgcttctttctgggcaacccggaacctgacaaaccttgccagcaacgtcaaaattgaaaacgatgggtgcaatgtcgacgaaggacagattgaaaattatcaaatgaacgactcctcatgggtccaagacggctcaccagagatggcagagaacgagagcgagggacagaccaaggtgtttatctggaacaacatgggctcccagggaattcaggagactggcaagacgcgtcgcaagaaccagacgacaaaaaggttcatttataacataccgccaaataacgaaactaacctggaagattgcagcgtaatgcagccccctgtggcatatcctgaagaaaacacattactgattaaggaggagccggatttagatggtgccctcttgtctggccctgacggtgatcgcaacgtcaatgcaaacctgttggccgaggcgggaactagccaagacggaggagatgcaggaacttcccacgattttaaatacgggttgatgcctggtccttccaatgatttcaaatacgggcttatccctggtacctctaatgactttaagtacggcctgatccccggagccagcaacgacttcaagtatggcctgctgcccgaaagttggcccaagcaggaaacatgggaaaacggggaatcgtctctgattatgaataaactgaaatgcccccactgctcctacgtcgccaagtaccgacgaacccttaagcgccatttgttaatccataccggggtaaggagcttttcctgcgacatatgtgggaagctgtttactcgaagagaacacgtaaagagacacagcctggttcataagaaagacaagaagtataagtgtatggtctgcaagaagattttcatgttggccgcttcggtgggcattagacatggctcccgtcgctacggcgtttgcgtagactgcgccgataaatcacagcccggagggcaagaaggcgttgaccaaggacaggacactgagttcccacgcgatgaagagtatgaagaaaatgaagtgggagaagccgacgaggagcttgtcgacgatggagaagatcagaacgatcctagcagatgggatgagagcggagaagtgtgcatgagcctcgacgattag

SEQ ID NO: 24897 - DNA, 2616 bp, Artificial Sequence
  Description of Artificial Sequence: Synthetic coding sequence
atgtccttcagcgaaatgaacaggcgaactctcgctttcaggggcggtggtctcgtcacggcatctgggggagggtctacgaataacaatgctggaggcgaggcctctgcttggccaccacagccgcagccacgacagccccctccccctgcccctcctgcccttcagccccctaatggaaggggggcagacgaagaagtggaactggaaggcctagaaccccaggatctggaagcttctgctggacctgccgctggggcagccgaggaggcgaaagagttgctgttacctcaggacgcagggggtcccactagtctcggtggaggggctggcggacctctccttgcagagaggaaccggagaactcttgcctttcgcggtggcggaggcggtggattaggtaataatggatcctcccgcggtaggcccgaaactagcgtttggccactaaggcactttaatggaaggggcccagctacagttgaccttgaactggatgccttggagggcaaggagctgatgcaggacggtgcttcgctgagtgactctacagaagacgaggaagagggagcctcactcggagatggatctggggcagagggcggtagctgcagtagcagtcgacgctcaggaggtgacggaggtgacgaagttgagggcagcggcgtgggtgctggcgagggcgaaaccgtgcagcattttcctctcgctcggccaaaatctctcatgcaaaaactgcagtgctcatttcagacttcctggcttaaggatttcccgtggctgagatattctaaagacaccggactcatgagctgcggatggtgtcagaagacacccgctgacggtggtagcgttgatttgccaccagtgggtcacgatgagttgagcagagggactagaaactataaaaagaccttgctcctcaggcatcacgtgagtaccgaacacaagttgcacgaggctaacgcgcaggagagcgagatccccagcgaagaaggttactgtgactttaactccagacccaacgaaaactcttactgttaccaactgctgagacaacttaacgagcagcgaaaaaaggggatcctttgtgacgtgtctatcgtggttagcgggaaaatcttcaaggcacacaagaatattctggtggcagggtcacgctttttcaaaactctgtattgtttttctaataaagagtcccccaaccagaacaacaccactcacctagacatagccgctgtccaaggcttcagcgtaatcctggattttctctattcaggaaacctggtcctgactagccagaatgcgatagaagtgatgaccgtggcaagttatctccagatgtccgaagttgtccagacctgtaggaactttatcaaagatgccttgaatattagcatcaagagtgaggccccagagagcgttgttgtcgactacaataacagaaagcctgtaaacagggacggactatcttccagtagggaccagaagatcgcttccttctgggccacccggaatcttaccaacttggctagcaacgtaaaaatcgagaacgacggatgtaatgtggacgaagggcagatcgaaaactatcagatgaacgattcctcatgggtacaggatggatcacctgagatggccgagaacgaaagtgaaggccaaaccaaagtattcatctggaataacatgggaagtcagggaattcaggagaccggaaaaacgcgccgtaagaaccagaccaccaagcgatttatctacaatatcccccctaataacgaaaccaacctggaagactgttctgtgatgcagcccccagtcgcatatcctgaggagaatactctcttaattaaagaggagcctgacctagacggtgccctcttatctgggccagatggtgatcggaatgtaaacgctaaccttcttgcggaagccggtactagccaggatggtggggatgccggaactagccacgacttcaagtacggcctaatgcccggtcccagcaatgactttaaatacggcctgatcccaggcactagcaatgacttcaaatatggcctgatccctggggctagcaatgactttaaatatggccttttgcccgagagttggcctaaacaggagacgtgggaaaatggtgagagcagcctgatcatgaataagctcaaatgtccacactgctcatacgtagctaaataccgaaggaccctaaaaaggcacctgctgattcataccggcgtgagatctttttcttgcgacatttgcggcaaattgttcaccaggagagagcacgtcaagcgccacagcctcgtccacaagaaggataagaagtataagtgcatggtctgcaaaaaaatttttatgctggctgcaagtgtgggcatccggcacggctcgcggaggtatggggtctgtgtggactgcgctgacaaaagccagcccggagggcaagagggagtggatcaaggacaggatactgagttcccaagagatgaggaatacgaggagaacgaagtgggagaggcagatgaggagctggtcgacgacggtgaggaccagaacgatcccagtcgatgggatgaaagtggcgaggtgtgcatgagtctggatgattag

SEQ ID NO: 24898 - DNA, 2544 bp, Artificial Sequence
  Description of Artificial Sequence: Synthetic coding sequence
atgtcatttagcgagatgaacaggagaactctcgcgtttcgtggcggaggtctggtcaccgcttccggtggcggatcaactaacaacaacgcaggtggggaggcttccgcctggccccctcagccacaaccacgccagcctccccctcccgctccgcctgctctccagccacctaacggtcgaggcgctgacgaggaagtggagcttgaagggttggaaccacaggacctcgaggcaagtgccggtccggctgccggtgcggcagaagaggccaaagaacttctcctgccccaggatgctgggggacccacgtcgctcgggggaggggcaggcggaccgttgttggccgaacggaaccggaggaccctggcctttcgcggaggaggtggtggaggcctgggtaataacggaagctctaggggacggcctgagacgtcggtttggcctctacgacactttaatgggcgaggcccagcaaccgtcgatctcgagctggatgcactcgaaggtaaggagctcatgcaagatggagcatccttaagtgactccaccgaggacgaggaggagggggcttccttaggcgacggcagcggcgcagagggtgggagttgctctagctctcgcagaagcggcggagacggaggcgatgaagtggagggcagcggcgtgggcgctggggagggagagaccgtgcagcactttcctctcgctaggcctaagtcactgatgcaaaaacttcagtgttcgtttcagacctcctggctgaaagactttccctggctgagatattcaaaggacacgggcttaatgtcatgcggatggtgtcagaagactccagcagatggaggtagtgtggatctccctccggtgggccacgatgaactcagccggggtaccagaaattacaaaaaaactttactgcttaggcatcatgtgtcgacagagcataagcttcacgaagccaatgcccaagagagtgagatcccttctgaagagggctattgcgacttcaactcgcggccaaacgagaattcttattgctaccagctgctcagacagctgaacgaacagaggaagaaggggattctctgtgatgtctccatcgtggtgtcaggtaagatctttaaagcccataagaacatcttagtggcaggctcacgcttctttaaaacattatactgcttctcaaataaggagtccccaaatcagaataacacgacgcacctcgacattgcagcagtgcaaggatttagcgtgatcctggatttcctgtactctggcaatctggtgctgaccagccagaatgcaatcgaagtcatgacagtggcatcgtaccttcaaatgtctgaagtcgttcagacctgtcgtaactttattaaagacgctctgaacatatcaatcaaatctgaagccccagagtccgtggtggtggattacaacaatagaaagcccgtgaatcgcgatggtctcagctcctcccgcgaccagaagatcgcctccttctgggccacaagaaacctaacgaacctggcttccaatgtaaagatcgaaaacgatgggtgcaacgtggatgaaggccagatcgagaactatcagatgaatgattcctcatgggtgcaggacgggtctcctgaaatggcagagaacgagtccgagggccaaacaaaggtgtttatttggaacaacatggggagccagggtatccaagagacaggtaagacccgaaggaagaaccagaccacgaagaggttcatctataatatcccccctaacaatgagaccaatctcgaagattgttcagtgatgcagccacccgtggcataccctgaagagaatacgttacttatcaaggaagagcctgacctcgatggagcactgctgtccggccctgacggagatagaaacgtgaacgccaacctcctcgcagaggctggtacctcacaagatggcggagacgcagggactagccacgatttcaagtacggtctcatgccaggtgcttctaatgactttaaatatggcctcttgccagagagctggcctaaacaggagacttgggaaaacggcgagagttctttgattatgaacaaactcaagtgccctcattgttcttacgtagctaaatacagacgcacactaaagaggcaccttctgatacacacaggcgtacgcagcttcagttgcgatatatgtggcaaacttttcacacggagggagcacgtaaagcggcattctcttgtgcacaagaaggataaaaaatacaagtgcatggtctgtaaaaagattttcatgcttgctgcatctgtaggcatacgccacggcagtcgtcgctatggcgtctgtgttgactgtgctgacaaatcccagcctggaggtcaggagggggtagaccaaggccaggataccgaattccctcgcgatgaagagtatgaagaaaatgaggttggagaggcagatgaagagctcgttgatgatggagaggatcagaacgacccatcaaggtgggacgagtccggagaagtgtgcatgagtctagatgactag

SEQ ID NO: 24899 - DNA, 3162 bp, Artificial Sequence
  Description of Artificial Sequence: Synthetic coding sequence
atgagctccgaggaaagttacagagcaattctccggtatttaacaaacgaacgcgaaccatatgctcccggtactgaggggaatgtgaagcgtaagatccgaaaagcggctgcatgttacgttgtcaggggcggtaccctttattatcagaggcgtcagaggcaccgcaaaacttttgccgaactggaggtggtcttgcagcctgagcgcagacgtgatcttatcgaggccgcacaccttggaccgggtggcacacatcataccaggcatcagacctggcattacctgtccaagacgtactggtggcgtgggatcctaaagcaggtgaaggactacattaagcaatgttcgaagtgtcaggagaaactggatcggagtaggccaatctccgacgttagcgagatgctcgaggaattaggccttgacctggaatctggtgaagaatccaacgagagcgaggatgacctgtccaactttacctcatcacctacaacagcaagcaagcctgctaaaaagaagcccgtttctaagcacgagctagtatttgtggatactaagggcgtggttaaacgcagcagccctaagcattgtcaggctgttctgaaacagctcaatgaacagagattatcgaaccaattctgtgacgtgactctgctgatcgaaggcgaagagtataaggcccacaaatccgttcttagcgccaattcagaatatttccgggacttgtttatcgagaaaggagcggtgtcgtcacatgaagcagtggtagaccttagcgggttctgtaaagcgtccttcttaccattgctcgagtttgcctacacatccgttctgagtttcgacttttgcagcatggcggacgtggccatactcgcccgacacctgttcatgtccgaagtgctggaaatatgtgagagtgttcataagttgatggaagagaagcagctgaccgtgtataagaagggcgaagtgcagaccgtggccagcacccaggacctccgggtgcagaatggcggaacggctccgccagtagcgagtagcgaggggaccacgactagcttgcctacagaactgggcgactgtgagattgtgctgttggtcaatggggagctccctgaagccgagcagaatggagaggtgggcagacagccagagcctcaggtcagctctgaggctgagtcggcgctctcaagtgtcggctgcattgccgattcacatcctgaaatggaaagtgtggacctcatcactaagaataatcagactgagctagagacttctaataacagagaaaacaataccgtgtctaacatccacccaaaactatccaaggaaaatgttatttcctctagccccgaggatagcgggatggggaatgacatttccgcagaggacatctgtgcagaagacattcctaagcatcgccagaaagtagaccagccattgaaggatcaagaaaatttggtggccagtactgctaagacggatttcggacccgacgacgatacatatcgaagcagactaaggcagagatccgtcaatgagggtgcttacattcgcctgcacaaagggatggagaagaagctgcaaaagcggaaggctgtgcctaagagtgctgttcagcaagtggcccagaaactggtgcaaagaggcaagaagatgaaacagccgaaacgtgacgctaaagagaatacagaggaagcaagccacaaatgcggagagtgcggcatggtcttccagcgacggtatgcccttatcatgcataagcttaagcatgaaagagcccgagattacaaatgcccactgtgtaaaaagcagttccaatacagtgcctcgcttagagcccatctcatccgccacacacgaaaagacgctccatcaagtagcagcagcaattcaacctcaaacgaagcctcaggcaccagctccgaaaaaggacggactaagcgggagttcatttgttctatctgtggtcgtactcttcccaagctttactccctgcgaatccatatgctcaagcacaccggggtgaagccccatgcttgccaagtgtgcggtaaaaccttcatctacaaacatggtctcaagcttcatcagtcgctgcaccagagccagaaacagtttcaatgcgagctctgcgttaaatcattcgtcaccaagcgctcattgcaggaacacatgtccatccatacaggggaatccaagtatctgtgctcagtctgcggaaagtcttttcaccgagggtcagggctgtccaagcacttcaagaagcatcaacctaaacctgaagtgcgagggtaccactgcactcagtgtgagaaaagcttcttcgaggcgcgagatttacgtcagcacatgaacaagcacctcggtgttaagccatttcagtgtcagttctgtgacaaatgttactcatggaagaaggactggtacagccatgttaaaagccattcggtgacggagccttatcggtgtaatatctgcggaaaggagttctacgaaaaggccctgttcagacgccatgtgaaaaaggcaacccatgggaaaaaggggcgtgctaaacagaacctggagcgggtctgtgaaaaatgcggacgaaaatttacacaactccgggagtatcgtcgccatatgaacaatcacgagggagtgaagccattcgaatgcctgacatgtggagtagcttgggccgatgccaggagcctcaaacggcacgtgagaacacataccggcgagcgcccatacgtgtgtcccgtttgtagtgaagcctatatagatgccaggaccttgaggaaacacatgactaagttccaccgagattatgttccttgtaagatcatgctggaaaaggacacacttcagtttcataatcagggaacacaggtggcccatgctgttagcattctgacggctgggatgcaagagcaggagagttctggaccccaagagctggaaaccgtagtggtgacaggcgaaacgatggaagccttggaagctgtggcagcaaccgaagagtacccgtctgtgtcaaccttatcggaccagtcaattatgcaagtagtcaattatgtgctcgcgcagcagcaaggtcagaagttgtccgaggtagctgaagccatacaaactgtgaaggtcgaggtggcacacatctccgggggagaatag

SEQ ID NO: 24900 - DNA, 1380 bp, Artificial Sequence
  Description of Artificial Sequence: Synthetic coding sequence
atggccagtggcgtagaagtcctgcggttccagctgcctgggcatgaggccgcaacactgcgaaatatgaaccaactacgggcagaggagaggttttgcgacgtgaccatcgtggcagactcccttaagtttcgaggccacaaggttatccttgccgcatgtagccctttcctgagggatcaattcttactgaaccctagcagcgaacttcaggtgagtttgatgcactccgcccgaattgttgctgacctgctgctgtcatgttatactggcgctttagagtttgctgtacgagatattgtcaactacctcacagcagccagttatctccagatggaacacgtggtcgagaaatgccggaacgcactttctcaattcattgaacccaagatcgggttgaaagaggacggtgtgtccgaggcctcattagtcagctccatctctgctacaaaaagtctattgccaccggcacggacacctaaaccggctccgaaaccccctcctcctcccccacttcctccccctctactccggccagtgaagcttgagttccctctcgacgaggatcttgagctcaaggccgaggaggaggacgaagatgaagacgaggacgtgtccgatatatgcatcgtcaaagtagaaagtgccctggaggttgctcatcggctcaagccaccgggagggctcggcggtggcttgggcatcggtggatcagtagggggacacctaggggaactcgcgcagtcgagtgtgcctccgtccacagtagctcctccccagggcgtagtaaaggcatgttatagtctgtccgaggatgcagaaggagaaggtctcctgctgattccagggggtcgggcttccgtcggggcaactagcggtttagtggaagcagctgctgtggcaatggcagctcgtggcgctggaggctccctgggtgccggtgggtccaggggaccgctgccaggcggtttttctgggggtaatcctcttaagaatataaagtgcacaaaatgccctgaagtgttccagggggtggagaagcttgtttttcatatgagggcccagcacttcatatttatgtgtcccaggtgtggcaaacagttcaatcattcttcaaatctaaaccgacacatgaatgtacacagaggggtgaagagtcacagctgtgggatctgcggcaagtgtttcacacagaagtctactctgcacgatcacctaaacctgcacagcggagccagaccataccgatgttcctattgtgacgttcgctttgcccataagcccgctattcggaggcatctcaaggaacagcatgggaagaccacggcggagaatgtactcgaggcgtctgtagctgagattaatgtgctgatccggtag

SEQ ID NO: 24901 - DNA, 1380 bp, Artificial Sequence
  Description of Artificial Sequence: Synthetic coding sequence
atggccagcggagtggaggtgctgcgcttccagcttcccggacacgaagcagcaaccttacggaatatgaaccagttgagagctgaagagaggttctgtgatgtcacaatcgtggccgacagtctgaaatttcgagggcacaaagtcatcctggcggcttgttcccccttcctgcgggaccagttcctgttgaatccgagttccgagttgcaagtgagtttaatgcacagtgcgcgtattgtggccgatctcctgctgagctgctatacaggagcactggaattcgcagtgcgggacatcgtgaactacctcaccgccgcttcatatcttcagatggagcatgtcgttgaaaagtgccgaaatgctctctctcaattcatcgagcctaagattggactgaaggaggatggcgtcagtgaagcctcgcttgtgtcttctatcagtgctacaaagagtttactgcctcctgctagaacacccaagcccgctcccaagccgccaccacctcctccgttgcctccaccactgcttcggcctgtcaaactggagtttccattagacgaagatctggagcttaaagctgaggaagaagatgaggatgaagacgaggacgtgtccgacatatgcatcgttaaggtagaatccgccctggaggtggctcatcgactgaaacccccaggcggacttggagggggtctcggtattgggggaagtgtgggtggacatctgggtgaattggcccagagctcggttcccccttccaccgtagctcctccccagggggttgttaaagcctgctacagcctgtccgaagatgccgagggcgagggtcttcttttaatacccggtggaagggccagcgtgggtgcaacttctggactggtcgaggctgcggctgttgccatggcagcgagaggggcaggtgggtcacttggcgctggcggttcgcggggtcccctgcctggtggattctccggcggaaacccgctcaaaaacattaagtgtaccaagtgccccgaagtgttccagggtgtcgagaaattggtctttcacatgagggctcagcatttcatttttatgtgtccccgttgcgggaaacagtttaaccactcgtcaaatcttaaccggcacatgaatgtgcaccgtggcgtgaagtcccattcctgcggtatctgtggtaagtgcttcacccaaaaatcaactctgcacgatcaccttaacttgcacagtggggctcggccataccgatgttcctactgcgacgtgaggtttgcccacaagcccgctattaggcgccacctgaaggaacaacacggtaaaaccacagctgagaacgtgctagaggccagcgtggccgagatcaatgtgctcattaggtag

SEQ ID NO: 24902 - DNA, 1380 bp, Artificial Sequence
  Description of Artificial Sequence: Synthetic coding sequence
atggcctccggcgtagaggtgctccgctttcaattgcccggtcatgaggccgcaaccttaaggaacatgaaccagctgagagccgaggaaaggttctgtgatgtgacaatagtggcagattctttgaagttccggggacataaagtgattctggctgcttgtagccccttccttagagatcagtttctgctgaacccgagctccgagctgcaggtgtcactcatgcatagcgccagaattgtggccgaccttcttctgtcctgttatacaggcgcactggagttcgccgtcagagatatcgtcaactacctgaccgctgcatcttacctgcagatggagcatgtggtggagaagtgtcgcaacgcactttcccagtttattgagcccaaaattggccttaaagaagacggagtttccgaagcaagcttggtgtcgtctatctctgctacgaagtccctgctgccacccgcaagaacaccaaagcccgcaccaaagccccctcctcctcctccactgccacctcccctgcttcgccctgtgaagttggaattccccctggacgaagacctcgagctcaaggcagaggaggaggacgaggatgaagacgaagatgtctctgacatttgcatcgtgaaagtggagtcagcactggaagtggcacacagactgaagccccctgggggactcgggggaggactgggtattggaggatccgttggcggacatctaggggagctggcacagtcatcagttccaccgtcgaccgtggctccccctcaaggcgtcgtgaaagcctgctactcgctctccgaagatgctgaaggcgaggggctgctgttgatacccggaggaagggcctcggtcggagcaactagtgggttagtggaagctgccgctgtggccatggcggcacggggagctgggggatcattgggggctggcggtagtcggggtcctctgccaggtggatttagtggcggaaatccactgaagaatattaagtgtaccaagtgccctgaggtgtttcagggcgtcgaaaagcttgtgtttcacatgagggcacagcatttcatctttatgtgccctagatgtggcaagcagttcaaccattcgtccaacctaaacaggcatatgaatgtgcatcgaggggtgaagagccacagttgtgggatttgcgggaagtgcttcacacaaaagagcacgttacatgatcatctcaaccttcattccggggctcggccataccgatgtagctactgtgacgttcggtttgctcataagccggctatccggaggcatcttaaggagcagcacggaaaaacaaccgccgagaatgttctggaagcctctgtggccgaaattaatgttctcatcaggtag

SEQ ID NO: 24903 - DNA, 1380 bp, Artificial Sequence
  Description of Artificial Sequence: Synthetic coding sequence
atggcctcaggcgtagaagtcctgcgtttccagctacctggccatgaggccgcaactctccggaacatgaaccagttgagggcggaggagcggttttgtgacgtaactatcgtggcggactccttaaaatttcgaggacataaggtgatcctcgcggcttgcagcccgttcctacgcgaccaattccttctgaatccgtcctcggaactacaggttagccttatgcattcagcgagaatagtggctgacctgctgctgagctgctatactggcgctctagaatttgctgtgcgggacatcgttaactacctgaccgccgcttcctacctgcagatggaacatgtggtcgagaagtgtaggaatgccttatcgcagttcatcgaaccgaagattggacttaaggaggatggggtgagcgaggcgtctcttgttagttccatatcagctactaaatcactgctaccccctgcccgaaccccaaagcccgctcctaagccaccacctcctccacctctgccccctcccttgttgcggcctgtgaaactggagttccctcttgatgaagacctggaactgaaggccgaggaggaggacgaggacgaagacgaagatgtgtctgatatttgtattgtgaaggtggagtcagcattagaagtcgcgcaccgtctgaagccaccgggtggcctgggcggagggctgggtattggcggttctgtcgggggtcatttaggtgagcttgcacaatcctctgtgcccccatccacagttgcaccccctcagggtgtggtgaaggcgtgctactccctcagtgaggacgctgagggagagggcctccttctcatcccaggtggcagggccagcgtgggcgcaactagtggactggtcgaagccgctgccgttgcaatggctgctaggggtgctggaggatccctcggagcgggtggctccagaggtccacttcccggtggcttttcaggtggaaaccccttgaaaaacatcaagtgtactaaatgtccggaggtgttccagggggtcgagaagcttgtgttccatatgcgagctcagcattttatcttcatgtgcccacggtgcggcaagcagttcaatcattcatctaacctcaacagacacatgaacgtacacagaggcgtgaagtctcacagttgcggcatttgtggtaagtgcttcacgcagaaaagtaccctacacgatcacctcaatttgcatagcggggctagaccctatcgctgcagctattgcgacgtgcggtttgcccacaagcctgctatacggaggcacttgaaggagcagcatggtaagactaccgccgagaatgtactagaggcttctgttgccgagatcaatgtactcatacggtag

SEQ ID NO: 24904 - DNA, 1380 bp, Artificial Sequence
  Description of Artificial Sequence: Synthetic coding sequence
atggctagcggcgttgaagtgttgcggtttcagctgcccggtcatgaagccgctacactacgcaacatgaaccagttgcgcgcagaggagcgtttttgcgacgtgacgattgtggcggactccctcaagttccgaggtcataaagttatcctggcggcttgttctcctttcctgcgggaccagtttttactgaatccctcatcggagctccaggtttccctcatgcacagtgcccgtatcgtggcagatctactactgagttgctataccggggctctcgagtttgctgttagagatattgtgaattacctcaccgcagcttcttacctgcagatggaacatgtggtggaaaaatgcaggaatgccctgtcccaattcattgaaccgaaaattggtctcaaggaagatggcgtgagcgaggcctcactggtttcgagtatctctgctactaaaagtctgctaccccctgccaggacacctaaaccagctcccaaaccacctcctccaccgccactccccccacctctgttgaggcctgtgaagctcgagttccccctcgacgaggacctggagctgaaagccgaagaggaagacgaggacgaagatgaggacgtgtctgacatatgtattgttaaggtggagagcgcacttgaggtggctcaccgtctgaaacctcccggtgggcttggtggaggcctggggatcggaggctctgtgggaggccatctgggggaattagcccagtcctctgtacccccaagcacggtcgcgccaccccaaggagtggtcaaagcgtgttattcactgtctgaggacgcagagggcgagggattgctcctgattccgggagggagagctagcgtgggcgctacctcggggctggtggaggcagccgctgttgccatggccgcacgtggagctggcggaagcctgggcgcaggaggctcacgaggcccactgcctggtgggttctccggcggtaacccgctgaagaatattaaatgcaccaaatgccctgaagtatttcagggcgtagaaaagctggtcttccacatgcgtgcacagcactttatttttatgtgcccacggtgcggcaaacaatttaatcactcttccaacctgaatcggcacatgaacgtgcatcggggagtaaagtctcactcttgtggaatctgtgggaaatgttttactcagaagagtaccttacatgaccacttaaacctgcacagcggggctcgtccataccggtgttcatactgtgatgttaggtttgcacataaacctgccatcaggcgccacttgaaagaacagcacgggaagaccaccgctgagaatgtgctcgaagcatctgtggccgagatcaatgtgcttattagatag

SEQ ID NO: 24905 - DNA, 1545 bp, Artificial Sequence
  Description of Artificial Sequence: Synthetic coding sequence
atggatctcgccaatcatggacttatcctgctccaacaactgaacgcgcaaagggagttcgggtttttgtgcgactgcactgtggctatcggcgacgtgtactttaaagctcacaaatctgtcctcgccagtttttcaaattactttaagatgctgtttgtgcatcaaacatccgagtgcgtgcgacttaaacccacagatatccagcctgacattttcagctatttgctgcaccttatgtatacggggaagatggctccccagctgattgatcctgtgcgtcttgagcagggcattaagttcctgcatgcttatccactcatccaggaagcttctttggctagccagggagcattctcccaccccgatcaagtgtttcctcttgcctcatccttgtacgggattcaaattgcagatcaccagctgaggcaagccacaaagatagcctcagccccagaaaagctcgggagagaccctcgccctcagacatctagaatttctcaggagcaggttcctgaggcatcccaattgagtcagttaacatccaatctcgcacaggtgaataggaccaatatgacccctagcgatcctctccagactagcctttctccagaactggtctcgaccccagttccaccacccccaccgggtgaggagactaatttggaagcatcgagctcagacgaacagccagcttcactaacaattgcccatgttaaaccatctattatgaaacgcaacgggtcatttcctaagtactacgcctgtcacctatgtgggagacgcttcaccttgagaagcagtctgcgtgaacacttacagattcacaccggcgtgccttttaccagctcacagcaaggcgagtcaagggtgcctcttacgctttgcagcaacgctgctgacctaggaaaagacgcaatggaggttcccgaggcgggtatgatctccgacagtgaactgcagcatatttccgactcccccattattgatggtcagcagcagagcgagactcccccaccttctgacatcgccgatattgataatctcgagcaggccgatcaggagcgggaggtaaagagaaggaagtacgagtgtactatctgtggccgaaagtttatccaaaaatctcactggcgggagcacatgtatattcacaccggaaaaccttttaagtgcagcacctgcgataagtctttttgtcgggcaaaccaagccgctcgccacgtttgtctgaatcaatctattgacacgtacacaatggtcgacaaacagaccctggagctttgtacgttcgaggaggggagccagatggacaacatgctggtacaaaccaataagccctacaagtgtaacctttgtgacaaaactttttcaacccccaatgaggtggtcaaacacagttgtcagaaccaaaattcggatgtttttgctcttgatgaggggagatcaatactgttgggctctggagacagcgaagttaccgagccagatcaccctgtactggcatcgatcaagaaggaacaagagactgtactactggactag

SEQ ID NO: 24906 - DNA, 1905 bp, Artificial Sequence
  Description of Artificial Sequence: Synthetic coding sequence
atggagcctagtcctctgtccccttccggtgcggctttaccgctgcctctgtccctcgcaccaccgcctttgccactgcctgcagctgccgtggtccacgttagttttccagaagtgacatcagcactactagagtcccttaaccagcaaagattacaagggcagctctgcgacgtttctatccgcgtgcagggccgtgagttcagggcccaccgtgccgttctcgctgccagctcaccatacttccacgaccaggtacttctgaagggaatgacttcaatttcactgccctcggtgatggaccccggagcatttgaaacagtcctagctagtgcctatactggtaggttgtccatggctgccgctgatattgtgaacttcctgacggtgggctctgttcttcaaatgtggcacattgtagataagtgtacggagctcctgcgcgagggcagggcatcagccaccactaccattaccactgcagcagccacgagcgtgaccgtgcccggtgcaggcgttccctccggcagcggcggtactgtggcaccagcgacaatgggtagcgcacggtctcatgcttcgagtcgcgcatccgagaaccagtcgccatcatcatccaactatttctccccacgggagtcgactgacttctccagctcaagccaggaagccttcgcagccagcgcagtggggtcgggtgaacgccgaggtggaggtccagtatttcccgctccagtggtaggttcaggcggtgccaccagcggcaagctcttgctggaggctgacgagctgtgtgacgacggtggcgatggaaggggggctgtagtgccaggcgcaggactgagacgcccaacttataccccgccatcgataatgccccagaaacattgggtttacgtcaaaaggggaggaaactgtcccgcacctacaccattagtgccccaagatccagacctcgaagaggaagaggaggaggaggatttagtcttgacatgcgaagatgacgaggacgaggagctgggcggatcaagtcgagttccggtaggtggcggtccagaagctaccctgtcaatttccgatgtgagaaccctgtcagaaccgcctgacaagggagaggaacaagtgaacttttgtgaatcatccaatgatttcggcccttatgaaggaggaggaccagtggcaggattggacgatagtgggggacccacaccatcttcatacgctccctcccatccgcctcggcctctccttcccctcgatatgcagggaaatcagatcttagtgtttcccagcagttcatcgagcagctcaagccaggccccaggacagcccccaggaaaccaggcagagcacggtgccgtgactgtgggcggaacctctgtgggcagcctgggcgtcccaggcagtgtaggaggggtccctgggggtacgggtagcggcgatggaaataagatctttctgtgccattgtggcaaggctttctcgcataagtccatgcgagacagacacgtcaatatgcacctgaacctcaggccgtttgattgtcctgtgtgtaataagaaattcaaaatgaagcaccatctgaccgagcacatgaaaactcatacaggcctgaagccatacgaatgcggtgtgtgcgcaaagaaattcatgtggagggactctttcatgcgtcataggggccattgcgagagaaggcacaggcttggcggagtcggggcagtacccggtcccggaacaccaaccgggccatccctgccaagcaagagggagagccctggcgtgggcggtgggtccggggatgaagcaagtgcagctactccccctagcagccgcagagtctggtctccaccaagagtgcacaaggtagaaatgggtttcggagggggtgggggagcgaattag

SEQ ID NO: 24907 - DNA, 1905 bp, Artificial Sequence
  Description of Artificial Sequence: Synthetic coding sequence
atggaaccgtcacctctgtccccctccggagctgccttgcctctgcccttgagcctcgcacctcctcctctcccactccccgctgcagcggttgtccacgtgagctttcccgaagtcacatctgcacttctcgaaagcttaaaccaacagcgactgcaaggacagttgtgtgacgtaagcatccgtgtacaaggacgcgagtttcgagctcaccgtgctgtgctggcagccagctctccatatttccatgatcaggtcttgctgaagggaatgacctctattagcttgccttctgtgatggatcctggggctttcgagactgtgctggcatcagcctatactggcagacttagcatggcagccgctgacattgtaaatttcttgactgtcggcagcgtgctgcagatgtggcatatcgtggataagtgcactgagctgctgagagaaggaagggcctcggcgacgaccacgattactacggctgcggctactagcgtgaccgtgccgggagctggagttccctcagggtcaggcggtacagtcgcacccgctacaatgggatccgctagatcccatgcatcctcaagggcttccgaaaatcagtctccatcctcctctaattattttagtccacgagaatcaaccgatttttcttctagctctcaagaggccttcgccgcatccgctgtgggttcgggcgagcgcagaggcggagggccagtctttcccgcacccgtggttggatccggaggcgcaaccagtggtaagctgctactcgaggccgatgaactgtgcgatgacggaggcgacggcaggggggctgtggtcccaggagcaggactccggaggccaacatatacacccccttccatcatgccccagaagcactgggtttatgtgaagagaggaggtaactgtcccgcacctacaccactggtgccacaggatcctgatctggaggaggaagaggaagaagaggatttggttctcacatgcgaagacgacgaagacgaagagctgggcggaagcagcagggtgcctgttggaggtgggcctgaagctacactgtcgatttctgatgtccgaacactatcagaacctccagataaaggggaagaacaggtgaacttttgtgaatcctccaatgactttggcccttacgaaggcggaggacccgtggcagggcttgacgattccgggggacccacgccaagttcctacgcccctagtcacccccctcggcctcttctccccttggatatgcagggaaatcagatcctggttttccctagctcctcttcttccagttcatctcaagctccgggtcagccccctgggaaccaggcggagcatggcgcagtgaccgtaggcggtacaagcgttgggagcctgggtgtgcctggaagcgtcggaggcgtgccagggggtacgggctcaggagacgggaacaaaatatttctgtgccattgcggtaaagcattcagccacaagtccatgcgtgaccgtcacgtcaatatgcacctcaatctccgcccattcgactgtcccgtttgtaataagaagtttaaaatgaagcaccatctgacagagcatatgaagacccacaccggtctgaaaccctatgaatgtggagtgtgtgccaagaaattcatgtggagggattcattcatgaggcataggggccactgtgaacgacgacatcggttgggaggggtaggtgccgtgcccggtccaggtacacctaccggaccttccctgccgtcaaaacgcgagtcaccaggcgtgggaggaggatccggcgacgaggccagtgccgctacaccgcctagctcacggagagtgtggtcgccaccgagggttcacaaagttgagatgggttttgggggaggtggcggagccaactag

SEQ ID NO: 24908 - DNA, 450 bp, Artificial Sequence
  Description of Artificial Sequence: Synthetic coding sequence
atggagccttcgcctcttagcccttcgggggctgctctgccccttcctctaagtttggccccacccccactgcctctccctgcagctgcggtggtgcacgtgtctttcccggaagtaacttcagccttgctggagagtctgaaccagcaaagactgcaggggcagctgtgtgacgtcagcattagagttcaaggtagagaattcagggcacatagagctgtgctagctgccagctcaccgtactttcacgaccaggtcctccttaagggaatgacttccatctcacttccaagcgtaatggatccaggggcatttgagaccgtgctggcaagcgcctatactggtcggttgagcatggccgcagcggatattgttaacttcttgaccgttggctcggtactccagatgtggcatattgtggataaatgcacagaactcctccgggagtag

SEQ ID NO: 24909 - DNA, 450 bp, Artificial Sequence
  Description of Artificial Sequence: Synthetic coding sequence
atggagcccagccctctgtcaccatcgggcgctgctctgcctctgccactcagcttagcacctccgccattgccactgccggctgccgcagtggtccacgtgtcattccccgaagtgacttcggcccttctggaatccctgaaccaacagcggctgcaggggcagctgtgtgatgtgagcattagggttcagggtagggaatttcgagcacaccgagctgtgttggctgccagctccccgtatttccatgaccaagtgctgttaaaaggaatgacatccatctccttaccatccgtgatggatcccggagcttttgaaacagtacttgcatctgcatacacaggcagactgtctatggcagccgctgacattgtgaacttccttaccgtgggttcagtcctccagatgtggcacatcgtggacaaatgtacagagctgctaagagaatag

SEQ ID NO: 24910 - DNA, 1905 bp, Artificial Sequence
  Description of Artificial Sequence: Synthetic coding sequence
atggagccatcgcctctctctccatcgggcgctgcgttgccacttccactgagcctggcccctcccccactgccgttgcccgctgccgcagtagtgcacgtgagctttcctgaagtgacctcagctctgcttgaatccctgaatcagcagcgacttcagggacaactgtgcgacgtttctataagggtgcaaggtcgcgagttccgagcccatagagccgtgctggctgccagctctccttacttccatgaccaagtgctgctgaaggggatgacttccatatcactgccgtctgtcatggatccgggagcgtttgaaactgttcttgccagcgcttacacaggtaggctgtcaatggcagctgctgacatcgtaaacttcctcaccgttggatcagttctccaaatgtggcatatcgtggataagtgcactgaactgttgcgtgagggcagagctagcgcaaccactacgataacaactgccgcagctacatccgttaccgttcctggcgctggcgttcctagcggttctgggggaaccgtggccccagcgaccatgggtagtgcgcgttcccacgcttctagccgggcaagtgaaaaccaaagccccagttcatccaattatttttctccacgggagtcgacagatttttcaagctctagccaagaagcctttgcagccagcgctgtgggttccggagagagaagaggtggaggtccagtttttcccgctcctgtggtggggtccggtggggctacttccggcaaactactcttagaagcggacgaactgtgcgatgatgggggagacgggaggggagctgtcgtacctggcgctgggcttcggagacctacttacacaccgccttccatcatgcctcagaagcactgggtgtacgttaaaagaggcggaaattgccctgctcctaccccgctcgtcccccaggatcccgatctggaggaggaagaggaagaggaggacctggtgttaacttgcgaggatgatgaggatgaggagcttggaggctcttcccgagtgccagtgggaggaggaccagaggccacactaagtatctcagacgtgagaaccctcagcgagcccccagacaagggtgaggagcaagtaaacttttgcgaaagttcgaatgattttggcccatatgaaggaggaggtcccgtggcaggacttgatgactcaggaggtccgaccccctcaagctacgccccttctcaccctccgaggcccctgctgcctctagacatgcaaggtaaccagattctggtgtttccctccagcagctcctcatcctcctcccaagccccaggccagcccccaggaaatcaggctgagcatggggctgtcacagtcgggggaacatctgtgggctcattaggggtgccaggctcagtaggaggcgtacctggagggacagggagtggagacggaaataaaattttcttgtgccactgtggaaaggcattctctcacaagagcatgcgggataggcacgtcaatatgcaccttaatctgcggcctttcgattgtcccgtgtgtaataagaaattcaaaatgaagcaccacttgacggagcacatgaagacccacactgggctgaagccttatgagtgcggagtctgtgccaaaaagttcatgtggagagatagtttcatgcgtcatcggggacactgcgagcgccgacacagattgggcggagtcggcgcagtgcctgggccaggcactcctacaggaccttcactgccctcaaaaagggagtcaccgggagtgggcggaggaagtggtgatgaagcctctgcggctacgcctccttccagtagaagagtttggtcacccccacgtgtgcacaaggtagaaatgggattcgggggaggtggaggggctaactag

SEQ ID NO: 24911 - DNA, 1905 bp, Artificial Sequence
  Description of Artificial Sequence: Synthetic coding sequence
atggagccatcccctctttcacctagtggggcagcccttcccctaccattgagcttggccccacccccactgcctctcccagccgcagctgttgtacacgtttcatttcccgaggtgactagcgctctgttggagtctctaaatcagcaaagattacaggggcagctttgcgatgtctctatccgcgtgcaggggagggaattccgagcccacagagcggttctcgccgcatcctcaccctacttccacgaccaagtattgctaaagggtatgaccagcatttccttgccttctgtgatggatcccggagcttttgagaccgtactggccagcgcttacactggaagactctctatggccgctgccgatattgtgaacttcctcacagtaggatctgtgctgcaaatgtggcacatcgtggacaaatgtaccgaacttcttcgtgaggggagggcatccgctacaacgaccatcacgaccgccgctgcaactagtgtgacagttcctggcgctggcgtcccaagtggttccggagggactgttgcacctgcaaccatggggtctgccaggtctcatgccagctcaagggcatctgagaatcagtccccctctagctctaactacttctcaccaagagaaagcactgacttctcctcatctagtcaggaagcattcgcagcaagtgctgtcggatccggagagcgcagaggaggcggtcccgtattcccagcccctgtcgttggaagcggaggcgcaacctccggcaaactgctactggaggccgacgaactatgcgacgatggcggagatggacggggagctgtcgtaccaggggcagggctccgcaggcctacatatacaccgccttcaataatgcctcagaagcactgggtgtacgtgaagcgcggaggcaactgtcctgctccgacaccactggtgcctcaggaccctgatctggaagaagaggaggaagaggaagaccttgtcctgacctgtgaggacgacgaagacgaagaactgggcggatctagcagggtacctgttgggggagggcctgaagcaactctgagcatctctgatgtcaggaccctgtccgagccacccgataaaggcgaggagcaggtgaatttttgtgaatccagcaatgatttcggcccatatgagggcggaggacccgtggcaggactggacgatagtgggggtccaacccctagttcctatgcgccatcacaccccccaaggcccttgctgccgctggacatgcagggaaatcaaatcctcgtgtttccatccagttcctcaagctcctcctcccaggcacctggtcaaccaccaggaaaccaggctgagcatggcgcagttactgtgggcggaactagtgtagggtccctgggtgttcccggatctgtgggaggtgtccctggaggtaccggctccggcgatgggaataagatcttcctttgccactgcggaaaagcattcagtcacaagtccatgagagatcggcacgtgaacatgcacctcaacctccgaccatttgactgtcccgtctgtaacaagaagtttaaaatgaagcaccatctgaccgagcacatgaagacacatacagggctcaagccttatgaatgtggtgtctgcgccaagaagttcatgtggcgtgactcattcatgaggcaccggggacactgcgaacgcagacataggcttggtggggtgggcgcagttcctggcccaggtactcctactgggccttcactcccaagtaagcgtgaatcccccggtgtcggtgggggatctggtgacgaggcatctgccgctacaccccctagcagtaggcgggtttggagtcccccacgagtgcataaagttgaaatgggattcggcggagggggtggagccaactag

SEQ ID NO: 24912 - DNA, 1326 bp, Artificial Sequence
  Description of Artificial Sequence: Synthetic coding sequence
atgagcgaacggtccgaccttctgcactttaagttcgagaattatggggacagtatgctccagaagatgaacaagctccgcgaggagaataagttttgtgatgttacagtcctgatcgacgacatcgaggtgcagggccacaagattgtgttcgcagcagggtctcctttccttcgtgatcaatttcttctgaacgattccagagaagtcaagatctccatcctgcagagtagcgaggtggggcgtcagctgctgttaagctgctatagtggcgttctcgagttcccagagatggaactcgtgaattaccttacagccgcatctttcctccagatgtctcatattgttgaaaggtgcactcaggccctgtggaagttcattaagcccaagcagcccatggacagtaaagaagggtgcgagcctcaatcagcaagtcctcagtcaaaggagcagcagggggatgccaggggttcccccaagcaggactcaccttgtatccacccaagcgaggattccatggatatggaggactcagacatccagatcgtgaaagtggagagtatcggggacgtatctgaagtcagatcaaagaaagaccaaaaccaatttatttcatccgagcccaccgccctccactcctcagagccacagcattcactgatcaactctaccgtggagaatcgagtctccgagatagagcagaatcacctgcacaattatgccctctcgtacactggcagtgataatataataatggcgtctaaagatgtttttgggccaaacatcaggggtgtcgacaaagggcttcaatggcatcaccagtgtcctaagtgtacaagagtgttccggcacctggaaaactatgcaaatcatctgaaaatgcacaagctgttcatgtgccttctatgcggaaaaaccttcacacagaaggggaatctccaccgccatatgagagtacacgccggaataaagccgttccaatgtaaaatctgcggaaagacctttagccagaagtgctccttgcaagaccacctgaatctccatagcggtgacaagccccataaatgtaattattgtgacatggtgtttgcccataagccggtgcttcggaagcatctaaaacagctccatgggaaaaactcttttgataatgccaatgaaagaaacgtccaagatcttacagtagactttgattccttcgcttgcaccaccgtgacagatagcaaaggctgccagccacagcctgacgccacccaagtgttggatgcaggaaagctggcacaggccgtactgaatctgcgcaatgacagcacttgtgtgaattag

SEQ ID NO: 24913 - DNA, 1326 bp, Artificial Sequence
  Description of Artificial Sequence: Synthetic coding sequence
atgagcgaaaggagcgaccttttgcatttcaagttcgagaactatggtgactctatgttgcaaaagatgaataaactacgcgaagagaataagttctgtgacgtcaccgtgctgattgacgatatcgaagtgcaaggacacaaaattgtgtttgcagctggctcacccttcctgcgggaccaatttctgctcaatgactccagagaagtgaaaattagtatactgcaatctagcgaagttggcaggcaactcctgctgtcctgctattcaggcgtactggagttccccgaaatggagctagtaaactacttaactgcagcctccttcttgcagatgagccacattgtcgagcgctgcacccaggccctgtggaagtttatcaaacccaagcagcctatggatagcaaggaggggtgtgaaccacagtctgcatctcctcaaagcaaagagcagcagggagatgccagaggcagccccaaacaggacagcccatgtatccatccaagtgaggactcaatggacatggaggactccgatattcagatcgtcaaggttgaaagtattggcgatgtgagtgaggtgagatctaaaaaggatcagaaccagttcatttctagtgagcccacggcactccactccagcgaaccgcagcattctttgattaatagtaccgtggagaaccgcgtcagtgaaatcgagcagaaccacctgcataattacgctctaagctataccgggtccgacaatatcataatggcctccaaggacgtgtttgggccaaacattcggggagtggacaaaggactccaatggcaccaccaatgcccaaaatgcactagggtgtttagacatttggagaattacgccaatcacctgaaaatgcacaagctattcatgtgcttgctgtgcggaaagacctttactcagaagggcaatttgcatcggcacatgagagtccatgctggcattaagccgttccagtgcaaaatctgtggcaagacctttagtcagaaatgcagcttgcaagaccatttgaaccttcatagcggcgataaaccacataaatgcaactattgtgacatggtctttgcacacaaaccggtcctcaggaagcacctcaagcagctgcatggcaaaaattccttcgacaacgcaaatgaacgaaatgtgcaggatctcaccgtagactttgacagttttgcatgcactaccgttactgacagtaagggatgtcagccacagccggatgctacacaagtgctggacgcagggaaactggctcaggccgtcctgaacctccgcaatgattccacttgtgtgaattag

SEQ ID NO: 24914 - DNA, 1725 bp, Artificial Sequence
  Description of Artificial Sequence: Synthetic coding sequence
atgctccgcgagttctccaagtggggtgtggaggcatcaccaggtaaggcttgggagcgaaagcggagcttactacgaggcgctgttggccgataccggggtgccaccggcggtgacctcttctgggcccctttcccatcatggggcaccatggagtttccagagcattcacagcagctcttgcaatccctccgggagcagagatcgcaaggctttctctgtgactgcactgtgatggtcggttccactcagttcctggcgcaccgagcagttctggcgtcctgctctccattctttcagcttttctacaaggagcgggaacttgacaagcgggatttagtgtgcattcataatgagattgtgaccgcccctgcgttcgggctgctgttagacttcatgtatgcgggtcagctgactcttcggggtgataccccagttgaagacgttctggcagcggctagttacctgcatatgaacgacattgtaaaggtctgcaagcgcagattacaggccagggctctggcggaagcagatagtacaaagaaagaagaggaaacaaacagtcagttgccgtcgctggagtttctctcctccacaagtcgcggtacacaacccagcctggcaagtgccgaaactagtggccactggggcaaaggagaatggaaagggagcgccgcaccttcacctaccgtaaggccaccggacgagccccctatgtcttccggtgcagataccactcagcctgggatggaagttgatgcgccacacctgagggcaccccatccccctgtcgcggacgtgagtctggccagcccaagctcgtctaccgagaccattccaacaaattacttctcatcaggtatcagtgctgtgtcgctcgagcctttaccttccttggacgtgggcccagaatctctgagagtggtagaaccaaaggatcctggcggtcctttgcagggcttctaccctcccgcttccgctccgacgtctgctccggctcctgtgtccgctcccgttccctcacaagcccctgcaccagccgaggccgagttagtgcaggtcaaggtggaagccatcgttatttccgacgaagagactgatgtcagcgacgagcaacctcagggaccagaaagagcttttccgagtggcggagccgtctacggtgcacagccaagccaacctgaagcgttcgaggacccaggcgcagccggacttgaagaggtgggaccatcagaccacttcctgcctacagacccgcatttaccatatcacctcctcccgggagccggacaataccatcgcggattggtaacaagcccattacccgcacctgcaagcctccatgaaccgctctacctctcttctgagtatgaagccgctcccggtagctttggagttttcactgaagatgttcctacctgcaaaacctgtggaaagaccttctcctgctcctacactttgagacgccacgccacagtgcatacaagggagagaccatacgagtgtaggtactgcctcaggtcttatacacaatccggagatttgtatcggcatatacgaaaagctcacaacgaagatttagccaaacggagcaaacccgaccctgaggtgggacctctcctcggagtgcaacccttgcctggaagccccactgcagacaggcagagcagttcaggaggcggtccccctaaagattttgtgctggctcctaaaaccaacatctag

SEQ ID NO: 24915 - DNA, 1512 bp, Artificial Sequence
  Description of Artificial Sequence: Synthetic coding sequence
atggagaaaggtggcaatattcaattagaaattcccgacttctctaactctgtactgagccatctcaaccagctccgtatgcagggacgcctgtgcgacattgtggtcaacgttcagggacaggcattcagagcacacaaggtggtgctggctgcctcttctccatactttcgggaccacatgagcctgaacgaaatgagtaccgtcagtatctccgtcatcaagaaccctaccgtcttcgagcaactgctgtccttctgttacacgggaagaatctgcctgcagctggcagatatcatctcctatctaactgccgcttcatttctgcagatgcagcatatcattgataagtgtacccaaattttggaggggattcatttcaaaataaacgtggccgaggttgaggcggaactcagccagactcggaccaagcaccaggaaaggccccctgagtcgcatagggtgactccaaacctcaataggtctttgtctcccagacacaacacaccaaaaggaaaccggcgaggccaggtcagcgcagtcctggatatccgcgaactgtccccgcctgaggaatccacaagtccccagatcatagagccttcttccgatgtggaaagccgagagccaatcctgcgaatcaatcgcgcaggacaatggtatgtagagaccggggtggccgaccgagggggacggtccgatgatgaggttagagtcttgggagccgtccatatcaagacagagaatctggaagaatggctggggcctgagaatcagcctagcggggaggacggctcttcggcggaggaggttacagctatggtcatcgacactacagggcatggatccgtgggacaggaaaattacaccttggggtcgagcggcgctaaggtcgcgaggcccacaagctcagaggtggatcgattctccccttccggtagtgtcgtccccctaaccgaacgccatcgagctcgatcagaaagcccgggaaggatggatgagcccaagcagccaagctcacaggtagaagagagtgccatgatgggggtcagcggctatgttgagtacctaagagagcaggaagtgtccgagcgctggttcaggtataatccacgcctcacgtgtatatactgcgctaagtcttttaaccaaaagggctctctggacaggcacatgaggctacacatgggtataactcccttcgtgtgtaggatgtgcgggaagaagtatacacgaaaagaccaactggagtaccatattaggaagcatactggaaacaaaccatttcactgtcacgtgtgcggcaagtcttttccattccaggctattctcaaccagcatttcagaaagaaccatccgggttgtatccctctagaaggtccacactcaatctctcctgagactactgttactagcaggggacaagccgaagaggagtctccaagtcaggaggagaccgtcgcgccaggagaagccgtacagggttccgtgagtacgactggacctgattag

SEQ ID NO: 24916 - DNA, 1236 bp, Artificial Sequence
  Description of Artificial Sequence: Synthetic coding sequence
atgccggcaactgggaggtatcatcagctgcccaactcttgccagttcagtgccaatgccgcttactacagacaaatgtacaccgaccccggagggcatagtttcaagataaacgtggcggaggtggaggccgagctcagccagactaggacaaagcatcaagaaaggcctccggaaagccatcgggtgacgcccaaccttaaccgctctctgagcccgcgacacaataccccaaagggcaatcgtcgcggacaggtgagcgctgtacttgatattcgcgagctctccccacccgaggagtccacctcccctcagatcattgagccgtcatcagatgtcgagagtcgggagccaatcctccgtattaacagggcaggacagtggtatgtagagaccggggtggccgaccggggtggtcggtcagacgatgaagtgcgagtgctaggagccgtgcatatcaagacagaaaatctggaagaatggttgggaccggagaaccagccctccggagaagacggctctagtgcagaggaggttacagctatggtcatcgatactactgggcatgggtccgtgggtcaggagaattatacgctgggatcatcaggggcaaaggtggctagacccaccagcagcgaagtcgatcggttctcaccctcagggagcgtggtgccactgacagagcgtcatcgcgctcgcagtgagtcaccgggtagaatggatgagccaaaacaacctagctctcaagttgaggagagtgctatgatgggagtttccggctatgtggagtatttgagagagcaggaagtatcagagcgctggttccgctataacccaaggctgacttgtatttactgtgcaaaatcttttaaccagaagggcagcctggaccgccacatgagactgcatatgggaattacaccttttgtgtgccgcatgtgtggaaaaaagtacacgcgcaaagatcagttggaataccatatccggaagcacaccggcaataagccatttcattgccacgtatgcggaaaatcttttccatttcaggctatcctgaatcagcattttcgtaagaatcaccctggctgtatccccctagagggtcctcactcgatcagccctgaaaccactgtcacctcccgcggtcaggccgaagaggaaagtccatctcaggaggaaacagtggctcccggagaggcagtgcaagggtctgtatccaccaccgggcctgactag

SEQ ID NO: 24917 - DNA, 927 bp, Artificial Sequence
  Description of Artificial Sequence: Synthetic coding sequence
atggagaaggggggtaatatccaactagagattcctgattttagcaactctgtgctgtcacacctgaatcagcttaggatgcagggcagactttgcgatattgtcgtgaacgttcagggacaggcattccgggcacacaaagtcgtactggccgcttctagcccttacttccgcgaccacatgtcgcttaacgagatgagtacagtgtccattagcgttatcaagaaccccaccgtctttgagcagctgttgtctttttgctataccggcaggatctgcctgcagctagctgatatcatcagttacctgacggctgcctcttttctacaaatgcagcatattatcgataaatgcacacagattctcgagggcatccactttaagatcaacgtggccgaagtcgaggcggagttaagccaaacgcggaccaagcaccaggagagaccaccagaatcacacagggtcactcccaatctcaatagaagtttgtctcctaggcacaatactccaaaaggcaatcgtcgcggacaggtaagtgctgtactggatattagagagctgagccccccagaggagtctacgagccctcagattatcgaaccctcttccgatgtagaatccagggagccaattttacgaatcaatcgggctgggcaatggtatgtggaaacgggcgttgctgacagaggcggacggagcgacgacgaagttcgggtcttgggagctgttcatataaaaacagagaacctagaggaatggctgggacctgaaaaccagccgtctggcgaggatggaagttctgcagaggaagttacagcgatggtaattgacactaccggacatggaagtgttgggcaagaaaattacacgctggggagtagcggtgcaaaagtggccagacccacatcatcagaagtggatagatag

SEQ ID NO: 24918 - DNA, 1512 bp, Artificial Sequence
  Description of Artificial Sequence: Synthetic coding sequence
atggagaagggaggcaacattcagcttgaaattccagatttttctaactcagtcctgagccacctcaatcagctgagaatgcaaggcaggctttgtgatatagttgtcaacgtgcaagggcaggccttcagggcccataaggttgtattggcggcaagcagcccttatttcagggatcacatgagcctgaacgagatgagcacagttagcatttccgtaatcaagaacccgacagtcttcgaacagcttctgtcattctgctacactggacgcatatgcctgcaacttgcagacataatcagttacctcactgctgcttcattcctccagatgcagcatattattgacaaatgtacacaaatcctggaagggatacattttaagataaatgtggccgaggtggaggcagaattgtctcagactcggacgaagcaccaggagaggccgccagagtcccatcgtgtgacccctaatcttaataggtcacttagtcccaggcataacacacctaagggcaacagacgcggacaggtctcagccgtactggatattcgcgaactctcccctcctgaggagagtacttcccctcagattatcgagccttcatccgatgttgagtctagagagcctattctgcggatcaatcgggctggccagtggtacgtggaaacaggggtcgccgaccggggaggcagatcagatgacgaagtaagagtattgggggcagtccatatcaagaccgagaacttggaagaatggcttgggccagagaatcagcctagcggtgaggacgggtcgtccgccgaagaggtaactgccatggtgatcgacactacagggcatggatccgtgggccaggagaactatacactgggaagcagtggggcaaaggttgccagacccactagctctgaggtggacaggttttccccttcagggtcggtggtccccctaacagagagacatcgggctcggagcgaatccccgggtagaatggacgagcctaagcagcctagctcccaggtcgaagagagtgccatgatgggcgtgtctggatacgttgagtatctcagagagcaagaggtaagcgagaggtggttccgctacaacccgagactcacctgtatttactgcgctaagagctttaaccagaagggatctctggataggcacatgagacttcatatgggaatcacacctttcgtatgtcgtatgtgcggtaaaaagtatacaaggaaagaccagctggagtaccatattagaaaacatacaggtaataaaccgttccattgccatgtgtgtggcaagtcctttcctttccaagccatcttaaaccaacactttaggaaaaaccacccgggatgcatacccctggaagggccacacagtatatcacccgagacaaccgtgacctctcggggacaagccgaggaggagagccccagccaggaggaaacagtcgcgcctggtgaggccgtgcagggcagcgtgagcactaccgggccagactag

SEQ ID NO: 24919 - DNA, 1086 bp, Artificial Sequence
  Description of Artificial Sequence: Synthetic coding sequence
atggagaaggggggaaacatccagctcgaaatcccggatttcagtaatagcgtcctttcacacctcaatcagctacgcatgcaggggagactgtgtgatatagtggttaatgtccaagggcaggctttccgagcccacaaagttgtcctggcagccagcagtccatattttagagaccatatgagcctgaacgagatgtccacggtaagcatctctgtcattaaaaatcccaccgtgttcgagcagcttttgtccttttgttacacaggcagaatttgtctgcagctggccgatatcatctcttatctgaccgccgctagcttcctccagatgcagcacattatcgacaaatgcacccagattttggagggtatccactttaagatcaacgtggctgaagtcgaagctgaactttcacagacacgcaccaagcaccaggaacgaccacctgaaagtcacagagtgacccccaatttgaatcgcagtctctccccgagacacaacacacctaagggaaaccgccgaggccaggtctcggccgtcctggacatccgcgagctctcgcctccggaggagtcgacaagtcctcagattatcgaaccgtcaagcgatgtcgaatcacgtgagcccatactccgcatcaatcgggctggtcagtggtacgttgagactggagtggctgatcggggagggcgttctgacgacgaggttagggtgttgggcgctgttcacatcaaaacggagaatttagaggagtggctggggccagaaaaccagccatctggtgaggacggatcctccgccgaggaggtgaccgctatggtcatcgatacaacaggccacggctctgtaggtcaggagaactatactctgggatccagcggagcgaaggtggctaggcctacgtcttccgaggtcgaccgttttagtccctctggatcagtcgtccccctaaccgaacgacatagggcacggtctgaaagccctggcagaatggatgagccaaagcagcccagctcacaagtgtggagctgcggcttccggacagccctagtggtggggggaattgccactgtgtacgagtag

SEQ ID NO: 24920 - DNA, 1512 bp, Artificial Sequence
  Description of Artificial Sequence: Synthetic coding sequence
atggagaagggaggcaacatccaactggaaatccccgacttttcaaattctgtgctaagccatctgaaccagcttcgtatgcagggtagactttgtgatattgtcgtgaatgtgcagggtcaggccttccgggctcacaaggtggtgttggcagcatcttccccctacttcagagatcatatgagcctgaatgagatgtctactgtgagtatcagtgtgatcaagaacccgaccgtttttgagcaactgcttagtttttgctacactgggaggatatgtctccagctggctgacatcatttcctacctgaccgcagcatctttcctgcagatgcagcatattatcgataagtgcacccagatcctcgagggcattcattttaaaatcaatgtggcggaggtggaagcagaactgagccagacacgtacaaagcatcaagagagaccccctgaatctcacagagtaaccccaaatctgaatcgaagcctgagccctcgccacaacactcctaagggcaaccgcagaggccaggtgtccgcggtacttgatatacgtgaactctccccacccgaggagagcaccagcccccaaataattgaaccaagcagtgatgtagagtctagagaaccaattctcagaatcaatagggcgggacaatggtatgtggaaaccggcgtagccgaccggggtggtagaagtgacgacgaagtgagggtcttaggagccgtacatattaaaactgagaacctggaggagtggttgggaccggaaaaccagccctcaggtgaagatgggagcagtgcggaagaagtgactgcaatggtgatcgatactacggggcacgggtctgtggggcaagaaaattacaccctcggcagctcaggggcaaaagtggccaggcccacctctagcgaggtggaccgtttcagccctagtggcagcgtggtgccccttacagaacggcaccgtgcaagatccgagagtcccggtcggatggacgagcccaagcagcctagctcacaggttgaagaaagcgcaatgatgggagtgtcaggatacgtggagtatctgagagaacaggaagtgagcgaacgctggtttaggtataaccctagattaacctgtatctactgtgcaaagtcgttcaaccagaagggtagcctggatcggcacatgagactgcatatgggaatcactcccttcgtatgcaggatgtgtggcaagaagtacacacgaaaagaccagctcgagtaccatatccgcaagcacacaggcaataaaccattccattgtcatgtgtgcggtaaaagcttccctttccaggctatactgaaccaacatttccgcaagaaccaccctggctgcatacctcttgaagggcctcattctatcagcccggagaccactgtaacatctcggggtcaggctgaagaggagagcccgtctcaggaggaaactgtcgcccctggtgaagcagtgcagggatctgtttctacaactgggcctgactag

SEQ ID NO: 24921 - DNA, 2139 bp, Artificial Sequence
  Description of Artificial Sequence: Synthetic coding sequence
atgggtatgcgcatcaagctgcagagcactaatcaccccaataacctgttgaaggagctaaataaatgtaggctgtctgagactatgtgcgacgttaccatagtggttggatctcgaagctttccggcacataaagccgtgcttgcctgtgccgctggatattttcagaatctgtttcttaatacagggctggacgccgcacggacctacgtcgtagacttcatcactcctgcgaactttgagaaggtcctcagcttcgtgtacacgagtgagctgttcactgacctgatcaacgtaggggtcatttatgaggttgctgagcggcttggcatggaagacctcttgcaggcatgccactcaactttccccgacttggaatctactgcacgtgccaaacccttaaccagcacctccgagtcacatagtgggactttatcatgtccatccgccgagcccgctcatcccttaggggagctgcgtggtggcggtgactatctgggcgctgaccgaaattatgtactcccctccgacgcaggcggatcctacaaagaagaggaaaagaacgtggcgagcgatgcaaaccattcactgcacttaccacagccacctccgcctccgccaaagaccgaggaccatgatactcccgcacctttcaccagcatcccatcgatgatgacccagccccttctcgggacagtgtcaactggaattcagacttctacatccagctgtcagccatacaaggtgcagagcaatggagactttagcaagaattccttcctgacgcctgacaacgcagtcgatataacaactggtactaatagttgtttatcaaattctgaacattcaaaggatcccggttttggacagatggatgaattgcagctagaagatctgggtgacgatgacctccagttcgaggaccctgctgaagacatcggcaccactgaggaagtgattgaactctccgatgactcagaagacgaattggcattcggggaaaatgacaaccgggagaataaggctatgccttgtcaggtgtgtaaaaaggtgcttgaacccaatattcagctcattcggcagcacgcgagagaccatgtagatttgttaacaggaaattgcaaagtttgtgaaactcactttcaggaccgtaattccagggtgacgcatgtgctgtcgcatatcggcatcttcctgttcagctgtgatatgtgtgagaccaaattctttactcaatggcaactgactttacaccgcagggacgggatttttgagaacaacatcatcgtccaccccaacgatcctcttccgggaaaattgggcctcttttccggagccgctagtccagagcttaaatgcgctgcctgtggcaaagtgctggcaaaagacttccacgttgtgaggggccacatcctggaccatctgaacctgaagggccaggcatgctctgtctgcgaccagcgccatctgaacctgtgcagcttgatgtggcacactctttcccacctggggatcagcgtgttctcctgttccgtttgcgccaattcttttgtggactggcacttgcttgaaaagcacatggctgtgcaccaatccttagaggatgccttatttcactgtagactgtgctcccagagcttcaaatccgaggccgcatacagataccacgtgagccagcacaaatgtaattccggccttgatgctaggcctggattcgggctgcagcatcccgctctccagaaacggaagctgcccgcagaagaatttctgggcgaagagcttgcactacaggggcagccaggaaactccaagtactcatgcaaagtctgcgggaaaagattcgcacatactagcgaatttaactaccaccgacgtatccatacgggagagaagccatatcagtgcaaagtgtgccataaattcttcagaggtcgatctacaattaaatgccatttgaagactcacagtggcgcactcatgtacagatgcaccgtttgcggccattactcgtctaccctgaacctaatgtctaagcacgtgggggtgcacaaaggctcacttcctcccgacttcacgatagagcagacgtttatgtatattatacacagcaaggaggctgataagaatccggatagctag

SEQ ID NO: 24922 - DNA, 2730 bp, Artificial Sequence
  Description of Artificial Sequence: Synthetic coding sequence
atgaaaaagcgacgcaaggtcaccagcaacctcgagaagattcatctaggctaccacaaagacagtagcgaaggaaatgtggcagttgagtgtgatcaggtcacatatacgcattccgccggtcgaccaactccggaagccctgcattgttatcaggagctcccaccttcaccagaccagagaaagctgttgtcatcacttcagtataacaaaaaccttctgaaatacctgaacgacgatcggcagaagcagccatctttctgtgaccttttgataatcgtggagggaaaggagttctcagcccacaaagtggtggtagcagtcggttcttcatacttccacgcctgtttgtccaagaatccaagcacagatgtggtgaccctagaccacgtgactcacagcgtcttccagcatttactagagttcctttatacctctgaattcttcgtgtataagtacgagattccactcgttttggaagccgctaaattcctggacatcatagatgccgttaaattactcaataacgagaacgtggcaccattccacagcgagctgaccgagaagagctcccctgaggaaaccctgaacgaactcacaggacggctgtccaataaccatcaatgtaaattttgcagtcgccacttctgttataagaaaagccttgaaaatcacttggctaagacgcaccgaagcttgttactgggcaaaaagcacgggctgaagatgctcgaaaggtcttttagcgcgagacgcagcaagcggaatagaaaatgccccgtaaaattcgatgacacgtccgacgatgaacaggagagcggggacggtagcgacaatctcaatcaggagaatttcgacaaagagaagagtgataggaatgacagtgaggatccagggagcgagtataatgccgaggaagacgaactcgaggaggaaatgtccgatgagtatagcgacattgaggagcaaagcgagaaggaccacaatgacgctgaagaagaaccagaagcgggagacagcgtcgggaacgtacacgaggggttgacgcccgtggttatccagaattcaaataaaaaaatcctgcagtgtccgaaatgtgacaaaaccttcgatcggataggtaagtatgagtctcacactcgggtgcacacaggggagaaacccttcgaatgtgacatatgccaccaacgctattctacgaaatccaacctcaccgttcaccgtaagaaacacagcaatgaaaccgagtttcacaagaaggaacacaaatgcccttattgtaataagctacacgccagcaagaagactctagccaaacacgtgaaaaggttccatcctgagaatgcacaggagttcatcagcattaaaaaaacgaaatctgagtcctggaagtgcgatatttgcaaaaaatcattcactcggcgaccccatctggaagaacacatgatactgcatagccaggataaacccttcaaatgtacctactgcgaagagcattttaagagcagattcgccagactcaagcaccaggaaaagtttcacctcggcccttttccttgtgacatctgcgggaggcaattcaatgatactgggaacctgaaaaggcacattgagtgcacccatggagggaaacgcaaatggacctgcttcatatgcggaaagtctgtccgtgaacgcaccaccctgaaagagcacctccgaattcactcaggcgaaaaacctcacttatgcagtatttgtgggcagtctttcaggcacggtagttcctaccggctccacctgcgcgtgcaccatgatgataagagatacgaatgtgacgagtgcggcaagactttcatccgccatgatcacctgactaagcacaaaaaaatccattcgggtgaaaaagcccaccagtgtgaggagtgtggaaagtgttttgggaggcgggatcaccttacagttcattacaaatctgtgcatctgggtgagaaggtgtggcagaagtataaggccacttttcaccagtgcgatgtctgcaagaaaattttcaaaggaaagagcagcctggaaatgcacttcaggacccacagtggcgagaagccctacaaatgccaaatctgtaatcagtcgtttaggattaaaaagaccctcactaagcacctggtcattcacagtgatgccaggccattcaactgccagcattgtaacgcgacgtttaagcgtaaggacaaactaaagtatcacattgaccatgttcacgaaatcaagtcccccgacgatccacttagcactagcgaagaaaaattggtttcattgccagtcgaatactcaagcgacgacaaaattttccaaacggagaccaagcagtacatggatcagcccaaggtgtatcaatccgaggcaaagaccatgctccaaaatgtaagcgcagaagtttgcgtgcccgtgactcttgtcccagtccaaatgcccgacaccccctcagacctggtcaggcataccactactttgcccccatcaagccacgaaattctaagcccccagccccagagtactgactacccacgagcggcagatctggcgtttctcgagaagtacacgctgacacctcagccggcaaacatcgtacatcctgtacggccagagcagatgctggatccccgtgagcagagctatctaggcaccctgctggggctcgactctaccactggcgtgcaaaatatatctaccaacgagcaccattcttag

SEQ ID NO: 24923 - DNA, 1404 bp, Artificial Sequence
  Description of Artificial Sequence: Synthetic coding sequence
atggagccagggactaactcttttcgcgtagaattccccgacttctcctcaacgatattacaaaagttgaaccaacagcgccagcagggccagctgtgtgacgttagcatcgtcgtacaggggcacatcttccgtgcacacaaggcggtcctggctgcctcgtccccctacttctgcgatcaggtcttactgaagaactcccgcaggattgtgttacccgatgtcatgaatcccagagtgtttgagaacatcttgctgagctcctatactggtcggcttgttatgccagcacctgagattgtttcatacttaactgcggcttccttcctgcagatgtggcacgtggtggacaagtgtacggaggtgcttgaaggcaatcctacagttctgtgtcagaaattgaatcacggcagtgaccatcagtctccatctagttcatcctataacggcctggtggagtctttcgagcttggaagtgggggacacacagacttccccaaagcacaggaacttcgggatggtgagaatgaagaggaaagcaccaaagatgagctgagctctcaactgacagaacacgagtacctgcccagcaattcctctaccgagcacgacagactgtctactgagatggctagccaggacggggaggagggcgcttccgattccgctgagttccattatacccgaccaatgtacagcaagccctctatcatggctcacaaaagatggatccacgtgaaaccagaacgactggaacaggcttgcgaagggatggatgtgcatgccacctacgacgaacaccaggtcactgaatctattaataccgtgcagactgagcacaccgtccaaccatctggcgtcgaggaggactttcatataggcgaaaagaaggtcgaggccgaattcgacgagcaggccgacgaatctaactacgacgagcaagtcgatttttatggctccagcatggaggaattcagtggagagcgaagtgatggaaacctgatcggccaccgccaggaagcagcactcgcagctggctattctgaaaatattgagatggtgactgggataaaggaggaagctagccacctgggatttagtgcaacggataagctttacccctgtcagtgcggcaagagcttcacacataaatcacagagagatcgacatatgtccatgcacctgggtctccgtccctacggatgcggggtctgtggaaagaagttcaaaatgaaacaccatctggtgggtcacatgaaaattcacactggaatcaaaccttatgaatgcaacatctgcgccaaacgatttatgtggcgtgactcatttcaccggcatgtgacatcctgcacaaagagctacgaagcggctaaggcagagcaaaatactaccgaggcaaactag

SEQ ID NO: 24924 - DNA, 1404 bp, Artificial Sequence
  Description of Artificial Sequence: Synthetic coding sequence
atggagcctggaacaaatagctttagggtggagttccccgatttttcaagcacgatccttcagaaactgaaccagcagaggcagcaggggcagttatgtgatgtctccatagtcgtacagggccacatttttcgcgctcacaaggccgtgttagctgccagctctccctacttctgcgaccaggtgctgctgaagaattcacgaagaatcgtgctgccagacgtgatgaaccctcgtgtgtttgaaaacatacttttgtccagctatacaggaaggcttgtgatgcccgctcccgaaatcgttagttatttgaccgcagccagtttccttcagatgtggcatgtggttgataaatgcactgaagtactggaaggcaatcccacagtcctgtgccagaagttaaatcatgggtctgatcaccagtcaccgagctcatcaagctataacgggcttgtcgaaagcttcgagttaggaagcggaggtcatactgatttccccaaggcccaggaacttagggacggcgaaaatgaggaggagtcaacaaaggatgaactgtccagccagctgactgaacatgaatacctcccctccaacagctctaccgagcacgataggctctctacagaaatggcttcacaggacggcgaggaaggcgcatccgactcagctgagttccattatacccgaccaatgtattctaaaccgagcatcatggcccacaaaagatggattcacgtgaagccagagcggttagagcaggcttgtgagggaatggacgtgcacgcaacctatgacgaacaccaagttaccgaaagcatcaacacagtgcagactgaacacacggtgcagcctagcggggtggaggaggacttccacatcggcgagaagaaggtcgaggcggagttcgacgaacaagctgacgagtcaaactacgacgaacaagtggatttttacggttcctctatggaagaattcagcggtgagaggagcgatggcaatctgattggccacaggcaagaagcagcactagcggcaggctactcagagaatatcgagatggtcaccggcattaaagaagaagcctcacacctcggtttctccgccacagataaactgtacccatgtcagtgcggcaaatcctttacccacaaatcccagcgtgatcgccacatgtctatgcacctcggcttgcggccttatggctgcggtgtttgcggcaagaagtttaagatgaagcatcacctggttggtcacatgaagattcacaccggcatcaagccgtatgaatgtaatatatgcgccaagagattcatgtggagggactcattccaccggcatgtgaccagctgtaccaagagctacgaagcagcaaaagctgagcagaatacaaccgaggcgaattag

SEQ ID NO: 24925 - DNA, 1404 bp, Artificial Sequence
  Description of Artificial Sequence: Synthetic coding sequence
atggagcccggaacgaattccttcagggtggagtttcctgatttttctagcaccattttgcagaaattgaaccagcagcggcaacaagggcagctctgcgatgttagcattgtggttcagggccacattttccgggcacataaggccgtcctcgcagcctctagtccgtacttctgcgatcaggtgcttttaaaaaactcaaggcggatagttttaccagacgtcatgaaccccagagtgttcgaaaatattctgctctcttcatacaccggaagattagtcatgccagcacctgagatagtgtcgtatttgacagcagcatcatttttgcagatgtggcatgttgttgacaagtgtacagaagtactggagggcaatccgaccgtgctgtgccagaaactgaatcacgggagtgatcatcagtccccatcatcaagtagctataatggattggttgaaagcttcgaactaggaagcgggggacatacagactttcctaaggcccaggagctccgtgacggagagaacgaagaggagagtactaaggatgagctgtcaagccagttaacggagcacgagtatttaccatctaatagcagcaccgagcacgacaggctgagcacagagatggcttcccaggacggggaggagggcgcaagcgacagcgcagaattccattacacaagaccaatgtattccaagccttcaatcatggcgcacaagaggtggatccacgtaaagcctgaacgcctggagcaagcttgcgaaggaatggatgtgcacgctacttatgatgagcatcaggtgactgaatctattaatactgtgcagactgagcacaccgtccagccatctggagttgaagaggatttccacattggagagaagaaagtggaggctgagtttgatgagcaggctgacgaatccaactacgatgaacaggtcgatttttacggaagttccatggaggagttttcaggggagagaagcgacggaaatctaatcggacacaggcaggaagcagctctggctgccggttatagtgagaacatcgagatggtgaccggcatcaaagaggaagctagccacctcggttttagcgcaacggacaaactctatccctgccagtgcggtaaatcgttcacccataaatcgcaacgtgatcgccacatgtccatgcacctgggtctacgtccatacgggtgcggtgtatgcggtaagaaatttaaaatgaagcaccatttggtgggacacatgaaaattcacactggcattaaaccgtatgagtgcaatatatgtgctaagcgcttcatgtggcgcgacagctttcaccgccatgtcacctcttgcactaagtcttatgaagccgcaaaggccgagcagaatactaccgaggccaattag

SEQ ID NO: 24926 - DNA, 591 bp, Artificial Sequence
  Description of Artificial Sequence: Synthetic coding sequence
atggagccaggcaccaactcattcagggtcgagttccccgacttttcatctaccatactccaaaagttaaatcagcagcggcagcagggccaactgtgtgacgtgagtatcgtagtccagggccacatctttcgtgcccacaaagccgtattggccgcaagtagcccttatttctgtgaccaggtactgctgaagaactccaggcgtattgtgctcccagacgtgatgaacccgagggtgttcgaaaatatcctgctgagctcatacaccgggcgtcttgtgatgcctgctcccgagatcgtcagctaccttacggctgcttcatttctacagatgtggcatgtcgtggacaaatgtaccgaagtcctggaaggcaaccctacagtgctctgccagaagctgaatcatggatcggatcatcagagtccatcatcgagttcttataatggcttagtcgagtcctttgagttggggtctggcggtcacacagatttccccaaggcacaggagctccgagacggggaaaatgaggaggagtccacaaaggacgaactcagcagtcagctgaccgagcacgaatatctgccttag

SEQ ID NO: 24927 - DNA, 1536 bp, Artificial Sequence
  Description of Artificial Sequence: Synthetic coding sequence
atggctgccgctgaggccgtgcatcatatccacctccagaactttagtagatcattactggaaaccttgaacggtcagagactggggggtcatttctgcgatgttacagtccgcatcagggaggcctccttaagagcccacaggtgtgttttggcggctggatcacctttcttccaagataagttgctgcttgggcactcagagatccgcgtcccgccagtagtgcccgctcagaccgtccgccagctggtcgagttcttgtactccggcagtctcgtggtggcacagggagaagctctgcaggtcctaacggcagccagtgtcttacgtatacagacagtgattgatgaatgcacccagatcattgcgagagccagggcacctggaacgtcggctcccacacccctcccgactccggtcccaccgcctctggcgcctgcacagctgaggcatcgcctgagacacttacttgccgctaggccgcctggccacccgggtgcggctcatagccggaaacagaggcagcccgcaagactccagctgcctgcgcctcctacacccgcaaaggccgaaggaccggacgccgaccctagtttatcagcagcccctgacgacaggggggacgaggatgacgaagaatctgatgacgagacagacggagaggatggcgaaggcggaggccctggcgagggacaggcacccccatctttccccgattgcgcagctggatttctgacagccgctgctgactctgcttgcgaggaaccaccagccccaactggcttggccgactacagtggcgcaggccgtgacttccttagaggcgcaggaagcgccgaggacgtttttccagattcttatgtgagcacctggcatgatgaggatggtgccgtacctgaaggttgtccaacggaaacccccgtgcaaccagattgtatcttgtcgggaagtcgacctccgggtgtcaaaaccccgggtcccccagttgctctgttcccattccatctgggggcacccggaccccctgcaccacccccatctgcaccctcaggaccggcacctgctccaccccctgcattttatcccaccttgcaacccgaagcagctccgtccactcaactgggtgaggttcctgctccgagcgccgcacccaccaccgctcccagcgggacccccgcacggaccccgggagccgagccccctacctacgaatgtagccattgcaggaaaactttctccagcagaaaaaactacacaaaacacatgtttatacattccggtgagaagccacaccaatgtgccgtatgttggagaagttttagtttaagggattacctgcttaagcatatggtgacacacactggcgtccgagcatttcagtgcgccgtctgcgccaagcgctttacgcagaagagtagtttaaacgtgcatatgaggacccatcgacccgaacgtgcgccttgtcccgcttgcggaaaagtgtttagtcatcgggcactgttggaacgccatctcgccgcacacccggctccttag

SEQ ID NO: 24928 - DNA, 1770 bp, Artificial Sequence
  Description of Artificial Sequence: Synthetic coding sequence
atgaataatagaaaagaggatatggagatcactagccattaccgtcacctcctgcgggagttgaatgaacagagacagcacggggtcctctgcgacgtgtgcgtggtcgttgaaggcaaggtgtttaaagcccacaagaacgttctcctgggctcaagtagatattttaaaacattgtactgccaggtccagaagacaagtgagcaagcaacagtgacccacttggacatcgtgaccgcacaaggtttcaaagcgatcatagacttcatgtatagtgctcacttggccctcacatctaggaacgtcatcgaagtcatgtcagccgcttcttttctacaaatgaccgacatcgtacaagcgtgccatgatttcattaaagcagctttggatatcagtatcaagagcgatgcgagcgacgagctggccgagttcgagatcggcgctagttcatcaagtagcactgaagccctgatttccgccgtcatggcagggcgatcaatctcgccatggttggccaggcggacgtcccctgccaattcctccggggacagcgcaatcgcatcttgccatgatgggggttcctcatacggcaaagaggatcaggaacccaaggcagatggcccagacgacgtgtctagtcagccactgtggccgggagacgtaggatacggccctttgaggataaaggaggagcaggtgagcccttcccagtacgggggttctgaattaccatcagcaaaggacggcgctgtccaaaattcattcagcgaacagagcgccggagatgcgtggcaaccgacaggccgtcgaaagaacaggaaaaataaagagaccgtgaggcacattacacagcaggttgaggatgatagtcgcgcttctagcccagttcccagctttctccctacatccgggtggcccttttcgtcgcgggactctaacgcagacctgagcgtaacagaagcttcgagtagtgattctagaggggagagagccgagctctacgcacaggtcgaagagggattactggggggagaagctagttatctcggaccgccactgacccccgagaaagatgacgcactgcaccaggccactgcagtggccaacctgcgcgcagccctgatgtccaaaaacagcctgctaagtctaaaggctgacgtactgggcgacgacggctctcttttgttcgagtacctcccacgcggagcccacagcttgtctttaaatgagtttacagtcatacgcaaaaaattcaaatgtccatattgtagcttttcggccatgcatcagtgtatactcaaacgccacatgaggtcacatacaggagaacgaccttacccttgtgagatctgcgggaagaagtttactagaagagaacatatgaagcgccacaccctggtgcactctaaggataagaaatacgtttgcaaggtttgcagtagagtatttatgtccgctgcgagtgttggtattcgacatggcagtagacgacatggggtgtgcactgattgcgctggcagaggcatggctggaccactggaccatgggggagggggtggggaagggagccccgaggccctgtttcctggagatgggccatatctggaagatccagaggacccaagaggtgaagccgaggagttaggcgaagacgatgagggcctcgctccagaggatgcgcttctagcagacgacaaagacgaagaggatagtccaaggcctagatctccccctgggggtcccgacaaagactttgcttggctttcctag

SEQ ID NO: 24929 - DNA, 1770 bp, Artificial Sequence
  Description of Artificial Sequence: Synthetic coding sequence
atgaacaacagaaaggaggacatggagattaccagtcactacagacacctcctacgcgaactgaacgagcagcggcagcacggcgtgctttgtgacgtttgtgtggtggtcgaaggcaaagtctttaaagcccataagaatgtgttgctagggagctccaggtacttcaagacactgtactgccaggtccagaagacttcggagcaggcgaccgtgacccacctcgatattgtcactgctcagggcttcaaggctatcattgatttcatgtactctgcacacttggccttgacatctagaaatgtgatcgaggtgatgagcgctgcgagcttcttgcagatgactgacatcgtgcaggcttgtcacgattttatcaaggccgcactggatatctcaattaagtctgatgccagcgacgaactggcggagtttgagatcggcgcttccagctctagctccacggaggccctcatttccgccgtcatggcgggacggagcatatcgccgtggttagcgcgacggacgtccccagccaattccagcggggacagcgctatcgcatcctgccacgatgggggttcatcttacggaaaagaggaccaggaacctaaagcagacgggccagatgatgtgtcctcccagccactgtggcccggagacgtagggtacggcccattgaggatcaaggaagaacaggtatccccctcacaatatggcggatccgaactgcctagcgccaaagatggcgctgtgcagaattctttcagcgaacaatctgccggtgacgcctggcagcctaccggaaggcggaagaatcggaagaacaaggagaccgtgagacacatcacccaacaagttgaggacgatagccgcgcatcttctccagtaccgagcttcctgcctacaagtgggtggcccttcagctcacgggattcaaatgccgaccttagtgtgactgaagcttctagttccgactccaggggcgagcgggcagagttatatgcccaagtcgaggagggactgttgggaggggaggcgagttacctcggaccacccctgaccccagagaaagacgatgctttgcatcaggccaccgcagtcgcaaatcttagagcagctctgatgagtaaaaattctttgctgagccttaaagcagacgtccttggcgatgacggcagcctactgttcgagtatttacccaggggagcccacagcctatccttgaatgagtttaccgtaattagaaaaaagtttaagtgcccctactgtagtttcagcgcaatgcatcagtgcatcctgaagcgacatatgcggtctcacaccggtgagagaccatatccatgcgaaatttgcggaaaaaaattcacccgcagagagcatatgaaaagacataccctggtacacagcaaggataagaagtacgtgtgcaaggtatgcagcagagtatttatgtccgctgcctcagtcggaatcaggcacgggtcaagaagacacggcgtgtgtaccgactgtgcaggtagaggaatggccggtccactcgatcacggtggaggaggaggcgaaggcagcccagaggccctcttccctggagacgggccatacttggaggacccagaggaccctcgtggtgaagccgaggaactgggggaggacgacgaagggttggcccctgaagacgcactcctcgccgacgataaagatgaggaggatagccctcggccacgatcacctcccggaggtccagataaagacttcgcctggcttagttag

SEQ ID NO: 24930 - DNA, 1770 bp, Artificial Sequence
  Description of Artificial Sequence: Synthetic coding sequence
atgaataatcgcaaagaggatatggagatcacaagtcactatcgacacctcctgcgggagctgaacgagcagagacagcacggtgtgctgtgtgatgtgtgcgtggtggtggaaggaaaggttttcaaagctcacaaaaatgttctcttgggtagcagccgatatttcaagactctgtactgtcaggtgcaaaagaccagcgaacaggccaccgtgacccatttggatattgtcaccgctcaaggctttaaagcgatcatcgattttatgtatagcgcccatctggctcttacttcacggaacgtcatagaggtcatgtccgccgcatcgttcctccagatgactgacatcgtgcaagcgtgtcacgactttatcaaagccgctcttgatattagcattaaatccgacgccagcgacgagcttgccgaattcgagattggggcatcttcttcatcctctaccgaagcgctgatatctgccgtaatggcagggagaagcatctcaccatggttggccaggaggacatctccagccaattcttctggggacagtgcgattgcatcatgccatgatggtggcagcagctatgggaaagaagaccaagagccaaaagccgatggtcccgatgatgttagtagtcagcccctctggccgggtgatgtaggctatggcccactccggatcaaggaagagcaggtgtccccttcccaatacggaggctccgaactgccaagcgctaaggatggggcagtacagaattctttctccgagcagtccgcgggtgatgcatggcagcccactggtcggagaaagaacaggaaaaataaggagactgttagacatattactcagcaggtggaggacgattctcgggcttcaagccccgtgccttcctttctgcctacatccggctggccattttcctcgagggatagcaatgcagatctgtctgttaccgaagcatccagcagcgactcacgtggcgaacgggcagaactgtatgcccaggttgaggagggcctgctcggcggagaggcctcatacttgggccctccactgactcccgagaaggatgacgcccttcaccaagctaccgctgtcgcaaaccttcgcgcagcattaatgtctaagaacagtttgctctccttgaaggcggacgtgttgggcgatgatggttcactcctgtttgagtacttaccgaggggtgcccacagcctgtcccttaatgaattcactgtgattaggaaaaagtttaaatgcccctactgcagcttctctgcaatgcatcagtgtatccttaaaagacacatgcggtcccatactggcgagcggccttatccttgtgaaatttgcgggaagaaattcacaaggcgggagcacatgaagcggcacacactggtccattccaaggacaaaaagtacgtgtgcaaagtgtgttccagagtgtttatgagcgcagcctcagtgggcattcggcatggaagtcgcaggcacggggtgtgcaccgattgcgctggtaggggaatggcaggaccccttgatcacggtggcggaggaggggaaggatctccagaggctctgtttccaggagatggcccataccttgaggatcctgaggaccctcgcggagaggccgaagagttaggggaagatgatgagggcctggccccagaagacgctctgttggccgatgataaggacgaggaggactccccacgacccaggagtcctccagggggaccggataaagacttcgcatggctgtcatag

SEQ ID NO: 24931 - DNA, 342 bp, Artificial Sequence
  Description of Artificial Sequence: Synthetic coding sequence
atgtctacgattcagaatttgcagagttttgaccctttcgctgacgccacaaaaggcgacgatctcctacccgcaggtacagaggactacatccatattagaattcagcagagaaatggtcgaaaaacgttgaccactgttcaggggatagccgatgattacgacaagaagaaactggtgaaggcattcaagaaaaagttcgcttgcaatggtacggtgattgaacacccagagtatggagaagtgatccagttgcagggcgaccagaggaagaacatctgtcagttcttgttggaggtgggaatagtgaaagaagagcagctcaaggtgcatggattctag

SEQ ID NO: 24932 - DNA, 1116 bp, Artificial Sequence
  Description of Artificial Sequence: Synthetic coding sequence
atggctacccgatcgcgggaaaacgccagaagaagaggcacacccgaacctgaagaggctggccgtcgcggtggcaagagaccaaagcctccacccggagtcgcctcagccagcgctagaggtccgccagccaccgacggtttaggcgcaaaggtcaaactcgaagaaaagcagcatcatccttgccagaagtgtccgagggtgttcaataaccgatggtacctggagaagcacatgaacgtaacacactcccgtatgcagatctgcgatcagtgtggcaaacggtttctccttgaatccgaattgttgttacaccggcaaaccgactgcgagagaaacattcagtgtgttacatgcgggaaagcgttcaagaaactgtggagcctgcatgagcataacaagattgtgcacggctacgctgaaaaaaagttttcttgcgagatttgcgaaaaaaaattctataccatggctcacgtgcgcaagcacatggtcgctcacactaaagacatgccctttacatgtgaaacatgcggaaaaagcttcaagcgtagtatgtccctgaaggtccattcgctgcaacacagcggagagaagcctttcaggtgtgagaattgtaatgaacgctttcagtacaagtatcagctcaggagtcatatgtctatacatatcggccataagcaattcatgtgccagtggtgcgggaaagattttaatatgaaacagtactttgatgagcacatgaagactcacactggtgaaaaaccctacatttgtgagatttgtggtaaatcctttacaagtaggccaaatatgaaacggcaccgacgcacccataccggagaaaaaccttacccctgtgatgtgtgtggccagagattccggttctcaaacatgctgaaggcccacaaggaaaagtgctttcgagtgagccacacactggcaggcgatggagtgcccgctgccccaggtctcccccctactcagccccaagcccacgcactgcccctactgccgggattgcctcagacgctgcctccccctccccacctgcccccaccacctcccctgtttccgactacagcaagtcctggaggccgtatgaacgccaacaattag

SEQ ID NO: 24933 - DNA, 1941 bp, Artificial Sequence
  Description of Artificial Sequence: Synthetic coding sequence
atgggcaggttgaacgaacagcggctgttccagccagatttgtgcgatgtcgaccttgtgctggtgcctcagcgttctgtgttccctgcacacaaaggtgtgttagctgcatactcacagttcttccactcacttttcacacagaacaagcaacttcagcgcgtggaattatctctggaggcccttgcaccagggggtctgcagcaaattctcaactttatctatacaagcaagctcctggtgaacgccgcaaatgttcacgaggtcctaagcgcagcctcattgttacagatggccgatattgccgcaagctgccaagaactgctggacgctcggagccttggcccaccaggtcccggaaccgtggcactggcccagcctgctgcctcatgtactccagctgccccaccttactattgtgatattaagcaggaagccgatacccccggtctgcccaaaatatatgcacgggagggacccgatccatacagtgtgagagttgaggacggcgctggcactgccggaggaacagtgcccgcaacaatcgggcctgcacaaccattcttcaaggaggagaaagaaggaggggtggaagaagccggaggtccacctgcctcactctgcaagctcgaagggggagaggaacttgaagaagagcttggtggttcagggacctatagcagacgcgagcaaagtcaaatcattgttgaggtcaacttaaacaaccaaactctacatgtgtccacagggcctgagggaaagccgggagcaggccctagccctgccacagtggtgctcgggagagaagatggactccagaggcacagtgacgaagaagaggaggacgacgaggaggaagaggaggaggaagaggaagaggagggtggcggatctgggagagaggaagaagaggaagaggaggggggatcccagggggaggaggaagaggaagaagaggacggccatagcgagcaggaggaagaagaggaagagaagcaacaccatccatgccagaaatgcccaagggtgttcaataatcggtggtacctagagaaacacatgaacgtcacccacagtaggatgcagatctgcgatcagtgcgggaagagatttcttttggaatctgaactgttgcttcatcgacagaccgattgcgagaggaacatacagtgtgtgacatgcggaaaggcattcaagaaactctggtcactccatgaacataacaagattgtacacggatacgccgagaagaagttttcttgcgagatttgtgagaaaaaattttacactatggcccatgtgaggaaacatatggtggcgcacacgaaagacatgccattcacatgcgagacgtgcggcaaatccttcaaaagaagcatgagcctgaaggtgcactccctgcaacactctggagaaaagccttttcgatgtgaaaattgcaacgagcggtttcagtacaaataccagctaaggagccacatgagtattcacatcgggcacaagcaattcatgtgtcagtggtgcgggaaggattttaacatgaaacaatactttgatgaacacatgaaaacccatacaggggagaaaccctatatctgcgaaatctgcgggaagagttttaccagtagaccaaacatgaaaaggcacaggcgtacgcatacaggtgagaaaccttacccatgtgatgtctgtggccagcgctttcgcttttccaatatgctgaaggcacacaaggaaaaatgcttccgcgtgagccataccctagcgggagacggggtccccgcagcccctggcctcccgccaacacagccccaagcgcacgcactgcctctgcttccaggactgccacagactttgcctcctccccctcatcttcccccacccccacctctgttcccaacgacagcaagtccaggcggacgcatgaacgccaataactag

SEQ ID NO: 24934 - DNA, 2298 bp, Artificial Sequence
  Description of Artificial Sequence: Synthetic coding sequence
atggacccggttgccacccactcttgccatctattacaacagctgcacgagcagcgcattcagggcctgttgtgcgactgcatgctcgttgtgaaaggagtctgtttcaaagcgcataagaacgttttagctgctttctcccagtattttcggtctcttttccagaattcttcgtcccaaaaaaacgatgtgttccatctcgacgtgaagaatgtgagcgggatcgggcagatcctagactttatgtacacctcccatctggacctgaaccaagataacatccaggttatgctcgacaccgcccaatgtctccaggtccagaatgtcttgagcctttgtcataccttcctgaagtccgccaccgttgttcagcccccaggtatgccttgtaacagtacactgtctttgcaatcaaccctgaccccagatgctacatgtgtgatatctgaaaattacccccctcatttactgcaggagtgttccgcagatgcacagcagaacaagactctggacgaaagccaccctcacgcctctccttccgtcaaccgccaccattccgccggagagatctcaaagcaggccccagacacttctgatgggagttgcaccgagctgcctttcaagcagccgaattattattacaagctccgtaatttttacagcaaacagtaccacaagcatgcagcgggtccctctcaggagcgggtagtcgagcagccgtttgccttctcaacatctacagatctcacaacagtggaaagtcagccctgcgctgtatcccactccgaatgcatcctggaaagccccgagcacttgcctagcaatttcctggctcaacccgttaatgactcagccccacatccagaatcagatgctacatgccagcaaccggtgaagcaaatgaggctgaaaaaggctatccacctcaagaaacttaattttcttaaatcccagaagtatgctgaacaggtatccgaacctaaatccgatgatggccttaccaagcgactggagtcagccagcaagaataccctcgagaaagcttcatcacagagcgccgaggaaaaggaatctgaagaagtcgtctcttgtgagaacttcaattgtatcagcgagaccgagcgccctgaggaccctgccgcactggaggaccagagccagacgttgcagtcacaacgacagtacgcttgtgagctgtgcgggaagccattcaagcatcctagcaatctggaactccacaagcgctcccacaccggagagaagccgttcgaatgtaatatttgtggcaaacacttttcccaggcaggaaatttgcagacacacctccggagacatagcggagagaagccctacatatgtgagatatgcggaaaaaggttcgctgctagcggggatgtgcagagacatatcatcattcatagcggggagaagcctcacctctgcgacatttgtggacgaggattttctaatttcagcaatctcaaagaacataagaagacacacaccgcagacaaggtgttcacctgtgatgaatgcggaaagtcctttaacatgcagaggaagctggttaaacatagaattcgccataccggtgagcgtccatattcttgctctgcttgcgggaaatgtttcggtggttcaggtgacctgcgtcggcacgtgcgtacccacacaggtgagaaaccctacacttgtgagatatgtaataagtgttttacacgaagcgccgtgctaaggagacataagaagatgcactgcaaggcaggcgatgagagtccggacgtgctagaagagttatctcaagcgatagagacatccgacttggaaaaaagccagagcagtgactctttcagtcaggacacatccgtcacactgatgcctgtgtcagtcaaattacccgtacaccccgtggaaaactccgtggccgagttcgacagtcactcaggcggttcctattgcaaactacgatccatgatccagccacatggagtcagcgaccaggaaaaacttagcctggacccagggaagctggccaagccacagatgcaacagacacagcctcaggcttacgcctactctgatgtggacacacccgcaggtggggagccactccaggcagacggaatggccatgattaggtccagcctggccgcattggacaatcacggaggggaccctctgggaagccgtgcttcctccacgacctataggaatagtgagggacaattcttctcttccatgacgctgtggggcctcgcaatgaaaactctgcagaacgagaacgagctcgatcagtag

SEQ ID NO: 24935 - DNA, 1932 bp, Artificial Sequence
  Description of Artificial Sequence: Synthetic coding sequence
atggacccagtcgccacgcattcctgtcacctgctacagcagttacacgaacaacgaattcagggccttctctgtgactgcatgctggtggtgaagggggtttgctttaaggcacacaaaaatgttcttgcagcattctctcagtacttccgatccctgttccagaatagttcttctcagaagaatgatgtctttcatttggatgttaaaaatgtcagcggcatcggccagatcctcgacttcatgtacacttctcatttagatctcaatcaggataacatacaggtgatgctggataccgctcagtgcttgcaagtccagaatgtcctatctctgtgtcacacatttctcaagtccgccacagtggtgcaacctcctggaatgccttgtaattccactctgagtctgcagtccaccctgacccctgacgctacatgtgtgatttcagagaattatccaccccatctcctacaagagtgttccgccgatgcgcagcagaacaagaccttggacgaatctcacccacatgccagcccctctgtgaacagacaccatagcgccggagagatctccaagcaggcacctgacaccagcgatggcagttgcacagagctgccttttaagcagcctaactattactataagctgagaaatttttactccaagcagtaccacaagcatgcggctggtccatcacaggagcgcgttgtggaacaaccttttgcgttcagcacctcgacagatctcactactgtggagagccagccctgtgccgtaagtcactcagaatgtatactggaatcacctgaacacttaccttcaaattttctggctcaacctgtgaacgatagcgcacctcatcccgagagcgacgctacctgccagcagcctgttaaacagatgcggctcaaaaaagccatccatttaaagaaattaaatttcctgaaatcgcagaagtacgccgaacaggtaagtgaacccaagtctgatgacggtctgaccaagagactggaatctgcctctaagaacactctagagaaagcgtcctcacaatcagccgaggagaaggagagtgaagaggtagtaagttgcgagaattttaactgtatctccgagaccgaaagaccagaagacccggcagcactagaagatcagtcccagacactgcagtcacaaagacaatacgcctgtgagctgtgcggtaaaccctttaaacacccaagtaacttggagcttcataaaaggagtcacacaggaaagtgcttcggcggatcaggagatctgcggcgacacgtccggacccacaccggcgaaaagccctatacgtgcgagatctgtaataaatgctttacccggtccgcggtacttcgccgacacaagaagatgcactgcaaggccggtgatgaatcccccgatgtgcttgaagaattaagccaggctatcgagacctccgacttagaaaagtcgcagtcttcggatagcttctcacaagacacctctgtgactctcatgcccgtgtctgtcaagctgcccgtgcatcccgtggagaacagcgtcgctgaatttgacagccatagcggagggagctactgcaagctgcgatcaatgattcagcctcatggggtatcagaccaagaaaaactgagtctggaccccggaaaactggccaagccacagatgcaacagacccagcctcaggcgtacgcatattctgatgtagatacacccgctggaggagagccactgcaggcagatggcatggctatgataagaagctccctcgccgctctggacaaccatgggggtgatcctctcggttctcgggctagctcaacaacgtacaggaactctgagggccagtttttttctagtatgactctgtggggcctggccatgaaaacactgcagaacgaaaatgagctggatcagtag

SEQ ID NO: 24936 - DNA, 441 bp, Artificial Sequence
  Description of Artificial Sequence: Synthetic coding sequence
atggaccccgtggcgactcactcttgccacctcctccagcagctgcacgaacaaagaattcagggactgttatgcgattgtatgttggttgtgaagggggtgtgttttaaggctcataagaatgtgttggccgctttcagtcagtatttccgcagcctgttccaaaacagcagttcccagaaaaacgacgtgttccatctcgacgtcaaaaacgtaagcggaataggccagatcttagattttatgtacacttcccatctggacctgaaccaagacaatatccaggtaatgctggatactgcgcagtgcctgcaggtacaaaacgtcttgagcctgtgtcataccttcttgaaaagtgctacggtggtgcagcctcccggaatgccatgcaatagcacactctcgcttcagagcacccttactcccgatgcaacttgctag

SEQ ID NO: 24937 - DNA, 747 bp, Artificial Sequence
  Description of Artificial Sequence: Synthetic coding sequence
atgcagcggaaactagttaagcacaggattaggcacaccggcgagaggccctactcgtgttcagcttgcggcaagtgttttggcggtagcggggacctgcggcgtcacgtgagaacccacacaggggaaaaaccctatacctgcgagatctgcaacaagtgcttcacacgctcagctgtgctgcgtcggcacaaaaaaatgcactgcaaagcaggcgatgaaagccctgatgtcctggaggagttatcacaagcaatagagacctctgacctggagaaatcccagagctctgactcgtttagtcaggacactagtgtcaccctgatgcccgtgagcgtcaaattacctgttcaccccgtggagaattccgtggcagagtttgattctcactcaggagggtcgtattgcaaactccgttcgatgattcagccacatggcgtgagtgatcaggaaaagctttctctcgacccgggaaagctcgctaaaccacagatgcagcaaacccagcctcaggcgtacgcctattcagatgtggacacaccagctggcggagagccactgcaagccgacggcatggctatgatccggtcttccctggcagctttagataatcacgggggagatccactcgggagtagagcctcctcaaccacgtaccgcaatagtgaggggcagttcttcagttcaatgaccctgtggggtcttgcaatgaaaacactccagaatgagaacgagcttgatcagtag

SEQ ID NO: 24938 - DNA, 2034 bp, Artificial Sequence
  Description of Artificial Sequence: Synthetic coding sequence
atggactttcctggacactttgaacagatttttcagcagctcaactaccagaggttgcacgggcagctctgcgattgcgtgatcgttgtggggaacagacattttaaggcacacagatcagtgctggctgcctgttcaacccacttccgggcactcttttcggtggcagagggcgaccaaacaatgaatatgatccaactcgatagcgaggtggtcactgctgaggccttcgcggctctgattgacatgatgtacaccagcaccctgatgctcggggagagcaatgttatggatgtgctgctggcagcctcacacctccacctgaactcagtggttaaagcttgcaaacactatctgaccacccgaacactccccatgtctccgccttcagagagggtgcaggagcaatcagccaggatgcagcggtcatttatgctgcagcagcttgggctgtccattgtgtcgagtgctttgaactctagccagaatggtgaagaacagccagcgcctatgtctagttctatgcgttcaaacttggatcagcgaaccccatttccgatgcgacgcttgcacaagcggaaacagtcagcagaagagagagccagacagaggttgaggccttccatcgacgaatccgctatcagcgacgtgacacctgagaatggcccatccggagtccatagtcgggaggagttcttcagcccagattcattgaaaattgtagataacccaaaggctgacggcatgaccgataatcaagaagactctgcaattatgtttgaccagtccttcggtactcaggaggatgcgcaagtgcccagtcagtcagacaatagcgctgggaacatggcacaactgtccatggcttcacgggctactcaggttgaaacgtctttcgaccaggaggctgccccagaaaagtcctcatttcagtgcgagaatccagaggttgggcttggagagaaggaacacatgagggtggtcgttaagagcgagccgttgtcctctcctgagcctcaggatgaagtctccgacgtgacatcccaggctgaggggagcgagagcgtggaagtggagggggtagttgtcagcgctgaaaagattgacctcagcccagagtcctctgataggagcttttccgatccacagagctccacagatcgggtgggggacatccacatactggaggtcactaataatctggagcataagtcaaccttcagcatcagcaattttctgaataagagccggggaaacaatttcactgcaaatcaaaataacgacgataacattccaaatacaactagcgactgtcgactggaatccgaggctccttacctgttgagtcccgaagctggcccagcaggaggcccttcttctgcaccaggatcgcatgtggagaaccccttcagcgagcctgcagacagccactttgttcgtcccatgcaggaagtgatgggcctgccttgtgtccaaacttcaggataccaaggaggagaacagttcggaatggacttcagtaggtccgggcttggactacactcttcctttagccgcgtaatgataggttcacctcggggaggagccagtaacttcccatattataggcgtatagcgcctaagatgcccgtagtaacgtcagtgagaagctctcaaatccccgaaaactcaacatctagtcaactcatgatgaacggggctacgagcagctttgaaaacggccacccatctcagccaggtcccccacagttgacccgagcgtccgctgacgtcctgagtaagtgtaaaaaagctctaagtgagcacaacgttctggttgtggaaggtgcgagaaagtatgcatgtaaaatctgctgcaagacattcctgaccttgaccgattgcaagaagcatatccgggttcacactggcgagaaaccctacgcttgcctgaagtgcgggaaacgcttcagccagtcctctcacctctacaaacacagtaagacaacctgtttgcgatggcaatcgtcaaatctgccatcgaccctgctctag

SEQ ID NO: 24939 - DNA, 1275 bp, Artificial Sequence
  Description of Artificial Sequence: Synthetic coding sequence
atggccgcagaatcagatgtgctgcatttccagtttgagcaacagggagacgtcgtcctgcagaagatgaatctcctgcgacagcagaaccttttttgcgatgtcagcatctatatcaatgataccgaatttcagggccataaggtaattcttgcagcctgtagtactttcatgcgcgaccaatttctgctgacccaaagtaagcacgtgcggatcaccatactccagagcgcagaagtgggtagaaagttgttactgagttgctacacgggcgcactggaagttaagaggaaagagctactgaagtacctcaccgctgcctcttatttgcagatggtacacattgtcgaaaagtgcactgaggccctatctaagtatttggagatcgatttgtcaatgaagaacaataaccaacacacggatctttgtcagtcgtcagatcccgatgtcaaaaatgaagacgaaaattctgataaggattgcgaaatcattgagatcagcgaagactcgccagttaacatcgactttcacgtgaaggaggaggagtctaacgccctgcagtcaacagtggaatccctcacctctgaacggaaagagatgaagagcccagagctcagcactgtggatataggattcaaagacaatgaaatctgtatactgcacgtcgagtccatatctaccgcaggtgtagaaaacggccagtttagccagccatgcacctccagtaaggcttctatgtacttttccgagactcagcattcgctgataaattctaccgtggagtcaagggtggctgaggtgcctggcaatcaggatcaagggttattttgcgagaacaccgagggttcatatgggactgtcagtgagattcagaatctggaggagggttattcgctacgtcatcagtgtcctcggtgtccccgtggattcctgcacgtcgagaactatttgaggcacctgaaaatgcacaagctgttcttgtgcttgcaatgcggtaaaactttcacgcaaaaaaaaaacttaaatcgacatattagagggcacatgggaatccggcctttccagtgtactgtgtgccttaaaacgtttaccgcaaagtctacccttcaggaccaccttaacattcacagtggcgacaggccttacaaatgtcactgttgcgacatggacttcaagcataagtcggcgctgaagaagcacttgaccagcgtgcatggtaggtcctcaggcgagaaactaagccgccctgacctaaaacgccagagcctcctgtag

SEQ ID NO: 24940 - DNA, 1755 bp, Artificial Sequence
  Description of Artificial Sequence: Synthetic coding sequence
atggcaggaggcgtggacgggcctattggaatcccctttcccgatcacagcagcgatatactgtcaggattaaatgagcaaaggacccagggactactgtgtgatgtagtcattctggtagagggcagagaatttcccacccacaggtctgtccttgcggcatgcagccagtatttcaagaagctgttcacatctggcgcagtggtagatcagcagaacgtgtatgagatcgactttgtcagcgccgaggcactgacagcactgatggactttgcgtacactgctacactaacggtttccacagcaaatgttggtgacattctttctgccgcacggctgctggaaatccctgcggtgagccacgtttgcgccgatttactggatagacagatcctggcagctgatgcaggggcagatgccggacagctggatctcgtcgaccagattgaccagaggaacctccttcgcgctaaagagtacttggagttcttccagtccaatccaatgaattcactcccaccagccgctgcagctgccgcagcctcctttccatggtccgcttttggggctagtgatgatgacctggacgcaacaaaagaagccgttgctgctgcagttgctgccgtggccgcaggagattgtaacgggctggacttctatggcccaggccctccagcagagaggcccccaacaggtgatggagatgaaggtgactctaaccctggattgtggccagaacgagatgaggatgcaccgacaggagggctcttcccacctcccgtggcgccacccgctgctacccagaatgggcactatggcaggggcggtgaggaggaagccgcaagcctgtccgaggccgcacctgaacctggagattcccccggatttctatcaggcgctgctgagggcgaggacggcgacggacccgatgtggatggcttggctgcgtccacgcttctgcagcagatgatgtcatccgtgggtagagccggagccgctgccggtgattccgacgaagagtccagagccgacgacaagggggtcatggattattatttgaagtatttctctggcgctcatgacggggatgtttacccagcgtggagtcagaaagttgaaaagaagataagagctaaagctttccagaaatgtcctatctgtgagaaagtcatacagggagcaggtaagctcccccgacacatccgcacccacacgggtgagaaaccttacgaatgtaacatatgcaaagtgaggtttactcgccaggacaaacttaaggtccacatgcgaaaacacactggcgagaagccgtacttgtgccaacagtgtggagctgccttcgcacataactatgatctgaagaaccacatgagggttcacacaggccttcggccttaccagtgtgactcctgttgcaagacatttgttcgcagcgaccacttgcatcggcaccttaagaaagacggctgtaatggagtgcccagccgtagaggacgaaaaccgcgagtcagaggaggagcccctgatcccagcccaggcgctactgccacccccggagcgccagctcagccatcaagccccgacgccaggcggaatgggcaggaaaagcactttaaggacgaggacgaggatgaagacgttgcaagccccgacgggctcggtcgtctaaacgtggcaggagccggagggggtggcgactctggcggaggtccaggcgctgcgacagacggaaatttcaccgcagggcttgcctag

SEQ ID NO: 24941 - DNA, 1620 bp, Artificial Sequence
  Description of Artificial Sequence: Synthetic coding sequence
atgggctctcccgaggatgatctgattgggataccatttcctgaccattcctctgaactgctgtcttgcctaaacgagcagcgacagttggggcatctttgcgatctgactatacgaactcaaggccttgagtatcgtacacaccgcgctgtgctggcagcctgctcacattactttaagaagctcttcacagaggggggaggcggagccgtgatgggcgcaggcggttcagggacagctactgggggtgccggtgctggcgtgtgtgagctcgatttcgtcggaccagaggcattaggggctttacttgagttcgcgtacacggccactctgacaacaagcagcgctaacatgccagccgtgctccaggccgctcggctgttggaaataccatgtgtaatagccgcttgcatggagatcctgcaaggatccggcttggaagccccttctccagatgaagacgactgcgagcgagctcgccagtatctcgaagcctttgctaccgccactgcctccggggttccaaacggagaggattctcccccacaggtgcccctgccccctcctccgcctccccctccccgaccagtggctcgacggagccgtaaacctcgcaaggcattcctgcagactaaaggtgctagagcgaatcatttggtgccagaggttcctactgtaccagcacacccattgacctacgaggaggaagaagtggcaggaagggttggctcatcggggggaagcggaccaggcgactcatacagccccccaaccggcacagcatcaccccctgaaggcccacagtcctatgaaccgtacgaaggtgaggaagaggaggaagaactggtttatccacctgcctatgggctagcgcaggggggaggccctcctctttctcccgaggagttgggatccgatgaagacgctatcgaccctgacctgatggcctatctgtcatccctgcatcaggataaccttgcccctggcctcgacagtcaggacaaactcgtgagaaaaaggagaagtcaaatgccccaggagtgccctgtgtgtcataagatcatccacggagcaggaaaactgccacgacacatgcgcactcataccggggagaagccatttgcgtgtgaggtgtgtggcgtccggtttaccagaaatgacaagctcaagatccacatgagaaaacacacaggcgagcggccatattcctgtccccactgccctgccagattcctgcacagttatgatctcaagaaccacatgcatctgcacactggcgacagaccgtacgaatgccacctctgtcacaaagcattcgccaaggaagaccatctgcagagacatttaaaggggcagaactgtctcgaggtgcgcactcggaggcgccgtaaagatgatgcaccccctcactacccccctcctagtacagcagccgcatctcctgccggtttagacttgtctaacggtcatctagatactttcagactgtcccttgctcggttttgggagcagagcgctccaaccggcccaccagtcagcacacccggacccccagatgatgacgaggaagagggcgctcctaccaccccgcaagcggaaggagctatggagtcctcctag

SEQ ID NO: 24942 - DNA, 1620 bp, Artificial Sequence
  Description of Artificial Sequence: Synthetic coding sequence
atgggatctcccgaagatgatttgataggcatcccctttcccgaccattcctccgagttactgtcatgcttaaacgagcagaggcaactgggccatctttgtgacctcactatccggactcaaggcctggagtacaggacccaccgtgccgtgctggccgcttgcagccattacttcaagaagctttttacggaaggcggtggcggagccgtaatgggggcaggcggatcaggcacagcaaccggaggagcgggtgcaggcgtttgtgagctcgatttcgttggcccagaagcacttggcgcactgctcgaattcgcttacacagccaccttgaccactagcagcgctaacatgccggcagtgctgcaggctgcaaggcttctcgagatcccctgtgtgatcgcggcttgcatggagatcttacagggctcggggctggaggctccaagtcctgatgaggacgactgtgagagagcacgacagtacctggaggcattcgctaccgctacagcttcaggtgtacccaatggcgaagatagtccccctcaagtccctcttcctcctccccctcctccaccccctaggcccgtggcccgtcggagtcgcaagccacgtaaggccttcttgcagaccaagggtgcccgagctaaccacctggtccccgaggtgcctactgtgcccgctcatcctttaacctacgaagaagaggaagtagcagggagagtgggaagtagtggcggaagtgggcctggagactcctacagtccccctaccgggaccgcctcccctccagaaggcccacagagctacgagccttatgagggcgaggaggaggaggaggagttggtgtacccgccagcctatgggttagcgcaaggcggtggccctcccctaagccccgaggagcttgggtccgacgaagatgcaatcgatccagacctcatggcctacttgtcctcactgcaccaagacaacctggctcccggactggacagccaggacaaactagtaagaaagagaagaagtcagatgccccaggagtgccccgtgtgtcataagatcattcatggggcaggcaaactgccacggcacatgcgcacccatacgggggagaaaccattcgcttgtgaggtgtgtggagtgaggttcacacggaatgataagctgaaaatccacatgcggaaacataccggcgaacgaccttattcttgtccccactgcccagctagatttctgcatagttacgatcttaaaaaccacatgcatctacacaccggggataggccctatgaatgccacctctgccacaaagctttcgcaaaagaagaccacctgcagcgccacctgaagggacagaactgcctggaggtacggactaggagaagaaggaaggacgatgctccacctcattaccctccaccgtctaccgccgctgcttcccctgccggactcgacctcagcaatgggcacctcgataccttcaggcttagcctggccaggttctgggaacagtcagcaccaaccggccctcccgtcagtacccccggaccccctgacgatgacgaggaggagggagctcctaccacacctcaggcggagggcgctatggagtctagttag

SEQ ID NO: 24943 - DNA, 1722 bp, Artificial Sequence
  Description of Artificial Sequence: Synthetic coding sequence
atgctacagcccggtccccatcccccttcaccacaggctgccgctcctggagaagcatggccaggcccttctcaggccccatggcagagtttggaggaaaagatggggagccccgaggacgatttaataggaatacctttccccgatcacagcagcgagttgttgtcgtgtttgaatgaacagagacagttggggcatctatgcgacctgacaattcggactcagggtctggaataccggacccaccgggctgtcctcgccgcatgctctcattattttaagaagctgttcacagaagggggaggcggtgcggtcatgggggctggcggaagtggcactgctactgggggtgccggtgccggagtatgcgaattagactttgtggggccagaggccctgggcgcactgctggagttcgcatacacggccaccctcactacctcaagtgcaaacatgcctgccgtcctgcaggcagcaagacttctggagatcccctgcgtgatcgctgcatgcatggagattctgcaagggtcaggactggaggcgccttccccagacgaggacgattgcgagcgtgccagacagtacctcgaagcttttgccactgccacggcctctggggtgccgaatggagaagattcgccaccgcaggtgccactcccccctcctccgccaccacccccacgtcccgtggctcgccgaagtaggaagcccagaaaggcctttctgcagacaaaaggtgccagagccaaccacctagtgcccgaggtacccacagttcctgcacaccccctaacttacgaggaagaagaagtcgccggaagagtggggtcctctggcggatcaggtccgggtgactcctactcacccccaaccggtactgcctcaccacccgagggccctcaatcttacgagccttacgagggagaagaggaggaggaggaactggtgtacccaccggcatatggactggcacagggaggagggcctcctctctcccccgaggaacttggaagcgacgaagacgccatcgaccccgatctgatggcctacctgtccagcctacaccaggataatctggcccctggattagattctcaggacaagctagtgagaaagcggagaagtcagatgcctcaggaatgtcccgtgtgccataaaatcatccatggtgccggtaagctgcctcgacacatgcgcacccacactggcgaaaagccttttgcctgtgaagtctgtggtgttaggttcacaaggaatgacaagctgaagattcacatgcgcaagcacacgggcgagaggccctactcatgccctcactgtcctgcgaggttcctccactcatacgacctgaagaaccacatgcatcttcacacaggagacaggccctatgaatgtcacctttgccataaggccttcgccaaagaggaccatctgcagaggcacctcaaaggacaaaattgtctcgaagttcgcacacggaggcgcaggaaagacgacgctccaccgcactatcccccaccgtcaacagctgccgcaagcccggcaggacttgatctgagcaacggccatctcgatacatttaggctaagcctggctagattttgggaacagtcagccccaactgggccaccagtttctacgccagggcctccagacgatgacgaagaagagggagcccctactacacctcaggcagaaggagccatggagtcctcatag

SEQ ID NO: 24944 - DNA, 1620 bp, Artificial Sequence
  Description of Artificial Sequence: Synthetic coding sequence
atgggaagtcctgaggacgacttgatagggatccccttcccagaccactcctcagagcttttgagctgtctgaacgagcagcgacaattgggccatctttgtgatttgacaatccgcacacaggggctagagtatcggacccatagggctgtcctcgctgcctgttctcactactttaaaaaactgttcaccgaagggggtggtggcgctgtcatgggggctggtgggagtggcacggcaactggcggtgcaggagcaggcgtgtgtgagctggactttgtgggtcccgaggccctgggggctctgctggagttcgcctacacggctacattgacaaccagttccgccaacatgcccgcagtcctgcaggcagcaagattgttggagatcccctgtgtgattgccgcatgtatggagatcctgcaaggctctggcctggaagccccaagccctgatgaggacgattgcgaacgagccagacagtaccttgaggcatttgctaccgccacagcatctggcgtgcctaatggggaggactctccgcctcaggtcccactgcctccacctcccccacctcctcccaggcccgtggcgcgaaggagtcggaagcctcggaaggccttcctccagacaaaaggcgctagggcgaaccatctcgtccccgaagtgcccacagtgccagctcacccattgacttatgaagaagaggaagtagctggacgggtcggaagtagcggaggctctggccctggtgactcctactcaccacccaccgggacggcgagcccgcctgaaggaccccagagctatgagccatatgaaggggaggaggaggaagaggaactggtctatcctcctgcctatggacttgcccagggcggaggccctccacttagccccgaagaactgggctcggacgaggatgccattgatcctgatttgatggcctacctatccagccttcaccaggataatcttgctcccggtctggacagccaggataagctggtgaggaagcggagatctcagatgcctcaagagtgtcctgtttgtcacaagatcatacatggcgctggaaaattaccaagacacatgagaacacataccggcgaaaaacccttcgcctgtgaggtgtgtggcgtgaggtttacccggaacgataaactgaagattcatatgcgcaaacacactggggagcgcccatacagctgtccccattgccccgctcggttcctacactcatacgacctcaagaatcacatgcatctccatactggcgacagaccgtacgagtgccatctttgccacaaggcctttgctaaggaggaccacttgcagcgccatctgaagggacagaattgtctcgaagtgagaaccagacggcgtcgcaaggatgatgctccgccacattacccccctccttctacagctgccgcttcgcctgctggtttggacctttctaacggacacctagatacctttcgactctcccttgcccgattttgggagcagtcggcaccaacaggccctcccgttagcacaccgggacctccagatgatgacgaggaggaaggagcaccgacaactcctcaggcagaaggcgctatggagtcttcatag

SEQ ID NO: 24945 - DNA, 1023 bp, Artificial Sequence
  Description of Artificial Sequence: Synthetic coding sequence
atggagatttccagtcaccagagtcacctgctgcaacagctaaacgagcaacgaagacaagatgtgttctgcgactgctctatactagtggaggggaaggtgttcaaggcacaccgcaatgtgcttttcgcatcctcaggctattttaagatgctgctgtcccagaattctaaagagacttctcagcccaccacagcaacattccaggcttttagcccggatactttcaccgtcatcttagattttgtatactcggggaagctgtcgctgactgggcaaaatgttatagaggtcatgtcagctgctagcttcttgcagatgaccgatgtgatttccgtttgtaaaactttcatcaagagttcactggatatctcagagaaagagaaagatcggtattttagcctatccgacaaggacgctaatagcaatggtgttgagcggtcatccttttattccggtggatggcaggaaggctccagcagtccgcgttctcacctcagccctgaacaaggaaccgggatcatttctgggaaatcgtggaataaatacaactaccatcccgcttcccagaaaaacactcagcagcccttagctaagcacgaacccaggaaggaatccataaaaaaaaccaaacaccttcgattatctcagccaagcgaggtgacccattacaagagtagtaagcgcgaggtgcgcacgtcagactcaagctcccacgtgagccagtccgaggagcaagctcagattgacgccgagatggacagcacaccagtggggtaccagtatgggcagggctccgacgtgacatcaaaatcattccctgatgatctaccccgaatgcggtttaaatgcccgtactgtacgcacgtggttaaaagaaaggccgacttgaagcgacacctacggtgccacactggcgagcggccatacccctgccaggcttgtggtaagcgcttttcgcggctggaccacctgagcagccacttccggactatggaaatcaggatcccggacggcacctag

SEQ ID NO: 24946 - DNA, 1326 bp, Artificial Sequence
  Description of Artificial Sequence: Synthetic coding sequence
atggagattagttcccatcagtctcaccttctacaacagttgaatgagcagcgtagacaggatgtgttctgcgattgctctatcttagtggaaggcaaggtgttcaaagcccaccgcaatgtgctgtttgccagtagtggttactttaagatgttacttagtcagaattctaaggaaacaagccagccaaccactgccacgtttcaggcgttctcacccgacacttttaccgtcatcttagactttgtgtactctggcaagctgtccttgacaggacagaatgtgatcgaggtaatgtcagccgctagttttctccagatgacagacgttatctctgtctgcaagacctttatcaagtcctccctcgacataagcgaaaaagagaaggataggtatttctctctcagcgacaaggacgcaaattcgaatggagtcgaacgctcttcattttacagcggtgggtggcaggaaggatccagtagccctaggtcccacctgagcccagagcaagggactggtattatcagcggcaagagctggaataagtacaattaccaccccgcaagtcagaagaacacgcagcagcccttagctaagcatgagcctagaaaggagtctattaagaagactaaacaccttcgactgagtcagcctagtgaagtcactcactacaagagttccaaacgggaagtacggacgtcagactcctcctcccacgtctctcagagcgaagaacaggcccagatcgatgcggaaatggactctaccccagttgggtatcagtacgggcaggggtccgacgtgacaagtaaatcattccctgacgaccttccgaggatgcgctttaaatgtccctactgtacccacgtggtcaagcgaaaggccgatctcaagcggcatcttcgttgccatacgggagaaagaccctatccctgccaggcctgcggcaagagatttagtcgtctcgatcacttgtcttcacacttcagaaccatacatcaggcctgtaagttgatctgcagaaagtgcaagagacacgtcaccgaccttacagggcaggtagtgcaggaggggactagaagataccgcctctgcaatgaatgcttggctgaatttggcattgacagtctaccgatcgaccttgaggccgagcagcacttgatgtctcctagcgatggtgacaaggactctaggtggcatctatcggaggacgaaaataggtcatatgtcgaaatagtcgaggatgggtctggggacctggtcattcaacaggtcgacgactctgaggaagaggaggagaaagagatcaaacccaacattcgatag

SEQ ID NO: 24947 - DNA, 1488 bp, Artificial Sequence
  Description of Artificial Sequence: Synthetic coding sequence
atggagatgcaatcctactatgcgaagcttctaggcgagctgaacgagcagcgcaagagagatttcttctgcgactgttcgataatagtggaagggcgtatctttaaagctcatcggaacatcctgttcgccaattctggctattttagagcattacttattcattatatccaggattctggcaggcatagcacagcatcacttgatatcgtcacctcagatgccttctctataatcctcgattttctgtacagcgggaagctggacctctgcggggagaatgtgatcgaggttatgagcgccgctagctatctgcagatgaatgatgtcgtaaatttctgtaaaacatacattagatcttccctcgatatatgccggaaaatggaaaaggaggccgcagtggccgctgccgtagcggctgccgcagccgctgcagccgctgcggcagccgctgctgcccatcaagtagactctgaaagccccagcagcggacgcgaaggcacctcttgcgggactaagtcgcttgtgagctcccccgctgagggagagaagagtgtcgaatgcctaagggagtccccatgcggtgactgcggggactgccaccctctggaattggtagtgcgggacagtctcggtggcggtagcgcagacagcaatctgagtaccccccctaagcgtatcgagcctaaggtggaatttgacgccgatgaagtagaagttgatgttggcgagcagctgcagcagtatgccgctccactgaacctggctcacgttgaagaagcccttcccagtggtcaagccgttgacctcgcctactccaactatcacgtgaaacagtttcttgaagcactgctgcggaacagtgcggctccttccaaagacgacgccgaccatcacttctctagaagcctggaagggaggcctgagggcgctggggtcgcaatgagcagtatgatggacgtgcaagccgactggtacggagaggatagcggcgatgtgctggtggtacccataaagctgcataaatgcccattttgtccatataccgccaagcagaagggaatactcaaacgtcacattcggtctcacaccggggagagaccgtacccatgtgaaacatgcgggaagcggttcactaggcaggagcacctgagaagtcacgcgttgtctgtacaccgcagcaacaggcccatcatttgcaagggctgtaggcggacatttacatcccacctctcccaggggctacggaggttcgggttatgcgattcctgcacttgcgtcaccgatactcccgacgacgacgacgatctgatgcctattaacctttccctggtggaggcctcctccgaatcacaggaaaaaagcgacacagacaacgattggcccatctatgtggagtctggggaggagaacgaccccgctggagatgattctgatgacaagccacaaatccagcccaatctgtctgatagagagaccctgacatag

SEQ ID NO: 24948 - DNA, 1422 bp, Artificial Sequence
  Description of Artificial Sequence: Synthetic coding sequence
atggagacgcccacccctctgcctcccgtccctgcgtcacctacatgtaacccagctccacggacaatccagatagagttcccacagcattcttcgtctcttcttgagtccctaaatcgccatcgactggagggtaaattttgcgatgtgtcattgcttgtgcagggacgagaactaagggcccataaggccgttctggctgctgcctcgccttactttcacgacaagctactgcttggcgatgccccacgtctaaccctgcccagtgtgattgaggctgatgcctttgagggcctgctccaactcatatactccgggaggctgcgtctgccgttagacgcccttcctgctcatctattggtagccagcggattgcaaatgtggcaggtagttgatcagtgttctgagatcctgcgagagctggaaactagcggtggcggaataagcgctcgcggaggaaatagctaccatgccctgctctccaccacaagttccactggagggtggtgcattcggagcagtccgttccagacaccagtacagagttcagctagtacggaaagcccggcaagtacagaatctcccgtcgggggagagggatctgagctgggagaagttttgcagattcaggtcgaggaggaagaggaagaagaagaagatgacgacgatgaggatcaaggttctgctaccctcagccagacaccgcaaccccagcgcgtgtctggtgttttcccacggcctcatggccctcatccgctcccaatgactgccactccacggaaactgcccgagggcgaatctgcgcctttggagctcccggctcctccggcactgcctcccaagatattctatatcaagcaggaaccgtttgagcctaaagaggagattagcggcagtggtacacagccaggaggcgctaaagaagagactaaagtattcagcggcggagatactgaagggaatggggagctgggctttctgctgccatctggacccggacctacgagcggtggagggggaccctcgtggaaacctgtcgatctgcacgggaacgaaatcctaagtgggggaggcggaccagggggagccggacaggccgttcatggccctgtgaaactgggcggaacacctcccgctgatggcaagcgctttggatgtctgtgcggcaagagattcgccgtcaagccaaagcgcgacagacacatcatgttgacattttcacttaggccttttgggtgtggcatttgcaacaagaggttcaagctcaagcaccatctaacagaacatatgaaaacccacgccggagcactgcatgcgtgcccacattgcggcagacgtttcagagtgcacgcgtgctttttgaggcaccgcgatctgtgtaaagggcaaggatgggctacggcccattggacatacaaatag

SEQ ID NO: 24949 - DNA, 1422 bp, Artificial Sequence
  Description of Artificial Sequence: Synthetic coding sequence
atggaaaccccaaccccccttccacctgtgcccgcatccccaacatgtaacccggcaccccgaaccatccaaattgaattccctcaacactcatcttccttgctggagtctcttaatagacatcgcctagaggggaagttctgtgatgtcagcctgctcgtgcagggaagagaactcagggctcacaaggcagtactggcggctgcctcaccctactttcatgacaaattgcttctgggcgatgcccctcggttaacactcccaagtgtcattgaagccgatgccttcgaggggttgcttcagttgatatacagcggccgtttacggttgccattggacgcattgcctgcccatttgttggtagcttcggggttgcagatgtggcaggttgtggatcagtgcagtgagatactgcgggaattggagacctccggcggtggcattagcgcccgaggcggaaactcataccatgctttgctttctaccaccagcagtacaggtggctggtgcatccgctccagtcccttccagacccccgtgcagtctagtgcaagtacggagagccctgcctctactgagagcccagtgggcggagagggatctgagctcggtgaggttctgcagattcaggtagaggaggaagaagaagaggaggaggacgatgatgatgaggaccagggaagcgcaacgctctcgcaaacaccacagccgcagcgagtctcaggcgtatttccaaggccacacggacctcatcctctccctatgacagctacccctcggaagctacccgagggtgaatcagcacctttggaactgccagccccaccggcattaccaccaaaaatcttctatatcaaacaggagccttttgaaccaaaagaggaaattagcgggagtggcacccagccagggggtgccaaggaagagactaaggtattctctgggggagacactgagggaaacggtgagctcggtttcctcctgccttcaggtccaggccctacgtccggagggggaggcccaagctggaagcctgtggacctccacggaaacgagattttgagcggcggaggcggtccaggaggcgctgggcaggcggttcacggacctgtgaaacttggcggaaccccacctgccgacgggaagagattcggctgtctgtgcggtaaaagatttgcggttaagccaaagagggacagacacattatgttaacattcagccttcgcccttttggctgcggcatctgcaacaagaggttcaaactaaagcaccacctgacagaacacatgaagacacatgccggagctctccacgcttgtcctcattgtggccgaaggtttcgggtgcatgcctgtttccttaggcacagggacctctgcaaggggcaaggatgggcaactgctcactggacatacaagtag

SEQ ID NO: 24950 - DNA, 1227 bp, Artificial Sequence
  Description of Artificial Sequence: Synthetic coding sequence
atgctccctcggccaaaggcgcctgctagtccacgacgccctcagacccctactcccagcgaacaggacgccgaccctggtccagccagccccagagacactgaagcgcaacgcctgagattcagacagtttcagtaccacgtggcaagtggacctcaccttgcactgggccagttatggacactgtgcaggcagtggttgcgccctgaagcaagatctaaagagcagatgctggaattgctggtgctggagcagttcctcggtgcgctgccatccaaaatgcggacttgggtccagtcccaggggccacgatcttgcagggaggctgcgtcacttgtggaggacctgactcaaatgtgccagcaggaggtgctcgtatctctggactctgtggaaccccaagactggagcttcggagaggaggaggacgggaaaagccctagatcacagaaagagccttcccaagcttccgagctcattttggatgcagtcgccgctgcgcctgccctcccagaagagtctgaatggctggagaccactcagctgcagcagtctctgcatacacgagcagaagccgaagcccctagagcgcctggcctgctgggctctagagcgcgtctgcccctcaaacccagcatctgggacgagcctgaggacttactcgccggacccagcagtgacctacgcgcagaagggaccgtgattagctcgcccaaaggaccgtccgctcaacgaatctccccccgtagacggaaccgtaacacagaccaatcaggcaggcaccaaccttcattgaagcatacgaaaggcggaactcaggaggccgtggccggaataagtgttgtgccacgcggtccaaggggaggcaggcccttccagtgtgccgactgcgggatggtgtttacatgggtcacgcacttcattgagcaccagaagacccaccgggaagagggaccatttccttgcccggaatgtggtaaagtgttcctgcacaactccgtactgactgaacacggcaagatccacctcctggagcccccaagaaagaaagcgcctaggtccaaaggtccacgggagtccgtgccccctagagacggagcccagggacccgtggctccgagatcaccaaaacgaccatttcagtgctccgtatgcggcaaggcatttccttggatggtgcacttaattgaccatcaaaagttgcacaccgcacatggtcacatgtag

SEQ ID NO: 24951 - DNA, 537 bp, Artificial Sequence
  Description of Artificial Sequence: Synthetic coding sequence
atgctccctcgacccaaggcaccagccagcccaaggcgtcctcagaccccaacccctagcgaacaggatgctgacccaggccctgcttcccctcgggataccgaagcccagagactgagattcaggcaattccaataccacgtcgcgtccgggccacacctggccctgggtcagctctggacactatgtcgtcagtggctccgacctgaggcccgtagtaaggagcaaatgctggagctgctcgtgctggagcagttcttgggtgcactgccatcaaagatgaggacgtgggtgcagtctcagggtccgaggtcctgtagagaagccgcaagtctggtggaagatcttactcaaatgtgtcagcaggaaggcgagaggcgcaggctgcctgctcccggaagggcgagaggcccagacgtatcagaggaccgcactgcactgctaccggctcatattgcccctacacctgccaggccgcttccaacaagcaagcctctgctcccccgaggctgtgtattcaactatttctacatatag

SEQ ID NO: 24952 - DNA, 2178 bp, Artificial Sequence
  Description of Artificial Sequence: Synthetic coding sequence
atgggtcctcgtgccagtctgagccgcttacgcgagttgtgtggccattggcttagacctgccctgcacaccaaaaaacagatccttgagttgctggtgctggagcagtttctttctgtgctgccaccacaccttttgggtaggctccagggacagccactaagagacggagaagaagtggttctgctcctcgaaggaatccaccgcgaaccttcacacgcaggtccccttgatttcagttgtaatgccggaaagtcatgccctcgtgcagacgtgacccttgaggagaaaggatgtgcttcccaggtaccatcccattcacccaaaaaagaattacccgcagaggaaccgtccgttctgggtccaagcgatgagcctcccaggccccagcctcgggctgctcagcccgcagagcctgggcagtggaggctccctccttcgtcaaagcagcctctgagccccggaccacaaaaaacatttcaagccttgcaagagagcagcccacaggggccttcaccttggcctgaggagagttctcgcgaccaagaactcgcggctgtgctagagtgtctgactttcgaggacgtgccggagaacaaggcctggcccgcacacccactcggcttcggatctcgaacgcctgacaaggaagagtttaagcaggaagaaccaaagggggctgcttggccgacaccaatcctagcggaatcacaagcggatagcccaggagtgcctggggagccttgcgcgcagtcactagggcgtggcgctgccgcatcaggaccaggcgaggatggcagtctgcttggatcctccgagatattggaagtgaaggtggctgaaggtgtcccagagccgaatcctgaactccaatttatctgcgctgattgtggggtgtcattccctcaactctcaaggttgaaagctcatcaattgagatcgcaccccgctgggcgaagttttctctgcttgtgttgtggaaaatccttcggtcgatcatccatcctcaaactccacatgagaacccacacggacgagaggcctcatgcttgccacctgtgtggacatcgattcagacagtcctcccacctgtccaagcatctactgactcactccagtgagcccgcattcctctgcgccgaatgtggcaggggatttcaaaggagagcatccctggtgcaacacctccttgcacacgcacaggatcagaagcctccttgtgctccggagtctaaagccgaggcccctccactaactgacgtgctgtgttctcactgtggacaatcctttcagaggcgtagcagcctcaagcggcacctgcgcattcacgcacgagacaaggacagaagaagctccgaaggtagcggaagccgacggagggattcagacaggagaccctttgtctgctccgattgcggcaaagcctttagaaggtccgagcatctggtcgcccacaggcgggtacacacaggcgaaagaccttttagctgtcaggcctgcggtcggagctttactcagtcgagccagctcgtgagccatcagagggtgcataccggtgagaagccttacgcatgtcctcagtgcggtaaacgatttgtgcgcagagccagtctagccaggcacctcctgacccacggcggtcccagacctcaccactgtacacaatgcgggaagtccttcggccagacccaggacctagcaaggcatcagaggtctcacactggggaaaaaccctgcaggtgctccgagtgcggcgagggcttctctcagagtgcacacctggcccgacatcagagaattcacactggggagaaaccacacgcctgtgatacttgcggacaccggtttcgcaactcatccaatcttgctcggcatcgccgttcacacacaggggagcgcccttattcgtgccagacctgcggcaggtcattccgacgcaacgcccacctgaggaggcacctggccacccacgctgagcccggtcaggaacaggcggagcccccacaggagtgcgttgaatgtgggaaaagcttttcacgcagttgtaatctgctgcgacacctgttagtgcacacaggagcccgaccttactcctgcactcagtgcgggaggagcttcagccgcaacagccatctcctgaggcacctgcgaacccacgcccgagagaccctttattag

SEQ ID NO: 24953 - DNA, 1977 bp, Artificial Sequence
  Description of Artificial Sequence: Synthetic coding sequence
accagagtacaagccgaagctcgtgggggaagcccggctgtgcagatgttacctgttagcggtggccatggggctaccggggtcccagaacctgctcccggagcactccgtcccctggccgcagcaggtagtgcacatcaggaaactgatcccggagcagctggcgctggagccgtacccgaatgcgctgcgtcagcgcctcctggccctccggctggtgccgcagctcagggttgggggggaggcggagctgcagcacgaggccatccgccaggggctcagcctcgaggggctgccggtcctcaaggcccttcaccctggcccgaagaaagtagcagggaccaagagctcgctgctgtcttagagtgcttgacctttgaagatgtgcccgagaataaagcctggcccgcacacccactgggcttcggatcacggactcccgacaaggaggaatttaaacaagaggagccgaaaggggcagcgtggcccactccaatcctggccgagtcgcaggctgatagccctggagtgcccggagagccgtgcgcccagagcctgggcagaggtgcggctgcttcaggacctggcgaggatggaagtctgctgggttccagcgaaattcttgaggttaaagtggcggaaggagtgcccgagcctaatcccgagttacagtttatctgtgcagattgcggggtgtcatttccccaactcagccggctcaaagcccatcagctccgcagtcaccctgccggaagaagcttcctttgcctttgttgcggcaaaagtttcggaagaagcagcatcctgaagctccatatgcgaacgcacactgacgagcggcctcatgcctgtcatctgtgcgggcaccgctttagacaatctagtcatctgagtaagcatctgctcacacactcatcggagcctgccttcctctgcgcagagtgcgggagagggtttcagcgcagagcttccctggtacagcacctgctggctcatgcgcaggaccagaaaccaccatgcgcaccagaatcaaaagcggaagctccccctttgacagacgttctgtgttcacactgtggtcagtcgttccagcgcagatcatctctaaagcgtcacctgcgtattcacgctcgggataaagaccgtcggagcagcgaaggaagcgggtccagacgtcgggacagcgacagacgcccttttgtgtgctccgattgtgggaaagcatttcgacgatctgaacaccttgttgctcataggagagttcatacgggggaaaggccgttcagctgtcaggcctgtgggagatctttcactcagagcagccagcttgttagccaccaacgcgtgcacaccggcgaaaaaccgtacgcctgcccccaatgcgggaagcgcttcgtgcgacgggctagtcttgccagacacttgctaacccacggagggcctagaccccaccactgtacccagtgtgggaagagttttggacaaacccaagacctggcccgtcaccagcggtctcacacaggggagaaaccgtgtaggtgcagtgagtgcggggagggatttagccaatccgcacatcttgctcgccatcagcggatacacactggcgagaagccacacgcctgcgatacttgcggtcatcgttttcggaacagctctaatctcgccagacacagaagatcacacacaggcgagagaccatactcatgtcagacatgcggcaggagttttcggagaaacgcccacctcaggagacatcttgccacacacgcagagccgggacaggagcaggccgaaccaccccaggagtgcgttgagtgtggtaagtctttttctcgctcatgcaatctgctcaggcacttgctcgttcatacaggagcccgaccttacagctgcacacagtgcggaagatctttttcccgtaacagccatctgctgcgtcatctcagaacacacgctcgagaaaccctttactag

SEQ ID NO: 24954 - DNA, 1047 bp, Artificial Sequence
  Description of Artificial Sequence: Synthetic coding sequence
atgacgacagccttggagcctgaggatcagaagggactgctgatcatcaaagccgaggaccactactggggccaagatagcagctcccagaaatgcagcccccaccggagggaactctaccgacagcatttccggaagttgtgctatcaagatgctcctggaccacgggaagccctcacacaattatgggagctgtgtcgccagtggcttagacctgaatgtcacacaaaagaacagatactggatctgctggtgctggagcagttcctcagtatattacctaaagacctgcaggcatgggtacgtgctcaccatcccgaaactggtgaggaagcagtgactgtcttggaggatcttgagagggagctcgacgagccaggaaagcaggtccccggtaactccgagcgcagagatattctcatggacaaactagctccacttgggcgaccttacgagagccttaccgtgcaactgcatccaaaaaagactcagctagagcaggaggccggaaagccacaacggaacggggataagacacggacgaagaatgaggagctgttccagaaggaggacatgccaaaagacaaagagtttctgggtgagatcaacgatcgactcaacaaggacaccccacagcaccccaaatctaaagacatcatcgagaatgaaggcagatctgagtggcagcagcgcgaacgcagacggtacaaatgcgacgaatgtgggaagagtttttcccatagcagtgatctgagcaagcacagaaggacgcatactggggagaagccttacaaatgtgatgagtgtggcaaggcctttattcagcgctcccacctgatagggcatcatcgcgtgcataccggggtgaagccatataagtgtaaggaatgcggcaaggatttctctggacgcacgggactgattcagcaccaacgcatccacacgggcgagaagccatatgagtgtgacgaatgcggccgaccctttagggttagctccgccctaattagacaccagaggattcacactgctaacaagctgtactag

SEQ ID NO: 24955 - DNA, 1533 bp, Artificial Sequence
  Description of Artificial Sequence: Synthetic coding sequence
atgttgccactggagaaggcattcgcttcaccaagatcctcaccagctccacccgacctgcccacaccgggttcagcagctggggtgcagcaagaggagcccgaaacaatcccggagaggacccctgccgatcttgagttcagtcgcttacgcttcagagaattcgtgtaccaggaggctgcaggtcctcaccagacactcgcaaggctgcatgaactgtgccgacagtggttgatgcctgaggccagatctaaggaacaaatgctcgagctgctggtccttgagcagtttctaggtatcctgccagataaagttcggccatgggtcgtggcccagtatcctgagtcttgtaagaaggccgcttctctcgtcgaaggcttggctgacgttttagaggagccgggaatgcttctgggttctcccgcaggctcctcctctatcctttccgacggggtgtacgagcggcatatggatcccttactcttaccgggagagctcgcctcaccctctcaggcgctgggagccggagagatacctgcaccgtccgagaccccctggctcagcccagatccgttgttcctggagcagcgcagggtgagggaagctaagacagaagaggatggacctgccaatacggagcaaaaactgaagtcatttccagaggaccctcagcatctcggagaatggggtcatctggaccccgcagaagagaacctcaaaagctatcgcaaactgttgctttgggggtatcaactgtcacagcccgacgcagcctccaggcttgatacagaagagcttcgacttgtggagcgtgacccacagggatcttctctgcccgagggcggtaggcgccaggaatctgctggatgcgcgtgcgaagaagccgcacccgctggagtgctgcctgagcttccgacagaggcaccacctggagacgctctggccgatccgccatccggaactaccgaggaggaggaggagcagccaggtaaagctccagatccccaggacccgcaagacgcagaatcagactccgccaccggctcacagaggcaatccgtgatccagcagcccgctcctgataggggtaccgctaaattgggcacaaaacgccctcaccccgaggatggggatgggcagtcactcgagggggtgagtagctctggtgactcagccggacttgaagccggacagggcccaggtgctgacgaacctgggctatccagaggcaaaccttacgcatgtggcgagtgtggcgaggcctttgcctggctgagtcacctgatggagcaccactcatcccatggaggaagaaagcgttatgcctgtcaaggctgctggaaaactttccacttttccctcgccctcgcagagcaccaaaagacacacgagaaagaaaaatcctacgccctcggcggagccaggggtccccagccctcgacaagggaggcccaggctggggcaagggccggtggccctcctgagtcagtggagggggaggcccctccagcgcctcctgaggctcaacggtag

SEQ ID NO: 24956 - DNA, 1125 bp, Artificial Sequence
  Description of Artificial Sequence: Synthetic coding sequence
atgctactgggatcacccgctggaagctcaagtattctctcagacggcgtgtacgagcggcacatggatcccctcctgctccccggagaactagcctcaccgagccaggccctgggcgctggagagattccagcccctagtgaaacaccttggttaagcccagaccccctgtttctggagcagaggagagtgcgggaagccaaaaccgaagaagatggacccgcaaacactgagcagaagttgaaatctttcccagaagaccctcagcatctaggcgaatggggccacctggatccggctgaggagaatctgaaaagctatagaaaactcttattgtggggctatcagttaagtcagccagatgcggcaagtcgcctggacacagaggaactaaggctagtagagagggatccccaaggctcttctctgccaggtggaaggcggcaggaaagtgcaggttgtgcctgtgaggaagctgcccctgcaggcgttcttcctgagctgcccactgaggcaccccctggagatgcactggctgaccctcccagtggcaccaccgaggaggaggaagagcagcctggcaaagcgccagacccgcaggacccccaggacgctgaatctgactcagccaccggttcccagaggcagtcagttatacagcagcctgccccagaccgcggtaccgctaaattaggcaccaaaaggcctcatccagaggacggagacggacaaagtctggaaggtgttagcagtagcggtgatagcgctggtctggaagccggacaggggcctggtgcggatgaacccggactgtcacggggaaagccatacgcttgtggggagtgcggggaagcgttcgcgtggctttcccatctgatggagcaccacagctcccatggaggcaggaaacgctacgcctgccagggatgctggaaaaccttccatttcagcctggccctagcagagcaccaaaagacgcacgaaaaggagaagagttatgccctgggcggagccaggggacctcaacccagtacgagggaagctcaggcaggagcgagggctggcggtcctcccgagtccgtcgagggagaggccccacccgcaccgccagaggctcagcggtag

SEQ ID NO: 24957 - DNA, 1701 bp, Artificial Sequence
  Description of Artificial Sequence: Synthetic coding sequence
atgagacgcgtcggcggtagagctgatgaagacgccaccgctgctggatccctttgggttttagctccaccggaaccaactggccacttggtaatccctggcactagtcctctcgagcctccgtgtccatggctcgactcccacatatttcaatgtcggtttggcaagatgctccccctggaaaaggctttcgcctccccccgatcttctcctgcccctcccgaccttcccaccccaggtagcgcagccggtgtccaacaagaagagcccgagacaattccagagcgcacccctgcggacctggaattttcccgactgaggtttcgtgagtttgtgtatcaggaggctgcaggaccgcatcaaacgctcgctcggctgcacgaactttgcaggcaatggctgatgcccgaggccagatccaaagagcaaatgctggaactgttggttcttgaacaattcctcggaattctcccagataaagtccggccatgggttgtcgcccaatacccagaatcctgcaaaaaggcagcaagcctggtggaaggcttagctgacgttctcgaagagcccggaatgctgctcggctcccctgctggtagctcttccatattgtcagatggtgtgtacgagcgtcacatggacccccttctgttacctggcgagctcgcttcccctagccaagcactgggggctggtgagatccccgctcccagtgagactccgtggctgagtcccgacccattattcttggaacagcgacgcgtcagagaggccaagacagaagaagatggaccagccaacaccgagcagaaactaaaatcattcccagaggatccacagcacttgggggagtgggggcatctggaccctgcagaagagaatctgaagtcataccggaagcttttgctctggggatatcagctgtcccagccggacgcagcctcccggttggacacagaagagctcagactcgtggagagagacccacagggcagcagtcttcccgagggcggacgacgccaggagtcagccggttgcgcctgcgaagaagctgcacccgctggcgttttacccgaactgccgaccgaagccccacctggggacgccctcgcagatccgcctagcggaaccacggaggaggaggaggagcagcccggaaaggccccagacccacaggacccccaggatgctgaatcagacagtgctactggctctcagagacaaagtgtgattcagcagcccgctccagacaggggaactgcaaagttaggtaccaagcgtcctcaccctgaggatggcgacggtcagtccttggagggcgtaagctcctccggggatagtgctggccttgaggcagggcagggaccgggagccgatgaacccggattgtcacgtgggaaaccatacgcatgcggcgagtgcggagaagcattcgcgtggctaagccaccttatggagcaccactcaagtcatggcggaagaaaaaggtatgcctgtcagggatgttggaagacttttcatttcagcctagctcttgctgaacaccagaaaacacatgagaaagaaaagagttatgccctcgggggtgctagaggacctcaaccaagtactagggaagcccaggctggagccagagctggcggtcctcctgaaagtgtagaaggggaagcaccacctgcacctcccgaggcccagaggtag

SEQ ID NO: 24958 - DNA, 1701 bp, Artificial Sequence
  Description of Artificial Sequence: Synthetic coding sequence
atgagacgagtcggcggtcgagccgatgaagacgctactgccgcaggatctctttgggttttagcccctccggaaccaaccggacacctggtgattcccggaacgtcgcctttggaaccaccctgtccgtggcttgattcacatatctttcagtgtcgattcggtaagatgctgcccctcgagaaagcctttgcaagtcccagatctagccctgctcccccagacctacctacacctgggtctgcggcaggagttcagcaagaagaacctgagacaattcccgaaagaaccccagccgatctggaatttagccgattgaggtttcgcgaattcgtctaccaggaggcagcaggaccgcatcaaactctcgcccgactccacgagctctgccggcagtggcttatgccagaggctcgatccaaggagcagatgctggaactcctggttctcgagcagtttctaggtattctccctgataaggttaggccctgggttgtggcacagtatcctgagtcatgtaaaaaagcggcatctctggtggaaggcctagcggatgtgctggaagaacccggtatgctattgggcagcccagccggaagcagtagcatcctctcggacggcgtgtatgagaggcacatggatcctctcttactgcccggtgagctggcttccccatcacaggctctaggggcaggggagattcccgctccttctgagactccttggttgtcacccgatccactgtttctggagcagcgtagggtgcgagaagctaagaccgaagaggatgggccagccaataccgagcagaagctgaagtcctttcccgaggatccgcagcatctgggcgaatggggccaccttgaccccgcagaggaaaatctaaaatcctatagaaagttgcttttgtggggttatcaattgtcacagcccgatgctgcaagccgactcgacaccgaggagcttagattagtggagcgcgaccctcaggggtcttccttgccagaaggtggaaggcggcaggagagcgctggatgcgcatgcgaagaggcagcccctgctggcgtgttacctgagctgcccactgaggccccaccaggggatgccttagcagaccctccctcagggacaaccgaagaggaggaggagcaacctgggaaagctccggatccacaagatccacaggacgccgagtcagacagcgcaactggttctcagaggcagtccgtgatacaacagcctgccccagacaggggcaccgccaagctgggtacaaagagacctcatccggaggacggcgatggtcagagcctggaaggcgtctcctcgtcaggcgactctgccggtttagaagcgggacaggggcctggcgctgacgaacctggcttatctcgcggaaagccctacgcctgcggtgagtgtggagaggcgtttgcctggctatcacacctaatggaacaccactcctcacacggcggacgcaaacggtacgcctgccaaggttgttggaaaaccttccacttctccctggctctcgccgagcaccagaaaacacatgaaaaggagaagagctacgcactgggcggtgccaggggtcctcagccctctacacgggaggctcaggcaggggctagagctggtggaccccctgagtcagtcgagggcgaggcgccacccgcaccccctgaggcccagcgttag

SEQ ID NO: 24959 - DNA, 453 bp, Artificial Sequence
  Description of Artificial Sequence: Synthetic coding sequence
atgatggccgctgacatccccagagtgaccactccactcagtagcctcgttcaggtccctcaggaagaagatcgtcaggaggaggaggtgaccaccatgatcctggaagatgactcttgggtgcaggaggcggtgcttcaggaggacggcccagaaagtgaaccattcccacagagtgcaggtaaaggcggaccgcaggaagaggtgactcgcggtccacaaggcgcattaggaaggctgagagagctgtgccgcaggtggttacgacccgaagtgcacacaaaagagcaaatgcttacgatgctccctaaggaaattcaagcttggcttcaggagcaccgccctgagtcttcagaggaagccgctgccctggtggaggacctcacacagaccctgcaagatagcgcagtcgcagtggttgcctcgctccccgtcgaagtgacatccctctag

SEQ ID NO: 24960 - DNA, 1788 bp, Artificial Sequence
  Description of Artificial Sequence: Synthetic coding sequence
atgatggcagccgacatccccagggtgaccactcctctttccagcctcgtccaggtacctcaggaggaggaccggcaggaagaagaggtgactactatgattctggaggatgactcatgggtgcaggaagcagtattacaggaggaagtgacccgtggccctcagggcgcacttggtcgcctccgcgagctctgccggcgttggctaagacctgaagtgcacacaaaagagcagatgctcaccatgctacctaaagagattcaggcctggttacaggagcacaggccagagtcctcggaggaggcggctgccctcgtggaggatctcactcagaccctccaggattctgacttcgagatccagtcggaaaacggggaaaactgcaaccaggatatgtttgagaacgaatcacggaaaatctttagtgagatgcccgagggcgaatccgcacagcattctgacggcgaatctgatttcgaacgggatgctggaatccagagactgcagggccacagtccgggtgaagatcacggcgaggtagtcagtcaagatagggaggtcgggcagctaatcgggctccaggggacttatctcggagagaagccctatgagtgcccacagtgcggaaagacattttctcggaaaagtcacctcataacccacgaacgcacacataccggggagaagtactacaagtgcgatgagtgcggtaagagcttttcggacggatctaactttagcagacatcagacaacccacacgggagagaagccttataagtgtcgtgattgcggtaagagcttttcacgaagtgctaacttgatcacacatcagcggattcacacgggggagaagccatttcagtgtgccgaatgtggaaagtccttttcccggagtccgaatctgattgctcatcagcgcacgcataccggtgagaaaccatattcatgtccagagtgcggcaaatccttcgggaataggtcctctctgaatactcaccaaggcattcatacaggggagaagccctacgagtgtaaagaatgcggcgagagttttagctacaatagcaatctcattcgccaccagcggatacacaccggcgagaaaccatataagtgcaccgactgtggtcagagatttagtcagtcttctgcactgattacccaccgacgaacccacaccggagagaaaccttaccagtgtagcgaatgcggcaagtccttcagtagatcaagcaacttagcaacacatcgcagaacccacatggtagaaaagccttacaaatgcggtgtgtgtggcaagtccttcagtcagagctcttccctaattgcccatcagggtatgcacaccggggagaaaccttatgagtgtctgacatgtggtgaaagcttttcctggtcctctaacctgctgaagcaccagagaatccatactggagagaagccctacaaatgcagtgaatgcggcaaatgctttagccagcgatctcagctggtagtacaccagaggacccacacaggcgagaagccgtataaatgtctgatgtgcgggaaatcattctccaggggtagtatattggtgatgcaccagcgagcgcacctcggagacaaaccatataggtgtcccgagtgcgggaaggggttttcctggaactcagtccttatcattcaccagagaatccacacgggtgaaaaaccctacaaatgcccagagtgtgggaaggggttctcaaactcctctaatttcattacccatcaaagaacgcatatgaaggagaagctctattag

SEQ ID NO: 24961 - DNA, 441 bp, Artificial Sequence
  Description of Artificial Sequence: Synthetic coding sequence
atgatggctgctgatattccgagagtgactaccccactgtcgtctcttgtgcaggtcccacaagaagaggacaggcaggaagaagaggtaacaactatgatcctggaggatgattcttgggtgcaggaagccgtgctccaggaagatggtccagagagtgagcctttccctcagagcgcgggaaagggaggaccccaggaggaagttacccgcggacctcagggcgcattaggccgtctgagagagctctgtcgacgctggcttcggcctgaagtccatactaaagaacagatgctaacaatgttacccaaagaaatacaggcctggctgcaagagcatcggcctgagtctagtgaagaagctgccgctctggtcgaggatcttacacagacacttcaggactccgagaccgcatcatgcgtccacggctgtcccgtgtag

SEQ ID NO: 24962 - DNA, 99 bp, Artificial Sequence
  Description of Artificial Sequence: Synthetic coding sequence
atgatggctgccgacatccccagggtgactactccgctcagctccctggtgcaggtgcctcaagaagaggataggcaggaggaggaagtgacaacctag

SEQ ID NO: 24963 - DNA, 1845 bp, Artificial Sequence
  Description of Artificial Sequence: Synthetic coding sequence
atgatggcggcagacattccgagagttaccacaccactgagctccctggttcaggtgccacaggaggaggatcgacaggaggaggaagtgactacaatgatccttgaggacgacagctgggtgcaggaagcggtgttacaggaggatggaccagaatccgaaccatttcctcaatctgctggaaaggggggtccgcaagaggaggtcactcgtggcccacagggcgcattgggacgcctgcgcgaactgtgtaggcggtggcttcggcctgaggtgcacacaaaagagcaaatgctcacaatgcttccaaaggagatccaggcatggttgcaagagcaccgacctgaaagttccgaagaagcggcagcattggttgaggacctcacccaaacactgcaggattccgactttgaaatccagagtgagaacggagaaaattgcaaccaggacatgttcgagaatgaaagccgaaagatcttcagcgagatgccggaaggggaaagcgcgcaacacagcgacggagaaagtgacttcgagcgcgacgctggcatacagagactccagggccactcccctggagaggaccatggagaggttgtgtctcaggacagagaagttggccaactcattggccttcagggaacatacctcggggaaaagccttacgaatgcccccagtgcggtaagactttctctcggaagtcacacctcatcacccacgagagaacgcatacgggtgagaagtactacaagtgtgacgaatgcgggaaatccttctcggatgggagcaacttctcccgccatcagaccacacacaccggggagaaaccctacaaatgcagggattgcggcaagtccttctcacgcagcgctaacctcatcacccatcagaggatccacactggggaaaagccatttcagtgcgccgaatgcggcaaatctttctcccgaagtccaaatctgatagctcaccagagaacccacactggggagaagccgtactcctgccctgagtgcggcaaatcttttggaaaccggtcatccctgaatacacaccaaggcattcacaccggcgagaaaccatatgaatgcaaggagtgtggcgagtccttctcctataacagtaacctgatccgtcatcagcggatacacaccggagaaaagccttacaaatgcacagactgcggacagagattctcacagtcgagcgccctgataacacaccgtcggacccacacaggggaaaaaccatatcagtgctccgagtgcggaaagagtttcagccgctcctcaaacctagccacccaccggagaacccacatggtggagaaaccctacaagtgtggggtgtgtggcaagtccttctcccaatccagcagtcttatcgctcaccagggtatgcataccggggaaaagccttatgagtgtctgacgtgtggagagagtttctcctggagttctaacttgctcaaacaccagagaatccatacgggtgagaaaccctataagtgcagcgaatgcggaaaatgctttagccaaagatctcagctggtcgtccaccagaggacacacactggcgaaaaaccttacaagtgtctgatgtgcggaaaatctttctcacgtggatcaattctggtgatgcaccagagagcacacctgggggataagccttaccgatgcccagagtgtggaaagggcttcagctggaactctgttttgattatccaccagaggatccacacaggggagaaaccttacaaatgcccagaatgtggtaagggattcagcaatagcagtaatttcatcacacaccagagaacgcacatgaaagagaaactgtactag

SEQ ID NO: 24964 - DNA, 84 bp, Artificial Sequence
  Description of Artificial Sequence: Synthetic coding sequence
atgatggctgcggacatcccccgtgttacaacaccattaagcagcctcgtgcaggtgcctcaggaagaggaccggcaggaatag

SEQ ID NO: 24965 - DNA, 1845 bp, Artificial Sequence
  Description of Artificial Sequence: Synthetic coding sequence
atgatggccgctgatatcccccgtgtgaccacacctctgtcttcgcttgtccaggtgccacaggaggaagatcggcaagaggaagaagtcacgaccatgattctggaagacgattcatgggtacaagaggcagttctccaagaggacggtcctgaatctgagcctttccctcagagcgctgggaagggaggaccgcaagaggaggttaccagaggtccgcaaggcgctcttggcaggcttagagaactgtgtaggaggtggttgcggccagaagtgcacaccaaggagcaaatgctcactatgctccctaaagaaatacaagcctggctgcaggagcatagaccagaaagctctgaggaggcggctgcactagtagaagacctcacacagactctacaggactctgattttgagattcagtctgagaacggagaaaactgcaatcaggacatgtttgagaatgaaagtcggaagatcttcagtgaaatgccagaaggtgagtcggctcagcattcagacggcgaatccgacttcgagcgggatgcgggaatccaacgacttcagggccatagccctggcgaggatcatggcgaagttgtgagccaggatcgcgaggtggggcaactgatcgggcttcaggggacttacctcggagagaagccctacgagtgtccgcagtgcggtaagactttctcaagaaagagccatctgatcacgcatgagcgcacccataccggagagaaatattacaaatgcgatgagtgtgggaagtccttttctgacggcagtaacttctcaaggcaccagactacccatactggcgagaagccttataaatgccgcgattgtggaaagtcgtttagcagatcggcaaatctaataacccaccagaggattcatactggtgagaaaccattccagtgcgctgagtgcggaaagtctttctctcgaagccctaatttgattgcgcatcaaagaactcacacgggcgaaaagccctattcttgtccagagtgtgggaagtcttttggtaacaggtcatcgcttaacacccatcaaggcattcacacaggcgagaagccatacgaatgtaaggagtgcggagagtcatttagctacaacagcaacttaattaggcaccagcggatccatactggcgagaaaccatacaagtgtaccgactgtgggcagagattttcacaaagttccgcgctcatcacgcatagacgcacccacacaggtgaaaagccataccagtgtagcgaatgcggtaagtccttctccagatctagcaatctggcaacgcatcgccgaacccacatggtagagaagccatataagtgtggcgtttgtggaaaaagcttttcccaatcctcttctctgattgcccatcaggggatgcatacaggggagaagccgtatgagtgcttgacttgtggcgaatcatttagctggtcatccaacctcctgaagcatcagaggatccataccggcgaaaaaccatataagtgcagcgaatgtggcaaatgcttcagtcagcgctctcagcttgttgttcaccagcgcacacacacaggcgaaaagccttataaatgtctcatgtgtggaaagagctttagtcgcggttctatcctagtcatgcatcagcgggctcacctgggagataaaccttacaggtgtccagaatgcggcaaaggattttcatggaactccgtgctcatcatccaccagcggattcataccggcgagaagccttacaaatgcccagaatgtgggaagggattctcaaatagctctaacttcatcacacaccagcggacacatatgaaggagaagctttattag

SEQ ID NO: 24966 - DNA, 1845 bp, Artificial Sequence
  Description of Artificial Sequence: Synthetic coding sequence
atgatggctgccgatattcctagagtcaccacaccactttcttcattagtgcaagtgccccaagaagaagaccggcaggaggaagaagttaccaccatgatcctggaagacgatagttgggtacaggaagctgttctgcaggaagatggaccagagtccgagccattcccacagtctgctggaaaggggggtccccaggaggaagtcacccgaggtcctcagggcgcactcgggcgactgcgcgagttatgcaggaggtggcttcgtccggaggtgcacactaaggaacaaatgctaaccatgttacccaaagagattcaggcatggctgcaggagcataggcccgagtcgtctgaagaggctgccgcactcgtcgaggacctaacacagactctgcaagactccgatttcgagattcagtccgaaaacggcgagaactgcaaccaggacatgtttgaaaatgagtcccgcaagatcttttcggaaatgccagagggggaaagtgcccagcacagcgatggggaaagcgattttgagagggatgcgggaattcagaggctccaaggccattcccccggtgaggatcacggggaggtggtgtcccaggacagagaggttggtcaactgattgggctccaagggacataccttggcgagaagccatacgagtgtcctcagtgcggcaaaaccttctccagaaaaagccatctcatcactcacgaaagaacccacactggcgaaaagtactacaaatgtgatgagtgtggaaaatcttttagcgatggctcaaacttcagtagacatcagacaacccacactggcgaaaagccttacaaatgtagagattgtggcaagtccttctctagatcagcgaatctcatcactcaccagaggatccatacaggggaaaagcccttccagtgcgcagaatgtggcaaatccttcagtcggagcccgaatctgattgcacaccagcggactcatacaggagaaaaaccatactcatgccctgagtgtggcaagagttttggaaacaggtctagcctaaatacccaccaagggattcacactggtgagaagccatatgagtgtaaggagtgtggggagtcgttctcttataatagtaatctgataaggcatcagagaatccataccggggagaaaccatataaatgcaccgattgtggccagcgattcagccagtctagtgccctgatcacccatcgcagaactcataccggggagaagccttatcagtgcagcgagtgcggcaaaagctttagtcgatccagcaacttagccacccatagaaggactcacatggtggaaaagccatacaaatgcggggtctgtggcaaatcattttcacagtcctcatcacttatcgcccaccagggcatgcatacgggtgaaaagccttatgaatgtttgacctgcggggaaagtttcagttggtctagcaatctcctgaagcaccagcgtatacatacaggcgagaagccctacaaatgttcagagtgcggaaagtgcttctcacagaggagccaactcgtggtgcatcaaagaacccacaccggcgagaagccttacaaatgtctaatgtgcggcaagtctttcagtagaggtagcatcctcgttatgcaccagcgggcacatctcggtgataagccttaccgttgtcccgagtgcggcaaaggattcagctggaatagcgtgttgatcatccaccagagaatacacactggcgagaaaccatataagtgccccgaatgcgggaaaggcttttctaactcaagcaacttcattacgcatcagagaacccacatgaaggagaaactctactag

SEQ ID NO: 24967 - DNA, 162 bp, Artificial Sequence
  Description of Artificial Sequence: Synthetic coding sequence
atgatggctgcagatatcccccgtgttaccacccctctcagcagtctcgtccaagtccctcaggaggaggacaggcaagaagaggaggtgacaactatgatcctggaggacgacagctgggttcaggaggcggtgcttcaggaggacggcccagaatcctag

SEQ ID NO: 24968 - DNA, 1422 bp, Artificial Sequence
  Description of Artificial Sequence: Synthetic coding sequence
atgatgacgaaggttcttgggatggctcctgtgctgggaccaagacccccacaggagcaggtgggccctcttatggttaaagttgaggaaaaagaggaaaaaggcaaatatctcccaagcctggagatgtttcggcagagatttaggcagttcgggtatcatgacacacccggacctagggaagcgctgtcccaactgcgagtattatgctgcgaatggctacggccagaaatccatactaaagagcagattctagagctgctggtgttggagcagttcctaaccatactgccccaggaactgcaggcttgggtacaggagcattgtccagagagcgctgaggaagccgtaacactgttggaagatcttgagcgggagctcgacgaacccggacatcaagtctctacccccccaaatgaacaaaaacctgtctgggagaagatttcttcttcaggaacggcaaaggagagcccatcttctatgcagcctcagcccttggagacatcccataagtatgagagttggggtccgttatacattcaagagagcggagaggaacaagagttcgctcaggatcctcgcaaggtcagagactgcagactcagcacgcaacacgaagagagtgctgatgaacagaaagggtcagaggccgagggcttaaaaggcgacatcatttcggtgattatcgctaacaaaccggaagcttctctggagcggcaatgcgtgaatctggaaaatgagaagggaactaaacccccactgcaggaagccggaagcaagaaagggagagagtctgtgcccaccaaacctaccccaggagaacggaggtatatctgcgccgagtgtggcaaagcgttctctaactcttcgaacctcactaaacatcggaggacacatactggggagaagccttacgtttgcaccaagtgcggcaaagctttttctcactctagcaacctcacgctgcattacaggactcatctggtagacagaccatatgactgtaaatgcggtaaagcttttggccagtcctctgacctcctgaaacaccagaggatgcacacggaagaggccccttaccagtgcaaagactgcggaaaagccttctctggaaaaggaagcctcatcagacactaccggatacatacgggagagaagccctatcagtgcaacgagtgcggcaaatccttctcccagcacgccggtttgtcttcacatcagcgcctccatacaggagagaagccatacaaatgcaaggagtgcggcaaagcattcaaccattcttccaattttaacaaacaccataggattcacaccggagaaaaaccttactggtgtcaccactgtgggaaaacgttttgttctaagagtaatctatcaaaacaccagagagtccatactggagaaggagaagctccatag

SEQ ID NO: 24969 - DNA, 1347 bp, Artificial Sequence
  Description of Artificial Sequence: Synthetic coding sequence
atgatgacaaaggtactgggtatggccccagtactcgggcctaggcctccgcaagagcaggtgggccctttgatggtgaaggtggaggagaaagaggaaaagggaaaatacctcccgagcttagaaatgttcagacagcggtttcggcagtttggttaccatgacaccccagggcctcgggaagccctgtcccagctcagggtcctgtgctgtgagtggctccgaccggaaattcacaccaaggagcactgccctgagtccgcggaagaagccgttacactgctcgaagacctggagagggaactggacgagcccggacaccaggtgagcactcccccaaacgagcagaagccagtgtgggagaagatctcttccagcgggacagcgaaagaaagtccaagcagcatgcagcctcaaccactggagaccagccacaagtacgaatcctggggccctttgtacatccaggaaagcggagaggaacaggaattcgcccaagacccccgaaaagtgcgagactgtagactctcaactcagcatgaggagagcgccgatgagcagaaaggctccgaggcagaggggttaaagggagatattatcagcgtaattatcgcgaataagccggaggctagtctcgagcgccagtgtgtgaatctagagaatgagaaggggacaaaaccacctttgcaagaggctgggtctaaaaaagggcgagagtctgtgccaactaaacccacaccgggtgagcggaggtacatctgtgccgagtgcgggaaagctttcagcaatagctctaatctgaccaagcatagaagaacgcataccggcgagaaaccatacgtgtgtacaaagtgcggaaaggcctttagccactcatctaatcttactctgcattacaggacacacctggttgatcgcccatatgattgcaagtgcggcaaggcattcgggcagagttctgacctgctgaagcaccagcggatgcacaccgaagaggccccttaccagtgcaaggactgcggcaaggccttcagcggaaaaggatctctgatccgacactacaggatccacactggggagaagccttaccagtgtaatgagtgcggtaaaagcttcagtcagcatgcagggcttagcagccaccagcggctacacaccggcgagaaaccgtataaatgtaaggagtgtgggaaggctttcaaccacagtagcaatttcaataagcaccacagaattcacacgggtgaaaagccttattggtgtcaccactgcggtaaaacattctgcagcaaaagtaacctctccaagcatcaacgagttcacacgggagaaggtgaggccccatag

SEQ ID NO: 24970 - DNA, 546 bp, Artificial Sequence
  Description of Artificial Sequence: Synthetic coding sequence
atgatgaccaaagtgttaggaatggccccagttctgggccctcggccacctcaggagcaggtcggcccattaatggtgaaggtggaggagaaagaggagaaaggcaagtaccttcccagtctcgaaatgttccggcagaggttccggcaattcggatatcatgacacacctggaccacgagaggcactctcccagctccgggtgttatgctgcgaatggctaaggccggagatccatactaaggagcagattctggagttactggtactcgaacaattcctgactatcctgcctcaggagctgcaggcctgggtccaagagcattgcccagaaagtgcggaggaggccgtcaccctgttggaggacctcgagagggaactggacgagcctggacatcaggtgagcacaccgccaaacgaacagaagccagtgtgggagaaaatctccagctccggcacagctaaagagagtccctcctccatgcaaccacaaccccttgagacctcccataaatacgagtcttggggacccctgtatattcagtag

SEQ ID NO: 24971 - DNA, 1353 bp, Artificial Sequence
  Description of Artificial Sequence: Synthetic coding sequence
atgatgacgaaagtcttagggatggctcccgttctgggcccacgcccaccacaggagcaggttggcccactcatggtcaaggttgaggagaaagaggaaaaggggaaatatctgccctcccttgaaatgtttagacagcgctttaggcagttcggataccacgatacacccggacctcgagaggctctatcccaattacgggtgctgtgttgtgagtggctacggcctgaaatccataccaaggagcaaatcctcgagctactggtccttgagcaatttctcacgattctgcctcaggaactacaggcttgggtgcaggaacattgcccagagtccgcagaggaggcagtgaccttgctggaagacctggagcgcgagctcgatgagcctgggcaccaggtcagcacacctccaaacgaacagaagccagtgtgggaaaaaatctcatcaagcgggacagcaaaggagtctcccagctccatgcaaccacagcctctggagacctctcataaatatgagtcctggggcccattgtacatccaggaatcaggggaggagcaggaatttgctcaagaccccaggaaggtacgcgactgccgattgagcacccaacacgaagagagcgcagatgagcagaaaggctctgaggctgaaggccttaagggagatataatcagtgtgatcatcgcaaacaaaccagaggccagtcttgagaggcagtgcgtgaacctcgagaacgagaagggcacaaagccccctctccaagaagcgggatctaagaagggtgagcacacgctcggacgtaacttgacctgtgccccttcagttggaaaactgagcgctacagcacagaccagcccctccactactgagcatacatggtggaccggcccaatgacagtttctgttgagaagctgctgggcagagcccagaccttccttaatatccgcgagtgcacacagaaaaggaggcatatatctgccaaaatcgtagcccgactgtctgcaggcaaggcagccagcttcgtgacaataggttctaccctggggcgatctctgatcagtgtgaccaacgtaggacgcgctagcgttagcatgcgcgcatctgcacctacaagggactccacacccgaaaggagccatatctccgttcgatccgtcggaaaaccgtccaccactgcacccacatcaattaacaccactgagtccacgcctggcaagtctccaacaggcgtaattacagtggagcgcccttccgttgcctcccccattttcccaaatatctccgagagtactttagaacgcgagaaacataggaacttccaggctctccttctgctgtctttattctag

SEQ ID NO: 24972 - DNA, 1170 bp, Artificial Sequence
  Description of Artificial Sequence: Synthetic coding sequence
atggcgattaccctcacgttacagactgctgagatgcaggaaggactcctggccgtgaaagtgaaggaggaagaagaggagcattcatgtggcccagaaagtggattatcaaggaacaacccacatacacgtgagatttttaggcgcaggttcagacagttctgttatcaggagtcgcctggacctcgcgaagcactacaacggctgcaggagttatgtcatcagtggctgcggccagaaatgcatactaaggagcagatccttgagctgctcgtcctggagcagttccttactattttgcccgaagagttacaggcctgggtgaggcaacaccgccctgtgtcaggcgaggaggccgtgaccgtgctggaagacctggaacgcgagctcgatgacccgggtgaacaggtactcagccacgcccacgagcaagaagaatttgtaaaggaaaaagctactcccggtgctgcccaagaatcctctaatgaccaatttcagaccctggaagagcagctgggatacaatctgagggaagtgtgtccagtccaagaaattgatggtaaggctgggacttggaatgtcgagctcgcccctaaacgagaaattagccaagaggtgaaatccctcatccaggtgctggggaaacaaaacgggaatatcacccagattccagagtacggcgatacctgtgatagagagggccgacttgagaagcaaagagtcagcagttctgtcgaaagaccttatatttgctccgagtgtggcaagtccttcacccagaattccatactgattgagcaccagagaacacacaccggtgagaagccatatgagtgcgatgaatgcggtcgtgccttctcacagaggtcaggcttgtttcagcaccagcggttacatacgggggagaaacgctaccagtgcagcgtgtgcggaaaggcttttagtcagaatgcagggcttttccatcacctgagaattcacacaggggaaaagccataccagtgtaatcagtgcaacaaatccttcagtcggagatctgtcctgatcaaacaccaacggattcacaccggggagcgaccctacgagtgcgaggaatgtggcaagaacttcatttatcactgcaatttaatccaacaccgcaaagtccaccccgtcgcagagagtagctag

SEQ ID NO: 24973 - DNA, 1392 bp, Artificial Sequence
  Description of Artificial Sequence: Synthetic coding sequence
atgatggctaaatctgccctcagagaaaacggtaccaactccgaaacattccggcaacggttccggcgattccattaccaagaggttgctggtcctcgggaagcattcagccagctgtgggaactgtgctgtcgctggctccggcctgaagtgcgtacaaaggagcagattgttgagttactagtgcttgagcagttcctgacagtactgccaggggaaatccaaaattgggtccaggagcagtgccctgaaaatggtgaggaggcagtgacgttggtcgaagacctggagagggagcctgggagacccagaagcagcgtgacggtttcagtgaaaggacaggaggtgaggctggagaagatgacgcctcctaagtcttcccaggagcttctcagtgttaggcaggagagtgtcgaaccacagccgaggggcgtaccaaagaaagaacgagcacggtctcctgacttgggccctcaggaacagatgaaccccaaggagaagctcaagcccttccagagatctggcttcgaggccggtttcgagaacgaggacaactcaaaacgggacatctctgaagaggtgcaattgcataggacattgttggcgcgttccgagcgtaagatccccaggtacctgcaccaaggcaagggaaacgagtctgattgccggagtgggaggcagtgggccaaaacttctggcgagaagcgtggcaaattgactcttccggaaaagagcctgagtgaggttctttcacagcagaggccctgcttgggagagcggccatataagtatctgaagtatagcaagtcttttggtccaaattctctgcttatgcaccaagtctcccatcaggttgaaaatccttacaagtgtgctgactgcggtaaaagtttttcccggtcggccagattgatccggcatagaagaatacataccggcgaaaagccatacaagtgcttggattgcggcaagtcattcagggattccagtaatttcattacccatcggagaatacatactggtgagaaaccctaccagtgcggcgagtgcggaaagtgttttaaccagagcagctccttaataattcatcagaggacacatacgggcgagaagccttatcagtgtgaggaatgcggcaaaagcttcaacaacagctcacactttagcgcccatagacgcatccacactggtgagcgcccacatgtctgtcccgattgtggcaaatccttcagcaagagttccgacttgcgggctcaccacaggacgcacactggggagaagccgtatggatgccatgactgcggcaagtgctttagcaagagcagcgctctgaataaacatggagagatccatgcccgagaaaaactcctaacacagtccgcccctaagtag

SEQ ID NO: 24974 - DNA, 2559 bp, Artificial Sequence
  Description of Artificial Sequence: Synthetic coding sequence
atgatggccaagtctgcactgagagaaaacggtactaacagcgaaactttccgtcagcgttttcgtcgatttcactatcaggaggtcgctgggccaagagaagccttctcccagctatgggaattgtgttgccgctggttgcgacctgaggtgagaactaaagagcaaattgtcgagctgctggtactggagcagttcctgacagttctgccgggagagattcaaaactgggtccaggagcagtgtcctgaaaacggagaagaagctgttacactggtggaggatctagaaagagaacccggacgcccaagatctagcgtgaccgttagcgttaaaggtcaggaggtaaggttagagaagatgacgccaccaaaatcaagccaggagctgttgagcgtacgacaggagagcgtcgagccccagccacgaggggtgccgaagaaagagagagccaggtctcccgaccttggcccacaagagcagatgaacccaaaggagaagttgaaaccctttcaaaggtctggcctgccttttccgaaaagtggggtcgtcagccgtcttgagcagggcgaaccatggattcccgacttattgggctcaaaggagaaggaattgccatcaggaagccatatcggtgaccgacgtgttcacgccgatctgctgcccagcaaaaaagatcgcaggtcgtgggtagagcaggaccactggtccttcgaggatgagaaggtggccggagtgcactggggctacgaagagacacgcaccctcctggccatcttgagccagacagagttttacgaagctctgcggaattgccatcggaactcgcaagtatatggtgctgtggccgagaggctgagggagtacgggtttctgcgcaccctggagcagtgtaggaccaagttcaaaggactccagaagtcatatcgcaaggtcaaatctggccacccccctgagacttgccctttttttgaggaaatggaggctttaatgtccgcccaagttattgccctgccatctaatggacttgaagccgcagcgagtcacagcggcctggtgggctccgatgctgagacggaggagcccggacaacgcggttggcagcatgaggagggggctgaagaggcggtggcacaggagtctgacagtgatgacatggacttagaggcgacacctcaggaccccaattccgcagcacccgtggtgttccggagcccaggaggcgtccactggggatatgaggaaacaaaaacttacctggctattctgtcggagactcaattttatgaagcacttagaaattgtcaccgtaacagccagctctacggggctgtggccgaaagactctgggagtacgggtttctgcgaacaccagaacagtgccgtacgaaattcaaatcactccagacctcataccgtaaggtcaaaaatggacaggcccctgagacatgtcctttttttgaagagatggacgctttggtgtctgtgcgggtcgctgcaccccctaacgacgggcaagaagagacagctagttgccctgtacagggcacttccgaagctgaggcacagaagcaggccgaagaggctgatgaggcgaccgaggaagattctgacgatgacgaggaggatacggagatccccccaggggctgttatcacccgtgccccagtgctgtttcaatccccgcgtggattcgaagcaggcttcgagaacgaggataactccaagagggatatctccgaagaagtgcaactgcacaggacactgttagctcggtcagagcgaaagattcctaggtatcttcatcaagggaagggcaatgaatccgactgcaggagtggaaggcagtgggcgaaaacaagtggcgagaagcggggaaaacttacattgcccgagaagtctctcagtgaagtcctgtcccaacagaggccttgcctgggagaaaggccatataagtatctcaaatacagtaagtcctttgggccaaattcattgctgatgcatcaggtgagccatcaagtagagaatccctataagtgtgccgactgtggcaagtcattcagcaggtccgccaggctgatcagacatagaaggattcacactggggagaaaccctacaagtgcttggattgtgggaaatctttcagagacagctctaattttataacgcaccgtaggatccatacaggcgaaaagccttaccagtgcggagaatgtgggaaatgctttaaccagagctcctcactgatcattcaccagaggacacacactggagagaaaccataccagtgtgaagagtgtgggaagtctttcaataactcctcccacttctcagcgcatagaagaatccacactggtgaaagaccccacgtgtgtcccgattgcggcaagagttttagtaagagctccgacctgagggcccatcacagaactcacactggcgagaaaccatatggatgtcacgattgcgggaagtgcttttccaagagcagtgctctgaataagcacggcgagattcacgcaagagaaaagctgcttacacaatctgctcccaagtag

SEQ ID NO: 24975 - DNA, 1485 bp, Artificial Sequence
  Description of Artificial Sequence: Synthetic coding sequence
atgtcaggcgaggccaccgtgcttgcttaccacgccccagaagaacaagaggggctacttgtggtaaaagtggaagaagagaactatgtcttagaccaggacttcggtctccaggaaaacccgtggagccaggaggtgttccggcaaaaattccgccaattttcctacagtgatagcaccggacccagagaagccctgtctcggctgagagagctctgttgccaatggttgcgacctgaggtgcacagtaaggaacagattctggagctcctgatgctcgaacagtttctcgctattctcccggaggaactgcaggcatggctgagggaacatcggccagaaaacggagaagaggctgtgacaatgttagaagagcttgagaaagagcttgaagaaccaagacagcaggacactactcacggtcaggagatgttctggcaggagatgacatccactggcgctctgaaaagtctgagtctgaactcacctgtacagcccctggaaaaccagtgcaagaccgaaactcaagaatcacaggcatttcaggagagagacggcagaatggttgcaggcaaagtattgatggcaaagcaagaaatagtcgaatgcgtcgctagcgcagctatgatctctcccggaaaactgccaggagagacacatagccagcggattgcggaagaggctctggggggtttagataactcgaagaagcagaaaggcaatgccgcagggaacaaaataagccaactacctagccaggacagacacttttcactggctacatttaatcggagaatcccgacggagcactctgtgctggagtcgcatgagtcagagggatctttctctatgaattccaatgacatcacacaacagtccgtagatacacgagagaaactgtacgagtgcttcgattgtggcaaggccttttgtcagagctctaagctgattaggcatcagcggattcatacaggcgagcgaccttatgcatgtaaggagtgtggcaaggctttcagtttgtcatccgacctggtgcgccaccaaaggatccatagcggggaaaagccatacgaatgctgcgagtgtgggaaggcctttagagggagctcggagctgatacggcacagaagaatccacacgggagaaaaaccctacgagtgcggcgaatgcggcaaggcattctcaaggagctccgctctgattcagcacaagaagattcatactggggacaaaagttatgaatgtattgcctgcggcaaagcattcggccgatcttcgatcctgattgagcaccagcgaattcataccggcgaaaaaccatacgaatgtaatgagtgcggcaagtccttcaatcagagctctgctttgacgcagcaccaacgcattcacactggcgaaaagccttatgaatgtagtgaatgtaggaagactttccggcatcgctccggcttgatgcaacaccagcgaacccacacccgcgtctag

SEQ ID NO: 24976 - DNA, 1284 bp, Artificial Sequence
  Description of Artificial Sequence: Synthetic coding sequence
caggaagtgtttcggcagaagttccggcagttctcctacagcgactccactggaccaagggaagcactttcccgcctgcgggagttgtgttgccagtggctgagacccgaagtgcatagcaaggagcagattctagagttgctgatgctagagcaatttttggccattttgcccgaggaattacaggcatggctgcgagaacatcgaccggaaaacggcgaggaagccgtgacaatgctggaagaactcgagaaggagctggaagagcctcggcagcaggtacgcagtaaacatttcttctgcgtgcctgccacgaccgtgtcttctgtcatgggatcaaagatattgaccctctccattcacatattccgctggcaggacgggggttggcagtccgtggacgggaaggcccgaaactctagcgcagctatgatctcccctgggaaactgcccggtgagacgcacagccagaggatagctgaggaagcgctcggcggactcgacaacagcaaaaagcagaagggaaacgccgcaggcaacaaaatctctcagctgccctctcaggataggcacttttccctggctacatttaacaggcgtattcctaccgagcacagtgtactcgagagtcacgagtcagaagggagtttctctatgaactcaaatgacattacccaacagtcagtggatactcgcgagaagctgtatgaatgcttcgattgcggaaaagccttttgtcaatcctctaaattgatccgccaccaacgtatccacaccggcgaaaggccatacgcctgcaaggaatgcgggaaggccttctctctgagcagcgatctagtcagacatcaacgaatccactccggggaaaagccttacgaatgctgcgagtgcggaaaagcattccggggttcgtcagaactgattagacatagaagaatacatactggggagaaaccatacgaatgcggcgagtgtggcaaagcctttagccgctccagcgcgctaatccagcataaaaagatacatacgggggacaaaagctacgagtgcattgcctgcgggaaggcattcgggcgttcctcaattctaatcgagcaccaacgcatccataccggagaaaagccttacgagtgtaatgagtgcggtaagtcttttaatcagagttccgccctgactcagcaccagcggatccatactggcgaaaaaccatacgaatgctcagagtgcagaaaaactttcagacaccggtcaggcttaatgcaacaccaaaggacccatacgtag

SEQ ID NO: 24977 - DNA, 666 bp, Artificial Sequence
  Description of Artificial Sequence: Synthetic coding sequence
atgtctggggaggccaccgtccttgcatatcatgccccagaggaacaagagggtctgctggttgtgaaggtggaagaagaaaactatgtgttggaccaggatttcggcctccaggaaaatccttggagccaggaagtttttagacagaaatttcgacagttctcctattcagactctaccggcccaagggaagccctctctagactccgggagctctgttgccaatggctgagacccgaggtccattccaaggagcagatcctggaactgttaatgctcgagcaattcctggcgattttacccgaagaactacaagcatggctacgagagcaccgaccggagaacggagaggaagcagtaactatgttggaggagcttgagaaggagttggaagagcccagacagcaggacacaacccatggacaggagatgttctggcaggaaatgaccagcactggcgctctgaaatcactgtccttaaactcccctgtgcagccgctggagaaccagtgtaaaacggaaacgcaggagtctcaagccttccaggagcgagatggagtcagcttatatcaccccggatggtccgctgtggtgcagccccagctgacagccgcagcactgaatccctgggttaaggtgatcctcctgccgcagccaccggagtag

SEQ ID NO: 24978 - DNA, 1485 bp, Artificial Sequence
  Description of Artificial Sequence: Synthetic coding sequence
atgtccggggaggcaacagtactggcctaccatgctccagaagaacaagaaggccttttagtggtgaaggttgaggaggaaaactatgttctggatcaggacttcggtctccaagaaaatccttggtctcaggaggttttcaggcagaaatttcggcaattcagctacagcgatagtaccgggccacgagaggccttgagtagactacgcgagttatgctgtcaatggctgcgtcccgaggtacattccaaagagcagatactggaattgctcatgcttgaacagttcttggctattcttcccgaagagctccaggcttggctcagagagcatcgcccagaaaacggcgaggaagcagtcaccatgttggaggagctggagaaagagctcgaagaaccacggcagcaagataccacacatgggcaggaaatgttctggcaagaaatgacgtcaacaggtgccttgaaatcattgtcgctgaatagtccggtgcagcccctggaaaaccaatgtaaaaccgagactcaagaatctcaggcctttcaagagcgtgacggcaggatggtcgctggcaaggtccttatggccaagcaggaaattgtagaatgtgtcgcctcagctgccatgattagtccgggaaagcttcccggagagacccatagccagaggatcgccgaggaggccctgggaggcctggacaatagtaagaagcagaagggcaacgccgctggaaacaagattagccagctcccatcacaagaccggcattttagcttggccacttttaatcgacgcattccgactgaacacagtgtcctggagagtcatgaaagcgagggttctttttccatgaacagcaacgacattacccagcagtcggtagacaccagggagaagctctatgagtgcttcgactgcggcaaggccttctgtcaaagtagcaaactgattaggcaccaaaggattcacactggggaacggccatacgcttgtaaagagtgtggcaaagcattcagcctgagctcagacctggtcagacaccaacgcattcacagcggagagaagccatacgaatgttgcgaatgcgggaaggctttcagaggatccagtgaactgatccggcacagacggattcatacaggggagaaaccctacgaatgtggtgagtgcggcaaggcattttcaaggtccagcgcgctaatccagcacaagaaaatacacacaggggacaaatcttatgaatgcatcgcttgcggcaaggcatttggtcggagctctattcttatcgagcaccagcgaatccatacaggggaaaaaccttacgagtgcaatgagtgtgggaagtccttcaaccagtcctccgctttgacacagcatcagaggatccacaccggagaaaagccttatgagtgtagcgagtgcaggaaaactttcaggcatagatctggactgatgcagcaccaacgcactcacacccgagtctag

SEQ ID NO: 24979 - DNA, 1140 bp, Artificial Sequence
  Description of Artificial Sequence: Synthetic coding sequence
atgatcgtgcgaccaccacagcccagggaaacttccgtcgtcaccttccatggaaaggaatacatcgtgcaggactccgacattgaaatggccgaggccccttcttccgtgcgggacgacttaaaagatgtatctagtcagcgcgcatctagtgtgaatcagatgcgccctggagaggggcaggctcaccgggaactgcaaattctgcctagagtgcctgctctgtccaggagacaaggggaggacttcctcctgcataagtccatcgacgtaactggtgacccgaaaagtctaagaccaaagcagacgcttgagaaagacctcaaagagaaccgggaggaaaacccgggactaacctctccagaaccccagctcccaaaatcacctaccgatctggtgagggctaaggaaggaaaggaccctcccaagatcgcctcagtggagaacgtggatgccgatacaccatccgcttgcgtggtggaaagagaggctagtactcattcagggaatcgcggagacgcactgaacctttcttcccctaaacggagtaagcctgacgcctcttctatttctcaggaagagccccagggggaagctacaccggttgggaaccgcgagtcaccgggtcaggcagggatgaattccattcatagtccaggacctgcatcgcccgtcagccatcccgacgggcaagaagccaaagccttgccgcctttcgcctgtgatgtatgcgaaaagcggtttacatgcaacagtaaactggtgattcacaagagatcccatactggtgagcgcttgtttcagtgtaacttgtgcggcaaaagattcatgcaattaatttccctgcagtttcaccagaggacccacaccggcgaacggccatacacctgtgatgtgtgccagaaacagttcactcagaaatcatatctgaagtgccacaaacggtcacatactggtgaaaagccctttgagtgtaaggattgtaagaaagtgttcacttataggggatcactgaaagagcaccagcggattcactctggcgagaaaccatacaagtgttctaaatgcccaagggcgttcagtagactcaaactgctcaggcgacaccaaaagacccaccccgaggccacttcccagtag

SEQ ID NO: 24980 - DNA, 1491 bp, Artificial Sequence
  Description of Artificial Sequence: Synthetic coding sequence
atggctgctaattgcacctcatcgtggagcttgggcgaatcctgcaacagacccggactcgagctcccccgttccatggcttcttccgaaacacagttagggaatcatgatgtggatcctgaaatttcacatgtaaatttccgtatgttttcttgccccaaggaatccgatccaattcaggcactgcgcaaactcacagaactttgccacctatggttgagacctgacctccacacaaaggagcagattctggatatgctggtcatggagcagtttatgatatccatgccacaggaactgcaagtgctggtgatgatgaacggtgtgcaaagttgtaaggatcttgaggatctgcttagaaacaacagacggcctaaaaaatggagtgttgtcacctttcatggtaaagagtatattgtacaggattcggacatcgaaatggcggaagcgccatcctcagttcgggatgacctcaaggatgtatcttctcaaagagcgtcatccgtgaatcagatgcgccctggagagggtcaagcccaccgtgagctccaaattctgccaagagtgcccgctctgtctaggaggcagggtgaagactttctattgcacaagtctatcgatgtcacaggcgatccaaaatcattgcggcctaagcagaccctggagaaggatctgaaggagaacagagaagagaatccagggctgacctcacctgaaccacagctgccgaagagtcctaccgacttagtgagggctaaagaaggcaaagaccctcccaagattgcttctgtggaaaacgtggatgcagacaccccctcggcttgtgttgtggagcgcgaagccagcacccactcaggcaatcggggagacgcattgaacctgagctctcccaagcggagcaaacctgacgccagttccatttctcaggaggagccccagggcgaggccactccagtgggcaacagagaatctcctggccaggcagggatgaactcaattcattcacccggaccagcctcacccgtgtcccatcccgacggacaggaagctaaagcactccccccatttgcatgcgatgtttgcgaaaagcggtttacttgtaattccaagttggtgatccacaaaagaagtcacacaggcgagcgcctcttccaatgcaatctttgcggaaagcgctttatgcagttgatcagccttcagtttcaccagagaactcacaccggggaacggccatatacgtgtgacgtttgccagaagcagttcactcagaagagctacctgaagtgccataagcgcagtcacactggggagaaacctttcgagtgcaaagattgtaagaaggtctttacatacaggggaagccttaaagaacaccaaaggatccatagtggcgagaagccctacaagtgcagcaagtgtccccgagctttctcacggctcaagcttctaagaagacatcagaaaacccatccggaggcaacttctcagtag

SEQ ID NO: 24981 - DNA, 2274 bp, Artificial Sequence
  Description of Artificial Sequence: Synthetic coding sequence
atggacgtggccgagtctcccgagcgggatccccactctcccgaggatgaagaacaaccacaaggcctgtcagacgacgatatcctgcgcgacagtggaagcgatcaggacctggatggcgcaggcgtcagggcctccgacctggaagatgaagaatcggctgccagggggccttcccaggaagaggaagacaaccactctgacgaggaggacagagcatccgaaccaaaatctcaggatcaagacagcgaagtaaatgagttgtcacgaggaccgacatcttctccctgcgaggaggagggagacgaaggtgaagaggataggacctccgacctccgggatgaagcctctagcgtgaccagggagctcgacgagcatgagctcgactacgacgaggaggtgccagaggaaccagcacccgctgtgcaggaggacgaggccgaaaaagcaggagccgaggatgatgaagagaagggggagggaacaccacgcgaggaggggaaagctggcgtgcaatccgtgggtgaaaaagagagcctggaggctgcaaaggagaaaaagaaggaggatgatgacggggaaatcgacgacggtgagattgacgatgatgatctggaggagggagaggtgaaagatccttccgaccgaaaagtccgcccaaggccaacctgccgattcttcatgaaggacgtcgtgacgccgctgagtactcttctccctccaatctccaacagtatcccgtttagggggcaagtgaaaggcaactgtacttggggtatgaactgccggttcattcatcctggcgttaatgacaaagggaattacagccttattaccaaagccgatccgtttccacctaacggagctccgccactcggtccacatcctctgatgccagcgaatccatggggaggccctgtggtcgacgagatcctgccgcctcctcctcccgagccgccaacagaaagcgcctgggagcggggactccgtcacgccaaagaggtgttgaaaaaagccacaatccgcaaagaacaggagcctgacttcgaggaaaagaggttcaccgtgaccatcggggaagacgagagagaattcgacaaagaaaacgaggtttttcgagactggaattccaggatcccaagagatgtgcgggacactgtcttggaaccatatgcagacccgtattatgattatgagatcgaacggttttggcgtgggggtcagtatgagaatttccgtgtgcaatacaccgagaccgagccttaccacaattaccgcgaaagggagcgcgagcgcgagagggaaagagaccgagatagggaaaaagaacgagaaaaggaaaagggaaagccaaaacccaggagcccacagccgccttccaggcaggccgaaccaccaaaaaaggaagccgctacaaccgggcctcaagttaaacgtgcagatgagtggaaagatccgtggcgccgttccaaatccccaaagaagaaactcggagtctcagtcagtccctctcgagcaaggagaagacggaagacatccgcttccagtgctagcgcttccaactctagtcggtcttctagtcgctcaagctcctattccggctccggctccagcagaagccgatcaaggtccagcagctactcttcatattctagtcggtcatccaggcattcttcttttagcggcagtagatcacgctcaagatccttcagtagttcaccttcaccttccccaaccccttcaccacatcgcccatcaattcgcaccaagggcgagcccgctcccccacccggaaaggcgggagaaaagagcgttaagaaacctgctccccctccagcccctccccaggccaccaagacaaccgctcccgtccctgaaccaacaaagccgggagatcctagggaggccagacgcaaagaaaggccagcgaggactccccctcgcaggagattgattaaggaggctggcagcgcgatgaatcaccaaactaggactggaagggcgctgctacagccttctggcccaacccatcctcagaccgaagttctgggcaccggtagccaggtgggggactgggctccgcgtagccaatctggcagggaagcaagaacccctaagcctttgcagcctcggttgaccgggtccgcctcctgtcacccttcaccacgcgcacccgcacgtagtcgcgcttgccctgccaagccacgcattccagcgcctccagccccaaaccaggggaggcctgctcggtgcttagggggtcggtcttgctag

SEQ ID NO: 24982 - DNA, 2862 bp, Artificial Sequence
  Description of Artificial Sequence: Synthetic coding sequence
atggacgtggctgagtcacctgagcgagaccctcattcccctgaggatgaggaacaaccccaggggctttcagatgacgatattctacgcgactctggcagcgatcaggatctcgacggggctggagtacgggcaagcgacctggaagacgaagaatctgccgcaagagggccttcccaagaggaggaggacaaccattcggatgaggaggaccgcgcttccgagcccaagtctcaggaccaggatagcgaggtcaatgaactgtcacgcggacctacttcctccccctgtgaggaagagggcgacgaaggggaggaggaccgcacaagtgacctgcgggatgaggcgtccagtgtgacacgcgagctcgatgaacatgagctggactacgatgaggaggtcccggaggagcccgctcctgccgtccaggaagacgaggctgagaaagccggagcagaggacgacgaggaaaaaggagaaggaacacccagggaagaggggaaggccggagtgcagtccgtgggtgagaaggaatctctggaggcagccaaggaaaagaagaaagaagacgatgacggggaaatcgatgacggcgagatcgatgatgatgatctcgaagagggagaggtcaaggacccttccgatcggaaagtgaggccacgacccacctgtaggtttttcatgaagggaaactgcacttgggggatgaactgtcggttcatacaccctggagtcaacgataaggggaattattcactcatcacaaaggctgaccctttccctccaaatggcgctcccccattaggtccgcaccctctcatgcccgcaaacccttggggcggacctgttgtggacgaaatcctgccaccaccaccacctgaaccaccgaccgaatccgcctgggaaagggggctgcgccatgcaaaagaggtgctgaaaaaggcaaccattagaaaagagcaggaacctgactttgaagaaaagagattcactgtcactattggagaagacgagagagagttcgataaggagaacgaagttttcagggattggaacagccggatcccccgtgacgttagggatacagtgcttgagccgtacgccgatccatactatgattatgagattgagagattctggcgagggggacaatacgagaattttcgggtccaatacactgagactgagccttatcataactatagggagagagagagagagcgggaaagggagaatcgccaaagggaacgcgagcgggaaagagagcgcgatagagagcgggaacgtcggcagagggagagggagagagagcgagagcgcgaaagagacaaggagcgtcagcgacggaaggaagagtgggagagggaaagggctaaaagggacgaaaaagaccgacaacatagagaccgcgatagagagaaggaaagagagaaggagaaagggaaaccaaagccaaggagcccacaaccacccagcagacaggcggagccacccaagaaagaagctgcaacaacaggccctcaggtgaagcgggctgatgagtggaaagacccatggcgacggtcaaaaagccccaaaaagaagctgggggtgagcgtgagtccaagcagggcccgaagaagacgcaagacatccgcatcctctgcctcggctagcaatagttcaagaagcagctctcgcagttcctcttacagcggctccggttcaagtcgctccagatcacggtcgtcttcttacagctcctactcttcacggtccagcaggcatagtagctttagcggttcacggtcaaggagccgttccttcagcagttccccttcgcccagtccaaccccatctccccatagacctagcatacgcacaaagggcgagccagctccacccccaggcaaggctggagaaaaatcagtgaagaagcctgcccctcccccagcaccaccacaagcaaccaaaacaacagctcctgtccctgaaccaactaaacccggagacccacgcgaggccaggcgcaaggagaggccagccaggaccccaccaagacggcgaacactgagcgggtcgggctctggatccgggtcatcatactctgggtcctcttcaagatcccggtcattgtcggtatcctccgtctccagtgtgtccagtgccacttcttctagtagtagtgcccattccgtggattcagaggacatgtacgctgacctggctagtcccgtgtcttccgcgtcgtcccgttctccagccccagcacaaactcgaaaggagaaaggaaagtcaaagaaggaagacggcgtgaaggaggaaaaaagaaaaagagactctagtacacagcctcccaagtccgcaaaacccccagccggaggtaagagtagtcagcagccttcgactcctcagcaggcacctccaggacagccccaacagggcacattcgtggcccacaaggagatcaagctcaccctgctaaataaggccgctgataagggatcgcggaaaaggtatgagcctagtgacaaggatagacagtcccctcctccagctaagagacccaacaccagccctgaccggggtagcagagaccgtaagtccgggggaagattgggatcccccaagccagaacgacagcggggacaaaactcaaaggcccctgcagccccagcagaccgcaagagacagctgtctccacaatccaagtcaagttcaaaagtcacgtcagtccctggcaaggcaagtgatcccggagctgcgtcgaccaaatcaggcaaggctagcaccctcagccgccgtgaggagctgctgaagcagctcaaggcagtggaggacgcaattgcccgaaagcgggctaagattcccggtaaggcttag

SEQ ID NO: 24983 - DNA, 2934 bp, Artificial Sequence
  Description of Artificial Sequence: Synthetic coding sequence
atggacgtcgccgaatcacccgagcgggatccacacagtccggaggatgaagaacaaccacagggactgagcgatgacgatatactccgagacagcggctctgaccaggatctcgatggagcaggagttagggcatctgatctggaagatgaggaatcggctgccagggggcctagtcaagaagaagaggataaccattcagatgaggaagaccgcgctagtgagcccaagagccaagaccaggacagcgaggtcaatgagctgtcccgaggcccaacttctagcccatgtgaagaggaaggagacgaaggtgaggaggaccgcaccagcgaccttcgggatgaagccagctccgtcactcgcgaactcgacgagcacgagttagactacgacgaagaggtcccagaggagccagcccctgcggtgcaagaagatgaagccgagaaggccggtgccgaggatgatgaggagaagggcgagggcacacccagggaggaaggaaaggccggagtccaatctgttggcgaaaaagagtcccttgaagcagccaaagagaaaaagaaagaggacgacgacggagaaattgacgacggcgagatagatgacgacgatctcgaggagggcgaggtgaaagacccgagcgacagaaaagttcgacccaggcctacctgtagattctttatgaaggacgtggtgactcctttgtccacgttactgccacccatctccaatagtatccccttccggggacaggtgaagggaaattgcacatgggggatgaattgtcgttttattcacccgggtgtgaatgacaaaggcaattattcgttaatcacgaaggccgatccgtttcctcccaacggcgctccaccccttggtcctcatccccttatgcctgcaaatccgtggggcggaccagtcgtcgacgagattctccctccgccaccccctgaaccaccaaccgagagcgcctgggaaaggggtcttaggcacgccaaggaagtgctcaaaaaggccactatcaggaaggaacaggagccagactttgaggagaagaggttcaccgtcactattggagaggacgaaagagaattcgataaggaaaacgaggtttttagggactggaattctaggatccctcgggacgtcagggatacagtactagaaccctatgctgacccgtactacgattacgaaatcgagcggttttggcgcggtggccagtatgagaattttcgagtgcagtacaccgagaccgagccatatcataactacagggagagggagagagaacgggaacgggagaataggcaacgggagagggagagagagagagagcgggatagagagcgggagaggcgccagagggaaagagaacgagagagagaacgagagcgcgacaaggagagacagaggcgaaaggaagagtgggaacgcgaaagagccaagagagacgaaaaagacagacagcatcgagatagagatcgggaaaaggagagagagaaggaaaagggcaagccgaagcccaggagcccacagccgccatccaggcaggcagaaccgccaaaaaaagaagcagcaactacaggaccacaggtaaagagagcagacgagtggaaggatccctggagacggtcaaagtccccaaaaaaaaagcttggcgtgtcggtcagcccatctagagctcggcgtaggaggaagacctccgctagttccgccagcgcctcaaacagctcccgatctagctcaaggtctagcagctactctggttccggcagcagtagatcacgcagtcgaagttcatcctactctagttacagctcacgttcctcgcgacactcttccttctcagggagcagaagcaggtctcggtcattcagttctagtccttctccttctcccactccatcaccacacaggccttccatcagaaccaaaggagagcctgctcctcctcccggtaaggctggggagaaatccgtaaagaagcccgcacccccaccagcaccacctcaggctaccaaaacaacagctcccgtgcctgaacctacgaaacctggagaccctcgggaggctcggagaaaagaacggccagccaggacccctccacgtaggcgaacactgtccggctcaggatccggcagcggctcttcctacagtgggagctctagtagaagccgctccctaagcgtgtcaagcgtctcatccgtgtcttcagctacaagttccagcagcagcgctcacagtgtagactcggaggatatgtacgcagacctcgccagccctgtgagtagtgccagctctaggtctcctgcacccgctcagacgagaaaggaaaagggaaaatccaagaaggaagacggtgtaaaggaagaaaaacgcaagagggacagctcaacacagccccctaagtcagccaaaccgccagccggaggtaagagttcccagcagccttctaccccccagcaggcccctccaggacagcctcagcagggcacgttcgtggctcacaaagaaataaagcttacactactgaacaaggccgctgataaaggttcccgtaaacggtacgaacctagcgataaggacaggcagtcaccacctcccgctaaacgcccaaacacgagcccagacaggggtagcagagacagaaaatcaggcggtagacttggctcgcccaagccggaacggcagcgtggccaaaactccaaggccccagccgctcctgccgacagaaagagacagctgagcccccagagcaagtcgagcagtaaagtgacgtccgtaccaggtaaagcaagcgaccctggtgcggcttctactaagtcaggcaaggcgtcaacactttcacggagggaggaactcctcaaacagcttaaagcggttgaagatgccattgctaggaagcgagccaagatccccggaaaggcatag

SEQ ID NO: 24984 - DNA, 999 bp, Artificial Sequence
  Description of Artificial Sequence: Synthetic coding sequence
atggatgtggccgaatcccccgaaagagatccacactctcccgaagacgaagaacagcctcagggtctgtccgatgacgatattctacgcgacagcggctccgaccaggacctcgacggcgcaggtgtcagggcctctgacctggaggacgaagaatcagccgctcgaggaccatcacaggaggaagaagacaaccattcagacgaggaagacagagcatctgagcccaaatcacaggatcaggacagcgaagacgacgacctggaggaaggagaagtcaaggatccctctgaccgcaaggtcagacctaggcctacatgcaggttttttatgaaagggaactgcacgtggggtatgaactgcagatttatacaccctggggttaacgataagggaaattactcactaatcacgaaagccgacccttttccgcctaacggggctccacctctcggaccccatccattgatgcctgccaatccctgggggggaccagtggttgacgaaattttgccaccaccccctccggaaccaccaaccgagtccgcatgggagcgaggcttgcggcacgccaaagaggtactaaaaaaagccaccataagaaaggaacaggagccagactttgaggagaagagatttactgtgactatcggggaggatgagcgcgagtttgacaaagagaatgaggtgttcagggattggaactcacgcatcccacgagacgtccgcgataccgttttagagccctatgccgatccatactacgattatgaaatagaacggttttggagggggggtcagtacgagaacttccgggtgcaatataccgagaccgaaccctatcataattatagagagagagagcgtgagagagagcgagagaatcgtcagcgagagcgtgacaaggagagacagcggaggaaagaggagtgggagagagaaagagcggcaaagttgtcccatcagagaaggcgtcttccaccgagaggaaggagatag

SEQ ID NO: 24985 - DNA, 2847 bp, Artificial Sequence
  Description of Artificial Sequence: Synthetic coding sequence
atggaggagaaagagattttacgccgtcagatccgcctcctccaaggactaatcgacgattacaaaactctgcacgggaacgcccctgctcctggtacaccagctgccagtggttggcaaccccctacatatcattcaggtagagcctttagcgcacggtacccaagaccctcacgacgcggttactcttcgcatcatgggccatcatggcggaagaagtacagtttagtaaaccgtcctcctggcccttccgatcccccagccgaccacgcagtgcggcctctgcacggcgcacggggaggacagccccctgtcccacagcagcacgtgctggaacgccaagtgcagctgagccagggacagaatgtggtgatcaaagtgaagcctcctagcaagagcggtagcgcaagcgcgtcaggtgcccagaggggatcattagaggagtttgaggagacaccttggagcgatcaacggccacgcgaaggggaaggggagccacctcgcggtcagctgcaaccctctagacccacaagggcacggggaacgtgctcagttgaggaccctctgctggtgtgccagaaggagccgggtaaaccccgaatggtgaagtccgtggggtccgtgggggactcccccagagaaccaagaaggaccgtcagtgagtctgtcatagctgtgaaagcaagttttccttccagcgctctgcctcccaggactggagttgcactcgggagaaagttgggatcacattcagtcgcttcttgcgctccacagttgctgggagatcgtagggtggacgccggtcacaccgatcagcctgtcccctctgggtccgttggcggtcccgcaaggccagcaagcgggccacggcaggccagggaggcctcacttgtagtgacatgtagaactaataagttccgaaaaaacaactataagtgggtggctgccagctcaaagtcacctagggtcgccagacgcgcactgtcccccagagtggcggctgagaacgtctgtaaggcttccgccggtatggctaataaggtggaaaagccacaactgattgcagatccggaacccaaaccacggaagccagctacctccagcaaacccggtagcgcgcctagtaagtacaaatggaaagctagcagtccctctgcatctagcagctcctccttccggtggcagtccgaggcgagttctaaagaccatgcttcccaattaagccctgtgctatcaagaagtccatctggcgatagaccggcagttgggcacagcggtttgaagccactatccggcgagactcctctctccgcctacaaggtgaaaagtagaacaaaaatcatccgacgaaggtccagcactagtcttcctggggacaaaaagagtggtacatcacccgcagccaccgctaagagccacctgtccctgaggcgcaggcaggcattacgaggaaagtctagtcccgtactcaagaaaacccccaacaagggcctggtgcaggtcaccacgcaccgactgtgcaggctgccaccaagccgggctcacttgccgacaaaagaggcttcaagtctgcatgcagtccgcacggcgcctacaagcaaggtgatcaagacacgctaccggattgtcaagaagacgcctgcctcgcctctaagcgctcctccctttccactctccctgccctcatggcgcgctaggcggcttagcttgtccagatcactggttctcaaccgactgagacctgtggcctcgggtggtggcaaggctcagcccggttcgccgtggtggcgatccaaaggctacagatgtattggtggtgtcttgtataaagtatccgctaataaactgtcaaagacctctggacagccttcagacgccggaagtcgtccactgctccggaccgggagactggatcctgccggaagttgttcgcgctctctagcatccagggcagtgcagcggtccctggcaatcataagacaggctagacagcgcagggaaaagagaaaggagtactgtatgtattataaccggtttggcaggtgtaacagaggggagcggtgcccttacatacacgatcccgaaaaggttgctgtgtgcacaaggtttgtgaggggtacatgtaagaaaacggacggcacctgtccgttttctcaccacgtcagcaaggaaaagatgccagtgtgctcctattttctgaagggtatctgcagtaactcaaattgtccttatagtcacgtgtatgtgagcagaaaggccgaagtgtgttctgactttctaaaaggctactgtcctctgggcgcaaaatgcaagaagaagcatacactgctctgtcccgattttgctcggagaggtgcctgccccagaggggcacagtgccagttgctgcataggacgcagaagcgccatagcagaagagccgcaacttcacctgccccaggcccttctgatgccactgcacgctccagagtatctgccagccatggaccaaggaagccctcagcttcgcagaggcccaccagacagactccctcatcagccgctctgaccgccgcagcggttgcggctccccctcactgccctggcggaagtgccagcccaagctcctctaaagcaagttccagttcttcctcctctagttcccccccagcttctcttgatcacgaggccccttcattacaggaagccgctctggctgcagcctgctctaataggctctgtaaactgccaagtttcattagcctgcagtctagcccctcaccaggcgctcagcccagagtgcgcgcaccgcgtgccccactcaccaaggattccggaaagccgctgcacatcaaaccgcgattgtag

SEQ ID NO: 24986 - DNA, 2916 bp, Artificial Sequence
  Description of Artificial Sequence: Synthetic coding sequence
atgagcaatgtgagcgaggaacgcaggaagcgccagcagaatataaaggaggggctccagttcattcagagtccgctatcatatcccggtacacaggaacagtatgccgtgtatctgcgagctctggtccgtaacctgtttaatgagggtaacgacgtgtatcgcgagcatgattggaataatagcatttcccagtataccgaggccctcaacatcgcagactatgctaaatctgaagaaatcctcatccctaaagagatcatcgaaaagttatatatcaacaggattgcatgttatagcaatatggggtttcacgataaagtcctggaggattgcaatatcgtgctgtctctgaatgcctctaattgtaaagcgctttatcggaagtcaaaagccctgtccgatctcggccgatataaaaaagcctatgatgccgtggccaagtgtagcctcgcagtcccacaggatgaacatgtgattaagctcactcaggaactcgcccagaaactgggattcaaaattaggaaagcttatgtgagggccgaactcagcctgaaatcagttccgggagacggggctacaaaggcgctcaaccattctgtggaggatatcgagccagatctgctcactccccgacaagaggcagtccctgtcgtaagtctaccagctccctcattttcgcacgaagtgggaagcgaacttgcctccgtcccagtaatgccacttacaagcatcctgcccttgcaagtggaggagtctgctctcccctccgccgtcttagcgaacggtggaaagatgccctttacaatgccagaggccttcctggacgacggcgacatggtgctgggcgacgagctggacgatttgttagattctgccccagagacgaacgaaacagtgatgccaagtgcgctggtccgaggccctctccagacggcctcagtgagcccctcaatgccattctcagctagcctattgggcaccctgcccatcggtgctcgctatgcccctccgccttcatttagtgagttttatccaccacttacatctagcctggaggacttttgtagtagtcttaattcatttagcatgtccgaaagcaagcgcgatctatcgacgagtacctcgagagaagggactcccctcaacaattccaactccagtctgctgttgatgaatgggccaggctccctgtttgcttctgagaactttcttggaatttcatctcagcccagaaacgactttgggaatttcttcggctcggcagtgacgaagcctagctcctctgtgacacctaggcaccccctagaaggaacccacgagctgcgtcaggcctgtcagatttgttttgtgaagtcaggaccaaaacttatggacttcacataccatgccaacatcgatcataagtgcaaaaaggatatcttaatagggaggatcaaaaatgtggaggataaaagctggaagaagatcaggccccgaccaactaagactaactacgagggtccctattatatctgcaaggacgtggctgccgaagaagaatgtagatactccgggcattgcacattcgcctattgccaggaggaaattgacgtatggacattagagaggaagggagcttttagcagggaagcattctttggcggtaatgggaaaataaacttaacggtgttcaagctgctgcaggaacatctgggtgaatttatcttcctatgcgagaaatgcttcgaccacaagcctcgcatgatctccaagcgcaacaaagataatagcacagcctgttctcatcctgtgactaagcatgagttcgaagataacaagtgtctggttcacattcttcgggaaactactgttaaatacagtaagatacgctcatttcatggacagtgtcagctagacttatgccgacacgaagttagatacgggtgtctcagagaagatgaatgtttctacgctcacagcctagtggagcttaaagtctggatcatgcagaacgagaccgggatttcccacgatgcgatcgcccaggagtccaagcggtattggcaaaaccttgaggctaacgtgcctggcgcacaggtgctgggtaaccagatcatgcccggatttctcaacatgaagattaaattcgtgtgcgcacagtgtttacgcaatggccaagtgatcgagcctgataaaaacaggaagtattgtagcgcaaaggcgcgtcattcatggacaaaagacagaagggctatgagagttatgtcaatcgagcgcaagaaatggatgaacatccgccctctgcctactaagaaacagatgccactgcagtttgatctgtgcaaccatattgccagtggaaagaaatgtcagtatgtgggaaattgctcttttgcacatagtcccgaagagcgcgaagtttggacctatatgaaggaaaatggtatccaggacatggaacaattctacgagctctggctcaagagccaaaagaacgagaaaagcgaagacatcgcttctcaatcgaataaagagaacggcaagcaaatacatatgccaactgattatgccgaggtgaccgtagattttcactgctggatgtgcggcaagaattgtaatagtgaaaagcagtggcaggggcatattagtagcgaaaagcataaggaaaaggtcttccatacagaggatgatcagtattgttggcagcaccgcttccccacgggctactttagtatttgtgatcgctatatgaacggcacttgcccggaaggcaattcatgcaaattcgcccacggaaatgccgaactgcacgaatgggaggaaagacgagacgccctgaagatgaagctcaacaaggctcggaaagaccaccttatagggccaaatgacaacgattttgggaagtactcatttttatttaaggatctgaattag

SEQ ID NO: 24987 - DNA, 2916 bp, Artificial Sequence
  Description of Artificial Sequence: Synthetic coding sequence
atgagcaatgtctccgaagaacggaggaagaggcagcagaacattaaagagggattgcagtttatccagtcccccctgtcttacccaggaacccaggagcagtacgccgtgtacctgcgagcccttgtgagaaatctgttcaatgaaggaaatgatgtataccgcgagcacgattggaataactccatatcccagtacactgaggctctgaacatcgcagactacgctaagagcgaggagatattgatcccgaaggagatcatcgaaaagctctacatcaataggattgcgtgctattctaacatggggtttcacgataaggtcctcgaggactgtaacatagtgctaagtctgaatgcatctaattgcaaggctctctacagaaagtctaaggccctgtccgatctgggaagatacaaaaaggcttatgatgcggtcgccaaatgtagcctggccgtcccccaggacgagcatgtgatcaagctgacacaggagctggcacagaagctgggatttaagatccgcaaggcctacgtcagagcggagctgagtcttaagagtgttcccggagatggggctactaaggccctcaatcactctgtcgaggatattgaaccggatctcctgacccctcggcaggaagctgttcccgtggtgtccctgcctgcaccatcattcagtcatgaggtcgggtcggaactggcttctgtgccagtcatgcccctgacctctatcttgcccctccaggtggaggagtccgcactgccttcagccgtgctggctaacgggggtaaaatgccctttactatgccggaggctttcctggatgatggcgacatggtgttgggcgacgagcttgacgatctcttagattctgcgccagaaacaaacgagaccgtgatgccgtctgctctggtgaggggaccgctccaaaccgccagcgtctcaccgtcaatgcctttctccgcgtcactcctaggaaccctacctatcggtgccaggtatgctcccccaccttctttctctgagttttaccctccactgacttcgagcctcgaagatttttgttcatctctgaactctttttcaatgtctgagagcaaaagggacctgtccacttctacttcgcgtgagggaacaccactaaacaattccaattcaagccttctccttatgaatgggccaggtagtctgttcgcctcagaaaacttccttggaatctcaagccagcccaggaacgatttcggtaacttcttcggctctgcggtgaccaagccctcaagctcagttacccccagacacccgctagagggcactcatgagctgcgacaggcctgtcagatctgctttgtgaagtccggtccaaaattgatggacttcacttatcatgccaacatcgatcataagtgcaagaaggatattctgatcggacgaataaagaatgtggaggacaagtcttggaaaaaaatcagacccaggccaacaaaaaccaattatgagggaccttattatatctgtaaagatgtagcggcagaggaggagtgtcgctattctggacactgcacttttgcttactgtcaggaggaaatcgatgtctggactctggagcgtaaaggcgctttctctagagaagcattctttggagggaatgggaaaatcaacctgacagtgtttaagctgttgcaggagcatttaggtgaatttatctttttatgcgaaaagtgtttcgaccataagcccaggatgatttccaaacgtaacaaagacaattccacagcgtgctcccatcccgtaaccaagcatgaatttgaggataataaatgcctggtacatatcttgcgcgagacgaccgttaagtatagtaaaatccgcagcttccatggccagtgccagcttgacctgtgtaggcatgaagttaggtatggctgtttacgggaggatgagtgcttctacgcacattccctggtggagctgaaggtctggattatgcagaacgaaacgggaatctcacacgacgccatagctcaggagagtaagaggtattggcagaacctggaggccaacgttcccggagcccaagtccttggtaaccagatcatgcccggattcctgaatatgaaaatcaagttcgtgtgtgctcagtgtctgagaaatggtcaagtgatcgagcccgataagaatagaaagtattgttccgctaaggctaggcattcatggactaaggacaggcgtgcaatgagagtcatgtctatcgagagaaaaaagtggatgaatattcggccattacccacgaagaagcagatgccacttcagttcgatctgtgcaatcatattgcaagtggcaagaagtgtcaatacgtgggcaactgttctttcgcccattcacctgaggaacgggaggtgtggacctatatgaaagaaaacggaatccaggatatggagcagttctacgaactgtggctaaagtcccaaaagaatgaaaaaagcgaggatattgctagtcagagcaataaggagaatggaaaacagatccacatgcctaccgactacgccgaggtgactgtggatttccattgttggatgtgtgggaaaaactgcaattccgagaagcagtggcagggacacataagctccgaaaaacacaaggagaaggtttttcacacagaagacgatcagtactgctggcagcatcgcttccctacgggctatttctctatctgtgaccgctacatgaatgggacgtgccctgagggcaacagctgtaagtttgcgcatggaaacgccgaactgcacgagtgggaggagaggcgggatgcactgaagatgaaactcaacaaggctcgaaaagaccacctgatcggtccaaacgacaatgacttcggtaagtattctttcctgtttaaagatctgaattag

SEQ ID NO: 24988 - DNA, 2934 bp, Artificial Sequence
  Description of Artificial Sequence: Synthetic coding sequence
atggaaaggcaaaagcgcaaagccgatatcgaaaagggactgcagttcatccaatctaccttaccactgaaacaggaagaatatgaagcctttctactgaaactggtccagaacttattcgcggaaggcaacgacctttttcgcgagaaggactataagcaggccctggtgcagtacatggaggggctcaacgtggccgactacgctgcctccgaccaggtggctttgcctcgggaattactatgtaagctccatgtgaatcgcgcagcatgctatttcactatgggtttatacgaaaaggcccttgaggacagtgaaaaagccctgggacttgattctgagtccatcagggcattatttcgcaaagctagagccttgaatgagctagggaggcacaaggaggcttacgaatgcagctcacgctgctcgctggctctgccacacgatgaaagcgtgacccagctgggccaagagctcgcacagaagctcggtctccgcgttcgcaaggcatacaagcggccacaggagctggaaacgttcagcctgctttccaatggaaccgccgcaggggtcgccgaccaggggacctccaatggactggggagcatcgacgatatagagaccgactgttatgtggaccccaggggaagccccgctctcctgccaagcactcccaccatgcccttattcccacacgtattggaccttctggccccactcgactccagcagaacacttcccagcacagatagtctcgatgatttctccgatggggatgttttcgggcctgagcttgacactctactggactcgctgtccctggttcagggtggtctctccgggtctggtgtccccagcgaactcccccagttgatccctgtgttcccaggcggaaccccactgttgccccctgtcgtagggggatccatccccgtctccagtccactgccacctgcgtccttcggactcgtgatggatccttcaaagaagctagcagcatccgtgctcgacgcccttgacccacctgggcctacgctggacccgctggacctccttccatacagtgaaacacgcctggatgccctggactccttcgggagcactcgcggatccttagataagcccgattctttcatggaagagaccaactcccaagatcataggcccccaagcggcgcacagaagcccgcaccatcaccagagccgtgtatgcctaataccgccctcctcatcaagaaccccctcgcggcaacccatgagttcaagcaggcttgccagttgtgctaccctaaaacggggccacgggcaggggactatacgtatagggaaggcttggagcataaatgtaagcgcgacattctactcggtaggttgcgcagttcggaggatcaaacctggaaaagaatccgaccccgaccaacgaaaacctccttcgtaggttcgtattatctttgtaaggatatgattaataaacaagattgtaaatacggcgataattgtacctttgcgtaccaccaggaagagatcgacgtgtggacagaggaaaggaaaggaactctgaatagggatctgcttttcgatcccctcgggggagtcaaaaggggttccctcacgattgcaaagttactcaaagagcaccaaggtatctttacctttttatgcgaaatctgctttgatagtaaacctcgaatcatttcaaaaggaacaaaggattctcccagtgtgtgctcaaacctggctgccaagcattccttctacaataataagtgtttggtgcatatcgtgcgctctacaagtctcaaatactctaaaatcaggcagtttcaggagcacttccagtttgacgtgtgtaggcatgaggtgagatatggttgtttacgagaagattcctgtcacttcgcgcattccttcatcgagctgaaggtgtggctcctgcagcagtactccgggatgacccatgaagatatagtccaggagagcaagaaatactggcaacagatggaagcccatgctggaaaggcaagttccagtatgggggctccgcgaacccatggcccttctacatttgacctacaaatgaagtttgtgtgcggccaatgctggcgaaatgggcaagtggtcgaacccgacaaagatctgaaatactgtagcgccaaagcacgccattgttggacaaaggagcgcagggttttgctggtcatgtctaaagctaagaggaaatgggtctccgttcgccctctgccgagtattagaaattttccacagcaatacgacctctgtatccatgcccagaatggccgtaaatgccagtacgtagggaactgctctttcgcccactccccagaggagcgtgacatgtggacatttatgaaagagaacaaaatactcgatatgcagcagacatacgatatgtggttgaaaaagcataacccgggaaagccaggagagggtacccccatcagtagcagagaaggagagaagcagatacagatgccaacagattatgcagatatcatgatggggtaccactgctggctttgtggaaagaatagcaactctaaaaagcagtggcaacagcatatacagtcggagaaacataaggagaaagtctttacatcagacagcgacgcttccggatgggctttcagattccctatgggggagttccgtctgtgcgatagacttcagaaaggaaaagcatgccctgacggcgacaagtgccgttgtgcacacggccaggaggagttgaatgagtggctggacaggagggaggtccttaagcagaaactggccaaggctcgaaaagacatgctgctctgtccacgagatgatgacttcgggaagtacaacttcctgctccaggaggatggagacctcgccggtgcgacacctgaggcgcctgccgcagctgctaccgcaactacaggggaatag

SEQ ID NO: 24989 - DNA, 2934 bp, Artificial Sequence
  Description of Artificial Sequence: Synthetic coding sequence
atggagcgccagaaaagaaaagccgatatcgagaaaggtctgcagttcatccaatccactcttcccctgaaacaagaggagtatgaggcttttttgttgaaactcgtacagaacctctttgccgagggcaatgatctcttccgcgaaaaggattacaagcaagccctcgtccagtacatggaaggattgaacgtcgctgattatgcggcaagcgaccaggttgcgctaccgcgagaattattatgcaaactgcacgtgaatcgcgctgcctgctacttcactatggggttgtacgagaaggcgttggaggattcagagaaggcattggggctagatagcgaatctatccgggcactttttcgcaaagcccgagcactgaacgagctgggtcgccataaggaggcatatgagtgtagtagcagatgttccttggccctccctcacgacgagagtgtcacacagctggggcaggagctcgcacagaaattagggctccgagtcaggaaagcttacaagcgccctcaggaacttgagacattttcactgctctccaatggtactgcagcgggagttgccgatcaaggcactagtaatgggctgggaagcatcgatgatatcgaaacagactgctatgtagatcccaggggttctcccgctctgctgccctctacaccaaccatgcccctttttccacatgttctggatctcctcgccccactcgattcatcgagaacactcccatcaaccgactcattggatgatttttcggacggcgacgtcttcggcccagaactggatacccttcttgactccctgagccttgtgcagggcggactgagcggaagcggagtgcccagcgagcttccgcaactgataccagttttccctgggggtaccccactgcttccacctgttgttggtggtagtatccccgttagtagccccctgccacccgcatccttcggccttgtgatggacccgagcaagaagcttgctgctagtgtgcttgatgccctagatcctcccggacctaccctggatcccctcgatctgctcccttattctgagacaaggctggacgccctggacagctttggcagtaccagggggtccctggataaaccggattctttcatggaggagacaaattctcaagaccatcgcccaccatcaggtgcccagaagcccgcaccttcccccgagccttgcatgccaaataccgctttgctcattaaaaaccctctcgctgcaactcatgagtttaaacaggcatgccagctttgctaccctaagacgggaccgcgagccggagattacacctatagggaaggtctcgaacacaagtgtaaaagggacatcctattgggaaggctgagatcttcagaagatcagacctggaagaggattaggccacgaccaaccaagacatcttttgtcggttcttactacctttgtaaagacatgatcaataaacaggactgtaagtacggggataattgcacttttgcgtaccaccaggaggagatcgacgtctggaccgaagaacggaaaggcacgctcaacagagatctgctgttcgaccccttgggtggtgtgaaacgcggaagcctgaccatcgccaagcttctgaaggaacaccaaggcatttttacttttctctgcgagatatgttttgacagcaagcccaggatcatctctaaagggactaaggactccccatctgtttgttctaatctggccgcaaagcacagtttttacaataacaagtgtttagttcatatagttaggtctacatccctgaaatattcaaagataagacagttccaggagcacttccagttcgatgtctgccggcacgaggtgcgctatggctgtctgcgagaagattcctgccacttcgcccattccttcatcgaactgaaggtttggctgctccagcagtactctggaatgacccacgaagacatcgtccaggagtctaagaaatactggcagcagatggaggcacacgccggtaaagcatcatcaagtatgggtgcacctcggacgcacggtccctccacttttgacttgcagatgaagttcgtgtgtggtcagtgctggcgaaacgggcaagtggtagagcctgacaaagacctgaagtactgttctgcaaaggcaagacattgttggaccaaggagaggcgggttctcctcgtgatgagtaaggccaaacggaagtgggtgagcgtccggccactgccctctattcgcaactttccacagcaatatgatctgtgcatacacgctcagaatggcaggaagtgccagtacgtgggcaattgctccttcgcccactctccggaggagagagacatgtggacctttatgaaggaaaataagattctcgatatgcaacaaacctatgacatgtggctgaagaagcacaatcctggcaaacctggagaggggaccccaatctctagccgggagggagaaaagcagatacagatgccgacggattatgctgatattatgatggggtatcactgctggctctgtggaaaaaattctaattccaagaagcagtggcagcagcacattcaatccgagaaacataaggaaaaagtcttcacgagcgatagcgatgcctctggctgggccttccgatttccaatgggagagtttcgcttatgcgaccgcttgcaaaagggtaaagcttgccctgacggagataagtgccgctgcgcccacgggcaagaagaactcaatgagtggctagaccgaagagaggttctgaaacagaaacttgctaaagcgcgaaaggatatgctgctctgtcccagagatgacgacttcggaaaatataatttcctgctccaggaggatggcgacctcgccggagcaactcccgaggccccagccgctgccgcaacagctactaccggagagtag

SEQ ID NO: 24990 - DNA, 876 bp, Artificial Sequence
  Description of Artificial Sequence: Synthetic coding sequence
atggactttgagaatttgttcagcaaacctcctaacccagccttgggtaagactgccaccgattcagacgagaggatcgacgacgagatcgacactgaggtggaggaaacacaggaagaaaagattaaattggagtgcgagcagattccgaagaagttccgccactcagcaataagtcctaagagctccctacaccgcaagtctaggagcaaagactacgacgtgtattctgacaatgatatttgcagccaagaaagtgaagataacttcgctaaggaattacaacagtacattcaggcacgagaaatggccaatgcggcacagcctgaggagtctaccaagaaagagggagttaaagacacaccgcaggcagcaaagcagaagaataagaaccttaaagccggacataagaatggcaaacaaaaaaaaatgaaacgaaagtggcccggacctggcaataaaggatcaaatgccttgctccgcaattcagggtctcaggaggaggatgggaagcctaaggaaaaacagcagcatctgtcacaggcctttataaatcaacataccgtcgagagaaagggtaagcaaatctgtaagtactttctggaaaggaagtgtattaaaggagatcaatgcaagttcgaccatgacgcagagatcgaaaagaagaaggaaatgtgcaaattttatgttcagggatactgtactcgaggagaaaattgcttatacctccacaacgagtacccttgcaagttctatcatacagggacaaaatgctaccagggagaatattgtaagttttcccacgccccattgactccagagactcaagagctgctcgccaaagtcctcgatacagagaaaaaatcctgtaagtag

SEQ ID NO: 24991 - DNA, 876 bp, Artificial Sequence
  Description of Artificial Sequence: Synthetic coding sequence
atggattttgagaacctgttcagcaaacccccaaatcccgcacttgggaaaacggcgaccgattccgatgagaggattgacgacgagatagacaccgaggtggaggagactcaggaggagaagatcaagctcgagtgcgaacaaatacctaaaaagttcagacattccgcgatcagccccaagtcttcgttacatcgtaagtctaggtcgaaggactacgatgtctatagcgataacgacatctgctcccaggaaagcgaagataatttcgcaaaagaactgcagcagtatatacaggctcgtgaaatggctaatgcagctcaaccagaggagtcaactaaaaaggagggcgtgaaagatacaccccaggcagctaagcagaagaataaaaatctcaaagccggtcacaaaaacgggaagcagaagaagatgaagaggaaatggcccggacctggaaacaaagggagtaatgccctgttgcggaattctggatcccaggaggaggacgggaagccaaaggagaagcaacagcacctgtcccaggctttcattaatcaacacacagttgagcgtaaagggaagcagatctgtaagtactttcttgaaaggaagtgtattaagggagatcagtgtaaatttgatcatgacgcagagattgagaagaagaaagaaatgtgcaaattttacgtccagggttattgcaccagaggtgaaaattgcctgtaccttcacaacgagtatccatgcaaattttaccatacaggcaccaaatgctatcagggggaatattgtaagttctcccacgctcctctcactccagaaactcaggagctcttagcgaaggtcctggataccgaaaagaaaagttgtaaatag

SEQ ID NO: 24992 - DNA, 846 bp, Artificial Sequence
  Description of Artificial Sequence: Synthetic coding sequence
atggcagaggcggctcccgctagagaccccgaaaccgacaagcacaccgaagaccagtccccttcaacacccctcccccagcctgctgcagaaaagaactcttacctatactcaacggagatcacattgtggaccgttgtagccgctatccaagcactagagaagaaggtcgacagctgcctgactcgcctactgactctggagggacgcacgggaaccgccgagaagaagttagctgattgtgagaagactgccgtggagttcggaaaccagcttgagggcaaatgggctgtgctggggacgcttctacaggagtatggcctacttcagaggcggctggagaacgtggagaatctgctgaggaatcggaatttctggatactcaggctcccccctggtagcaagggggaggctccgaaggtcccagtcacattcgatgatgtcgcggtctacttcagcgagctggaatggggcaaactcgaggactggcaaaaggaactgtataagcacgttatgagggggaattacgagacccttgtttctttggattacgcaatcagcaagcccgatattctgacacggattgagcgaggagaagagccatgtcttgaccgttggggccaggaaaaggggaacgaagtggaggtgggcagaccacgcatgatgggaacagggctgcccccatatccagagcacctcacatcaccattgtcgccggcacaggaggagttgaaagaaggccaggctcctaagcaacaacaagatagcgaggcccgtgtggcgcctgcaggacccgaggccggactcgctctgcggactgatttacaaggagaagcacagatatag

SEQ ID NO: 24993 - DNA, 540 bp, Artificial Sequence
  Description of Artificial Sequence: Synthetic coding sequence
atggctgaggccgctgctccccctgattggcactgtggtcttacaagcagagaaaggccgcgtagtgacctgcagaggagcccatttaggttaagttggctgctctttcggtggtggcgcagacgatggaaccccaggcttcctggatatcgggcttggagggatgcctgtggccaacccagacgaagctggcttaccgctcgtcggtggctgtggagcagcggcactagttggcgcgctctggttaacggaggcgcatcgctggtttgcggtagccaagtcgggttggtgtctagcgagtggttgtgccagaaaggattggtgtacgatcgcaacgcaggccagctagagcgcccacaagcattttgcccagggagcagcaagcgaaaaggtcaggtggggggagcctccagggctcataggcgtcccctgtggcacacttgcgcgcaggtgaggcacgctggtccttgtctgctaaggcccgtgtctctgggtctccggagacacggcgtcccatggggcgcttctcaacgtttgtag

SEQ ID NO: 24994 - DNA, 1641 bp, Artificial Sequence
  Description of Artificial Sequence: Synthetic coding sequence
atggctgaggcagcccctgccagggacccagagacagataagcataccgaggatcagagtcccagtacgccactgccacagcctgccgcagaaaaaaattcctatctttactcaaccgagatcacactgtggaccgtggtggccgctattcaggctctggaaaaaaaggtggactcctgtctcactagactgctaacacttgagggcaggaccggcactgccgagaaaaagttggctgactgtgagaaaaccgcagtggagttcggcaaccaattggaaggcaagtgggctgtgctggggactctgttacaggagtacgggcttttacagcgccgactcgagaacgtggagaacctgcttcgtaatagaaatttctggattttgcggctcccacctggcagcaagggagaagccccaaaggttccagtgacctttgatgacgttgctgtgtacttttctgagctagagtggggaaagttggaggactggcagaaagaactgtataagcatgtcatgagggggaattatgaaacattagtctccctcgattacgctatcagcaagccagatatcttaacaagaatcgagcggggagaggaaccgtgtctggataggtggggacaggaaaagggcaacgaggtagaggtcggcaggccacggatgatggggacaggccttcccccttacccggaacacctgacatctcctctgtctcctgcccaagaggaactgaaggagggccaggccccaaaacagcaacaggattcagaagcccgtgtagcacctgctggccctgaggctgggggaggggttgctattaagaccgaagcacaaagtgaggacgaaatgaccccagaacggctctttcttggggtgagtaggggtcagaccgagtgtagaataccaagagggccaagaaatcgcccaggcggacccagcagacatcaagcccaggggatgcctcgagtccgagctggggagccccgacccccaggagcctccggagaaacaccaagggtcctgagccgcaggaggcagcgggcatttccttgtcctgattgtgggcagtccttcaggctgaagatcaaccttacaatccatcagaggacacacgtggaggagggcaggcaggaggcacccggaagaagccccacttcatgcggcgactctcaggcgatgctggagccaggggaggtagtcgtgcctggcccagttattaggtggttgcccgaagagccagagggaagacgctccgttgctggaggcagagccctcgtgggacgcaggcctgccgcttccaaaatgtatcactgttccgagtgcctgaggttttttcagcagcgcaaaagcctattactgcatcagcgcttacacactggtaatggacaggggtggccggcatgtccttattgtggcaaggcttttcgcaggccttctgacttgtttcggcaccagagaatccatacgggtgagcgtccttatcaatgtccacagtgcgggaggaccttcaatagaaaccatcatctcgccgttcacatgcagacccacgcccgtggtcaggttgggccacattttccggctgctcctgcgagacatggctcactgccgttaccttggccatcacgtaaggaggagggatag

SEQ ID NO: 24995 - DNA, 846 bp, Artificial Sequence
  Description of Artificial Sequence: Synthetic coding sequence
atggctgaagcagccccagctcgagatccagagaccgacaagcatacagaagaccagagcccttcaacgcctctgcctcaaccggctgcagagaagaactcatatctatatagtaccgagatcacactctggaccgtcgtcgctgccatacaagcgctggagaagaaagtggattcctgcctaaccagacttttaacgctggaaggtcggacaggcacagccgagaaaaagctggccgactgcgaaaaaacagctgtggaatttggcaaccagttagaaggaaagtgggcggtcttagggacactgctccaggaatatgggctcctgcaacggagactggagaatgtggaaaatttgcttagaaaccggaacttttggattctgaggctcccacccggttccaagggtgaggctccaaaagtacccgtaacgttcgacgatgtcgccgtttattttagcgagctcgagtggggcaaattggaagactggcagaaagaactttacaagcacgtgatgagaggcaattacgaaactcttgtttctcttgattacgccatctcaaaacccgacattctgaccaggatcgagagaggagaagagccttgtctggaccgatggggacaggaaaaaggcaatgaggtggaagttggtagacctagaatgatgggcaccggactgcccccatacccagaacacctcaccagcccgttgtcccccgcacaggaggagcttaaggagggacaggcgcctaagcagcagcaggatagcgaagccagggtggccccagcgggacccgaggcaggactggccctgagaaccgacttacaaggcgaggcacaaatttag

SEQ ID NO: 24996 - DNA, 2589 bp, Artificial Sequence
  Description of Artificial Sequence: Synthetic coding sequence
atggcaaccctcaattccgcttctactaccggcactacaccctccccaggtcacaacgctccctccttgccatcagacaccttcagttctagcactccttccgaccctgtgaccaaggaccccccagctgcgagttccacttccgagaacatgcgatcctcagagcctggtggacagttgctggagtccggatgtggactggtgccaccaaaagaaataggcgagcctcaggaaggccctgactgcggccactttcccccaaacgaccctggcgtagagaaggataaggagcaggaggaggaagaggaggggctaccaccgatggacctctccaaccacctgttctttacagcaggtggggaggcctatctggtcgctaagctgtccctgcctgggggttctgagctactccttccaaaaggctttccatggggggaagccggaattaaggaagagcctagtttaccgtttctggcatacccccctccttcccatctgaccgcactccacatacagcacggtttcgatcctatacagggtttttcttccagcgaccagatcctgtcacatgacactagtgccccttcacccgcagcttgtgaagaaaggcacggagctttctggagttaccagttggcccctaatccacccggagatccaaaggatggccctatgggcaatagcgggggtaaccacgtagccgtcttctggttgtgcctgctttgtcggctggggttttctaagccgcaggcattcatggaccacacccagtcccacggggtcaaactgaccccagcacagtaccagggactctctgggagtccggctgttctgcaggagggggatgaaggctgcaaggccttaatttccttccttgagcccaagctgcctgccaggccttcctcagacatccctttagacaacagttctactgttaatatggaagctaatgtagcacagacggaggacggtcccccagaggccgaagtccaggctctcatactgttggacgaagaagttatggccctatcccctccctccccacccacagctacttgggacccgtctcccacccaggcgaaggaatcaccggttgcggcaggagaggctggcccagactggttcccggaggggcaggaagaagatggtggcttgtgccctccgcttaatcagtcctctcccacctcgaaagaggggggtactttgccagccccagtcggcagtcctgaagacccatcagaccctccgcagccttataggcttgcggatgactatacaccagctcccgcagctttccaaggcctgagtcttagtagccatatgtcccttctgcacagtcggaatagttgtaaaactctgaagtgcccgaagtgcaattggcactacaagtaccaacagaccctggacgtccatatgcgggaaaaacatcccgagtccaacagccattgttcgtactgcagtgcaggcggtgctcatccgcgtcttgcaaggggagaaagctacaattgtggctacaagccctatcgctgcgatgtgtgtaattacagcacaacaacaaaagggaacttatccatccatatgcagtcagacaagcaccttgcaaacttacaggggtttcaggcaggccctgggggacaaggatcaccaccagaggcatctctgccaccaagcgcgggagataaagagccaaagacaaagagctcttggcagtgcaaggtgtgttcgtacgaaaccaatatatcccgtaacctgcgcatccacatgacgtcagagaagcatatgcagaacgtcctgatgttgcaccagggcctgccactcggcctgcctcccggtctgatggggcctggcccaccccctcctcccggagctacccccacttccccaccagaactatttcagtacttcggtccccaggccctgggtcagccgcagactccccttgccggaccaggcctccggcctgataaaccacttgaagcccagttgctgttaaatggcttccatcatgtcggagcaccagctaggaagtttccaacttccgccccaggaagcctgtcccccgacgcgcatctgccacccagccagttgctggggtcttccagtgactcacttcctactagcccgcctccagatgatagcctgagcctcaaagttttccgttgcctggtttgccaggccttctccacagattcactagaactgctcctctatcactgttctatcggccgaagcctcccagaagctgagtggaaagaagttgctggcgatactcaccgatgcaaactatgctgttacggaacacagctaaaagcaaactttcagctccacctgaagacagataagcacgcacaaaaataccagctggccgcacaccttcgggagggaggtggcgcaatgggcaccccaagtcccgctagccttggtgatggggctccttacggatctgtttcacccctgcatctccggtgcaacatttgcgatttcgagagcaacagtaaagagaaaatgcagctgcacgcacgaggcgctgcacacgaggagaacagccaaatatacaagaggacgggaacggggctattaattaagtag

SEQ ID NO: 24997 - DNA, 303 bp, Artificial Sequence
  Description of Artificial Sequence: Synthetic coding sequence
atggccaccttgaatagtgcctccaccacgggtactactccttcccctggccacaatgccccaagcttgcccagcgacacgttcagtagcagcactccatcagatccggtgacgaaagaccctccagctgccagtagtaccagcgagaacatgagaagcagcgagccgggtggccagctcctggagtcaggctgcggactcgtccctccaaaggagattggggaacctcaggagggcccagattgcggtcacttcccgcctaacgaccccggagtcgagaaagataaggagcaagaggagtag

SEQ ID NO: 24998 - DNA, 7718 bp, Artificial Sequence
  Description of Artificial Sequence: Synthetic coding sequence
atggcaaccctgaactctgcctcaaccaccggaaccacaccatctcctggccataacgccccaagcctcccctcggacacattcagcagctcaacccccagcgatccagtgaccaaggacccacctgccgcaagtagtacctctgagaacatgcggagcagcgaacccggaggacaactgttggagtcaggttgtggtcttgtgccaccaaaggagataggagagccccaggaaggtcctgattgtggccactttcctcccaatgatccaggagtggaaaaggacaaggagcaggaggaagaggaggagggactacctcccatggacctgtccaaccacttatttttcaccgccggtggggaagcatatctggtggctaaattaagtttgccaggtggtagcgaactccttctcccaaaggggtttccctggggggaggccggaatcaaagaagaacccagtctcccatttttggcatacccaccaccctcgcacctgactgccctgcacattcagcacggatttgaccctatccagggatttagctcctcggatcagattttgagccacgacactagtgccccaagtccggcagcctgcgaggagcgccacggagctttctggagctatcagctggctcccaaccctcccggtgaccctaaggacggccctatggggaatagtgggggaaatcacgtggcagtgttttggctttgcctgctgtgccggttaggcttctcgaagccccaggctttcatggaccacacccagtcgcacggggtaaaactcacccccgcacagtaccagggactgtctggcagcccagccgtcctgcaggagggcgacgaaggttgtaaggcactcatttctttcttagaaccaaagctgcccgctcgtcccagttcagatatccccctggacaatagttctactgttaacatggaagccaacgtggcccagacagaggacggtcccccagaagcagaggtccaagctttgatcctcctggacgaggaggtgatggcactgtctcctccatcacccccaaccgcaacatgggatccctctccaacacaggctaaggaaagccccgtcgctgccggtgaggccggaccggactggttccctgaggggcaggaggaggatggcggtctgtgccccccactgaaccagagttcgcctacatctaaggaagggggtacattaccagcccctgtcggtagtcccgaggacccatccgaccccccacaaccctaccgcctcgcggatgattacacccctgctccagcggcatttcaagggctatccttaagctcgcatatgagcctgctgcatagccgcaactcgtgtaaaacactcaagtgccccaaatgtaactggcattacaaataccaacaaactctggacgttcacatgcgcgaaaagcacccggagtctaactctcactgctcctattgttcagccggtggtgctcaccccaggctcgccagaggcgagagttacaattgtggttataagccgtatcggtgcgacgtatgcaactactcaaccactacaaaggggaatttatctatccacatgcagagtgacaagcacctcgccaatctccaagggtttcaagcgggacctgggggtcagggttccccgcctgaggcttcccttccgcctagcgctggcgacaaggaaccgaagaccaagagctcatggcagtgtaaggtttgctcttacgagacaaatatatctcggaacctccgcatccacatgacttcggagaagcatatgcagaatgtgctgatgcttcatcagggtctgcccttgggccttccccctgggctgatgggaccaggcccaccccctcctcctggcgcaacacccacctctccacccgaactgttccagtatttcggaccccaggctctggggcagccccaaacacctctggctggccctggattacgcccagataagccactggaagctcagctacttctgaatggattccaccacgtaggcgcacctgctcggaaatttcctacgagtgccccagggagtctgtctcctgacgcccacctccctccctcacagttgctgggctcaagttctgatagccttccaacgtcccctccacctgacgatagcttgtctttgaaggtatttcggtgtctggtgtgccaggccttttctacagatagcctggagttgctgttatatcactgcagtatcggaaggagtctcccggaagctgaatggaaagaagtggccggagacacacaccgatgcaagctttgttgctacggcacccagctgaaagcgaattttcaacttcatttgaagacagacaagcacgcccagaaataccagctagcggctcatctgagagagggaggcggagcaatgggtacaccctcccccgctagcctcggggatggggctccttatggaagcgtgtctccactgcatcttcggtgtaacatttgtgattttgagtcaaactccaaggagaaaatgcagttacacgccaggggagcagcacacgaagagaattcccaaatctacaagttcctcctggacatggagggcgctgaagcaggtgctgagcttgggctttatcactgcctgctgtgtgcctgggagacaccctctcgcctagcagtacttcagcatctgcgaactcctgcacaccgggatgcacaagcgcaaagacgtctgcaactcctccagaacggccctaccacggaagagggtctggcagccttgcaatcaatcctttcattcagccatggacaattacgtacccctggcaaagccccagttacccctctggcagaaccaccaactcccgaaaaagacgcacaaaacaagacagaacagttggctagcgaggagaccgaaaacaagactggccctagcagggatagcgcaaatcagaccacagtgtactgttgtccatactgttcttttctgtcaccagaaagcagccaggtgcgggcacatactcttagccagcatgcggtacagcctaaataccgctgccctttgtgtcaggaacagctcgtgggtcgacctgctcttcatttccatttgtcccatctgcacaacgtagtgccagaatgcgtggagaaactcttactggtggcgaccacggtggaaatgaccttcacaaccaaggtgctgtctgcccctactctgagccccctcgataatggccaggagcctccaacgcatggacctgaacccactcccagtcgtgaccaggcggcagaagggcctaacctcacgcctgaagcaagtcctgatccactgcccgagcccccacttgcgtccgtagaagtcccagacaagccgtcagggtctccagggcagccacccagtcccgcaccatcccctgtgccggaacctgatgctcaagccgaagatgtggcccctcctcccactatggccgaggaagaggagggaacaaccggagagttgcggagcgccgaaccagctccagcagactcacgacaccctttgacctaccgtaagaccacaaactttgccctggataagttcttagaccccgctagaccctacaagtgtactgtgtgcaaagagtcttttacccagaagaatatccttctggtgcactacaactccgtttcacacctacacaaaatgaagaaggctgctatagatccctctgcccctgccagaggtgaagctggcgctcccccaactaccactgcagctaccgataagccctttaagtgcactgtgtgcagagtctcttacaatcagagcagcacgcttgagatccacatgagaagtgtgctgcaccagacgcgctcccgtggtacaaaaacagactcaaagatagaaggaccggagaggagccaggaggaaccaaaggagggagaaacagaaggtgaggtcggcaccgagaagaaaggaccagatacatcgggctttatcagcgggctccccttcctaagcccccctcctcccccacttgatctgcatcggtttcctgctcccctatttacgccacccgttttacccccatttcctctggttccagaatcactgctcaagctgcaacagcagcagctattgctgcctttttatctgcatgatctcaaggtgggcccaaaactaacactggctgggccagccccagtgctatctttgcctgccgcaacacctccaccacccccacagcccccaaaggccgaactggcggagcgcgagtgggagaggcctccaatggcgaaggaaggaaacgaggccggaccatccagccctcccgaccccttgccaaacgaagcggctaggacagccgctaaagccttattggagaatttcggattcgaacttgtgatacaatataatgaaggcaaacaggcagtgcctccacctcccaccccccctccgccagaagcgctcggcggtggcgacaaattggcatgtggggcatgcgggaagttattttcaaacatgttgatattgaaaacccacgaggaacatgtgcacaggcgctttcttccctttgaagccctgtcacgttacgcagcccagtttaggaagagctacgactccctgtatccccctctcgcagagcctccgaagcctccagacggcagccttgattcaccagtgccacatctcgggcctccatttttggtccctgagcctgaagccggagggacccgcgcacccgaggagcgctcacgagcgggagggcattggcctatagaggaagaggaatcgagtcgcggtaacctcccgccactcgtgccagccggacgaaggttttcaaggacgaagttcactgaattccagacccaggccctgcagtccttctttgaaacaagcgcttaccccaaggacggagaagtggagcggctggccagtctgctgggcctcgcctctcgggtagtggtggtctggttccagaatgcacgacaaaaggcgagaaaaaacgcttgtgaaggtggcagtatgcctaccgggggaggcacaggtggggcaagcgggtgtagacggtgtcacgctacattttcatgtgttttcgaattagttagacacctgaagaagtgttacgacgatcaaactctagaggaagaagaagaagaagctgaacggggagaggaggaagaggaggtagaagaagaagaagtcgaagaagaacagggactggagccccctgccggacccgaaggcccactccctgagccaccggacggagaggaactcagccaggcagaagccactaaagccggtggaaaagaacccgaggagaaagcgaccccaagtccatctccagcacacacttgcgatcagtgtgccatttcctttagttctcaggatctgctcacttctcatcggaggctgcactttctgccgagtctgcaaccctcagccccaccacagttattggatctgccactgctcgtgttcggcgaaaggaatcccctcgtggcggctacttcacccatgcccggaccacccttaaagagaaagcatgaggatggatctttatctccaacgggctctgaagccggaggaggtggggagggcgaacccccacgcgataaacgcctcagaacaaccatcctccctgaacagctggagatcctataccgatggtatatgcaggattcaaaccctactagaaaaatgctggactgcatctcagaggaggttgggctgaagaaaagagtggtccaggtctggtttcaaaatacccgcgcacgggagcgcaaaggacagttccgtagtacaccaggcggagtgccatcacctgcggtgaagcctccggctaccgctacccccgctagtctgcctaagttcaacctcctgctgggcaaagtcgacgacgggacaggacgcgaagctccgaaacgtgaggctccagcattcccctatcccacagccaccttggcgagtggcccacagccttttttgcccccagggaaggaggctacaacaccgacgccagaaccaccactgcctctgttgccaccccctcctccttccgaggaggaaggtccggaagagcccccaaaagcttccccagaatccgaggcttgtagcttatccgccggagatctaagtgacagcagcgcatcctcccttgccgaacccgaatctcccggtgccggtggaacttcgggtgggcctggaggagggaccggcgttccggatggaatggggcaacggaggtatcggacgcagatgtcttccttgcagctgaagatcatgaaggcttgctacgaggcctaccggacccctactatgcaggagtgcgaggtgttgggggaggaaatcgggctgccaaagagggtcatacaagtctggtttcagaacgcgagagcaaaggagaaaaaggccaagctacagggaactgctgcgggaagtacgggagggtctagtgagggcctactcgctgcgcagagaactgactgcccttattgcgacgtgaagtacgacttctatgtttcatgtcgaggccacctctttagtcggcagcacttggctaaactaaaagaggcagtcagagcacaactgaaatctgagtccaagtgttatgacctggcacctgccccagaggcccctcctgctctgaaagcaccgcctgcaaccactcccgcatccatgccgcttggcgctgccccaactcttccacggctggcccctgtcctgctgagcggccctgcgctggctcagccacccctgggaaacctcgcacctttcaattcaggcccagctgcatcgagtggccttcttggcctggcaacaagcgtcctcccaacaacaacggttgtccagactgcaggccctggcaggcccctgccccaacgaccgatgcctgaccagactaacacgtctaccgcgggaaccacagaccctgtcccaggtcctcccaccgaaccactcggagacaaagtcagcagcgagcgtaagcctgtagccggaccaacgtcaagtagtaatgacgccttaaagaatctgaaagccctgaagaccaccgttcccgcactactgggcggacaattcttacctttccccctgccgccagccggtggcactgctcccccagccgtcttcggccctcaattgcagggcgcttatttccagcagttgtacggcatgaaaaaggggttgtttcccatgaaccctatgatccctcaaacactgatcgggctcctcccaaacgcacttttgcagccccctccccagcctcctgaaccaacagcaactgctcctccaaagccaccagagctgcccgctcctggcgagggagaagccggagaagtcgacgaactgctaactggatccaccggcatcagcactgtcgacgttacccatcgctatctgtgtcgccaatgcaaaatggcctttgacggcgaagcgccagccaccgcgcaccagcggtccttttgctttttcggacggggatcgggcggtagcatgccccctccacttagagtgcctatttgcacttaccattgcttagcatgcgaagtcctgttgtccggtcgggaagcgttagcgagtcacctcaggtcgtcagcgcacagaagaaaagctgcacccccacagggaggtccccctatttccattactaatgccgctacagcagcgagcgcggctgtagcatttgccaaagaagaggcccgtttgcctcacactgattcaaacccaaaaaccactacaacgagcactttactcgctctgta

SEQ ID NO: 24999 - DNA, 1227 bp, Artificial Sequence
  Description of Artificial Sequence: Synthetic coding sequence
atggctacccttaatagtgcttcaacgaccggtaccacaccgtctcctgggcataacgctccctccttgccttcggatacattctctagttctaccccatccgatcctgtcactaaggatcctcccgcagccagctccactagtgagaatatgcgatctagtgaacccggagggcaacttctggagtcagggtgtggactcgtgcctcccaaagagattggggagcctcaggagggcccagattgcggtcactttccacctaatgatcctggggtggaaaaagacaaggagcaggaagaggaggaagagggtttgcctcctatggacctgtctaaccacctgttctttactgccggaggtgaggcatatctcgtagctaaattgtctttaccaggcggatccgaattactcttgccgaaagggtttccctggggcgaagctggaatcaaagaggagccaagcctaccttttctcgcctatcctcccccaagccacttgaccgcactgcatattcaacacggttttgacccaattcaggggttttcttcttccgaccagatactcagccatgacacctccgctccttcccctgccgcatgtgaggaacgccatggtgccttttggtcgtatcagttagcaccaaaccctccaggcgatcctaaggacggcccaatgggaaattctggcggaaaccacgtagccgttttctggttgtgcctcctgtgcagactgggcttcagcaaaccccaggcctttatggatcacacacagagtcatggagtgaaactgacacctgcacagtaccaggggctgtcaggttcccccgctgtcttacaggagggcgatgaaggctgtaaggctctgatatctttcctagagcccaagctcccggcaaggccttctagcgacatccccctggacaatagctcaactgtcaatatggaagctaacgtagctcagacagaggatgggccacctgaggcagaggttcaggcactgattttactggatgaagaggtgatggctctttctccaccttctcctccaaccgccacttggggttacaccactgcctgctgcgtgcgcggaaggcaccctcctgcttggctatgttgtaatacatgcgctcacctcccaacagcgatgccccgtccacgcggtgtatgcagctgctaccgaatggcccaacctctgagaaaagattctcagctgttccgcgcatcatag

SEQ ID NO: 25000 - DNA, 741 bp, Artificial Sequence
  Description of Artificial Sequence: Synthetic coding sequence
atggccacactcaatagtgcaagtacaacaggcacgactccatcgcctggccacaacgccccatccctccccagtgacaccttttctagttccaccccatcggaccctgttacgaaggacccgcctgctgcttcttctactagtgaaaacatgaggtcatctgaaccaggtggccagttgctcgagagcggctgcggtctggttccacctaaggagatcggagaaccgcaagagggaccggattgcgggcattttcctcctaatgacccaggggttgagaaggataaggaacaggaagaagaggaagaggggttaccgccaatggacctgtccaatcacctctttttcacagcaggcggagaggcttacctggtcgcgaagctttcactcccaggtggtagcgagttactgctcccgaagggttttccttggggtgaagctggcatcaaagaagagccgagcctgccctttcttgcctacccgccacccagtcacctcactgcactccacatccaacacgggttcgatccaattcagggcttttcatcatcagatcagattttgtcccacgacactagtgcgccttctcccgctgcatgtgaggagcggcacggggcattctggagctaccaacttgccccaaacccgccaggtgaccctaaggacggtccgatggggaattctggtgggaatcatgtggcggtcttctggctgtgtctgctgtgccggctcggcttctag

SEQ ID NO: 25001 - DNA, 1563 bp, Artificial Sequence
  Description of Artificial Sequence: Synthetic coding sequence
atgtcacagttatccctatcatggctggggctgtggcctgtcgccgcttctccgtggctcctactgctgctcgtcggcgcttcttggctgctcgcgcacgtgttggcttggacatacgcattttacgacaactgccgaagactgaggtgcttcccgcagccaccacgcagaaactggttctggggccatcaaggcatggtcaacccgactgaggaaggcatgagagtcctgacacaattagtagccacatatcctcagggtttcaaggtgtggatggggcctatcagccctctgcttagcctgtgccatccggatatcatacggagtgttataaatgcaagtgctgctattgcgcctaaggacaagttcttctatagcttccttgagccctggctgggcgatggtctactgctgagtgcaggagacaaatggagcagacaccggagaatgttgaccccagcctttcatttcaacatcctaaagccttacatgaaaatattcaacgaaagtgtcaacatcatgcacgctaagtggcagctgctggcgtccgagggttccgcttgtcttgatatgttcgaacacatctctttgatgacgctggactccctccagaaatgcgttttctcttttgacagccattgccaggagaaacccagtgagtatatcgcagcaatactggagctgtctgccctggtttcaaagagacaccatgaaatcctcctccatatcgactttttatactacctgactcctgacggccagcgttttcgtagggcctgccgcctggtccacgacttcacagacgcggttatccaagaaagacgccgaacccttccgtcccaaggcgtggacgattttctgcaagcaaaggccaagtccaaaacacttgacttcattgatgtcctgctcctgagcaaagatgaagatggaaaaaaactgtctgacgaggacattagggctgaagcagatacttttatgttcgagggacacgacactacagcctccggactgtcatgggtcctgtaccatttagctaagcaccctgaataccaagaacggtgcagacaagaagtgcaagagttgctaaaggatcgcgagcctaaagagattgagtgggacgacctggctcaccttccctttctcaccatgtgcatgaaagagtcgctgcggctgcatcctccagtgccggtaatctcacgccatgtcacgcaagatatcgttctgccagacggccgtgtgatccctaagggcattatttgtcttatcagcgtttttggtacccatcacaatccggctgtatggcccgacccggaggtctatgaccctttccgctttgaccctgagaatatcaaggagcgttcccctttggcatttattcctttctcagccggaccgaggaattgtataggtcagacgttcgcaatggccgaaatgaaagtggtactggcactgaccctattacgctttagggtcctcccagaccacactgagccgcgacggaagcctgagctggtcctacgtgctgaaggagggctgtggttaagggtcgaacccctttcatag

SEQ ID NO: 25002 - DNA, 1584 bp, Artificial Sequence
  Description of Artificial Sequence: Synthetic coding sequence
atgtatcagcctgaagatgataataattccgatgttacttcagacgacgatatgacccgtaacagaagggagagttctcctcctcatagcgttcatagcttttccggggaccgcgattgggaccggcgaggaagatcccgggatatggaaccacgggaccggtggtcgcacacaagaaacccccgttcgaggatgcccccacgcgatctgtcactgcctgtggtcgccaaaacaagtttcgaaatggacagagaggatgatagagatagccgagcctacgagtcccgcagtcaagatgctgagtcctaccaaaacgtagtcgatttagctgaggatcgcaagccacacaataccatccaggacaatatggagaactaccgtaagcttttgtcactgggtttcttggctcaggacagcgtccctgctgagaaacgcaacacagagatgctcgacaatctgccttcagccggttcccaattccctgatttcaaacatctggggacgtttctcgtcttcgaagagctggttactttcgaggacgtgctggttgacttttcacccgaggagctgtccagcttatccgcagcccagagaaacctgtacagagaggtcatgttggagaattaccgcaacctggtttcgttggggcaccagttctctaagcccgatattatcagccgtttggaagaagaagagtcctatgccatggagactgactccaggcacaccgtgatatgtcagggggagtcccatgacgatcccctggagccccatcagggaaatcaagaaaagctcctgaccccaattaccatgaacgatcccaaaaccctcacgcctgagaggagctacggctccgatgagtttgagagatctagcaatctgtctaagcaaagcaaggatccccttggcaaggatccacaggagggtaccgcacctggtatttgcactagccctcagtccgcaagccaggagaacaaacacaacaggtgcgaattctgcaagcgcacattttctacccaggtcgctctgaggagacacgaacgcattcacaccggtaaaaaaccctacgaatgtaaacagtgcgccgaggccttctatctgatgccacatctgaaccgccaccagaagacccactcgggcagaaagacttctgggtgtaacgagggacgaaagcccagcgtgcagtgcgccaatttgtgcgaacgcgtgcgaattcattctcaggaagactatttcgaatgtttccagtgcggtaaagccttccttcagaacgttcacctgctccagcatctcaaagcccacgaagcagccagagtgttacccccaggtctcagtcactctaagacatacctgattaggtaccagcggaagcatgactacgtcggcgaaagagcctgccagtgctgcgattgcggcagagtcttttcccgaaatagttacctaattcagcactacagaactcatacccaggagcgcccataccaatgtcagctgtgtggcaagtgcttcggccgtccaagctaccttacacaacactatcagctgcacagccaggagaaaacagtcgagtgcgatcattgctag

SEQ ID NO: 25003 - DNA, 1584 bp, Artificial Sequence
  Description of Artificial Sequence: Synthetic coding sequence
atgtaccagcctgaagatgataacaacagcgatgttacttcagatgacgacatgacccgcaaccgtcgagagtcttcgccacctcactccgtgcacagtttctccggcgacagagattgggaccgacggggaaggtcaagggatatggaaccgagggaccgctggagtcacactcgtaaccccaggagtcgcatgcccccaagggatctgagtctccccgtcgtggctaagacatccttcgagatggatagggaagatgatcgggattcgcgcgcttatgagagccgctcccaagatgctgagtcttaccagaacgtagtcgacctggccgaagataggaagccccacaacacaatacaggacaatatggaaaactacagaaagctcctttccctgggttttttagctcaggattcagtccccgctgaaaagaggaatacagaaatgctggacaacctgccaagcgcgggttctcaatttcctgacttcaaacaccttggaacatttctggtgtttgaagagcttgtcacatttgaagatgtgctggtggatttcagtccggaagaactgagttctctgtccgctgcacagcggaacctatatagggaagtcatgctagagaattacagaaacttggttagcctcggccatcagttctcaaagccggacattatatccagactggaagaggaggaatcttatgcgatggagacagattctagacacactgtgatctgtcagggcgaatcccacgatgatccgctggagccacaccaaggtaaccaagagaagctgctgactcccatcacaatgaatgatcctaagaccctgactcccgaaagatcatatggatcagacgagttcgaacgctcctcaaacctgtctaaacagtccaaagaccctcttgggaaagaccctcaggaggggacagctcccggaatatgtacatcccctcagtccgcgagccaggagaataaacacaataggtgcgagttttgtaaaaggactttctcaacccaggtcgctctacggcgacacgaaaggattcataccgggaaaaagccgtatgaatgcaagcagtgcgcagaagccttctatctcatgccgcacctgaataggcaccagaaaacgcattctgggaggaagaccagtggatgcaacgagggccgtaagccatcagtacagtgtgctaacctttgcgaacgtgtcaggatccacagccaggaagactattttgaatgctttcaatgtggaaaggcctttctgcagaacgttcacctgcttcagcatctcaaggcccatgaggccgctcgagtcttgcctccagggctctctcactccaagacttatctgatccggtatcagcgaaagcatgattacgtgggggagagggcatgccagtgttgcgactgcgggagggttttcagcagaaacagctatctcattcaacactacaggacccatacccaggagcggccttaccaatgccaattgtgtggaaaatgtttcggtcgcccaagctatcttactcaacattatcagttacattctcaggagaagaccgttgaatgtgaccactgttag

SEQ ID NO: 25004 - DNA, 1584 bp, Artificial Sequence
  Description of Artificial Sequence: Synthetic coding sequence
atgtatcagccagaggatgataacaattccgacgttacatccgacgacgatatgacacggaaccgccgtgaaagtagtccccctcatagcgtgcacagcttttcaggcgaccgggactgggacagacggggaaggtcaagagatatggagccgagggacagatggagtcacacccgaaaccccagatccaggatgccacctcgggacctctctttacccgtcgtggccaagacctcctttgaaatggatcgggaggacgaccgggactctagagcatatgagtcacgctcccaggacgcagaaagctaccagaacgtcgtggacttagccgaagaccgtaaaccccacaacacaattcaggacaatatggagaattacagaaaattgctcagcctgggattcctagctcaagatagcgtgccggctgagaaaaggaacactgagatgctggataacctgccttctgccggatcacaatttccggatttcaaacatcttggaaccttcctcgtgttcgaagaacttgtgactttcgaagacgtgctcgtggatttttcaccagaggagctgagctccctctctgcagcacagcggaatctgtatagggaggtgatgctcgaaaattacaggaacctggttagtttgggccatcagttcagtaagcctgatattatctcccggctggaggaggaggaatcctatgccatggagacagactcaagacacactgtgatctgtcaaggggagtcacacgacgacccccttgaaccccatcagggtaatcaggaaaagctgttaacaccaataaccatgaacgacccgaaaaccctgacacctgagcgctcttacggtagcgatgaattcgagcgctcatccaacttgtccaagcagtccaaagaccccctcggcaaagatccacaggagggtactgccccaggtatttgcacatccccgcaatcggcctcccaagagaataagcacaaccgctgcgagttttgcaaacgtacattttcaactcaagtggccctgcggcgtcacgaacgcatccatacaggaaaaaaaccatatgagtgcaagcagtgtgccgaagccttctaccttatgcctcacttgaatcggcaccagaagacacattccggcagaaaaacttccggctgcaacgagggaagaaagccctcagtgcagtgcgcaaatttgtgtgagcgagtacggatccattcacaggaagactatttcgagtgcttccagtgtgggaaggcctttctgcagaatgtccatttgctgcaacatctgaaggctcacgaggctgccagagtgctccctcccggattgagccattcaaaaacctaccttattcggtaccaacgtaaacacgactatgtaggcgagcgagcatgccagtgttgcgactgcggccgagtcttttctaggaacagttatttgattcagcattatcgcactcacacccaggagagaccgtatcagtgtcagctctgtggtaaatgttttggcaggccttcatacctgacgcaacactaccagttgcactctcaggagaaaacagtcgaatgcgaccactgctag

SEQ ID NO: 25005 - DNA, 1584 bp, Artificial Sequence
  Description of Artificial Sequence: Synthetic coding sequence
atgtatcagcctgaagatgacaacaatagcgatgtaacttcagatgatgacatgaccaggaatcgacgggagtcatcaccaccccatagcgtgcactccttttcaggagaccgcgattgggatcgaagaggcagaagccgtgacatggaacctcgtgataggtggtcgcacactagaaacccccgaagtcggatgccgcctagagacctgagcctgcccgtcgtggctaaaacatcattcgagatggatcgcgaggacgacagagactctagagcctacgagagtcggagtcaagatgctgaatcttaccagaatgttgtggatctggctgaggatcggaagccccacaatactatccaggacaacatggagaactataggaagcttctgtcactagggtttctagcccaggactcagtgcccgcagaaaagcgcaatactgaaatgctggataaccttccatcagccggttcccaatttcccgacttcaaacatctgggcacattccttgttttcgaagagttggtgaccttcgaagacgtcctcgtcgatttctcgcctgaggagctgtccagtttaagtgcggcacagaggaatctctaccgggaggttatgcttgaaaactacaggaatctggtcagcctggggcatcagtttagcaaacctgacattatttcaagactagaggaagaagaatcatacgctatggaaactgattcacgacatactgtcatctgccaaggggaaagccatgacgacccgcttgagccgcatcaaggcaatcaggaaaaattgctgacaccgatcacgatgaacgaccctaagactctgacgcccgagcgcagttacgggtccgatgaatttgagaggagttctaacctgagcaagcagagtaaggatcccctgggcaaagaccctcaggagggcacagcaccaggtatctgcacgtctcctcagtcagcctcacaggaaaataagcacaacaggtgtgagttttgcaaaagaactttttccacacaggtagctctccgacgtcatgagcgcattcatacagggaaaaagccctacgagtgcaaacagtgtgcggaggcgttttacctaatgccacacttgaaccgccaccaaaaaacacattccggacgcaaaacgtctggatgcaatgaaggcagaaagccctcagtccagtgcgccaatttgtgtgagagggtcaggattcacagccaagaggactacttcgagtgcttccaatgtggaaaggcatttctgcagaacgtccacctgctgcagcatctgaaggctcacgaggccgctagggtgttacctcccggtctctcccattcgaagacttatctgatccgctaccagaggaaacatgattacgtgggcgaacgggcatgtcagtgctgcgattgcggccgagtattttctcggaacagctacctgatccagcactatcgcactcatacccaggagcgaccgtaccagtgccagctgtgcggcaagtgttttgggaggccgtcgtatttgactcaacattaccagctccatagccaagaaaagactgtggaatgcgatcactgttag

SEQ ID NO: 25006 - DNA, 1707 bp, Artificial Sequence
  Description of Artificial Sequence: Synthetic coding sequence
atggcgagactgactaaacgacgccaagccgacactaaagcaattcaacacctgtgggccgcaattgagatcattcggaaccagaagcagattgcaaacatcgacagaatcactaaatacatgtctagggttcacggtatgcacccaaaggagaccacccggcagctgtcactggcggtcaaagacggacttattgtggaaactctcactgtcggctgcaaaggtagcaaagcagggatagaacaggagggttactggctgccaggagacgaaatcgactgggaaacggagaatcatgattggtactgttttgaatgtcatctgccaggagaggtgcttatttgtgacctgtgcttccgtgtgtaccattctaaatgcttgagcgacgaattccggctgcgcgattcatccagtccttggcagtgccctgtgtgcagatcgattaaaaagaaaaataccaataaacaagagatggggacatacctgaggtttatagtgtctagaatgaaggaacgtgctatagacctcaacaagaaggggaaggacaacaagcatcccatgtaccggcgacttgttcactcagctgtcgatgtgccaaccatccaggagaaagtgaatgaagggaagtacagatcttacgaggagtttaaagctgacgcgcaacttctgcttcataacactgtaatattttacggagcagactccgaacaggcagatatcgctagaatgctttataaggatacttgccacgaactcgatgaattacagctttgtaagaattgtttctacctaagcaacgccagacccgacaactggttctgctacccatgtatccccaatcatgagttagtttgggctaaaatgaaagggttcggcttctggcctgccaaagtgatgcagaaagaagacaatcaagtggatgtacgttttttcgggcatcaccaccaacgtgcttggattccttcagaaaatattcaagacatcacagtaaatatccatcggcttcacgttaaacgctccatggggtggaaaaaggcgtgcgacgaactcgagctccaccagcggttccttcgcgagggaagattttggaaatctaaaaacgaggacagaggggaggaggaagcggaatcttcaatctcctccacatctaatgagcaactaaaagtgacgcaggagcccagggccaagaaaggcagaagaaatcaaagtgtcgagcctaaaaaagaggaacccgagccagagacagaggctgtgagtagttctcaggagattccaaccatgccccaacctatcgagaaagtttctgtgtccacacaaacaaagaaacttagcgcaagctcaccacggatgttgcacagatcaactcagaccaccaatgatggcgtgtgccagagcatgtgccatgataagtataccaaaatctttaacgactttaaagacagaatgaaaagcgatcacaaaagggaaaccgaacgggtggtgagggaagcactggagaaactcagatctgaaatggaggaggaaaagcggcaggcagtgaataaggccgtggcgaacatgcagggtgaaatggaccgaaaatgtaagcaggtaaaggagaaatgtaaggaggagttcgttgaggagattaagaagctcgcaacccagcataaacagttgataagccagactaagaaaaaacagtgggtgaatacaagtctcttttag

SEQ ID NO: 25007 - DNA, 1224 bp, Artificial Sequence
  Description of Artificial Sequence: Synthetic coding sequence
atgaacaagtcacaggggagcgtctctttcactgacgtcactgtcgactttacccaggaagagtgggagcagctggacccatcccaacgcattctgtacatggacgtgatgctcgagaattattcgaatctgttgtccgttgaagtgtggaaggcagatgatcagatggagcgagatcaccggaaccctgatgaacaggcacgtcaattcctcattctgaaaaatcagactcctattgaggaacggggtgacctgtttgggaaagctctaaacttaaacaccgattttgtttctctgaggcaggtgccttacaagtacgacttatatgaaaaaaccttgaagtacaattctgacctgctgaactctaatagaagctacgcagggaagcagacagatgagtgcaacgagttcgggaaagcattactctacctgaagcaggagaaaactcactccggtgtcgaatattcagagtataataagtccggtaaagccctgagccacaaggcagcaatctttaagcatcagaagataaaaaaccttgttcagcccttcatttgtacatattgcgacaaggccttttcatttaaaagcctgctgatctcccataagcgcatccacactggcgagaagccgtacgagtgtaacgtgtgtaaaaagacctttagtcataaagctaacttgataaagcatcagcgtatccatactggggaaaaaccattcgaatgtcctgaatgtggcaaggcttttactcatcagtccaatctgatcgttcatcagcgcgcacatatggagaaaaagccctacgaatgttctgaatgcgggaaaacattcgcccagaagtttgagctcacgacgcaccagcgtattcatacaggggagagaccctacgagtgcaacgagtgcgccaagacattttttaaaaagagcaatctgatcatccaccaaaaaatccataccggcgagaagcgttacgagtgcagcgaatgtggcaagtcttttattcagaacagccagctcattatacacatgcgtacgcacacaggtgaaaaaccatatgaatgcactgaatgcggaaagacgttttcacagcgatcgactctgaggctacacctccgaatacatacaggtgaaaaaccctatgagtgttccgaatgcggcaaagcgttctctcgtaagagcaggctcagtgtgcatcaaagggtgcacattggagagaaaccctag

SEQ ID NO: 25008 - DNA, 1224 bp, Artificial Sequence
  Description of Artificial Sequence: Synthetic coding sequence
atgaacaagtcacagggcagtgtgtcttttacggacgtcaccgttgacttcactcaggaggagtgggagcaacttgacccatctcaacgcatcctatatatggatgtgatgctggagaactatagcaatctgttgtccgtcgaggtgtggaaagccgacgatcagatggaacgcgatcatagaaaccctgatgagcaagcgaggcaattccttattctcaaaaatcaaaccccaattgaggagaggggggatctgttcggcaaggcactgaacctgaataccgactttgtctcactacggcaagtgccatacaaatacgatctttacgagaagaccctgaaatacaattctgacctgttgaacagcaataggtcctacgctggcaagcaaactgatgaatgtaacgaattcggaaaagcccttttatacttgaagcaggaaaagacccactcaggggtggagtactccgagtacaataagtctggcaaggccttgagtcacaaagccgctatcttcaaacatcagaagattaaaaaccttgtccagcccttcatttgcacgtattgtgacaaggcttttagctttaaatcgctgctcatatctcataaacgcatccatacgggtgagaagccttacgaatgcaatgtgtgcaagaagaccttttctcacaaagctaatttgatcaagcaccaaaggatccacactggcgagaaaccctttgaatgcccagagtgtgggaaagccttcactcaccagagtaacctgatagtgcaccagcgggcacacatggaaaagaagccctacgagtgtagcgagtgtggaaagaccttcgcacagaagtttgaattgaccacccaccagcgtatccacaccggggagaggccgtacgaatgcaatgagtgcgctaagacattcttcaagaagtccaacctgataattcaccaaaagatccataccggagagaagaggtacgagtgctctgaatgcggaaagtcattcatacagaactctcagctcattattcacatgagaactcacaccggcgaaaagccatacgaatgtaccgagtgcgggaagacattttctcagagatctacgctgcgacttcatctccggatccataccggcgaaaaaccttacgagtgcagtgagtgcggtaaagccttttccagaaagagccggctttccgtgcaccagcgagtgcatatcggcgaaaaaccctag

SEQ ID NO: 25009 - DNA, 1602 bp, Artificial Sequence
  Description of Artificial Sequence: Synthetic coding sequence
atggctcacggcagcgttaccttccgtgacgtcgccatcgatttttcccaagaagagtgggaattcttagacccagcccagcgggacctgtacagggatgtaatgtgggagaactacagtaacttcatcagtctgggaccatctatttcaaaaccagatgtgattacgttgttggacgaagagagaaaagagcctggtatggtggtgcgtgagggcactcgcaggtattgccctgatcttgagtcaagataccgaaccaatacacttagtcccgaaaaggacatctatgagatttattcctttcagtgggatatcatggaacgcatcaagagttatagtctacaggggtccatcttccgtaacgactgggaatgtaagagtaaaattgagggtgagaaagaacagcaggaggggtattttgggcaggtaaaaattactagtgagaagatgaccacatataagagacacaactttctcaccgaatatcaaatagtgcacaacggcgagaaagtctatgaatgtaaagaatgcaggaagacctttattaggcgaagtactttaagccagcaccttcgaattcacacaggcgaaaagccctataagtgtaaagagtgtgggcaggcctttaggcagcgagcacatctgatccggcaccacaagctgcacaccggggagaagccttatgagtgcaaggagtgcggaaaagcgttcaccgtcttgcaggagctaacacagcaccagaggctacacaccggggaaaagccatatgagtgcaaagagtgtggcaaagcattcagagttcatcagcagctagccaggcaccagcgaatacacaccggggaaaagccgtatgagtgcaaagactgcggtaaaaccttccgtcagtgcacccatctcacaagacaccagagactgcataccgctgaaaaactctacgagtgtaaagagtgcggtaaggcttttgtttgcggaccagatctcagagtgcaccagaagatccactttggcgaaaagccctacgagtgcaaggaatgtgggaaggcatttaggatctgccaacagcttaccgtgcatcaatccatccacaccggtgagaagccctacgagtgtaaagagtgcggaaagaccttcagactgagacagcaattggtacgccatcagcggatccacacaagagagaaaccttacgaatgcatggagtgttggaaaaccttttctagctattcccaattaattagccatcagagtatccacatcggggagcgcccatatgagtgtgaggagtgcgggaaagcgttcagattactgtctcagctgacccagcaccagagtattcataccggcgaaaagccctacgagtgcaaggagtgccggaaaccctttcggctgctttcccagctcactcagcatcagagcattcatacgggagaaaagccctatgaatgcaaggagtgcggcaaagcgttcagattgtactcctttttgactcaacaccagagaatccataccggcgaaaagccatacaaatgtaaggaatgcaagaaggcgttcagacaacactcacacctgactcagcaccagaagatccacaacggaatttag

SEQ ID NO: 25010 - DNA, 1602 bp, Artificial Sequence
  Description of Artificial Sequence: Synthetic coding sequence
gtggcccacgggagtgtgacattccgtgacgtggcgattgacttttcccaagaggagtgggaatttctggacccagcccaaagagacttgtaccgggacgtgatgtgggagaattactcaaactttattagcttgggccctagtataagcaaaccagatgtgatcactctgctggatgaagagagaaaagaaccaggtatggtggttagggaagggacacgcagatattgcccagaccttgagtctcgctacagaactaatacattgtcgccagagaaagacatctacgaaatctattcctttcagtgggatatcatggagaggattaaaagctactccctgcaagggtccatttttaggaatgactgggaatgcaagtccaaaattgagggtgagaaggaacagcaggagggctacttcggccaggtgaagataacctccgagaagatgacaacatacaaaaggcataactttctgactgagtatcaaattgtgcataatggcgaaaaagtctatgaatgtaaggagtgcagaaaaaccttcatccggcgatccactctcagccagcaccttcgaattcacacaggcgaaaaaccatataaatgtaaggaatgtggccaagctttccggcaacgcgcacatctcattagacatcacaagctccatacgggagagaagccctatgaatgtaaggaatgcggcaaagctttcacagtgctacaggagctgacgcaacaccagagattgcataccggtgagaagccttatgaatgtaaagagtgcggcaaggcgtttcgcgtccaccagcaactggctaggcaccagcgcatacacacgggcgaaaagccatatgagtgcaaggattgcggaaagactttccgccagtgcacgcatcttaccaggcaccaacgcctgcatacggccgaaaaattgtacgagtgtaaggagtgcgggaaggcattcgtatgcggcccagatctgcgcgttcatcagaagatccattttggcgaaaagccttatgaatgtaaagagtgcgggaaggcttttcggatctgccaacagttgaccgtgcaccagtcgattcatactggcgaaaaaccttatgaatgtaaagagtgcgggaaaacgttccgcttgaggcagcagcttgtgcgccatcagaggatacacacccgagagaagccatatgaatgtatggagtgttggaaaaccttttccagttattcgcagttgataagccaccagtcaatccacatcggagaaaggccatacgaatgcgaggagtgcgggaaggcatttcgactgctttcacaattgacccaacaccagtctatacatactggcgaaaaaccttacgaatgcaaagaatgtaggaagccatttaggttactctctcagctcacccagcatcaatctatccataccggggaaaaaccctacgaatgtaaggaatgtggcaaagctttcagactgtattcttttctgacgcaacaccagcgcatccacaccggagaaaagccgtataagtgcaaggagtgcaagaaggccttcagacagcattctcacctgacacagcaccagaagatccacaacggcatctag

SEQ ID NO: 25011 - DNA, 2265 bp, Artificial Sequence
  Description of Artificial Sequence: Synthetic coding sequence
atgaccactgccggaagaggcaatcttggcctgattccgagatcaacggccttccagaaacaagagggacggttgacagtcaagcaggagcctgccaaccagacctggggtcaggggagcagcctccagaaaaactatccccctgtatgtgaaatttttaggttgcatttccgccagctatgctaccacgaaatgtccgggcctcaagaagctttaagtcgcctgcgcgaactgtgccgctggtggctcatgcctgaagtgcatactaaagagcagatactggagctgcttgttctggagcaatttctatccatcttgcctggagagctcagaacctgggtccagttgcaccatcctgaatctggggaggaagctgtagctgtggtggaggatttccagcgccatttatccggctctgaggaagtatctgctcctgcacagaagcaggagatgcattttgaggaaaccaccgccctgggtaccacaaaagagtcacctccaacatctcccctcagcggcggatctgccccaggtgctcacttagagcctccatacgatcctgggactcatcatcttccctctggagacttcgctcagtgtactagccccgtccctacactcccacaagtgggaaactcgggtgatcaggcgggtgccacggtcctcagaatggtccgtcctcaggacaccgtggcctatgaagacttgagtgttgattatacacagaaaaagtggaaatcactgactctgtcacaacgcgcactgcagtggaatatgatgcccgaaaaccatcattctatggcctcattagctggcgagaacatgatgaaagggagtgagctcactccaaaacaagagttctttaagggttccgagagcagcaatcggactagtggaggcctgttcggtgttgtccctggggcagctgaaacgggtgacgtttgtgaagatacgtttaaagagctggagggtcagaccagcgacgaggagggctcacgccttgaaaatgatttcctggagatcacggatgaagataaaaagaaatccacaaaggaccgatacgataaatataaagaggtgggcgaacatccaccccttagcagctcccctgttgaacatgaaggagtgctaaaaggacagaagtcttataggtgtgacgagtgcggtaaagctttcaacaggtcctctcatctgataggccaccaaagaatacacactggcgaaaaaccttacgagtgtaacgagtgcggcaaaacttttagacaaactagtcagttaatcgttcacttgagaacccataccggagagaaaccctacgaatgctccgagtgtggtaaagcctacaggcactctagtcatctcattcagcaccagagattacataacggggaaaaaccctacaaatgtaatgaatgcgccaaagccttcacccagtcgtctcgattaactgaccaccagcgcacacatacaggcgaaaagccctatgaatgtaatgaatgtggtgaagccttcattcggtccaagagcttggcacggcatcaagtccttcatactggaaaaaaaccctataagtgtaatgagtgcgggcgagccttttgcagcaatagaaacctaatcgatcatcaacgcatacacacaggggagaagccatatgagtgctcagagtgtggaaaggccttcagcaggtccaaatgcctgattcggcaccaaagccttcatactggcgagaagccatataaatgcagtgagtgcgggaaggcctttaaccagaactcccagctgatcgagcacgagaggattcacacaggagaaaagccctttgagtgttccgagtgtggaaaggcatttggcctgtcgaagtgcctgattagacaccagcgtctccacacaggagagaaaccatataagtgtaacgagtgcggcaaatcatttaatcagaattcccacctgatcattcatcaacggatacacaccggtgaaaaaccctacgagtgtaacgaatgtggtaaggttttctcttattccagcagcctgatggtccatcagcgcactcacacaggggaaaagccttacaagtgtaatgactgtgggaaggccttttctgacagttcacagctcattgtacatcagcgggtccatactggcgaaaagccgtacgagtgttcagaatgcgggaaggccttctctcaacggtctacatttaaccatcaccaaaggacacacacaggagaaaaaagctcagggcttgcttggtccgtgagctag

SEQ ID NO: 25012 - DNA, 612 bp, Artificial Sequence
  Description of Artificial Sequence: Synthetic coding sequence
tcgaagtgccttatcaggcatcaatcactgcataccggggagaagccgtataagtgttctgaatgtggcaaggcgtttaatcagaacagccagctgatcgaacatgagcgaattcacaccggagagaagcctttcgagtgctctgagtgtggaaaggccttcgggctgagcaagtgcctgatccggcatcagagactgcataccggcgaaaagccttacaaatgtaatgaatgtggaaagagcttcaatcagaactcccatctcatcatccaccagcgaattcacacgggagaaaaaccatacgaatgtaatgaatgtggtaaagtattctcatactcttcgagtctgatggtgcaccagcgaacccacaccggagagaaaccctataagtgcaacgactgcggcaaggctttctctgactcttctcagctgattgttcaccagcgcgtccacactggcgaaaagccttacgaatgttcagagtgcgggaaggcatttagccagcgatcgacgttcaatcatcaccaaaggacccatacaggcgaagtacttcggtctggtctggtgagcttcctgcgctatggttcagagacggagagcaatgacttatag

SEQ ID NO: 25013 - DNA, 831 bp, Artificial Sequence
  Description of Artificial Sequence: Synthetic coding sequence
atgactactgccggacggggaaacctcggattgatccctcggtctacggcctttcagaagcaagagggcaggctgaccgtgaaacaggaacccgctaaccagacatgggggcagggttcttctctgcagaaaaactacccaccggtgtgcgagattttccgcctgcactttcgccagctttgttatcatgagatgtctggccctcaagaagccttgagccggctgcgggagctctgccgctggtggctaatgcccgaggtgcataccaaagaacagatactcgagttgctggtgttagagcagttccttagtattttgccaggtgaactgcgcacttgggtgcaacttcatcatccagagagtggtgaggaagcagtggccgtcgtggaggacttccaacggcatctgtcgggcagtgaagaagtcagcgcaccggcacagaaacaagaaatgcactttgaggagactacagctctgggaaccaccaaggagagtcccccaacaagccctcttagcggtggaagcgctcccggagcccacctggagcctccatacgaccctggaacccaccatctgccttctggggatttcgcacaatgtacctcaccagtccccaccctgccacaggtgggaaactctggagaccaggcgggagccaccgtgctacgaatggtccgccctcaggataccgtggcttacgaagacctcagtgtggactacacccaaaagaagtggaagagtctaaccctgagccagagggctctgcagtggaacatgatgccggagaaccatcattctatggcaagcttggggtggtcgaccatggcctag

SEQ ID NO: 25014 - DNA, 2265 bp, Artificial Sequence
  Description of Artificial Sequence: Synthetic coding sequence
atgactaccgctggaagaggtaacctgggtctgataccccgaagcacagccttccagaagcaagaaggcaggctgactgtgaaacaagaaccggctaatcagacctggggccaaggatcatccctgcagaagaactacccacccgtgtgcgagatctttcgactgcatttccgtcagctgtgctatcacgagatgtccggtccccaggaggccctttcccgactgcgagagttgtgtaggtggtggctgatgccggaagtgcatacaaaagagcagattctggagcttctagtgctagagcagtttctgtccattttacccggagagttgaggacatgggtgcagttgcatcacccagaatccggagaggaggccgttgcggtggttgaagatttccagagacatctttctggatctgaggaagtgtccgcacctgcacagaaacaagagatgcactttgaagaaactacagcgttgggcaccacaaaagaatcccctcctacctcccccctgtctgggggaagcgccccaggcgcacatctggagcccccatacgacccaggtacccaccatctcccctccggcgacttcgcccaatgtactagcccagtgccaacactaccccaggtcggcaattctggtgaccaagctggagccaccgtcttgagaatggtgcgcccacaagatactgtggcttatgaggacctgtcggtcgattatacccagaaaaagtggaagtccctgaccctgtcccagcgcgctttgcagtggaacatgatgcctgagaatcaccactccatggccagtctggccggtgagaacatgatgaaaggatctgagttaacacccaaacaggagttttttaaagggagtgagtcatccaatcggacaagcggtgggctgtttggagtggttcctggagcagctgaaaccggagatgtttgcgaagatacgtttaaggagctggagggacagacgagcgacgaggaaggaagtaggctggagaacgacttcctggaaatcacagatgaggacaagaagaaatctaccaaagataggtatgacaagtacaaagaggtgggcgagcacccacctctgagctccagtcctgtggaacacgaaggcgtgttgaagggccagaagtcctacagatgtgatgagtgtgggaaggcgttcaatcgctccagccacctgataggccatcagcggatacatacaggagagaagccttatgagtgtaatgaatgcggaaagactttcaggcaaacttcccaattgattgttcacctgcgcacccatacaggtgaaaagccctatgagtgtagcgagtgcggcaaggcctaccgccacagtagtcatctcattcaacaccaaaggcttcataatggtgagaaaccgtacaagtgcaatgaatgcgcaaaagctttcacgcaatcaagtagactgactgaccaccagaggacgcatactggggagaagccttatgagtgcaacgaatgcggagaggcgtttattcgctctaaaagtctagcccgtcatcaagtgctgcacaccggcaaaaagccgtataagtgcaatgagtgtggcagagcgttctgttccaaccgaaatcttatcgatcaccagcgcattcataccggggagaagccctatgagtgcagtgaatgtggaaaagcgttctcccggagtaagtgcctgattcgccatcagtctctgcacacaggagagaaaccttataaatgcagtgagtgcgggaaggcctttaatcagaattcccaattaatcgagcatgagcggatccatacaggcgagaagccattcgaatgtagcgaatgcggcaaggccttcggcctcagcaagtgcttaattaggcatcaaagactccacacaggcgagaagccgtacaagtgtaacgaatgtggcaagagtttcaatcagaatagtcacctcatcatacaccaaagaattcacaccggcgagaagccatatgagtgcaatgaatgcggcaaggtgttctcatactctagtagcctgatggtgcatcaaaggacccatactggggagaagccctataaatgcaatgactgcggaaaggcattcagcgatagcagccagctcatagtgcatcagagggtgcacaccggcgagaagccttatgaatgcagtgaatgcgggaaggctttcagccagaggtccactttcaatcaccaccagcggactcacacgggtgagaagtcctcaggattggcgtggagtgtgtcttag

SEQ ID NO: 25015 - DNA, 831 bp, Artificial Sequence
  Description of Artificial Sequence: Synthetic coding sequence
atgactacagcgggtcgtgggaatctcggcctgatacccagaagcacagctttccagaaacaggagggcaggctgactgttaagcaggagccagcaaatcagacttgggggcagggaagttcattgcaaaagaattaccctcccgtgtgtgagatctttcgcctccatttcagacagctatgctaccacgaaatgtcagggcctcaggaggcactctccagactacgggagctctgcagatggtggctcatgccggaggtgcatacgaaagaacaaatcctcgagctcctggtgctggagcagttcctgtccatactccccggtgaacttcgcacgtgggtgcagctgcatcacccagagtctggcgaagaggccgtagctgtggtggaggatttccagcggcacctgagtggatccgaagaagtatccgccccagcccagaaacaagagatgcatttcgaggaaaccacagctcttggaactactaaggaatctccaccaacctctcccctctccggtggctctgcaccaggcgctcacctcgagcccccttacgatccagggacgcaccacttgccgtccggcgattttgcacagtgcacttcgcccgtaccaacccttccacaggtgggaaactccggcgaccaggccggagccaccgtgcttcgaatggtgcggccacaggataccgtggcctatgaggatctgtcagtggattatacccagaaaaagtggaagtcactgacattgagccagcgagccctgcaatggaatatgatgccagaaaaccatcattcgatggcttcactcggttggtcgactatggcatag

SEQ ID NO: 25016 - DNA, 1989 bp, Artificial Sequence
  Description of Artificial Sequence: Synthetic coding sequence
atgaacttgactgaggattacatggtctttgaggacgtggcaatccatttcagtcaagaggaatggggaatacttaacgacgtgcagaggcatctgcacagcgatgtaatgctcgagaatttcgccttactgagctcggtgggctgctggcacggcgctaaggacgaggaagccccttccaaacagtgcgtctctgtcggggtgagtcaagtgactaccctgaagcccgctctcagcactcaaaaggcgcaaccatgcgagacatgcagtagtctccttaaagacatcctgcacttggcagaacacgacggaacacaccccaaacgtaccgctaagctgtacctgcaccagaaggaacatcttcgggaaaagctcacaaggtccgacgagggccgaccatcatttgtgaatgacagtgttcatctcgccaagaggaatctgacatgtatgcagggtggtaaagattttactggagactctgacctgcaacaacaggctctccattctggttggaagcctcatagagatacccacggagtcgaggcttttcagagcggacagaataactatagttgtacccagtgcggcaaggatttctgccaccagcatacacttttcgagcatcagaagattcatacagaagagcggccttatgaatgctccgaatgtggcaagttgtttcgctacaatagtgacctgataaagcatcagagaaaccatacaggggagcggccttataagtgttcagagtgtggaaaagctttctcactgaagtacaatgtggtccagcatcagaagatccacactggcgagagaccttacgaatgtagcgaatgtggaaaggctttccttcgtaagtcacacctgctgcagcatcagcgcattcacactagacctaggccttacgtgtgctcagagtgtggcaaggcattcctcacgcaggcccacttagtgggccatcaaaagatccacaccggggaacgcccttacgggtgcaacgaatgcggtaaatattttatgtacagcagcgcattgatccggcatcagaaagttcataccggagagcgccctttctattgttgcgagtgtggaaaatttttcatggattcttgtaccctgataatccatcagagggtccataccggggagaaaccttacgagtgtaatgaatgcggtaaatttttcagatacaggtcgacccttattcgtcaccaaaaggttcacactggggaaaagccctacgagtgttctgaatgcggcaaattctttatggatacctctactctcatcatccaccagcgggtccacacaggtgagaagccttatgagtgcaataagtgtgggaaattttttcggtactgcttcacgttgaatcgccatcagagggtacattctggcgagcgcccatacgagtgttcggaatgtggcaagttcttcgttgatagttgcaccttaaaaagccatcagcgagttcacaccggagagcgaccattcgagtgctccatctgcggaaagtctttcaggtgtagatctaccctagacactcaccagagaatacatacaggtgaaagaccctatgaatgttccgagtgcggcaaattcttcagacataatagtaaccatattcggcatagaaggaaccacttcggtgagcgaagctttgagtgcacagagtgtggccgtgtgttctcccagaacagtcatctcattaggcatcagaaggttcacacaagggaaaggacttataagtgctccaagtgcggaaagtttttcatggactcgtccactctgatctcacatgagcgagtgcataccggggagaaaccctacgagtgcagcgagtgcgggaaagtgttccggtacaacagcagtctcattaagcataggcggatacacacgggcgagcgcccatatcaatgtagcgaatgtggtagagtgtttaaccagaactctcacctgattcagcatcagaaggtccatactcgttag

SEQ ID NO: 25017 - DNA, 1989 bp, Artificial Sequence
  Description of Artificial Sequence: Synthetic coding sequence
atgaatctgaccgaggactacatggtgttcgaagatgtcgctatacacttttctcaagaagagtggggcattcttaacgatgtgcaaagacatttgcactcagacgttatgttggagaatttcgcactgctgtcatccgtcgggtgctggcacggtgctaaggacgaagaagctccttctaagcagtgcgtgtccgtgggcgtgtcccaggtgacaactctgaagcctgctctgagcactcagaaagcccaaccatgcgaaacatgttcgtccctgctgaaagacatcttgcatcttgctgagcacgacggaacacacccaaaacgaactgccaaactgtatttgcatcagaaagagcacctccgcgagaagctaacaagatctgacgaggggcgtcctagttttgttaacgactctgtacatttagccaagcggaatctcacttgcatgcagggagggaaggattttacaggcgacagtgaccttcagcagcaggccttgcactctggatggaagccacatagagacacacatggcgtcgaggctttccagtctggtcaaaacaattatagctgtacacagtgtgggaaggacttttgccaccagcatacgcttttcgaacaccaaaagattcatactgaggaacgcccatatgagtgctcagagtgcggaaagctgtttagatataatagtgacctgattaagcaccagcgtaaccacacaggggagagaccctataagtgcagtgagtgtgggaaagccttttcattgaagtacaacgttgttcagcatcaaaagatacacacaggcgaacgaccttatgaatgcagtgagtgcggtaaggcgtttctccgaaagagccaccttctgcagcaccagcgcattcacacccgacccagaccttacgtgtgttccgagtgcggaaaggcctttttgacccaggctcatctggtcggccatcaaaaaattcacacaggcgaacgcccttacgggtgcaatgaatgcggaaaatactttatgtattcttccgcactgattcgccatcaaaaggttcacacaggtgaacggcctttctactgttgcgaatgcgggaagttttttatggatagctgcactcttattattcaccaacgggtgcatacaggcgaaaagccttacgagtgtaatgaatgtggcaaattcttcagataccgctcaaccctcattagacatcagaaagtgcataccggcgagaaaccttacgaatgttctgagtgcgggaaattttttatggacacttccacacttattatccatcagagggttcacacaggagagaagccatacgaatgcaacaaatgtggtaaatttttcagatactgcttcaccttgaacagacatcagcgcgttcactcaggtgagcggccatatgagtgctcagaatgtgggaagtttttcgtcgatagctgtactctgaaatcccatcagcgagtccatacaggcgagaggccattcgagtgctccatctgcgggaagtccttcagatgcagaagcacactggatacgcaccaacgcattcataccggggagaggccctacgagtgttcagagtgtgggaaattttttaggcacaattcaaatcacataagacatagacgcaatcactttggagagagatcctttgaatgcactgaatgtggcagggtgtttagccagaattcccacctgatccggcaccagaaggtgcacacccgcgaacggacttataagtgcagcaaatgtggcaagttcttcatggattcgtctacgcttatttctcatgagagggtgcatacaggcgaaaagccatatgagtgttcagagtgcggcaaagttttccggtataacagctcgctcatcaaacaccgcaggattcatactggagagcggccttaccagtgtagtgaatgtggcagggtcttcaaccagaactctcacctcattcagcaccagaaggtgcatacccggtag

SEQ ID NO: 25018 - DNA, 3090 bp, Artificial Sequence
  Description of Artificial Sequence: Synthetic coding sequence
atgaccagggagaacgtcgcacacaacgcactgaggcaagagggtttggtgaagggcaaggacgacacttggaagtggggaacttctttccaggggtctagctcaagcgtgtgggagacctcccatctgcatttccgtcagctgcgctaccacgagacctcgggaccgcaagaggcactgtccaggctccgagaactgtgccggagatggctgcgtccagaggcacggaccaaagctcagatattagagctcttggtgctggaacaattcctctctattctgccaggagagattaggacttgggtgcaactccatcatcccggttccggtgaggaggcggtggctctggttgaggaacttcaaaaagacctggacggccctgccatacaagtacctgtcctggtgaaggaccaggatacactgcagaaagttgtgagcgctcccggaacgacattacccccagtcttaccgggttcacatattgccgcagagatttgcccacatccccctaccgacctggtggccttcaacctgcaggatccgcagcacgattctcccgcaccagaggccagcgccctgtcacaagaggaaaatccgaggaatcagctgatggctctgatgctcctcacggcgcaacctcaggagcttgtgatgttcgaagaggtcagtgtctgctttacgtctgaagagtgggcttgcctggggccaatacaaagggcactctactgggatgttatgctcgagaactatgggaacgtgacaagcctggagtgggagaccatgacagaaaacgaagaagtgaccagcaaaccatcttcctcacagagagcagatagtcataaaggaaccagcaagcggctgcagggcagcgtgcctcaagtcctggatttcgaagaagaatgcgagtggcaggtcctcgccagtcagtggggaaacgagactgacgaaagagccgacacggtgaagaaggtgagcttgtgtgaaagggacaaaaaaaaacgtacacccccagagaaacaaggccagaagtggaaagaactgggcgacagcctgacttttggttctgccattagcgaaagcttaatcggtacagaaggaaagaagttttacaaatgcgacatgtgttgtaaacactttaataaaatttctcatctgataaatcatcggaggatccataccggcgaaaaaccacacaagtgtaaagaatgcgggaaaggcttcatccaacggtccagtctcttgatgcacctgcgcaaccatagcggagaaaaaccctataagtgtaacgagtgtggcaaggctttttctcagagcgcctacctgctgaatcatcaacggatacacaccggggagaagccttacaaatgtaaggaatgtggtaaagggttttacagacactcgggcctgataatccatttacgtaggcacagtggagagcggccatacaaatgcaacgagtgtggcaaggtttttagccagaatgcctaccttattgatcaccagcgtctgcacaaaggcgaagagccatacaagtgtaacaagtgccagaaggcattcattctgaagaagagtttaatcttgcaccaacgcatccacagtggggagaaaccgtacaaatgtgacgagtgcgggaagacctttgcccagacaacctatctgatcgatcaccaaagactacatagtgcggagaatccatacaaatgtaaggagtgtggcaaggttttcattcgttctaagtctctgttactccatcagagggtacacacagagaaaaagacctttgggtgtaagaagtgcgggaaaatctttagcagcaagagtaatttcatcgatcataagcgcatgcactcaagagagaagccatacaagtgtactgagtgcggcaaggccttcacccagtctgcgtacctgtttgaccaccaacggttacataacggggagaagccctatgaatgtaacgaatgcggcaaagtgttcatcctgaagaagtccctgatccttcatcagaggttccatactggggagaatttgtacgaatgtaaggactgtggcaaagtgtttggaagtaaccgcaatctgatcgaccacgagagattgcacaacggcgagaaaccatacgagtgtagggaatgtggaaagacatttatcatgagtaaaagctttatggtccatcagaagcttcacacacaggaaaaggcctacaagtgtgaagactgtggaaaagccttctcctacaacagctccctgctggtccaccgccgtatccataccggtgagaaacctttcgaatgcagtgagtgcggcagggccttctcaagtaacagaaacctgatcgagcacaaacgcatccatagcggtgagaaaccatacgaatgtgacgagtgtggtaaatgcttcatcctgaaaaaatccctcatcggacaccaacggattcatacccgcgagaaaagctacaagtgcaatgactgcggcaaggtctttagttatcgttccaacctaattgcccatcagcggatccacaccggggagaaaccgtacgcttgctctgaatgcggcaaaggattcacctataaccgcaacttgatcgagcaccagcggatccactctggtgaaaagacgtatgaatgtcatgtctgcagaaaggtgcttacatcttcacgaaacctcatggtgcatcaacgtatacacacaggagaaaagccctataaatgcaacgagtgtggaaaggattttagccagaacaagaacctcgtggttcaccagcggatgcacaccggcgagaaaccttatgagtgcgacaagtgtcgaaaatcttttacctctaaaagaaatcttgtgggccaccagagaattcacaccggggaaaaaccatacgggtgcaacgactgctctaaggtttttcgacagcgcaagaacctcacggtgcaccagaagattcacaccgacgagaaaccatgcgaatgcgatgtgtcagaaaaagaattctcacaaacatctaatctgcatctgcagcaaaagattcacactattgaggaattcagctggttgcagaatacaaacgaatctaaaatcgagatacagaaaatatag

SEQ ID NO: 25019 - DNA, 804 bp, Artificial Sequence
  Description of Artificial Sequence: Synthetic coding sequence
atgacccgggagaacgtggcgcacaacgcacttcggcaagagggccttgttaagggcaaagacgatacgtggaagtggggcaccagctttcaaggctcctccagtagcgtttgggagaccagccacctccactttagacagctgaggtatcatgagaccagtggtcctcaggaggcactctcccggctccgtgagctttgtcgccgttggctgcgtcccgaggcccgtacaaaggcgcagatcctggagctgctcgtcctcgaacagtttctgtctatcttgccaggcgagattagaacgtgggtgcagctccatcacccaggaagtggggaggaagcagtcgccctggtagaagaactgcagaaggacttagatgggccagcaattcaggtccctgtcctggtgaaagatcaggacacacttcagaaagtcgtgagtgctcccggaactaccctgccacctgtgctccctgggtcccatattgcggcagagatctgcccccatccccctactgatctcgtagcgttcaacctacaggatccacagcacgactcgccagccccagaggcttcggctctgagccaagaagagaacccccgaaaccagctaatggccctgatgctgttaactgctcagcctcaagaacttgttatgttcgaagaggtgtccgtgtgctttacatccgaagaatgggcgtgtctgggacctatccagagagcattgtattgggacgttatgttggaaaattacggcaacgtgaccagcctgggctacagaaaatatcgaaggcaaaggaacaaatag

SEQ ID NO: 25020 - DNA, 804 bp, Artificial Sequence
  Description of Artificial Sequence: Synthetic coding sequence
atgactcgcgagaatgtagctcacaacgcactccgccaagaggggctggtgaaaggaaaggacgacacgtggaagtgggggacttcttttcagggctcttccagcagtgtctgggaaacatcccatcttcactttagacaactgcggtaccatgagaccagcgggccacaggaggccctgtctagattacgggaactttgtagaaggtggcttagaccggaagccaggactaaggcgcaaatcctagaactcttggtgctcgagcagtttcttagcatactccctggcgagatcaggacctgggtgcagctacatcatcccggatcaggggaagaggccgtggcactggttgaagaactacagaaggatctggacggcccagcaatccaggttccagttctcgtcaaagaccaagataccctccagaaggttgtgtccgccccaggcactacgctacctcccgtgctccccggaagtcacattgcagctgaaatatgcccccacccccctacagacctggtcgcgttcaatctgcaggaccctcagcatgattctccggcacccgaagcttctgcactctctcaggaggaaaatccgaggaaccaattgatggcactcatgctgcttaccgctcaaccacaggaacttgtcatgttcgaggaggtgagtgtttgtttcacgagcgaggaatgggcctgcctgggcccaattcaaagagctctgtactgggacgtgatgttggaaaactatggcaatgtgacgtccctcgggtacaggaagtatcgcagacagcggaataaatag

SEQ ID NO: 25021 - DNA, 3090 bp, Artificial Sequence
  Description of Artificial Sequence: Synthetic coding sequence
atgacaagagagaacgttgcccacaatgcattgcgccaggaaggactggttaaagggaaggacgatacatggaaatggggcactagctttcagggcagctctagttcggtgtgggagaccagtcacttgcacttccgtcaacttagatatcacgagactagtggccctcaagaggccctcagtaggctccgcgaactttgcagaaggtggctgaggcccgaggcaaggactaaggcccagatactggaattgttggtcctcgagcagtttctatcgatcctgccgggtgagatccgaacgtgggttcagcttcaccacccagggtcaggtgaggaagcggttgcactcgtggaggaactccagaaggacctggacggccctgccatccaggtgcccgttctggtgaaagatcaggatacactccaaaaggtcgtttctgcaccaggcactaccctgcctccagtgcttccaggttctcatattgccgctgaaatctgtccacatccccctacagacctggtggccttcaatttgcaagatccacaacacgattctcctgccccagaggcttccgcccttagccaggaagagaatccacgcaaccagctgatggccctcatgctcctgactgctcaaccccaggagctggtcatgttcgaggaggtgtccgtgtgctttacttctgaggagtgggcatgtctgggacctattcagcgcgctctttattgggacgtgatgctcgaaaattacggtaatgtcacatccctggaatgggaaaccatgacggagaacgaagaggtgaccagcaagccttcttcaagtcagcgcgctgatagtcataaaggaacctccaagcgtctccagggctcggtaccccaggtcttggattttgaagaggaatgtgagtggcaggtgctcgccagtcagtggggaaacgagactgacgaacgggctgacactgtaaaaaaagtgtctttgtgtgaaagagacaagaaaaaacgcactcctcctgaaaagcaagggcagaaatggaaggaactaggcgattcactgacatttggcagtgcaatcagcgagagcctgatcggcacagaaggcaagaagttctacaaatgcgacatgtgctgtaaacattttaataagatctctcacctgattaatcatcggagaatccacactggcgagaaaccacataaatgcaaagaatgcggcaaggggttcatccagcgatccagcctgcttatgcacctccgtaatcattcgggcgaaaagccctataagtgtaatgagtgcggaaaggcattcagtcagtctgcctacctcctgaatcatcagagaattcataccggggagaagccctacaaatgtaaagagtgcggaaaggggttctatagacacagcggcctgattattcacctgaggaggcattctggggaaaggccatacaaatgcaacgagtgcggaaaggtgttctctcaaaacgcatatctgattgaccaccagcgcctgcacaaaggagaagagccttataaatgcaataaatgccaaaaggcctttatcttgaagaagtccttgatcctccaccaaaggattcatagcggtgagaagccttacaaatgcgacgagtgcggcaaaacgttcgctcagaccacttacttgatcgaccatcaacgtctgcactcagccgaaaatccgtacaagtgcaaggagtgtgggaaggtcttcatccgaagtaagtccttgcttctgcatcagcgagtgcacaccgagaagaagacatttggttgtaagaagtgtggcaaaatcttttcatctaaatccaacttcatcgatcacaagcgtatgcactctagggagaagccttacaagtgcacggaatgcggaaaggcattcactcagagtgcctacctattcgaccaccagaggttgcataatggagaaaagccatacgagtgcaatgagtgcggaaaggttttcatcctcaagaaatcgctgatacttcaccagagattccacacaggagaaaacctgtacgaatgtaaggactgcggaaaggtgttcggcagcaaccggaacctcatcgaccatgagcgcctgcataacggcgagaagccctacgaatgtcgcgaatgtgggaaaactttcatcatgtccaaatcttttatggtgcaccagaagctccatacccaggagaaggcttacaaatgcgaggattgcggcaaggctttttcatataactcctccctccttgtgcacaggcgcatccatacaggagaaaagcccttcgagtgtagtgagtgtggtagggccttttcttctaacaggaacctgatcgagcataagcgaattcattccggagaaaagccgtatgaatgtgatgagtgtggaaagtgcttcatcctaaagaagagcctgataggacatcagaggatccatacaagggaaaagagctacaagtgtaacgactgcggcaaggtgttttcgtaccggtccaatctcattgcccaccaacggatccacacaggcgaaaaaccatacgcatgctccgagtgcggaaaagggtttacttataatagaaacctcatcgagcaccagcggatccattcaggagagaagacatatgagtgtcatgtctgccgcaaggtgttaacatcttcccggaacctgatggttcaccagaggatacacacaggcgaaaaaccatacaaatgtaatgaatgtggcaaggacttctctcaaaacaaaaacctggtcgttcaccagaggatgcacaccggggaaaaaccgtacgagtgcgacaagtgcaggaagagtttcacgtcaaagagaaacttggttggtcatcaaagaattcacacaggtgaaaagccttatggatgcaacgactgcagtaaggtgttccgccagcgtaaaaatctgaccgtgcatcagaaaatccacaccgatgagaaaccctgtgagtgtgatgtgtctgagaaggaattttcccagacctcaaatctacaccttcaacagaaaatccatactatcgaggagttttcctggctgcagaatacaaatgaatccaagatcgagattcagaaaatctag

SEQ ID NO: 25022 - DNA, 240 bp, Artificial Sequence
  Description of Artificial Sequence: Synthetic coding sequence
atgacaagggaaaatgtggcccacaacgccctccggcaggagggactggtgaaaggcaaagacgatacttggaagtggggcacctcattccagggaagctccagctctgtatgggagaccagccacttgcacttccgacagctacgatatcacgaaacctccggaccacaggaagccctgagccgtctgcgggaactgtgcagaaggtggttgagaccagaagcgaggaccaaggcctag

SEQ ID NO: 25023 - DNA, 966 bp, Artificial Sequence
  Description of Artificial Sequence: Synthetic coding sequence
atgacccgcgagaatgttgcccataatgcactgaggcaagagggcctggttaaagggaaggacgacacctggaaatggggtacctctttccaggggtcatcttcctctgtttgggagacctcccacttgcatttccggcaactccgatatcacgagacttctggccctcaggaggccctgagccgcttgcgagagttatgtcggagatggctgaggcccgaggcgaggaccaaagcccagatcttagagcttctagtacttgagcagttcttaagtatcctccctggcgagattagaacttgggtgcaactccatcacccagggtcaggcgaagaagcggttgccctcgtggaagagctccagaaagacttagatggcccagctattcaggttccagtactagtgaaagatcaagacaccctacagaaagtcgtgtctgccccaggcacaacccttccacccgtcctgccaggatcccatatcgccgcagagatctgccctcatcctcccaccgaccttgtggccttcaacctccaggacccacaacacgactcacctgcccctgaggccagtgcattgtcacaggaggaaaacccaagaaatcaattgatggcattgatgctcctcactgcccagccccaagagctggtgatgtttgaggaggtctccgtgtgcttcacgtccgaggaatgggcgtgtctcggcccaatccagagagctctctactgggacgtgatgctggagaactatggtaacgtcacatccctcgagtgggaaaccatgaccgagaacgaggaagtcacaagtaagccatcatcatcccaaagggccgattcccacaaagggacgtcaaagcgcctgcagggctctgttccacaagtgttggactttgaggaagaatgcgaatggcaggtgcttgcctctcagtggggcaacgaaactgacgagagagcagacacagtctag

SEQ ID NO: 25024 - DNA, 1386 bp, Artificial Sequence
  Description of Artificial Sequence: Synthetic coding sequence
atggagcgagaaggtatttggcactccacattgggagaaacctgggagcctaataattggcttgaagggcagcaggatagccacttgtcccaagtgggtgttactcataaggagacattcacagaaatgagagtttgtggtggcaatgagttcgaacgatgctctagtcaggacagcatcctcgatacccagcagtccatcccgatggtgaagcggcctcacaactgcaatagccatggcgaagacgccacccagaacagtgaactcattaagacacagagaatgtttgtgggtaaaaagatctacgagtgtaatcagtgctccaaaacgttttcacagtccagttctctcctgaaacaccaacggatacacaccggcgaaaagccatataaatgtaatgtatgtggcaagcacttcattgaacgctcttccctgactgttcatcaacgcatccacactggagagaaaccttataagtgcaacgaatgtggcaaggctttctctcagagcatgaacctaactgtccaccagcgtacccacacaggcgagaagccttaccagtgtaaggagtgcgggaaggctttccacaagaactcaagtcttattcaacatgagcggattcataccggcgagaaaccatataagtgcaatgagtgtggaaaggcattcacccaatctatgaatctgacagtacaccagcgcacccacaccggagagaagccctacgagtgtaacgagtgcggcaaagccttttctcagtcaatgcacctgatcgtccatcagcgcagtcacaccggagagaaaccttatgagtgctcccaatgcggcaaggcctttagtaaatcaagcactctgacattgcaccaaaggaatcacaccggcgagaaaccctacaaatgcaataaatgcggtaagagcttcagccaatctacctatctgatagaacaccaacgcctccatagcggagtgaagcctttcgagtgcaacgaatgtggtaaggccttttcaaaaaatagtagcctgacccagcaccggcgaatacatacaggggaaaagccctacgagtgtatggtgtgtggcaagcattttaccggacgctcctctttgacagtacatcaagtgatccacacaggtgaaaagccctatgagtgcaacgaatgtgggaaagctttcagccagtctgcctacttaattgagcatcaacgcattcacacgggcgaaaagccatatgagtgcgaccaatgcggcaaggcctttattaaaaattctagtctcaccgtgcaccaacggacccacactggcgagaagccttatcagtgcaatgaatgcggcaaagccttctccaggtcaacaaacctgacgagacatcagagaactcacacatag

SEQ ID NO: 25025 - DNA, 1386 bp, Artificial Sequence
  Description of Artificial Sequence: Synthetic coding sequence
atggagagggagggaatttggcacagcacccttggcgagacttgggagcctaataactggctggaaggccagcaagatagccacctgtcgcaggtcggggtgacacataaggaaacattcacagagatgcgcgtgtgcggaggcaacgagtttgagagatgttcttcccaagattcaatcctggatactcagcagagcatcccaatggttaagcggcctcataactgcaattctcatggagaggacgcaacccaaaactccgaactcatcaaaactcagagaatgttcgttggaaagaagatttatgagtgcaatcagtgctccaaaacgttcagccaatcctctagcctgttaaaacatcagcgaattcacaccggtgagaaaccctataaatgcaatgtttgtggcaaacacttcattgagcggtcttccttaaccgtccaccagagaatacacaccggagaaaaaccctacaaatgcaacgagtgcggaaaagcttttagccaatccatgaacctgaccgtccaccagcggacccacaccggggagaaaccttatcaatgcaaggaatgcgggaaggccttccacaagaactccagcctcatacagcatgaacgcatccatacaggggagaagccctataaatgcaacgaatgcggaaaagcatttacacagtcaatgaatcttacagtgcaccagcggactcacaccggagaaaagccgtacgagtgcaacgaatgcggaaaggccttctcccagagtatgcacctcatagtacaccagcgctcacataccggcgagaagccctatgagtgctctcagtgcggcaaagccttctcaaagtcctccaccttgacacttcaccaacggaaccacacgggtgagaagccatacaaatgcaacaaatgtggcaaaagcttcagccagagtacctacctgattgaacaccaacgtcttcatagtggagtgaaacccttcgaatgtaacgaatgcgggaaagcgtttagtaaaaactcctcactgactcaacatcgacgaatccatacgggagaaaaaccatacgaatgcatggtctgcggcaaacatttcacaggcaggagcagcctgacagtgcaccaagtcattcacactggcgagaaaccttacgaatgcaacgagtgtggaaaggccttctcccagtctgcctacctcatagaacatcagagaattcatacaggagaaaaaccttacgaatgtgaccagtgtggaaaagctttcatcaagaacagtagtctcacggtgcaccaacggacccacacaggcgagaagccttatcagtgcaacgagtgcgggaaagcctttagtcgttccaccaacctaactagacatcaaagaacgcacacctag

SEQ ID NO: 25026 - DNA, 1386 bp, Artificial Sequence
  Description of Artificial Sequence: Synthetic coding sequence
atggagagagaaggtatatggcacagcaccctcggcgaaacctgggagccaaataactggttggaggggcagcaagattctcatctgagccaagtcggggtgacacataaagaaaccttcactgaaatgcgggtgtgcgggggaaacgagttcgaacggtgctcttctcaagacagcatcctggacacacagcagtcaattccaatggtgaagcgccctcataattgcaattcgcatggagaggatgcgactcagaatagcgagttgatcaaaactcagcgcatgtttgtcggcaagaagatctatgaatgcaatcagtgtagcaagacatttagccagtcctcttccctcctgaaacatcaacggatccacactggagaaaagccttataagtgtaatgtgtgcggaaaacatttcatcgagcggtcaagtcttactgtgcaccagcgaatccacaccggagagaaaccctacaagtgtaacgagtgtgggaaggctttcagccaatctatgaatctcacggtccatcaacgcacgcacacgggagagaagccataccagtgtaaagaatgcggaaaggccttccacaaaaacagctctttgatacaacacgagcggatacatacaggtgagaaaccatataagtgcaacgaatgcggaaaagcctttacccagagcatgaatctcacggtgcaccagagaactcacaccggagaaaaaccttatgagtgtaatgagtgcggaaaggcatttagccagagcatgcatctcattgtccaccaacgtagtcatacaggcgaaaagccctatgaatgttctcagtgtgggaaagccttcagtaaaagttccaccttgaccctgcaccagcgtaaccacaccggagaaaaaccctacaagtgtaacaagtgtggaaaatctttctcccagtctacatatttgattgagcatcagagactgcacagtggtgttaaaccctttgaatgcaacgaatgcggtaaagccttctctaagaattcctctcttactcagcaccggagaattcacacaggggaaaagccatacgagtgtatggtttgtgggaagcactttacaggccgatcctctctcacagttcaccaggtgatccacacgggtgagaagccatacgagtgcaatgagtgcgggaaggcctttagtcagtccgcctacctcatcgagcatcagcggatccataccggggaaaaaccttatgagtgtgaccagtgtggaaaggcttttataaagaatagcagcttaactgttcaccagaggacccacacgggcgagaagccctaccaatgtaatgagtgtgggaaggcatttagccggagtaccaacttgaccagacaccagaggacccatacttag

SEQ ID NO: 25027 - DNA, 72 bp, Artificial Sequence
  Description of Artificial Sequence: Synthetic coding sequence
atggagcgtgagggcatttggcacagtactctaggagagacttgggagcccaataattggctggagggctag

SEQ ID NO: 25028 - DNA, 30 bp, Artificial Sequence
  Description of Artificial Sequence: Synthetic coding sequence
atggagcgggaggggatctggcacagctag

SEQ ID NO: 25029 - DNA, 1386 bp, Artificial Sequence
  Description of Artificial Sequence: Synthetic coding sequence
atggaacgggagggaatctggcattctaccctgggtgaaacttgggagccaaacaattggctcgagggccagcaggactcccatctgtcgcaggtaggggtgacccataaggagactttcactgaaatgcgggtgtgtgggggaaacgagttcgaacgctgctcttcacaggacagcattcttgacacacagcagtcgatccctatggtcaagaggcctcataattgtaactcccatggcgaggacgctacccagaactctgagcttatcaagactcagagaatgttcgttgggaagaagatttatgaatgcaatcagtgcagcaaaacattcagtcagagcagtagcttgcttaagcaccagcggatacacactggagaaaaaccatataaatgcaacgtttgtggcaaacactttattgagagatctagcctgactgtgcatcagcggatacataccggggagaagccttacaagtgcaatgaatgcggcaaggcattctcgcaaagcatgaatctcaccgtccaccaacgcacccacacaggcgaaaaaccatatcagtgtaaggaatgtgggaaagcattccataaaaatagcagtcttatccagcacgaaaggattcacactggcgagaaaccttataaatgcaacgagtgtggcaaggcctttacacagagtatgaacctcaccgttcaccagaggacacacactggcgaaaaaccctatgagtgcaacgaatgcgggaaagcattctcccagtccatgcacttaatcgtacaccagcggtctcatactggagaaaaaccctatgaatgtagccagtgtggaaaggcattctccaagagcagcacacttacactccatcaaagaaaccacacaggggaaaaaccatacaaatgtaataagtgtggaaaaagtttttcccagtccacttatctgattgagcatcagcggctgcattccggggtgaagccctttgagtgcaacgaatgtggcaaagcattctctaagaactcctccctcacacagcatcgacgaattcacactggcgagaaaccttacgagtgtatggtgtgcggcaaacacttcacaggtcgatcatcacttaccgtgcatcaggtgattcatacaggtgagaagccttatgagtgcaacgagtgcggcaaggcttttagtcagtcagcatatctgatcgaacatcaacgcatacacactggggaaaagccctatgaatgcgatcaatgtgggaaggctttcattaaaaattcctctctgaccgtccaccagaggacgcacaccggcgaaaaaccctaccagtgtaatgaatgcggcaaagccttcagccggtctacaaacctgacacgtcaccagcgaacacatacatag

SEQ ID NO: 25030 - DNA, 1734 bp, Artificial Sequence
  Description of Artificial Sequence: Synthetic coding sequence
atgctcggcttccccccaggtagaccacagttaccggtccaactgcgaccccagacccggatggccacagcgctgagggacccggcttccgtcccaatagccacggaggttctgtttaaactgactcagggtagcgtaacttttgaagatgtggctgtttacttttcatgggaggaatgggacctgctggacgaggctcagaaacacttgtattttgacgttatgctggagaattttgcgctgacaagcagcctgggttgctggtgcggggtggaacatgaagagaccccaagcgagcagcggatatccggtgaaagagtaccccaatttcgcaccagcaaagagggatcttcctcacagaatgctgactcatgtgagatctgttgtctggtgctgagggatattctccacctagccgaacaccaagggaccaattgcgggcagaaactccacacctgcggcaagcaattttacatttccgccaacctacagcagcaccagcgacagcacataactgaggctcccttccgctcctatgtggataccgcctcatttactcagtcatgtattgtgcatgtaagtgaaaagcccttcacatgcagagaaatccgaaaggacttcctggcaaacatgaggttcctgcatcaagacgccactcagacaggcgaaaagcccaacaacagcaataagtgcgccgtcgctttctattctggcaagtcccatcacaactggggtaaatgcagcaaggcgttctctcacatcgacacgttagtccaggatcagcgcatcctgaccagagaaggattatttgaatgctccaagtgtggcaaggcctgtacgcgacgctgcaatttaatacagcatcagaaagtgcactcagaggagcggccatacgaatgtaatgagtgcggcaagttcttcacatactactcatcatttatcatacatcagcgcgtgcatactggcgaaagaccctacgcctgtcctgaatgtggaaagtccttctcccaaatttactctcttaactcgcatcgcaaagtccatactggagaacgcccatatgagtgcggtgagtgcgggaagtctttctctcagaggtcaaacctgatgcaacaccgccgagtccacaccggggagcgcccatacgaatgttccgagtgtggaaagtcttttagccaaaacttcagcctgatttaccatcagagagtgcacactggggagaggccccatgagtgtaatgagtgcggtaagagcttctctcgcagctcatcactgatccaccatagaagattacatacaggcgaacggccttacgaatgcagcaaatgcggcaagagcttcaaacaatcatcctctttctctagtcatagaaaagtccataccggagagcggccatacgtctgcggagaatgcggcaagtcatttagtcactcttctaacctcaaaaaccaccagcgtgtccacaccggagagcgacccgttgagtgttcagaatgcagcaaaagtttcagctgcaagtctaacttaattaagcacctccgggtgcacactggggagcgcccttacgagtgcagcgaatgtgggaagtcattcagtcagagctcgagtctgatacagcatcggagggttcacacaggtaagcgcccttaccagtgttcccaatgtggaaagtccttcggctgtaaatccgttcttattcagcaccaaagagtccatattggtgaaaaaccctag

SEQ ID NO: 25031 - DNA, 1668 bp, Artificial Sequence
  Description of Artificial Sequence: Synthetic coding sequence
atgctggagaacttcgccctgacctcatcgctggggctcatatcttcgtggtcccacgtggtggcccagttaggattaggggaggtgccctctgtcttgcaccgcatgtttatgacccccgcatccgcaagatgggatcagaggggaccaggactgcacgaatggcacctgggcaaggggatgtcgagcggatgctggtgcggcgtggaacatgaggagacccctagtgagcagcgcatttccggggagagagtgccccagttcaggacatccaaagagggtagctcttcccaaaacgcagattcatgcgaaatatgttgcctggttctgcgggatatccttcacctggctgaacaccagggaacaaactgtggacagaagttacacacctgcggcaagcagttctacatttctgccaatctgcagcagcaccagcgccaacatatcactgaggccccatttcgcagttacgtcgacaccgcctctttcacgcagagttgtatcgtgcacgtatcagagaagcctttcacctgtcgggagatccgaaaggactttcttgcaaatatgcggttcttgcatcaggacgcgacacaaactggcgagaagccgaataattccaataagtgcgccgtggcattttatagtggcaagtctcaccataattgggggaagtgttcgaaagcgttcagccatatcgacaccctagtccaggatcagcgcattttgacaagggagggcctgttcgaatgctctaagtgcggaaaagcctgcaccagacggtgcaacctaattcaacaccagaaagtgcactccgaggagagaccatacgaatgtaatgagtgcggaaagttctttacttattacagctctttcattatccatcaaagagttcatacgggagagagaccgtacgcctgcccagaatgtggaaagtcattcagtcagatctattctttgaattcccacaggaaagtccacacaggagaaagaccttacgaatgtggcgaatgcggcaaatccttctctcagcggagtaacctcatgcagcatcggagggtgcacactggtgaaaggccttatgagtgctctgaatgcggcaagtctttctctcagaatttctcattgatttaccatcaaagagttcatacaggtgagcgtccgcatgagtgtaatgagtgcgggaagtcctttagccgctccagctcactaattcaccatagaaggttgcatactggggagagaccatatgaatgctctaagtgcggaaagtcattcaagcagtcatcaagcttctcttctcaccggaaggtccacacaggcgaaaggccttatgtctgtggtgagtgcggtaaaagcttttcacatagtagcaatctgaaaaatcatcagcgggtgcacactggcgagcggccagtcgaatgcagcgagtgttcaaagtccttcagctgcaaatccaatctgattaaacatctgcgggtgcacaccggtgagcgaccatacgaatgctccgagtgtggcaagtctttctctcagagctcctccctgattcagcacagacgcgttcacaccggcaaaaggccataccaatgctcccagtgtggcaagagttttggctgcaagtctgtcctgatacagcatcagcgagtgcacataggtgaaaaaccatag

SEQ ID NO: 25032 - DNA, 1695 bp, Artificial Sequence
  Description of Artificial Sequence: Synthetic coding sequence
atgctcggcttccctccagggagacctcagcttccagtgcagctgagaccacaaacgagaatggccaccgctcttcgcgatccggcttccgggagtgtcacattcgaagacgtggcagtgtattttagctgggaagagtgggacctcctggatgaagcccagaagcatttgtattttgatgttatgctcgagaatttcgccctcacctccagtctgggatgttggtgtggtgttgagcatgaagaaaccccttcggaacagagaatttcgggcgaaagagtgccccagttccggacctctaaagagggatcatcgagtcagaacgctgattcatgtgagatctgctgcctggttctacgggatatcctgcacctcgccgaacaccaggggacgaactgtgggcagaagttgcacacatgcggaaaacaattctatatttccgctaatctccagcagcaccaacgacagcacattactgaggcaccattcaggtcttatgtagacaccgcttcttttactcaatcctgtatcgtccacgtgagcgagaaaccctttacatgtcgagaaataagaaaggattttttagcgaatatgcggttcttacatcaggacgcaacccagactggagagaagcctaataatagtaataagtgcgctgttgccttttatagtggaaagtcacaccataattggggaaaatgttcaaaagccttcagccatatcgataccttggtgcaggatcagcgtatcctgacacgtgagggcctattcgaatgttctaagtgtggtaaagcctgcacccgcaggtgtaacctgatacagcaccaaaaggttcattccgaggagcgaccctacgagtgtaatgaatgcggtaaatttttcacctattatagctcttttatcatccaccagagggttcataccggcgaacggccttatgcttgcccggaatgcggaaagtcgttttctcagatatacagcttgaactctcaccgaaaagtgcacactggcgagcgtccttacgagtgtggggagtgcggcaaatcgtttagccaaaggtccaatctcatgcaacacaggagggttcacactggagagagaccctacgagtgttccgaatgtggtaagtccttctcccagaatttctcacttatttaccaccagagggtacacaccggagaacgacctcacgagtgtaacgagtgtggcaagtccttctctaggtcatcctcccttattcatcatagacgactgcacactggagagaggccttacgaatgtagcaaatgtggcaaatcttttaagcagagcagcagcttctcttctcatagaaaggtgcacactggcgagagaccctacgtatgcggagagtgcgggaaaagctttagtcatagttcgaacctcaagaaccatcagcgcgttcataccggggagcgaccagttgaatgctctgaatgtagtaaatctttctcgtgcaagtctaacctcatcaagcaccttcgtgtgcacacaggcgaacgcccatatgagtgttccgagtgtgggaagtcttttagccagagctcgagcttgattcaacaccgcagagtgcacacgggtaaacggccataccagtgcagtcagtgtggcaagtcatttggctgcaaatcagtactgatacaacatcagagagtccacatcggcgaaaagccatag

SEQ ID NO: 25033 - DNA, 1512 bp, Artificial Sequence
  Description of Artificial Sequence: Synthetic coding sequence
atgctagagaattttgcgctgacctcaagcctgggatgttggtgtggcgtcgagcatgaggagacaccctctgaacagaggatctccggggagagggtcccccagttcagaaccagcaaggaaggctcgtctagtcagaatgccgacagttgcgagatttgttgtctggttttgcgggatatacttcatttggccgaacatcagggcaccaactgtggccaaaagctccacacgtgtggaaaacaattttatatatccgcaaatctccagcaacatcagaggcaacacattaccgaggccccttttagatcatacgtggataccgcctcttttacccagagttgcatcgtgcacgtgtctgaaaagcccttcacatgtagggagataagaaaggacttcttagccaatatgagatttctgcaccaggacgcgacccaaaccggagagaagcctaacaactccaataagtgcgctgttgcgttttactccggaaagagccaccataactggggcaagtgcagtaaagcgttttcgcatatagacaccctcgtgcaggatcagagaattctcacccgggaaggactatttgaatgctccaagtgtgggaaggcttgtacacgccgttgcaatttgatccagcaccagaaggtgcatagcgaggaacgcccatacgaatgtaatgaatgtgggaagtttttcacgtactatagctctttcattatccatcagcgggttcacactggtgaaagaccttatgcttgccctgagtgcggaaagtccttctcccaaatctattccctgaatagtcacaggaaggtgcataccggggagagaccctacgagtgtggcgagtgtggcaaaagcttcagtcagagatccaatcttatgcaacacagaagagtgcacacaggagaaagaccttacgagtgttccgaatgtggcaagtcttttagtcagaatttctccctcatctaccaccagcgggtgcacacaggcgaacggccacacgagtgtaatgaatgtggaaaatcattctctaggagctctagtttgatccatcatcggcgtctacatactggcgaacggccttatgagtgcagcaagtgcggaaagtcgttcaagcagagcagttccttttctagccatcgcaaggttcatactggagagagaccgtacgtatgcggcgagtgtggaaaaagcttctcacacagctccaacctcaagaaccatcagagggtgcacaccggcgaaagacccgtagaatgtagcgagtgttcaaagagctttagctgcaagtctaacctgataaagcacctgcgcgtgcacaccggcgagcggccatatgaatgctcggagtgtggtaagtccttctcacaaagtagctccctcattcagcatcggcgtgttcatacaggcaaacggccttatcagtgttcccagtgtggtaagagcttcggctgcaagtccgttctgatacagcaccagcgcgtgcatattggagagaagccttag

SEQ ID NO: 25034 - DNA, 1707 bp, Artificial Sequence
  Description of Artificial Sequence: Synthetic coding sequence
atgatttctgcctactgtaacttgcatctgctgggcagcagtgacagccccgcttcagctagccaggttgctggtacaacgggcatgaggcaccatgcgcagggaagcgtgactttcgaggacgtggctgtgtacttcagctgggaagagtgggacctgttagacgaggcacagaaacatttgtatttcgatgtcatgttagagaactttgctcttacatcttcgcttggatgctggtgtggcgtggaacacgaggaaaccccaagcgaacaacggatatctggagagagggtgccacagttccgtacgagcaaggaggggtcaagcagtcagaacgctgactcctgcgagatctgttgccttgtgctgagagacattctccacctcgctgaacaccaagggaccaactgcgggcagaagttgcacacctgcggcaagcagttttatatttccgcaaaccttcagcaacatcagagacagcatattaccgaagccccttttcgaagctacgtggacaccgcttcctttacacagtcctgcatcgttcacgttagtgagaaacctttcacctgtcgggaaattaggaaggacttcctggccaatatgcggtttctgcaccaggatgcgacacagacaggggagaaaccaaacaacagcaacaaatgcgccgtggcattttatagcgggaagtcccaccacaattgggggaagtgctcaaaggccttctctcacatcgacactctagtgcaagatcagcgtatcttgacacgcgaggggttgtttgagtgttccaagtgtggcaaggcttgtacgaggcgctgtaatctaatccagcaccaaaaagtgcactccgaggaaaggccttacgagtgcaacgagtgcggcaaattctttacttattactcctctttcatcatccatcagcgggttcacacaggcgaaagaccctatgcatgtccagagtgcggaaagtctttcagccagatctactccttgaattctcatcgtaaagtgcatacaggtgagaggccctacgaatgcggtgaatgcggaaagtcttttagccaacgttctaacctaatgcagcaccggagggtgcacactggtgagcggccatatgaatgttcggagtgtggcaagtcgtttagtcagaacttctcactcatttaccatcaaagagttcacaccggggagaggccacacgagtgtaacgaatgcggcaagtcgttttccaggagcagcagccttatccatcatagacggctgcacacaggagagagaccctatgaatgtagtaaatgcggcaagtcatttaaacagtcaagctctttcagctcccacagaaaagtccacaccggagagaggccctacgtctgtggcgagtgcggaaaaagttttagccattccagcaacctgaagaaccaccagcgggttcataccggggagagaccagtagagtgcagtgagtgttcaaagtccttctcctgcaaatctaaccttattaagcatttgcgcgtgcacaccggcgaaagaccctacgagtgtagcgagtgcggtaaaagcttctcacagtcgtcatctctaatccagcaccggcgagtacatactggtaagcgaccttaccagtgtagtcagtgtggtaaatctttcggatgtaaaagcgtcctgatccagcaccagagagtccacattggcgagaaaccatag

SEQ ID NO: 25035 - DNA, 1668 bp, Artificial Sequence
  Description of Artificial Sequence: Synthetic coding sequence
atgctggaaaatttcgctctgacatcttcactcggcttgatttcaagttggtctcatgtggtcgcgcagctgggactcggcgaagtcccttctgttctccatcggatgtttatgacccccgcttccgcaagatgggaccaaagaggtcctggcttacatgagtggcaccttggcaaaggtatgtcttccgggtgctggtgcggtgttgagcacgaagaaacacccagcgagcaacgtatcagcggggagcgagtgcctcaattccgcacctccaaagaaggatcttctagtcaaaacgccgatagctgcgaaatctgctgccttgtcctgcgcgatattcttcatttggccgagcaccagggcacaaactgcggacagaagctccacacctgcggcaagcagttctacatttctgctaatttgcagcaacatcaacgccagcatataaccgaggctccatttaggagctatgtggacaccgccagctttactcagtcatgtatcgtgcacgttagcgagaagccattcacgtgtagagagatccgaaaggacttcctggccaatatgagattcttgcatcaggacgccacgcagaccggcgagaagcccaacaatagcaataagtgtgccgtcgccttctattccgggaaaagtcaccataactggggtaaatgcagcaaagccttctcccatatcgatacactagttcaggaccagagaatcctaacacgcgagggcttgtttgaatgctcaaaatgtgggaaagcgtgcacccgcaggtgtaatctgatccagcaccagaaagtccacagtgaagaacgtccctacgagtgcaatgagtgtggaaagtttttcacttattattcttcattcattatccaccagagggttcacactggagagagaccctatgcatgccccgaatgcgggaagagcttctcccaaatctatagtctaaacagtcaccgaaaagtgcacacaggggaaagaccttacgaatgtggtgaatgtggcaagagtttctctcagcggtcaaacttgatgcagcacagacgcgttcacaccggcgagaggccatacgaatgcagcgaatgcggaaagagcttctcccagaatttttccctcatatatcaccagcgggttcacactggcgaacgaccacacgagtgtaacgaatgtgggaaatcatttagccggtccagtagcctaatacaccaccggaggctgcacacaggcgagagaccttacgagtgttcgaaatgcggcaaaagtttcaagcagtctagctcatttagtagccacaggaaagtgcatactggcgagaggccttacgtgtgtggagagtgtggcaagtcatttagtcactcctcaaacctcaaaaatcaccaacgggtacataccggcgaacgccctgttgaatgcagtgagtgtagtaagagtttctcctgcaagagcaatctgatcaaacacctgagggtgcacacgggagaacgcccttatgaatgtagtgagtgtggcaagagcttctcacaaagtagctccctaattcagcaccggagggtccataccgggaaaaggccttaccagtgcagtcaatgtgggaagagtttcggttgtaagtccgtgctgatccaacaccaacgagtgcacattggtgaaaagccttag

SEQ ID NO: 25036 - DNA, 1731 bp, Artificial Sequence
  Description of Artificial Sequence: Synthetic coding sequence
atgagaaccttgagacagcgcgaagtggaatacttcagtaaggcaacacagcttgtcagaggcagcaccaaggaccgcggagcacaggtgcctattgcaacggaagtgctgttcaagctgacgcaggggtctgtgacattcgaggacgtcgccgtctactttagctgggaagaatgggatctactcgacgaggctcagaaacacctgtatttcgatgtgatgttagagaatttcgcgctcacctcctcactcggttgctggtgtggggtggagcacgaggagactcctagtgaacagagaatttctggggaacgggtcccgcagttccggacttcaaaagaaggttccagcagccagaacgccgactcttgtgaaatttgttgcttggtccttcgcgacatactgcatttggcggagcaccaggggacaaattgcggacagaagttacatacgtgtgggaaacagttctatatctctgccaacctgcagcaacatcagaggcagcatattacggaggcaccatttcgctcatacgtggataccgcatcctttacgcagtcctgtatcgtgcatgtctctgaaaaaccattcacctgtagagagatccggaaggacttccttgccaacatgcggttcctccaccaggatgccacacagaccggcgaaaagcccaacaactctaacaagtgcgctgttgctttctattctggcaagtcccaccacaactggggtaagtgctcaaaagccttcagccatatcgatactctggtgcaggaccaaaggatcttaacaagggagggcctgtttgaatgctcgaaatgcggcaaggcttgtactaggcggtgtaacttgatccagcatcagaaggtgcactcggaggagagaccgtacgagtgcaacgaatgtggaaagttctttacctactacagttctttcattatacaccagagggtgcacacgggagagaggccatacgcctgccctgagtgtggtaagagtttttctcagatttactctctcaactcacatcgtaaagtacataccggcgaacgaccctatgaatgtggtgaatgcggcaaaagcttctcacagagaagtaatctcatgcagcatcgcagagtgcacacaggtgaaagaccatacgagtgctcggagtgcgggaagagcttttcgcaaaactttagcctcatatatcatcaaagagtacacaccggcgagcgccctcatgaatgtaatgagtgcggaaagtcgttttcgaggagctcaagtctgatccatcatagacgcctccatacaggcgaaaggccatatgaatgtagcaaatgcggcaaaagctttaaacagtcttcttctttttcttctcatcggaaagtgcacacgggagaaagaccatacgtttgcggcgaatgtggaaaatcgttcagccactctagcaacctgaagaaccatcagagagtgcacactggggaacgccctgtcgaatgcagtgagtgcagtaagtcttttagttgtaagtctaaccttataaagcatctgcgcgtccacactggcgagaggccctacgagtgcagcgaatgcggcaagtcatttagccagagctcatctctgatacagcataggagggtgcacactggaaagcggccataccagtgtagtcagtgcggcaagtcatttgggtgtaagtccgtcttgattcagcaccagcgcgtgcatattggagaaaagccttag

SEQ ID NO: 25037 - DNA, 1890 bp, Artificial Sequence
  Description of Artificial Sequence: Synthetic coding sequence
atgttgggattccctccgggacggcctcaactgccagtgcagctgcggcctcaaactcgcatggctaccgccctgagggaccccgcaagtgtgcctattgccacagaggtgctgttcaagttgacacagggcagcgtcaccttcgaggacgtggccgtatacttctcttgggaagagtgggatctgcttgacgaggcccagaaacatttgtacttcgatgtgatgctcgagaattttgccctcacatcatctctggggctaatttcctcgtggtcccatgtagtagcccagctcggcttaggggaggtgccgagcgtactgcatagaatgttcatgactccggcttccgcgaggtgggatcagcggggaccagggttacacgaatggcatctaggtaaaggcatgagttccggctgctggtgtggcgtggaacacgaagagactccatccgagcagaggatcagtggcgaacgcgtcccccagtttagaacgtcaaaggaaggctcctccagccagaacgccgatagctgtgagatctgctgcctggttctgagggatattctccatcttgctgaacatcagggtactaactgcgggcagaaactacatacttgtggaaaacagttctatatctctgctaacctccaacagcaccagcggcaacacataactgaggccccatttcgcagttatgttgacactgctagcttcactcagtcctgcattgtccacgtgtccgagaagccatttacctgtcgggagatacgaaaagatttcctagccaatatgagattcctgcaccaggacgccacccagacaggggagaaacctaataattctaacaagtgcgctgtcgccttttactcgggaaaatcacatcacaattggggcaaatgctccaaggctttctctcacatcgataccttagtgcaggatcagcgcatcctaactcgagaaggattgtttgagtgctcaaagtgcgggaaggcctgtacccggagatgcaatctgatacagcatcagaaggtccactctgaagagaggccatacgagtgcaacgagtgtggaaagttctttacctattatagttcctttattatccaccagagggttcacacgggggaacgtccttatgcctgtcctgagtgcggaaagagtttcagtcagatctattccctcaactcccatagaaaagtgcatactggggagcgaccctatgaatgcggggagtgtgggaagtccttcagccagagaagcaatctcatgcaacaccgacgggtacatacaggagagaggccttatgagtgctctgagtgtggaaagtctttcagccagaatttctctcttatctaccatcaacgtgtccataccggcgagcggccacatgaatgtaacgagtgcggcaagtctttcagccgcagttcctctctaattcatcacagacgtttacatacaggcgagcgaccttatgagtgctctaaatgcggcaaatctttcaagcagtcatcttccttctcgagccatcggaaagtgcataccggtgagagaccttatgtgtgtggagaatgtggaaagtccttctctcatagctcaaatctcaaaaaccatcagcgagttcacactggcgagagacccgtagaatgctctgaatgtagcaagtccttcagctgtaaatctaacttaattaaacaccttcgagtacatactggggagagaccctatgaatgtagtgaatgcggtaagtctttctctcaatcaagctcactcatccagcacagacgcgttcacaccggaaaacggccttatcagtgttcccagtgcggcaaaagtttcggttgtaagtctgtgttaattcagcaccaaagagtccatatcggcgaaaagccttag

SEQ ID NO: 25038 - DNA, 117 bp, Artificial Sequence
  Description of Artificial Sequence: Synthetic coding sequence
atgctaggctttccgcctggcaggcctcaattgcctgttcagcttaggccgcagacacgaatggccaccgcactcagggatcccgctagcgccgttcagtggaaaaagaggctctag

SEQ ID NO: 25039 - DNA, 1854 bp, Artificial Sequence
  Description of Artificial Sequence: Synthetic coding sequence
atgatatcaccctcactcgagttactccactccggcctttgcaaatttcctgaggtggaggggaaaatgactacattcaaggaggcagtgacattcaaggacgttgccgtggtgtttacagaggaagagttggggttgctggatcccgctcagcgcaagctgtaccgggacgtgatgctcgagaacttccgcaacttgttaagcgttggaaaccagcccttccaccaagacacgttccacttcctgggtaaagaaaaattctggaaaatgaaaaccacatcccagcgggaaggcaactctggcggaaaaatccagatcgagatggagactgtgcccgaagctggaccacatgaagagtggtcgtgccagcaaatttgggaacagatcgcatccgatttaacccgcagtcaaaattcgatacggaacagttcacagttttttaaagagggtgatgtgccctgtcagattgaggccagactttctatttcccatgtccagcagaaaccatacaggtgcaacgagtgcaagcagtcattctccgacgtgagtgtattcgatctccaccagcagagccacagtggcgagaaaagccatacctgcggtgaatgtgggaagtccttttgctactcacctgctctccacatccaccaacgagttcacatgggcgaaaagtgctacaagtgtgacgtgtgcggcaaggaatttaatcagtcatctcatctgcaaacccaccaacgggtgcatactggcgaaaagccatttaagtgtggacaatgcggaaagggcttccactctcggtcagcactaaatgtgcattgtaagttacacacaggcgagaagccatataattgcgaagaatgcggaaaggcctttatccacgatagtcaacttcaagaacaccaaagaatacataccggagagaagcccttcaagtgtgacatttgcgggaagagcttccgcgttagatccaggttgaacaggcactctatggtacataccggggagaaggcatttagatgcgacacatgtggaaagaacttcaggcaacggtctgccttgaacagccattctatggttcacatagaagagaaaccttataaatgtgagcagtgcggcaagggttttatctgtcgcagagatttttgtaagcatcagatggtgcacacaggtgagaagccatataattgtaaggagtgtggaaaaacatttcgttggtcgagttgtttgctcaatcaccagcaagtgcactctgggcaaaagtcatttaagtgcgaggagtgtggcaaaggcttttacaccaattctcgaaggagtagtcaccagcggagtcacaacggtgaaaaaccctataattgcgaagagtgcggaaaggactacaagcgacgcctcgacctagagttccaccagagagtgcacactggcgaaaggccatacaactgcaaagagtgcggaaagagtttcggatgggcatcatgcttgttaaaacaccagaggttgcattccggggaaaagcccttcaagtgtgaagagtgcggcaaacgctttactcaatctagtcagttacactcccaccaaacgtgtcatactggcgagaagttgtacaagtgcgaacaatgtgagaaggggtacaattctaagtttaacctcgatatgcaccagagggtgcacggtggagaaaggccatacaactgtaaagagtgtggtaaatcatttggttgggcctcatgcctcctgaaacaccagagactgcactctggtgagaagcccctgaagtcaggagtgtgggaggagatatattctgagtttacagcaagctttacttccgtgtcattgtgcggtaggaaagcgatttag

SEQ ID NO: 25040 - DNA, 144 bp, Artificial Sequence
  Description of Artificial Sequence: Synthetic coding sequence
atgactacattcaaggaggccgtgacctttaaggatgtggcagttgtcttcactgaagaagagctcggcctactcgaccccgctcaaaggaaactatacagggatgttatgttggagaacttccggaacctcctcagcgtatag

SEQ ID NO: 25041 - DNA, 1356 bp, Artificial Sequence
  Description of Artificial Sequence: Synthetic coding sequence
atggccaaactctatgaggcagtcacattcaaggacgtggccgttatcttcaccgaagaggaattgggcctcctggatcccgctcagaggaaactgtaccgagacgtgatgctcgagaactttcgcaatctcctcagtgtgggaggaaagatccagactgagatggaaaccgttcctgaagcgggaactcacgaggaattttcatgcaagcagatatgggaacagattgcatctgatctgacccggtcgcaggataccacgatttccaatagtcagctatttgagcaggacgataatccctcacagatcaaggcgagactgagcacagttcatactcgggaaaagccttttcagggcgaaaattgcaaacagtttttctcggacgttagcttctttgatctccctcagcagctgtacagcggcgagaaatctcacacatgcgatgaatgtggaaaaagtttttgttacattagtgcactgcacattcaccaacgcgtgcacatgggagtcaagtgctacaagtgcgatgtgtgtgggaaggaattttcccagagctctaggctgcagacccaccagagagtgcatacgggagagaagcccttcaagtgcgaacagtgtgggaaaggatttagatgccgctctgccttgaaagtacactgcaaattgcacatgcgcgaaaagccttataactgtgaaaaatgcggaaaagccttcatgcataacttccagctacagaaacaccatagaattcataccggggaaaaacctttcaaatgtgaaatttgcggtaaatcattttgtttgaggtccagtctgaaccgtcactgcatggtgcacacagcagaaaagttatacaagagtgagaagtatggacgcggttttatagaccggctggatcttcacaagcaccagatgattcatatgggccagaaaccttacaactgtaaggaatgcggaaaaagcttcaaatggtcctcgtacctgctggtgcatcagagagtgcacaccggtgagaagccatataagtgtgaggagtgtggtaagggctatataagcaagtctggcctggattttcatcacaggacccacaccggagaacggtcttataactgtgataactgtgggaaatcattcaggcacgccagcagcattctcaaccacaaaaagttgcactgtcagcggaagccactgaaatgcgaggactgcgggaaacgcttggtttgccggagttattgtaaggatcagcagcgagatcactccggggagaacccttccaaatgcgaggactgtggcaaaagatataaacggaggcttaacttggacatcatcttgagcctcttcctgaatgatatttag

SEQ ID NO: 25042 - DNA, 1194 bp, Artificial Sequence
  Description of Artificial Sequence: Synthetic coding sequence
atggaaacagtcccggaggcaggcacacacgaagaattcagctgtaaacaaatctgggaacagattgcctcagacttgacaaggtctcaggataccaccatctccaattcacaactcttcgagcaggacgataacccaagtcagattaaggccagactcagtacggtgcacacaagagagaaaccattccagggcgagaattgtaaacagttcttctctgacgtcagcttttttgacctaccccagcagctctatagtggtgagaagtctcatacttgtgacgagtgcgggaagagcttctgctatatcagcgccctgcacatccatcagcgcgtacacatgggcgtcaaatgctacaagtgcgatgtatgtgggaaggagtttagccagagcagccggttgcagacccatcagagagtgcacaccggcgaaaaaccctttaaatgtgaacagtgcggaaagggctttagatgccgctcagccctcaaagtgcactgtaaactgcacatgcgggagaagccttataattgtgagaaatgtggaaaagctttcatgcataacttccagcttcaaaagcaccacagaatccatactggtgaaaaacctttcaaatgcgaaatttgcggtaaatctttctgtttgcgtagctctctgaacagacattgcatggtgcacacagcagaaaagttatacaagtcggagaaatacggcagaggtttcatagatcggctggatctccacaagcaccaaatgatacacatgggccagaaaccatataactgcaaggaatgcggcaagagcttcaaatggtcaagctatctgttggttcaccaacgcgtgcacacaggggaaaagccatataagtgcgaggagtgcggaaaaggctatatctctaaatcgggcttggacttccaccatagaacacatacaggcgaaaggagctataactgcgataattgcggaaaaagttttcgccatgcatcatctattctcaaccacaagaagctacactgtcaacgaaagcctcttaaatgtgaagattgcgggaagcggctggtttgccgcagttactgtaaggatcagcagagagaccacagtggggaaaacccctccaagtgcgaagattgtggtaagagatataagcgacgcttaaatctagacatcatcctgtccctgttcctgaacgacatctag

SEQ ID NO: 25043 - DNA, 1476 bp, Artificial Sequence
  Description of Artificial Sequence: Synthetic coding sequence
atgatagacagcggggagaagaagcctggcaggagagcggaagaagcggtgactttcaaggacgtggccgtcatcttcacagaagaggaactagggctcttagatccggcacagaggaaactctacagagatgtgatgctcgagaattttcgaaatttgctgtctgtgggacaccagccgttccatggggacactttccacttcttacgggaagagaagttttgggtgatgggcacaacatcgcagagagagggcaatttaggcggtaagatacagactgaaatggaaaccgtgcccgaggcgggtacccatgaggaattctcatgcaagcagatttgggagcagatcgccagtgatctgactaggtctcaggacactaccatcagcaattctcagctgttcgaacaggacgacaatccgagccagattaaggcacgcctttctacagtacatactcgagagaaaccattccagggggagaactgtaaacagtttttcagcgacgttagcttctttgacctgccacaacagctttacagtggagaaaagagccacacttgtgacgagtgcgggaaatctttttgctacatttctgcactccacatccatcaacgcgttcacatgggtgtgaagtgctacaagtgtgacgtttgcggtaaggaatttagccagagtagccggctgcaaacccaccagcgggttcacacgggtgagaaaccattcaagtgtgagcaatgtggcaaggggttccgctgtaggtccgccctgaaagtgcactgcaagctgcatatgcgggagaaaccctacaactgcgagaagtgtgggaaggcctttatgcacaacttccagcttcagaagcaccacagaatccacaccggggaaaaaccattcaaatgtgagatctgtgggaaatctttctgcctgcgttcatctctgaatcgccattgcatggttcacacagcggagaagctctataaatcagagaagtatgggcgaggatttattgatcgattggatctccacaaacatcaaatgattcacatgggacaaaaaccgtacaactgcaaagaatgcgggaagagctttaaatggagttcctacctgctcgtgcatcagcgtgtgcataccggcgagaagccctataagtgcgaggaatgcggcaagggctatatctctaagagtggactagattttcaccacagaacccatacaggcgaacgatcatataactgtgataactgcggtaaaagtttcagacacgcctcgagtatcctgaatcacaagaaactgcactgccaaagaaagccactgaagtgcgaggactgtggcaagcgcctagtgtgccgcagctactgcaaagaccagcaaagggaccacagcggggagaacccatctaaatgtgaggattgtggaaagcgatacaaaagacgcctgaatctggacattattctatccttgtttctcaatgatatttag

SEQ ID NO: 25044 - DNA, 1449 bp, Artificial Sequence
  Description of Artificial Sequence: Synthetic coding sequence
atgacaatgtctaaggaggctgtgacgtttaaggacgtggccgtggtgttcaccgaggaggagttaggcctcctcgacctcgctcagaggaaactgtacagagatgtcatgctggagaatttccgcaatctcctttcagtgggacaccagccctttcatagagatacctttcactttctccgcgaggagaagttttggatgatggacattgctacccaacgcgaaggaaactcaggcggtaaaatccagcctgagatgaaaaccttccctgaggccggtccccatgaggggtggtcctgtcaacaaatttgggaggaaatcgctagtgacctaacacgcccacaggattctactattaagtcctcgcaattcttcgagcaaggcgacgcccactcccaagtagaagaaggactctctattatgcacacggggcagaaacccagtaattgtggaaagtgtaagcagagtttctccgacatgtccatcttcgacttaccacaacagatccggtctgcggagaagtctcattcatgcgacgagtgtggtaaaagtttttgctatatttccgctttgcacatccatcaacgagttcacctcggcgagaagctcttcaagtgtgatgtgtgtggtaaagaattttcccagtcgcttcacctccaaacgcaccaacgagtgcacacaggagagaagccattcaaatgtgagcaatgtgggcgagggtttcgttgcagatcagccctgaccgtacactgcaaacttcacatgggcgagaagcattacaactgcgaagcttgcggcagagctttcattcatgatttccaattgcaaaagcaccagcggatccacaccggagagaagccatttaagtgcgagatttgttctgtgtcgtttagattaagatcatctcttaaccgccactgtgttgtacacaccggcaagaaaccaaattcaacaggggagtacggcaaggggtttattcgcagactggacttgtgtaagcaccagacgatccacacaggagagaagccctacaactgcaaggagtgcggaaagtctttccggaggagtagctacttacttatccatcagcgagtgcacacaggagagaagccttacaagtgtgacaagtgtggcaagtcgtacattaccaagtcaggcctggatctgcaccaccgtgcccacacaggagagagaccttataattgcgacgattgtggcaagtcattcaggcaggccagctcaattctcaaccacaagcggctacattgtcggaagaagccctttaaatgtgaggactgcggaaaaaagctggtatatcgatcttaccggaaggaccagcagaaaaatcatagcggtgagaatccctcaaagtgtgaggactgtgggaagaggtacaaaagaaggctgaacttggatatcatcctgagtctgttcctgaacgatacttag

SEQ ID NO: 25045 - DNA, 2121 bp, Artificial Sequence
  Description of Artificial Sequence: Synthetic coding sequence
atgactacgctgaaagaggcagttacttttaaagatgttgccgtagtattcaccgaggaggagctgagacttctggacctggcgcagcgaaaactctacagagaggtgatgctagaaaatttccggaatcttttgtctgtgggccaccagagcctgcatcgggatacattccactttctaaaagaggagaaattctggatgatggaaactgccactcagcgtgaaggcaacctcgggggaaagatccagatggagatggagaccgtgtctgagagtggaacacatgaagggctgttcagccatcagacgtgggagcagatcagtagcgacctgacgagattccaggactctatggtgaactcttttcagttttctaagcaggatgacatgccctgtcaggttgacgctggactcagcatcatccatgtcagacagaaacctagcgagggtaggacgtgcaagaagtccttctctgacgtgagcgtcctagacctacatcagcagctgcagagccgtgaaaagagccatacatgcgatgaatgtgggaagtctttttgctatagcagtgctctgagaatacaccagagggtacatatgggcgagaaactttataattgcgacgtttgcggaaaagagttcaatcagagctcccatctgcagatacaccagcggatccatactggagagaaacccttcaagtgtgagcaatgcggtaaggggttttcccgcaggtcggggctgtatgttcacaggaagctgcacactggcgtgaagcctcatatctgcgagaaatgcggaaaggcctttatccacgacagccaactccaggaacaccagagaatccacacaggcgagaagccttttaagtgcgatatttgttgcaagtcattcaggagcagagccaatctgaacaggcactcgatggtgcacatgagagaaaaaccattcagatgtgacacatgtggcaagagttttggacttaaatcagctctcaattctcatagaatggtacacacaggagagaaacgttataaatgcgaggagtgtggcaaacggtttatttatagacaagatctttataaacatcagatcgatcacacgggagaaaaaccatataattgtaaggaatgcggaaagtccttccgctgggctagtggactttcaaggcacgtgcgagtgcattctggagaaacaacattcaagtgcgaggaatgcggaaaaggattctacacaaacagccagaggtactctcaccagcgtgcccacagcggagaaaaaccctataggtgcgaggaatgcggaaaaggctataaaagacgtctcgatttagactttcatcaaagggtccaccgcggtgagaagccttacaattgtaaggaatgcggtaagtcatttggatgggcttcttgtttgctgaaccaccaacggatccactcaggtgagaagcctttcaagtgcgaagagtgcggaaagcgctttacccagaactcccagctgtacacccacaggcgcgtgcattctggagaaaaaccctttaagtgcgaagaatgtgggaaaagattcacacagaatagtcagctgtattcccacaggagagtgcacacaggcgtcaaaccttataaatgtgaggagtgcgggaagggatttaatagtaagtttaatctggacatgcatcaaagagtacataccggagagcgcccttacaattgtaaagagtgtggaaagtctttcagccgggcaagcagtatcttaaatcataaaagattacacggcgatgaaaagccatttaaatgtgaagagtgcgggaagagattcaccgagaattcgcagctgcatagccatcagagggtgcatacaggggaaaagccatataagtgcgaaaagtgcgggaaatcttttcggtgggcgagcacccaccttacacatcaaagactgcactcgagagagaagctgctccagtgtgaggattgtgggaagagcatcgtccacagcagctgtttaaaggatcaacaacgtgaccagtccggggagaaaacgtcaaagtgcgaagattgtggcaaacgctacaaacggaggctgaatctcgacactctgctgtcgctcttcctgaacgacacctag

SEQ ID NO: 25046 - DNA, 2013 bp, Artificial Sequence
  Description of Artificial Sequence: Synthetic coding sequence
atgcttgagaatttccgtaatcttctgagcgtaggccaccaaagcttgcaccgagacactttccactttctgaaagaagagaaattttggatgatggaaaccgctacccagcgggagggaaatctgggcggtaaaattcagatggagatggagactgtgtccgagtccggtacccacgaggggctcttctctcatcagacctgggagcaaatctctagtgacttgacccgtttccaggatagtatggtgaactcttttcaattctccaaacaggatgacatgccctgccaggtagacgcaggcctgagcatcatacacgttcggcagaaaccatcagagggcaggacatgcaaaaagtccttcagtgatgtcagcgtgctcgatctgcaccagcagctgcagagtagagagaagtctcacacatgcgatgagtgtgggaagtcattctgttattcgtccgctctgaggatccaccagagagtgcatatgggagaaaaactgtataactgcgatgtgtgcggcaaagagttcaaccagtcttcacacctgcagattcatcagcggattcatactggagaaaaacccttcaaatgcgaacagtgtggaaagggattcagtagaaggtccggtctgtatgtccaccgcaagctgcatactggggtgaagcctcacatatgcgaaaaatgtggcaaggctttcattcatgattcacagctgcaggagcaccaacgaattcacactggtgagaagccatttaaatgcgatatttgttgcaagtccttccggtcaagagccaacctgaacagacattcgatggtgcatatgagagagaagcccttccgctgcgatacctgcggtaagagcttcggtctgaagagtgcactgaacagtcacagaatggtccataccggggagaaaaggtataagtgcgaggagtgtggaaagcgctttatctacagacaagatttatataagcaccagatcgaccatacaggggagaagccttacaattgcaaagaatgcggcaagagcttccgatgggcgtctggcctcagtagacatgtgagggtccactccggtgagactaccttcaagtgcgaagagtgcgggaaggggttctacacaaatagtcagcgttattcccatcaacgcgcacactccggtgagaagccttaccgttgtgaggagtgcggcaaggggtacaagagacggctagatctggacttccaccagcgggtgcaccgaggagagaaaccttacaattgcaaagaatgtggaaaatccttcggctgggcctcctgcttgctcaatcatcagcgaattcattccggagagaagccttttaaatgtgaagagtgcgggaaaaggttcacccagaattctcagctctatacacaccgcagagtccactccggcgagaagccctttaagtgcgaggaatgcggtaagaggttcacacagaacagccagctatactctcaccgcagagtgcacaccggtgtcaaaccttataaatgcgaagagtgcggcaaggggttcaacagcaagttcaatttagacatgcaccagcgggtgcacaccggcgaaagaccgtacaactgtaaggaatgcgggaagtccttttctcgcgcatcttctattctcaaccacaaaaggctccacggggatgagaagccgttcaagtgtgaagagtgtggtaaacgatttacggaaaattcccaactccactcgcaccagcgagttcatactggcgaaaaaccctataagtgcgaaaaatgtgggaaatccttccgctgggcctcgacccatctgacccaccagaggctgcactctagggagaagttgttgcaatgcgaagactgcggcaaatccatcgtgcacagctcttgtctcaaagatcagcagagagaccagtccggcgaaaagacaagcaagtgtgaggactgcggaaagagatacaagaggagactcaacctggatacactgctctccctgtttctaaacgacacttag

SEQ ID NO: 25047 - DNA, 285 bp, Artificial Sequence
  Description of Artificial Sequence: Synthetic coding sequence
atgaacatgtttaaggaggccgtaacctttaaggatgttgcagtagcgttcaccgaggaggaactcggactgctggggccagcccaaaggaagctttatagagatgtgatggttgaaaattttcgaaacttgctgagcgtcgggcatcctccctttaaacaggatgtttcgcccatcgagcgcaatgagcagctgtggatcatgaccactgccacacgacgtcaaggaaatcttgacaccttgctagtgaaagccctgctcttgtacgacctcgcacaaacatag

SEQ ID NO: 25048 - DNA, 2412 bp, Artificial Sequence
  Description of Artificial Sequence: Synthetic coding sequence
atgaacatgtttaaggaggctgtgaccttcaaggatgttgcggtcgccttcactgaggaggagcttgggttgctgggtcccgctcagcgcaagctatatagggatgtgatggtcgaaaatttccggaacctcctgtctgtcgggcatcccccattcaaacaggacgtatctcctatcgaacggaatgaacagctgtggataatgactactgccaccaggaggcaggggaacctgggcgagaaaaaccaatctaaacttataactgtgcaggatagagaatctgaagaggaactatcctgctggcagatttggcaacaaattgcaaatgatttgacacgttgtcaggactctatgattaataactcccaatgtcataaacagggagatttcccctatcaggtaggaaccgagctgagcattcagatcagcgaggatgaaaattacatagtgaacaaagcagatgggcctaacaataccggcaatcccgaatttcctattctgcgtactcaggactcgtggagaaagacatttctaaccgagagtcagagactaaatagagatcagcagatttcaattaagaataaattgtgtcagtgcaagaaaggtgtagaccctattggatggatctcacaccacgacggccaccgcgtgcataaaagcgaaaagagttataggccaaatgactacgaaaaggataacatgaaaatactcactttcgatcacaacagcatgatccataccgggcagaagtcttaccagtgcaacgaatgcaagaagcccttctctgatctgagctccttcgacctgcaccagcaactacagtcgggggagaagtcactgacatgcgtggagagaggcaaaggcttttgttatagccccgtgttgcccgttcaccaaaaggtccatgtcggcgagaaactgaagtgtgacgaatgcgggaaggaattttctcagggagctcatttgcagactcaccagaaggtgcacgtgattgagaagccctataaatgtaaacaatgtgggaagggattttctaggaggtcggcgctgaacgttcattgtaaggtccataccgccgaaaagccatataactgcgaggaatgtggtcgagccttctctcaggctagtcacttacaggatcatcagcgactacacacaggcgagaaaccgtttaaatgcgacgcttgtggcaaaagcttcagtagaaacagtcacctccaaagccaccagagagttcatactggcgaaaaaccctacaaatgtgaggaatgtggcaagggtttcatttgcagttcgaatctctacatccatcaacgcgtgcacacaggcgagaagccttacaagtgcgaggagtgcggcaagggtttctctaggccttcgtcactgcaggcacaccagggcgtacacacaggagaaaaaagctacatctgtactgtctgtggaaagggatttacactgagcagcaatttgcaggcacaccagagggtccacaccggggaaaagccttacaagtgcaatgagtgcgggaagtcgttcagacgcaactctcactatcaagtccatctggttgtccacacaggcgagaaaccctataagtgtgagatttgcggcaagggtttcagtcagagcagttatctccagatccaccagaaagcacattcaattgaaaagccttttaagtgtgaggaatgtgggcaaggattcaatcaatcttctcgcctgcaaatccatcagctcattcacaccggtgagaaaccctacaaatgtgaggagtgtggcaaaggctttagccggcgtgcggatctgaaaatacactgtagaatacatactggcgaaaagccttacaactgtgaggagtgcgggaaagtatttaggcaggcttccaacttgttggcgcaccagagggtgcatagcggcgaaaagccgtttaagtgtgaagagtgcggaaaaagttttggcaggtcggcacaccttcaagcgcaccagaaggttcataccggtgacaaaccatacaagtgtgatgagtgtggtaagggctttaagtggagcctcaatctcgatatgcaccagcgcgtccacacaggggaaaagccatataagtgcggcgaatgtggtaagtacttctcccaggcttcctctcttcagctacatcagagtgttcacaccggggagaaaccttacaagtgtgacgtgtgtgggaaagttttctcgcggtcaagccaattgcagtctcatcagagagtgcataccggggaaaaaccttataaatgtgagatctgcggtaaatcttttagctggagatccaatctaaccgttcaccaccgcatccacgtcggcgacaaatcttataagagtaataggggcggaaaaaacattagggaaagtactcaggaaaagaagtcaattaagtag

SEQ ID NO: 25049 - DNA, 285 bp, Artificial Sequence
  Description of Artificial Sequence: Synthetic coding sequence
atgaacatgtttaaagaggccgtaactttcaaggacgtggctgttgcttttactgaagaagagttgggcctattaggaccagcccagaggaagctctacagggatgtgatggttgaaaactttaggaatttgttaagtgtcggacaccctcccttcaaacaggatgtttcccctatcgaacgaaacgaacagctctggattatgacgaccgcgacccgcaggcagggtaacctggacacactgctagtgaaggccctgctgctgtacgatttagcccagacctag

SEQ ID NO: 25050 - DNA, 2103 bp, Artificial Sequence
  Description of Artificial Sequence: Synthetic coding sequence
atgaccaccttcaaagagggccttacattcaaggacgttgccgtggtattcaccgaggaagagctcggactgctggacccagtgcaaaggaatctctaccaggacgtcatgttggagaatttcagaaatctgctctcagtcggacaccacccattcaagcatgacgtgtttctgctagagaaggagaagaaattggatataatgaagactgccacgcagcggaagggcaaaagcgcggataaaatccagtctgaggtcgagacggtgccagaagccggaaggcatgaggagctctattggggccagatctggaaacagatcgcttctgatctgatcaaatacgaagactccatgatctccatatcaagattccccaggcagggagatctgagctgccaggtgcgggctggcctgtatacgacacatacaggccaaaagttctatcagtgtgacgagtacaagaaatcatttacagatgtttttaacttcgatctgcatcagcagttacatagtggcgaaaagagtcacacatgtgacgagtgcgggaaatccttttgctacataagcgctcttcacattcaccagagagtgcacatgggtgaaaagtgttacaagtgcgacgtttgcggcaaggaattctctcagtcatctcatctccaaacacaccagcgtgtgcacacagtcgagaagccttttaagtgcgtcgagtgtggaaaaggtttctcccggaggtccactctgaccgtacactgcaagcttcactccggcgagaaaccatacaactgcgaagaatgtggtcgcgcattcattcatgcttcccacctgcaggaacatcaaaggatccacacaggcgaaaaaccattcaagtgcgatacctgtggaaaaaatttccggaggcggtcagccctgaacaatcactgtatggtgcacacaggcgagaagccttacaagtgtgaagactgcggaaagtgtttcacctgcagttccaacctgagaattcatcagagagtgcatactggcgagaagccatataaatgtgaagaatgcggaaaatgtttcatccagccctcccagttccaggcccatcgcaggatccataccggagagaaaccatatgtgtgcaaagtctgtgggaaaggctttatatattctagctcattccaggcacaccagggcgttcataccggagaaaagccctacaagtgcaacgaatgcggcaaaagttttaggatgaagattcactatcaggtccaccttgtggtccacaccggggagaagccctacaagtgcgaggtttgcggcaaagcttttagacagtcttcctacttaaagatccatctcaaagctcacagcgttcaaaagccttttaagtgcgaggaatgtggccagggatttaatcaatcctccagacttcagattcaccagctgattcatacaggcgaaaagccatacaagtgtgaggaatgcgggaaaggattctcccgcagagcagacctcaagattcattgccgaatccataccggagagaaaccatacaactgtgaggaatgtgggaaagtgttcagccaggcctctcatcttctgacccaccaacgcgtgcactccggcgagaaaccatttaaatgtgaagagtgcgggaaatccttctctcgctctgcacacctgcaggcgcatcagaaggtgcatacgggcgagaaaccctacaagtgcggtgagtgtggcaaggggttcaaatggtcgcttaatctggacatgcaccaaagggtccatacaggcgagaaaccctatacctgcggtgagtgcggcaaacatttttcccaggccagttcgcttcaactccaccagagtgtgcatacaggcgagaaaccgtataaatgtgatgtttgtggaaaggttttcagcagatcgtcccaactccagtaccatcggagggtgcataccggcgaaaaaccgtataagtgcgagatctgtggaaagagattctcttggcggtcaaacctggtttcccatcacaagatccatgcagcgggaaccttctatgagaatgacgagaactctaaaaatatccgcgagctgagtgaaggcggatcctcaaccaggtag

SEQ ID NO: 25051 - DNA, 2412 bp, Artificial Sequence
  Description of Artificial Sequence: Synthetic coding sequence
atgaatatgttcaaagaagcggtgacattcaaggatgttgccgttgcctttactgaggaagagctgggccttctcggacctgcacaaaggaaattatatcgcgatgtgatggttgaaaactttcggaatctgcttagtgtgggccatcctcccttcaagcaggacgtgtcccccatcgagcgcaacgaacagctttggataatgactacagcaactcgtaggcaaggcaatttgggtgagaagaatcagagtaaactgataaccgtgcaggatcgggagtcggaggaggagcttagctgctggcagatctggcagcagattgctaacgacctgacgcggtgccaggatagtatgatcaataattctcagtgtcacaaacagggagacttcccctatcaggtgggaacagagctttcaatccagatctctgaagatgagaattacatcgtcaataaagccgacgggcctaataataccggcaatccagaattcccaattctgcggacccaggattcatggcggaagaccttcttgacagagagccagagactcaaccgcgatcaacaaatcagtattaagaacaagctgtgccagtgcaagaaaggcgtcgacccaattggatggatttctcaccacgacggacatagagtgcacaagagtgagaagtcctatcggcctaacgactatgagaaggacaatatgaagatacttactttcgatcacaactcgatgatacatactggacaaaaaagctaccagtgtaatgagtgcaagaagcctttctcagatctgtcgtcattcgatctgcatcaacaactccagagtggggaaaaaagtttgacctgcgtggagcgcggaaaaggattctgttacagccctgtcctgcccgttcaccagaaggtgcatgtgggagagaagttgaaatgcgacgagtgcgggaaggaattttcccaaggagctcatttacagacccaccagaaagtccacgtcatcgagaaaccatataaatgtaaacagtgtggcaaggggttcagccgcagatcagcgttaaacgtgcattgtaaagtgcacacagccgaaaaaccatataactgtgaagagtgtggccgagctttctcccaagcttcccacctgcaggaccatcaaagactccatacaggcgagaagcctttcaaatgtgatgcatgtggaaagagcttctcccggaactcgcatttgcagagccatcagagagttcatacgggtgaaaagccttacaaatgtgaggagtgcggaaagggttttatctgttctagtaatttgtacatccaccagcgtgttcacactggtgaaaagccatataagtgcgaggagtgcgggaaggggttctcaaggccctctagcctccaggcgcaccagggcgtgcacacaggagaaaaatcatatatatgcactgtatgcggcaagggctttacactgtcttccaatctgcaggcccatcagcgggttcacacaggggagaagccatacaaatgcaatgagtgcggcaaatccttccgccgaaatagtcactatcaggtgcacctcgtcgtgcatacaggcgagaagccttataagtgcgaaatatgtggcaaaggcttctcccagtcctcataccttcagatccaccaaaaagcccattcaattgagaagccattcaaatgtgaggaatgcggccagggctttaatcaatcgtcacgattgcagatacaccaactgattcacactggcgaaaaaccttataagtgtgaggagtgcggaaaaggcttttcaagaagagctgacctgaagatccactgcagaatccatacgggggagaagccatataattgcgaagagtgtggcaaggttttcagacaggcatccaacctgctggctcaccaacgtgttcattcgggtgagaagccttttaagtgtgaagagtgtggaaagtccttcggcaggagcgctcatcttcaggcacaccaaaaggtgcacacaggagacaaaccctacaagtgtgatgaatgtggaaaggggtttaagtggagcttgaacctcgatatgcaccagcgcgttcacaccggagaaaagccctacaagtgtggcgagtgtggcaaatatttctcccaggcatcttcacttcagcttcatcagtcagtccataccggggaaaaaccatataagtgtgacgtatgtgggaaggttttcagccgcagcagtcagttgcaatcccaccaacgcgttcataccggggaaaaaccatataagtgcgaaatatgcggcaaatctttctcctggagatctaaccttacagtacatcaccggatccacgttggggataagtcttacaaatcgaatagaggcggtaagaatatacgggaaagcacccaggagaagaaatctattaagtag

SEQ ID NO: 25052 - DNA, 207 bp, Artificial Sequence
  Description of Artificial Sequence: Synthetic coding sequence
ttgaagagtcctacgtccagcgaactgcacgtcggggagaagctgaaatgtgacgaatgtgggaaggagtttagccagggcgctcacctgcaaacccaccagaaggtgcacgtgattgagaaaccttataagtgcaagcagtgtggtaagggatttagcaggagatccgctctaaatgttcactgcaaggttcacacagccgaatag

SEQ ID NO: 25053 - DNA, 207 bp, Artificial Sequence
  Description of Artificial Sequence: Synthetic coding sequence
cacagcggcgaaaagtcacatacctgtgatgaatgtaaagcctcggtcaccagccagccatttatacatcagagagtgcatatgggcgaaaagtgttataaatgcgacgtttgcgggaaagagtttagccagagctcgcacctgcagacacaccagcgagtgcacaccgtggagaaaccatttaagtgcgtcgagtgcggaaaatag

SEQ ID NO: 25054 - DNA, 2400 bp, Artificial Sequence
  Description of Artificial Sequence: Synthetic coding sequence
atgccttcacagaactatgacctgccacagaagaagcaggaaaagatgacgaaatttcaggaggcagtgaccttcaaagacgtggcggtcgtcttctctagagaggagttgaggctcttggacttaacacagcgaaaactctacagagacgtgatggtggagaacttcaaaaatctggtggccgttggccacctgccgtttcaacccgatatggtttcacagcttgaagccgaagagaaactttggatgatggagacggaaacacagagatccagcaaacaccagaacaagatggaaactttgcaaaaattcgccttgaagtatctgtcgaaccaggagctctcatgttggcagatctggaagcaggtggcctctgagctgacacggtgtttgcagggcaaaagttcccaactgttgcaaggcgactccatccaggtgtcggaaaacgaaaataacatcatgaatcccaagggtgattccagcatatatatagaaaatcaggaattcccattttggcgcacccagcactcatgtgggaatacttacctctctgagtctcagatacaatcccgaggaaagcagatcgatgtgaaaaacaatctgcagatccatgaggattttatgaagaagagtccctttcacgaacatataaagactgatactgagcccaagccgtgcaaaggaaatgagtatggcaaaatcataagtgatggatccaaccaaaagctgcccctgggcgaaaagcctcatccttgtggagagtgcgggagagggttctcctacagtcctcggctgccactccaccctaacgtccataccggtgaaaagtgtttcagtcagtcctcccacctcagaactcatcagaggatccacccaggagagaagctcaatcgctgccatgaatcaggcgattgcttcaataagtcctcctttcacagttaccaatcaaaccacaccggggaaaagagctatcgctgtgactcctgtggcaagggatttagctcctccacaggactcattatccactaccgaacacataccggagagaagccgtacaaatgtgaggagtgcggcaagtgcttcagccaaagcagtaatttccaatgtcatcagcgggtgcatactgaggagaagccttacaagtgcgaagaatgtgggaagggctttggttggtctgttaacctgcgggtgcatcagagggttcatcggggtgaaaaaccatacaaatgtgaagagtgtgggaaggggtttacccaggctgcccatttccatatacaccagagggtgcatacaggagagaagccgtacaaatgtgacgtgtgtgggaagggattttctcataactcgccactgatctgtcacagaagagtccatactggagagaagccgtacaagtgtgaagcatgcggtaagggctttacccggaataccgacctgcacattcattttagagtgcataccggcgagaagccctataaatgtaaagagtgcggtaaaggctttagccaggcatctaatcttcaggtccatcagaatgtgcacactggcgagaagcgttttaaatgtgagacctgtgggaagggcttcagccagtcttccaagctgcagacgcatcagcgagtgcacacaggcgaaaaaccctatcgctgtgacgtctgcggcaaggacttttcctatagttctaacttgaagctccaccaggtgatacacacaggcgaaaaaccttataagtgcgaggaatgcggcaaggggttttcctggaggagcaatctgcatgctcatcagcgcgtccatagcggcgaaaagccatataagtgcgaacagtgcgataaaagtttttctcaggcaatcgattttagggtacaccagcgagtgcacactggcgaaaaaccatacaagtgcggggtatgtgggaaaggcttctcccagagctccgggctacagtcccaccagagagttcacaccggagaaaaaccctataaatgtgacgtgtgtgggaaaggcttcagatactcctcacagtttatttaccatcagcggggacacacgggggaaaagccgtataagtgtgaggaatgtggaaaaggatttggtcgcagtcttaatctccgacatcatcaacgggtgcacacgggcgaaaagccccatatttgcgaggagtgtggtaaggccttcagcctgccttctaatctgcgggtacacctaggcgtccatactagggaaaagctatttaaatgcgaggaatgcggtaaaggttttagccagtccgcacgtctggaggcccaccaacgagttcacacaggggagaagccatataaatgtgatatctgtgacaaagattttaggcacaggtcccgtctcacttaccatcagaaggtgcatactgggaaaaagctctag

SEQ ID NO: 25055 - DNA, 2271 bp, Artificial Sequence
  Description of Artificial Sequence: Synthetic coding sequence
atgaccaaattccaggaagccgtcacttttaaagatgtagccgtggtgttcagtcgggaggagctgcgattgctggacctgacccagcggaagctgtatcgagatgtgatggtggaaaacttcaagaacctggttgccgtcggcagtaaacaccagaataaaatggagactcttcagaagttcgcactgaagtacctctccaatcaggagctgtcctgctggcagatctggaaacaggtagcatcagagttgacgaggtgcctacagggtaagagctcccagctccttcaaggcgatagcatccaggtctcagaaaatgagaacaatatcatgaaccctaagggcgattcgagcatatacattgagaaccaggaatttcctttctggaggactcagcactcgtgtggcaatacgtatctgtctgaatcccaaatccaatcaagaggaaaacaaatagatgtcaaaaacaatttgcagatccacgaagatttcatgaagaaatcacctttccatgaacacatcaagacagacactgaaccaaaaccctgcaaggggaatgagtacggtaagatcatcagtgacggtagtaaccaaaagcttccattgggcgagaaaccacacccatgtggagaatgtgggaggggctttagctactcccccagattgcctctgcacccaaacgtgcacaccggagagaagtgctttagccagagctcgcacctgcgtactcaccaacgcattcaccccggagaaaagttgaaccggtgtcacgaatccggggattgcttcaacaagtcctccttccactcttatcagtcaaatcatacaggggagaagtcctaccggtgcgacagctgcgggaagggatttagctcatcaaccggattaattatccactacagaactcacactggcgagaagccttacaagtgcgaggaatgtggaaaatgtttcagtcaaagcagtaacttccagtgtcatcaacgagtccacaccgaagagaaaccgtacaaatgcgaggaatgtggcaaaggcttcggatggtcggtgaacctgcgcgttcatcagcgggtgcacaggggagagaagccatacaaatgcgaggagtgtggaaaaggattcacccaggcagctcactttcatatccatcagcgggtccatactggtgagaagccgtacaaatgtgacgtgtgcggaaagggcttctcacacaactcacccctcatctgtcaccgtagggtgcacactggcgagaaaccatataagtgtgaagcatgcggaaagggcttcacgcggaatactgacctccacatccattttagagtgcatacaggtgaaaagccttataaatgcaaagagtgtgggaaggggttctcccaggcctcaaacctccaggtccaccagaatgtccataccggagagaagcgttttaaatgcgagacatgtggcaaagggttcagccaaagtagcaaacttcagacccaccaacgcgtccacacaggagaaaagccttaccgatgtgacgtctgtggaaaagacttctcctactctagtaatctgaaattgcatcaggtgattcatacgggcgaaaaaccttacaaatgcgaagagtgtgggaagggattcagctggcgatctaacctgcacgcgcatcaacgcgtgcacagtggtgagaagccttacaaatgcgagcagtgcgacaagtccttttcccaggcgatcgatttccgagtgcaccagcgtgtgcataccggggagaaaccatacaagtgtggcgtttgtggcaagggcttcagccagagtagcggcctgcagagccatcagcgcgtgcacacaggagaaaagccctacaagtgtgatgtttgtggcaaagggttccgttactcttctcagtttatataccaccagagaggccacacaggcgaaaagccttataaatgtgaagaatgtgggaagggcttcggtagatctcttaatctgaggcaccaccaacgcgtgcacaccggtgagaagccccacatatgtgaagagtgtggaaaggcattttcactgccgtccaatctcagggtccacctcggagtgcatacaagggagaagctgttcaaatgtgaggagtgcggtaagggattctcacagtctgcccgactcgaggcccatcagagagttcacaccggtgaaaaaccatacaagtgcgacatatgtgacaaggactttcgacatcgctcgagactgacgtatcatcagaaagttcacactggaaagaaactatag

SEQ ID NO: 25056 - DNA, 1317 bp, Artificial Sequence
  Description of Artificial Sequence: Synthetic coding sequence
catgagagcggggattgtttcaacaagtcctccttccactcctaccagagcaatcacactggtgagaagtcctatagatgcgatagctgtggtaaggggttctcctccagtaccggtctaataatacattaccgcacccacaccggagaaaagccttacaagtgcgaagaatgtgggaaatgtttctctcagtcatcgaacttccagtgtcaccagagagtacatactgaagagaagccatataagtgtgaggagtgtggcaagggattcggctggagcgtcaatctgagagtccaccagagggtgcaccgtggcgagaaaccctataagtgtgaagaatgcggcaagggctttacccaggcagcccacttccacatccaccaaagggtgcataccggggagaaaccatataaatgcgacgtgtgtggtaaagggttcagccataattcacccctcatctgtcatagacgagtccatactggcgagaaaccttacaaatgcgaagcctgcgggaaagggttcacgaggaacacagatctgcatatccatttccgagtgcataccggtgagaaaccgtataaatgtaaagaatgtggtaagggcttctcccaggccagcaacctgcaggtgcaccaaaatgtgcataccggagagaagcggtttaagtgcgaaacttgtggcaagggcttttcccagtcttcgaagcttcaaacgcgcgaaaagccctataagtgcgaacagtgtgataagtctttcagccaggccattgacttccgtgtacatcaacgagttcataccggagaaaagccttataagtgtggcgtatgcgggaaaggattttctcaatcatcagggctacagagccaccagcgtgtgcacacaggggaaaaaccttataaatgcgatgtgtgcgggaagggctttcggtacagttcccagttcatctaccaccagagaggccatacgggagagaaaccttataagtgtgaggagtgcggcaaaggtttcggaaggtctctcaacctgaggcaccaccagcgagtgcatacgggggaaaagcctcatatatgtgaggagtgtgggaaggcgttcagcctgccctcgaacttgcgggttcatctgggcgtgcacactcgtgaaaagctctttaagtgcgaggaatgtggaaaaggatttagccagtctgcgagactggaggcccaccagcgcgtgcacaccggcgagaagccttacaagtgtgatatttgcgataaagacttccgacatcgaagccgtcttacctaccaccagaaagtgcacacaggaaagaagctgtag

SEQ ID NO: 25057 - DNA, 2247 bp, Artificial Sequence
  Description of Artificial Sequence: Synthetic coding sequence
atggttgagaacttcaagaacctggtggcagtggggcacctgccctttcagcctgacatggtgtcccagttagaggctgaggagaagctttggatgatggaaacggagactcaaaggtctagcaaacaccagaataagatggaaacgttacagaaattcgcgttgaaatatctaagcaatcaggagctgtcctgctggcagatctggaaacaagtcgccagcgagttgacaaggtgcttgcagggcaaatcgagtcaattgctccagggtgactctatccaggtctctgagaacgagaataatataatgaatcccaagggggacagctctatctatattgagaaccaagagttcccattttggcggacacagcactcatgcggtaatacatacttgtctgagtcccagatccagagccgcggtaaacaaattgatgtcaaaaataacctgcagattcacgaggacttcatgaaaaaatcaccttttcatgaacacatcaaaaccgacactgagcctaaaccctgtaagggcaacgaatatggcaagatcatatccgatggtagcaaccaaaaattgcccttaggggagaaacctcacccctgtggcgagtgtggacgcggattttcctatagtcctcgcctgcccctccatcctaatgtccataccggcgaaaaatgcttttctcaatccagtcatcttagaactcaccagcggatccatccaggcgagaagctcaatagatgccatgagtccggcgactgcttcaacaagagctcgtttcatagttatcagagtaaccacacgggtgaaaaaagctataggtgtgatagctgcgggaagggattttcttcttccactggtcttatcattcattacaggacacatacaggtgaaaaaccctacaagtgcgaagaatgtgggaagtgcttctcacaatccagcaatttccagtgccaccagcgagtgcacaccgaagaaaagccttacaaatgtgaggaatgcgggaaggggtttggttggtcagttaacctgagagtccatcagagggtgcaccggggagagaaaccttacaagtgtgaagaatgcgggaagggcttcacacaggccgcacacttccatattcaccagcgggttcacactggagaaaagccttataagtgcgatgtgtgtggaaaggggttctcacacaactctcctctcatctgtcacaggcgtgtccatacgggggagaagccctataagtgcgaagcatgtggtaagggcttcactaggaacacagaccttcacatccacttcagagtacataccggggaaaaaccttataaatgtaaggaatgcgggaaaggtttctcccaggctagcaatttgcaagtgcatcaaaatgttcacacgggtgagaaacgatttaagtgcgagacctgcggaaaagggttttcacagagttcaaaactccagacccaccaacgggtccatacaggcgaaaaaccttacagatgtgatgtttgtgggaaggacttcagttacagttccaacctcaagctgcaccaggtcatacacaccggagaaaagccatacaagtgcgaagagtgcggcaaaggattcagctggagatcaaatttacacgctcaccaacgagtccatagtggcgagaagccttataagtgcgaacagtgtgataagtccttcagtcaggcaatcgactttcgggtgcatcagcgagtccacactggcgaaaagccatacaagtgtggggtctgcgggaagggattcagccagagttccggcctccagtcccaccaaagggtccacaccggtgagaaaccttataagtgtgacgtttgcggaaaaggctttcggtatagcagccagtttatataccatcagcggggacatactggcgaaaagccctataagtgtgaagagtgtggaaaaggcttcggacgatctttgaatctgcggcatcaccagcgggtgcatacaggcgaaaagcctcatatctgtgaagagtgcggcaaggctttctctctgccatctaacctccgcgtccatttaggggtgcacacccgggagaagctctttaagtgcgaggaatgcggcaaagggttctcacagtccgctagactggaggctcatcaacgggtgcacacaggggagaaaccttacaagtgtgacatatgtgataaagattttcggcaccggtccaggcttacatatcaccagaaggtgcacacggggaaaaagttgtag

SEQ ID NO: 25058 - DNA, 2337 bp, Artificial Sequence
  Description of Artificial Sequence: Synthetic coding sequence
aaggtgacacagttacaggaggcagtaacgtttaaggacgtcgccgtcgtgttttcccgggaggaactgcgattgctggatctgactcagcgcaaactgtaccgggatgtgatggtggaaaactttaagaacctggttgctgtcgatatggtcagccaactggaggccgaggagaagttgtggatgatggaaacagaaacccagcggagcagcaaacatcagaacaagatggagactctccagaagtttgccctgaaatacctttcgaatcaggaattgagttgctggcagatttggaagcaggtagcttctgagttgacacgctgcctccagggaaaatcatcgcaactcctgcagggcgactcaatccaggtctctgaaaacgaaaacaatatcatgaaccctaaaggggacagcagcatctacatcgaaaatcaggagtttccattttggaggacgcagcatagctgcggcaatacttatctctccgagtcccagattcagtctcgaggcaagcaaatcgacgtgaagaacaatctgcagattcacgaagattttatgaaaaaatcaccattccatgaacacataaaaaccgacaccgaacccaaaccctgtaaaggcaacgaatatggaaaaatcatctccgatggcagcaaccagaaattgcccttaggcgagaagcctcacccttgtggcgaatgcgggcgaggcttttcttattcacctcgcctcccactgcatcctaatgtgcatacgggtgagaagtgcttttcacaaagcagccatcttaggactcatcaacggattcatcccggtgagaaactgaatcggtgtcatgagagtggagattgtttcaacaaaagtagcttccattcttaccagtcaaatcatacaggcgagaagagctacagatgcgactcatgcggcaaagggttcagctcatctactggcctgatcattcactaccggactcacacgggcgagaagccctataaatgtgaagagtgtggaaagtgctttagtcaatcttccaatttccaatgtcaccaaagagttcatactgaggagaagccttataaatgtgaagaatgcgggaaagggttcgggtggagcgtgaacctgagggtccatcagagggtgcaccgaggcgaaaagccctacaagtgtgaggagtgtggaaaagggttcacccaggcggctcacttccacattcatcagcgagtgcacactggcgaaaagccttacaagtgcgacgtgtgtggcaagggcttttcacacaattctcccctgatctgtcatagaagggtgcataccggcgaaaaaccttacaagtgtgaggcttgtggcaaaggattcacccggaatactgacctacacatacatttccgtgttcatactggtgaaaagccctacaagtgcaaggagtgcggtaaggggtttagtcaggcttctaacctgcaggtgcaccagaacgtgcatacaggagagaagcgattcaaatgtgagacatgcggcaagggttttagccagagcagtaagctgcagacccaccagagggtccataccggagagaaaccctatcgttgtgacgtgtgcggcaaagattttagttacagcagtaacctaaagttgcaccaggtaatccacacaggagagaaaccatacaagtgcgaggaatgcggtaaagggttctcatggcgatctaacctgcacgcgcaccagcgggtgcacagtggggagaaaccctacaagtgcgagcagtgtgataagtcattcagccaggccatcgatttccgggtgcaccagcgagtgcataccggggaaaagccatataagtgtggagtctgtggcaaaggattctcccagtcctcgggactgcagagccaccagagggtgcacacgggggaaaagccctacaaatgcgatgtttgtgggaaagggttccgttattccagccagtttatttaccaccaacgaggtcacacaggggagaaaccttacaaatgtgaggagtgtggtaaggggtttggcaggagccttaacctccgccaccatcaaagagtccacacaggtgaaaaaccccatatttgcgaggagtgcggtaaagccttcagcctaccatcaaatctccgggttcacctaggagtgcacacaagagagaaactgttcaaatgtgaggaatgcgggaaaggcttttctcaatcagcacgcctcgaggcgcatcagcgagttcacaccggagagaaaccctacaagtgtgacatctgtgacaaggacttccggcaccgatccagactcacctaccatcagaaggtacacacaggcaaaaaattatag

SEQ ID NO: 25059 - DNA, 2478 bp, Artificial Sequence
  Description of Artificial Sequence: Synthetic coding sequence
atggagacgctgaccagtcgccacgaaaagcgcgctctacactctcaggcatctgctatttcgcaggatcgggaggagaaaataatgtcccaggagccgctcagttttaaagatgttgcagttgtctttacggaggaagaactcgaactgcttgacagtacgcagcgccagctgtatcaggatgtgatgcaggagaacttcagaaatctcttgtccgttggcgagcggaaccctctgggggataaaaacggcaaggatacggagtacattcaggacgaggagctcagatttttctcacacaaagagctgtcctcttgtaagatatgggaagaggttgcgggtgagctccctgggagccaagattgccgcgtgaacctgcagggaaaggatttccaattttccgaggacgcagctccccaccagggatgggagggtgccagcacgccatgttttccaatcgagaactctttagattcactgcagggagatgggctgatcggcctcgagaatcagcagtttcccgcatggcgtgcaattagaccaattcctatccaaggaagttgggctaaggcttttgttaaccagctcggggatgtgcaggagcgctgtaagaatctcgatacagaggataccgtctacaaatgtaattgggatgacgattccttttgctggatcagttgccacgttgaccaccgattcccagaaatcgataaaccgtgcgggtgcaataaatgtcggaaggattgtatcaagaacagtgttcttcataggatcaacccgggagagaacggactgaaatcgaacgaataccgcaatgggttccgcgacgacgcagatctgcctcctcaccccagggttcccctcaaggagaagttgtgccaatacgatgaattctccgagggccttaggcacagtgcccacctgaatcgccaccaaagagtcccaaccggagagaagagcgtaaaatccctggagcgcggtaggggggtcaggcagaacacacatattaggaaccatccgcgtgccccagttggggatatgccctaccggtgcgacgtctgcggtaaaggatttcggtacaaaagcgtactgcttatccaccaaggagtgcatactgggaggagaccttacaagtgtgaagaatgcggcaaagcgtttggtaggagttccaacctgctggtgcaccagcgcgttcatacaggcgaaaagccctataaatgcagcgagtgtggaaagggattttcctattcttctgtcctgcaggtccaccagcggctgcatacgggcgaaaaaccttatacttgtagtgagtgcggaaagggcttctgcgccaaatccgcacttcacaaacaccagcacattcacccaggcgagaagccctatagctgcggtgagtgcggcaaaggattttcatgctcatcccatctctcgtctcaccaaaagacacatactggcgagaggccgtatcagtgcgacaaatgtgggaaaggattcagtcacaatagttaccttcaggcccatcaaagggtgcatatgggacaacatctctacaaatgtaacgtgtgcggcaagtcgttcagctattcctccggactgttgatgcaccaaaggctgcacactggtgagaagccttacaaatgtgaatgtggaaaaagcttcggcaggagctccgatctgcatatccatcagagagtgcacactggcgagaagccctacaagtgcagcgaatgcggaaaggggttcagaagaaacagtgaccttcattcccaccagcgggtccacactggggagcgaccttatgtgtgtgacgtttgtgggaagggtttcatctacagtagtgatctgctcatccatcagcgcgtgcacacgggggaaaagccctacaagtgtgcggagtgtggcaaaggcttctcatatagtagcggccttctcatccatcagagagtacacacaggcgaaaagccgtacaggtgccaagaatgtggcaaaggatttaggtgtacctccagcctccataagcaccagagagttcacaccggaaaaaagccatacacatgtgaccagtgtggaaaaggcttttcctatggctcaaacctgagaacacatcagcgcctccacacgggcgagaagccctacacgtgttgcgagtgtgggaaaggttttaggtatggctcagggctgttgtctcacaagagagtccatactggagagaaaccttataggtgccatgtgtgtggaaagggatactcccaatcctctcacctgcagggacaccagcgggttcacacgggggagaaaccgtacaaatgcgaagagtgtggtaaaggattcgggagaaacagctgcctgcacgtgcaccaaagagtgcatactggagaaaaaccctacacatgtggggtgtgtggcaaaggtttcagctacacatctggcctgcggaatcaccagcgcgtgcatttaggtgagaatccctacaaatag

SEQ ID NO: 25060 - DNA, 2478 bp, Artificial Sequence
  Description of Artificial Sequence: Synthetic coding sequence
atggaaaccctgacctcaaggcatgaaaaaagggcccttcacagtcaagcgtccgctatctcacaggatagggaagagaagattatgtcacaggagccactgtctttcaaggacgtggcagttgtgtttactgaggaggagctcgaactgttggattctacccagagacagctataccaggatgtgatgcaggagaattttcgtaatctgttgagcgtaggcgagcgcaaccctctcggcgacaagaatggcaaagatacggagtacatccaagatgaggagttgcgattctttagccacaaagagctgtccagctgcaagatttgggaagaagtagccggagagctgcccggtagtcaagactgccgcgttaatttacaaggaaaggattttcagtttagcgaagacgcagcccctcaccagggctgggaaggagcttccactccgtgctttcccatcgagaactccctggatagtttgcaaggagacggactgataggcctcgagaatcaacagtttccagcgtggagagcaatcaggcctatacccattcaaggaagttgggccaaggctttcgtcaaccagctaggcgacgtccaggaaaggtgcaaaaacttggataccgaagatacagtctataagtgtaactgggatgacgattccttctgctggatcagctgtcacgtagatcatcgtttccccgagattgacaagccttgtggatgtaacaaatgccggaaggactgcatcaagaactcagtgttgcatcggatcaaccccggtgaaaacggtctgaaatctaacgaatataggaacggctttcgggatgacgccgacttgccgcctcatccacgggtcccattgaaagagaagctatgccagtatgatgaattttccgagggcctccgccatagcgctcatctgaatagacatcagcgggtccccactggcgaaaaatccgtgaaatcactagaacgcggacggggagtgcggcagaacacacatattcgtaaccaccctagagcccctgtaggcgacatgccgtacaggtgtgacgtttgtggtaaaggatttaggtataaatctgtcttgctgatccaccaaggagtgcacacgggaaggaggccgtataagtgtgaagagtgcggcaaggcatttggacgctcctcaaatctattggttcaccagagagtccatacaggggaaaagccatacaagtgcagcgagtgtgggaaaggcttctcgtactcttctgtgctgcaagtgcaccagaggcttcacacaggagaaaagccatacacatgctctgagtgtggcaagggcttttgtgctaagtcagcacttcacaagcatcagcatatccaccctggcgagaaaccgtactcctgtggagagtgcgggaaaggtttttcatgtagcagtcacctgtcatcacatcaaaagacacacaccggggaacgcccatatcagtgtgacaaatgcgggaaaggatttagccataacagttaccttcaggcacaccagcgggtgcatatggggcaacatttgtataagtgcaatgtgtgtggaaaatccttctcatacagctctggacttcttatgcatcaacgacttcacactggagagaagccttataagtgtgaatgtgggaaatctttcggaagatcctcagacctgcacatacatcagagagtgcataccggggaaaagccctataagtgttctgagtgtgggaagggcttccgacgtaactccgacctccacagccatcagcgcgttcatacaggtgagcggccatacgtgtgtgacgtgtgtggcaagggatttatttattcctccgatctattaatccaccaaagagtgcatacgggggaaaaaccctataaatgtgcggaatgcggcaaagggtttagctacagcagtggacttctaatccatcagcgggtgcacacaggggaaaaaccttaccggtgccaggaatgtgggaagggcttcagatgcacctcttctctccacaaacatcaacgggttcacacgggtaaaaaaccttatacatgcgatcaatgcggtaagggcttttcctatggatctaaccttcgcacccatcaacgccttcatacgggcgaaaagccttacacttgttgtgagtgtggaaagggcttcagatatgggagcggcctgctttcccacaagcgcgtgcatacgggggagaaaccataccgctgtcacgtgtgtggcaaagggtactcccagtcatcacacttgcaaggccatcagcgcgtacatactggagagaagccctacaaatgcgaggaatgcggcaaagggttcggacggaacagttgtctgcatgtgcatcagcgagtgcacactggcgagaaaccctatacctgcggagtgtgcggcaaggggttttcctacactagcggactgaggaaccatcaacgagtacatctgggggaaaatccttataagtag

SEQ ID NO: 25061 - DNA, 1425 bp, Artificial Sequence
  Description of Artificial Sequence: Synthetic coding sequence
atgactaccttcaaagaagccgtgactttcaaggatgtggcagtgttcttcacagaggaggaactgggcctgctggaccccgcacagagaaagctctatcaagacgtcatgctcgaaaacttcactaatttgctgagtgtggggcatcagccgtttcacccattccatttcttgcgagaggagaagttctggatgatggaaacagcaacacagcgtgaaggcaattcaggcggtaagacaatagcagaagcgggaccgcacgaggattgtccttgtcagcagatttgggagcagaccgccagtgacctgacgcagagccaggattcaatcattaataattcccacttctttgaacagggcgacgtcccatcccaggtcgaggcgggactctccatcatccacacaggacagaaacctagtcagaatggtaagtgtaaacagagtttctccgatgttgccatttttgacccaccccagcaattccatagcggggaaaaatcacatacatgcaacgagtgtggcaaatctttttgttatatttcggcactcagaatccatcagcgcgtgcacttgagagagaaacttagcaagtgcgacatgcgagggaaggagttctctcaaagcagctgcctccagactcgcgaacgcgttcatactggggagaagccatttaagtgcgagcaatgcggcaaaggctttcgatgtcgcgctattcttcaggtgcattgtaagctgcatacaggtgagaaaccttacatctgcgagaaatgtggtcgcgctttcatccacgactttcagctacagaagcaccagattatccacactggggagaaaccctttaagtgtgagatttgtggcaagtcattctgtctccggtccagtttaaatcggcactgtatggtccacacagccgagaagctgtataagagcgaagagtgcgggaagggcttcactgactcgctcgatctgcataagcaccagattattcacactggacagaaaccctataactgcaaggagtgtggcaaatcatttcgatggtcttcctatctcctcattcaccagcgcatacacagcggagagaagccctaccgttgcgaggagtgtggaaagggttatatctctaagagcggcctcaatctgcaccagcgagtacatactggagagcgaccgtataactgtaaggaatgcggaaaatccttcagccgcgcttcctccatcttaaaccataaaaagcttcactgcaggaaaaagccgtttaaatgcgaagattgtggcaagcgactcgtgcaccgctctttctgtaaagatcagcagggagaccacaatggagaaaacagctccaagtgcgaagactgtggaaaacgctataagcggagattgaacctggacatcattctaagtctgttccttaacgacatgtag

SEQ ID NO: 25062 - DNA, 1335 bp, Artificial Sequence
  Description of Artificial Sequence: Synthetic coding sequence
atggagccgccaggaccagtacgtggtcctctgcaggattcctcttggtacgagccgagtgccgaactcgtgcaaaccagaatggcagtgtctttgactgctgccgagaccttggcactgcagggcacccagggccaggagaagatgatgatgatggggcctaaggaggaggagcagtcatgcgagtacgaaacacgactaccgggaaaccattccacatctcaggagatttttagacagcggtttaggcatttgcggtaccaggagacacctggtcctcgagaagcactaagccagcttcgcgtgctgtgctgcgagtggttgagacctgaaaagcacactaaggagcaaattctcgagttcctcgtactggaacagtttttgacaatcctgccggaggagttgcaatcctgggtgcgcggacatcatcccaagagcggagaggaggcagtgaccgtcttggaagatttggagaaagggctggagccagagccacaagtgcctggcccagcccacgggcctgcccaggaggagccttgggagaaaaaagagagcttaggagcagcacaggaggctttatcaatccagctgcagccaaaggagactcagccattccccaagtctgaacaagtgtatttgcactttctctctgtcgtgacagaagacgggcctgagcccaaggataaagggtctctcccacagcccccaataactgaggtcgagtcccaggtgttcagcgaaaaattagcaaccgatacttctacattcgaagccactagcgaagggaccctagaactgcaacaaaggaaccccaaggcagaacggctcagatggagcccggctcaagaggagtctttccgccagatggttgtcattcataaagagatcccaactggcaaaaaggaccacgagtgctctgagtgtggaaaaaccttcatctataattcccatttggttgttcatcagcgtgtgcattccggcgagaagccatacaagtgttctgactgtggtaaaacattcaaacagagttccaacctgggtcaacatcagcgcattcacacaggagaaaagccattcgaatgcaatgaatgtggcaaagccttcaggtggggggctcaccttgtgcagcaccagaggatccatagcggtgaaaaaccctacgagtgcaatgagtgtggcaaggccttctcccagtccagctacctatctcagcatagaaggatacactcaggggaaaagccttttatctgtaaggagtgtggcaaagcctatggctggtgcagcgagctcataagacatcgcagggtgcacgcaaggaaggagccctcccactag

SEQ ID NO: 25063 - DNA, 579 bp, Artificial Sequence
  Description of Artificial Sequence: Synthetic coding sequence
atggcggtgtcacttaccgctgccgagacactagctttgcagggtacacagggacaggagaagatgatgatgatgggacccaaagaggaggagcagagctgcgagtacgagaccaggttacccggtaatcactccacgtcccaggaaatatttagacagcgcttcaggcatctccggtaccaagaaactccgggaccccgtgaagcactgtcgcagctgcgggtactttgctgcgagtggttgcgtccagaaaagcataccaaggagcagattttggagtttctggttctggagcaatttcttaccattcttcctgaagagctgcagtcgtgggtgcgaggacatcatcccaaatctggtgaggaggccgtgacagtcctggaagatttggagaagggcctcgaacccgagcctcaggtggggaggggaatatggtctgtgatgggcgcacggcttatgacttttagattggaccgaggcgcagccgtgggaggcggtgccaaatttaaaccactgcttgggcaggtggaacagctggtgtgtgtttcggtgtctgttttctcagccctggagccgtag

SEQ ID NO: 25064 - DNA, 1704 bp, Artificial Sequence
  Description of Artificial Sequence: Synthetic coding sequence
ggacataaaaaccaaaacgagatagatacgctgcaagaggttcgactacgcttcctgagctatgaggacctgatctgctggcagatttgggaacagttcacttccaagcttacaagcaaccaggatctgattatcaacctccaaggtaagcgttctaagctactgaaacagggggactctccatgtcaggtttggactggggagagcagccaagtcagtgaggatgaaaactacgtaatcaagttacaaggggagtccagcaatagtattaaaaaccaggagttaccactgcgtacaacgtgggacttttggcggaagatgtatctccgggagccacagaactaccaaagtcggtgtcagcaaattgatgtgaagaacaaactatgcaagtgtgaccactgcgtgaggcagcgcatcgctcaccagcacgatgatcatggggtacataaacgcgaaaaggctttctcccataacaattgcggcaaagactgcgtgaaggagagttcacagcattccattatccagagcggcgagcagacaagcgatgaaaacgggaaggggctttctgtgggctcgaaccttgagctccatcagcagctacacctgagagacaagccacacgtgaatgtggagtacggaaagggcatcgggtacagctccggcctacccagacaccagtgctttcatattggcgagaagtgctacaggaatggagacagtggggagggcttttcacaagggagccacctccaaccgcatcagagggtgtctaccggggaaaacctctatagatgtcaagtgtatgcacgcagcagcaatcaaaattcctgtcttccgagccacgaactcacccacccaggcgagaaactttgcacatgtggcagatgcggtaaaggctttcaccacagcttagattttgacattcactgcgtcgacagcgccggagaaagagcctgcaagtgcgatgtgtatgacaaggggttctctcagacctctcagctgcaggctcaccagcgcgtgcataccggcgaaaaaccttacaagtgcgaagtctgcgacaaaggcttttccaaagctagcaatctccaggctcaccagagaattcatacaggggagaagccttacaaatgtgatgtttgtgataagaactttagtcggaattcacatctgcaggcccatcagagagtacataccggcgagaaaccctacaagtgcgacacatgcgggaaggactttagccaaatctcgcacttacaggcccaccaaagggtccataagggagaaaagccttacaagtgtgagacatgcggaaaagggttctcgcagagcagccatcttcaggatcaccagcaggtacatactggtgaaaatccctacaagtgtgacgtttgtggtaaaggatttagctggagctctcatctgcaggcgcaccagcgcgtccatactggcgagaaaccctacaaatgtgaggagtgtagaaagggcttcatctggaacagttacctgcacgtgcaccaaaggatccacaccggcgaaaaaccgtataagtgtgggatgtgtggaaagtcttttagtcagaccagtcacctccaggcgcatcagagagtgcataccggcgagaagccatataagtgttttgtctgtggcaaaggattcagtaagtcgtctctgcagattcaccagagagtacatgatggggattag

SEQ ID NO: 25065 - DNA, 1959 bp, Artificial Sequence
  Description of Artificial Sequence: Synthetic coding sequence
atggtcaagcgcagtatgcagcaggaagagttaaccatccttaatatctacgcccctaatactggggctcccaggtttatccgggctgtcgcctgcttccgtagcggaatactcgggagtgttgtgcagaagccactgcagccatgcgtcctgccactccaggaaggagaggccgctgtcatctaccccctatgggaagtgagccagagaggcacctcagccagcacggcttcattcccaggactgggtgtgggattggccgtgctaccttcccaggatcccgctctgccccagaaagagcaggagaaaatgactaagtttcagttgctcgctataagactcaggctgcatctgcttgacgtcgttggagatggcgatattcagggttgtgggtgtgggctgcaccaggggggagcaggcgtggccggtccatgccctgagaaggctgtgccccgttgcgacgctggcgaactccaggagcctgcagtatcaggactcagcactctgcaaaccagatgcgatataaccgttgggaaaagacggcaggcctcagacgacggcgatcggaatccgcgaagatgggtatttcgccaacgcattgcccaccagcatgatgaccatggggtgcacaagagggaaaaagccttctcacataataactgcgggaaagactgcgtgaaagaatctagccaacacagtatcatccagtctggagaacagaccagtgatgaaaacggcaaggggctttccgtggggtcaaacttagagcttcaccagcagttgcatctgcgcgacaagccacatgtgaatgtagagtatgggaaaggcattggctattcatccggtctcccaaggcaccagtgcttccacattggggaaaagtgctaccggaatggcgactcaggcgaaggattcagtcagggctcgcatttgcagccacaccagagagtttcgacaggcgagaatctgtacagatgccaggtgtacgctaggtcttctaaccaaaacagctgccttcccagtcacgaactcactcatcctggtgaaaagctttgtacctgtggtaggtgcggaaagggctttcaccattcactggacttcgacatccattgcgtggattctgccggagagcgcgcttgcaagtgtgacgtgtatgataagggtttttctcagacctcacaactccaggcacatcaaagaggccatagccgtgacaagacctataaatgggaggtttctgatcgcattttcaatagaaattccggcctgcatcagagagtccatactggggagaaaccctacaagtgcgaagtttgcgataaaggcttctccaaagcgtctaatctacaggcccaccagcggatccatacgggagagaaaccgtataagtgcgatgtatgtgataagaatttttcacggaattcccacttgcaagcccaccagagggtacatacgggagagaaaccctacaagtgtgacacatgtgggaaagacttttcacagattagtcacctccaagcccaccagagagtgcataagggcgagaagccgtacaaatgcgaaacatgtggcaagggcttctctcaatcgtcccatttacaggaccaccagcaagttcacaccggcgagaacccatacaagtgcgatgtgtgtgggaagggcttttcatggagttctcacctgcaggcgcaccaaagggtccataccggtgaaaaaccgtacaagtgcgaagaatgcagaaagggcttcatctggaactcctatctgcacgtgcaccagagaattcataccggggagaagccgtacaaatgtggaatgtgtggcaagagtttttcccaaacttctcatctgcaggctcaccagcgtgtccatacgggtgagaaaccctataaatgttttgtgtgcggcaagggctttagcaagagtagcctatcatctgattcatcagagagtccttag

SEQ ID NO: 25066 - DNA, 2013 bp, Artificial Sequence
  Description of Artificial Sequence: Synthetic coding sequence
atgacaaagtttcaggagatggtgaccttcaaagacgttgctgtagtgttcacccgggaggaactgggactcctcgaccttgcacagcggaagctctatcaggatgttatgttagagaacttccgcaatcttttgtccgtcggataccagccgtttaaactcgatgtcattctgcagctggggaaagaggacaagctacgcatgatggagacggaaatccagggagatggctgtagtggccacaagaaccaaaatgagattgatacactgcaagaggtgaggctcaggttcttgtcatacgaagatctgatttgttggcagatctgggaacagttcacgtccaaactcactagtaatcaggacctgattattaacctccagggaaaacgctccaaactactcaaacaaggcgattcaccctgtcaggtttggacgggcgagtcttcccaagtgtccgaggacgaaaattacgtgattaagcttcagggagagagtagcaactctatcaaaaaccaggaacttcctttacgaaccacttgggatttttggcggaaaatgtacttgagagagcctcagaactaccagtctcgctgccaacagattgatgttaaaaacaagctgtgcaaatgcgatcactgcgtgcggcagcggattgcccaccagcatgatgaccatggtgtccacaagcgggaaaaagcgttctcacacaacaattgtggcaaagactgcgtcaaagagtctagtcagcattccattatccagagtggagagcaaaccagtgatgaaaatggcaagggtctctcagttgggagcaacctggaactacatcagcaactgcaccttcgtgataaaccacacgttaacgtggaatacggcaaaggtattggctattcctccggtttacccaggcaccagtgcttccatattggggagaaatgttatcggaacggggactcaggtgaaggcttttctcaggggagccaccttcagccccatcagagagtatctaccggcgaaaatctctataggtgccaggtttatgctaggagttccaatcaaaattcttgcctcccgtctcatgaattgactcacccgggagagaagctctgcacatgtgggagatgcggaaaaggttttcatcacagcctcgacttcgacattcactgtgttgactctgcaggtgaaagagcctgcaaatgcgatgtgtatgacaaaggattctctcagacctctcaattgcaggcgcatcagcggggacatagcagagacaagacttacaaatgggaggtgagtgatcggatttttaatagaaacagcgggcttcatcagcgggttcacaccggcgagaaaccctacaagtgcgaggtgtgcgataagggtttttccaaggcttccaatttgcaggcgcaccagcggattcacaccggcgagaagccatataaatgtgacgtctgtgacaagaatttcagtcgcaacagccatctgcaggcccaccaacgcgtacacactggcgagaagccatataagtgcgacacttgtggcaaagacttctcccaaatatcccaccttcaggctcaccagagagtacataagggcgagaaaccatacaagtgtgagacctgtggcaagggcttctcgcaatctagtcatttacaggatcatcagcaggtgcacacaggcgagaatccatataagtgcgatgtgtgtgggaagggctttagttggagttcccacctccaagcccaccagcgcgtgcacacaggtgagaaaccatacaagtgcgaagaatgcaggaaagggttcatctggaatagctacctgcacgtgcatcagcgaattcataccggggagaagccctataagtgtggtatgtgcggaaagtcgttctcccagaccagtcatctgcaggcgcatcaaagagtccacactggagaaaagccctataaatgctttgtttgcggcaagggtttttctaaatccagtctgagcagcgattcctctgagagcccctag

SEQ ID NO: 25067 - DNA, 321 bp, Artificial Sequence
  Description of Artificial Sequence: Synthetic coding sequence
gggcacaagaatcagaatgagattgacacacttcaggaggtgagactgagattcctctcgtacgaggaccttatttgctggcagatctgggagcaatttacctctaagctgactagcaatcaagacctcataatcaacctgcagggcaagcgcagtaagctgctgaaacagggcgactccccctgtcaggtctggaccggagaatcctctcaagtgtcagaggacgaaaattatgtgatcaagcttcagggggaatcaagtaactccatcaaaaaccaggagttaccatcacaaaagaagaaaaagaagaaaaaaaagtag

SEQ ID NO: 25068 - DNA, 2217 bp, Artificial Sequence
  Description of Artificial Sequence: Synthetic coding sequence
atgactaagtttcaagaggctgtaaccttcaaggacgtggcagttgcttttaccgaagaagaacttggtctgctggattccgcacagaggaagctataccgcgacgttatgcttgaaaactttcggaacctagtgtcagttggacatcagtcgtttaagccagacatgatcagtcagttggaacgggaagagaaactgtggatgaaggaactccaaacccagcgaggtaagcatagtggcgatcgcaatcaaaacgaaatggcaaccctccacaaagccggactgagatgcttctcccttggagaactcagctgctggcaaataaagagacacattgcctctaagctagcacggagtcaggattccatgattaatattgaagggaagagctctcaattccctaaacatcacgactcaccatgccaagtcggtgcaggagaaagcattcaggcctccgtggacgacaactgtctggtaaatcacattggggaccatagcagtattatcgagaatcaggagttccccacaggcaaggttcccaactcctggtccaagatctatctgaacgagacgcaaaattaccaacggtcctgcaagcagacccagatgaagaataaattgtgcatatttgcgccatatgtagatatcttttcctgcattagccaccaccacgacgataacatagtgcacaagcgcgacaaggttcattccaatagcgactgcgggaaagatactcttaaggtgagtccactcacccagaggtcaattcacacagggcagaaaacttaccagggaaatgagtgcgaagaggctttcaatgactctagctccttggagttacacaagcaggtacacctgggaaaaaagtctcctgcctgctctacacatgagaaggatactagctactcgtcgggcattcctgtccagcagtcagtccggactggcaagaagagatattggtgtcacgagtgcggaaagggtttcagtcaaagttcaaatctacagacacatcagcgggtgcatacaggggagaaaccctatacttgccatgagtgcggcaaaagcttcaaccagtccagtcatttatacgctcatctccctattcacacaggggagaagccatatcggtgtgattcctgtggcaaggggttttcgcggagcactgatctgaatatccactgtcgtgtgcacaccggagagaaaccttataaatgtgaggtgtgtggtaagggtttcactcagcgatctcacctgcaggcccatgaacggatccacaccggcgagaaaccctacaagtgcggcgactgcggcaagagattttcttgcagttccaatcttcatacgcatcagcgggtgcataccgaagagaaaccttacaagtgtgatgagtgcggcaaatgcttttccctgtcttttaatttgcactctcatcagcgtgtgcacacaggcgagaaaccctacaagtgcgaggaatgcggaaagggattctctagtgcaagtagttttcagagccatcagcgggttcataccggagagaagccctttcgttgtaacgtctgcggtaagggatttagtcagagctcttatttccaggcacatcagcgcgtgcacactggtgaaaagccttacaagtgcgaagtgtgcggcaaacgcttcaactggagccttaacctgcataaccatcagagagtgcacacgggggagaagccatacaaatgcgaagaatgcgggaaaggctttagtcaggcgagcaatctgcaggcgcatcagagcgtgcacacaggcgaaaaaccatttaaatgtgacgcatgccagaagcgatttagccaggctagtcaccttcaggcccatcagagagtccataccggggaaaagccttacaagtgcgacacttgtggtaaagccttctcccagagaagcaacttgcaggtacatcagatcatccacaccggcgagaagccgttcaaatgtgaagaatgcggtaaagaattttcctggagcgcaggtctcagcgcacaccagcgagtccataccggtgagaagccatatacctgccagcagtgtggcaaagggttttcccaggcctcgcacttccacactcatcagcgggttcatactggcgagcgcccttatatctgtgacgtatgctgcaaagggttctcccagagatcgcatctgatttatcaccaacgcgtccacaccggtggtaacctctag

SEQ ID NO: 25069 - DNA, 1767 bp, Artificial Sequence
  Description of Artificial Sequence: Synthetic coding sequence
tccggcgatcgaaaccagaatgagatggctacactgcacaaggcgggtctgcggtgcttctcgttgggagagctcagctgttggcagattaagcgccacattgcttccaaactcgccagatcccaagattctatgattaacattgaaggaaagtctagccagttccccaaacaccacgactcaccgtgccaagtgggcgcaggcgagagtattcaggctagcgtggatgataactgcctggtcaaccatataggggatcactcaagtataatcgagaaccaggaatttcccactggaaaggtgccaaattcatggagtaagatctaccttaatgagacccagaactaccaacgttcttgcaaacaaactcagatgaaaaacaagctctgcatcttcgccccatatgtcgacattttcagctgcattagtcaccaccatgacgacaacattgtgcataaaagagacaaagtccactcaaactcggattgtggtaaggatacactgaaggtgagcccgcttacacagcgatcaattcataccggacagaagacttatcagggcaacgagtgcgaagaagccttcaacgactctagctccctggagctgcacaaacaggtccatctcggcaaaaagagcccagcatgctctactcatgaaaaggacacttcttatagttcgggaatacctgtgcagcagtctgttcggactgggaagaagcggtactggtgtcatgaatgtgggaagggcttctcacaaagtagtaatctgcagactcatcagcgcgttcataccggggagaagccctacacctgtcacgagtgtgggaagagtttcaaccagagttcacatctctacgcacacctgcccatccacaccggtgagaagccatacagatgtgatagttgcgggaaggggttctctaggagcactgatctgaatatccactgtagggtgcatacaggtgagaaaccctacaagtgcgaagtgtgtgggaaggggtttactcaaaggagccacctacaggcccacgaaaggattcataccggagaaaagccttataagtcacagatattcatccccatcagagattttaatttgcattcccaccaacgagtacacactggtgagaagccatacaaatgcgaagaatgtggaaaaggctttagtagcgctagtagcttccaatcacaccagcgagtccatactggggagaaacccttccgctgtaacgtttgtggcaaaggtttcagtcaatcatcctacttccaggcacaccagcgggtccacactggtgagaagccatacaaatgcgaggtttgcggcaaaaggtttaactggtccctgaatttgcataatcaccagagagtacacaccggtgaaaagccctacaaatgtgaggaatgtggaaagggattttcccaagcttcaaaccttcaggcccatcaatcagtgcacactggcgaaaagcccttcaaatgtgacgcgtgtcagaaacgcttcagccaggccagtcatctgcaggcgcaccagagggtccacacaggcgagaagccttataaatgtgacacatgtgggaaggccttctcacagaggagcaacctccaggtgcatcagatcattcacacaggcgaaaaaccctttaaatgcgaagagtgtggtaaggaattttcgtggagtgccggattatccgctcaccaaagggtccacaccggcgagaaaccttatacatgccagcagtgcggcaaaggtttttcacaagctagctag

SEQ ID NO: 25070 - DNA, 2217 bp, Artificial Sequence
  Description of Artificial Sequence: Synthetic coding sequence
atgggcaggatccaagaggctgttaccttcaaggacgtggccgtagcctttactgaagaagagctggggctcttagattcagcgcagcgaaaactttaccgcgacgtgatgctcgagaacttcagaaatctcgtgtccgtagggcatcagtcctttaagcctgatatgatatcccagttagagagagaggagaaattgtggatgaaggagctgcaaacacagcggggaaagcactccggcgataggaaccaaaatgagatggctactctgcacaaggctggtctgcgatgttttagtctgggtgagctttcatgctggcagatcaagagacacatcgcatctaaacttgcccgaagtcaagactctatgatcaacatcgaagggaagagtagtcagtttccaaagcaccacgattccccatgtcaggtgggtgccggtgaaagcattcaagcatcagtggatgacaactgtcttgtgaaccatatcggtgaccacagttccatcatagaaaaccaggaatttccaaccgggaaggtacctaattcttggagcaaaatatatctaaatgaaactcaaaattaccagcgctcctgcaagcaaacgcaaatgaagaacaagctctgtatttttgcgccttacgtcgatatcttttcctgcatctctcaccaccatgacgacaatattgttcacaaaagagataaagtacacagcaattcagactgcggcaaggacaccctgaaggtaagcccacttacccaaagaagcattcacacgggacagaagacttatcagggcaatgagtgtgaagaagcattcaacgatagctccagccttgagctccataagcaggtgcatctgggaaaaaaaagccctgcctgtagcacgcatgaaaaggacacctcctacagctctggaattcctgtacagcagtcggtcagaacaggcaagaagagatattggtgccatgagtgtgggaaaggcttcagccagtcctcgaacctgcagactcaccaaagagtgcacacgggcgagaaaccatatacgtgccatgaatgcggaaaaagttttaatcagagtagccacttgtatgcccatttgcccatccacaccggggaaaagccttaccgctgcgacagctgcgggaaagggtttagccgctcaacagacctgaacatccactgcagagtccacaccggagaaaagccttacaaatgtgaagtgtgcgggaaaggattcacccagaggtcccacctgcaggcgcatgagcggatccacactggcgagaagccttacaagtgcggggactgcggaaaacggttttcctgcagctctaacctgcacacccatcagcgagtgcacacagaggagaaaccttataagtgcgatgagtgtggtaagtgtttttctctgtccttcaatctacatagccaccagagggtgcacaccggcgagaagccctacaagtgcgaggagtgtgggaaggggtttagctccgcctcttcatttcagtcccaccaacgcgtccacacaggggagaagccattccggtgtaatgtgtgcggcaagggcttttcccaaagctcttatttccaggctcaccagagggtgcacactggagagaagccgtataagtgcgaggtttgcggaaagcgtttcaactggagcctgaatcttcataatcatcagcgagtgcacactggcgagaaaccctataaatgtgaggaatgtgggaaggggttctcccaggcctcaaatttacaggctcaccaatccgtccacaccggagagaagccttttaaatgtgatgcttgccagaagagattctcccaagcctcccacctccaggcacaccagcgtgtgcacactggagagaagccatacaagtgcgatacctgcggcaaagctttttcccagcgctccaatcttcaggtgcaccaaattattcacaccggcgagaaacccttcaagtgcgaggaatgtggcaaagaattttcatggagcgcagggttgagcgcccaccagagggtgcataccggagagaagccctacacctgtcagcagtgtgggaaagggttctcacaggcatctcatttccatactcatcagcgcgttcatactggtgagagaccctatatctgcgacgtttgctgcaaaggcttctcacaacgaagccatcttatctatcatcagcgagtccacacgggcggaaacctgtag

SEQ ID NO: 25071 - DNA, 546 bp, Artificial Sequence
  Description of Artificial Sequence: Synthetic coding sequence
atgggccgtatccaggaagcagtcacattcaaagacgtcgcggtggcgttcacagaggaggagctgggtctgcttgacagcgcacaacggaagctctatcgggatgtgatgctggagaactttcgcaacttggtctccgtgggccaccagagctttaagcccgatatgatctcacaactcgagagggaagaaaaattatggatgaaagagctgcagacacaaaggggcgaccggaatcaaaacgagatggcaactctgcataaggccggattacgctgcttttcactgggcgagctgagctgctggcagatcaaaagacacattgcatctaaactggcccgatctcaagattcaatgataaacattgaaggaaagagttcccagttcccgaagcaccacgatagcccttgccaggtgggtgccggagagtctatccaggcgtcagtggatgacaattgcctcgtgaaccacatcggcgatcatagctcaataattgagaaccaggagtttcccacagggaagaaaaagaaaaaaaagaaacagtag

SEQ ID NO: 25072 - DNA, 1740 bp, Artificial Sequence
  Description of Artificial Sequence: Synthetic coding sequence
atgaataaaagccaggaacaagtaagtttcaaggatgtatgcgtggattttactcaagaggaatggtatctgctcgaccctgcccaaaaaattttgtacagagacgtgatcttggaaaactatagtaatctggtaagcgtcgggtattgtattaccaagccggaagtaatttttaagatagaacagggcgaggagccctggattttggagaaaggatttccctctcagtgtcatcctgaacggaaatggaaggtggatgatgtgcttgagagttcccaagagaacgaggacgaccacttttgggaattgctctttcataataacaagaccgtctctgttgaaaacggcgatagagggtctaaaacattcaatctagggacagatccagtatcactccggaattacccctataagatatgcgatagctgtgaaatgaatctcaagaatatcagtggcctcatcatcagtaaaaagaattgcagtaggaaaaaaccagacgaatttaacgtgtgtgaaaagctcctgctggacatacgccacgaaaagatacctatcggcgaaaagtcctacaagtacgatcagaagcggaatgctattaactatcaccaggacctcagccagccttcgtttggtcaatcctttgagtactccaagaacggccaagggttccatgatgaggcggcattctttactaacaagcgttcccagatcggcgagacagtctgtaagtataacgagtgtggtagaacctttattgagtctcttaagcttaacattagtcaaaggcctcatctggaaatggaaccgtacgggtgcagcatttgtgggaagtccttctgcatgaacctccggttcggtcatcagcgggctctgaccaaggacaacccctatgagtataacgaatacggcgagatcttttgcgacaactccgcctttattatccatcagggcgcttacacaaggaaaattctaagggaatacaaagtgtccgacaaaacctgggagaaaagtgccctcttgaaacatcagattgttcacatgggcggtaagagttatgattacaacgaaaatgggtccaatttctctaagaagtcccacctaacacagctgcgcagagcccacacaggggaaaaaaccttcgagtgtggggaatgcgggaagaccttttgggagaagagcaatcttacccagcaccagcggacccacacgggcgagaaaccctacgaatgtactgagtgcggaaaggcattttgtcagaagccccacctgacgaaccatcagaggacacacaccggggaaaagccatatgagtgcaagcagtgtggcaaaaccttctgcgtcaagagtaaccttacagaacaccaacggacgcatactggtgaaaaaccatacgagtgtaacgcttgcgggaaatcgttctgtcaccgatctgccctgaccgtacaccagaggacacacacgggcgaaaaacctttcatctgtaacgagtgcggaaaatcattctgtgttaaatcaaatctgattgtgcaccaacgcacacacacgggcgagaaaccatataaatgcaatgaatgtgggaagaccttctgtgaaaagtcggcccttactaaacaccagcgaacacacacaggggagaaaccttatgagtgcaacgcatgtgggaagacgttctcccagcgatccgtcctaactaagcaccagcgcatccacacgagagtgaaggctctgtccacatcctag

SEQ ID NO: 25073 - DNA, 360 bp, Artificial Sequence
  Description of Artificial Sequence: Synthetic coding sequence
atgaacaagagccaggagcaggtctcctttaaggatgtatgtgtcgatttcactcaagaagaatggtatctgctagaccctgcacaaaaaattctttaccgcgacgtgatcctcgaaaattacagtaacctggtttcagtgggctactgtataacaaaacctgaagtcatttttaagattgaacagggtgaagaaccctggattctggaaaagggctttcccagccagtgccatcccgaaaggaagtggaaggtggacgacgtcttggaaagttcccaggagaatgaggatgaccacttttgggaactgctgtttcataataataaaacgtggaatttgaagctgatcaaggtggaatag

SEQ ID NO: 25074 - DNA, 1740 bp, Artificial Sequence
  Description of Artificial Sequence: Synthetic coding sequence
atgaataagagtcaggagcaagtgtcttttaaggacgtctgtgttgattttactcaggaagaatggtacctgctggatcctgcacagaagattctctaccgagacgtgatattggaaaactactcgaatctggtctcggtgggttattgcattactaagcccgaggtgatctttaaaatcgaacagggagaggaaccctggattctcgaaaaaggcttccctagtcagtgccatcccgaacgcaagtggaaggtggacgatgtactggagagcagccaggaaaacgaggacgatcacttttgggagctcttattccacaacaacaaaaccgtctcagtcgagaacggcgatcgtggctcaaagacatttaacttgggcactgatccagtctctcttcggaactatccctacaagatttgcgacagttgtgaaatgaacctgaagaatatctctggcctgatcattagtaagaagaattgttccagaaaaaaacccgatgaatttaatgtttgcgagaaacttctgttagacatccgacatgagaagatcccaatcggcgagaaatcctataagtacgatcaaaagcgaaacgcgatcaattaccaccaagatctctcccagcccagttttgggcagtcatttgagtatagcaaaaatggccaaggctttcacgacgaggccgctttctttacaaacaaacgatctcaaatcggggaaactgtctgtaagtataacgaatgtggtagaacattcattgaatccttgaaactaaatatctctcaaagacctcacttggagatggagccatatggctgcagtatctgcggtaaaagcttctgcatgaacctgcgttttggacaccagcgagctctaaccaaggataatccttatgagtataacgaatacggagagatcttctgtgataactctgcattcattattcaccagggagcatatacgaggaaaatactgcgagagtataaggtctctgacaagacctgggaaaagagtgcactcttaaaacaccagatcgttcatatggggggaaaatcctatgattataacgagaatggatcgaacttctccaaaaagagtcatttgactcagctgcggagagcccacaccggggagaaaacctttgagtgcggcgagtgcgggaagaccttttgggagaaaagcaacctgacgcagcaccagagaacccataccggcgaaaagccttacgagtgtaccgagtgtgggaaagctttctgccagaaaccccatctgacaaaccaccaaagaacccatactggtgagaagccatacgagtgcaagcagtgtggaaaaacgttttgtgtgaaaagtaacttgacagaacaccaacggacacataccggtgaaaaaccttacgagtgtaatgcatgtgggaagagtttctgccacagatcggccctaaccgtgcaccagaggactcatacaggggagaagccctttatctgtaacgagtgtggaaaaagcttctgcgtcaagtcaaacctgatcgtccatcaaagaacccacaccggcgagaagccttacaagtgtaacgaatgcggcaaaacgttttgcgaaaaatccgccttgactaaacaccaacgtactcataccggcgaaaagccatacgaatgcaatgcctgtggaaagacctttagccagcggtcggtgctgacaaaacatcaacggattcacactcgggtaaaagctctatccacatcgtag

SEQ ID NO: 25075 - DNA, 303 bp, Artificial Sequence
  Description of Artificial Sequence: Synthetic coding sequence
atgaacaagtcccaggagcaggtgagcttcaaggatgtgtgcgtagacttcacacaggaggagtggtatcttctggaccccgctcagaagatcctgtatcgggacgtcattttggaaaattattccaacctcgtgagcgttgggtactgtattacaaaaccagaggtgattttcaagatcgagcagggcgaggagccatggatcttagagaaaggtttcccctcccagtgccatccagagagaaaatggaaggtcgacgatgtcttagagtcaagtcaagaaaacgaggacgatcacttctag

SEQ ID NO: 25076 - DNA, 210 bp, Artificial Sequence
  Description of Artificial Sequence: Synthetic coding sequence
atgaataaatcgcaggagcaggtgtccttcaaagacgtgtgtgtcgactttacccaggaagagtggtacctcttggacccagcacagaagatattataccgtgacgtaatactcgaaaattactctaaccttgtaagcgtaggttactgcatcacaaaaccagaagttatcttcaagatcgaacaaggcgaggagccatggattctctag

SEQ ID NO: 25077 - DNA, 1683 bp, Artificial Sequence
  Description of Artificial Sequence: Synthetic coding sequence
atggcagccgcacgcttgcttcccgtaccagctggtccacagcctctctcctttcaggctaaactgactttcgaagacgtggctgtcctgttgtctcaggacgaatgggatcgcttatgtcctgcccagcgcggactttataggaatgtgatgatggagacttatggcaatgtggtttccctgggcctgcccggaagcaaaccggatatcatctcccaacttgaacggggagaggatccttgggtactggataggaagggagcgaaaaaaagtcaggggctgtggtctgattactccgacaacctgaagtatgaccatactaccgcctgcacccagcaagattccttaagctgtccgtgggagtgtgagaccaagggcgagagccaaaacaccgacctgtctccaaagcccctgattagcgaacagactgtgattctcgggaagacgcccctcgggagaatcgaccaggagaacaacgagaccaagcagtcgttctgcctgagccccaattcagtggaccaccgggaagtacaggtcctgtcccagtcaatgccacttacccctcatcaggcagtgcccagcggcgagcgtccatatatgtgcgtggagtgtgggaaatgctttggtagatcaagtcacctgttacagcatcaacgtatacatactggcgagaaaccctacgtctgttcagtgtgtggcaaagcttttagccagtcttcggtactgagcaagcatcgcaggatccatactggagaaaaaccttatgagtgcaacgaatgtggtaaggcattccgagtgagttctgatcttgcacagcatcataagattcatacaggagagaaacctcatgaatgcctggagtgccgcaaggcattcacacagctaagccatctgattcagcatcaaaggatccacaccggcgagcggccttacgtgtgccctctttgtgggaaagcatttaatcactctaccgttctcagatcgcaccagcgtgtgcatacaggagaaaagcctcaccgttgtaacgagtgcggcaagacgttctccgttaagcgcaccctgctccagcaccaacggatacacactggcgaaaaaccatacacatgctctgagtgcgggaaagcatttagtgaccgctcagtcctgattcagcaccacaacgtgcacaccggtgagaaaccttacgagtgtagtgaatgcgggaagactttctcacacagaagcaccctgatgaaccacgaacggatccacactgaggagaaaccttatgcatgctacgagtgtggcaaagcattcgtgcagcattcgcatctaatacagcaccagagggtccacaccggtgagaagccctatgtctgtggagagtgcggccacgctttttctgccaggcggtcgctcatccagcacgaacgcattcatacaggagagaagcccttccagtgcactgaatgcgggaaagccttcagcctgaaggcaaccctgatagtccatctgagaacccacactggcgaaaagccttacgaatgtaacagttgcgggaaggcctttagccagtatagcgtcctgatccagcaccagaggatacataccggtgaaaagccttatgaatgcggagagtgcggaagagcgttcaatcagcatggacacttgatccagcatcagaaggtgcatcggaagctttag

SEQ ID NO: 25078 - DNA, 369 bp, Artificial Sequence
  Description of Artificial Sequence: Synthetic coding sequence
atggcagctgctcggcttttacccgtgcctgcgggaccccaggctaagctgaccttcgaggatgtggccgtgttgcttagtcaggatgagtgggatcgcctgtgccccgcacagagagggctctatcgaaacgtcatgatggagacatacggtaatgtcgtcagcctgggccttcctggcagcaaacccgatatcataagtcagctggagagaggtgaggacccctgggtgctggaccgcaagggtgcaaagaaaagtcaggggctgtggagcgactacagcgataatctgaagtacgatcataccactgcttgcactcagcaagactcactgtcatgtccatgggacccagtcccacaaaaaccttag

SEQ ID NO: 25079 - DNA, 1332 bp, Artificial Sequence
  Description of Artificial Sequence: Synthetic coding sequence
atggcagcggctcgcttgctccctgtgcctgcgggaccgcaagctaagctgactttcgaagatgtagcagtcttgttatctcaggatgagtgggatcgcctgtgccctgctcagagaggactgtataggaacgtgatgatggaaacttatggaaacgttgtctccctcggcttgccaggaagtaaacccgatattatcagccagctggaacgcggtgaagatccatgggtgttagatcgaaagggcgctaaaaagtcccaagggttgtggtccgactattctgacaatctgaagtatgatcacacaaccgcctgtacccagcaagatagtctgtcatgcccctgggagtgcgagaccaagggggaaagccagaacaccgatctctcacccaagcctctgatctcagagcagacggtgatactgggtaaaacaccacttgggcgaatcgaccaggaaaataacgaaaccaaacagagcttttgcctttcaccaaacagcgtggatcatcgtgaggtgcaggtgctctcccagtccatgccactcacccctcaccaggcagtgccctcaggagagcggccatatatgtgcgtcgaatgcggtaagtgcttcgggagatcgagccatttgctccagcaccagagaatacacactggggagaaaccatacgtatgcagcgtgtgcggaaaggccttctcccaaagtagcgttctctctaagcaccggaggatccacaccggagagaagccatacgagtgtaacgagtgtggaaaggcttttcgtgtttccagcgatcttgcgcagcaccataagatccacacgggcgaaaaacctcatgaatgtcttgagtgtaggaaggcatttactcagctgtcccacctaatacagcatcagaggatacacactggcgagaggccgtacgtgtgccccctgtgtggtaaggcattcaatcattctactgtcctgaggagccatcagagagttcacacgggggaaaagccccaccgatgcaatgaatgtgggaaaacctttagcgtaaagcgtacgttgctgcagcaccagcggattcacacgggagaaaagccattccaatgcacggaatgtggaaaggctttttccctgaaggcgactctaattgtacacttgcgcacccatactggtgagaagccgtatgagtgtaactcatgcggtaaggccttttcacagtactcggttctgatccagcatcagcgcatacatacaggtgagaagccctacgagtgcggcgagtgtggacgcgcatttaaccagcacgggcacctgatccagcatcagaaagtgcatagaaaactctag

SEQ ID NO: 25080 - DNA, 1668 bp, Artificial Sequence
  Description of Artificial Sequence: Synthetic coding sequence
atggccgcagcaaggctactgcccgtgcccgctggccctcaggcaaagctgacgtttgaagacgtggccgtgctgctgtcccaggacgagtgggaccggctgtgcccagcccaacgcggtctgtacagaaatgtgatgatggagacctatgggaatgtcgtatctctcgggctcccgggatcgaagccggatatcatttcacagttggagaggggcgaggatccatgggtcttggatagaaaaggtgccaagaagtcgcaggggctttggtcagactactccgacaatctgaagtacgatcacaccaccgcatgcacgcaacaagattccttgagttgcccttgggaatgtgagacaaagggcgagagccaaaacacggaccttagcccaaagccactcatcagtgagcagacagtgattcttggaaagactcccttagggagaatagatcaggaaaacaatgaaacgaagcaatccttctgcctgtcaccgaactcggtagatcatcgagaagttcaggtactatctcagtcaatgccactgacccctcaccaagcagttccttctggagagaggccctatatgtgcgtcgagtgcggtaagtgcttcggcaggagctctcatctgctgcagcaccagcgaattcacacgggggaaaagccttacgtttgcagcgtgtgtggcaaggccttcagccaatcctcggttttgagtaagcatagaaggatacatactggggagaaaccttacgagtgcaatgaatgcgggaaagcgtttagggtgagttccgacctcgcacagcaccacaagatccacactggcgagaagcctcatgaatgtctggagtgcaggaaggccttcacccaattgtcacacctgatccagcatcagcggatccacaccggcgagcgaccttacgtatgtcctctctgtggcaaggcctttaaccatagcaccgtgttgcggtcccaccagcgagtgcacacaggggagaaacctcaccgctgcaatgagtgcggaaaaacgttctctgtcaagaggacgctgctgcagcatcaacgtattcacacaggcgagaagccctatacctgctcagaatgtggcaaggccttcagcgacaggagtgttttaattcagcaccacaacgtgcacacaggcgaaaaaccttacgaatgctccgaatgcggcaaaacgttcagccatagatcaacactgatgaaccacgagagaattcatacagaggagaagccatacgcgtgttacgaatgcgggaaagcgttcgtccaacattcccacctcatccagcaccagcgggttcacaccggagagaaaccttatgtatgcggagaatgtggacacgccttttcggcacgtcgctccttgatacagcacgaaaggattcataccggagagaaaccattccagtgtaccgaatgcgggaaagcattttccttgaaggctacccttattgttcacttgcggactcatacaggggagaagccgtatgaatgtaactcttgcggtaaggcctttagccaatactcagttttgatacagcatcagcgaatacataccggcgagaaaccttatgaatgcggggagtgtggtcgggcatttaaccagcacggtcacttaattcagcaccaaaaggtgcatcggaagctgtag

SEQ ID NO: 25081 - DNA, 369 bp, Artificial Sequence
  Description of Artificial Sequence: Synthetic coding sequence
atggcggctgcccgattgttacccgtcccagctggccctcaggcaaagcttacgttcgaagatgttgctgtgctgctttcacaggatgagtgggacagactgtgtcccgctcaacgcggactttatagaaacgttatgatggaaacctacggtaatgttgtgtcactgggactccccggatcgaagccggatattattagccagttagagaggggggaagacccctgggtgcttgaccgcaagggcgcaaaaaagtcccagggactgtggagcgattattctgataacttaaagtacgaccatacaaccgcatgcacccaacaggactcgctttcatgtccttgggacccggtgccccaaaagccatag

SEQ ID NO: 25082 - DNA, 384 bp, Artificial Sequence
  Description of Artificial Sequence: Synthetic coding sequence
atggcagctgcaagactgctgcctgttcctgccggtccacagccgctttcgttccaggctaaattaacgtttgaggatgttgccgtattactgtcccaggacgagtgggatcggctgtgtcccgctcagcggggattataccgcaacgttatgatggagacatatgggaacgtagtgtccctcggcttaccaggaagcaagccagacatcattagccagctggagcggggagaagatccgtgggtgctcgacaggaagggagcaaagaagtcgcagggactgtggtcggattattcagataacttaaagtacgatcataccaccgcttgcacacaacaagatagcctgtcgtgcccttgggaccctgtcccccaaaagccttag

SEQ ID NO: 25083 - DNA, 2016 bp, Artificial Sequence
  Description of Artificial Sequence: Synthetic coding sequence
atggcggctacatttcagttgcctgggcaccaggagatgccactgacctttcaagacgtggctgtgtatttcagccaggccgaaggcaggcaattgggtccacaacagagggctttataccgcgatgtgatgttggaaaactatgggaacgtagcgtccctagggttccctgtgccaaagcccgagctgatttctcaactagaacagggaaaagagctgtgggtcttgaatctgttaggggcagaggagcccgatattctgaagagctgtcagaaggattctgaagtaggcaccaaaaaggagctgtcgattcttaatcagaagttcagcgaagaggtcaagactcctgagtttgttagcagacgtctcctgagagacaacgcacaggctgctgagttccgagaagcttggggacgagagggtaagttgaaggagcgcgttggcaacagtgcaggacagtcacttaataaacctaacatccacaaacgggtgctgaccgaggctacagttggacgtgagcgcagtcttggcgagcgaactcaggaatgttcagcctttgaccggaacttaaatctggatcagaatgtggtccgactccagcgtaataagaccggcgaacgcgtattcaagtgcgacatctgcagtaagacttttaaatataatagtgatttgagtcgtcatcagcggtctcatactggggagaaaccttacgagtgcgggaggtgcggacgggcattcactcactcttccaaccttgtgcttcaccaccacattcacactggaaacaaacccttcaaatgcgacgaatgtggaaagaccttcggcttgaactctcacctgagattacataggcgcattcacacaggcgaaaagcccttcgggtgcggcgaatgtgggaaagcattttctagaagcagtacactcatacaacacaggataatccacacaggtgagaaaccttataagtgcaacgaatgtggtcggggattctcacagtccccacaacttacccagcatcagcgcattcatacgggcgaaaagcctcacgaatgtagccactgcggcaaagcattcagtcggtcatctagtctaatccaacacgagagaattcacacaggagagaagccgcataaatgcaaccagtgcggcaaagccttttcccagagctccagcttgtttttgcatcacagagtacatactggcgagaaaccttacgtatgcaatgagtgcggacgcgcatttggctttaatagtcatcttaccgaacacgtgagaatccacacaggggaaaagccatacgtctgtaatgagtgtggcaaagccttccgccgatctagcacactggttcagcacaggagagtccatactggcgagaaaccctaccagtgcgtagagtgcggcaaagccttctcccagtcttcgcagctgacactccatcagagagtgcataccggggagaagccctatgattgcggcgattgtgggaaagctttcagccgcaggtctacattgatacagcaccagaaagtccactctggggagactcggaagtgcaggaagcatggtccagcctttgtacacggctcctcactaacagccgatggacagattccaactggggagaaacatggaagggccttcaaccacggagcaaatctgattttgagatggacggtccatactggtgagaaatcctttgggtgcaacgagtatgggaaagcgttctccccgacatctcgacccaccgaagatcagattatgcacgcaggcgagaagccatacaagtgccaggagtgtggaaatgccttctccggaaaaagtacccttatccagcaccaggtgacacacaccggtcagaagccatgtcattgtagcgtgtatggcaaagcgtttagccagtcctcacaacttacaccaccacaacaaacaagagtaggagagaaaccagcgcttaacgatgggtccaaacgctactttatacatattaagaagatattccaagagcggcatttttag

SEQ ID NO: 25084 - DNA, 1602 bp, Artificial Sequence
  Description of Artificial Sequence: Synthetic coding sequence
atggcaacgagttttcggactgcatcttgctggggcttgctgagttttaaggacatctctatggaattcacctgggatgaatggcaactgctcgactccacccagaaatacctgtaccgcgatgtgatactggaaaattatcataacctgatatccgtagggtaccacgggacaaaaccagacctgattttcaagttagagcagggcgaggacccatggatcatcaatgcaaaaatttcccggcagtcctgcccagatggttgggaggagtggtatcaaaacaaccaagatgagctggaatctatcgagcgcagctatgcttgctctgtattgggacgcctgaatctttctaagacccatgatagctcacgtcagcggctgtacaacactcgcggaaagagcctgactcagaacagtgccccttcacgcagttatcttcggaagaatcccgacaaattccatgggtacgaggagccatattttctgaaacatcaaagagcccacagcatcgagaagaattgcgtttgcagcgagtgtggcaaagctttcagatgcaagtcccagttaatagtacacctgaggattcacactggggagcgcccatatgagtgttccaagtgcgaacgggcattctctgcaaagtcgaacctgaatgctcatcagcgcgtacacacaggagagaagccgtacagttgcagtgaatgcgagaaggttttcagctttaggagccagctgattgttcaccaagaaattcacaccggcggaaagccgtatggctgttccgagtgcggtaaagcttactcctggaagtcccagcttctccttcaccaacgttcccatacgggagtcaaaccctatgagtgtagcgagtgtggaaaggccttcagcctgaagtcaccatttgttgtgcatcagcgaacgcataccggcgttaagccacataagtgttcagagtgtgggaaagctttcaggagcaaaagctacctcctagtccacatcagaatgcacacaggggagaagccctaccagtgtagcgattgtggaaaggcatttaatatgaaaacccagctgatcgtgcaccagggtgtgcacacagggaataatccttatcagtgtggcgaatgcggaaaagccttcggcagaaaggagcagctgacagcgcacctgcgcgctcacgccggagagaagccatatgggtgtagtgagtgcggaaaggcattcagttcaaaatcctatctggtgatccatagacgcacccacaccggggagaggccctacgaatgttctctctgtgagcgagcattctgtggcaaatcccaactcataatccaccagcgcacacactctacagaaaagccctacgagtgcaatgagtgtgagaaggcctaccctcgaaaggccagtcttcagatccaccagaagactcattctggggagaaaccttttaaatgttccgagtgcggcaaagcctttacccagaagagttccctgagcgaacaccaacgggtccatacaggcgagaaaccatggaaatgtagtgagtgtggcaagagtttttgctggaactctgggctgcgcatacatagaaagactcacaagtag

SEQ ID NO: 25085 - DNA, 939 bp, Artificial Sequence
  Description of Artificial Sequence: Synthetic coding sequence
atgtgctcacctcaggagagcggcatgacagccctttcagctaggatgttgacccggtcccgctccctgggaccgggtgctggccctaggggctgccgagaggaaccaggacccttgcgcaggagagaggccgctgctgaagccaggaagtctcatagccctgtgaaaaggccaagaaaagcacagcggttgcgcgtcgcctacgaagggtccgattcagagaagggggagggcgcagagccactcaaagtccccgtgtgggaacctcaggactggcagcaacagctagtgaacatcagagccatgcgtaataagaaggacgcacccgtggaccacttgggtactgagcattgctatgattcctctgctccacccaaggttaggcgctaccaggtactactcagcctgatgcttagctctcaaactaaggaccaggtcaccgccggagcgatgcagcgactgagggccagaggtctcaccgtcgattctattctgcagaccgacgatgccaccttaggcaaactcatttatcccgtgggtttttggcgctctaaagttaaatacatcaagcagaccagcgccatcctgcaacagcactacggaggggacatcccggcaagtgtcgctgagctggtggccctcccaggggtgggccctaaaatggctcacctggccatggccgtggcctggggtactgtttcaggcattgctgtcgacacccatgtacatagaatcgccaaccgactgcgctggactaagaaggccacgaaatcgcctgaggaaacaagagccgctctggaggaatggctgccccgtgagctctggcacgaaattaacggccttctggtcgggtttggccagcaaacctgcctcccagtacacccacgctgccacgcatgcctgaaccaggccctgtgcccggcagcccagggcctatag

SEQ ID NO: 25086 - DNA, 996 bp, Artificial Sequence
  Description of Artificial Sequence: Synthetic coding sequence
atggagcaggcccttgcgggagcatcatccggtagggagctgggacgtcctaaagagttacaacctaaaaaactgcacctgtgccctttgtgcggcaagaactttagtaataatagtaatttaatccggcaccaacggatccatgcggcagagcggttgtgcatgggcgtggattgcactgaaatttttggaggcaacccccgatttttatccctccacagggcacacctgggggaggaggcccataaatgtttagagtgcgggaagtgtttctcacaaaatacacacttgacgaggcaccaacggacccacacaggagaaaaaccttaccagtgcaatatctgtggtaagtgttttagttgtaatagcaatctgcaccgacaccaaagaacccacactggcgagaaaccttataaatgtcccgagtgcggcgagatatttgcacactccagcaatctgctccgtcaccagaggattcatacaggtgagcggccttataaatgccctgagtgtggtaagagcttcagccgttctagccacctggtgatacacgagagaacccatgagagggagagattgtatccattcagcgagtgcggggaggcagtgagcgattctaccccatttttaacaaatcacggcgctcataaagcagagaagaaactgttcgaatgtctgacgtgcgggaaaagcttcaggcagggtatgcacctgaccaggcaccagcgcactcacacgggagagaaaccctacaagtgtacgttgtgcggcgaaaattttagccatcgctctaatctgatcaggcatcagagaatccataccggagagaaaccctatacatgccatgaatgcggggactctttttcacattccagtaatcggatacgacacttgaggacccacactggcgaacgtccctacaaatgctctgagtgtggtgagtctttttcccgatcgtctcgtcttatgagtcaccagagaacacacactggctag

SEQ ID NO: 25087 - DNA, 1515 bp, Artificial Sequence
  Description of Artificial Sequence: Synthetic coding sequence
atgctggataactatagaaacctggtgttcctcggcatcgcggtctcaaagcccgacctgatcacctgtctcgagcagggtaaggaaccatgtaacatgaaaagacatgccatggtggcaaaaccacccgtggtttgtagccactttgctcaggatctttggcctaagcaggggttaaaggacagtttccaaaaggttatcctccgtcgatatggcaaatacggccatgagaacttgcagcttagaaaaggatgcaaatccgccgacgagcacaaagtgcataagcgcggttacaatggactaaatcagtgtcttacaacaacccaaagcaaaatcttccagtgtgataaatatgttaaagtgctgcacaagttcagtaactcaaacatccataaaaagcggcagacagggaagaagccatttaagtgcaaagagtgcgggaagagttgttgtatcctgagtcagctgacgcagcacaagaaaacagccacaagggtgaacttctacaagtgtaaaacatgcggaaaggcttttaaccagtttagtaatctgaccaagcataaaatcattcaccctgaagttaacccgtataagtgcgaggaatgcggaaaagctttcaatcagagcctgactctgaccaagcacaaaaaaattcatactgaggaaaagccttacaagtgcgaggactgtggaaaggttttctccgtattctccgtgctcacaaagcataaaattatacacaccggcactaaaccgtataactgtgaagaatgcggtaaaggcttctctatcttctccactcttaccaaacacaagatcattcatacaggggaaaagccatacaaatgtaatgagtgcggtaaagcctttaactggtcttctactctgaccaaacacaagcgcatccatacaggcgaaaagccctacaagtgcgaagagtgtggcaaggcatttaatcagtctagtaccctgacaagacacaaaatcgtgcacaccggcgagaagccctacaagtgtgaagagtgtggcaaagctttcaaaagatccaccacactgacaaagcacaagaggatttacacgaaggagaagccttacaagtgtgaagagtgcggcaaagcatttagcgtgttttctaccctgacgaaacacaagattatccatactggggctaaaccttataaatgtgaagagtgcgggtccgcattccgcgcatttagcacgctcacggagcacaaacgagtccatactggtgagaaaccatacaagtgcaatgaatgtggcaaggcattcaattggtctagcaccctgacaaagcataaaaggatacacacgggtgagaaaccttacaagtgtgaggagtgcggcaaggcctttaacaggtcaagcaacttaacaagacataagaaaattcacactggtgaaaagccatataagcccaaaagatgtgattctgcttttgacaatacacctaattttagtaggcataaacgaaaccatatgggggagaagtcttag

SEQ ID NO: 25088 - DNA, 1710 bp, Artificial Sequence
  Description of Artificial Sequence: Synthetic coding sequence
atgtcttctgctcccagagggccaccttccgtcgcaccactcccagcgggaatcggcagatctaccgcgaagaccccaggcctcccgggttccctggaaatggggcctctgaccttccgcgacgtggctatagaattcagtctggaggaatggcaatgtctcgatacatctcagcagaatctgtaccggaatgtaatgctggataactataggaaccttgtgtttctgggaattgcagtgtccaaaccggatctcatcacctgcctggagcaaggaaaggagccatgtaacatgaagagacacgccatggtggcaaaacctccagtcgtctgctcccacttcgcccaggacctttggccgaaacaagggttaaaagattctttccagaaagtcattctgaggcgctacggaaaatacggtcatgagaacttacagctgagaaaggggtgcaagtccgccgatgagcacaaagtgcacaagagagggtacaatggcctgaaccagtgcctgacaacaactcaatcaaaaatctttcagtgtgacaagtatgtgaaggttctgcacaaattttcgaattccaatattcacaagaaaagacaaaccggcaaaaagccattcaaatgtaaagagtgcggaaagagctgttgcattctgtcccagctgacccagcataaaaagactgcaaccagggtcaacttctacaagtgtaagacatgcggcaaggcttttaatcagttttccaacctgacaaagcacaaaatcatccatccagaggtcaacccctacaagtgtgaagaatgtggaaaagcgtttaatcagtctcttaccctgaccaagcacaagaagattcataccgaagagaagccctacaagtgtgaggactgcggcaaagtgtttagcgtgttcagcgtcctcacaaagcacaagatcattcatactggcacaaagccctacaattgtgaggaatgcggtaaaggatttagtatttttagtactctaacaaagcacaagataatccacaccggtgagaagccttataagtgtaacgagtgcggcaaggcctttaattggagctctactttaaccaagcataaacggatacacaccggcgagaagccttacaaatgcgaagagtgcggaaaagcatttaaccagtcctcgacactgacaagacataagatagttcataccggcgaaaagccctacaagtgtgaggaatgtggtaaggcattcaaacgaagcacaacgctcaccaaacacaagagaatctacaccaaagagaaaccctacaagtgcgaggaatgcggtaaggctttcagtgtgttctccaccctgaccaaacacaaaattatccatacgggtgctaagccttataaatgtgaggagtgcggatcagccttcagggctttcagtaccctgacagaacataaaagggtgcacacaggggaaaaaccctacaagtgcaatgagtgcgggaaggcattcaactggagcagcacactgaccaagcataagcgcatccacacaggtgagaagccatacaaatgtgaggagtgtggaaaagcttttaacagatcttccaatctcaccagacacaagaagatacataccggggagaaaccatacaaaccaaagaggtgcgattcggcgttcgataatactcccaattttagcaggcacaagaggaaccatatgggagaaaagtcttag

SEQ ID NO: 25089 - DNA, 246 bp, Artificial Sequence
  Description of Artificial Sequence: Synthetic coding sequence
atgggacctctgacatttagagatgtggcgattgaattttcactagaagagtggcagtgcttagatacatctcagcagaacctctatcggaacgtgatgctggataactatcgaaacctcgtcttcctgggaatcgccgtgtctaaaccagacctcatcacctgtctggagcagggcaaggagccttgtaacatgaaaaggcacgctatggttgccaaaccacccggttggtcagccgtggcctag

SEQ ID NO: 25090 - DNA, 1131 bp, Artificial Sequence
  Description of Artificial Sequence: Synthetic coding sequence
atgaagggcgaggacgcacagcctcaagaaatggctagtacaagtttcccccgtgctagtgggccatcacccgagtttcgccaacacggggattccgacggtaaaaggggcagcccacagaacttacctatcgagcaccactttgcatgtaaggaatgcggggatacattcagactgaaagtgcttttagtccagcaccagcgtgtccattctgaggaaaaggggtgggaatgtggggactgcgggaaagtgttcagaggtgtggccgaattcaacgaacataggaagagtcacgtggccgctgaaccccagcctggtcccagtcgggctctcgaaaacgccgctgaaaagagagagcaaatggagagggaggcaaaaccctttgaatgcgaggagtgtggaaagagattcaagaagaacgctgggctgagccagcatctgagggtccacagccgcgaaaaaccatttgactgtgaggaatgtgggagaagcttcaaagttaacacacacttgtttagacatcagaagctccacaccagtgagaagccgttcgcatgcaaggcttgctccagggacttcctggatcgacaggagttgctcaaacatcagcgtatgcatacgggtcacctcccatttgactgcgatgactgcgggaaaagctttcggggagtgaatggccttgcagaacatcaaagaatccacagtggtgcaaaaccttacggctgcccccattgtgggaaactattccggcgttcttcagagttaacaaaacatcggaggatccatactggtgagaagccatatgcatgcggtcagtgcggaaaggcctttaggcagtcctcgtcactgttagaacacgccaggatccattccggcgaacgcccatacgcttgcggtgaatgcggcaaggctttcagggggccttctgatttgattaagcacagaaggatacatagcgggctaaaaccctatgagtgtgacaaatgcggaaaggcgtttcggcgtagctccgggttgtcccgccaccggagaatccactctggggctagaagatgcgaatgctcacaatgtggaagggtctttaagcgtaggtccgcgcttcagaaacaccaacccacacatcacgagtag

SEQ ID NO: 25091 - DNA, 990 bp, Artificial Sequence
  Description of Artificial Sequence: Synthetic coding sequence
atgatgtcccacccctgtgtttccctattaggggttccagtgttaaaccccgcattggtgccccacttggcccaggggcaggtgctactcgtgagcgacccctcaccaaacacagaccccgctaagtactcagagtccaccagtgccactcgacatcagatgaagggggaagacgcccagccgcaagaaatggctagcacaagtttcccacgtgccagcggcccttcgcccgaatttagacagcacggggattccgacggaaagcgcggatcaccccaaaacttacctatagagcatcattttgcatgcaaggaatgcggggatacgtttcggctaaaggtcttgttagtgcaacaccaacgggtgcacagcgaggaaaaaggctgggagtgtggtgactgcggaaaggtctttcgaggggttgcagagttcaatgagcaccggaagtcccacgtggccgcagaaccccagccgggaccatcccgtgctctggagaacgccgctgagaagcgcgaacagatggaaagagaagcgaagcctttcgaatgcgaggaatgcggcaagaggttcaaaaaaaatgccggtctgagccaacacctcagggtccacagtagggaaaaacctttcgactgcgaggagtgtggccgttccttcaaggtcaatacacacttgtttaggcaccagaagttgcacacctctgagaagccctttgcatgtaaagcttgctccagggactttctggatcgacaggagttactgaaacaccagcgtatgcacacaggacacctcccatttgattgcgacgactgcggaaaaagctttagaggagtgaatggtctggccgagcaccagagaatccactctggcgcaaagccttatgggtgtccccattgcgggaaactatttcgcagatcaagcgagcttacgaagcaccgacgcattcacacaggggagaaaccctacgcctgcggtctgccctgggccctttag

SEQ ID NO: 25092 - DNA, 1290 bp, Artificial Sequence
  Description of Artificial Sequence: Synthetic coding sequence
atgatgtctcatccatgcgtctccctgcttggcgtaccagtccttaacccagccctagtgccccatcttgcacagggccaagtgctgcttgtttctgatcctagcccaaatacagatcctgccaagtatagtgagagcactagcgctaccagacatcagatgaagggtgaggatgcacagcctcaggagatggcgtcaacaagtttcccccgtgcatctggaccgtccccggagttcagacagcacggcgattccgatggaaaacgaggcagtcctcaaaaccttccaatcgaacatcacttcgcttgtaaagaatgtggggacacattccggctcaaggttctgctcgtccagcaccagagagttcacagtgaggagaagggatgggaatgcggagactgtgggaaggtgttcaggggggtggccgaatttaacgaacaccgaaagtcacacgtggctgccgaaccccagcccggacccagcagggcactcgagaacgccgcagaaaaaagagagcagatggaaagggaagccaagcctttcgaatgtgaggagtgtggcaagcggttcaaaaaaaatgccggtctgtctcaacatctgcgtgtccattccagagaaaaacctttcgactgtgaagagtgcggcagatcattcaaggttaacacccatctatttcgtcaccaaaaactgcatacctctgagaaacccttcgcatgcaaagcctgctctagggacttcctcgataggcaagaattgctaaaacaccagagaatgcacaccggacatctccccttcgactgcgacgattgcggtaaatctttcaggggggtgaacggcctggccgagcaccagcgtattcatagcggagctaagccctacggctgcccgcattgcggcaaattgtttcgaagatcctcggagctgaccaaacaccggaggatccacacaggggagaagccatacgcatgtggacagtgcggaaaggccttccgacagtcatccagtctactcgagcacgcccgtatccatagcggcgagaggccatacgcttgcggggagtgtggaaaagctttccggggaccctccgacctgatcaagcaccgcagaattcattctggactgaaaccttacgagtgtgataagtgcggcaaggcttttagacgttcttccggattgtcccgacatcggcgaatccacagcggggcacgacgatgcgaatgttctcagtgtggccgagtgttcaaaaggcgcagcgctcttcagaagcatcagccaactcaccatgagtag

SEQ ID NO: 25093 - DNA, 1380 bp, Artificial Sequence
  Description of Artificial Sequence: Synthetic coding sequence
atgcccgaagatctcgtgacttttgatgatgttgcttggtatttgaccacgcgcgaatggtttaagttggacccagagcaacgggcactggagtactatggaaatgtcaccagcgtcgccggagtcccagtgctgaatccagctcttgtgcctcacttggcccagggccaggtcctgctggtctcggacccatcgcctaacactgatccagccaagtattccgaatccacctccgccacccggcaccaaatgaagggcgaggatgctcagccccaagagatggcgagcacatcattcccgagagcttccggcccttctcccgaatttagacaacacggtgatagcgatgggaaacgtgggtccccccaaaacctgcctatagagcaccactttgcctgtaaggaatgcggggataccttcaggctgaaggtccttctcgttcaacaccagagagttcactctgaagagaagggctgggaatgcggagactgcggcaaggtgttcagaggcgttgctgagtttaatgaacatcgcaagagccacgtggccgcagaaccgcaaccaggaccctccagggcccttgaaaacgcggctgagaagcgggaacagatggagagggaagccaaaccctttgagtgcgaggagtgcggcaagcggtttaagaaaaatgctggcctgtctcagcatcttcgcgtccacagcagggaaaagccttttgattgtgaggaatgtggacggtcattcaaggttaatacgcacttgttccgccaccagaagctccacaccagcgaaaaaccatttgcatgcaaggcgtgctctcgagatttcctcgatcgtcaggaattattgaaacaccagaggatgcatactgggcacctgccctttgattgtgacgactgtggcaaatcctttcgaggcgtgaacggccttgccgagcatcaacggatccacagtggcgcaaagccatacgggtgcccccactgcgggaagctgttcaggaggagcagcgagttgactaagcaccgacgaatccataccggcgagaaaccatacgcctgtggccagtgcggaaaagctttcaggcagtcctctagccttctggaacacgcgcgtattcatagcggagagagaccttatgcctgtggtgaatgcgggaaagctttcaggggaccctctgatctaattaagcacaggcggattcatagcggcctaaaaccatacgaatgcgacaaatgcggaaaagcgtttagacggagttccggcctctctcgacacagacggattcatagcggcgctcggaggtgcgagtgctcccagtgcggaagggtgttcaaacgcagatcagcgttacagaagcatcagcctacacatcacgaatag

SEQ ID NO: 25094 - DNA, 1620 bp, Artificial Sequence
  Description of Artificial Sequence: Synthetic coding sequence
atgggacactgtcggctttgccacggaaaattctccagccggtctttgcgtagtatcagcgagagagctcctggcgcaagcatggagaggccatcagccgaagagagggttttggtaagggacttccagcgcctattgggagttgccgtgcgccaggatccaacactgtcccccttcgtctgtaagtcttgtcatgcccagttttatcagtgtcacagtcttctgaaatcttttcttcagagggtgaatgccagccccgctggaaggcgaaagccgtgcgctaaggttggagcccagccccctactggcgctgaagaaggcgcatgtctggtggatttgattacgagttcaccccagtgtctgcacggtcttgttggttgggtgcatggacatgcggcttcgtgcggcgctctccctcatcttcagagaactctgtctagcgagtattgcggtgtcatccaggtggtttggggctgcgaccaggggcacgattatacaatggatacttcaagcagttgcaaggccttcctgttagattctgccctggctgttaaatggccctgggacaaagagacggcccctcgcctaccccagcaccggggatggaatcccggtgacgctccccagacctcacaaggcagaggtacagggaccccagtcggagccgaaaccaagactttgccctcaactgacgtggctcagccacccagcgatagcgacgctgttggcccacgctccgggtttccgcctcaaccctctttgcccctgtgcagggcacctggccagctgggggagaagcagctaccatcttccacttctgacgatagagtcaaggacgaatttagcgacctctctgaaggcgatgtcctgtctgaagatgaaaatgacaagaaacagaacgcccaatcttcagacgagtcattcgagccataccccgaacggaaggtctccggcaagaaatctgaatcgaaagaagccaaaaagtctgaggagccaaggatcaggaagaagcccggaccaaagcccggttggaagaagaagctacggtgtgaacgagaggaactgccaactatctataaatgcccctatcagggttgtacagccgtgtataggggagctgatggcatgaaaaagcatatcaaggagcaccacgaagaggttcgagagcggccatgccctcacccgggatgtaacaaagtgtttatgattgatcggtatctgcagcgacacgtgaagctgatccacaccgaggttaggaattacatctgtgacgagtgcgggcagaccttcaagcagcgtaagcatctactggtgcaccagatgaggcacagtggagctaagccgttgcagtgcgaggtttgtggattccaatgtcgacagcgcgcttccctaaagtatcatatgacaaagcataaggctgagacagaactagatttcgcatgcgatcagtgcggcaggcgatttgaaaaagctcacaacctgaacgtgcatatgtctatggtgcatccactgacccagacccaggacaaagctcttccattagaggctgaacctccccctgggcctcccagtccttccgtgaccacagagggacaagcagttaaacccgaacccacttag

SEQ ID NO: 25095 - DNA, 1845 bp, Artificial Sequence
  Description of Artificial Sequence: Synthetic coding sequence
atgaagagagaccgcctgggccgattcttgtccccagggtcatcaagacaatgcggtgctagcgatggtggcggtggcgtgtctcggacaagagggcgacccagtctgagcggtggacccagggtggacggagctactgctcggagggcatggggacctgtcggttcgtgtggagacgctggcgaggacggggctgacgaggctggagcaggccgagctctggcgatgggccactgccggctgtgccacggtaaattcagcagtcggtcactcagaagtattagtgagcgcgctcccggtgctagcatggaaaggccctcggcagaagaacgcgttctggtccgcgattttcaacgtctactgggagtggctgtcagacaggaccctactctctcaccttttgtttgtaagagttgtcatgctcagttttaccagtgccacagcctcctcaaaagttttctccagagggtgaatgcttcccccgctggccgtaggaaaccctgcgcaaaagtgggggcacaacccccaacaggtgctgaagagggcgcttgcctggtggacctgattacgtcgagtccccagtgcctccacggtctggttggctgggtgcacggccatgccgcaagttgcggcgcactgccccacctccagaggaccctcagctcggaatattgcggggtgatccaggttgtgtggggatgtgatcaggggcatgactatacaatggatacctcaagcagttgcaaggctttcctgttggattctgctcttgccgttaagtggccgtgggacaaggaaaccgcgccacgcctgccacaacacaggggatggaatccaggagacgctcctcaaacatcgcagggaaggggaaccgggacccctgtgggggctgaaactaaaacgcttcccagcacagatgtcgctcaaccacctagcgatagcgacgccgtgggacctcgctctggctttccaccacaaccaagcctccctctgtgtagggctcctgggcaactaggcgaaaagcagctcccatccagtacgtccgacgaccgggtcaaggacgagttttcagacctgtctgaaggggatgtgctctcggaagacgaaaatgacaaaaagcaaaacgcgcagagctccgacgaaagcttcgagccctaccccgagagaaaagtgtctggaaaaaagtctgaaagtaaggaagcgaagaagagcgaagagcctaggattagaaagaaacctggtcccaaacctggttggaagaaaaagctgcgctgtgaaagggaggaactgcccacaatatacaaatgtccgtaccagggctgcacagccgtataccggggtgcggacggcatgaagaaacacattaaggaacaccacgaagaggtcagagagagaccttgccctcaccctgggtgcaataaggttttcatgattgatcgttacttgcaaaggcacgtgaagcttatccatactgaagtcaggaattatatctgtgatgaatgtgggcagacattcaaacagcggaagcatttgcttgtgcatcagatgcggcactccggagccaaaccccttcaatgcgaagtgtgtggcttccaatgccgccaaagggcttccctaaaatatcatatgactaagcataaagcggaaactgagctagatttcgcatgtgaccagtgtggcagacgtttcgagaaagcccacaatttaaatgtgcacatgtctatggtccatcctcttacacaaactcaggacaaggcccttccattagaagcggagcctccccctgggccacccagcccttcagtgaccacggaggggcaggcagtcaaacccgagccaacgtag

SEQ ID NO: 25096 - DNA, 1203 bp, Artificial Sequence
  Description of Artificial Sequence: Synthetic coding sequence
atggatatgagaccagcggcaggcccttgtcctaccttccgcggtcattgtccaccgagcactgcagcctctagtcggtcttgcggcgcagccaccagagccaccaccactccttggatcccggcacccgcagcaagacctagttgctggaccgttcgttggcagtcctccgggcatggtacaaagagacggcgtcacgggtgcccgtccactgagggcggtaccttggggatgcctctgaggccgccacgagttgaaggacagggaccacagctggggcttagacctcgcccatgtcctgctagaatgtggccttccctcctccgcactgctacacgatgggggcctgggagagcctcccacctgagtcaagcctgtcccttcgccggaccccagggaagctgggtgcgctccagtttccatctgcagccccgtatgatcggcgacgtgcttagtgaggacgagaatgataagaaacagaatgcacagagttccgatgaatcatttgaaccttatccagagcgaaaggtttcaggcaaaaagagcgagagcaaagaagcaaaaaaaagcgaggagcccagaattcgcaagaaaccgggacccaaacctgggtggaagaagaagttgcggtgcgagcgagaggaactccctacaatctacaagtgcccataccaggggtgcaccgccgtgtatcggggtgccgatggaatgaagaagcatattaaggagcatcatgaggaagtccgcgaaagaccttgtccacaccccggttgcaacaaggtgtttatgattgatagatacctgcaaaggcacgtaaagctgatccacacagaagtgcggaactatatctgtgacgaatgcgggcagactttcaagcagcgaaaacacctgctggttcatcagatgaggcactcaggcgctaagccgttgcagtgcgaggtgtgtggcttccagtgcaggcagcgagcttccctgaaatatcatatgactaaacataaggcggagacggagctggattttgcttgtgatcagtgtggtcggcgatttgagaaggcacacaatctcaatgtgcacatgagcatggtacatcctctgacacaaactcaagataaagcactgccactcgaagcggaacccccacctggaccaccctccccttctgtcactacagagggccaagctgtgaaacccgagcctacatag

SEQ ID NO: 25097 - DNA, 1998 bp, Artificial Sequence
  Description of Artificial Sequence: Synthetic coding sequence
atgatgaagacattctttagtacaggccaaggcaataccgaggcttttcacacaggcactttgcaacgacaggcctctcaccacatcggagatttttgcttccaaaaaattgaaaaggacatccatggttttcagtttcaatggaaagaagacgagaccaatgaccacgccgctccgatgactgaaatcaaagaactgaccggttctacgggacagcacgatcaacgccatgctgggaataaacatattaaagatcaactgggcctttcattccatagtcacctcccggagctgcacatttttcagcccgaagggaagataggtaatcaggtggagaaatctatcaataacgcctcctctgtttccacctcacagcggatctgttgtaggcccaaaacccacatctcgaacaagtacggcaacaacagcctccacagctcacttctaacccagaaacgcaacgtgcatatgagggaaaaatcctttcagtgcattgagtcagggaaaagttttaattgctcttctctcttaaaaaaacaccagatcacccatctggaggagaaacagtgcaaatgtgatgtgtatggaaaagtgttcaatcaaaagcgttacctcgcgtgtcaccgcagatctcatatcgacgagaagccatacaaatgcaatgagtgtggcaagatattcggacacaatacatctctgtttctacataaggccctccataccgcagacaaaccctacgagtgcgaagagtgcgataaagtgttctcccggaaaagtcatcttgagacacacaagattatctatacggggggaaaaccttacaaatgtaaagtttgcgacaaagctttcacctgcaacagttacttggctaagcacactatcatccatacgggggagaagccatataagtgtaatgagtgtggcaaggttttcaatcgcctgtctactttagccagacataggaggctccataccggtgaaaagccatatgaatgcgaggaatgtgaaaaagttttcagccgcaaatcacatctcgagaggcacaagaggatccacacgggtgagaagccatataagtgcaaagtgtgtgacaaggccttcgcatacaacagttacctggcaaagcactcaatcattcatacaggcgagaaaccttacaaatgcaacgagtgtggcaaggtgtttaatcagcagagtactctcgcacggcaccaccgactgcacactgcagagaaaccctacaagtgtgaagaatgcgacaaggtatttcgctgcaaaagccacctggaaagacacagaaggatccacactggggagaagccctacaaatgcaaagtgtgtgataaggcgtttcggtctgacagttgcttaactgagcatcagagggtccacaccggggaaaagccatacatgtgcaacgagtgtggtaaagtatttagcacaaaggcgaaccttgcttgtcaccacaaactgcatactgccgagaaaccttataaatgcgaagagtgtgagaaggtgttctccagaaagtcccacatggaacgacatcggaggatccataccggagagaaaccttataaatgcaaagtttgcgacaaggcctttaggcgcgattctcacctggcccaacaccaaagagtccataccggggagaagccctacaagtgtaacgagtgcggtaagacattcagacagacttcctccctgatcattcacagacggcttcacacgggagagaaaccgtacaaatgtaatgaatgtggtaaaacatttagccagatgtcttcactcgtgtaccaccacagactgcacagcggtgaaaaaccttataaatgcaacgaatgcggtaaagtatttaaccagcaggcccacctggcacagcatcaacgtgtccacactggtgagaagccctacaagtgcaacgagtgcggcaagaccttcagccagatgtccaatctggtataccaccatcgcctgcattcaggcgagaagccttag

SEQ ID NO: 25098 - DNA, 1998 bp, Artificial Sequence
  Description of Artificial Sequence: Synthetic coding sequence
atgatgaagaccttcttcagcacaggtcagggaaacactgaggcctttcacaccggcactctgcaacggcaggcctcccatcacatcggggatttctgcttccagaagatcgagaaggacattcacggcttccagttccagtggaaggaagacgagactaacgatcatgccgctcctatgacggaaatcaaagagctcaccggcagtacaggccagcacgatcagagacatgccggaaacaaacatattaaagatcagttgggtctttccttccatagtcacttaccggaacttcatatctttcagccagaaggtaagattggcaaccaggtcgagaaatctatcaacaacgccagctcagtatccacaagtcagagaatttgttgccgtccaaaaacacacattagcaacaaatacgggaacaacagcttgcattccagtctgctgacccagaaacggaacgtgcacatgagagagaagtcttttcaatgcatcgagagcgggaagtcctttaactgttcatcactgctgaagaagcaccagatcacccatctggaagagaagcagtgcaagtgcgacgtctacggcaaggtgtttaaccagaagaggtacttggcctgccaccgccgaagtcatatagacgaaaaaccctataaatgcaacgagtgcggcaagatattcgggcacaacactagcctgtttctgcataaagcactgcatactgccgacaagccctatgagtgcgaggaatgcgacaaagtcttttcgcgaaagtcgcacctcgagacacacaagattatttacacaggcggaaaaccttataaatgcaaagtgtgcgacaaggcattcacttgtaattcctacctggcaaaacatacaataatccacactggggagaagccctacaagtgtaacgaatgtggcaaggtcttcaacaggctgtctaccctggccaggcaccgtcgcctgcacaccggcgagaaaccctacgagtgtgaggagtgtgaaaaggtattctcccggaaaagccatttggaaaggcacaagcgcatacatactggggagaagccctacaagtgtaaggtttgcgataaagcatttgcttacaacagttatctcgcaaaacactctatcattcacaccggcgaaaagccatacaagtgtaacgaatgcgggaaggtgttcaaccagcaatcaacgctggcccgacaccacagacttcataccgccgagaaaccttataagtgcgaggagtgcgataaagtgtttcgctgtaaatcacacttggagcgccaccggaggatccacaccggagaaaagccctacaagtgtaaagtttgtgacaaggcttttcggtcagatagctgtctgacagaacatcagcgggtccacaccggggaaaagccatatatgtgcaatgagtgcggaaaagtctttagtacgaaagcaaacttggcctgtcaccacaagctacatacagcggagaaaccatataagtgtgaggaatgtgaaaaggtattcagcagaaaatctcatatggagcgccaccggaggatacatactggggagaaaccatacaaatgcaaagtctgcgacaaggcatttagacgcgattcgcacttagcacagcatcagcgcgtacatactggagagaagccctacaagtgcaacgaatgtggcaagacttttaggcagacttcctcgcttattatacacagaagactgcacaccggtgagaaaccctacaaatgcaacgagtgcggcaagaccttctcacagatgagttcactggtgtaccaccatcgattgcacagtggggaaaaaccgtacaaatgtaatgaatgtggcaaagtgttcaaccagcaggcccatcttgcccagcatcaaagagtccacacgggcgaaaagccatataaatgcaacgagtgcggaaaaacatttagtcagatgtccaatttagtgtaccatcaccgattacattctggagagaagccttag

SEQ ID NO: 25099 - DNA, 2157 bp, Artificial Sequence
  Description of Artificial Sequence: Synthetic coding sequence
atggccctgcctcaggggctcttgacttttcgggatgtggcaattgaattcagtcaggaagagtggaaatgtcttgaccccgctcagaggaccctgtatcgcgatgtcatgctggagaattatcgaaatctggtgagcttggatatcagctcaaagtgcatgatgaagacattcttcagtaccgggcagggcaatacggaagctttccatacagggaccctgcagcgccaggctagccatcacatcggggacttctgctttcaaaagatcgagaaggatattcacggcttccagtttcaatggaaggaggatgaaactaacgatcatgcggctccaatgacagaaattaaagagctgaccggcagtacagggcagcatgatcaacggcatgccggaaacaaacacattaaagaccagctgggcttaagctttcactctcacctacctgagctacacatctttcagcccgaaggcaagattggcaatcaagttgagaagtcaatcaacaatgctagctctgtctccacaagccaacgcatttgctgtcgaccaaagacgcacatcagtaataaatatggtaataacagcctgcatagctcactactgactcaaaagagaaacgtccatatgcgtgagaaatcattccaatgcatagagtctggcaaaagctttaattgttctagtcttctcaaaaagcatcagatcactcatctggaagaaaagcagtgcaagtgcgatgtgtacggaaaagtgttcaatcagaagcgatacttagcatgtcaccgccgttcccacatagacgaaaaaccatacaagtgtaacgaatgcggcaagatctttggtcacaacacatctctttttttacataaggccctgcacaccgctgataagccgtacgaatgtgaagagtgcgataaagtcttctccaggaagagtcacttagagacccacaagatcatctacactggcggaaaaccatacaagtgcaaagtgtgtgacaaagcctttacctgcaactcataccttgccaaacacacaattatacacacaggcgaaaagccgtacaagtgtaatgagtgtggaaaggtatttaaccgcctcagtacccttgcgaggcataggcggcttcacacaggagaaaagccatatgagtgtgaagaatgcgagaaggttttctccagaaagagccatttggaaaggcataagagaattcatactggagaaaaaccctacaagtgcaaggtttgcgacaaggcctttgcctataattcctatctggctaaacattctatcatccacacaggcgagaaaccatataagtgcaatgagtgtggtaaagtgttcaaccagcagagcacccttgcacgtcaccataggctgcatactgctgaaaagccctacaaatgtgaagagtgtgataaagtgttccgttgtaaatcccacttggaacgccatcgccgaatccacactggcgaaaagccgtacaagtgcaaggtttgtgataaagcctttaggagcgacagttgtctcaccgagcatcagagggttcatactggcgaaaagccctatatgtgcaatgagtgcgggaaagttttttccactaaggccaacctggcctgtcaccataaactgcatacagccgaaaaaccttataaatgtgaggaatgtgagaaagtcttttctcgcaaaagtcacatggagagacatcgtcggatacacaccggcgagaaaccatacaagtgcaaggtgtgtgacaaggcatttcggagagactctcatctcgcacaacatcagcgagtgcacactggcgagaaaccgtataaatgcaacgaatgtggcaagacattccgccagactagcagtctaattatacaccgccgtctccataccggagagaaaccgtataagtgcaatgagtgcgggaaaactttctcccagatgagttcgctggtttatcaccacagactgcatagcggcgagaagccatataaatgcaacgaatgcggcaaagtgtttaatcagcaagcgcatctagctcagcaccagcgagttcatacgggcgagaaaccctacaagtgtaatgagtgtggcaaaaccttcagccagatgtctaatctggtctatcaccaccggcttcacagcggcgagaaaccttag

SEQ ID NO: 25100 - DNA, 2607 bp, Artificial Sequence
  Description of Artificial Sequence: Synthetic coding sequence
atgcggggagccgcatctgcctcagtgcgggagcctacccccctgcccggtagaggtgcccctaggacaaagccgagggccggtagggggcctacagttggaacacccgctactctcgcgttgccggctcgtgggcgtcccaggtcgaggaatggcttggccagtaaggggcagcgtggcgctgcgccaactggccctggacaccgcgcacttcctagtagggacaccgcgctgccacaggaaagaaacaaaaaattggaggccgttggaacaggtatcgagcccaaggctatgtcccaggggcttgtgacgtttggtgatgttgccgttgacttcagccaagaggagtgggagtggctgaaccccatccagcgcaatctatatcggaaggttatgctggagaattacagaaatttggcgtcactcggcctttgtgtgtccaagcccgacgtgatctcatctttagaacaaggcaaggaaccttggaccgtcaaaaggaaaatgaccagggcgtggtgccctgacctcaaggcagtttggaagatcaaagagctgccgttgaagaaagatttttgtgagggcaagctgtctcaggctgtgataaccgagcgcctgacctcctacaatcttgagtactccttattaggggagcattgggactacgatgccctgttcgagacgcaacccggactagtcaccatcaagaatctcgctgtggacttccgccagcagctgcaccccgctcagaagaatttctgcaaaaacggtatctgggagaataacagtgacctggggtctgccggacactgcgtggctaaaccagaccttgtgtctctgctcgaacaggaaaaggagccatggatggtcaagcgggagttaaccggcagcctgttcagcggacaaagatcagtgcacgaaacccaggagctcttccctaagcaggactcgtatgcagagggggtgaccgatagaacatcaaacacaaagctcgactgctcaagctttcgggagaactgggactccgactacgtgtttggtcgcaaactggccgtggggcaggagacacaattcaggcaagagcccatcacccataataagaccctctctaaggagcgcgagcggacctataataaaagcggacgatggttttacctggatgactctgaggaaaaggttcacaacagagactccataaaaaattttcaaaaaagttcagtggtcatcaagcagactggcatttatgctggtaaaaagctttttaaatgcaacgaatgcaagaaaaccttcacccagtcttccagtctgaccgtccatcaacggatccacaccggcgaaaaaccatacaagtgcaatgaatgcggcaaggctttctccgatgggtccagcttcgccagacaccaacgttgccacactggtaaaaagccttatgaatgtattgaatgcggcaaggcatttatccaaaacacatcgctgatcaggcactggcgatactatcacactggagaaaaaccatttgactgcatcgactgcgggaaggctttttccgatcatatcggattgaatcagcaccgaaggattcatactggtgagaaaccctataagtgcgacgtctgtcataaatctttccgttatggaagctccttgactgtacaccagcggattcacactggagagaagccctacgaatgtgacgtgtgtcgcaaggccttcagccaccacgccagtctgactcagcatcagagagtccactcaggagagaaaccattcaaatgcaaggagtgcgggaaagcgttccgccagaacatacatcttgcatctcacctaagaatccacaccggtgaaaagcctttcgagtgcgctgagtgcggcaagagtttcagcatcagcagccagctcgcaacccaccagaggattcacacaggggaaaagccctatgaatgtaaggtatgttctaaggccttcacacagaaggcccatctcgctcagcaccagaaaactcacaccggggagaagccgtacgagtgtaaagagtgtgggaaggctttttcccaaaccacacacctgatccagcatcagagggtgcataccggtgagaaaccttacaagtgtatggagtgtggaaaggccttcggggacaactcatcctgcacgcagcaccaacgtctgcacaccggacagcgtccctacgagtgcatcgaatgtggcaaagcttttaagaccaaatctagtctcatatgccaccggagatcccacactggggaaaagccttacgagtgtagcgtgtgcggaaaggccttctcccatcgacagtctctttcagtccaccaacggatccacagcggcaagaaaccttatgaatgcaaagagtgtcgcaagactttcattcagattggccacctcaatcaacacaagcgcgttcacaccggcgagcggtcttataactataaaaagagccggaaggtattcagacaaactgcgcacttggcccatcaccagcgtatacatacaggagagtcttcgacttgtccatcccttcccagcacctccaaccccgttgacctcttccccaagtttctgtggaacccgagtagcctcccatcgccatag

SEQ ID NO: 25101 - DNA, 1629 bp, Artificial Sequence
  Description of Artificial Sequence: Synthetic coding sequence
atgggcgacatcttcctgtgcaaaaaagtggagagtccaaagaagaacctgcgagaatctaagcagagggaagaagacgatgaggaccctgacctcatttatgttggcgtggaacatgtgcacagagacgccgaagtgttattcgtaggaatgataagcaatagtaagccagtagtgagcaacattctgaacagggtcactcccggaagcaagtctcggaggaagaaaggccatttccgtcaatatcccgcacacgtttcacaacctgccaaccatgtgacctccatggccaaagccattatgccagtgagcctctccgaaggcagaagcacggatagccctgtgaccatgaaaagctcctccgaacccggatacaaaatgtcctcaccccaagtcgtgagtccaaattattccgactccttgcccccaggaacacagtgtctggtcggggcaatggtgagcggagggggtaggaacgagtcatcaccagatagcaagagattgtcaacatcagatataaattcacgagattccaaaagggtcaagttgcgcgatggcattccgggtgtcccaagccttgctgttgttccttctgatatgtcttctactatctctaccaataccccatcgcaggggatttgtaacagtagcaaccatgttcagaacggagtcacgtttccttggcctgatgctaacggcaaggcacactttaatttaacagaccctgaacgagccaacgaaagcggcctcgccatgaccgatatttccagtttggcctcacagaacaagaccttcgacccgaagaaggaaaacccaattgtgctgttatcaaacttttactatggccagcataagggcgacggccagcccgagcagaagactcataccacatttaagtgtctgtcgtgtgttaaggtcttaaagaatataaaatttatgaaccatatgaagcatcatctggaatttgaaaaacagagaaacgactcctgggaggatcataccacctgccagcattgccatagacagttccccacaccatttcagcttcaatgccacattgacagtgtgcatatcgccatgggcccatctgctgtgtgcaagatttgtgaactgtcctttgagactgaccaagtcctgttgcaacacatgaaagaccatcacaaaccgggagaaatgccctacgtttgtcaagtgtgccactatcgcagctccgtgtttgccgatgtagagacacattttagaacctgccatgaaaacacaaagaatctcctttgcttgttctgcctcaagttgttcaagacagcaatcccttacatgaatcactgttggcgccactctcggaggcgcgttttacaatgttccaagtgtaggctacagtttttaactttgaaggaggaaatcgaacacaaaactaaagatcatcagacgtttaagaagccagagcagctgcagggcttccctcgcgaaactaaggtgatcattcagacctctgtgcaaccaggatccagtggaatggcctctgtgattgtttcaaacacagacccacagtccagtcccgtgaagacaaaaaaaaaaactgctatgaacactcgtgatagccgtctgccctgttccaaggacagtagttag

SEQ ID NO: 25102 - DNA, 1632 bp, Artificial Sequence
  Description of Artificial Sequence: Synthetic coding sequence
atggagcagtcatgcgaggaggaaaaggagccagagcctcagaagaatattcaggagacaaagcaagtagatgacgaagacgcagagctcatattcgttggagttgagcatgtcaatgaggatgccgagctcatttttgttggagtgacatcaaattcaaaacctgtagtgtctaatattctcaaccgggtgactcctgggagctggtcacgccgtaagaaatatgaccatttaaggaaggatacagctagaaagcttcagcccaaaagccacgagaccgtcacatctgaggctgtgaccgtactccctgcttcgcagttggaatcacgtagcactgattctcctataatcattgagcccctgtctaagccagattacagaaattctagcccccaagtcgtccccaacaactcatcagagctacctagtcctctcattacctttacagacagcctgcaccatcccgtttcaaccgcgctcagcgttggcggtatcaatgaatcccctagagtgagcaaacagctgtccacatttgaggtaaattcaataaaccctaaacgggcaaaacttagggacggcatcatagaggggaacagctccgctagtttcccttcagatacgttccatacaatgaatacccaacagagtacgccaagcaacaatgtgcatacctcacttagccacgtccaaaatggagcaccgtttccagccgcttttcccaaggataatattcacttcaagcccatcaacaccaacttggatagggaaaatgaactggcaaagacagatatcctgtcactgacttcccagaacaagactttcgatccgaaaaaagagaaccctatcgtgctgctgtcagacttttactacgggcagcataagggggagggtcagcctgaacagaaaacacacactacatttaaatgcctttcatgtgtcaaggtcctgaagaacgtgaaatttatgaaccacgtaaagcaccatctcgaatttgagaagcagcgcaatgatagctgggagaatcatacaacatgccagcattgccataggcagttccccacacccttccagcttcagtgccacattgagaacgtgcatacagcacaggagcctagcactgtgtgcaagatttgtgagcttagttttgaaaccgaccaggtactgttgcagcacatgaaagaccatcacaaacccggagagatgccctatgtgtgtcaagtctgtcactaccggagttctgtcttcgctgacgttgagacacactttcggacctgccacgaaaataccaaaaatctcctgtgccctttctgcctgaagatctttaaaaccgctacaccatatatgtgtcattataggggtcattggggaaagagcgcccatcagtgtagtaaatgcagactgcagttcttaactttcaaggaaaagatggagcacaaaactcaatgtcaccagatgtttaagaaacccaagcagctcgagggccttccccctgaaaccaaggtgacaatccaagtgagcctcgaaccccttcaacctggctcggtcgatgtagcgtcaatcaccgtgtccacaagtgactcagagccatctttgcctcgcagtaaatctaagatatctaagaagtcacactag

SEQ ID NO: 25103 - DNA, 1632 bp, Artificial Sequence
  Description of Artificial Sequence: Synthetic coding sequence
atggagcagagctgcgaggaagaaaaagaacccgagccccagaagaatattcaggagacaaagcaagtggacgatgaggacgccgagcttatcttcgtgggcgtggagcacgtcaacgaggacgcagagcttatcttcgtgggcgtgacgtcaaactccaaaccagtcgtgagcaatatccttaaccgggtgacccccggaagttggagcaggcggaaaaaatatgatcatttaaggaaggacaccgccagaaaactccaaccgaaatcccacgagacggtaacatctgaggccgtgacagtgttacctgcttctcaactggagtcacgaagtactgattctcctatcataattgaacctctgagtaaaccagactacaggaattcgtctccacaagttgttcccaataatagctccgagctgccttccccactgattaccttcaccgattctctgcaccaccctgtcagtacagcgttgagtgttggaggaataaatgagtcaccaagggtgtccaaacagctgtcaacttttgaggtgaactccattaatccaaagcgagccaaattacgggacggtattattgagggaaatagcagcgcctcttttccctccgacacttttcacacaatgaatacacagcaaagtaccccaagcaataatgtgcacacctcacttagccacgtgcagaatggcgctccgttccccgcagcctttccaaaggacaatatacatttcaagcccatcaacacgaacctggatagagagaacgagctggctaaaactgatatcctcagcctcacatcccagaataaaacctttgatcccaagaaggaaaaccctatcgtcctgctgtcggacttttactacggccaacacaagggcgagggacaaccagagcaaaagacacatacgactttcaagtgcttatcatgtgtgaaagtgctaaaaaacgttaagttcatgaatcacgtgaagcatcatctggaattcgaaaaacagagaaacgatagctgggaaaaccataccacgtgccaacattgccacaggcaatttcccaccccatttcaactgcaatgccatatcgaaaatgtacatactgcccaagaacctagtaccgtttgtaaaatctgcgagctgtcatttgaaaccgaccaggtgttgttgcagcatatgaaagaccaccataagccaggtgagatgccctatgtctgccaggtgtgccactatagaagttcagtgttcgctgacgtagagactcatttccgcacatgccacgagaatactaaaaatcttctgtgtccattctgtctaaaaatttttaaaacagcaaccccttacatgtgtcactatagaggccattggggaaaaagtgcccaccagtgtagcaaatgccgcctgcagttcctcaccttcaaagaaaagatggagcacaaaacgcagtgtcaccagatgtttaaaaaacctaaacagctcgaaggcctccctcctgaaacgaaagtaactatccaggtgagtctcgagcctctgcaacctgggagcgtcgacgtggccagcattactgtgagcacttcagacagcgagccttctttgcctaggagcaagtccaaaatcagcaagaagtcccattag

SEQ ID NO: 25104 - DNA, 1833 bp, Artificial Sequence
  Description of Artificial Sequence: Synthetic coding sequence
atggacgatgataagccatttcagccaaaaaatatcagcaaaatggccgagttatttatggagtgcgaggaggaagagcttgaaccatggcaaaagaaggtggaggagacacaggacgaagatgatgacgagctgatcttcgtgggggaaatctcgagcagcaaacccgcaattagcaatatactgaaccggggtcactcaagcagttctagcaaaggaatcaagtccgaaccacacagccccggaatccctgagattttcagaactgcttcccaacggtgccgggacccccctagcaatccagtggccgcttccccccgtttccacctggtaagcaaatccagccaaagtagtgtgaccgttgaaaatgcttcgaaacccgacttcactaaaaatagccaggtgggaagtgacaacagctcaatcctgttatttgatagcactcaagaatccttgcccccaagccaagacatccctgccatttttagagaaggtatgaagaacaccagctatgttcttaaacatccatctacttccaaggttaactcggtgactcctaagaagccaaaaacctcagaggacgtgccgcagattaatccttccacaagcctcccccttattggaagccccccagttactagttcccaggttatgctgtcgaaagggaccaatacaagctccccatacgacgccggtgctgattatcttcgagcatgccctaaatgcaacgtccaattcaacctcctggaccctcttaagtaccacatgaagcactgctgccccgacatgatcaccaagtttctgggcgtgatcgtcaagagcgaacgaccctgcgatgaagacaaaaccgattccgagacgggaaaactaatcatgctcgtgaacgagttctattacgggaggcacgagggcgttactgagaaggagccaaagacatatactacattcaagtgtttctcatgcagcaaagtgctgaaaaacaatatccgatttatgaatcacatgaaacatcatctagagcttgaaaaacaaaataacgagtcttgggagaaccatactacatgtcagcattgctaccgccagtatccgaccccattccagctgcagtgccacatcgaaagtacacacacaccacacgaattttctaccatctgcaagatttgcgaactctcgtttgagactgagcatattttgttacagcatatgaaagacactcataaacccggtgagatgccttacgtctgccagaagaagggtgtgcaccggtgcccaaaatgccgcctgcagttcctgacatcaaaagaaaaggctgagcataaagctcagcacaggactttcatcaaacccaaagaactggaaggcctgccccctggagccaaggttactatccgcgcatcacttggcccattgcaatctaagctgccaacagccccattcggatgtgcgccaggtacaagcttcttgcaagtgactccacccacgagtcagaacacgaccgcccgtaacccacgaaagtctaacgcttcgagaagtaaaacatcaaagttgcacgcaacaaccagcacggctagcaaggtgaacacatccaaaccgaggggccgaattgccaaaagcaaagcaaagccatcctacaaacaaaagcggcaacgaaaccgcaagaacaaaatgtccctggcactcaagaatattcgttgtagacggggtattcacaagtgcattgaatgtcacagcaaaattaaagactttgccagtcacttctcaatttacattcactgctcgttctgtaagtacaacactaattgtaacaaggcctttgttaatcatatgatgtag

SEQ ID NO: 25105 - DNA, 2214 bp, Artificial Sequence
  Description of Artificial Sequence: Synthetic coding sequence
atggacgatgataagcccttccagcccaagaacatctccaagatggcggaactctttatggaatgcgaagaggaggaactcgagccttggcaaaagaaagtagaagaaacgcaggatgaggatgatgatgagctcattttcgttggggagataagtagtagcaaaccagctatctcaaacatattaaatagagggcattcctccagtagttccaagggcatcaagagcgagccgcattcaccaggcatcccggagatcttcaggaccgcatcccagcggtgcagggaccccccatccaatcctgttgcagcctccccaaggtttcacctggtatctaaaagtagccagagctctgtcaccgtggaaaacgcttcgaagccagactttacaaaaaattcacaggtgggatcagacaactctagcatcctgttgtttgatagcactcaggagtctctgccaccatctcaggacattcccgcaatattccgggaggggatgaaaaatacttcctacgtgcttaaacacccctcaacctccaaggtgaacagcgtcacgcctaaaaaaccaaagaccagcgaagacgtgcctcagattaatccatcaactagtctgcctctgattggatcaccgcctgttacctcatctcaggtgatgctaagcaagggcaccaacacatcaagtccttatgatgccggtgccgactatctccgggcatgccctaaatgcaatgtccagtttaacctgctcgatcctttgaagtatcatatgaagcactgctgcccggacatgattaccaaattcctgggagtgatcgtcaagtctgaaagaccttgcgacgaagacaagacagacagcgaaaccggcaaacttattatgttagtgaatgagttctactacggcagacacgagggggtgaccgagaaggagccaaagacctacactacctttaaatgcttctcttgctcgaaggtgctgaagaataatattcgctttatgaaccacatgaagcatcatttggagttggagaagcaaaacaacgagagttgggagaatcacacaacatgtcaacactgttatcggcaatacccaactccatttcagctgcaatgccacattgagtccactcacactccccatgagttttctactatatgtaagatctgtgagctgagttttgagactgagcacatcttactgcaacacatgaaagacacgcataagccaggcgagatgccctatgtgtgccaagtttgccagttccggtcatccacattttctgatgttgaggcccattttcgagccgcacacgagaacacgaagaatctgctctgcccattctgtctgaaggtatccaagatggccaccccctatatgaaccactacatgaagcaccagaagaagggagttcatagatgcccaaaatgtaggctgcagtttttgacaagtaaggaaaaagctgagcataaggctcagcacagaacatttataaagcccaaggaattggagggcctacccccaggggctaaagtcacaatacgtgcatccctggggccacttcagagcaagctccctactgcaccctttggctgtgctcccggtacgtcttttctgcaggttacacctccgaccagccagaacaccacagctcgtaacccgaggaaaagtaatgccagccggagcaagacttccaagctccacgcaaccacatctaccgcgtcaaaggtgaatacctctaaaccacgcggacgcatagctaagagtaaagcaaaaccatcatataagcagaaacgccagcgaaatcgtaaaaataagatgtcactggcacttaaaaacattcgttgccggagaggcattcacaaatgcattgagtgtcatagcaaaatcaaggatttcgcgtctcatttctctatatacatacattgctcgttctgtaagtacaacaccaactgtaataaagcctttgtcaaccacatgatgtcctcccactcaaatcatccaggcaagagattttgtattttcaagaaacacagcggaactttgcgaggaatcactctggtgtgccttaagtgcgactttttggctgattccagcggtctggacaggatggccaagcatctgagccagcgaaaaacacatacttgccaggttatcatcgagaatgtgtccaagagtacatccacttcagagccgacgaccggctgtagcctcaagtag

SEQ ID NO: 25106 - DNA, 1833 bp, Artificial Sequence
  Description of Artificial Sequence: Synthetic coding sequence
atggatgacgacaagccattccagcccaagaatattagcaaaatggccgagctgttcatggagtgtgaggaggaggagcttgaaccatggcagaaaaaggtcgaagagacgcaggatgaagatgacgacgaactgatctttgtcggagagatctcgtcctccaagccagcgattagtaacatccttaaccgaggacacagtagctcttcctcaaagggtatcaagtccgagccacattcacccggaattccagagatttttcggaccgcatcccaacgatgtagggaccctccttccaatccagtagcagcctcccctcggttccatttagtgagtaaatcctcccaaagttctgtgaccgtggaaaatgcaagcaaacccgattttacaaagaattcgcaggtgggatccgacaactcatccattctgctgtttgacagcacacaggagtcactgcccccatctcaggacatcccagcaatctttcgtgagggaatgaaaaatacaagctacgttttgaagcatccttcgacgtcaaaggtcaatagcgtgacaccaaagaaaccaaagacttctgaggatgtcccacagattaacccctccactagcttaccacttattggtagtccacctgttacttcttctcaggtcatgctgtccaagggcaccaacacgagtagcccatacgacgcaggcgctgactatctgagagcttgtcctaaatgcaacgtccagttcaacctgcttgatcccctcaagtaccacatgaagcattgctgccccgatatgattactaaattcttgggagtgatcgtaaaaagcgaaagaccctgcgacgaggacaagaccgacagcgagaccggaaagttaatcatgctggtgaacgagttttattacgggagacatgagggtgttacagagaaggaaccaaaaacctataccactttcaaatgcttcagctgtagtaaggtgttaaagaacaatattagatttatgaaccacatgaagcatcatctggaactggagaagcagaacaacgaaagctgggagaaccacactacttgtcaacactgctatcggcagtaccctaccccttttcagctgcagtgccacatcgagtccacgcacaccccacatgagttttccactatctgcaaaatatgtgagttatcttttgaaacggaacacatcctgctgcagcacatgaaggacacccataagcctggggaaatgccatacgtgtgtcagaaaaagggagtccaccgttgtcctaagtgtcgtcttcagtttctgacatccaaggaaaaagctgagcataaggcacaacaccgtacattcatcaagcctaaagaactggagggcctgcccccaggggcaaaggtgacaatacgcgcatctttgggcccacttcagagtaagctaccaactgccccatttggatgcgcccctggtacaagttttctccaggtaacgcctcctacctcccaaaataccactgctcggaatccaaggaaaagtaacgccagtcgctccaaaacaagcaagcttcatgctaccactagcacagctagtaaagtgaacactagtaaacctcgaggaagaatagctaaatccaaagccaaaccttcatataagcagaagcgacaacgaaataggaaaaacaagatgagcttggcgcttaaaaacattcggtgccggcgtggcatccacaagtgcatcgaatgtcattctaaaatcaaggacttcgcatctcattttagcatttatatacattgctctttttgcaagtataatacaaactgcaataaggcgttcgtcaaccacatgatgtag

SEQ ID NO: 25107 - DNA, 909 bp, Artificial Sequence
  Description of Artificial Sequence: Synthetic coding sequence
atggccggtatgtcagagagtagctttttaagcaagcggccatcaacctcggaagtgaataatgtcaacccaaaaaaacctaaaccttccgaaagcgtgtctggcgctaattctagcgctgttctcccgtctgtcaaaagccccagtgttactagttcccaggctatgctggcaaaggggacaaacacttcgagcaaccagagcaaaaacgggaccccattccccagggcctgcccgaagtgtaacatccactttaacttgctggacccactcaagaaccatatgaaatattgctgtcctgacatgataaataattttcttgggttagcgaagacggagttcagctccacagtgaacaaaaatactactatcgattccgagaagggcaagctgattatgttagtcaacgatttctactacgggaagcacgagggcgatgtgcaggaggagcagaagacccacaccacattcaagtgctttagctgcctaaagattctgaagaataacatccggttcatgaaccatatgaagcatcatctcgagttggaaaagcaatctagcgaaagttgggaaaaccacacgacgtgtcagcactgttacagacaattccccacgcctttccagctgcagtgtcacattgagagcacccacactccccatgagttttcaacgatctgtaagatctgcgaactgagctttgaaacggaacacgtcctgctccagcacatgaaagacaatcataaacctggcgagatgccatacgtgtgtcaggtctgcaattaccgtagtagctcttttagcgatgtggagactcacttcaggacctcccacgagaatactaaaacctgctatgcccgttttgctagcaaactgctgaagctgcagcaccacatctgcatcataatctag

SEQ ID NO: 25108 - DNA, 2940 bp, Artificial Sequence
  Description of Artificial Sequence: Synthetic coding sequence
atgggggacaatcctttccagcccaaatccaatagtaagatggcagaactgttcatggagtgtgaggaggaagagcttgaaccctggcagaagaaggttaaggaagtcgaggatgacgacgacgatgaaccaatttttgtcggggaaatatcgtcctccaagcccgctatctctaatatcctgaacagagtgaacccttccagctactctagagggctgaaaaacggcgcattgtcacgcggtataaccgccgcatttaagcccacatcccagcattacacaaatcccacaagcaaccctgtgccggctagccctattaacttccaccctgaaagccggtctagcgacagcagcgtaatagtccagccctttagtaaaccaggatatattacaaatagtagccgggtcgtgagcaacaagtccagtgagttgttgtttgacttgacccaggacaccggtctttctcactatcagggagggccaacactgagcatggctggaatgtcggaaagcagttttctgtccaagaggccctctacaagtgaggtgaataatgtcaatccgaaaaagcccaaaccaagcgaatctgtcagcggggctaactcatcagcagtgctgccttctgtgaaatcacctagcgtgaccagttcccaggccatgctggcgaagggaaccaatactagctccaaccagagtaagaatgggacaccttttccacgcgcatgtccaaaatgtaacatccatttcaatcttctggatccactgaagaatcatatgaagtactgttgtcccgacatgattaacaacttcctagggctagcaaagaccgaatttagtagtaccgttaacaaaaatactactatcgatagcgaaaagggcaaattgatcatgcttgtcaatgacttctactacggtaagcacgaaggcgacgttcaggaagagcagaagacacacacaacattcaagtgtttttcttgtttgaaaattctaaagaataacatccgcttcatgaaccacatgaaacaccatttggagttggagaagcagagcagtgagtcctgggagaaccacacgacctgccaacattgctaccgtcagtttccgactccttttcagctccagtgtcatatcgagagtactcataccccacatgagttcagcaccatctgcaagatctgtgaactctcctttgaaaccgaacatgttttgctgcaacatatgaaagataatcacaagcccggagaaatgccatatgtatgccaggtctgtaattataggtcgagcagcttttcagacgtggaaacacatttccgaaccagccacgagaatacaaaaaacctcttatgccctttttgtctgaaggtaattaagatagcaacaccatacatgcaccactacatgaagcaccaaaaaaaaggtattcacaggtgtaccaaatgtagattacagttcctgacatgcaaggaaaaaatggaccataagactcagcaccaccggaccttcatcaagcccaagcagctggagggattacccccagggactaaagttaccatacgtgcaagcgtcggacccctccaaagtggagccagccctactcctagcatctcagcttccgctagcacactgcaactcagccctccgcgaacaaagaatatcaccgcaaaaaatcccgcaaaatctaatacaagcaaacctaacaccgtgaaatcgaatgccagcaaacccaatacttcaaagccaaacggctccaagtcaaagtataagcccaagataagtaatatgcaaaaaaaacagtcaactctcgcctcttcaaacaagaaaagcaaggttaataccgcgctccggaatctcaggtatcgaaggggtatccacaagtgcatcgaatgttgctcggagatcaaggattttgccaaccacttccctacatatgtgcactgttccttctgtagatataacacttcgtgctctaaggcctacgtgaaccatatgatgtcttttcatagcaatagaccttctaaacgcttttgtattttcaagaagcatagcgagaatctccgcggtatcaccctagtctgtctgaactgcgacttcctgagcgatgtgtccgggctcgacaatatggcgacacacctgtcgcagcacaagacccacacttgccaagtggttatgcagaaggtgagcgtctgtataccaacttccgaacatttgtctgaactcaaaaaagaggcgcctgcaaaggagcaggaacccgtgagtaaggaaatcgccagaccaaacatggctgagcgagaaaccgagacatccaattcagaaagcaagcaggataaggccgctagttccaaggagaaaaatgggtgtaacgctaattcattcgaagggagctccaccacaaaatctgaggagtccattacagtatctgataaggaaaatgagacgtgtttggctgatcaggaaacgggttcaaagaacatcgtgagctgtgattcaaatatcggagcagacaaagttgagaaaaagaaacaaatccagcatgtgtgccaggaaatggaactcaagatgtgtcaatcttccgaaaatattattcttagcgatcaaatcaaggatcacaacagctccgaagctcgtttcagcagcaagaatataaaagacctgagactggcttctgacaatgtgtccattgaccagttccttcgcaagcgacatgaaccggagtccgtctcttctgacgtgtcagagcagggatctatccatctggagccactaactcctagtgaagttttggaatacgaggcaaccgaaatactccagaagggtagcggggatccctcagctaaaaccgacgaagtggtttctgaccagaccgacgacatcccgggaggtaataatccctcaactactgaagccaccgtggatctcgaggacgaaaaggaacggagctag

SEQ ID NO: 25109 - DNA, 1266 bp, Artificial Sequence
  Description of Artificial Sequence: Synthetic coding sequence
atgctggtcaacgatttctactatggcaaacacgagggcgacgtgcaggaagagcaaaagactcatacaactttcaaatgtttcagctgcctgaaaattctgaaaaataacatcaggttcatgaatcatatgaaacatcacttggagctggagaaacagagttccgagagttgggagaatcatacaacctgtcagcattgctatagacagtttccaacaccatttcagctgcaatgccacatcgagtccacccacaccccccacgaattcagcacgatctgtaagatttgtgagctcagctttgaaactgagcacgtcctgctccagcacatgaaggacaatcataagcccggagagatgccatacgtttgtcaggtgtgcaattatagaagcagctccttctcagatgttgaaactcatttcagaacatctcatgaaaatacaaagaacctcctctgccctttttgcctcaaagtgataaaaatcgcaaccccctacatgcaccactatatgaagcaccagaaaaaggggatacacagatgcaccaagtgccggctccagttcctgacatgcaaggaaaaaatggaccataaaacacaacaccataggactttcattaaaccaaagcagttggaaggcttgccccctggcacaaaagtcacaatccgggctagtgtgggtcctctacagagcggggctagccccactccttcaatttccgccagcgccagcaccctgcaactgtcccccccacgcacaaagaacattaccgccaaaaatccggcaaagtctaatacgagtaaacctaacaccgttaagtctaatgcttctaaaccgaacacctcaaagcctaatggcagcaaatctaaatacaagcccaagataagtaacatgcaaaagaaacaaagcaccctggcgtcttctaataaaaagagcaaggtcaacacagcactacgaaacctcagatacaggcgaggaatacataaatgcatcgagtgttgttccgagattaaggactttgctaaccattttcccacgtacgtgcactgttccttctgtcggtacaacacatcttgcagcaaggcctatgtgaaccatatgatgagtttccacagtaatcgaccctccaaaagattctgtatcttcaagaaacactctgagaatctcagatgcgttgggggtcagatcgaatgcgatctgccgaagctacataagctggtggtcgaaccgagactcacactagggttactgactcctaacttctag

SEQ ID NO: 25110 - DNA, 2901 bp, Artificial Sequence
  Description of Artificial Sequence: Synthetic coding sequence
atggctgaattattcatggagtgcgaggaagaagaattggagccatggcagaaaaaagtaaaggaagtggaggacgacgacgacgacgaacctatcttcgttggggagatctctagcagcaaaccggcaatctccaacatcctgaacagagtcaatcccagctcttatagtcgcggactcaaaaatggagccctatcccgtgggattaccgcagccttcaaaccaacgagccagcattacactaaccccactagcaaccccgttcctgccagccctatcaatttccatcccgaatcgcgctccagtgactcctctgtgatcgtgcagcccttcagtaagcccggatatatcactaattcatcacgcgtggtatcaaataaaagctctgagctcctcttcgatttgacacaggacactggcttatctcactatcagggcggaccgacgttaagtatggcgggaatgtcggaaagcagctttctctcgaagagaccctctacctccgaagttaataacgtcaaccctaaaaaacctaagccttccgagtcagtgtctggagccaatagcagcgctgtcttacccagcgttaagagcccttccgtaacctcatctcaggcgatgctagccaagggaacaaatacttcatctaaccagtccaagaatggcactcccttccccagggcgtgccctaaatgtaacattcattttaacttactggaccccctgaagaaccacatgaagtattgttgtcccgatatgatcaataactttttaggcttggctaaaactgagttcagctccaccgttaacaaaaatactactattgattctgaaaaaggcaaattgatcatgctggtgaacgatttctattacggcaagcacgaaggggatgttcaagaggagcagaaaacgcataccacctttaagtgtttctcatgtctcaagatcctcaaaaacaacatccgcttcatgaatcatatgaagcaccacctggagctggagaaacaaagctccgaaagttgggagaaccacaccacctgccaacactgctaccgccagtttccgaccccttttcaactccagtgtcatatcgagtctacacacaccccacacgaattcagcactatctgcaagatctgcgagctcagttttgaaaccgagcacgtgctcctgcaacatatgaaggacaaccacaagccgggtgaaatgccttacgtctgtcaggtatgcaactatcgctcatcctcctttagtgacgtcgagacccattttagaaccagccatgagaacactaaaaacctgctctgccccttctgtctgaaggtgattaagatcgcaacaccatacatgcaccactacatgaagcatcagaaaaaagggatccatcgctgtaccaaatgtcgactgcagtttctaacctgcaaagaaaagatggatcataagactcagcaccatcggacctttataaaaccgaagcagttagaagggttgcccccaggaaccaaagttaccatacgggctagtgtgggaccccttcaaagcggcgctagccctactccgtctatctcagcctctgcaagtacacttcagcttagcccaccccgtaccaaaaacataaccgcgaagaatccagccaagtccaatactagtaaaccaaacacagtgaaaagcaacgcgtcaaaacccaacacttccaagcctaacggatctaaaagcaagtataagcctaaaattagcaacatgcagaaaaaacaatccactctagccagcagcaataagaagtcaaaagtaaacaccgccctcaggaacctgcggtatcgcagaggaattcacaaatgcatagagtgctgtagtgaaataaaggatttcgcaaaccacttcccaacctacgtgcattgttccttttgtagatataataccagttgttctaaggcctatgtgaatcacatgatgagcttccacagcaatcggccaagcaagcggttctgtatcttcaaaaagcactccgagaacttgcgtggcatcactctggtttgtcttaattgcgacttcctgagcgatgtctcagggcttgataatatggcgacccacttgtcacagcataagacacatacttgccaggttgtgatgcaaaaggtctctgtctgtatccccacctctgagcatctgtctgaattgaaaaaggaggctccggctaaggaacaagaaccagtttcaaaggagatcgccagaccaaacatggcagagcgggagacagagacctctaatagcgagtccaagcaggacaaggccgcaagctccaaggagaagaatggctgcaatgccaactcattcgaggggtcctctaccaccaagtcagaggagtccataaccgtgagtgataaagagaatgagacatgtctagccgaccaggaaacaggtagtaaaaacatcgtcagctgtgatagtaatattggagccgacaaggtggagaagaagaaacaaatccagcacgtctgccaggaaatggagcttaagatgtgccaaagctccgaaaacatcattctgtccgatcagattaaagaccataatagtagcgaggccaggttctcttccaagaacataaaggatctgaggttggcctcagacaacgtgagtattgaccaattcttacggaaaaggcatgaaccagagagtgtatcgagcgacgtgagcgagcagggatctatccacctcgagcccctgaccccctcagaggtgttagagtatgaggccactgaaattcttcaaaagggctcaggagacccgtccgcgaaaaccgatgaagtggtctccgaccagacagatgacatccctggaggcaacaacccctctacgacagaagctaccgttgatctggaggacgaaaaagaacggtcttag

SEQ ID NO: 25111 - DNA, 2244 bp, Artificial Sequence
  Description of Artificial Sequence: Synthetic coding sequence
atggctgaattgttcatggagtgcgaggaggaagaactcgagccgtggcagaaaaaggtaaaggaggtagaggatgacgatgacgatgagccaatcttcgtgggcgagatcagctctagcaagccagctatctcaaacatcctgaatcgggtgaacccatcctcatatagtaggggcctgaagaacggggctctgtcccggggaattacagccgctttcaaacctacttcccagcactataccaaccccacaagcaaccccgtccctgcttcaccaattaacttccatccagagagtcggagttcagatagttccgtaattgtgcagccgttcagcaagcctggatacatcacaaacagttctcgcgtggtgtccaacaaaagcagcgagttgctcttcgaccttacccaagacacaggcctgtcacactaccagggtggcccaacactctctatggccggaatgagtgaatcctctttcctgtctaagcgtccttcaacatcagaagtaaacaatgttaacccaaagaaacctaagccatctgagtctgtttcgggcgctaattcctcagctgttctgcccagtgtaaaatcaccctcggttacttccagccaggccatgctcgctaaaggaactaatacatcatcaaaccagtcaaagaacgggaccccttttccccgtgcatgtcccaagtgcaatattcatttcaatttgttagatcccctgaagaaccatatgaagtattgttgtcctgacatgataaataatttccttgggttggcaaagacggagttctcctcaaccgtgaataagaacactacaatcgactcagaaaaggggaaactgatcatgctcgtgaacgatttttattatggtaagcatgagggcgacgtccaggaggagcaaaagacgcataccacctttaagtgtttttcctgtctaaagattcttaaaaataacattagattcatgaaccacatgaaacaccaccttgagctggaaaagcagtcaagcgagagctgggagaaccataccacgtgccagcattgctacagacagttccccacaccattccaactacagtgccacatcgaaagtacccacacaccccatgagttcagcacaatttgcaaaatctgtgaactctcttttgagaccgaacacgtcctcttacagcacatgaaggacaaccataaacccggagaaatgccctatgtctgccaggtatgcaactacaggagttcctcattcagtgacgtcgagactcacttcagaacaagccacgagaacacaaaaaacctactgtgtcctttttgtttgaaagtaataaagattgcaactccgtacatgcaccattacatgaagcaccaaaaaaaaggaatacatcgatgtacgaagtgcaggctgcagttcctgacctgcaaagagaaaatggaccacaaaacacagcaccaccggactttcattaagcctaagcagttggaggggttgcccccagggactaaagttacgatccgtgcttccgttggaccgttacaatcaggtgcctccccgactccgagcattagcgccagcgctagcacgctccagctcagtccacctaggactaagaacatcacggcaaagaacccagcgaagtcaaacacgtccaagccgaacacagtaaagtcaaatgcctccaagcccaatacaagtaagccgaacgggagcaagagcaagtataagcccaaaatttctaatatgcaaaaaaagcagtctacgctcgcctcgagtaacaagaaaagtaaagtaaacaccgctctgaggaatctacgatatagacgcggtatccacaagtgtatcgagtgttgctccgagatcaaggacttcgctaaccacttcccaacttacgtgcactgctcattttgccgatataatacatcatgttccaaggcctacgtgaatcatatgatgagctttcattctaaccgcccaagcaaacgcttctgtatttttaaaaagcatagtgagaacctgcgaggaatcacccttgtctgtctgaattgtgatttcttatctgatgtgtcggggctcgacaatatggccacccatctatcgcagcataagacacacacctgccaggttgtcatgcagaaggacgcagaagccgctcagaggtttcagaagatcagccgggtatacttggactccgtgcccctcagatggactcagcttatgccggtattgtcattccagggaatgtag

SEQ ID NO: 25112 - DNA, 243 bp, Artificial Sequence
  Description of Artificial Sequence: Synthetic coding sequence
atgggtgacaatccatttcagcccaaatccaactcaaagatggcagagctctttatggagtgcgaggaggaagaactggaaccttggcagaaaaaagttaaagaagttgaggacgacgacgatgacgaacctatcttcgtaggggagatatcaagtagtaaaccagccatttctaacatattgaatagggttaacccaagcagctactctagagggttaaaaaatggggcactgtcacgatag

SEQ ID NO: 25113 - DNA, 477 bp, Artificial Sequence
  Description of Artificial Sequence: Synthetic coding sequence
atgggagacaacccattccagcctaagtccaactcaaagatggctgagctcttcatggaatgtgaagaggaggaactagaaccctggcagaaaaaggtgaaggaggttgaggatgacgacgatgatgagccgatcttcgtgggtgaaatttcatcctctaaacccgctattagcaatattctgaaccgggtaaacccatcttcttacagccgaggtttgaagaatggagctttgagccgaggaattactgccgcttttaaacccacctcacagcactatactaatcccacatctaacccagtccctgcctctcccattaattttcaccctgagtctcgcagcagcgattctagcgtgattgttcagcctttctctaaaccagtaagtgtgtcaaagactatcagaccagcccagggatcgatagggtgttgcttgtccatatcaaccgtgccaagttataattcaggtctatcctag

SEQ ID NO: 25114 - DNA, 2901 bp, Artificial Sequence
  Description of Artificial Sequence: Synthetic coding sequence
atggccgaactgttcatggagtgtgaagaagaggaattagaaccatggcagaaaaaggttaaggaagtggaagatgatgatgatgatgaacctatcttcgttggggaaataagctcaagcaagccagcgattagtaacattctgaaccgtgtcaacccatcctcttattctagggggctgaagaatggggctttgtcacgaggcattacggcagccttcaaaccaacttcacagcattacacaaaccccacgagcaacccggttccggcatccccaattaattttcaccctgagagtcggagctctgactcatcggtcatagtgcagccatttagtaaaccaggctatatcaccaactccagccgggttgtgtccaacaaaagctcagaactgctgtttgacctaactcaggatactggcctgtcacactatcaagggggacccaccctgagtatggctggcatgtccgagagcagcttcttgtctaaacgccctagtaccagtgaggtgaataacgtcaatcccaaaaagccaaaaccttctgaatcagtgagtggtgcaaatagcagtgctgtgctcccctctgttaagtccccaagcgtgacatcttcgcaagctatgttggctaaaggaaccaacacgagctccaatcaatccaagaatggaaccccttttcccagagcttgcccgaaatgcaatattcacttcaacttgctggatccactcaaaaaccatatgaagtattgctgccctgatatgattaataactttctaggactagcaaagactgagttctcttctacagtgaacaagaacacgaccatcgacagcgagaaagggaagctcattatgcttgtgaatgatttctactacgggaaacacgagggcgatgttcaggaagagcagaaaacccacactacctttaaatgtttctcttgcctgaaaatattgaaaaacaacatacgctttatgaatcacatgaaacatcatctggaactggaaaaacaaagctccgaatcgtgggagaatcatactacatgccaacattgttaccggcagtttccaacaccattccagttacaatgtcatattgagtcaacacacactcctcatgagttttcaacgatctgtaagatctgtgagctgtcctttgagaccgagcacgttcttctacaacatatgaaggataaccataaacccggagagatgccttatgtatgccaggtttgcaactaccggagttctagcttcagtgatgtggagacacacttccggacatcccatgaaaacacaaagaacctcttatgccccttctgtctgaaagtgattaaaatcgctacgccatacatgcaccattacatgaaacatcagaagaaaggtatccataggtgcactaagtgtcggttgcagttcctgacatgtaaggagaagatggatcataagactcagcatcacagaacctttattaaacccaaacagttggaagggctaccccctggcacaaaggtcaccatcagagcctctgtaggaccactgcagagcggtgccagcccgacaccctcaatctctgcatcggcgtctacgctgcaactcagccccccacgaacgaaaaatattactgccaaaaaccctgccaaaagcaacacatctaagcccaatacagtgaagtccaatgcgtcaaaacccaatacctctaaacccaacggctctaaatcaaagtacaagccgaaaatctccaatatgcaaaaaaaacaatccactctggcatcctcgaacaaaaagtctaaggttaacacggcactgcgaaacttaaggtacaggcgcggaattcataaatgtatagagtgttgctccgaaattaaggacttcgccaatcactttccaacttacgtccattgtagcttctgtcggtataacacctcctgctctaaagcctatgtcaatcacatgatgagtttccattccaatagaccaagcaagaggttttgtatattcaagaagcatagcgaaaatctgagaggtattaccctggtttgtctgaattgtgacttcctgtcggacgtgtccggcctcgataatatggccacgcacctgagtcagcacaagacccatacttgtcaggtggtgatgcagaaagtcagtgtgtgtattcccacgtcggagcacctgtcggagcttaaaaaagaggccccagccaaggagcaggagcccgtgtcaaaggagatcgctcgcccaaacatggccgaaagggaaaccgagactagcaattctgaatcaaagcaggataaagccgcatcctccaaagaaaaaaacggttgcaacgccaattctttcgaggggagttctactacaaagtcggaggaatccattaccgtgagcgacaaggagaacgagacctgcctggcagatcaggagaccggatctaaaaacattgtatcctgtgactctaacatcggcgctgacaaagtcgagaaaaagaagcaaatccagcacgtgtgtcaggaaatggaattaaagatgtgccagtcttctgaaaacatcattctctccgaccagatcaaggatcacaactcatctgaggctagattttcctccaagaatataaaggatttgcgactcgcatccgataacgtttctatcgatcaatttctaagaaaacggcatgaacccgaatcagtcagcagcgatgtgtctgaacagggatctatccacctcgaacctctaacgccctctgaggttctcgagtacgaagccacagaaatcctgcagaaggggtccggagaccccagtgccaagactgacgaggtcgtgagtgaccagactgatgacattccgggaggtaacaacccctccacaacggaggcaacagtggaccttgaggatgagaaagaaaggtcctag

SEQ ID NO: 25115 - DNA, 2688 bp, Artificial Sequence
  Description of Artificial Sequence: Synthetic coding sequence
atgaaaatcgggtccggctttttgagtggcggtggaggaactggcagctctgggggatccggcagcggcggtggtggctcgggaggtgggggaggaggcggatccagtgggaggcgagctgaaatggaacccacctttcctcaaggaatggtgatgttcaaccaccgactccccccagtaaccagttttactcgaccagcaggtagcgcagctccgccacctcagtgtgtgctcagttcaagcacctctgccgcaccagctgccgagccccctcctccccctgctccagacatgaccttcaagaaagagcctgctgcctccgctgctgcgtttccttcacagcggacgtcgtggggttttttgcaatccctcgtgtcgattaagcaagaaaagccggctgacccagaggagcagcagtcacatcaccatcaccaccaccatcattatggaggtttgttcgcaggggctgaagagcgttcccccggtctcggaggcggagaggggggtagccatggagtcatccaggatctttccattctgcatcagcatgtccagcaacaaccagctcaacaccaccgtgacgtgctcctctcgagctcctcccggactgacgaccatcacgggaccgaggaacctaagcaggacacgaacgtgaagaaggccaaaaggcctaagcccgaatcccagggcataaaggccaagcgcaagccctccgcctctagcaagccatcattggttggagatggagaaggagccatcctgtcgccgtcacaaaaaccacatatttgtgaccattgctcagcagctttccgctcaagttatcatttgagaaggcatgtgcttatccataccggtgaacggcctttccaatgctcccagtgttctatggggtttatacagaagtaccttcttcagagacacgagaagattcatagccgagagaagccgttcgggtgcgatcaatgttcaatgaagtttatccagaagtatcatatggaacgccacaagaggactcactccggggagaagccatataagtgcgatacttgccagcagtatttctccaggactgatcgactcctcaagcatcggaggacgtgcggagaagtcatcgttaagggtgccaccagtgcggagccgggtagttccaaccacaccaatatggggaacctggccgtgctgagtcagggtaacacgagcagctcacggcgaaagaccaaaagtaagtctatcgctatcgagaacaaagaacagaaaaccggaaagaccaatgaaagccagatatcaaacaacatcaatatgcaatcctactcggtggaaatgcccactgtctctagctccggcggaatcattgggacagggatagacgaactacagaagcgggtacccaaactgatttttaagaaagggtcccggaagaatacggataagaattatctgaatttcgtttctcccctgccagacatcgtgggccaaaagtcattatcagggaagcctagtggatcactgggcatcgtaagcaacaattctgtcgagactatcggtcttttacagtccacaagcggaaaacaaggccagatctcaagcaattatgatgatgcaatgcagttctccaagaagcgtcgctatctgcccactgcctcttctaattccgcattcagcattaatgtggggcacatggtctcacagcagagcgttattcagagcgccggagtgtctgttctggacaatgaggcccctctgagtctgatcgacagcagcgccctgaacgccgagatcaaatcctgccacgacaagtcgggaatcccagacgaggttctgcagtctatcttagaccagtattcaaataagtctgaatctcagaaggaggacccctttaatattgccgagccacgggtggatcttcacacaagcggagaacactccgagctcgtgcaagaggagaacctgtcacctgggacccagactccatccaatgataaggcctcaatgttacaggagtattcaaagtacctgcagcaggcttttgagaaaagtacaaacgcctctttcactctgggacacgggtttcaattcgtcagcttaagtagcccattacataatcatactttgttccctgagaaacagatctacacgacttcacctctcgagtgcggctttgggcaatcagtcacctctgtccttccatcgtccttgccaaagccaccatttggaatgttgttcggaagccaaccagggttgtacctcagcgcgttggatgccacgcatcaacaattaaccccatcgcaggaacttgatgacctgatcgacagtcagaagaacctggaaaccagttcagcctttcaaagcagctcccagaaactgacatcccagaaggaacagaagaacctggaaagctcaaccggatttcaaattccatcccaggagttggctagtcagatcgatccacagaaggatatcgaaccacgcaccacttatcaaattgagaactttgctcaagcctttggaagccaattcaaatcaggctccagggtccccatgacctttattaccaattccaatggggaagttgaccatcgcgttcggacttccgtatcagatttttcgggctacaccaacatgatgagtgatgtatctgaaccctgttccactagagtgaagactccgacttctcagtcttatcgttag

SEQ ID NO: 25116 - DNA, 2580 bp, Artificial Sequence
  Description of Artificial Sequence: Synthetic coding sequence
atgaagatcggatctggttttcttagtggcggaggtggcacaggttcttcaggaggttctggaagtggcggaggtggtagcgggggaggcggagggggtggcagctccggaagaagagctgagatggaacccacctttccccaggcccctgctgccgaacccccaccccctcccgctcccgacatgacatttaagaaagaaccagcagcatccgcagcagcattcccaagccaaagaacctcgtggggattcctccagtccctggtctccatcaagcaggaaaagcctgccgacccagaagagcagcagtcccaccaccaccatcatcaccaccactatgggggactgttcgccggagctgaggaacgatcgccgggactgggtggtggtgagggtggatctcacggagtaatacaagacctctccatcctgcaccagcacgttcagcagcaaccagcccagcaccatcgggacgtgttattaagctcctcaagccgaactgatgatcaccacggcactgaggagcccaagcaggacacaaacgtgaagaaagcgaaaagacctaaacccgagtcacagggcatcaaagctaaaagaaagccttctgcctcaagcaagcctagcctggtaggggacggggagggcgctattctgagtccatcacaaaaacctcacatctgtgatcactgtagcgccgctttcagaagctcctaccatcttcgacgccacgttctgattcacacaggggagcggccattccaatgctcacagtgttccatgggatttatacaaaagtatcttttgcagcggcacgaaaagatccattcacgcgagaaaccttttggctgtgaccagtgtagcatgaaattcatccagaagtatcacatggagcgccacaagcgtacccactctggggagaaaccctataaatgtgacacttgccaacagtatttttcccggacagatagattacttaaacatcgaagaacatgcggtgaggtgatagttaagggagcaacttctgcagaaccaggctcctccaatcataccaatatgggtaatctggctgtcctgtcacaaggcaatacctctagtagccggaggaagactaaaagcaagtctatcgccatcgagaataaggaacagaaaaccggtaaaaccaacgagtcccaaatttctaacaacatcaacatgcagtcctacagcgtagagatgccgaccgtctcctctagcgggggaataattggaaccggcatcgatgaactccagaagcgcgtaccaaagctgatattcaagaagggctccaggaaaaacacagataagaactatctgaatttcgtttctcctctaccagacatcgtcggccaaaagagcctgagtggtaaacctagtgggtctcttggaattgtaagtaataatagtgtcgagactattgggttactgcagagcacatcggggaaacaagggcagataagctccaactacgacgacgccatgcagttcagcaagaagcggaggtatcttcctaccgcttcctctaattctgccttttcaattaacgtcgggcatatggtcagtcagcaatctgtgattcagtcagcaggcgtgtcagtgctggacaatgaggccccactctctctaatcgacagtagtgctctgaacgccgaaatcaaaagttgccatgacaaaagtggaatccccgacgaggttttacaaagcattcttgatcagtattctaacaaatccgagtctcagaaggaggatccgttcaatatcgccgagccacgggtggatttgcacacctccggggaacactctgagttagttcaggaggagaacctgagcccaggcactcagacaccatcaaatgataaggcaagcatgctgcaagagtatagtaaatatcttcagcaagctttcgagaaatctacaaatgcctcttttacgctaggacacggttttcagttcgtgtccctgagctcacctctacacaaccacacactgttcccagagaaacagatatacactacgagccccttagagtgcgggtttggacaatcggtgacttccgtacttcctagctctctaccgaaacctcccttcggcatgcttttcgggtcccagcctggcttatacctgtcggcacttgacgcaactcaccagcagttaacaccaagccaggaattagatgatctgattgactcacagaagaacctcgaaaccagcagcgcttttcaatcatccagccagaagctaacctcccagaaagagcagaagaatcttgagtcatccaccggattccagattcctagccaggagctcgcaagccaaatcgatccgcagaaggacattgagcctcgaactacataccagatcgaaaactttgcacaggctttcggctcacagtttaagtcagggagcagggtgcctatgacttttatcacaaacagtaatggggaggttgatcacagggtcagaacttccgtgtccgatttttctgggtacaccaacatgatgtccgacgtgagcgagccctgctccactagagtgaaaacacccaccagccagtcttatagatag

SEQ ID NO: 25117 - DNA, 2688 bp, Artificial Sequence
  Description of Artificial Sequence: Synthetic coding sequence
atgaagataggttccggattcctttccggtgggggtggcaccggatcatctgggggtagtgggagcggcggaggtggctcgggaggcggagggggagggggttcgagtggacgtcgggcagagatggaacccacattcccccagggcatggtcatgttcaatcatcgactcccaccagttaccagctttacccgcccagccggttcggctgcacccccacctcagtgtgtgctatcctcctcgacttcggccgctccagctgcagaaccaccgccaccccctgcccctgacatgaccttcaagaaagagccggcagcatccgccgctgcgttcccctctcaacgaacgtcatggggctttctgcagtctcttgttagtataaagcaagagaaaccagccgacccggaggagcaacagtctcaccaccaccaccaccaccatcactatggtggcctgttcgccggagctgaagagaggtcgcccggactggggggtggtgaggggggatcacatggcgttatccaggatctgtccatcctgcaccaacatgtgcagcaacagccggctcaacatcaccgggacgtgcttcttagtagctcctccaggacggatgaccatcacggaactgaagagccaaaacaggatacaaacgttaaaaaggctaaacgcccaaagccagaatcccagggaataaaagcgaagcggaaaccctccgcatcctccaagccaagtctagttggcgacggcgaaggcgctattctatcacccagccagaaaccacacatttgcgaccattgctccgcagcctttcggtcaagctaccacttacgcaggcatgtcctgatccatacgggcgagcggccttttcagtgctcgcagtgttctatgggcttcattcagaagtacctgctgcagagacacgagaagattcattcgagagaaaaacctttcggatgtgatcagtgtagtatgaagtttatacagaaataccacatggaacgtcataagaggacacactctggcgagaaaccctataagtgtgatacctgccagcagtacttttcaagaactgaccggttgctgaaacatagaaggacctgtggcgaggtcatcgttaaaggcgctactagtgccgaacccggatccagtaaccacaccaatatgggcaatctcgccgtcctcagtcagggaaatacttcaagttctcggagaaagacgaagagtaagtcaatagctatcgagaataaagaacagaaaacagggaagaccaatgagagccagatatctaacaacatcaatatgcaaagctatagtgtggaaatgcccacggtgtcttcatctggtgggattatcggaaccggcattgacgagctgcagaaaagagtgccaaagttgatcttcaaaaagggctcccggaaaaataccgacaagaattacctgaattttgtgagtcctctccctgatatagtcggacaaaagtctctgagcgggaagcccagcggctctcttggcatcgtatccaataactccgtggaaacgatcggcctgctgcaaagcacgagtggaaagcaaggacagatcagtagcaattacgacgatgccatgcagttttctaaaaagcgcagatacctccccacagcctcgtcaaactccgcgtttagcataaatgtgggccatatggtgtcacagcagagcgtgatccagtctgccggagtgtcggtcctcgacaatgaggctcccttgtctctcatcgattcttccgcgttaaatgccgagattaaatcatgccacgataagtccggaatccccgatgaagtcctgcagtcaatcctggatcagtactccaataaaagcgagagccaaaaggaagacccatttaatatcgccgagcccagggtggacctgcataccagcggggagcacagtgaactcgtccaggaagagaacctcagccctggcacacaaacgccctctaacgacaaggcatctatgctccaggagtactccaagtacttacagcaagcctttgaaaaaagtaccaatgcgtcctttactctcggccatggctttcagttcgtgtctctgtcatctccgcttcacaaccacaccctcttccccgaaaagcagatctacactactagtccactggagtgcggttttggacaatcagtgacctcagtgctgccaagcagcctgcccaaacctccattcggcatgctctttggaagccaaccgggtctctatttgtcagccctggatgcaactcaccagcagctaaccccctctcaggagctggatgatctgatcgatagccagaagaatctcgaaacctcgtccgccttccagtccagctcacagaagcttacctctcagaaggagcaaaaaaatctggagtccagcaccggattccagattccttcccaggagttggcaagtcaaatcgacccacagaaagatatagagcctagaaccacctatcagatagagaatttcgctcaagcctttgggtcccagttcaaaagtgggtctcgggttcctatgacttttataactaattcaaatggcgaggtcgaccaccgagtgcggacgagcgtgagcgattttagcggatacacaaatatgatgtcagacgttagcgaaccttgttccactcgagttaaaacccccacctcgcaaagttacaggtag

SEQ ID NO: 25118 - DNA, 1803 bp, Artificial Sequence
  Description of Artificial Sequence: Synthetic coding sequence
atgggctttatacagaagtacctcctacagaggcatgagaagatccacagccgggaaaagccctttggttgcgaccagtgtagtatgaagtttattcagaagtaccatatggagcgacacaagcgcacacattccggggagaagccctacaagtgcgacacatgtcagcagtatttctctcgtaccgataggcttctgaaacaccgtagaacatgcggggaagttatcgtgaagggagcaaccagtgccgagccaggaagttcaaatcacacaaacatgggtaatcttgccgtcctgtcacagggcaatacatcctcatccaggaggaaaacaaaatccaaaagtatcgccatcgaaaacaaagaacagaagacagggaagacaaacgagtcacagatctctaacaatatcaatatgcagagctactccgtggagatgcccaccgtgtcatccagcggcggtatcatcgggaccggtatcgacgaacttcagaagagagtgcctaagctgatcttcaagaagggatcacggaaaaacacggataagaactacctgaactttgtttctcctttgcccgatattgtggggcagaaaagcctcagcggtaagccctctggatcactaggaatcgtgtccaataactccgtcgagaccatcggcctcctgcaaagtacatccggtaagcagggacagatctcatccaactacgatgatgcaatgcagtttagcaagaaacgccgttacctgcctacagcttccagcaattctgccttcagcatcaacgtggggcacatggtgtcccagcagagtgtgatccagtccgccggtgtgtcagttctggacaacgaagcacctctttccttgattgattcatctgctcttaacgccgagatcaagagctgccacgataagagcggtatccctgatgaagttcttcagtccatcctggaccagtatagcaataagtccgagtctcagaaagaggatccctttaatatagctgaacccagagtcgatctccatacctctggagaacactcagaactggttcaggaggagaatttgtcacccggtacacagacccccagcaatgacaaagcctctatgctgcaggaatattccaaatatttacaacaggctttcgagaagtcaactaacgcgagcttcactctaggccacggcttccagttcgtgtccctgtcaagcccgctacataatcatacgctgttccctgagaagcagatttataccacttcccctcttgaatgcgggttcgggcagagcgtgacaagcgtgcttccctctagtctgccgaagcccccatttggcatgctgttcggctcccagcctggactgtacctgtctgctttagatgccacacatcagcaactgactccctcacaggagctcgatgatttaatcgattctcagaagaatctcgagacctcatctgcatttcagagctcatcacagaaactcacttcacaaaaagagcagaagaacctggaaagcagtaccgggttccagattccaagtcaggagctagcttcccagatagaccctcagaaagatattgagcccaggaccacctatcagatcgaaaacttcgcccaggccttcggctcccagttcaagagcggcagtcgcgtacctatgaccttcattactaatagtaatggtgaggtagaccaccgcgtgcgtactagcgtgagcgattttagtggctacaccaacatgatgtctgatgtcagcgaaccatgctccactcgagtgaagacccctactagtcagagctaccgttag

SEQ ID NO: 25119 - DNA, 2016 bp, Artificial Sequence
  Description of Artificial Sequence: Synthetic coding sequence
atgcagtttgtttcaacccggccacagccccagcagctgggaatccagggcctggggctggatagcggatcttggtcatgggcccaggctctaccccctgaggaagtgtgccaccaggaaccagcgctaaggggtgagatggctgagggaatgccccctatgcaggcccaggaatgggacatggacgccaggaggccaatgccattccagtttccaccttttccggatagggccccagtgttccctgaccggatgatgcgtgaacctcaattaccaacagcggaaatctcactatggactgtggtagctgctattcaggccgtggagagaaaggtcgatgcccaggccagtcaactgctgaatctagaaggccgtaccgggactgccgagaagaagctcgctgattgcgagaaaacagccgttgagtttggcaaccatatggaatctaaatgggccgtgctgggtacactgctccaggaatatggactgctgcagcgcagattggaaaatctcgagaatctgctacggaatcggaacttctgggtgctgcggctgccgccaggaagtaaaggtgaggctccgaaagtgccggtgacctttgtggacattgctgtctacttttcagaggacgagtggaagaatcttgacgaatggcagaaggagctctataacaacctagttaaggaaaattataaaaccctgatgtccttagacgctgaaggtagtgtaccaaaacctgacgctcctgtgcaggccgagccaagggaggaaccgtgcgtatgggaacagcgacaccccgaggagcgagagattccaatggatcccgaagccggagcagaaccgttagttcccgcacaggacgcctcttcacaggtgaaacgggaagataccctctgtgtacggggacagagagggttggaagagagagcgattcctactgaaagcattactgacagtcccatctctgcccaggaccttctgtcccggattaaacaggaagagcatcagtgcgtgtgggaccagcaggacctggccgatagggacatcccaacggaccccaatagtgagtccctcattagcgcgcacgacatattaagttggattaaacaggaggaacaaccgtacccctggggaccacgcgactctatggacggagagctggggctggactcgggaccctccgattcattactaatggtaaaaaatcctcctcccgcaccacctcaaccacaacctcagccgcaacctccccagcctcaactgcaaagtcagcctcagcctcagtccctgcctccaatcgcagtcgcggaaaacccagggggtccaccctccagagggttgttagacgacggctttcaggtcctaccaggcgagcgaggcagtggcgaggctccgcctggcggagatcgctcgacaggagggggaggcggagatggaggcggaggcggtgggggagctgaggccggaacgggtgctgggggaggatgtgggtcatgttgtcccggaggtctccgtaggtctcttctcctccatggggcacggtccaagccttactcttgccccgagtgcggcaagtcttttggcgtacggaaatccctcattattcatcatcggtcccacactaaagaacgcccatacgagtgcgctgaatgtgagaagtcattcaactgtcattccgggctgattaggcatcagatgactcatagaggggagcggccatataagtgctcagagtgtgagaaaacttacagccggaaagaacacctgcagaaccatcagcggctacacacgggcgagcgccctttccagtgcgcgctctgtgggaaatcatttattcgcaagcagaacctcctaaagcaccaaagaattcatactggcgagcgcccttacacttgtggggaatgcggtaagagcttcagatataaagaaagtctgaaagatcatcttagggtgcactcaggcggaccaggccctggggcaccacggcagctgccccctccccctgaaagggactag

SEQ ID NO: 25120 - DNA, 975 bp, Artificial Sequence
  Description of Artificial Sequence: Synthetic coding sequence
atgcgagagccccagcttcctaccgccgagataagtctgtggaccgtggtggccgcaatacaagctgtggagaggaaagtggacgctcaagcgagtcagcttcttaatcttgaagggaggaccggcaccgcagagaagaaactcgccgattgtgaaaagaccgctgttgaatttggcaaccatatggaatctaagtgggccgtgctgggcaccctgctccaggagtacgggctgttgcagcgcaggctggagaacctggagaacctgctgaggaacaggaatttttgggttctgagactgccaccgggttctaagggagaagctccgaaggtgcccgttaccttcgtggatatcgccgtgtatttctctgaagatgaatggaaaaacctggacgaatggcagaaggaactctataacaaccttgttaaggagaactataagactctgatgtcacttgatgccgagggaagtgtgcccaagcccgacgcccctgtccaggcagagccatcatactcttgtcccgagtgcggcaagtcatttggtgtgcgtaagtcccttattattcatcacaggtcccacacaaaagagaggccttacgagtgtgccgagtgtgaaaaatccttcaattgccactcaggactcatccgtcatcagatgacccacagaggagagcgaccatataagtgttcagagtgcgaaaaaacgtactcaaggaaagaacatttgcaaaatcaccaacgcctgcataccggtgaacgccctttccaatgtgccctgtgcggaaaatcatttatccggaagcagaatctcctgaaacaccagcgcatccacaccggagagcgcccttatacctgcggcgagtgcggcaagtcattcagatacaaggagtcactgaaggatcacctgcgcgtgcacagcggcggtcccggtcctggtgcgcctaggcaattgccaccaccccctgaaagggactag

SEQ ID NO: 25121 - DNA, 1392 bp, Artificial Sequence
  Description of Artificial Sequence: Synthetic coding sequence
atgcagttcgtttctaccagaccccagccccagcagttagggatacagggcctgggactggactccggtagctggagttgggctcaggccctccctccggaggaagtctgtcaccaggagccggcactccggggtgaaatggccgaaggcatgcctcctatgcaggcccaggagtgggacatggacgcgagacgtccaatgccattccaatttcccccattcccggaccgcgcacctgtgttccccgaccggatgatgcgcgagccgcagttacccacggcggagatctctctgtggactgttgtggctgcaatacaggcagtggagcgaaaagtcgacgcccaagcctcccaactgctcaatttggaaggccgaacaggaactgccgagaaaaagttggctgactgcgagaagacagccgttgagttcggcaatcatatggaaagcaaatgggccgtccttggcacactcttacaggagtacggactcctgcagcgcaggttggagaatctggagaacttattgcggaataggaacttttgggtccttcggctgccccctggaagcaagggcgaggcaccaaaggtccctgtgacattcgtggatattgctgtgtacttttcagaagacgagtggaagaatctcgacgagtggcaaaaagagctctataataatttagtcaaagagaattataagactcttatgagcctggacgccgagggcagcgtgccaaaacctgatgctccagtgcaagccgagcccagggaggagccatgcgtatgggagcagcgacatcccgaagaacgtgagatccccatggatcccgaagctggggctgagccccttgtgccagcccaggatgccagcagtcaggttaaacgggaggatacactttgtgttagggggcagcgaggcctcgaggagagagccattcccaccgaatcaatcaccgattctcccattagcgcacaggacttgctgtctagaatcaaacaggaggaacatcaatgcgtctgggaccagcaagacttggcagatcgggatattcccacagatccaaatagcgaaagtttgatctctgcccacgacatattgtcctggattaagcaggaggaacagccctacccctgggggcctagggacagtatggacggcgagctggggctggattccggccctagcgatagtctcctgatggtaaaaaatcctccacccgcaccgccacagccccagccccagccacagccccctcagccccagctccagtcccaaccccaaccacaatcgctgcccccaatcgctgtggctgagaaccctgggggaccgcctagcaggggactgctggatgacggcttccaaccacaccagggagctgcactccgggtccggtag

SEQ ID NO: 25122 - DNA, 252 bp, Artificial Sequence
  Description of Artificial Sequence: Synthetic coding sequence
atgtttgaatcatgtagtggttttagcgggttttgcgccagccccatcgaggaaagccacggcgctctgatttcgtcctgtaactcccgtacgatgacagatggcctggtgaccttccgagacgtcgcgattgacttttctcaggaagaatgggaatgccttgaccctgctcagcgggacttatatgtagatgttatgctggagaattacagtaacttagtgagtttaggcaaagtcatttgcctgaaatag

SEQ ID NO: 25123 - DNA, 2040 bp, Artificial Sequence
  Description of Artificial Sequence: Synthetic coding sequence
atggaatctaggtccgttgcacaggccggtgtgcaatggtgtgacctgggctcacttcaggcaccgccacctggatttaccctcttttcctgtctgtccctactgtcttcctgggactattccagcggattttcagggttctgcgcttcgcctattgaggagtcacatggagcgctaataagctcttgtaattccagaaccatgactgatggtttagttaccttcagagacgtggcaattgatttcagtcaagaggaatgggagtgtctggatcctgctcagcgcgacctgtacgtagacgtcatgctcgagaactactcaaatctggtgtcattggacctggagtcaaaaacctatgagacaaagaaaatcttcagtgagaacgacatcttcgaaatcaacttttcgcaatgggagatgaaggacaagagcaagacactcgggttggaggcaagcatattcaggaataattggaagtgtaaaagcatcttcgagggactaaaaggccatcaggagggttatttttcacagatgataatatcttacgaaaaaatcccttcgtatagaaagtcgaaatctctcacaccacaccagaggatacacaatacggagaagagctacgtctgtaaagaatgcggtaaagcttgctcccatggcagtaaactggtgcagcacgagaggactcacactgcagagaagcactttgagtgcaaagagtgcggcaagaactacctgagcgcttatcagcttaatgtgcatcagcgctttcatacaggcgaaaaaccttatgaatgtaaggaatgcggcaaaaccttcagctgggggagtagtcttgttaaacacgaacgtatccatacaggtgaaaaaccctacgaatgcaaggaatgtgggaaggcctttagcagaggctaccaccttactcagcaccagaagattcacactggagtgaaatcctacaaatgcaaagaatgtggcaaggcattcttctggggcagcagtctggccaagcacgagattattcacactggcgagaaaccttacaagtgtaaagaatgcggcaaggctttcagccggggttaccagctcacccagcaccagaagattcacacagggaaaaagccctacgaatgtaagatatgtggaaaggctttttgctgggggtaccagttaacacgacatcagatctttcacactggggagaagccctacgaatgcaaggaatgtgggaaggcatttaattgtggcagttctctgatccagcacgagcggattcacacaggagagaaaccttacgagtgcaaagagtgtggtaaggcattcagcagagggtatcacctgtcgcagcatcaaaagatccataccggggaaaaaccatttgaatgtaaggagtgtggcaaggcctttagctgggggtcaagtctggtcaaacatgaacgggtccacactggggagaagtctcacgaatgtaaagagtgtgggaaaactttctgttcaggctaccaactgacacggcatcaggtcttccacacaggtgaaaaaccttatgaatgtaaggagtgtgggaaagcttttaattgtggcagttcattggtccagcatgaaaggatccacacaggtgaaaaaccttatgaatgtaaggaatgtggtaaggccttctctcgcggatatcacctgacacaacaccaaaagatccacactggcgaaaagccattcaaatgcaaggagtgtgggaaggccttttcttggggctcctccctggtgaagcacgagcgcgtgcataccaacgagaagtcgtatgaatgcaaggactgcggaaaagccttcgggtcaggttaccagctgtcagtacaccaacgatttcacacgggggagaagctgtatcagcggaaggagttcgggaagaccttcacatgtggatcaaaactggtccatgaacggactcacagcaacgataagccttataagtataacgagtgcggggaagccttcctgtggactacttacagcaatgagaaaatcgatactgatgagaccctttag

SEQ ID NO: 25124 - DNA, 1782 bp, Artificial Sequence
  Description of Artificial Sequence: Synthetic coding sequence
atgacgatgtttaaagaagccgtgacattcaaggacgtggccgtggtttttacagaagaagagttgggtctgttggatgtgagtcaacggaaactataccgagatgtgatgctcgagaatttcagaaacctcctctccgtagggcatcagctgagtcacagggatacttttcactttcaacgagaggaaaaattctggataatggaaaccgccacccagagagaggggaattcgggaggcaagattcaaacagagctggagagcgtgcccgagaccggcccacacgaggaatggagttgtcagcagatctgggagcaaaccgcttcagagctcactcggcctcaggatagtattagttccagtcaattcagtacacagggtgatgtcccctctcaggttgacgccggactgtctataattcatatcggtgaaacaccctcagaacacggcaagtgcaagaagttttttagcgacgtgtcgatcctggatttacaccagcaattgcactccggcaaaatctcccacacgtgcaacgagtatagaaagaggttctgttatagttccgctttgtgcctgcaccagaaggtgcacatgggtgaaaagaggtacaagtgcgacgtgtgcagcaaagccttttcccagaactcccaactacagactcaccaacgaatccatactggtgaaaagccattcaaatgcgaacagtgcggaaaatcattctctagaagaagcgggatgtacgttcactgcaagctccacacaggtgagaagccgcacatttgtgaagaatgcggaaaggctttcatccataatagccaattacgtgaacaccagaggatccatacaggggagaaaccctttaagtgctatatatgtggcaaaagttttcacagtagatctaatctgaatagacactccatggtgcatatgcaagaaaaaagttttagatgcgacacttgtagtaattcttttggacagaggagcgcgttgaactctcactgcatggatcacacaaaggaaaaactgtataaatgcgaggaatgcggaagaagtttcacctgtcgccaagacctatgtaaacaccagatggatcacacaggagacaaaccatataactgcaatgtctgtggcaaaggcttcagatggtccagctgcctcagtagacatcagagggtgcacaatggagagacgactttcaagtgtgatggctgcggtaaaagattttatatgaatagccagggccatagccatcagcgggcttatcgggaagaggaattgtacaagtgccaaaaatgcggtaaaggttacatttcgaaattcaatctcgatctacatcagagagttcatacgggagaacggccatacaactgcaaagaatgtgggaaaagcttccgttgggcttccggcatccttcggcataagagactgcacaccggagaaaaaccgttcaaatgcgaggaatgcggcaagagatttactgaaaattctaagctgcggtttcatcagagaatacacacaggggagaaaccatacaagtgcgaagaatgcggtaagggttttcgatgggcctctacccatctgacacaccagaggctgcacagccgggaaaaactctttcagtgtgaggactgcggcaagtcctccgagcattcctcttgtttacaggaccagcaatctgatcacagcggtgaaaaaacatcaaaatgcgaagattgtggcaagcgctacgagcgaagactgaacctggacatgattctgtcacttttcttaaacgacatttag

SEQ ID NO: 25125 - DNA, 2739 bp, Artificial Sequence
  Description of Artificial Sequence: Synthetic coding sequence
atgatcaagtttcagatggtgacctttaaagatgtagccgtcgtatttacagaggaagagctcggcctgttagacagcgtgcagcggaagttgtatagagacgttatgcttgagaacttccgcaatttgctgctcgtcgcacatcaacctttcaagcccgacctgatctcccagctggagcgggaggaaaagttgttgatggtggagaccgagacgccgagagacggatgcagcggaaggaaaaatcaacagaaaatggagagtatccaggaggttacagtgagctacttttcccctaaggaactgtccagcagacagacatggcagcaatccgccggaggactgattcgctgccaggattttcttaaagtattccaggggaagaatagccaactgcaagaacagggaaactcccttggtcaggtgtgggccggtattccagtccagatctcagaggacaagaattacatctttacccatataggtaatggaagcaattacatcaagtctcaggggtacccttcatggagggcacaccacagttggagaaagatgtaccttaaggagtctcacaactatcaatgcagatgtcagcagataagcatgaagaaccacttttgcaaatgtgattctgtcagctggctgtcccaccataatgataagctcgaggttcatcggaaagagaactatagctgccatgattgcggtgaggacatcatgaaggtttcactgctgaaccaggagtccatccagacagaagaaaaaccctacccgtgtacggggtataggaaggcattcagtaacgattcatcctctgaagtgcatcagcagttccacctagaaggtaaaccttatacctattctagctgcggaaaagggtgtaactacagctcactacttcacatccatcagaatatcgaaagggaagacgacatcgagaatagtcacctaaagagctaccagcgggtgcataccgaggaaaagccatgtaagtgcggggagtatggggaaaattttaatcactgttcccctctgaacacatatgaattgatacacactggggaaatgtcttacagacataatatttatgaaaaggcgttttcccattcacttgacttaaactcaatattccgggtacacacacgggacgagccccatgaatatgaggagaatgagaatgtttttaaccaatcctcttgtctacaggtgcaccagaagattcacacagaggagaaactttacaccgatattgagtacggcaagagctttatctgtagctccaatttggacatccaacatagagtgcatatggaggaaaattcatacaattccgaagagtgcgggaacgggttcagccttgcatcacacttccaggaccttcagatcgttcatacaaaagagcagccttacaagagatacgtttgctccaacagttttagccataatctgtacctccagggccatccaaaaattcatataggagaaaagcctagaaaggaacatgggaatggcttcaattggtcctctaagctgaaggatcatcagcgagtgcacaccggccaaaagccatataaatgcaacatctgcgggaaaggatttaaccatcgtagtgtactcaatgtgcatcagcgcgtccacaccggggagaaaccttacaagtgcgaagagtgtgataagggattctcaaggagttcttatctgcaggcccaccagagggtgcacacgggagaaaagccctacaaatgtgaggagtgtgggaagggattctccagaaacagctatttgcaaggtcaccagagagttcacaccggagagaagccgtataaatgtgaggagtgtggcaaagggttctcacggagcagccatttgcagggccaccagcgggtccacaccggagagaagccctttaagtgcgaagagtgcggcaagggcttcagctggtcgtttaatctgcaaatacatcaacgcgtacatacgggagagaagccttataagtgtgaggaatgcggtaaaggtttctctaaggcctctaccctgctggcacatcaaagagtacacaccggagagaaaccatatcagtgtgacgagtgcggaaaatcgttttcccagcgaagctacttgcagagccatcagagtgtgcattctggtgagcgcccttatatatgcgaagtgtgtggtaagggcttcagtcagagggcgtacctgcagggacatcagcgggttcatacacgagtgaaaccctacaaatgtgagatgtgcggcaaaggctttagccaatcctcccgactggaggcacatcgaagggtgcatacagggggtaaaccatacaagtgtgaggtgtgcaccaagggtttcagcgagtccagcaggctgcaagctcaccaacgcgtccatgtggaagggagaccctataaatgcgaacaatgtggcaaaggtttttccggttatagctccctgcaggcgcaccacagggtgcacacaggggaaaaaccgtataaatgcgaagtgtgcggaaagggcttttctcaaaggtcaaatctccaagcacaccagcgcgttcacaccggagaaaaaccatacaagtgcgatgcctgcggcaaggggtttcgatggtcttctggcttgctgattcaccaacgggtgcatagctcagacaagttctacaagagcgaggattacggcaaagattatccaagctctgagaatctccatcgcaacgaggactccgtgcttttctag

SEQ ID NO: 25126 - DNA, 1773 bp, Artificial Sequence
  Description of Artificial Sequence: Synthetic coding sequence
atgattaaattccaggaacgcgtgacctttaaggacgtggcagtcgtctttactaaagaggaattagcattgctcgataaagcccaaattaacctctaccaggacgtgatgctggaaaactttagaaaccttatgctggttagggatggaattaaaaacaacatcctcaacttgcaggcaaagggactgtcctacttaagtcaggaggtactacattgctggcagatttggaagcagaggattcgcgatctgaccgtttcacaggattacatagtgaacctccaggaggagtgtagtccccatctggaagatgtgagcctctccgaggaatgggccggtatcagtctccaaatatccgagaatgagaattatgtggtaaacgctataattaaaaatcaggatatcaccgcatggcagtcgcttacacaagttctgaccccagaatcctggagaaaggcaaacatcatgacagagccgcagaattcgcagggcagatacaagggcatctacatggaagaaaagttataccgacgcgctcagcacgatgatagcctctcctggaccagctgtgaccaccatgagtctcaggagtgtaagggtgaagatcccggaaggcacccaaactgtggcaagaatttagggatgaagtcaacagtggagaaaagaaacgcagcgcatgtgctaccccagccattcccatgtaacaactgtggggttgccttcgcggacgacacggacccccatgtccatcactctactcacctaggcgagaagtcatataaatgtgaccagtacggaaaaaacttctctcagtcacaggatctgatagtacactgcaagacgcatagcggcaagacgccatacgaatttcacgaatggcccatgggatgtaagcaatcttcagacctgcctcggtatcagaaagtctcgagcggggataagccttataagtgcaaagaatgcggaaaggggtttcgcaggtctagctccctgcataaccaccatcgagtgcacacaggcgaaatgccttacaagtgcgacgaatgtgggaaaggcttcggatttcgttccctcctttgcatccaccagggcgttcacaccggtaaaaagccctataaatgtgaggagtgcggcaaggggtttgatcagtcctctaatctcctggtgcaccagcgcgtacacaccggggaaaagccatataagtgttcagaatgtgggaagtgtttcagctcgtcaagcgtcttgcaagtgcactggaggttccacacaggtgagaagccatacaggtgcggtgagtgtgggaaggggttcagccaatgtacccacttacacatccatcagcgagttcatacaggcgaaaagccatacaaatgtaatgtgtgtggcaaagatttcgcttactctagcgtgctccacacccaccagcgtgtgcacacaggagagaagccctacaaatgcgaggtgtgcggcaaatgtttttcttatagttcctactttcacctgcaccagagagaccacatccgggagaaaccttacaaatgcgatgaatgcgggaagggatttagccgtaattcggacctcaatgtacaccttcgcgtccacacgcgggaacggccttataagtgcaaggcctgtggcaaaggtttctccaggaacagctatctactggcccatcagcgcgtccacattgacgagactcagtacactcattgcgaacgaggtaaagacctgctcacccatcaaaggctgcatgagcagcgggaaactctctag

SEQ ID NO: 25127 - DNA, 2742 bp, Artificial Sequence
  Description of Artificial Sequence: Synthetic coding sequence
atgaccaaatttcaggagatggttactttcaaggatgtcgcagtggtctttacagaagaggaactaggtcttctggatagtgtccagagaaagctctacagagacgtcatgttggaaaatttccggaaccttctgttagtggcccatcagccctttaagcccgatctgatttctcagctagagcgagaggagaagctgttaatggttgaaaccgaaacaccaagggacggttgctccgggagaaagaaccagcagaaaatggaatccatccaggaagtcactgttagctacttcagtcccaaagagctaagtagccgtcagacatggcagcagtccgccggaggcctaatccgctgtcaggattttctcaaagtctttcaaggaaagaactctcagttgcaagaacaggggaattccttaggtcaggtatgggcaggcatacctgtccagatttctgaggataaaaactacatttttacacatatcggtaatgggtccaactacataaaatcccagggctatccttcctggagagcccatcattcttggcgcaagatgtatctcaaggagtctcataattaccagtgccgttgccagcagatctccatgaagaaccacttttgcaagtgtgactccgtgtcttggttgagtcatcataatgacaagctggaagtgcatcgtaaggagaactacagttgccacgactgcggtgaagacatcatgaaggtgagtctcctgaatcaggaatcaatccaaactgaggagaagccttatccatgtacaggctaccggaaggcattctctaacgacagtagtagcgaagtgcatcaacagttccacctggagggaaagccctacacctactcttcttgtggcaagggctgcaattacagttctctgctgcacatccaccagaacattgagcgcgaggatgatattgagaactcgcacttgaaatcctatcagagagtccacaccgaagaaaaaccctgtaaatgcggcgagtatggagaaaatttcaaccattgttctccactgaatacatacgaactgattcatacgggggaaatgtcctacaggcataatatttatgagaaagcatttagccattcacttgacctgaattctatcttcagggtgcacacaagagacgagccccatgaatacgaagagaatgaaaatgtatttaaccagtcaagctgtctccaggtgcaccaaaaaattcacacagaggagaagctgtacaccgacatcgagtacgggaaatcttttatttgttccagcaatttagacattcaacaccgggtacatatggaggaaaattcctacaactcggaggagtgcggaaacggtttctctctggcaagtcattttcaggacctgcaaatcgtccatacaaaagagcaaccatacaaaaggtacgtgtgctccaattcttttagccacaacctttatctacagggacacccaaaaattcacatcggagaaaagccacggaaagaacacggaaatggattcaattggtcttctaagctgaaggatcaccagagggtccacaccggccaaaagccctacaagtgtaacatctgcggaaaggggttcaaccatcgatcagtgctgaacgtccatcaacgcgttcacaccggcgaaaaaccttataagtgcgaggaatgcgacaaaggcttttctcgttcctcctacctgcaggctcaccagagggtccacacaggcgaaaagccatacaaatgcgaagagtgcggtaagggcttttctagaaattcataccttcaggggcatcaacgggtgcacacaggcgaaaagccttataaatgcgaggagtgcggtaaagggttcagtagaagtagccacttacagggccatcagagggtccatacaggcgaaaaaccattcaaatgtgaggaatgtggaaagggcttctcgtggtcctttaacctgcagatacaccagagggtgcatacaggcgagaaaccttacaagtgcgaggaatgtggtaagggcttttccaaggcctccaccctgttggcacatcaacgagttcacacaggagaaaagccgtaccagtgtgacgaatgcggaaagtccttttctcagcgtagttatctgcagtcacatcagtccgtgcattctggcgaaaggccttatatctgcgaggtttgcggaaagggattttcacaaagggcctaccttcaggggcatcagagagtgcatacgcgggtcaagccatacaaatgtgagatgtgtggcaaagggttcagccagagcagtagactagaagctcataggagagtgcataccggaggaaagccatacaaatgcgaagtttgcaccaaaggcttcagcgagagctccagactgcaggcccaccagagggtccatgtggaaggacgcccatacaaatgcgaacagtgcggaaaaggcttttctgggtatagctccctgcaggctcatcaccgcgttcacactggagagaagccttataagtgcgaggtctgcggcaagggattctcccagcgctccaacctgcaagcccaccagcgggtccacaccggtgaaaaaccatataaatgtgacgcatgtggaaaaggattcaggtggtcgtcaggcctgctgatccaccagcgcgtgcacagctcagacaaattttacaaatctgaggattacgggaaggattacccttcttccgagaatttacaccgcaatgaggactcggtgctgttttag

SEQ ID NO: 25128 - DNA, 2724 bp, Artificial Sequence
  Description of Artificial Sequence: Synthetic coding sequence
atggtgacttttaaggacgtggctgttgtgtttacagaggaggagcttggactgctggatagtgtccaacgtaaactgtaccgggacgttatgctggagaatttccgaaatctgctcctcgtcgcccatcagccattcaagcctgatctcatcagccagctggaaagggaggagaagctcctcatggtagaaacagagactccgagagatggttgtagcggacggaagaatcaacaaaagatggagtctattcaagaggtgacagttagctacttctctccaaaggagctgtcctccagacaaacatggcagcagtcagcgggtggtttgatccgatgtcaagatttcctaaaggtcttccaggggaagaactcccagttgcaggaacaggggaatagcctggggcaggtttgggcgggaatccctgtccagatctcagaggataagaattatatttttacgcacatcggaaatgggtcaaattatatcaagtcacagggctaccccagctggcgggcacaccatagctggcggaaaatgtatttgaaggagtcgcataattaccagtgtagatgtcagcaaatctcaatgaagaaccacttttgcaaatgtgactctgtttcatggctatctcaccacaatgataagcttgaggtgcatagaaaggagaactattcgtgtcacgattgtggtgaggacatcatgaaagtctccctcttgaaccaggaatctatccagacagaggaaaagccctatccctgtacaggctataggaaagccttctcaaacgatagttcttcggaggttcaccagcagtttcatcttgagggtaaaccatacacatactcaagttgcggaaagggttgcaattattcctcactcctccatatccaccagaacattgaacgcgaagacgacatcgaaaattcacatctgaagagttaccagcgtgttcacaccgaggagaagccctgtaagtgcggcgagtatggcgagaactttaaccattgctcccctctgaacacctacgagctgattcatactggcgagatgagctacaggcacaacatttatgagaaagcttttagtcactctttagacctcaattccatcttccgtgttcatactcgagatgagccacacgagtatgaggagaacgaaaacgtgttcaatcaatcttcctgtttgcaggtccaccagaagatccacaccgaggagaagttgtataccgatatcgagtacgggaagtcctttatttgctcatcgaacctggatattcagcaccgcgtgcatatggaggagaactcctataattctgaggagtgcggcaacggtttctcacttgcctcccattttcaagacctccagattgtgcacacaaaagagcagccgtacaagcgatacgtgtgttccaattcctttagtcataatctgtacctccagggccatccgaagattcacatcggtgaaaaacctagaaaagagcacgggaacgggtttaactggtccagtaagctcaaggaccaccagagagtccacactggccaaaaaccctataagtgcaacatctgcggcaaaggattcaatcaccgcagcgttctcaatgtacaccagcgtgtccataccggcgagaagccttataagtgcgaggagtgtgacaaaggcttttctcgaagcagctatctgcaggcccatcagcgagttcatactggcgaaaagccttataagtgtgaggaatgcgggaagggtttttctcggaatagttatttgcagggccatcagagagtacataccggcgaaaagccctataagtgcgaagagtgcggtaagggcttttccagatcctctcatctacagggacatcagagagtacataccggcgagaaacctttcaagtgcgaggaatgcggcaaaggcttctcatggtctttcaacctgcagatccatcagagggtccacactggagagaaaccatataagtgcgaggaatgcggcaaaggattctcaaaggcttctaccctgctggcacatcagcgcgtgcacacaggggaaaagccttaccagtgcgacgaatgtggaaagtccttcagtcagagaagctacctccagtcccaccaatccgtccactctggcgagcgcccttatatttgcgaagtgtgtggcaagggattttctcaaagggcttatctgcagggccaccagcgagtccatacgagggttaagccatacaagtgcgaaatgtgtgggaaagggttcagtcaatcctcacgcttggaagctcatcgacgcgtgcataccgggggtaagccttacaagtgcgaagtctgcactaagggcttcagtgaatcatctagactacaggcacaccagcgcgtgcacgtggaaggcagaccttacaaatgtgagcaatgcggcaagggattttctggttacagcagtctgcaggctcaccatcgagttcacactggtgaaaaaccgtacaagtgcgaggtctgcgggaaaggtttcagccaaagatctaatttgcaggcccatcagagagttcacacgggagagaaaccatacaaatgtgacgcttgcggcaaagggttccggtggagctctggcttgctaatccatcagcgagttcactcatcagacaaattttacaagtccgaagactacggcaaagactatccttcatctgagaacctccaccgcaatgaggattctgtgcttttctag

SEQ ID NO: 25129 - DNA, 2742 bp, Artificial Sequence
  Description of Artificial Sequence: Synthetic coding sequence
ctgaccgtttgccaggaaatggtgacatttaaggacgtagcagtcgtgtttacggaagaggagctgggactcctcgattccgtccaacgtaaactgtatcgcgacgtgatgctcgagaacttcagaaatctgcttcttgttgcccatcagcctttcaagcccgaccttatcagtcagcttgagagagaagaaaaactgttaatggtagagaccgagactcctcgggatggctgtagcgggcgaaaaaatcagcaaaagatggagagcattcaggaagtgaccgtctcttacttcagtccaaaagagctgtcaagtaggcagacatggcagcagtctgccggtggacttattcgctgtcaggactttctgaaagtgtttcaggggaaaaactctcagctgcaagagcaggggaattcactcggccaggtttgggccggaatccctgtgcagatttcggaggataagaactatattttcacgcatataggcaacggctccaactatatcaaatcacaaggttacccgagctggagagcgcatcactcttggaggaagatgtacctcaaggagtcccataactaccaatgcaggtgtcagcagatctccatgaagaaccacttttgtaagtgtgattccgtgtcctggctgagtcaccataacgataagctggaggtacaccgcaaggagaactactcctgccacgactgcggagaggacattatgaaggtttcactgctgaatcaggaaagtatacagaccgaggagaagccctacccttgtacagggtaccgcaaggcctttagtaatgatagcagtagcgaagtccaccagcagttccacctagaaggaaagccatatacttattctagctgtggaaagggttgtaattactcatcgttgcttcatatccaccagaacattgaaagggaggacgacatcgaaaacagccacctgaagtcgtaccagcgagtccacacagaagagaaaccctgcaagtgtggcgaatatggggaaaatttcaatcactgtagtccgcttaacacctatgagcttatacatactggtgagatgtcctatagacacaacatctatgaaaaagcctttagtcactctctggacctaaatagcattttccgggtccacactcgagatgaaccccatgagtatgaggagaatgaaaacgtcttcaaccaatccagctgcctgcaagtccaccagaagatccacaccgaggagaagctgtacaccgatattgagtacggaaaaagcttcatctgtagctctaatctggacattcagcacagagttcacatggaggaaaattcctataattcagaagagtgcgggaacgggttcagcctggccagccatttccaggacttgcagatcgtgcacacaaaggagcagccctataaacgatatgtgtgctctaacagtttctcacataatctgtatctacagggacaccccaaaatccatatcggcgaaaagccaaggaaagagcacggtaacggatttaactggtctagtaaactcaaggatcaccagagggtccatacagggcagaagccatacaaatgtaacatatgtgggaaagggtttaatcatcggtcagtgttgaatgtgcatcagagggtgcatacaggcgagaaaccatacaagtgtgaggagtgcgataaggggttctccaggtcgagttacctgcaggcacaccagagggtccacaccggagagaaaccctataaatgtgaggaatgcgggaagggattttccaggaatagctacttgcaggggcaccagagagtgcatactggcgagaagccctacaagtgtgaggagtgtggaaagggattctctagatccagccacctccagggccaccagcgtgttcacacaggggaaaagcccttcaaatgcgaagaatgcggaaagggcttctcttggtcatttaacctccagatccaccagagagtgcatactggcgaaaagccctataaatgcgaagagtgtggcaagggcttttctaaagcgtcgacgttgcttgcacaccaacgtgtccacaccggtgagaaaccatatcagtgtgatgagtgcgggaagtctttttcacagcgcagctacctccaatctcatcaatccgtccacagtggggagagaccgtacatttgtgaagtgtgcggtaagggcttcagtcagcgggcttatttgcaaggtcaccagagggttcatactagagtgaaaccatacaagtgtgaaatgtgtgggaaaggcttctcccaatcttcaagacttgaggcacatcggagagttcacaccggaggaaagccgtataagtgtgaagtgtgcactaaggggttttcggagtcgtctcgcctgcaagctcatcaaagggtgcacgtggaggggagaccctataaatgtgagcagtgtggaaaggggttttccggttacagctctctgcaggcccaccacagagttcatacgggagaaaaaccttacaagtgcgaggtgtgcgggaaaggtttctcccaacgaagcaacctgcaggctcaccagagagtccataccggggagaaaccgtataaatgtgatgcctgtgggaagggttttagatggtctagcgggctgctgatccaccaacgcgttcatagctccgacaaattctacaagagtgaggattatggaaaagactacccaagttcagagaacttgcatcgcaatgaagactctgttctgttttag

SEQ ID NO: 25130 - DNA, 2793 bp, Artificial Sequence
  Description of Artificial Sequence: Synthetic coding sequence
atgggtttaggacctcgctctctcccttttagtcgaaagcgcaagcgcaaaatgacgaagtttcaagaaatggtgacgttcaaagacgtggccgtagtttttaccgaggaggagctgggacttttggacagtgtgcaacggaaactataccgcgatgtgatgcttgaaaattttaggaatctcctcctagttgctcatcagcccttcaagccagatttgatctcccaactagagcgggaggagaagctcttaatggtcgagaccgagacacccagagacggctgctccggccgtaaaaaccaacagaagatggaatccattcaggaggtgaccgtgtcttacttctctccgaaggagctgagcagccgccagacctggcagcaatccgctggagggctaataaggtgtcaggattttttgaaggtttttcagggcaaaaactctcaactccaggaacaggggaattctctcggacaggtctgggccggtatccccgttcagatctcagaagacaagaattacatctttacacacatagggaatggaagtaactacataaaatcacagggctatccgtcatggcgcgcacaccactcatggcgaaagatgtaccttaaggagtctcataactaccaatgccgatgtcagcagatctccatgaaaaatcacttctgcaagtgcgactcagttagctggctgtcacatcataacgacaagctagaagtacaccggaaagagaactacagctgtcatgattgtggggaggatattatgaaagtgtccttgctgaatcaggagagcatccagacggaggagaaaccctatccttgtaccggctataggaaagctttctcaaatgactcttccagcgaagtccatcagcagtttcatttagagggaaaaccctatacctattcatcatgcggaaaaggatgcaattactcatctctcttacatattcaccagaatatcgaaagggaggacgacatcgagaatagccatttgaaatcataccaaagagtgcatactgaggaaaaaccgtgcaagtgtggcgaatatggagaaaattttaaccactgcagcccactgaacacatacgaattaatacatacaggtgagatgagctatagacataacatatacgagaaggccttttcccatagtctcgacttgaacagcatttttagggttcatactagagacgagcctcacgaatacgaagagaacgagaacgttttcaaccagtcctcctgcctgcaggtgcaccaaaaaatccacaccgaggaaaaactttacacagacattgagtacggtaaatcgtttatttgctctagcaacttggatatccaacatcgggtgcatatggaggaaaacagctataattctgaggagtgtggtaatggcttcagtctcgcttctcattttcaggatttgcagatcgtgcatactaaggaacagccatataagcgttacgtctgttccaattcctttagccacaatttgtacctacaggggcacccaaagattcacatcggggagaaaccccgtaaggaacacgggaatggcttcaattggagcagcaaattgaaagatcatcagcgtgtgcatactggccaaaagccatacaaatgcaacatttgcggtaaagggttcaaccaccggagcgtgctgaatgtgcaccagagagtacataccggagagaaaccttacaagtgcgaggagtgtgacaaaggtttttctcggagctcctacttgcaggcccaccagcgggtccacacaggcgagaagccctacaaatgcgaggaatgtgggaagggattttctcggaattcatatctgcaggggcaccagcgcgttcacacgggcgagaagccatacaagtgcgaggaatgtggtaaggggttctcgaggtctagccatctacaggggcaccagcgagtgcacaccggggaaaagcccttcaaatgcgaggaatgtggaaagggcttcagttggtcattcaatctccagatacatcagcgcgtccacacaggcgaaaaaccatataagtgtgaggagtgcggtaagggattctccaaggcatcgacactcctcgcccatcagcgagtgcacactggagaaaaaccataccagtgcgacgaatgcggtaagtccttttctcagcgtagttacctgcaaagccatcaatcagtccactcaggggaaaggccatatatttgcgaagtttgcggaaagggattcagtcaaagggcctatctccagggccatcagcgggtgcatacccgcgtgaagccgtacaagtgtgagatgtgcgggaaagggttctctcaaagcagccggctggaagcccatcggagggtccataccggcggtaaaccttacaaatgtgaggtatgcaccaaaggcttttcagagtctagccggcttcaagcgcaccagagagtacatgtggaaggcaggccttacaagtgtgaacagtgtgggaaggggtttagcgggtattcgagcttacaggcccaccacagggtacatacaggcgagaaaccctataaatgcgaggtgtgcgggaagggattttctcagagatctaatcttcaagcccaccagagggtgcacactggggagaagccatataagtgcgatgcgtgtggaaagggctttcggtggtcttccggcctgctgatccaccagcgggttcacagttcggataagttttataagagcgaagactatggcaaagactatccgagtagtgagaatctccatcgcaatgaggatagtgtgttattctag

SEQ ID NO: 25131 - DNA, 1842 bp, Artificial Sequence
  Description of Artificial Sequence: Synthetic coding sequence
tgttcaagcgcattccccgagtcctgtcccttccaaaaagaagacgggatgattaaattccaagtgcggctttccaaccttcaggaacgggtgactttcaaagatgtggctgttgtgttcacaaaggaggaacttgctttgcttgataaggcgcaaatcaatttataccaagatgtgatgcttgaaaatttccgtaatctcatgctggttcgagacggaattaaaaacaatattctcaatctccaggcgaagggtctgtcctatctcagccaggaggtactgcattgctggcaaatctggaagcaacgcattagagacctgacggtctctcaggactatatagttaatctgcaagaggagtgttctccacacctggaagacgtctctttgtccgaagagtgggccggtatttcacttcagattagtgaaaatgagaactacgtagtgaacgccattataaagaatcaggatatcactgcatggcaatcactgactcaggtcctcacccctgagagttggcgcaaggctaacatcatgactgaaccccagaactctcaagggaggtataaaggaatttatatggaggagaaattatatcggcgagcccagcacgacgatagcctgagctggacgtcttgtgatcaccatgaaagccaggagtgcaagggcgaagatcctggcaggcatcccaactgtggcaagaaccttggtatgaagtcaactgtggaaaagcggaacgccgcacacgtcctgcctcagccattcccatgcaacaactgcggagtggctttcgctgatgataccgatcctcatgtccatcatagtacccacctgggcgagaaaagctataaatgcgatcaatacggaaagaactttagccagtctcaggacctcatagttcactgcaagacgcactctggcaaaactccatacgaattccacgaatggccgatgggctgcaaacagagttctgacctcccacgctatcagaaggtgtctagcggcgataagccgtataaatgcaaagagtgtggaaaggggttccgcagatctagttctctccacaaccatcaccgcgtacataccggagagatgccttataaatgtgatgaatgcggtaaggggttcggcttcagatcactgctctgcattcaccagggagtacacactggtaaaaaaccgtacaaatgcgaggagtgtgggaaagggtttgaccaaagtagtaaccttctggtgcaccagagggttcacacgggcgagaagccttataagtgcagtgaatgtgggaaatgcttctccagtagttcagtgctgcaggtgcactggaggtttcacacaggagaaaaaccctacaggtgcggggagtgcggaaaaggattctcccagtgcacacacctgcacattcaccagcgggtgcacacaggagagaagccttacaagtgcaatgtgtgcggcaaagacttcgcttactcatccgtactccacactcaccagcgtgtgcacactggggagaaaccctacaaatgcgaagtatgtggcaagtgtttttcttactccagttatttccacctccaccaaagagaccacataagagagaagccgtacaagtgcgacgagtgcggcaaaggtttttcccgcaattccgatctgaacgtccatctgcgcgtgcacacaagggaacggccttacaagtgcaaggcttgcggcaaaggattctccagaaattcgtacctgctggcgcaccagcgggtccatatagatgaaacacagtacacacattgtgagaggggcaaggacttacttactcatcaaaggctgcatgagcagagggaaacactttag

SEQ ID NO: 25132 - DNA, 426 bp, Artificial Sequence
  Description of Artificial Sequence: Synthetic coding sequence
atggaaaccgacctggccgaaatgcctgagaagggggcactgagctctcaggactcgcctcattttcaggaaaaaagtactgaggagggggaagtggctgcgctgcgactcacagcacggtcacaagaaacggtgacgttcaaggatgttgcaatggatttcacgccagaggagtgggggaaattggatccagctcaacgagacgttatgctggagaattaccgcaatctggtgtccctttggctgcctgtatctaagcccgagagctataatctcgagaatggcaaggaaccacttaagctcgaaagaaaggcgccaaagagcagttatagcgccgttgcagtgattattttattcctgatcccttatgtccatctcgaatcctggtttagggaaattaccggcagacggatctctcgcagttag

SEQ ID NO: 25133 - DNA, 1566 bp, Artificial Sequence
  Description of Artificial Sequence: Synthetic coding sequence
atggagacagacctagccgagatgcctgagaagggggcactgtcatcccaggactcccctcattttcaagagaaatccactgaggaaggggaagttgctgcgctccgtcttactgccaggtcacaggagaccgtgaccttcaaggacgttgcgatggattttaccccagaagaatggggaaaattggatcctgcccagcgtgacgtaatgcttgagaactaccgaaacctggtaagcctgtggctgcctgtgagtaaaccggaaagctataacctcgaaaatggaaaagagcccctgaagctggaacggaaggccccaaaatcatcctatagcgacatggagactaggccccagtcaaaagattcaacctctgtacaggacttcagtaaagccgagagctgtaaggtagcaattatcgataggttgactaggaactcagtctacgacagtaatctggaggcagcactagaatgcgaaaactggctggagaatcagcagggaaatcaggagcgtcatctcagagagatgttcacacacatgaacagcctgagcgaggaaaccgaccacaagcacgacgtgtattggaagagtttcaatcaaaaatctgttttgatcaccgaggacagggtgcccaaaggctcgtatgctttccacactctggagaaatcattgaaacagaaatcgaacctcatgaaaaagcagagaacttacaaggaaaagaagccacacaaatgcaacgattgcggcgagttatttacctaccattctgtcttgatccgacaccagagggtccacaccggtgaaaaaccgtacacgtgtaatgagtgcgggaagtcattctcacaccgggcaaacctcaccaaacatcagaggactcacacgcgaatcctctttgagtgcagcgagtgcaagaaaacatttacagagtccagctccttggctactcaccagcgcattcatgtgggcgagcggccttacgaatgcaacgaatgcggcaaagggtttaatagatccacccacttggttcagcaccaactgatccatactggtgtaaagccctacgaatgtaacgagtgtgacaaggctttcattcactcatcagccctgatcaagcatcagcgtacacatacaggtgaaaaaccctacaaatgccaggaatgtggaaaagcgttttcacactgctcgagcttgaccaagcatcagcgagtgcataccggggagaaaccatacgaatgtagcgagtgcggtaaaaccttttcacagtccacccatctggttcaacatcaaaggatccatacaggcgaaaaaccttatgaatgtaatgagtgcggcaaaaccttctcccgtagtagcaatttcgccaagcatcagcggatacacatcggaaagaaaccttacaagtgttccgagtgtggcaaagcttttattcattcttcagcgctgatacagcatcagcgaacgcacactggcgagaagccctttcgctgcaacgaatgtggaaagtcattcaagtgttcgtcttcactgatcagacaccagcgcgtgcatactgaggaacagccctag

SEQ ID NO: 25134 - DNA, 1536 bp, Artificial Sequence
  Description of Artificial Sequence: Synthetic coding sequence
atgggcgcattgtcctctcaggactctcctcactttcaagagaagtccacagaggaaggcgaagtggctgccttaaggctaaccgctaggtcgcaggagactgtgacatttaaagatgtcgccatggatttcactccagaggaatggggtaaactggatccggcacagagagatgttatgttagaaaactatagaaacttagtctccctgtggcttcccgtaagtaaacctgagagctataacctggaaaatggtaaggagcccttaaaactcgaacggaaggcgccaaaatcaagctactcagatatggagacaaggcctcagagcaaggatagcaccagcgtacaggacttctccaaagcggagtcttgtaaggtggcgatcattgacagacttactcgcaatagtgtctacgattctaatcttgaggctgctctcgaatgtgagaactggcttgaaaatcaacagggcaatcaggagaggcacttgcgggagatgttcactcacatgaatagtcttagcgaagagacagatcacaagcatgatgtctattggaaaagtttcaaccagaagtcagtgttgatcactgaagaccgggtgcccaaggggtcgtacgcattccacaccctggaaaagtcgctgaagcaaaaatcaaatctaatgaagaaacagcgaacttataaggaaaagaagccccataagtgtaatgattgcggagagttgttcacctatcacagtgtgctgatccgccaccagcgagtccataccggcgagaaaccgtatacatgcaacgagtgcgggaaaagcttcagccatcgggcaaacctgacaaaacaccagcgcacccatacacgcatactctttgagtgctctgaatgcaagaaaaccttcacagagagctcatccttagccacccaccagagaatacacgtaggcgaaaggccttacgaatgcaacgaatgcgggaagggattcaacaggtccactcacttagtgcagcaccagctgatccatactggggtgaaaccatatgagtgcaatgagtgcgacaaagcatttatccactcctcggccctgatcaaacaccagcgtacgcataccggtgagaagccctacaaatgccaggagtgtggaaaggcattttcacactgcagcagcctcaccaagcaccaaagagtgcacacaggcgaaaaaccatacgaatgtagcgagtgtggaaagacattcagtcagtcaactcatctggtgcagcatcagcgaatccataccggagagaaaccatacgaatgtaatgagtgtggtaagacattttctagatcctcaaacttcgccaaacaccagagaatccatatcggcaagaaaccttataagtgctctgagtgtggaaaagcatttattcattcctcagcactgatccagcatcaacgaacacacaccggcgaaaaaccttttagatgcaacgagtgcggaaaaagcttcaagtgcagtagcagcttaatcaggcatcagcgggtgcatacggaggaacaaccgtag

SEQ ID NO: 25135 - DNA, 1566 bp, Artificial Sequence
  Description of Artificial Sequence: Synthetic coding sequence
atggagaccgacctggccgagatgccagaaaaaggcgctctcagctctcaagatagccctcacttccaggaaaagtctacggaagagggcgaggttgccgctctgcggctcacagcacggtctcaggagacagttacatttaaggacgttgctatggattttacccccgaggaatggggaaagctagatcccgctcagagagatgtgatgctcgaaaactaccggaacctcgtttcgctatggctgcctgtctccaaaccagagagttataatttagagaacggcaaggaaccattaaaactggagagaaaggctcctaaaagcagttattcggatatggaaacgcgaccccagtccaaggattcaacgtctgttcaagatttttccaaggctgaaagttgtaaggtcgcaataatcgaccgccttacccgaaacagtgtgtacgactcaaacctcgaggctgcactggagtgcgagaattggctagagaatcagcagggtaaccaagagagacacctccgcgaaatgtttactcatatgaactcactttcagaagagacagaccacaagcatgacgtgtactggaagtcattcaaccagaagtcagtgctgattaccgaggatcgcgtgccaaagggaagctatgcctttcacactttggaaaagtcactgaagcagaagtctaacctcatgaaaaaacagcggacctacaaagagaaaaaaccccacaagtgtaatgactgcggggagctctttacctaccactcagttttgattcgacatcaaagagtgcacaccggagaaaagccctatacgtgtaatgaatgcggcaaaagcttctctcatagggccaatctgactaaacaccaacggacacacacacgcatcctctttgagtgctctgaatgcaagaagaccttcacagagagttcaagtctcgcgacgcaccaacgcattcacgtgggggaaaggccatatgagtgtaacgagtgtggcaaggggttcaacaggtcgacccaccttgtgcagcaccagctgatccatacaggggtgaagccctacgaatgtaatgagtgtgacaaggcgttcattcacagtagcgctttgattaagcatcagaggactcatacaggtgaaaaaccctacaaatgccaagagtgcggaaaggctttctcacattgctctagccttaccaagcatcagcgcgtgcacaccggcgagaaaccttatgaatgctccgaatgcggtaagacattcagtcaaagcacgcatcttgtgcagcaccagcgaattcacactggcgaaaaaccctacgagtgtaatgagtgtggcaagacctttagccgctcatccaattttgcaaaacatcaacgcatccacatcggcaagaaaccctataaatgctctgaatgcggtaaagctttcatacacagtagtgccctgatccagcaccaacggacacacaccggtgaaaagccatttaggtgtaacgaatgcgggaagagcttcaaatgttcttccagtctgattagacaccagagagtgcataccgaggagcaaccttag

SEQ ID NO: 25136 - DNA, 1566 bp, Artificial Sequence
  Description of Artificial Sequence: Synthetic coding sequence
atggaaacagaccttgccgagatgccagagaaaggtgccttgagctctcaggattctcctcatttccaagaaaagtctaccgaagaaggcgaggtggccgctctgagattgaccgctaggagtcaagaaacagtgactttcaaagatgttgccatggacttcacccccgaggagtggggcaagctggaccccgctcagagagacgtgatgcttgaaaactatcggaatctcgtctccctgtggctcccagtgagcaagccagaaagctacaatctggagaatgggaaagagcctctgaaactggagcgaaaggccccaaagtcgtcctactcagacatggaaacccgccctcagtctaaggacagcacctcggtacaggactttagtaaagcggaatcctgcaaagtggccatcatcgatcgccttacgcggaactccgtgtatgactctaacctcgaggcagctcttgaatgcgaaaactggctggagaaccagcaagggaatcaggagagacacttgcgcgagatgtttactcacatgaattctctatctgaggagacagatcacaaacatgacgtgtactggaaaagttttaatcaaaagtcagtactcatcacagaggaccgagtccctaaaggaagctacgccttccatacactggaaaagtctctgaagcagaagtctaatcttatgaagaaacaacgaacttataaagaaaaaaaaccacacaaatgcaatgattgtggggaactgttcacataccatagtgtgctgatcaggcaccagcgggttcataccggtgagaaaccatacacatgcaacgagtgtggtaagtcattttcccacagggccaatctgactaagcaccaacggacacacacgagaatattgtttgagtgcagcgaatgtaagaaaacattcaccgaatcttcgagcctcgccacacaccagagaatccacgtcggggaacggccttatgagtgcaacgagtgcggtaaaggttttaatcggagcacccacctggtccagcatcaactcattcatacaggggtcaagccttatgaatgtaatgagtgtgacaaggcgtttatccactccagcgctctgatcaaacaccagaggacacacaccggcgaaaaaccatacaagtgtcaagaatgcggcaaggccttttcacactgttcatccctgacgaagcatcagagagtgcacacgggggagaagccgtacgagtgctccgaatgtgggaagactttcagtcagtcaacacatctcgttcaacaccagaggattcatactggggaaaagccctatgagtgcaacgagtgtggtaaaactttctcaagatcctctaattttgcaaaacaccagaggatccacattgggaagaagccctataagtgttccgaatgtggcaaggccttcatccacagttctgcgttaatccagcaccaacgcactcacactggggagaagcctttccgctgcaacgagtgcggtaaaagtttcaagtgcagctcgagtctcatccggcatcaacgcgtgcacacagaggagcagccttag

SEQ ID NO: 25137 - DNA, 1569 bp, Artificial Sequence
  Description of Artificial Sequence: Synthetic coding sequence
atggagacggacctcgccgaaatgcctgagaaaggtgtgctatcatcccaggattccccgcattttcaagagaagtccactgaagagggggaggtagcagccctccgccttacagccagaagtcaagctgctgccgctgcagctgcgccaggatctaggtcccttaggggcgtgcacgtgccaccccctcttcacccggctccagcacgggaagaaatcaaatccacctgttcattaaaggcttgcttcagcctgagcctgactctgacgtattatagaacagcatttctcctgtctaccgagaatgaaggaaacttgcactttcaatgcccgtctgatgtagagacccgccctcagtcgaaagatagcacttccgtgcaagactttagcaaagctgaatcttgcaaagtggctattatcgacaggcttacaaggaattccgtgtatgatagcaacttagaggcagcactggaatgcgagaattggctagagaagcagcaagggaaccaggagaggcacttacgcgagatgttcactcatatgaattccctgagtgaggagacagatcacgagcatgacgtgtactggaagtccttcaaccagaaatctgtgctgataactgaagatcgtgtaccaaaggggagttatgccttccacacactcgaaaagtccctgaaacagaagagcaacctcatgaagaagcagagaacgtataaggaaaaaaagcctcacaagtgcaatgattgcggagagctctttacttgccactctgtccacatacagcaccagcgagtgcacaccggcgagaagccatacacctgtaatgagtgtggaaaatcattctcccacagggccaatctgaccaaacatcagaggacacataccagaattttattcgagtgtagggagtgcaaaaagactttcactgagtcctcttcactggccacccaccagcgcatccatgtcggcgaacgcccttatgaatgtaatgagtgcggaaagggtttcaaccgatcgacgcacctggtgcagcaccaactgatccatacaggagtgaggccatacgaatgtaacgagtgcgacaaggcatttatccattcctcagcactaatcaagcatcagaggactcacaccggcgagaaaccctacaagtgccaggagtgcggcaaggccttctctcactgtagctctctgacaaagcatcaacgcgttcacacaggagaaaaaccatatgaatgtagcgaatgcggaaagacctttagtcagtctactcacttagtccaacatcaacgcatccacacaggggagaaaccctatgaatgcagcgaatgcggcaagacattcagccaatcttccaactttgccaagcaccagagaatccacatcggcaagaaaccctacaagtgtagtgaatgcgggaaagcatttattcacagcagcgccctgattcagcatcagagaacccacacaggagagaagccatttcggtgtaatgagtgtgggaaatcgttcaaatgctccagcagcctgattaggcatcaaagagtccatacagaggagcagccttag

SEQ ID NO: 25138 - DNA, 2286 bp, Artificial Sequence
  Description of Artificial Sequence: Synthetic coding sequence
atgttagcatcctctaaacggatgaactcatcaagtagaagtcaaatcctgctccgttggaaatcagacaaggcgcagtctgggccttataatgttgagaaggaaatccttacctccaggttcctcagagacaccgagacatgtaggcagaactttagaaacttcccgtaccctgacctggcgggaccccgtaaggcactgagtcagcttcgcgagctctgcctcaagtggttgaggcctgaaatccattcaaaagaacagatacttgagctattagtcctcgagcagtttttgacaatactaccaggcgaggttcggacctgggtgaagagtcaatatcccgagtcgtcagaggaggccgtaaccctcgtggaggatctgacgcagattctggaagaagaagccccacaaaatagcactttgtcccaggacactcccgaggaggatccgagaggtaagcacgcattccagaccggttggttaaacgaccttgtgacaaaggaatctatgacctttaaagatgtggctgtggatattacacaggaagactgggagctgatgaggcctgtgcagaaggagctgtacaaaacggtgaccctgcaaaattactggaatatggtgagtttggggttgaccgtctacaggcctaccgtgattccgatcctagaggaaccttggatggtcattaaagagattttagagggaccctccccagagtgggagaccaaggcacaggcgtgtacaccagtggaggacatgagtaaactgaccaaagaggaaacacacactattaaactggaggatagttatgattatgatgataggctggagaggcgcggaaaaggcggattctggaaaattcatactgacgagcggggattttccctgaagtctgtcctttcgcaagagtatgaccctaccgaggagtgcctatctaagtacgatatttaccgaaataattttgaaaagcactctaacctaatcgtacagtttgatactcagctggataacaaaacaagtgtctacaatgaagggagagccacgtttaaccatgtgagctacgggatcgtccatcgcaaaattttgcctggggaaaagccctataagtgtaatgtctgcggaaagaaatttaggaagtacccaagcttactgaagcatcaatccacccatgcgaaagagaaatcgtacgagtgcgaagagtgtgggaaggagttcaggcatatatcttcgcttattgcccatcaacggatgcacactggagagaaaccgtatgaatgccaccagtgcgggaaagctttctcacaacgggctcacctgactattcaccagcgaatccatacaggcgaaaaaccctacaagtgcgacgactgtgggaaggactttagtcaaagggcacatttaactatccaccaacgcactcacacaggggagaaaccgtataaatgtctggaatgcggtaagacgtttagtcattcgagttcgctgattaatcaccaaagagttcacacaggcgaaaagccatacatctgtaatgaatgtgggaagaccttttcccaaagcacacacctgttgcagcaccaaaagatccatacaggcaaaaagccctataagtgcaacgaatgttggaaggtgttcagccagagtacttacctgatcagacaccaacggatccactctggcgaaaagtgctacaaatgtaacgaatgcggaaaagcctttgcccactccagcactctcattcagcaccaaactacccacactggagagaaaagctacatatgtaacatatgcggcaaagccttctctcagtctgctaaccttacccaacatcatagaacacatacgggcgaaaaaccttacaaatgctccgtgtgcgggaaagcgttcagtcagtctgtgcatctcacacaacatcagcggattcacaacggagagaaaccttttaaatgtaatatttgtggaaaggcctacaggcaaggggctaatttgactcagcaccagagaattcatactggcgaaaagccctataaatgtaacgagtgcgggaaggcatttatttattcctcgtcattgaaccagcatcagcggacccatactggagaaaggccgtacaagtgcaatgagtgcgataaggattttagccagagaacctgcctcattcaacaccagcgcatccataccggcgagaaaccatacgcctgcagaatctgcggcaagacgttcactcaatccacaaatttgatacaacatcagcgggttcatactggagcaaagcaccgcaattag

SEQ ID NO: 25139 - DNA, 2286 bp, Artificial Sequence
  Description of Artificial Sequence: Synthetic coding sequence
atgctggcttctagtaaaagaatgaatagtagcagcaggagccagattctcctccggtggaagagtgataaagcccagtccggaccttataatgtcgagaaagagatattaaccagccgatttctcagagacacagagacatgcagacagaattttaggaatttcccttatcccgacctcgcaggcccaagaaaagccctgtctcagctccgggaattatgtctcaaatggctgcgtcctgagatacactctaaggaacagattctggagcttctcgtcctcgagcaattcctgaccatacttcccggtgaagtgagaacatgggtcaagagtcagtatcctgaatcctctgaagaggccgtgacactggtcgaggatctcactcagatcctggaggaagaagcaccacagaatagcactctgtctcaggacacgccagaagaggacccgagagggaaacacgctttccagaccgggtggctgaacgatttggttaccaaggaaagcatgacatttaaggacgtcgccgtagatatcacacaggaggactgggaactcatgagaccagtgcagaaggagctctataaaaccgttacactacaaaactattggaacatggtgagcctaggtctgaccgtgtaccgtcccacagttatccccatccttgaggagccttggatggtaattaaggagattttggagggcccatccccagagtgggagacgaaagctcaggcgtgtacccctgtggaggacatgagcaagctgaccaaagaggaaacccatactattaagctggaggattcctacgattatgacgataggctggaaaggcgaggaaagggagggttttggaagattcacaccgacgaacggggtttttccttgaaatccgtactctcgcaagagtatgacccaacagaggaatgcttgagcaaatatgacatctataggaacaactttgaaaagcatagtaacctgattgtgcagttcgatacacaactggataacaagacctcggtgtacaatgagggtcgcgctacatttaatcacgtgagctatggaatcgttcatagaaaaattctgcccggtgaaaaaccgtataaatgtaacgtgtgcgggaaaaagtttcgtaagtatccatctctcctcaaacaccagtccactcacgcgaaagagaaaagctacgagtgcgaagagtgcggtaaagagttccgtcacatctcgtccttaatagcccaccagcgaatgcacacgggagagaagccctacgaatgccatcagtgtggaaaggctttcagccagcgtgcccatctgacaatccaccaacggatccacactggcgaaaagccatacaaatgcgacgactgtggtaaagatttcagccagagggcgcacctcaccatccaccagcggactcacactggagagaagccttacaagtgcctggaatgtggaaagacatttagccattccagttctcttatcaaccaccagcgggtgcacacaggtgagaagccgtatatctgtaacgagtgcggcaaaacctttagccagagtacccaccttttgcaacaccagaagatccatacaggtaaaaaaccatacaagtgcaatgagtgctggaaagtcttctcacagtctacctatctgattcgccatcagcgtattcatagcggagagaagtgctacaaatgcaatgagtgtggcaaggcattcgcccacagttctacgctgatccagcaccagaccacacatactggcgaaaagagctatatctgtaatatatgtgggaaggcattctcccagtcggctaacctgacgcaacaccaccgcactcataccggggaaaagccttataaatgttcagtatgcggcaaagcattttcccaatcagtccatctgacccagcaccagcgcatccacaacggcgaaaaaccctttaagtgtaatatctgcgggaaagcgtatagacaaggcgcaaacctcacacagcatcaacgaatccacacaggcgagaagccttataagtgcaacgagtgcggaaaagccttcatttactccagtagtctcaatcagcaccaacgcactcatacaggcgagcgaccgtacaaatgcaacgaatgcgataaagacttctcgcagcgaacatgtcttattcagcatcagcgtattcataccggagagaagccatatgcatgccggatctgtggcaaaacattcacacagtccaccaatctaattcaacaccaacgggtccacactggggctaagcaccgcaattag

SEQ ID NO: 25140 - DNA, 174 bp, Artificial Sequence
  Description of Artificial Sequence: Synthetic coding sequence
atgctggccagctccaagagaatgaatagttcttctcgcagccaaatcctactgagatggaagtctgataaggcacagtccggcccatacaacgtcgaaaaggagattctcactagtagatttttgagggacacagagacatgtaggcagaacttccgtaatttcccctactag

SEQ ID NO: 25141 - DNA, 8156 bp, Artificial Sequence
  Description of Artificial Sequence: Synthetic coding sequence
atggccgacgaagaagccgagcaagaaaggctctcatgcggcgaaggaggctgcgtagcagagctgcagcgcctgggcgagcggctccaagagctcgagcttcaacttcgcgaatcccgcgtcccagccgttgaagctgctaccgattactgtcagcaactgtgtcagactctcctcgagtatgccgagaaatggaaaactagcgaagaccctctccctctcttggaagtttacaccgtagcaatccagagctacgtgaaagccagaccgtatcttacgtctgagtgcgaaaacgtggcacttgtgctggaacggcttgccctcagctgcgtagagctgctgctgtgtcttccggtagagctatctgacaaacagtgggagcaatttcagaccctggtgcaagtggcccatgagaaactgatggagaacggcagttgtgagctgcactttctcgctaccctggcccaggaaaccggtgtttggaaaaatccggttctgtgcaccatcctgtcgcaggaaccgctggacaaggacaaagctttcgagggccctatcctacttgatatgcggattaaacacttgatcaaaaccaaccagctgtcacaagcaactgccctcgccaaactttgctcagaccaccctgaaattggaatcaagggatccttcaagcagacatatctggtttgtctgtgtacttctagccccaacggcaaacttatcgaggagatctcagaggtggactgcaaagacgccctggaaatgatttgcaatctcgagtcagagggggatgagaaaagcgcattggttctatgtacagcgttcttgtcgagacagctacagcagggtgacatgtactgcgcctgggaactcacgctgttttggtcaaaactgcagcagagagtcgaacctagtattcaggtctatctagagcgctgccgacagctgagcctgctgacgaagactgtgtatcacatcttcttcctcattaaggtaattaactcggaaaccgagggcgctggcctcgctacatgtatcgaactttgcgtgaaagccctgcggctggagagcactgagaatacagaggtcaagattagcatctgtaagaccattagctgtctactaccggacgacctggaagttaagcgtgcttgtcaactttccgaatttctcattgagcccactgtagacgcttattacgctgtcgagatgctatacaatcagcctgaccagaaatacgacgaggagaacttaccgatccccaatagcttgcgctgtgagctgttgctggttctgaagactcagtggcccttcgatcctgagttctgggactggaagactctgaaaagacagtgcctcgccctgatgggcgaggaagcatcaatcgtcagtagtatcgatgagctcaacgactccgaggtgtacgagaaagtggtagattatcaggaggagtccaaggaaactagtatgaacggactctctggcggtgtcggagctaactctggcctgcttaaggacataggggacgagaagcagaaaaagcgagaaatcaaacaactgcgggaacggggtttcatctcagctcgatttagaaactggcaggcctatatgcagtactgtgttttatgtgacaaggaattcctgggccatcgaatcgtccgccatgcccaaaagcattataaggatggcatctattcgtgccccatatgcgccaaaaattttaattccaaggaaaccttcgtacctcacgtaaccttacatgtgaagcagagcagcaaggaacgcctggccgctatgaagccactccgccgtctagggagaccccctaaaattaccacaacaaatgagaaccagaagacgaatactgtggctaagcaggagcaaaggccgataaaaaagaactcactgtatagtaccgacttcattgtgtttaacgacaatgatggctctgacgacgagaatgatgacaaggacaagagttatgaaccagaagtaatccccgttcagaagccagtgccagtaaatgagtttaactgtcctgtaacattctgcaaaaagggattcaagtacttcaaaaacctcattgcgcacgttaaaggccacaaggacaatgaggatgctaagcggtttctagaaatgcagtcaaaaaaggttatttgccagtactgccgcagacatttcgtgtctgtcacacacttaaacgaccatcttcagatgcactgcggatctaaaccatatatctgcattcagatgaagtgtaaagctggattcaattcctatgccgagttgctgacgcatcgtaaggaacaccaggtgtttcgtgctaaatgcatgtttccaaagtgtggcagaatcttctcggaggcatatctcctctacgatcatgaggcacaacactataacacctatacttgcaagttcacggggtgcggcaaggtgtaccgtagccagggggagctcgagaaacatctggacgatcacagcaccccaccagagaaagtgttgccgccagaagcccagctgaattcctccggggacagcatccagcccagtgaggtgaaccaaaatacagccgaaaacattgaaaaggagaggtctatgctgccatccgaaaacaatatcgagaactcacttctcgccgatagaagcgacgcttgggataaaagcaaagcagaaagcgccgtcaccaaacaagaccagattagtgcttctgagcttcggcaagccaatggaccacttagcaacggactggaaaaccccgcaactactcctctcctgcagtcatccgaggtagctgtgagtatcaaagtgtccctgaatcagggaattgaagataactttggaaagcaggagaattctactgtcgaggggtccggggaagcattagtcacagacctccatacacccgtagaagacacctgtaatgatctgtgtcatcctggcttccaggaacgaaaggaacaggactgctttaatgacgcacacgttacccagaactcattagtgaacagtgagacgcttaagatcggggacctgactccacaaaacctggagcgccaggtaaacaatttgatgactttcagtgtgcagaatcaggcggcattccagaataatctccctacttctaagttcgaatgcggcgataacgtaaagaccagctcaaacctgtacaacctccctctgaaaaccctcgagtccatcgcttttgtgcctccccagtctgatttgtctaactcactgggcacaccttctgttccacccaaggcccctgtgcagaaatttagctgccaagtcgaggggtgtacacgcacttataattcctctcagagcattggcaagcatatgaagacagcacacccagatcagtatgccgcattcaagatgcagagaaaaagcaaaaaggggcaaaaggccaacaatctgaatacccccaataatggaaaatttgtttatttcctaccgtcgcctgttaactccagcaatcccttctttacgtcccagaccaaggccaatgggaatcccgcatgttccgcacagctccaacatgtgtcacccccaattttccccgcacacttggcctccgtctctaccccattgttatccagtatggaatctgtcataaatcctaacataacctcacaggataaaaatgaacagggaggcatgctgtgcagccaaatggagaacttacccagtactgcattgccggctcaaatggaggatcttacaaaaaccgtcctaccgttgaacattgactcgggatcggacccttttctgcccttacccgctgaaagtagctcaatgtccctttttccaagccccgctgactctgggactaattcagtgttcagccagctcgagaacaacaccaaccactattcatcacagatagagggaaacactaacagcagttttttgaagggtggtaacggcgagaatgccgtctttccatcccaagtgaacgttgctaacaacttctcctcgaccaatgctcagcagagtgcacccgagaaagtgaaaaaagatcggggtagaggcccaaatggcaaagaacgaaagcctaagcacaacaaacgcgctaaatggcccgctattataagagatggcaaattcatatgctcacgttgctacagagcgtttactaacccgaggtccttgggcggtcatctgtccaagaggagctattgcaagcccttggatggcgcagagatcgcccaggaactgttgcagagcaacggacaaccaagccttttggcaagcatgatcctgtctaccaatgccgtgaatctgcagcagcctcagcagagtacctttaatcctgaggcttgctttaaagatcctagttttctccagctccttgccgaaaatcgcagccccgctttcctgccaaatactttccccaggtctggtgtaacgaacttcaacacttcagtttcccaagagggatctgagattattaaacaagctctagagactgcgggaatcccctccacttttgagggcgcagagatgctctcccacgtttcgactggctgtgtgagcgatgctagtcaagtgaacgccaccgtgatgcccaatccaacggtacctcccctcctccacaccgtgtgtcaccctaacaccctcctgaccaaccagaataggacctcgaacagcaagacctcatctattgaggaatgttcttccctcccagtatttccaacaaatgaccttctcttaaaaaccgtggaaaatgggctgtgctcctcgtccttccctaacagcggcggaccgtcccagaattttacctctaattcaagccgggttagcgtaatctcaggcccacagaacacacgcagctcccacctgaacaagaagggtaattctgccagtaaaaggcgcaaaaaggtagcacctcctctgattgctccaaatgcctcgcagaatctcgtgacgtcagatctcaccacaatgggtcttatcgcgaagtctgtggagatccccactaccaacttacacagtaatgtgatacctacctgcgagcctcaaagtcttgtggagaatttgactcagaaactgaataatgtcaacaaccagcttttcatgaccgacgttaaagagaactttaagacaagcctggaaagtcataccgtgctagcacccctgactttaaaaaccgaaaacggggacagccagatgatggccctgaattcctgcaccactagcatcaattccgatttgcagatttcagaagacaatgtgattcagaactttgagaaaacccttgagataattaagaccgcgatgaactctcagatcctggaggttaagtcaggtagccagggcgctggggaaacctcccagaatgctcaaatcaattacaatatacagctcccatctgtcaatactgttcagaataacaaacttcctgattccagtcctttttcatcttttataagcgtgatgcccactaaatcgaacatcccccagagcgaggtgtctcacaaggaagatcagatacaagaaattctcgagggcttacaaaagctgaaattggaaaacgacctgagtactcctgcctcccagtgcgtcctgattaatacttcagtgaccctcacaccgacgcctgtgaagtcaacggctgacatcaccgttatccagcctgtgtccgagatgattaatatccaattcaatgacaaagtgaacaagccgttcgtttgccagaatcagggctgtaactatagtgctatgacgaaggacgccctgtttaaacattatggaaaaattcaccagtacacaccagagatgatattggagattaaaaagaaccagctgaaatttgcaccattcaagtgcgtggtgcctacttgtacaaagacattcacccgcaatagtaacctgagagcacactgtcaactggtgcaccatttcaccactgaagaaatggtgaagctgaagatcaagcgaccttacggtaggaagtcacagagtgagaatgtcccggcatccagatccacacaagtcaaaaaacagctggccatgaccgaggagaacaagaaagaatctcagccagccctcgagctgcgcgcagagactcagaacacgcacagtaatgtggccgtcattcctgaaaaacaactagtcgaaaaaaaaagccctgataagacagagtctagccttcaagtgattaccgttacatccgaacagtgcaataccaatgccctgactaacacacaaaccaagggcaggaagatacggagacacaagaaagagaaggaggagaagaagcgcaagaagccagtcagccagtccctggagtttccgacgcgctactccccatacagaccttataggtgtgtgcatcagggttgctttgcagctttcacaatccagcagaacttaatactgcactaccaggcagtgcataagtccgacctgcccgcattctcagcggaagtcgaagaggagtcggaggctggtaaggagagtgaggaaactgagaccaagcaaacgctgaaggagtttcggtgccaggtgagcgactgcagtcgaatcttccaggctatcactggcctgatccagcactatatgaagttacacgaaatgacacctgaagaaattgagagtatgactgcaagtgttgacgtgggcaaatttccttgcgatcagctggaatgcaagtcctccttcacgacctacttaaactatgtggtccatttggaggccgaccacggaatagggttacgagcaagcaagacagaagaagatggtgtctacaaatgtgactgtgagggctgcgaccgaatctacgccactagatccaatctgcttcgccacatttttaacaaacacaacgacaaacataaggcgcaccttatccgaccacgcagactaacccctgggcaggagaatatgagcagtaaggccaaccaagagaaatcgaaatcaaagcaccgcggtaccaagcacagcaggtgtggcaaagaaggcatcaagatgcctaagaccaaaaggaagaaaaagaataaccttgaaaacaagaatgcgaagatagtccagatcgaagagaacaaaccttattccctgaagagggggaagcacgtgtattctatcaaggctaggaatgacgctttatccgaatgcactagccggttcgtcacccagtatccctgtatgattaaggggtgcacttctgtcgtcacttcagagagcaacattatccggcactacaagtgccataagttatctaaagccttcacatcacagcaccggaatctcctgatcgtcttcaagagatgctgcaacagccaggtcaaggagacatcagagcaggaaggagcgaaaaatgatgttaaagatagcgacacttgcgtgtcagagtcaaacgacaactcgcggactaccgctactgtgtcgcagaaggaggtcgagaagaatgagaaagacgagatggacgagctcactgagttgttcatcacgaagctcatcaacgaagactccaccagcgtcgaaacacaggccaacacctcctcgaatgtgtccaacgattttcaggaggataatctgtgtcagagcgagagacagaaagcgtctaacctgaagcgagtgaacaaagaaaagaacgtgagtcaaaataagaagcggaaggtggagaaggcagagcccgcatcagccgcagaactgtcctcggtgaggaaagaagaggagacagccgtcgccattcagactatcgaagaacatcctgccagcttcgactggtcttccttcaagcccatgggttttgaggtgtccttcttgaagtttttggaagagagcgccgtgaagcaaaagaaaaacactgataaagaccacccaaataccggcaacaaaaagggttcccacagtaactcacggaaaaatatagacaagacagctgtcacttcaggtaatcatgtatgcccatgtaaggaatcagaaaccttcgtccagttcgcgaatccaagtcagttgcaatgttctgataatgttaaaatcgtcttggataaaaaccttaaagactgtaccgaacttgtcttaaaacagctccaagaaatgaagccaacggtgagcctgaaaaagctggaggtgcactccaatgacccagacatgtcagtcatgaaggatatttccatcgggaaagccacgggaagggggcagtatta

SEQ ID NO: 25142 - DNA, 8171 bp, Artificial Sequence
  Description of Artificial Sequence: Synthetic coding sequence
atggcagacgaggaagccgagcaggaacgcctttcatgtggcgagggcggatgcgtggcagagctgcagcgtcttggtgagcggttgcaggaattagagctgcagctgcgcgagagccgcgtaccagccgtagaggctgcaactgactactgccagcagctctgccagacactgttggaatatgccgagaagtggaagacctcagaggatcctctacctttactcgaagtgtacaccgtcgccatccaatcatacgtaaaggctcggccatacttgacttccgagtgtgaaaacgtagccctcgttctcgaacgactggcactgtcatgcgtggaactcctgttgtgtttgcccgtcgagctaagcgataagcagtgggagcagttccagacgctcgtgcaggtggctcacgagaagctgatggagaatggaagctgtgagctgcattttctcgccacactggctcaggagactggtgtatggaaaaatccagttttgtgcacgatcctttcccaggaaccccttgacaaggacaaggtgaacgaatttttagccttcgaggggcctattcttcttgacatgcgtattaagcatcttatcaagaccaatcagctctctcaagctacggcgctcgcaaaactttgctccgatcatccagaaattggaataaaagggagtttcaagcagacatatctcgtgtgtctgtgtacgtcaagtcccaacggaaagttgattgaagaaataagcgaagttgactgcaaggacgctctcgaaatgatttgtaacttagagtccgaaggcgatgagaaatccgcactggtcctttgtacagccttcctgtctaggcaactgcagcagggcgatatgtactgcgcttgggaactgactttgttctggtctaaactgcagcaacgcgttgagcctagtattcaggtatatttggagagatgccgccagctgagtttgctgactaaaacagtgtatcatatcttttttctgattaaagttatcaactctgagaccgaaggcgctgggctggctacctgcattgaactgtgtgtcaaggcccttagattggagtctacagagaacaccgaggtcaagatctccatctgcaaaaccatcagctgtctgttgcctgacgatctggaagttaaacgcgcttgtcagctgtcagaattcctgatcgagccaaccgtggacgcgtactacgccgtggagatgctgtacaatcaaccagaccaaaaatacgatgaggagaatttgccaattcccaattcgctacgatgtgagctgctgctggtgttgaaaactcagtggccatttgatcccgaattttgggattggaaaactctcaaacgccagtgccttgcgttgatgggagaggaggcatcgatcgtgtcctctatcgacgaactaaacgactctgaagtgtacgagaaggtagtggattatcaggaagaaagtaaagagacgagcatgaatggcttgtctggcggagttggggctaattctggactactcaaggatataggcgatgaaaaacagaagaaacgagaaatcaagcagttacgagagagagggtttatcagcgcaagattccgaaattggcaggcctatatgcaatattgtgtcctatgcgataaagaatttcttggccaccgcattgtgaggcacgctcaaaagcattataaggacggaatatactcctgtcccatttgcgctaagaatttcaatagcaaagaaacatttgtcccccatgttaccttacacgtgaagcagtcctcaaaggagcgtctggccgctatgaagcccttgagaagacttgggaggccgcctaaaattactacaaccaacgaaaatcagaagactaataccgtcgccaagcaggagcagcggccaatcaaaaagaattcattgtatagtactgacttcattgtcttcaatgataacgatggtagtgacgacgagaacgacgataaggataagtcttacgagccggaggtgatccccgtccagaagcctgtgccagtgaatgagttcaattgccctgtgacattctgcaagaaaggattcaagtatttcaaaaatttaattgcacatgtgaagggacacaaggacaacgaggacgctaaaagattccttgagatgcagagcaaaaaggtgatctgtcagtactgtcgtaggcacttcgtttcggtaacacacctcaacgatcacctgcagatgcactgtggatctaagccctatatttgtattcagatgaaatgtaaagccggtttcaattcttatgccgagttattgacacaccgaaaagagcaccaggtgttcagagcaaagtgtatgttcccaaagtgtggcaggatcttctcagaagcatacctgctgtacgatcatgaggcccagcactacaacacctacacttgcaagttcactggatgcgggaaggtgtaccggagccagggcgagttggagaagcatctggacgaccattccacacctcctgagaaagttttgccccctgaagcccagctgaattctagcggtgattctatccagcccagtgaggtgaatcaaaatactgctgaaaacatcgagaaagagagatccatgttaccttctgagaataatattgaaaatagcctgctggccgaccggagtgacgcttgggataaatccaaagccgagtctgcagtgactaaacaagatcagatctcagcctccgaacttcggcaggccaatggcccactttccaacggtctggaaaatcccgcaacaaccccattactgcagtccagcgaggtggccgtgtctattaaggtatcgttgaatcagggaatagaggacaacttcggcaagcaggaaaactccactgtcgaggggagcggcgaggcactggtgacagacctgcatacccccgttgaggacacctgtaacgacctctgccaccccggattccaggagcggaaagagcaagactgcttcaatgatgcccacgtgacacagaattccctcgtgaactccgaaacgctgaagatcggtgatctgactccacagaacttggaacgccaggtgaataacttgatgaccttctcagtccagaaccaagctgccttccaaaacaacctccccacaagcaagtttgagtgcggtgataacgtcaaaacctctagcaacctgtataatctcccactgaagacactcgagagcatcgcctttgtaccaccccaaagtgacctttcgaatagccttggaacaccgagtgtccctcccaaggcccctgtgcagaagttttcttgtcaggtggaggggtgcacccgtacatacaacagctcccagagcattggaaaacatatgaagactgcgcatccagaccagtacgcagcctttaaaatgcagaggaaatcaaagaaggggcagaaggccaacaacttgaatacccctaacaatgggaagttcgtgtacttccttccatccccagtgaactccagtaaccccttctttacaagtcaaactaaggctaacggcaatccggcttgctctgcacagctccagcacgtctctcctcccatctttcccgcacatttggcgtcagtgtctacgccactgctttcaagcatggaatccgtaattaacccgaatattacttcccaggacaagaacgagcaaggaggaatgctgtgctctcagatggaaaacctcccgagtaccgccctccccgctcagatggaggacttgaccaaaaccgtcctgccccttaacatcgattccggttcggaccctttccttccccttcccgctgagtcctccagtatgagcttatttccttcacccgcagactctggtactaatagcgtattttcgcaactcgagaataataccaatcattactctagccagattgagggcaatacaaattcctcctttctgaaagggggtaacggggagaatgcagttttcccttcccaggtgaatgtcgcaaataactttagctctaccaatgcacagcagtcagcacctgagaaggtgaagaaggatcgcggtcggggtcccaacgggaaagaaaggaagccaaaacacaacaagcgggctaaatggccggcaataatcagagatggcaagttcatttgtagccgctgctatcgcgctttcaccaacccaagaagcctcggaggtcatcttagtaagcggagttattgcaagcctcttgatggcgctgaaattgcccaggagcttttacagagcaatgggcagccgtccctcctggcatcgatgatccttagtactaacgccgtcaaccttcagcagccccagcaatctactttcaaccctgaggcatgcttcaaagatccgagtttcctgcagttgttagcagagaatcgtagcccagctttcctgccgaatacgttcccacggtccggggttactaactttaacacgtcggtttcccaggaaggatcagaaatcattaaacaggcactcgagacggcgggaataccctctactttcgagggggctgaaatgttaagccatgtgtctaccgggtgcgttagcgacgcctcccaggtcaatgctacggtcatgcctaacccaacagttccgcctctcctgcacaccgtttgccaccccaataccctgctgactaaccagaatcggaccagcaactccaagacttcctcaatagaagagtgcagctccctgccagtgtttccgacaaatgatctgcttctcaaaacagtggagaacggcctctgctctagctcattccccaatagcggtggaccgtctcagaatttcacctctaactcttccagggtgtccgtcattagtggaccccaaaacacacggtctagccatctcaataagaagggcaatagtgcctcgaaaaggaggaaaaaggtggctcccccactcatcgctcctaacgcctcccagaacctggttacatccgatctgaccaccatggggttgatcgccaaaagtgtagagattcctacgaccaacttacattcgaacgttattcccacatgcgaaccccagtcacttgtagaaaatttgacacagaaactgaacaacgtgaacaaccaactctttatgactgatgtaaaggagaactttaagacctctctggaatcacatacagtgctggcaccccttaccctcaagaccgagaacggggacagccagatgatggctctgaactcttgcacaacaagtataaattcagacctgcagatctctgaagacaatgtcatccagaatttcgaaaaaaccttggaaataatcaaaactgccatgaattcgcagattctggaggtgaagtctggttcgcagggggctggggagacaagtcagaatgcccagatcaattacaatatccagcttccatctgtcaatacagtgcagaacaataagctgccagattctagtcctttcagctctttcatcagcgtgatgccgacaaaaagcaacataccgcaaagcgaagtgtcccataaggaggaccagatccaagaaatcctggagggcctgcaaaaattgaaattggaaaacgatctttctacaccagcctcccagtgcgtactcatcaatacaagcgtgacactgactccaactcccgtaaagtctactgccgacataacagttatccaacccgtgtcagagatgatcaacattcagtttaacgacaaagtaaataaaccatttgtgtgccagaatcaaggttgcaattattctgccatgactaaggatgcactatttaaacactatggcaagatccaccaatatacgcctgagatgatcctggaaatcaagaagaatcagcttaaattcgccccatttaagtgcgttgttccaacatgtacgaaaaccttcactcggaattctaacctccgtgcacactgtcaactggtgcatcatttcaccaccgaagagatggttaagcttaaaatcaaacgcccatatgggcgaaagagtcagtccgaaaatgtgccggctagcaggtctacacaagtgaaaaaacagctcgctatgaccgaagagaataaaaaggagtctcagcccgcacttgaattaagggcggaaacacaaaacacccattccaacgtggcggtaatacctgaaaagcagctggtggagaagaaatcccctgataagacagagtccagcctgcaggttattaccgtgacctcagaacagtgtaacactaacgccctaacaaatacccagaccaaggggaggaagatcaggcgtcacaagaaggagaaagaggagaaaaaaagaaagaagcctgtttctcagagcctcgagttccccacccgctacagtccctacaggccgtatcgctgtgtacaccaggggtgctttgcagcctttacaattcaacaaaacctgattctgcactatcaggccgttcataaaagcgatcttcctgcattcagtgccgaggtggaagaagaaagtgaggccggtaaggagagcgaggaaacagaaaccaagcagaccttgaaagagttccgatgtcaagtttcagattgctcccggatatttcaggctatcacaggtctgatccaacactatatgaagcttcacgagatgacccctgaagagatcgagagcatgacggcatcggtggacgtggggaaatttccttgtgaccagttagaatgtaagtcttcctttacaacatacctcaactacgtggtgcacctcgaagccgaccatgggattggtttgcgcgcttcaaaaactgaggaggacggggtttacaagtgtgattgtgagggatgcgatagaatatacgcgacccgaagcaacctgttacggcacatcttcaataagcacaacgataaacacaaagcccaccttatcaggcccaggagattgactcctggccaggagaacatgtcctctaaagcgaatcaggaaaaatccaaatccaagcaccgcggaaccaagcactctcgatgtggaaaagagggcattaagatgccaaagaccaagcgtaaaaaaaaaaataatctcgagaacaagaatgcaaagatcgtgcagattgaagaaaataagccttacagcctcaagagaggaaagcacgtgtatagcatcaaagccaggaatgacgctctctccgaatgcacttctagatttgtgacccaatacccctgcatgatcaaagggtgtactagcgtggtaacaagcgagagcaatataattcgccactataaatgtcataaacttagtaaagcattcacttctcagcacaggaacctattgatcgttttcaaaaggtgctgtaacagccaggtcaaggaaacctctgagcaagagggagctaaaaatgacgtgaaggattctgacacctgcgtgtctgagagtaacgataattcacgaacgactgcaactgtgtcccagaaagaggtcgagaagaatgaaaaggacgagatggacgaattaacagaactgttcattacgaagctgataaacgaggactcaaccagcgtagaaacccaggcaaacacatcctcaaatgtgtctaacgattttcaggaggacaatctttgccagagtgagaggcagaaagcaagtaacctaaagcgggtgaataaagaaaaaaacgtatcccagaataagaagcgcaaggtcgaaaaagctgaaccggcatcagccgcagagctctcaagcgtccggaaggaggaagaaacagccgtggctatacagacgatcgaagagcaccctgcctctttcgattggagctctttcaagcctatgggcttcgaagtgtcgtttttaaagtttctcgaggaaagtgctgtgaagcagaagaaaaatacggataaagatcatccaaacacaggtaataaaaagggatcccactcgaactcacggaagaacattgacaagacagccgtgacttccggcaatcatgtgtgtccgtgcaaagaatccgaaaccttcgtgcagttcgccaatccttcgcagctgcagtgcagcgacaacgttaagatcgtgctcgataaaaacctgaaggattgcactgagctcgtccttaaacagttacaggaaatgaagcctacagtcagtctgaagaaattagaagtccactccaatgatccagatatgtcagtgatgaaggacatttcaattgggaaagccaccgggcgtggccaatacta

SEQ ID NO: 25143 - DNA, 3201 bp, Artificial Sequence
  Description of Artificial Sequence: Synthetic coding sequence
atggagggcctccttcactacataaatcccgcacacgcaataagcctcctgtccgccctcaatgaagaacggttgaagggacagctgtgtgacgtattgttgatcgtgggagatcagaaattccgggcacacaaaaacgtactcgctgcctcctctgaatactttcagtccctctttacaaataaggaaaatgagtcacagaccgtattccaattagacttttgcgagccggacgcctttgataacgtcttgaattacatatatagttcaagtctgtttgtggagaaaagctcgctcgccgcagtgcaggaactaggctatagcttgggcatctccttccttacaaacattgtatcaaagaccccccaggccccattccccacctgcccaaatcggaagaaagtgttcgtcgaagacgatgaaaacagcagtcagaagcgcagcgtcatcgtttgccagtcacgtaacgaggcacagggtaagacagtgtcacagaaccagcccgatgtctcccatacctcaagaccctccccttcgatcgcagtgaaggccaacactaacaagccacacgtgccaaaacctatcgaacccctccacaacctgagtctgaccgagaaaagttggccaaaagactcatccgttgtgtacgccaaatcccttgaacattcaggctcactcgatgacccaaaccgcattagtctggtgaagcgaaatgcggttctgccgtctaaacctctgcaagatcgagaagctatggacgacaagccgggtgtgagcgggcaactgccaaaagggaaagccctcgagttggcactaaagcgtccacgccctccggtcctgtccgtgtgctcttcctccgaaactccttatctactgaaggagactaacaagggtaatgggcagggggaggatcgcaacctcctatactactcaaagctgggactggtcatccctagctcgggtagtggaagtggcaaccagtccatcgaccggagtggaccacttgttaaatcactgttaagaaggtccctgagcatggactcccaggtcccagtgtactccccgagtatcgaccttaaatcctctcaggggtcttcctctgtgtcctccgacgcacccggtaacgtgctgtgtgcccttagccagaagagcagtttgaaggactgtagtgaaaagactgccctggacgatcgcccacaagtcctgcagcctcatagactacggtctttttcagcatcccagtctactgatagagagggggcaagccccgtgacagaggtgcgaattaaaacagagccgagctcaccactttccgatccttcagacatcattagagtgactgtgggggatgccgctactaccgcagccgcttctagctcatcagttacccgggacctcagtctcaagacggaagacgatcagaaagatatgtcgcggctccccgcaaaacggagatttcaggctgaccggcgactgccctttaagaagctgaaggtgaacgaacatggaagtcccgtctctgaggacaatttcgaggagggcagttctcccactctcttggacgctgactttcctgactctgatttgaataaagacgaatttggtgaactcgaggggacccggccaaacaagaagtttaagtgtaagcactgcctgaaaatcttccgtagcaccgcaggactccatcgtcatgtgaacatgtaccataacccagagaaaccttatgcctgtgatatttgtcacaaaagattccacacaaatttcaaggtttggacgcactgtcagactcagcacggaattgtaaaaaatccatctcctgcttcttccagtcacgccgtcttggacgagaagttccagcgtaagctgatcgatatcgtgcgcgaacgcgagattaagaaggcactgatcatcaaattgcgacgagggaaacccggtttccaagggcaatcctcttctcaggctcagcaggttatcaaaagaaacctccgttcacgcgctaagggggcttacatctgcacatattgtggcaaggcctatagattcctgagccagtttaaacaacatatcaagatgcatcctggtgaaaaacccctgggagttaataaagtcgcaaaaccaaaggagcatgcaccactggcttccccagtggagaataaagaggtgtaccagtgccggctgtgcaatgcaaagctgagttccctgctggagcagggctcccatgaaagactgtgtcgaaacgcagcagtctgtccgtactgctctcttaggtttttttcaccagaactgaagcaggagcacgagtctaaatgcgaatataagaagctcacctgcctggagtgtatgaggacctttaagagctcattttctatctggcgtcaccaggtcgaagtccacaaccagaacaatatggctcctaccgagaacttctccctgccggtgctggaccacaacggcgatgtgacagggtccagccggccacagagccagccagaacctaataaagtgaatcatatcgtgaccaccaaagatgataatgtgttctccgacagcagcgagcaagtgaatttcgacagcgaagacagcagttgtctgccggaggatcttagcctaagcaaacagcttaagatccaggtcaaggaagagcccgtcgaggaggctgaagaagaagccccagaggcttccactgcaccaaaggaggcaggtccgagtaaagaggcgtcattatggccttgcgagaagtgtggaaagatgtttacagtccacaaacagctggagagacatcaggagctgctgtgtagtgttaaaccctttatttgccatgtgtgcaacaaagcctttcgaactaacttccgcctgtggagccactttcagagccatatgtcccaagcttccgaggagagcgcccacaaagagtccgaggtctgcccggtgccaaccaatagtccctcccctccccctttaccgccaccccctcccctgcccaagatacagccattagaaccagattcacctactggcctctccgagaatccgacaccggctactgaaaagctcttcgtgcctcaggaatccgatacactgttctaccatgctccaccgctgtccgcaattacatttaagaggcagttcatgtgcaagctgtgtcaccgcacattcaaaaccgctttttccctgtggtctcacgagcagactcataactag

SEQ ID NO: 25144 - DNA, 150 bp, Artificial Sequence
  Description of Artificial Sequence: Synthetic coding sequence
atggaaggcctgttacattatatcaatccagctcacgccatctcattgctctcagcactaaatgaggaacgcctgaaggggcagctgtgtgatgtgctgttgatcgtcggcgaccagaagttccgggctcataaaaatgttttggcttag

SEQ ID NO: 25145 - DNA, 3201 bp, Artificial Sequence
  Description of Artificial Sequence: Synthetic coding sequence
atggaaggcttgctgcactacatcaatccagctcacgctatcagtctcctgtccgcactgaatgaagagaggctgaagggacaactctgtgatgtgctgcttatcgtaggggaccagaaattccgcgcacacaaaaatgtactggcagcctcatcagaatacttccagagtctgtttacaaacaaagagaacgaatcacagaccgtcttccaactagatttttgtgagccagatgccttcgataacgtactaaactacatttactctagcagcctgttcgtggagaaatcctcactggcagccgtacaggaattgggctatagcctcggtatctccttccttacgaatatagtgtctaagactccacaggctcccttcccaacatgtcccaacagaaagaaggtgtttgtcgaggatgacgagaactcctctcaaaagcgttccgtgatcgtctgtcagagcagaaatgaggcccagggcaagaccgtgagccagaaccagcctgacgtcagtcatactagtcgtccctcaccatcaatcgcagtcaaggccaatacgaataaacctcacgttccaaaaccgatagaaccgcttcacaaccttagtctgaccgagaagtcgtggcccaaagactcaagcgtcgtgtatgcgaaatcgcttgagcactccggctctctcgacgaccccaatcgtatctccctggttaagaggaacgcggtcctgccgagcaagccacttcaggatcgtgaggcgatggatgataaacctggcgtttcaggccagcttcccaagggtaaagccctcgaattggccctgaaaagacccaggcctccggtcctgtctgtgtgctctagctcagagacaccctatttgcttaaagagaccaacaaagggaacggacaaggagaggaccgcaatctgttgtattactcaaagctcgggcttgtgataccttccagtggcagcggcagcggcaatcagtctatcgacagatcagggcctcttgtgaagagcctgcttcgtcgaagtctgtccatggacagccaagtgccagtctattcacccagcatcgatcttaaatcctcgcaaggaagcagcagcgtttcaagtgacgccccagggaatgtgctgtgtgcactctctcaaaagagctcgctgaaggactgttccgaaaagacagctctggatgacaggccacaagtgctgcagccgcaccgattgagatccttctccgcgtcacagtcaacagatagagagggcgctagtcctgtgaccgaagtgaggatcaaaactgagccctcttcaccattgtcggatccaagcgatatcattcgcgtcacagttggcgacgctgccacaactgctgcggctagcagttcctccgttacgagggatttgtccctgaagacagaggacgatcaaaaggacatgtcccggctgcccgctaagcgaagattccaggcggaccggaggttacctttcaaaaagttgaaagtgaacgagcatgggtcaccagtatctgaagacaactttgaggagggatcttccccaaccttacttgacgccgactttccagactccgatttgaataaggatgagttcggagagctggaggggactagaccaaacaaaaaatttaagtgcaagcattgcctgaaaatttttagaagtacagctggactgcatagacatgtaaatatgtatcacaaccctgagaaaccatacgcctgtgacatctgtcacaagcggtttcacaccaattttaaggtttggacacattgtcagacacagcatggcatagtcaagaatccaagccccgcaagttctagccacgccgtgctcgacgaaaagtttcagcgaaaactaatagacatagtgcgcgagcgtgagatcaagaaggctttaattattaagctcaggcgcggaaaacctgggtttcaagggcagtctagctcccaggcacagcaagttataaagcgcaacctccgtagtagggccaagggcgcttacatctgtacttactgtgggaaggcctaccggtttttgtcacagttcaaacagcacatcaagatgcatcccggtgaaaaaccactgggggtcaacaaggtagccaaacctaaggagcacgcccctctggcaagcccagtagagaacaaagaggtgtatcaatgcagactctgtaacgcaaaactgagctccctgctcgagcaaggaagtcatgagcggttgtgccgcaatgccgcagtgtgcccatactgctcactacgattctttagcccagagcttaaacaggagcacgaaagcaaatgtgagtataagaagctgacttgcctggagtgtatgcggacatttaaatctagcttctccatttggcgccatcaggttgaggtgcacaaccagaacaatatggcaccaaccgagaatttttcgctacccgtattagatcataatggagacgtgacggggtcctctcgtcctcagagccagcccgaacccaacaaggtcaatcacatcgttacaaccaaggatgataacgtgttttctgacagcagcgagcaggtgaacttcgatagcgaggattcttcttgcctgcctgaggatctgtcgttgtccaaacagctgaagattcaggtcaaagaggaacctgtggaagaggcagaggaggaagcaccggaagcatctactgctcccaaagaggctgggcctagtaaggaggctagcctgtggccctgcgaaaaatgcggcaaaatgttcacagtgcacaaacaattggaacgacaccaggagctactgtgctctgttaagccattcatttgccacgtctgtaacaaggcgttcaggaccaacttccggctctggtcgcacttccagagccacatgagtcaggcatcagaagaaagcgcccacaaagaatctgaggtgtgtcccgtccccacaaatagtccctcccctccacccctcccacctccccctcctctgccaaagatacagcctctggaaccagactctccaaccggccttagcgaaaatcccacgccagccacagagaagctctttgtgccacaggagtcagacacactgttttatcacgctccccctctgagtgccatcactttcaaacgtcagtttatgtgcaaactttgccaccggacgtttaagaccgcatttagtctgtggtcacacgaacagacacacaactag

SEQ ID NO: 25146 - DNA, 2598 bp, Artificial Sequence
  Description of Artificial Sequence: Synthetic coding sequence
atggaagggctgctgcattatatcaatcctgcccatgctatctccctgctctctgccctgaacgaggaacgactgaaagggcaactgtgcgatgtcttactgatcgttggggatcagaagttcagagctcacaaaaatgtgctggcggcttcatccgaatatttccagtctctgtttaccaataaagagaatgaatcccaaacggtcttccagttggatttctgtgaaccagacgcattcgacaatgtcctgaactacatttactcgtcttccttatttgtggaaaaaagctctctggctgccgtgcaggaattgggctactccctgggtatctcttttctgaccaatatcgtatccaaaacacctcaagccccttttccaacgtgccccaaccggaagaaagtgtttgtcgaggacgacgaaaatagtagccaaaagaggtctgtgattgtgtgccagtctcgaaatgaggcccagggcaaaacggtttctcagaatcagcctgacgtttcccacacttctcgtccatctccttcgattgccgtcaaggccaacaccaataaaccacacgtacccaaacccatagagccactgcacaacttgtcgttgaccgaaaagagttggcccaaagatagctctgttgtgtatgctaaatctctcgaacacagcggaagtcttgatgatccaaaccggatatccctcgtaaaaagaaacgccgtgctcccaagcaagccgttgcaggatcgagaagccatggacgacaagccaggagtgtcaggtcaactcccaaaagggaaggcactcgagctggctctcaaaaggcctaggcctccagtgctctccgtttgcagttcctcagagacaccttacttactcaaagagaccaataagggcaacggacagggggaggatcgaaacttgctgtactattccaagctcggtttggtgatcccaagcagtggcagcggctctggaaaccagtctatcgaccgttctggacctctcgttaaaagcctgctgcgcaggagtctcagcatggactcacaggtgccagtgtattcgccatccattgatttgaaatctagtcagggctcaagcagtgtgtcctcagacgcacccggtaacgtgctgtgtgccttgtcccaaaaaagctcactgaaggactgttccgagaagactgcattggacgacagaccacaggtcctgcagccccatagactacgatctttttccgccagtcaatccaccgatagggaaggggcatcaccagtgaccgaggtacgcattaaaactgagccgtctagccccttatcagacccgagcgacatcatccgcgtcactgtcggggatgccgcaactacagcagctgcatcctcttcgtctgtcacacgggacctctccctcaagacagaggatgatcagaaggacatgagcagactccctgctaagcggcgttttcaagccgatcgaaggcttcccttcaagaagctcaaggtcaacgagcacggaagcccagtgagcgaggacaacttcgaggaaggatccagtcctacactcctggatgcagacttcccagattcagacctgaacaaggatgaatttgaacagggctcccacgagaggctgtgccggaacgcagccgtgtgtccatattgctccctaagattttttagtccagaactcaagcaagagcacgaaagcaagtgcgaatataaaaagctcacttgtctagaatgcatgcggaccttcaagtcttcgttttcaatctggagacaccaagtcgaagtgcataaccagaataacatggcacccaccgagaacttcagcctaccagtgctcgatcataacggcgacgtcacaggcagcagcagaccccagtcacaacccgagcctaacaaggtgaatcacattgtgacaacaaaagacgataacgtattcagcgactctagcgagcaggtcaacttcgactctgaagacagttcatgcttaccagaggacctatcgctgagcaagcagctgaaaattcaagtgaaggaagagcctgtggaagaggccgaagaggaagccccagaggcgtcaaccgctccaaaagaggccggtccatcgaaagaagcatccctttggccctgcgagaagtgcggcaaaatgttcacagtccataaacagctagagagacaccaagaattattgtgctctgtgaaaccctttatatgccatgtgtgtaacaaggcattccggacaaatttcagactttggtcccatttccaatctcacatgagtcaggccagtgaggaaagtgcacataaagaatccgaagtttgtcccgtgcctactaactcaccaagcccacccccactcccccctcccccacctttgcccaagatccagcctctcgaacccgattctccgacaggtctgagtgaaaatcccacgccagctaccgagaaattgttcgtcccacaagagtctgatacactcttctaccacgcaccccctctatcagccatcacatttaagcggcagtttatgtgtaaactgtgtcaccgaaccttcaaaacagccttttctctctggtctcatgaacagacacataactag

SEQ ID NO: 25147 - DNA, 3201 bp, Artificial Sequence
  Description of Artificial Sequence: Synthetic coding sequence
atggaaggccttttacattacattaatccagcgcatgctatttcactgctttctgcactgaatgaggagcggctgaagggtcagctgtgcgacgtcctgctcatcgttggtgatcaaaagtttagggcccacaaaaatgtgctggccgcttcctcggagtatttccaatccctgttcacaaataaagagaacgagtctcagactgtgttccagctggacttctgcgaacccgacgcattcgacaatgtgctaaactatatttacagctctagcttatttgtcgagaagtctagcctggccgctgtccaggagctgggctacagccttgggatctctttccttactaacattgtgagcaagacaccccaggctccattccctacttgtcccaatagaaagaaggtgtttgtcgaagatgatgagaactcgtctcagaagcggtccgttatcgtctgccagtccaggaatgaggcacagggtaaaacagtaagccaaaaccagcccgatgtctcacacacatctagaccttcaccatccattgctgttaaggctaacacaaataagccccacgtcccgaaacccattgaaccactgcacaacctcagtctcacagagaaaagttggcccaaagattcttcagtagtgtacgcaaagagtctggagcattccggttctctggatgacccaaatcggatttctctggtcaagaggaacgctgttttgcctagcaaacccctacaagaccgagaagcgatggacgataaacccggtgtcagcggacagctgcctaaaggtaaggccctggaattggccttaaagcgcccaagaccacctgttcttagcgtgtgttctagcagcgagaccccctaccttctgaaggagaccaacaaagggaacggccaaggtgaagaccgcaacctgctgtactactcaaagctcggtctggttattccaagctcggggagcggaagcggcaaccagtccatagatagaagcggaccacttgtcaaatctttgcttagacgatcactgagtatggacagccaggtgccagtatatagcccttccatcgatctgaagtcatctcaaggttctagtagcgtaagttcagatgccccaggtaacgtgctgtgcgctctctcccaaaaatcatctcttaaggactgctcggagaaaactgcactcgatgaccggccacaggtgctgcagcctcataggctgcgaagcttttctgcatcccagtcaacagatcgggaaggcgcatcccccgtgaccgaagttagaatcaagacagagccgtctagccctctctccgatcctagcgacataataagagtgacggtcggggatgcagctacaacagctgccgcaagcagcagttcagtgactcgggacctgtcacttaagactgaagacgaccaaaaggatatgtcacgtctgccggcaaagcgtagatttcaggccgaccgcaggctaccgttcaaaaaactgaaagtaaatgaacacggcagccccgtttccgaagataattttgaggaaggcagttccccgacattattggatgctgatttcccagactccgacctgaacaaggacgagtttggggagctcgaaggcaccaggccaaacaaaaagttcaaatgcaaacattgtcttaagatattcaggagtactgctgggctgcaccgccacgtgaacatgtaccataacccagaaaagccatatgcctgcgatatatgtcacaagagatttcataccaatttcaaggtttggacccactgtcaaacccagcacgggattgttaagaatccctctccagccagttcgtcccacgccgtgcttgatgagaagttccagcggaagcttatcgatatcgttagagagcgcgaaatcaaaaaggccctcatcattaaactgagaaggggcaaacctgggttccagggccagtcctctagccaagcacaacaggtgatcaagcggaatttgagaagtagggccaaaggagcctacatctgcacttactgtggcaaggcctacaggttcctgtcccagttcaaacaacatattaagatgcaccccggtgaaaaacccctgggcgtcaacaaggttgccaagcctaaagagcacgctcctctggccagtccagtagagaacaaagaggtgtatcagtgtaggctttgtaacgccaaactctcctctctcctggagcaggggtcacatgagcgcctttgtcggaatgcagcagtgtgtccatactgcagcctccgctttttttcccccgaacttaagcaagagcacgagagtaaatgtgagtataagaagctgacatgccttgaatgtatgaggactttcaagagctccttttcaatctggcgccatcaggtagaggtgcacaaccagaataacatggctccaacagaaaatttctctctgccagtgttagatcataatggcgatgtgactgggagcagccgtccgcagtctcagccggaaccaaacaaggttaatcacattgtgaccaccaaggacgacaacgtcttctcggactcgtcggagcaggtgaattttgattctgaagatagctcatgtctccccgaggacctcagtttatcaaagcagctcaagatccaggtgaaggaggaacctgttgaggaggccgaggaggaggccccagaggcatccactgccccaaaggaggcagggcctagtaaggaagcctcactgtggccgtgtgagaagtgtgggaaaatgtttacagtacacaagcagctcgagcgccaccaggagctcctctgttctgtgaagccatttatatgccatgtgtgcaacaaggcttttaggaccaatttcaggttatggtctcacttccaaagtcacatgagccaggcatctgaagagtccgcccacaaggagagtgaggtgtgccccgtgccaactaacagtccatcacccccacctctcccacctccaccccctttaccaaaaattcagcccttggaaccagactcacctacggggctcagtgagaatccaactcccgcaactgaaaagctgtttgtgcctcaggaatcagacaccttattctaccacgcaccacctctgagcgcgattaccttcaagagacagttcatgtgcaagttgtgtcatagaacatttaagactgcatttagtctgtggagtcatgagcaaacccataattag

SEQ ID NO: 25148 - DNA, 360 bp, Artificial Sequence
  Description of Artificial Sequence: Synthetic coding sequence
atggaagggttgcttcactacataaatcctgcgcatgccatcagtttgctctcagccctgaacgaggagcggttgaaaggccaactttgcgacgtgctgttaatagtcggcgatcagaagttccgggctcacaagaacgttctcgctgccagctctgagtatttccagtcattgtttaccaataaggagaatgaaagtcagacggtcttccagctagatttctgcgaacctgatgccttcgataacgtacttaactacatatatagttcctccctctttgtcgaaaaaagtagcctggcagccgtgcaggagctcggatactccttgggtatcagtttccttaccaatatagtgtcctag

SEQ ID NO: 25149 - DNA, 150 bp, Artificial Sequence
  Description of Artificial Sequence: Synthetic coding sequence
atggaggggctcctgcactacattaaccctgctcacgcaatctctctgctctcggcgttgaatgaagagaggctaaagggccagctgtgcgatgtcctgctcattgtgggggaccaaaagttcagggctcacaaaaacgtccttgcatag

SEQ ID NO: 25150 - DNA, 1872 bp, Artificial Sequence
  Description of Artificial Sequence: Synthetic coding sequence
atggctcataaatacgtggggctgcagtaccatgggtccgtaacattcgaagacgtagccatcgctttcagtcaacaggaatgggagtcattggactcgtctcaacgcggtctgtacagagatgtcatgctcgagaactatcgcaacctggtctcaatgggccacagtaggagtaagccccacgtcattgccctgctggaacagtggaaggaacctgaagtgacagtcaggaaggatggacgcagatggtgtacagatctgcagcttgaggacgacactatcggatgtaaagaaatgcccacaagtgagaactgcccctcttttgccttgcatcaaaaaatctccaggcagaaacctcgggagtgtcaggagtatggaaagacgctgtgtcaagactcaaaacctgtccagcacgagcgtatccattcttccgaaaagccgaacagatgcaaagaatgtgggaaaaatttctcaaacggccaccagttgacaatccatcaacgtctgcatgtcggcgagaaaccgtacaagtacgaaaaatgtggcaaggccttcatctccggaagcgcgtttgtcaagcacggtcgcattcacacaggagaaaagccactgaagtgtaaacagtgtggtaagaccatctccggctcataccagctgacagttcacaaaagtattcatactggcaaaaaaccatacgaatgcggcgagtgcgggaaagcgtttttagtgtatgggaagttgacccgacatcaaagcacccacaccggagagaaaccattcggttgcgaagaatgcggtaaggccttttctaccttttcctatctcgtgcagcatcaacggatacacaccagtgaaaagccctatgagtgcaaggaatgcgggaaagctttctcaactagcagtcctctggctaagcaccaacgaatccatacaggggagaaaccttacgagtgtaaggagtgtgggaaatcttttactgtctacggccagctcaccaggcaccagtccatccacacaggggagaagccctttgagtgtaaggaatgtggcaaagcgtttcgactcagttcgttcctccatgcccaccaaaggatccatgctgaaataaagccctatggctgtaaagagtgtggcagaacctttagccgggcaagttacctggtgcagcacgggagattgcatacaggcgagaagccatatgagtgcaaggagtgtggcaaagccttttcaactggctcctatcttgtgcaacaccagcggattcacactggcgaaaaaccatacgagtgcaaggaatgtggcaaagcctttatcagcagacaccagctaactgtccatcagcgggttcataccggtgagaagccttacgagtgcaaagaatgtggaaaggccttccgtgtccacgtgcatctgactcagcaccgcaaaattcacactgatgtcaagccctacgagtgtaaggagtgcggaaagacattctctcgtgccagctacctggtccagcacagccgaattcacacggggaaaaaaccctatgagtgcaaggaatgtgggaaagccttcagcagcggaagctatctcgtgcagcaccaacggattcacacaggtgagaaaccgtatgagtgcaataaatgtggcaaagcgttcacagtctacggccaacttattggtcatcaatccgtgcacacgggtgaaaagccttttgagtgcaaagagtgtgggaaggcgtttagacttaacagttttctcacagagcaccaaagagtgcacacaggtgaaaagccattcaagtgcaagaagtgtggaaagacctttcgctattcctctgccctgaaagtgcacttgagaaagcacatgagtgtgatcccgtag

SEQ ID NO: 25151 - DNA, 945 bp, Artificial Sequence
  Description of Artificial Sequence: Synthetic coding sequence
gagtgcggtaaggcctttagcaccttctcttacttggtgcagcaccagaggatccatacatccgagaagccctacgagtgcaaggaatgcgggaaggcttttagcacctcatctccactggcaaagcatcagcgcattcacactggtgaaaaaccctatgaatgcaaggaatgtggtaaaagcttcacagtgtatgggcagttgacaagacaccaatcaatacatactggcgagaagcctttcgagtgtaaggaatgcggtaggacattctcccgagcttcatatttggttcagcacggcagactgcataccggggagaagccctacgaatgtaaggaatgcggtaaagccttcagcactggcagttacctggtccaacaccagcgaatacatacgggtgaaaagccctacgaatgcaaggagtgcgggaaggcattcattagcagacaccagctgactgtccatcagagagtgcacacaggagagaagccctatgagtgtaaggagtgcggaaaggccttccgagttcatgtacaccttacacagcatagaaagatacacacagatgtgaagccttatgagtgcaaagaatgcggaaaaactttttcacgggctagttacctcgtccaacattcacgcatccatactggcaaaaagccctatgaatgcaaagaatgcgggaaagcattctcttccggttcctaccttgtacagcaccagcgaatccacacaggcgagaagccttatgagtgcaataaatgcggaaaagcattcaccgtgtacggtcaactgattgggcaccaatcagtgcacacgggcgaaaaacccttcgaatgtaaagagtgtggcaaagctttccgtttgaacagtttcctcacagagcatcagagagtgcataccggtgaaaagccattcaagtgcaagaaatgtgggaaaaccttctag

SEQ ID NO: 25152 - DNA, 1629 bp, Artificial Sequence
  Description of Artificial Sequence: Synthetic coding sequence
atggagccaaaagacctccagctggaggacgacacgatcggctgtaaggaaatgcctacttccgaaaattgtccctccttcgcactccaccaaaaaatatccagacagaaacccagggagtgtcaagagtacggtaaaaccctctgccaggacagtaaacccgttcaacacgaacggatacacagttccgagaaacctaatagatgtaaagaatgcgggaagaacttctcaaatggtcaccagctgacgattcaccagagactccacgttggagagaaaccctataaatacgagaaatgtggtaaagcgttcataagcggctctgctttcgtgaaacatggacgcattcatactggcgaaaagccgcttaaatgtaaacagtgcgggaagacaattagcggctcataccaacttaccgtgcataaaagtattcacacaggtaagaagccttatgaatgtggggagtgtggcaaggcttttcttgtttacgggaaattgacaagacaccagtctacgcacacaggtgagaagcctttcggttgcgaagagtgcgggaaggccttctccaccttctcatacctggtacagcatcagagaatccacacctctgaaaaaccctacgagtgtaaagagtgcggcaaagccttctccacatcatcacccctagcaaaacatcagcgtatacatactggtgagaagccgtacgagtgcaaggaatgcgggaagtcttttactgtgtatggacaactgaccaggcaccagagcatacatacaggcgaaaagcctttcgagtgcaaggaatgtggtaaggcatttagactctcatcctttctgcacgcccaccaacgtatccatgcagaaataaaaccctatggctgtaaggaatgtgggcgaacgttctcaagggcctcctaccttgtgcagcacggaagactgcatacaggtgaaaagccctacgaatgcaaagagtgcggaaaggcattcagtactggttcttaccttgtacaacaccaacgaatccacacaggtgaaaagccatacgagtgtaaggaatgtggcaaagcgtttatcagtcggcaccagctgactgtgcatcagcgtgtccatacaggagagaagccatacgagtgcaaggagtgtggaaaggcatttcgtgtgcacgtccatttgactcagcaccggaagatccacaccgacgtgaaaccttacgaatgcaaagagtgcggtaagactttctccagggcttcctacctcgtccagcactcacggatccacacaggcaagaaaccatacgagtgcaaggagtgcggaaaagcattttcaagcgggtcataccttgtccaacatcagcgcatacatacaggggaaaaaccgtatgagtgcaataaatgcggcaaggctttcactgtctatggacaactcatcggccaccagtccgtgcacaccggagagaagccgttcgagtgcaaggagtgcgggaaagcatttcgcctaaacagctttctgacagagcatcaacgggttcacaccggcgaaaagccatttaagtgtaaaaaatgtggcaagacattcagatattcatcggccctcaaagtgcatctccgcaaacacatgtccgtcatcccttag

SEQ ID NO: 25153 - DNA, 1875 bp, Artificial Sequence
  Description of Artificial Sequence: Synthetic coding sequence
atggctcacaaatatgtggggctccagtatcacggatcagtgactttcgaggacgtcgccatagccttttcacaacaagagtgggagtcgctcgactcctcccaacggggtctgtaccgggatgtgatgctggagaattatcgcaacctggtgagtatggccggacactcaaggtcgaaaccccacgtcattgccttactggaacaatggaaggaacctgaagtaaccgtgagaaaagacggaagacgttggtgcactgacctccagctcgaggatgataccatcgggtgcaaggaaatgccaactagtgagaactgcccctcatttgccctgcaccagaaaatcagtagacagaaacctcgggagtgccaggaatatgggaaaacactgtgtcaagattcaaaaccggtgcagcatgaaaggatccatagcagcgaaaagcctaaccgttgcaaagagtgtggaaaaaacttctcaaacggccaccaactgaccattcatcagcgcttgcacgttggggagaaaccttacaaatatgagaagtgcggcaaggctttcatatcaggctcagcctttgttaaacatggcagaatacacacaggagaaaaacctcttaagtgtaagcagtgcggcaagactatcagcggttcctaccagcttacggtccacaaatcgatccacaccggtaagaaaccatatgagtgtggggagtgtggcaaagcatttctggtgtatggaaagctgacccggcaccaaagcacacataccggcgagaagccttttggatgcgaagaatgtgggaaagccttctccactttctcttatctagtacagcaccaacggatccacacaagcgagaagccctacgagtgtaaggaatgtgggaaggctttttcaacaagttcacccctggccaagcaccagaggattcacacaggagaaaagccttacgaatgtaaggaatgtggcaaaagctttacggtttacggtcagctcactaggcaccaatcaattcataccggtgaaaagcctttcgagtgcaaagaatgtggaaaagccttccgtctttcatccttcctgcacgctcatcagcggattcacgccgagatcaaaccatatggctgcaaagagtgtggtcggacttttagtcgcgcatcttatctggtacagcacggcaggcttcacaccggcgagaagccatacgaatgcaaggaatgcggaaaggccttttcgactggaagctatcttgtgcagcaccagcgcattcacacaggcgagaagccatatgaatgcaaagaatgcggtaaggctttcatcagcagacatcaattgacggtgcatcagagagtacacacgggcgagaagccctacgaatgcaaagagtgcggcaaggcttttcgtgtacacgtccatttaactcagcaccgaaagattcacactgacgtgaagccgtatgagtgcaaagaatgtggcaaaacatttagtagggcctcctatttggtgcagcattctaggatccatactggcaagaaaccctacgagtgcaaagaatgcgggaaagccttcagtagcgggagttatctagtgcaacaccagcgcattcatactggggaaaagccttatgagtgcaataagtgtggcaaagcctttaccgtctatggtcagctgatcggacatcagtctgtgcataccggcgagaaaccatttgaatgtaaagaatgcgggaaggcctttcgtttgaatagcttcctgaccgagcatcagagggtccacacaggggaaaaacccttcaagtgcaaaaaatgcggcaagacgtttcggtattcgagcgcacttaaagtccacctgcgaaagcatatgtccgtcatcccatag

SEQ ID NO: 25154 - DNA, 1872 bp, Artificial Sequence
  Description of Artificial Sequence: Synthetic coding sequence
atggcacacaaatacgttgggctgcaataccatggttctgtgacatttgaagatgtcgccatagccttttcccagcaggaatgggagtccttagacagctcacagcgaggcctgtacagagacgtgatgctggagaactacagaaatctggtctcgatggggcattcaaggtccaaaccgcatgtcattgcactcctcgagcagtggaaagagccagaggtgactgtgcgcaaggacggccgtcgctggtgtactgatctgcagttagaggacgacactataggatgtaaagagatgcccacctcggaaaactgcccatcattcgcattgcatcagaagatctctcgccaaaaaccacgggaatgccaggaatacggcaagactttatgccaggattcaaagcctgtccagcacgagaggatacattcttcagaaaagcctaacaggtgcaaggagtgcggcaaaaacttctctaatggacatcagctgacaatccatcagcgccttcacgtaggagaaaagccgtacaaatatgagaaatgcggcaaagctttcatttccgggtctgccttcgtgaagcacgggaggatccataccggtgagaagcccttaaaatgtaagcagtgtggaaagacaatcagtgggtcgtatcaactcacggttcataagagcattcatacggggaagaagccctatgagtgtggagagtgcggcaaggcgtttttagtatacggaaaattgactcggcaccagagcacacatacaggagaaaagccattcggatgcgaagagtgtggaaaggcctttagtactttttcctatttggttcagcaccaaagaatccatacttctgagaagccttatgagtgtaaggagtgtggcaaggcttttagtacaagctcacctctcgccaagcaccagaggatccataccggggaaaagccatacgagtgtaaagaatgcggaaagtcattcacggtgtatggtcaactgaccagacatcagtccattcacaccggtgagaaaccctttgaatgcaaagaatgcggcaaggctttcagactgagttcttttttgcatgcccatcagaggatccatgcagagattaagccatacggctgtaaggagtgcggccgtaccttcagtcgcgctagttatctcgtgcagcacgggagattacacacaggggagaaaccttatgagtgtaaggagtgtggcaaggctttcagcacaggcagttaccttgtgcagcaccagagaatccacaccggagagaagccttacgagtgtaaggaatgcggcaaagccttcatatcccgccaccaactgacggtccatcagcgagtccatacgggcgagaagccctatgagtgcaaggaatgtggcaaggccttcagagtgcacgttcacctgacgcagcacaggaagatccataccgacgtcaaaccctacgaatgtaaagaatgtggcaagacattcagtagggcctcttatttagtgcagcattcaagaatacacactggaaaaaaaccatatgaatgcaaggaatgtggcaaggcctttagttctggatcttatttggtgcagcatcagaggatacataccggcgaaaagccctacgaatgcaataaatgtggcaaggcatttaccgtttacgggcagcttattggtcatcagtcagtccacacaggggaaaagcccttcgagtgtaaggaatgcggcaaggcattcaggctgaacagctttctgacggagcaccagcgcgtgcataccggtgaaaagccttttaaatgtaagaagtgtgggaaaacctttcgctatagcagcgctctgaaggtgcacctcaggaaacatatgagcgttattccatag

SEQ ID NO: 25155 - DNA, 1560 bp, Artificial Sequence
  Description of Artificial Sequence: Synthetic coding sequence
atggcacgcgatctggtcatgttcagggacgtagcggtcgacttttctcaggaggagtgggagtgcctgaattcgtatcaaaggaacctatatcgagacgtgatacttgagaactactcaaacctggtatctctggcgggatgctccatttccaagcccgacgtgatcacgctgttagaacagggaaaggaaccatggatggtggttagggatgaaaaacgtcgctggacactggacctggaatcccgttacgatactaaaaagttgtttcaagggaaagacatatatgaaatgaacctgagtcagtggaaagtgatggaacggattaagtcctgtgggttagaagaacaggaatccccacatgaggtatgctttagacaggtgactaagactacgtcggaaaagatgcctacatacagaaaactgactagcttacctctgtaccagaaaagccataaccgcgagaagccctacgagtgtggtgaatgcggtaaggcatttcgtgtaagacagcaactcacgttccaccaacggatccacacaggcgaaaagccatatgaatgtaaggaatgcggaaaagcttttagacagtgtgctcacctgagccggcaccagcggattcataccagtgacaagctctacgagtgcaaaaagtgcggtaaaatatttacctgtggaagcgatcttcgggtgcatcagagaatccatattggggagaagccttacgaatgcaaggagtgcggcaaggccttccgggtcagggggcagctcaatctgcaccagagaattcacactggtgagaaaccctacgaatgcaaagagtgtggtaaggcgttccggcagtatgctcatttgacacggcatcagaggctcaacatagctgaaaaatgctacgagtgcaaagaatgcggtcaggcgttcctctgttcgaccggcctccggctccaccacaaactgcacactggggagaaaccatacgagtgtaaggagtgcggaaaggccttcagagtcaggcagcagcttactctccatcagcggattcatactggagagaaaccatatgactgcaaggaatgtggtaaaaccttttcccgcggataccatctgaccttgcatcagagaatccacaccggtgagaagccctatgaatgcaaggagtgtcagaagttctttcgcagatattccgaactgatttcccaccagggaatacacatcggggaaaagccttacgaatgcaaggagtgtggcaaggccttccggctgttttcccagttgacgcagcatcaaagcattcattttggagagaaaccttttaagtgcaaagaatgtgaaaagacattcagattgctgtctcagctgacccagcatcagtccattcataccggcgaaaagccgtatgattgcaaggagtgtggaaaggcgtttcgcctgcattcttcattaattcagcatcaaagaattcattccggggaaaagccatataaatgcaaggagtgcaaaaaggcttttcgtcagcactcacatttgacttatcatcagaggatacataacgtgacatag

SEQ ID NO: 25156 - DNA, 1560 bp, Artificial Sequence
  Description of Artificial Sequence: Synthetic coding sequence
atggccagagatctggtaatgtttcgggatgtagccgtggacttttcacaggaggagtgggagtgcttgaatagttaccagcgcaatctgtatcgtgatgtgatcctcgagaactacagcaacttagttagtctggccggttgcagcatttctaagcccgatgtgatcaccctgctggagcaaggcaaagaaccttggatggtggtacgggacgagaagaggcgctggaccctggatttggaaagcaggtacgacactaaaaaactctttcagggtaaagacatctacgaaatgaacctcagccagtggaaggtaatggaacggatcaagtcatgcggcctagaggaacaggagagcccacacgaggtgtgtttccgtcaggttactaagactacctccgaaaaaatgcccacctaccgcaaactgaccagcttaccgctgtaccagaagtctcataatcgagagaaaccctatgaatgtggcgagtgcggaaaagcctttagagtgcgacaacagctgacatttcatcaacggattcatactggggaaaagccatacgagtgtaaggaatgcggcaaggcttttagacagtgtgcgcacctctctcgccaccagcgcattcacacatccgacaagctttatgagtgtaagaagtgtggtaagatcttcacttgcggtagcgacctgagggtccatcaacgaattcacatcggcgaaaaaccgtacgagtgcaaagagtgtgggaaggctttccgggtccgcggtcaactcaatttgcaccagcgaattcataccggggaaaaaccatacgagtgcaaggagtgtggaaaagcattccggcagtacgcacacctcacccgccaccaacgcttgaacattgctgaaaaatgctatgagtgtaaggagtgcgggcaggcgttcttgtgtagcacaggcctgcggctgcaccacaaactgcacactggcgagaaaccgtatgaatgcaaggagtgcggaaaggctttccgcgttcggcagcagctgactctacaccagcgtatccatacaggtgaaaaaccttacgactgcaaagaatgtggtaagaccttcagcagagggtaccatctcactctgcatcaaagaatacacacaggcgaaaagccttatgagtgcaaagagtgtcagaagttctttcggagatactctgagctgatctcacaccaagggatccatatcggtgagaagccatacgaatgtaaggaatgtggcaaagcgtttagactgttcagccagctgactcagcatcagtccatccacttcggcgagaaacccttcaaatgtaaggagtgtgagaagacctttcggctgctaagtcagttgacccagcaccagtctattcataccggagagaaaccatatgattgcaaagagtgcggtaaggcattccggctgcactcttccttgattcagcatcagagaatacatagcggggagaaaccatacaagtgtaaggagtgtaaaaaggcctttcgtcagcactcccatcttacttaccatcagaggattcacaacgtgacctag

SEQ ID NO: 25157 - DNA, 1305 bp, Artificial Sequence
  Description of Artificial Sequence: Synthetic coding sequence
atggcaagagacctcgtcatgtttagagatgttgccgtcgacttttctcaggaagagtgggagtgcctcaatagctaccaaaggaacctttatagagacgtgattctcgagaattactcgaacctagtgagtttgggctgcagtatcagcaaaccagatgtcattaccctgttggagcagggcaaggagccttggatggtggtacgggatgaaaagaggcggtggacgttagatctggagtcgcgctatgacaccaagaagctgtttcaagggaaggatatttacgaaatgaacttgtcacagtggaaagtgatggagcggatcaagtcatgcggactggaagagcaggaatctccacatgaggtgtgctttagacaggtcactaagacaaccagtgagaaaatgccaacctacaggaagttgacttcacttccactgtatcaaaagtctcacaatcgcgagaagccctatgagtgtggcgaatgcggcaaggcattcagggtgcggcagcagctcacgttccatcagcggatccacactggcgagaagccatacgagtgtaaggaatgtggaaaagctttccggcagtgcgcgcacctgtcaaggcaccagcgaatacacactagtgataaactctatgagtgcaagaaatgcggcaaaattttcacgtgtggctccgaccttcggctacaccacaagctccacaccggagaaaaaccctatgagtgtaaggagtgcgggaaagcctttagggttcgccaacagttgactctacaccaaaggattcataccggcgaaaaaccgtacgattgcaaagaatgcggaaagacttttagtaggggctaccacctgacactgcatcaacgaatccacactggtgagaaaccttacgaatgcaaagagtgtcaaaagttcttccggagatacagtgagctgatctcacatcagggtatccatattggagagaagccgtacgagtgtaaggagtgcggcaaagctttcaggctgttttcccagttaacacaacatcagagcatacactttggagaaaagccatttaagtgcaaggaatgcgagaagaccttccggttgctctcgcagctgacccagcaccagagtatccataccggcgaaaagccttacgattgtaaagaatgcggaaaggccttccgcctgcatagttctttaattcagcaccagcgcattcactcgggagaaaaaccctataaatgcaaagagtgcaaaaaagcgtttcgccaacatagccatctgacataccatcaacgaattcacaatgtgacctag

SEQ ID NO: 25158 - DNA, 1560 bp, Artificial Sequence
  Description of Artificial Sequence: Synthetic coding sequence
atggcacgcgacctggtgatgtttagagatgttgccgtggatttttcacaagaagagtgggaatgtctgaactcgtatcagagaaatctgtacagggatgtgatcctcgaaaactactcgaacctggtgtctctcgccggatgcagcatctctaagcctgatgtcattacactcctggaacagggtaaggagccctggatggtggtgcgtgacgaaaaacggagatggaccctggatcttgagtcccggtatgacactaagaagctctttcagggaaaggacatctatgagatgaatctgtcccagtggaaagttatggaaaggatcaaatcctgcgggcttgaggagcaggaatcccctcacgaggtctgcttccgacaggttaccaagaccacttccgaaaaaatgcccacttataggaaactgacctccttacccctttatcagaaatcacacaacagggagaagccatacgagtgtggcgagtgtggcaaggcctttagggtgcgtcagcaactgaccttccaccagcggatccacactggggagaagccttacgaatgtaaagagtgcggcaaagccttcaggcagtgcgctcatttaagtagacatcaaagaattcacacctcagacaagctctatgaatgcaagaagtgtggcaagatcttcacctgtggctccgacctgcgcgtgcatcagcggatccatatcggggagaagccctatgagtgtaaagaatgcggaaaagcgttcagggtgagagggcagctcaatctgcaccagcggatccacaccggcgaaaagccctacgagtgcaaggaatgcgggaaagcattccgccaatacgcccacctgacaagacaccagcgcctcaatatagccgagaagtgttacgagtgcaaggaatgcggacaggccttcctgtgctcaacaggtctgcgcctacatcacaaactccatactggtgagaaaccgtatgagtgcaaagaatgtgggaaggcatttagagtgagacagcaacttacactgcaccagaggatccatacaggcgagaagccctacgattgcaaagagtgcggcaaaacattctcccgagggtaccacctcactctgcaccagagaatccacacaggcgagaaaccatacgaatgcaaagagtgccaaaaattcttccggaggtacagcgaactgatatcccatcagggcatccatataggagagaagccatatgagtgcaaggagtgtggcaaggcattcagactgttcagccaactgacccagcaccagtctatccattttggggaaaaaccgttcaaatgcaaagagtgcgagaaaacttttcggctcctcagccagcttacacaacaccagtcaatacatacaggtgaaaaaccttatgattgtaaagagtgcggcaaagcgtttagactccactctagtctgatccagcaccaaaggatacattccggagagaaaccttataaatgtaaggagtgcaagaaggccttcagacagcattcccacctgacatatcatcagcggattcacaatgtcacatag

SEQ ID NO: 25159 - DNA, 2001 bp, Artificial Sequence
  Description of Artificial Sequence: Synthetic coding sequence
atgcaggaggtcgtgttactcgacgagtcgtctggcccaccgtcacaactgctgtggacgcgccaggacacacaactgccccaggagtccgctcttctccccgctccctatcccgcattcaccaaagatggtagccagggaaatctcccccaggccgacattacgctaatgtctcaggctcaggaaagcgttacgttcgaggatgttgcagttaacttcaccaaccgagagtggcagtgccttacctacgcacagaggcatttatacaaagacgtaatgttagagaactacgggaatatggtttctttggggttcccttttccaaagccacccctgatttctcacctcgaaagggaagtggatccctgtgttcaggatccacaggatagagaatccttgtcctgcagttatcctgttagcgctgataagatgtggcctgaaaacgaaaaggcctcgtcccagcaagaaattttcgaaaatggggaggcgtattggatgaagttcaactccttgttgaaggttgattcgagggatcctaaagtgcgcgaagtctgtgtgcaagatgtgaagctggagaatcagtgggaaaccagcattcgagaaaaactgcgtgaagaaaaagaaggctccgaagaggtaacctgtaagaaaggtaagaaccagaaggtcctgagcaaaaacctgaaccccaactcgaaacattcacaatgcaacaaggtgctgatcgctcagaaactgcacgaatgtgctcgttgtgggaagaactttagctggcactcagatctaattctgcatgagcaaattcattccggagagaagccccacgtgtgcaatgagtgcggtaaggcctttaaaactagaaaccaactctccatgcatcgaatcatccatactggggaaaagccttttaactgcacacagtgtggcaaggcattcaatagtcggagcgcgctgtgccgacacaaaaagacacactcaggagaaaaaccccatgagtgtagggactgcggcaaagcctttaagacccgaaacagattgtgtatgcaccagctgatccatacaggggaaaagccatacaaatgtaattgttgtggcaaagcatttcagtttaagcatagtctcacgatccacggcagaatccacaccggagagaagccatacgaatgtgaagagtgtggcaaagccttctcaggctcctccgacttgacaaagcatatccgaatccacactggtgaacgaccctatgagtgtagcaaatgtgggcgagccttctcacgcagcagcgacctgtctaagcacaaacggattcatactcgcgagaagcactacggatgccctcaatgtggcaaggacttctcaatcaaggccgaactcaccaaacaccgcagaatccacaccgaagagaaaagatacaggtgcgaggaatgcggcaaagccttccgtcataattgtaagagaagagctcatgagcgcgagcatactggggagaagccttaccaatgccgagactgcggaaaaacattccaggataaacattgtctgacaatccaccagcggatccacactggtgaaaagccatataagtgcctcgaatgcgggaaagctttcagtgggaaatctaatctgaccaatcacagacgtatacatacgggcgaaaagcctcacaagtgcgaggtctgtgggatggccttccaccactcatctgtgctgcgccagcataagcggatccacaccggagaaaagccttacacatgttccgaatgcggcacctccttccggcaaggaagcgcccttattgggcacaagagggttcatacaggcgaaaagccctatgaatgcgaagaatgcgggaaggcttttagagtgagctcgaatctcaccggccataagaaaaggaaacaccaggtgtggagcacccacgaattagatggcagcaggaaatccttgagccccgtcactgtatcccagactagcgtcgttagcattctcacatccgcatag

SEQ ID NO: 25160 - DNA, 2001 bp, Artificial Sequence
  Description of Artificial Sequence: Synthetic coding sequence
atgcaggaagtggtgttactggacgaatcctctgggcctccatcacagctgctgtggacccgacaggacactcagctccctcaggagtctgccctcctgccagccccttaccctgcctttaccaaggacggctctcagggcaaccttccccaggccgatattacattaatgagccaagcccaggagtctgttactttcgaagatgtcgctgtgaactttacaaaccgtgaatggcaatgtttaacctatgcccaacggcacctgtacaaggacgtcatgctcgagaattacgggaatatggtctccctcggctttccattcccgaagccacctctcataagccatttagaaagagaagtagatccgtgtgttcaggatccacaagaccgcgaatcactgagctgttcgtaccctgtctcagcggacaaaatgtggcctgagaatgagaaggctagttcccagcaagagatctttgagaatggtgaggcctactggatgaagtttaatagcctcctgaaggtggattctcgggacccaaaggtgagagaggtctgcgtccaagatgtgaaactggaaaaccaatgggagacctctattcgagagaagctccgggaagaaaaagagggtagcgaagaagttacatgtaagaagggaaaaaaccagaaggtgctcagcaaaaacctcaatccgaactccaaacacagtcagtgtaacaaagtgcttattgctcagaaattacatgagtgcgcccgatgcggcaaaaacttcagttggcattctgatctgattttgcacgaacagatacatagtggtgaaaagccacacgtctgtaatgaatgtggtaaagcgttcaaaacccggaaccagttatccatgcaccgtattatacacaccggcgaaaagccatttaactgcacccaatgtgggaaggccttcaactcgaggagtgcgttatgccgtcacaagaaaacacacagcggcgagaaaccccacgaatgtcgcgattgcgggaaagctttcaagacccgaaaccgtctgtgtatgcaccagctgattcacaccggtgagaaaccctacaagtgtaactgttgcggaaaagcctttcagtttaaacattcgcttactattcacggcaggatccatactggtgagaaaccctatgagtgcgaggaatgtggtaaggccttctccggctcatctgatctgactaagcatatccggattcacaccggagaacgaccttatgaatgctcgaaatgtggcagagccttctctcgttccagtgatcttagcaagcacaaacgaatccatactagggaaaaacactacggctgcccacagtgcggaaaggatttctctattaaagcggaactgacaaagcatcggagaatccacactgaggagaagcgttaccgatgcgaagaatgcggcaaggccttccggcacaattgtaagcgtcgggcacacgagagagaacacacaggcgaaaaaccttaccagtgcagggactgcggaaagacctttcaggataaacactgtttgaccattcaccagcgcatccataccggagagaagccttacaagtgcttggaatgtgggaaggcgttttccggcaaaagtaacttgacaaatcaccgccgaattcacactggtgaaaaaccacacaagtgcgaggtctgcggcatggcgttccatcacagctccgtgctccgacaacataaaaggattcataccggtgagaaaccgtacacttgcagcgagtgcgggacctctttcaggcaaggatctgccctgatagggcacaagagggtgcacaccggagagaagccatacgaatgcgaagagtgtgggaaagcattcagagtttccagcaatctcacaggacataagaagcgcaagcaccaagtgtggtccacccacgaactggatggcagccgaaagtctcttagccccgtgacagtgtcacagactagcgtcgtgagcatcttgactagcgcatag

SEQ ID NO: 25161 - DNA, 2001 bp, Artificial Sequence
  Description of Artificial Sequence: Synthetic coding sequence
atgcaggaggtggtgctgttggacgaaagttccggacccccttcccagctgttgtggactcggcaggatacccagttgccccaagaaagcgccctgttgccagccccatatcccgcattcacgaaggacggaagtcagggcaatctcccacaggccgacatcaccttgatgtcacaggcccaggaatctgtgactttcgaagatgtggccgtcaattttacaaatcgcgaatggcaatgcttaacatatgcacagaggcacctgtacaaagatgtgatgttggaaaactatggcaacatggtctcccttggcttccctttccctaaaccgccacttattagccacctggagcgagaagtggatccttgtgtccaggacccacaggatcgcgagtcactttcatgtagctacccagtgtccgccgacaagatgtggcctgaaaacgagaaggcatcatcccagcaggagattttcgagaatggggaggcctactggatgaagttcaatagtcttttgaaagttgactcccgagacccaaaggtgagggaagtttgtgttcaggacgttaaactggagaaccaatgggaaaccagcattcgcgagaagttgagggaggaaaaggaaggcagcgaagaagtgacctgtaaaaagggcaagaaccagaaggtcctatccaagaatcttaaccccaactctaagcacagtcagtgcaacaaagttctgattgcccagaagttacatgaatgtgcccgatgtggtaagaatttttcctggcactctgacctgattcttcatgagcagattcacagcggcgagaagcctcatgtttgtaatgagtgcggaaaggccttcaagaccagaaatcaattatccatgcatagaatcatccacaccggagaaaaaccctttaattgcacccagtgtggtaaggccttcaattctaggtccgctctgtgtcgccataaaaagacacattccggggaaaaacctcacgagtgcagggactgcggcaaagcgtttaaaacccgcaaccgactgtgtatgcaccagctgatccacactggagagaagccctataaatgtaattgctgtgggaaagcctttcagtttaaacactcattaacaatccatggaagaatccacacaggcgagaaaccctatgaatgtgaggagtgtgggaaagcctttagcggtagctccgatctcactaaacacataaggatccacactggagagcgcccttacgagtgctcaaagtgcggtcgtgcattcagccgtagctccgacctgagcaagcataagagaatccatacacgggaaaaacactacggatgccctcagtgtggtaaagattttagtattaaagcagaactgacaaaacatcgtaggatccacaccgaggagaaaaggtacagatgtgaagagtgtggcaaggcgttcagacacaattgtaagaggagagcccacgaaagggaacatacaggcgaaaagccctaccagtgcagggactgcggcaagaccttccaggataagcactgtttaactattcatcagcggattcatactggtgagaaaccgtacaaatgtctggagtgcggcaaagcattcagcggaaagagtaacctgaccaaccacagacggatccacactggtgaaaagccacataagtgcgaagtctgcggcatggcttttcatcactcttcagtccttagacagcacaagcggatacatacaggcgaaaagccctatacgtgcagtgagtgtgggactagcttccgacagggatctgcactgattggacacaagcgagtgcatactggggaaaagccctacgagtgcgaggagtgcgggaaggcctttcgcgttagctccaatttaactggccataagaagcgtaagcaccaggtctggtcaacgcacgagctggacggttctcggaagtcattgagtccagtgacggtgtcacaaacatccgttgtctctattttgacatctgcctag

SEQ ID NO: 25162 - DNA, 2001 bp, Artificial Sequence
  Description of Artificial Sequence: Synthetic coding sequence
atgcaggaggtggtgctactggacgagagcagtggacctcctagccagctgctctggacacgccaagacacccagctaccgcaggagagtgctctgttacccgcaccctatccggcttttactaaggacggctctcaaggtaacctacctcaggcggatattacactgatgagccaggcccaggagagcgtaacttttgaggacgttgccgttaacttcaccaatagagagtggcagtgccttacgtatgctcagcgccacctgtataaagacgttatgttagaaaactatggcaacatggttagtcttggctttccttttccgaaacctcctttgatttcccatctggagcgagaagttgatccttgcgttcaggaccctcaggatcgcgaaagtctaagctgctcctatccagtcagtgctgataagatgtggcccgagaacgagaaggccagctcccaacaggaaatcttcgagaacggagaggcctactggatgaagttcaacagcctcctgaaggtcgacagccgtgaccctaaggtcagagaagtttgtgttcaggatgtcaaactggaaaaccagtgggaaacaagcatcagggaaaagctgcgggaagaaaaagaaggctctgaggaagtgacatgcaagaaaggaaagaaccagaaggtcttgtccaaaaacttaaaccctaattccaagcattctcagtgtaataaggtgcttatcgctcagaagctgcatgagtgtgcacggtgtggtaaaaacttctcttggcatagtgacttaatcctgcatgagcagattcactcgggggaaaaacctcatgtctgtaatgagtgcggcaaagctttcaaaaccaggaaccagctgtccatgcatcggatcatacatacgggagaaaagccattcaactgcactcagtgtgggaaggctttcaactcacgcagtgccttgtgtcgccataagaagactcattccggcgagaagccccacgagtgccgggattgcggaaaagcttttaagacaagaaatcggctatgcatgcaccagcttatccacacgggggaaaagccctacaagtgtaattgctgcggtaaggccttccagtttaaacactccctgacaatacacgggcgaatccataccggcgaaaaaccttacgagtgcgaggaatgcggaaaggcctttagcggaagttctgatctgacgaagcatattagaattcatacgggggagcggccatacgagtgctccaagtgtggtcgcgcatttagtagatcctctgacctgagtaagcacaagagaatccacacacgcgaaaagcattacgggtgtccacagtgtggaaaggattttagcatcaaagctgagcttacaaagcatcgcagaatccataccgaggagaaaagataccgctgtgaggagtgcggaaaagcattcaggcataactgcaaacgcagggctcatgaacgagaacacactggtgaaaagccataccaatgcagagattgcggaaaaactttccaggacaaacactgtctgacaatccaccagcggattcacacaggggagaagccgtataagtgcttggagtgcggcaaggccttctctggaaaatccaatttgaccaaccaccgcagaatacacacgggcgaaaagcctcataagtgtgaagtctgcggtatggcttttcaccacagcagtgtgctgcgacagcataaacgaatccatacaggagagaaaccttatacatgctcagaatgcgggacctctttcagacaggggagcgctctgatagggcacaaacgggtgcacactggtgagaaaccgtacgaatgcgaagagtgtggcaaagcattccgggtctccagtaaccttactggccacaaaaagcgcaagcaccaggtgtggtcaacccacgaactagacgggagtcgcaagtccttaagcccagttactgtgagccagacttcggtggtgtcaatcctcacatcggcttag

SEQ ID NO: 25163 - DNA, 2001 bp, Artificial Sequence
  Description of Artificial Sequence: Synthetic coding sequence
atgcaggaggtcgtcctgctggacgaatcttcggggccacctagccagctgctctggacccgccaggatactcagcttcctcaggagtcagccctcctgcccgctccatacccagcctttactaaggatggtagtcagggaaacctgccacaggcagacattacattgatgagccaggcacaggaatccgtgacgtttgaagatgtggctgtaaattttaccaatagggagtggcaatgcctgacctatgcacaacgacatctttataaagatgtgatgctggagaactacggcaacatggtatcattagggtttccttttcccaaacccccattaatttcccatctcgagcgagaggtggacccctgtgttcaggacccacaggatcgcgaatcacttagctgctcttatccggtaagtgctgacaagatgtggcctgaaaacgagaaagctagtagccagcaagaaatctttgagaatggagaggcctactggatgaagtttaattcactgctgaaagtcgatagccgggaccccaaggtgcgcgaagtctgtgtacaggacgtcaagctggagaatcagtgggagacttctatacgcgagaaactaagggaggagaaagaaggaagcgaggaggtgacatgcaaaaagggtaaaaaccagaaggtactgtccaagaacctcaacccaaacagtaaacattcacagtgcaataaggtcttgatcgctcagaagcttcacgagtgcgctagatgcggcaaaaactttagttggcactcggacttgatcctccacgagcagatacactctggagagaaacctcacgtctgcaatgagtgtgggaaggccttcaagacacgaaatcagctgagcatgcacagaataattcacacaggagaaaaaccattcaattgtacacagtgcggaaaagccttcaactctcgctcagccctgtgtcggcataagaaaacacattctggcgagaagccacacgagtgcagggattgtggcaaggcctttaagacgcgaaatcgcctgtgtatgcaccaattgatccatacaggcgaaaagccttataagtgcaattgttgtgggaaagcatttcagtttaagcactccctcaccattcacggacgcatccataccggtgagaagccctatgaatgcgaggaatgtgggaaagccttcagtggctccagtgacttgaccaaacatattagaatacatacaggtgagcgcccttatgaatgttctaaatgtggacgggctttctcacggtcttcagatctgagtaagcataaaagaattcatacccgggagaaacattacggctgtccacagtgtggaaaagactttagtatcaaggcagagctgacaaagcacagaagaattcataccgaagagaagcgctacagatgtgaggagtgtggtaaggcatttagacacaattgtaaacgccgtgcgcacgagcgcgagcacactggcgagaaaccctatcagtgtcgggactgcgggaagacctttcaagacaaacattgtttaacaatccaccagcgaatccacacaggcgagaagccatataagtgtctagagtgcggtaaggcattttccggaaagagcaacctgactaaccataggaggattcacaccggggagaaaccgcataagtgcgaagtgtgtgggatggccttccatcacagctcagtgctgaggcagcataagaggattcatacgggcgagaagccttatacttgctcagagtgcggcacttccttcagacagggcagcgcactcataggccacaagagagtccacaccggtgaaaaaccttacgagtgcgaggaatgcggcaaggcttttcgggtgtcctctaacttaaccggtcataaaaagagaaaacatcaggtctggagcacccatgagctcgatggatcaaggaagtccctctctccagtcaccgtgtcacagacatctgtggtgtccatactcacgagtgcctag

SEQ ID NO: 25164 - DNA, 2001 bp, Artificial Sequence
  Description of Artificial Sequence: Synthetic coding sequence
atgcaggaggtggtcttgctggatgagtcttctgggccacccagccagttgctatggactcgacaggacactcagctgccacaggagtcagccttgctgcccgctccatatccggcatttacgaaggacgggagtcaagggaatctgcctcaggcagacataaccctgatgtcccaggcgcaggaaagtgtgactttcgaagacgtcgctgtaaactttaccaaccgcgaatggcagtgtctgacctacgcacagcgacatctctacaaagacgtaatgttagagaactatggaaatatggtgtccctcggatttcccttcccaaaacccccacttattagccatctcgaaagagaggtcgacccatgcgtccaggacccccaagatcgagagagtcttagttgtagctatccagtgtccgccgacaagatgtggcctgagaatgaaaaagctagctcacaacaggagatttttgaaaatggggaagcctactggatgaagttcaactcactcttgaaggtcgactcccgcgatcctaaggtgagggaggtgtgtgtgcaggatgtaaaacttgagaatcagtgggaaactagtatcagagaaaagctgcgagaagaaaaggaaggctccgaagaagtcacttgcaaaaaaggaaaaaaccaaaaggtcctgtccaagaatctgaacccaaattcaaagcacagtcagtgcaacaaagttctcattgcacagaagctgcacgaatgtgccaggtgcggtaaaaacttttcgtggcacagcgacttaattctgcacgaacaaatacatagcggcgaaaaaccacatgtctgcaatgaatgcggtaaggccttcaaaacccgtaaccagctctcaatgcatcgcattattcacactggcgagaagccattcaactgtacacagtgcggtaaagctttcaactcacggagcgccctgtgccggcataagaaaacccacagtggcgaaaaacctcacgaatgtagggactgcggcaaagcctttaagaccaggaatagactgtgtatgcaccaattaatccataccggtgaaaagccatataaatgcaactgctgtggcaaggctttccagttcaaacacagtctcaccatacatggccgaatacacacgggcgagaaaccctatgagtgcgaagaatgtggcaaggcattctccgggtccagtgatctaactaaacatattcggattcacaccggggagcgcccatatgagtgctcaaaatgtggcagagcgttttcccgctcctcagatttgagcaagcataaacgcatccatacaagagaaaaacactatggctgtccacagtgcgggaaggacttttctattaaggccgagcttacaaaacaccggaggatccatacagaggagaagcgctatcggtgcgaagagtgtggaaaggccttcaggcataattgcaagaggcgcgctcatgagcgcgagcacaccggcgagaaaccatatcagtgtcgggactgcggaaaaacatttcaggacaaacactgcctgaccattcatcagcggatacacactggagagaaaccttacaaatgtttggagtgtggaaaagccttttcggggaaatctaatcttacaaaccaccgtaggattcacacaggggagaagcctcacaaatgcgaagtgtgcggcatggcttttcatcactcttctgtgttacggcagcataaacggatccacaccggcgagaaaccgtacacgtgttcagagtgtggcacttcttttcgccagggtagtgccttaattggccacaagcgggttcacaccggagagaagccatacgaatgtgaggagtgcggaaaagcgttccgggtttctagcaacctgaccggacacaaaaagaggaaacaccaagtctggtccacacacgagctggatggcagccgcaaaagtctctcgccagtaacagtctcccaaacttcagtagtttccatcctaacatctgcatag

SEQ ID NO: 25165 - DNA, 1725 bp, Artificial Sequence
  Description of Artificial Sequence: Synthetic coding sequence
atgctggaaaactatggtaatatggtgtctttgggattcccttttcccaagcctcccctaattagccacttagagagagaagttgatccctgcgtacaggacccccaagacagagagtccctaagttgctcttatccagtcagcgctgataaaatgtggccagaaaatgaaaaggcgagctcccagcaggagatattcgaaaacggcgaagcatattggatgaaatttaactcactcctgaaggtggatagcagggaccctaaggttcgggaggtgtgtgtccaagacgtgaaactcgaaaaccagtgggagacgagtataagggagaaactgcgggaagaaaaagaaggctccgaggaagtgacatgtaagaagggaaagaatcagaaagtgctgagcaaaaacctcaatccaaattctaagcacagccagtgcaacaaagtcctaattgctcagaaactgcacgagtgtgcgagatgcgggaaaaattttagttggcactccgacctgattctgcacgagcaaattcacagtggcgaaaagccccacgtctgtaacgaatgcgggaaggcgttcaagactcggaaccagttgtcaatgcacagaatcatacatacaggagagaagccttttaactgtacccaatgtgggaaggcttttaactcacgaagtgcactctgccgtcacaagaagacccactcgggcgagaagccccatgagtgccgagactgcggcaaggcatttaagactcggaatcgcctttgtatgcaccagctgatccacactggcgagaaaccgtataagtgcaattgttgtggtaaagcatttcagttcaaacacagtcttacaatccacggacggattcatacaggcgagaagccctatgaatgtgaggaatgtggcaaagccttctctgggtcttcagaccttacaaaacatatcagaatacacactggagagagaccctatgaatgttctaagtgcgggagggccttctcacgcagcagcgatctcagcaaacacaaacggattcatacgcgcgaaaaacattacggttgtccccaatgtggtaaggacttctcaattaaagctgagcttacaaagcaccgaaggattcatacagaggaaaagagatatcgttgtgaggaatgtggcaaagcattcagacataattgcaagaggcgcgcacacgaacgagaacataccggggagaaaccgtatcaatgtagggattgtggcaagacattccaggacaagcattgcctcacaattcatcaacgcatccataccggcgagaagccatacaagtgcttggagtgcggaaaagccttttccggtaaatcaaaccttaccaatcatagaagaattcataccggagaaaaacctcataaatgtgaagtttgcggcatggcattccaccactcctctgtgctccggcagcataagagaatccacacaggtgaaaagccttacacttgttctgagtgtgggacttcttttcggcaggggagtgccctgatcgggcacaagagggtgcatacaggtgagaaaccctacgagtgcgaagaatgcggtaaagccttcagggtgtcgagtaacctgactggtcataaaaaacgcaagcatcaggtgtggtcaacacacgaactagacggctcccgaaagtctctgtcccccgtaacggtcagtcagacaagtgtggtctcaatcctgactagtgcttag

SEQ ID NO: 25166 - DNA, 1725 bp, Artificial Sequence
  Description of Artificial Sequence: Synthetic coding sequence
atgctggaaaactacggcaatatggtttctcttggttttccctttcccaaaccacctcttatatctcatctcgaacgggaggtggatccctgcgtgcaggatcctcaggatagggagtctctttcatgctcatatcccgtgagcgccgacaagatgtggcccgagaatgaaaaggcctcttctcagcaagaaatctttgagaatggtgaagcttactggatgaaattcaatagcctgctgaaagtagacagtcgggatccaaaggtgcgcgaggtttgtgtgcaggatgtgaagctggagaatcaatgggagacttccatccgcgagaagctgcgcgaagaaaaggagggctcagaggaagtcacctgcaagaagggtaagaaccaaaaggtgctgtcgaagaatttaaacccaaattcaaagcactctcagtgcaataaggtgctcattgctcagaagctccacgagtgtgcacggtgcggcaaaaatttttcctggcactcggacctgatcttgcacgagcaaattcatagcggagaaaaaccacatgtgtgcaacgaatgtggcaaggcttttaagacccgcaaccaactgagcatgcaccgtattatacacactggcgaaaaaccttttaattgcacccagtgtgggaaggcctttaactctagatccgctctttgcagacataaaaaaacccacagcggggaaaagccacatgagtgtcgagattgcggtaaagcctttaaaactcgaaatagactctgcatgcatcagctaatccacaccggtgaaaaaccttacaagtgcaactgctgcggaaaagcctttcagtttaaacatagcctcactattcatggcagaatacataccggagagaagccctacgaatgtgaagagtgtggtaaggcgttctcgggttccagtgacctgaccaagcacatcaggatccacacgggagagcggccatatgaatgttcaaaatgtggtcgagcgttctcacggtcatcagatctttccaaacataaaagaattcatactcgggagaagcactatggctgtccacaatgcggcaaggacttctctatcaaggctgaattgactaagcaccggagaatccataccgaggagaaacgctatagatgcgaggaatgtggaaaggcgttccgtcacaattgtaaacgtagagcacacgagagggaacacacaggcgagaagccttatcaatgtagagactgtggaaagacctttcaggataaacactgcctgactatccatcagcgcattcataccggggagaaaccgtacaagtgcttagagtgtggtaaggccttctcaggtaaatccaaccttacaaatcacagaagaattcatactggcgagaagccgcacaaatgcgaagtgtgtgggatggcattccaccattcatccgtgctcagacagcacaaacggatccatacgggtgagaaaccctacacatgctcggagtgcggaacctcattccgccagggcagcgccttgatcggacacaagagggttcacaccggtgagaagccttacgagtgtgaagagtgcgggaaagcgtttcgagtcagctcaaacctcaccggtcataagaaacggaaacaccaggtgtggagcacacacgaattggacgggtctcggaagtctctaagtcccgtgacggtgtcccagaccagcgtagtttccatattgacaagtgcatag

SEQ ID NO: 25167 - DNA, 1725 bp, Artificial Sequence
  Description of Artificial Sequence: Synthetic coding sequence
atgctggaaaattacggaaatatggtgtcactcggcttcccatttcctaaaccgccattaatcagccatctggagcgcgaggtcgacccttgtgtgcaggacccccaagatagagagagtctgtcatgctcctaccctgtctctgcagacaaaatgtggcccgagaacgaaaaggcctcttcacagcaggagattttcgagaatggcgaagcctactggatgaaatttaatagtctgctgaaagttgacagccgagatcctaaagtgagagaagtctgcgttcaggacgtgaagctcgagaatcagtgggaaacaagcatcagagagaaactgagggaggaaaaagagggatctgaggaagtcacttgcaaaaagggaaaaaatcagaaggtcttgtctaaaaaccttaatccaaattcaaaacattcccagtgtaacaaagtgcttatcgcccagaaattgcacgaatgtgcgcgttgtggtaagaacttcagctggcactccgacctcatattgcacgaacaaattcacagtggtgaaaagccccacgtgtgcaacgaatgcggtaaggccttcaagacaaggaaccagctgagcatgcaccgtattattcacaccggagaaaaacctttcaactgcacacagtgtggaaaagcatttaacagccgaagcgccctttgtagacataagaagacacactcaggcgaaaagcctcatgaatgtagggattgtggcaaagcgttcaagacgaggaacagattgtgtatgcatcagctcatacataccggagagaaaccatataaatgcaactgctgtggcaaggcctttcaattcaagcactctctgacaattcacgggagaattcatactggggagaagccctacgagtgcgaggagtgcgggaaggcattctccggttcttctgacctgaccaagcacattaggatccacactggcgaaagaccgtatgaatgcagtaagtgcggaagggcattctcaagatcctcagacctgtccaaacataagcgtattcatacacgggagaaacactacggatgcccccaatgtgggaaagacttctcgattaaagccgaactaaccaaacaccgacgcattcatacagaggagaagcggtatcggtgcgaagagtgtgggaaggcatttagacacaactgcaaacgacgcgcacatgagagagagcacactggggaaaagccctatcagtgtagagactgcggcaagactttccaggacaagcattgcctgacgatccaccagagaatccacaccggtgaaaaaccatacaagtgtttagagtgtgggaaggccttcagcgggaaaagcaacctgaccaatcatagaagaattcataccggggagaaaccccacaagtgcgaggtctgcgggatggcgtttcatcattcatctgttctgcgacagcacaaaagaatacacaccggggaaaagccttacacatgctccgagtgcggcacaagttttcgtcaaggctcagccctgattggacacaagcgagttcacaccggggaaaagccctacgagtgcgaggagtgtggcaaagccttcagggtttcctctaatctcactggtcataaaaagagaaagcaccaggtttggtccacgcatgagcttgacggtagccgaaagtctctgtcccctgtgactgtgagccaaacctcggtcgtctctattttaacctctgcatag

SEQ ID NO: 25168 - DNA, 1725 bp, Artificial Sequence
  Description of Artificial Sequence: Synthetic coding sequence
atgctggagaactacggtaacatggtgtccctcggctttcccttccccaaaccgcctttaatcagccaccttgaacgggaagttgacccctgtgtgcaggatccccaagacagagagtccttgtcttgtagctatcctgtgtctgctgataaaatgtggcctgaaaacgagaaggcttcttctcaacaagagatcttcgaaaacggggaagcttactggatgaagtttaactccttattaaaggtggactcacgagacccaaaagtgcgtgaggtgtgcgtgcaggatgtgaaactcgaaaaccagtgggagacgtctatccgcgaaaaactgcgagaggagaaagaaggtagcgaggaggtgacatgtaaaaagggcaaaaatcagaaagtcctgtccaagaatctgaaccctaatagtaagcatagtcagtgtaataaagtgcttatcgcccagaagctgcatgagtgcgctaggtgcggcaaaaacttctcatggcactcagatctcattctccatgaacagatccacagcggggaaaaacctcacgtgtgtaatgagtgcgggaaagcattcaaaactagaaaccagttgtccatgcaccgtatcatccataccggtgagaagccgtttaattgcacccaatgcggaaaagcattcaactcgcgcagcgcactgtgcagacataaaaaaacacattccggggagaaacctcatgagtgccgcgactgcggcaaggccttcaaaactcgcaatcgcctgtgcatgcaccagctgatccacactggcgagaagccttataagtgcaactgttgcgggaaagcgttccagttcaaacatagtctgacaattcatgggagaatccataccggcgagaagccatacgagtgtgaagagtgcggaaaggcgttctcagggagctccgatctaaccaagcatatccgcatccacacaggcgagcgcccatatgaatgctccaagtgcgggagagctttcagtaggtcttctgacctcagtaagcacaaaagaatacacacacgggaaaaacactatgggtgtcctcagtgtgggaaagacttctcaatcaaggcggagcttacaaagcacagaaggattcacaccgaggagaaacggtacagatgcgaggagtgtggaaaagctttcagacacaactgtaagcgtagggcccatgaacgggagcatactggagagaagccatatcagtgccgtgactgcggaaaaacctttcaggacaagcattgccttaccatccatcagcggatccacaccggggagaaaccttacaagtgcctagagtgtggtaaagccttcagcggtaaatcaaacttaaccaatcatagaagaatccacacgggcgagaagccccataagtgtgaggtgtgcggcatggcatttcaccatagcagcgtgttacgccaacacaagcgtatccacactggggaaaagccttacacttgcagtgagtgcgggacaagctttcgacaggggtctgcactgatcggccacaagcgggtacataccggcgaaaaaccctacgagtgcgaagagtgcgggaaggcttttcgcgtctcctcaaatctgaccggccacaaaaaaagaaaacaccaggtgtggtctacccacgaacttgacggaagtaggaagtccctgagccctgtgactgtcagccagacatccgtggtctctatactgaccagcgcatag

SEQ ID NO: 25169 - DNA, 1725 bp, Artificial Sequence
  Description of Artificial Sequence: Synthetic coding sequence
atgctcgagaactatggaaatatggtgagccttggtttccccttccctaagccaccacttatatctcatctggagagggaggtcgacccatgcgttcaggacccccaggatagggaatcactgagttgctcttatcctgtgagcgctgacaagatgtggcctgaaaatgagaaagcaagctcccagcaggaaatattcgaaaacggcgaggcctactggatgaaattcaacagtttactgaaagtggacagtcgagatcccaaagtgagagaagtgtgcgtccaggatgtaaaactggagaaccaatgggaaacatctatccgtgaaaagctaagggaagaaaaggaggggtccgaggaagttacatgtaaaaagggcaaaaaccagaaagtgctgtctaagaatttgaacccaaactcaaagcacagtcaatgcaacaaggttctgatcgcccaaaaattgcatgaatgcgctaggtgcggcaagaatttctcttggcacagcgatttaatcctccacgaacagatccattcaggcgagaagccacacgtctgcaacgaatgcggcaaagctttcaaaacccggaaccagttgagcatgcataggatcattcatactggcgaaaagccattcaactgtacccaatgtggaaaggccttcaactcaaggtcagcactttgccggcataaaaaaactcacagtggagaaaagcctcacgaatgtcgggattgcgggaaagcatttaagacacggaatagattgtgtatgcatcagctaatccataccggagagaagccatataagtgcaactgttgcggaaaggctttccagtttaagcattctctgacaatccacggcagaattcatacgggagaaaagccctatgagtgcgaagagtgcgggaaagcctttagtggctctagcgatctgacaaagcacatccggattcacaccggggaacgaccttacgaatgtagcaagtgcggccgtgcttttagtcgctcatcagacctgtcaaagcacaagcggatccacacacgggaaaagcactacggatgcccccagtgtgggaaggatttcagtatcaaagccgaattgactaagcatcgaaggatccatacggaggaaaagcgctaccgttgcgaggagtgcgggaaggcctttcgacataattgcaaaagacgggctcacgagagggagcatactggcgagaaaccgtaccagtgtcgtgactgtggcaaaacattccaggacaagcactgcctgactatacatcaacggatacatactggcgaaaagccatacaagtgcctggagtgcggcaaagctttttcaggcaaatccaatctcactaaccacaggagaatccacactggtgaaaagcctcacaagtgtgaggtatgtggaatggccttccaccatagtagtgtcctgcgacaacacaagcgaatccacactggggaaaagccttatacttgctccgagtgcggcacatcattccgtcagggcagtgcgctcatcgggcacaaacgtgtccatactggtgagaagccctatgaatgcgaggagtgcgggaaagcttttcgggtgagctccaaccttacaggccacaaaaaacgaaaacaccaggtttggtctacccacgagctggatggcagccggaagagcctgtccccggtgaccgtgtcccagaccagcgtcgtgagcatcctcaccagcgcatag

SEQ ID NO: 25170 - DNA, 1725 bp, Artificial Sequence
  Description of Artificial Sequence: Synthetic coding sequence
atgttagaaaattacggaaatatggtgtcactcgggttcccctttccgaaaccccctctgatttcccatctcgaacgggaggtggatccctgcgttcaggatccgcaggatcgggagtcactgtcttgctcatatccagtgtctgccgacaaaatgtggcccgaaaacgaaaaagcatcatcccagcaggagatctttgagaacggcgaggcgtattggatgaagtttaattctctactcaaggtggacagtagagaccccaaggttcgcgaggtttgcgtgcaggacgtgaaactggaaaaccaatgggagaccagcatccgcgagaaactccgggaggagaaagaggggtctgaagaagtgacctgtaaaaaaggtaaaaaccagaaggtgttgtcaaaaaacctaaatcccaatagcaaacattcacagtgtaataaggtgctgatagcccagaaacttcatgagtgcgccaggtgcggaaagaacttctcatggcactccgatctgatccttcacgaacagatacatagtggcgaaaagcctcacgtgtgcaatgagtgcggcaaagcctttaagaccagaaaccagctgtccatgcaccgcattattcataccggcgaaaaaccttttaattgcacccagtgtgggaaggcatttaattctaggtccgccctgtgccggcataagaaaacacatagtggcgaaaagccccacgagtgccgggactgtggtaaggcttttaagactcgtaaccggctttgtatgcatcagcttatccacacaggcgagaaaccttataaatgcaactgctgtggaaaggccttccagtttaaacactctctcactattcacggaaggattcacacaggagagaaaccttacgagtgtgaggagtgtggaaaagctttttctgggtcttcggatttgactaagcatatcagaatacacacaggtgagagaccctatgagtgcagcaaatgtggaagagccttctccagatccagcgacctaagcaaacataagagaatacacacaagagagaaacattacgggtgtccacagtgtgggaaagacttctctattaaggcagaactcaccaagcatcggaggatccataccgaggagaagcgttatcgctgtgaagagtgtggtaaggcatttaggcataactgtaagagaagagcacacgagcgcgagcatactggtgagaaaccgtaccagtgccgggactgtggtaagacttttcaagataagcattgcctgaccattcatcagaggatccacacaggtgaaaaaccctataaatgcttagaatgcgggaaggcgtttagcggcaaaagcaacctcactaaccacaggagaatccacactggagaaaaaccgcataaatgcgaggtgtgcggcatggcgttccaccattcttccgttctccggcagcataaacggatccacactggcgaaaagccctatacctgctctgagtgtggtacatccttcaggcagggctccgctctcataggtcacaagagagtgcacacaggcgagaagccctatgagtgtgaagagtgtgggaaggcttttcgagtcagttccaacctcaccggacacaaaaagaggaagcatcaggtgtggtcaacccacgagctggacggaagtagaaaaagcctgtcaccagtgacggtgagccagacatccgtggtaagtatcctgacaagcgcatag

SEQ ID NO: 25171 - DNA, 1749 bp, Artificial Sequence
  Description of Artificial Sequence: Synthetic coding sequence
atgtcggagagttggcagcagccaccccaaacccaacctcagcagccgcaacctccccaaccgcagcaccatgcggagcctcccccagctctcgccgaacacaccttacccccaggcacagccgagaaccctctgggatgtgcagtgtatggcattctactccagcccgaccctggtctgcagccccctcagcacgcacctctgcaggcagccggagaacctggacccaagtgcggtgtgtgtgggcatgacctcgcacacctgagctcccctcacgaacaccaatgcctcgccggtcacgatagaagctttcagtgcacccaatgtttaaagattttccaccaggcaacagacctcctcgagcatcagtgcgtgcaggccgaacagaaaccttttgtttgtggagtctgcaagatgggattttccttgctgacaagcctcgcgcaacatcattcaagtcactccggcctggtgaagtgttccatttgtgagaaaacatacaaacccgctgaagccgcagaaccagcaacaaccgctgctcccagtctgccggcagcacccgctccgagtaccgtaactcctgctgaacaggctgataagccatattcgtgccctatctgccagaagcccttcaaacatctcagcgagctctctagacatgagaggattcatacaggagagaagccctataagtgtacactctgtgataagagcttcagccaaagctcgcacctggtgcaccataagcggactcacagttccgaacgaccgtataaatgtgccgtatgcgagaaaacctttaagcaccggagccacctcgtgaggcacatgtatgctcactcgggggagcaccacctatttcgctgtaatgtgtgcgagttgcattttaaagaatcctccgagctactgcagcatccttgtaccccctcaggcgaacggccatttcgatgcggagaatgtcagaaggcatttaaacgacccagcgacctacggcagcacgaaagaactcattccgctgaacggccattcaaatgcgatctctgccctatgggcttcaagcagcagtacgccctgatgaggcacagacgcacgcacaaaaccgaggagcctttcaagtgcggactgtgtgagaagggatttgggcagccgtcacatctgctgtatcatcagcacgttcatacgctggagactttgttcaagtgtcccgtgtgtcaaaagggtttcgaccagtcagctgagctgctgcggcataaatgccttcctggcgcagcagagcgccctttcaagtgccccgtgtgcaataaggcgtacaagcgcgcttccgcactccagaaacatcaattggcacattgcgctgcagcagagaaacccctgagatgcactctgtgtgaacggaggttcttttctagctccgaatttgttcagcatcgctgcgaccctgctagagaaaagcctttgaagtgcccagactgcgagaagcgatttaaatacgcttccgacctacaacgccatagaagagtccacaccggggagaagccttataagtgtcctaactgcgacaaagcgtttaagcagcgagaacaccttaacaaacaccagggagtgcacgctagggagcagcaatttaaatgtgtgtggtgcggggagagattcctagacgtggctctgctgcaggagcacagcgctcagcactctgcagcagccgcagcggctgagggtgcctaccaggtggctgcgtgtcttccttag

SEQ ID NO: 25172 - DNA, 1209 bp, Artificial Sequence
  Description of Artificial Sequence: Synthetic coding sequence
atgtacaccagtgaagaaaagtgtaaccaacgcacacagaaacgcaaaatttacaatgtatgtcctaggaaaggtaaaaagattttcatccacatgcatgagattatccaaattgatggacacatctatcagtgtctggagtgcaagcagaatctttgtgagaacctggctttgatcatgtgtgaacgtactcacacgggcgagaaaccctacaagtgcgatatgtgcgaaaagacctttgtgcaatctagtgacttaacgagccatcagagaattcataattatgagaagccttacaaatgctcaaagtgtgagaagagcttctggcaccatctggtgctcagtggtcatcagcggacccacgctggcaaaaaattttatacatgtgacatatgcgggaagaacttcggtcagtcctctgatctgttagtacatcagcggagtcatactggtgagaagccctacctttgttctgaatgtgataagtgcttttcaagaagcactaacctcatcaggcacaggaggacacacaccggggagaagccctttaagtgcctggagtgcgaaaaagctttctctggcaagtcagatctgatttctcaccagcggacccacactggcgaacggccttacaagtgcaataagtgtgaaaagagctatcgtcatagatctgccttcattgtgcacaagcgagttcacactggagagaagccctataagtgtggcgcatgtgagaaatgttttggccagaagagcgacctgatcgttcatcagcgtgtgcacactggtgagaaaccgtataaatgtctggagtgtatgcgatccttcacaagatccgccaatctgattcgccaccaggctactcacactcatacatttaaatgtctggagtatgaaaaatcttttaactgctcctctgatctgattgtacatcaacgaatccacatggaggagaagcctcaccagtggagtgcttgcgagtcgggctttctactaggcatggattttgtggcccagcagaagatgcggacccagaccgaggaattacattacaagtacacagtgtgtgataagtcatttcaccagtcttccgctttgttgcagcatcagactgtgcggataggagagaagccttttgtgtgtaacgtgtctgaaaagggattagaactgtccccgcctcacgccagtgaggcatcccagatgtcctag

SEQ ID NO: 25173 - DNA, 1662 bp, Artificial Sequence
  Description of Artificial Sequence: Synthetic coding sequence
atggcctttgaagacgtggcagtgtatttcagccaggaggagtgggggctcctggacacagctcaacgcgcactctatagaagggtgatgttggataactttgcgctggtggcctccttgggtttgtcaaccagcaggcctagggtagttatccagctcgaacgaggcgaagagccatgggttccgtcaggtaccgacaccacactgtctaggacaacctatcggcgtaggaatccaggatcctggtccctcactgaggatagggacgtgtccggggagtggccacgcgcattccctgacactccccctggcatgaccacctctgtgttccctgtcgccggagcttgccattccgtgaagagcctacagaggcagagaggcgcttctcctagcagagagcggaagccaacgggtgtgagtgttatttattgggagagactgctgcttggcagtggctccggacaggcgtctgtgtccctgcggctgacatcaccacttaggcccccagaaggtgtgcgattgcgcgagaaaacccttaccgaacatgctctcctcggccgtcaacccagaacacccgagcggcaaaagccatgcgcacaggaagtgcccggacgcacattcggctccgcccaggacctcgaggcagccggtgggcgaggccatcataggatgggcgcagtgtggcaggagccccatcggttgcttggcggtcaagaaccaagtacatgggatgaactcggggaagccctgcacgccggtgaaaaatcctttgagtgtcgggcatgttctaaggtgttcgtgaagtcctcagacctgctgaagcacctgagaacccacactggcgagagaccctacgaatgcgctcagtgcgggaaggcgttctcacagacatcacatctgacccagcaccagaggatccactctggcgaaaccccatacgcatgccccgtttgtgggaaagcctttcgccattcttcctccttagttcggcatcaaagaatccacaccgcggaaaagagcttccgatgttctgagtgtggcaaggcattctctcatggctctaacctgagccagcatcgtaagatccatgcaggcggacgaccttatgcttgcgctcagtgcggcaggcggttttgtagaaacagccatctcatccagcacgagcgcacccacaccggcgaaaagcctttcgtctgcgctttatgcggggctgctttttcccagggatcttcactcttcaaacaccagcgggtccatacgggcgagaagcctttcgcatgccctcagtgtgggagggcatttagtcatagtagtaacttgactcaacaccaactgctgcacactggcgaaaggccatttcggtgcgtcgattgcggcaaggccttcgcgaagggagccgtgctgttgtcccatcgacgcattcatactggcgaaaagccatttgtctgcacgcaatgtggaagagcattccgagaaagacctgctctgtttcatcatcaacgcattcacacaggagaaaagaccgttagacggtcccgggcatccctgcacccccaggcccgtagcgtggccggagccagctcagaaggtgcccctgctaaagagaccgagccgacgccagcctctggcccagctgctgtcagtcaacctgcggaggtgtag

SEQ ID NO: 25174 - DNA, 861 bp, Artificial Sequence
  Description of Artificial Sequence: Synthetic coding sequence
atggcgtttgaggacgtagctgtctatttctcccaagaagaatggggcctgctggataccgctcagagagctctataccgtcgggtcatgttggataattttgccctcgtggcaagcctgggcctgtccacctccaggccccgtgttgtcatccagctggagcgaggagaggaaccgtgggttccctccggaacggacaccaccctgtcacgcacaacctacagacgaagaaatccagggtcttggtcattgactgaagatagggatgttagcggagaatggcctcgcgctttccccgatacccctcctgggatgaccacttccgtcttcccagtcgcaggagcttgccactccgtgaagtctctgcagagacaaaggggggcaagtcccagccgagaacgtaaaccgacgggagtgagtgttatttactgggagcgacttctgttgggcagcgggagtgggcaggctagtgtctcccttcggttgacatccccattgagacctcccgagggggtgagacttagagaaaagacactgacggagcacgctctgctcgggcgacagcctagaacacctgagcggcagaagccgtgtgctcaggaggtacccggacggacattcggctcggcccaagaccttgaggccgcagggggacgcggacatcatcggatgggagcagtttggcaagagccacaccggctgcttggcggtcaggagccttctacctgggatgagctcggagaagctctgcatgctggcgaaaagtcttttgagtgtcgggcttgttctaaagtgtttgtcaagtcctccgacctcttgaagcacctccggacccgggttagacagggcctcccggcatag

SEQ ID NO: 25175 - DNA, 993 bp, Artificial Sequence
  Description of Artificial Sequence: Synthetic coding sequence
atgggcgcagtctggcaagagccacacaggctgctggggggtcaggaacccagtacgtgggatgaactgggggaggcactgcatgctggagagaaaagtttcgagtgccgtgcttgttcaaaggtgtttgttaaatcgagcgatttgctgaagcatcttcgaacacatacaggtgagcggccatacgagtgcgcacagtgcggcaaagcgttctcccagacctcacacctaacccagcaccagagaattcattcgggcgaaacaccgtacgcttgtcctgtctgcggaaaggccttccggcattccagcagtctggtcagacatcagcggattcataccgcagagaagagttttaggtgctccgagtgcggaaaagccttcagtcacggctctaacctatcacagcaccgcaagatccatgcgggaggacgaccctatgcctgcgcacagtgcggccgtcgcttctgcaggaactcccatcttattcaacacgaacgcacacacacaggtgagaagccattcgtgtgtgctctgtgcggtgcagctttcagtcaaggctctagtctcttcaagcaccaaagggtccatacgggcgaaaagccgtttgcttgtcctcaatgcggaagagcattttcacactcttcgaacctcactcaacatcagcttctgcacactggagaacgaccatttaggtgtgtcgattgtggaaaagcctttgctaaaggcgctgtgttgctgagtcaccgcagaatccacaccggggaaaagccatttgtctgtacacaatgcggaagagctttcagagaaagacccgctctttttcatcaccagcgcatccacaccggcgagaaaaccgtgcgcaggagtcgcgcatcacttcatccgcaggcgagatctgttgcaggcgctagctccgagggggctccagcaaaagaaaccgaaccaacacccgcatcaggccctgctgccgtgagtcagcctgccgaggtgtag

SEQ ID NO: 25176 - DNA, 1662 bp, Artificial Sequence
  Description of Artificial Sequence: Synthetic coding sequence
atggcctttgaagatgttgcagtctacttttctcaggaagagtggggactgttggatacagctcaacgcgcattgtacagacgagtcatgctggataacttcgccctggtagccagcctgggcctgagcacgtctcgtcctagagtcgtcatccaactcgaacgaggcgaggaaccatgggtgccgtccggtaccgacacaaccctgtctcggactacatatcgcagaaggaaccccggaagttggagtttgaccgaagatagggacgtgagtggcgagtggccgagggcatttccagatactcccccaggtatgacgaccagcgtattcccagtggcaggtgcctgccactctgtcaaatctcttcaacgtcagagaggcgcatcccctagtagagagcgtaagcccactggcgtgtctgtaatttactgggaacgattgcttctcggatccggctccggccaagctagtgtgtcccttcgactgacaagccctttgcggcctcccgaaggagtgaggctgcgggagaagaccctcacagaacacgccctactgggccgtcagcccaggacacctgagaggcaaaaaccatgcgctcaggaggtcccaggaagaaccttcggttctgcacaggatctggaagccgcaggtggacggggtcatcatcggatgggtgctgtgtggcaggagccccacaggctcctaggagggcaagaaccctctacttgggacgaactaggagaggctctccacgccggtgagaagtcttttgagtgccgagcctgttccaaggtgtttgtgaagtcatccgaccttctcaagcacctgcgcacccacacaggggagaggccatatgagtgcgcccaatgtgggaaggctttctcccagacaagtcatctcactcagcaccagcgaattcactcaggcgagaccccatatgcgtgccctgtgtgtggcaaagcctttagacactccagtagcctcgttcgccaccagcgaattcacaccgcagaaaagagttttagatgcagcgagtgtggcaaggcgttctcccatggcagcaatctgagccagcataggaaaattcacgccggtggaaggccttacgcttgcgctcagtgtggcagaagattttgtcggaactcccacctgatccagcacgagcgaactcacacgggggagaagccctttgtctgtgctttgtgcggtgcagcctttagccaggggtccagtctattcaagcaccaacgggttcacaccggagagaaaccatttgcttgccctcagtgcggcagggcctttagtcattctagcaacctgactcagcatcagctgctccacacaggtgagagacccttcaggtgcgtggattgcggcaaagctttcgccaagggtgcagtgctgttaagtcaccggagaatccatacaggcgaaaagccgtttgtgtgtacccagtgtggccgagccttcagggagaggccagctctcttccaccaccaacgaatccacacgggggagaagaccgtaagacgctctcgcgctagtctccacccgcaggctaggtccgtggccggagccagcagtgagggggctccggcaaaggagactgagcctacaccagcgtctggccctgcagcggtgtctcaacctgcggaggtctag

SEQ ID NO: 25177 - DNA, 1605 bp, Artificial Sequence
  Description of Artificial Sequence: Synthetic coding sequence
atgggggtgccatcagtggtttcagccattcctattagagccgattgcagctcgaagccgcaacctctcctccaggggcagcctcatttgtacttttccccaaagctgctgtgccagttgcgcggaagtttcttacctgtccattcagcttgcccaggaccactgctgacgcgcatgccccaggccacgacggtttctctgcctctgggatcttggagcctcactgaagaccgggatgtctctggcgaatggcctcgcgcattccccgacactccaccagggatgacgactagcgtgttccctgtagccggagcttgccacagcgtcaagagccttcagcgccaacggggagcctccccatcacgagaaaggaaaccaaccggggtgtctgttatttactgggaaagacttttgctgggaagtgggagtggccaggctagtgtgagtctgaggctcacctccccccttcgcccaccggagggcgttaggttgcgggaaaagactctcactgagcatgcactcttaggccgacaaccaagaactccagagcgccagaagccctgcgcacaggaggtcccagggcgtacgttcggatcagcccaggatctagaggctgctgggggacgaggtcaccacaggatgggcgcagtgtggcaagagccacacaggctgttgggcggacaagaaccctccacgtgggacgaacttggggaggctttgcacgctggggagaaaagttttgagtgcagggcatgttccaaggtattcgtgaaatctagcgacctgctgaagcacttacggacccatactggggaacggccatatgagtgtgcccagtgcggtaaagcgttttctcaaacttcacatctgacccagcaccaacgaatccactctggagagacaccttatgcctgcccagtctgcggtaaggcattcagacactctagctcactggtgcgacaccagcgaatacatacggcagaaaaaagtttccggtgtagcgaatgtggaaaagccttctctcacggttcgaacctgagccagcataggaagattcacgccggagggcgaccttacgcttgcgctcaatgcggacgccgattttgccgcaattcccacttgatccagcatgaaaggactcacaccggagagaagccttttgtctgcgccttatgcggggctgccttttctcagggatcctctcttttcaagcaccagagggtgcacacaggcgagaagccctttgcatgccctcagtgtggtcgggcattttcccacagctccaacttgacccaacatcaactactccacacaggcgagcgcccattcaggtgcgtagactgtgggaaagccttcgctaagggggcagtccttctgtcccaccgcaggatccatacgggagaaaagccatttgtgtgcacacagtgtggaagggctttccgcgaacgaccagccctcttccaccatcagcggatacacaccggcgagaaaaccggcgatccaggacccgcatgcactcccagaccgggactgctccctggccaccatcagaaagtccggcagagaagaaaaccgagcccactaccacccagagctcagccatag

SEQ ID NO: 25178 - DNA, 1635 bp, Artificial Sequence
  Description of Artificial Sequence: Synthetic coding sequence
atgaccttcgaggacgtcgctgtatactttagtcaggaagagtggggcctcttagacaccgcccaacgggctctctaccgccacgttatgctggagaatttcaccctggttacttctctgggcctgtctactagccggcctagagtggtaatacaactcgagcggggtgaagaaccgtgggttccgtccggcaaggacatgactctggctcgcaacacatatggtcgcctaaactccggttcctggagtctcaccgaagaccgagatgtttctggagagtggcctcgggctttccccgacacgcctccagggatgactactagtgtgttccctgtggctgacgcctgtcattctgtcaaaagtcttcagaggcagcccggtgcttccccttcacaagagagaaaaccaacgggtgtgagcgtgatatactgggagagactgttgctgggcagccggagtgaccaggcttccattagcctccgtcttacatctcctctgagacctcccaaatcgagtcgcccacgagagaaaacctttactgagtatagggttccaggtagacagcccagaactccagagcgccaaaaaccttgcgcccaggaggttcctggaagggccttcggtaacgccagtgatttaaaagctgcttctggaggacgggacaggcgcatgggggctgcctggcaggaacctcatcgcttacttgggggacaagagccgtcaacatgggatgagctgggcgaggcactgcacgccggtgaaaagtcgttcgagtgtcgggcatgctccaaggtgtttgttaaatcaagcgatctgctgaaacacttgcgcacccataccggggaacgcccatacgagtgcacacaatgcggaaaagccttctcacaaacttctcacctgacccagcatcagcgcattcactcgggggagacaccttacgcttgccccgtctgtggcaaggcttttcgtcattcatcttcattggtaaggcaccagaggattcatactgcagagaaatctttcagatgttcagaatgcggaaaagccttctctcacgggtcaaatctatcccaacatcgaaagatacatgccggagggaggccgtacgcatgtgcccagtgcggtcgtcgcttttgtcgaaattcccacctcatccagcatgagaggacacataccggggagaagcccttcgtctgtgccctgtgcggggctgctttttcgcaggggagttctctgtttctgcaccagcgcgtgcacaccggtgaaaagcccttcgcgtgtgctcagtgcggcagaagctttagccggagctcgaatctcacgcaacaccaactgctccacaccggggagcgaccgtttcgctgcgtggattgcgggaaaggtttcgcaaaaggcgcagtgctgctgagccaccgcaggatccacactggcgagaagccattcgtttgcactcaatgcggccgagcctttagagaaagacctgccttgctacaccaccagcgcattcataccacagagaagacaaatgccgcagctccggattgtacgcccggtcccggtttccttcagggccatcaccgcaaagtgcgtcggggaggaaaaccttcccctgtgctgaaacccgctaaagtatag

SEQ ID NO: 25179 - DNA, 1605 bp, Artificial Sequence
  Description of Artificial Sequence: Synthetic coding sequence
atgggcgtccctacagcggttagcgctacacccgtgcgcgctgatgcaagctcaaaaccgcagccgctgctccagagtcaacctcacctattctttttccccaaactgctgtcccgactgttgggctctcctctgccagtccatagcgcttgtcccggacctctgcttaccagaatgcctcaggcaacaacagtctccctgcgcctcggctcttggagccttaccgaagacagggatgttagcggcgaatggcccagggcattcccggacactcccccaggtatgaccaccagcgtctttcccgtggccgatgcctgccactctgtgaaatccctccagcgccaaccgggagcaagtccctcacaagagaggaagcctacaggagtgtccgtgatctactgggaacgcctgttgcttggttcaagatctgatcaggcttctatcagcctgcgtctcacttcacccctccggcctccaaagtcaagccgccctcgtgagaaaactttcaccgaatacagggttcctggtcggcagcctagaacccccgagagacaaaagccatgcgcccaggaggtaccaggtagggcgtttgggaacgcaagtgatttgaaggcagcctccggagggcgtgaccgacgaatgggagccgcttggcaggagcctcaccgattgctgggcggtcaggagccttctacctgggatgagcttggcgaagccctgcacgcaggggaaaagagcttcgagtgtcgcgcttgcagcaaggtatttgtgaagtcatcagaccttctgaagcacctgcgcacacatacgggggagagaccttacgaatgcacgcagtgcggtaaagccttttcgcagacatctcacctaactcagcaccagagaatccacagcggggagaccccttatgcgtgtccggtgtgcggaaaggctttcagacattcgtcgagcctcgtgagacaccagcggatccacacagcagagaaaagcttccggtgctctgagtgtggtaaagcattctcacacggctccaatttgtcgcagcacaggaaaattcacgcaggtggaaggccttatgcctgcgcccagtgcggtcgcaggttttgtagaaactcccatctcattcagcacgagcggacccacactggagaaaaaccattcgtgtgcgcactgtgtggtgctgccttttctcagggatcctcgcttttcctccaccagagagttcacacaggcgagaagccgtttgcctgcgctcagtgcggacgatctttctcccgaagctctaaccttacccagcaccagttgctacataccggggagcggccattccggtgtgttgactgcgggaagggtttcgccaaaggggcagttcttcttagccatcgtaggatacacactggtgaaaagccgttcgtgtgtacacaatgtgggcgagctttcagagaacggcctgctctgctgcaccaccagagaatccatacaacggagaagacaaatgcggctgccccagattgcacaccaggtcccggattccttcaggggcatcaccggaaagtccgtcgagggggtaaaccaagcccggttctcaagccagccaaggtatag

SEQ ID NO: 25180 - DNA, 1635 bp, Artificial Sequence
  Description of Artificial Sequence: Synthetic coding sequence
atgacctttgaggatgttgctgtgtacttttcccaagaggagtggggtcttctggacacagcccagcgggcactgtatagacatgttatgctcgagaatttcactttggtgacgtctcttggcctgtccaccagcaggccacgggtggttattcagttagaacgtggggaagaaccgtgggtgccatccggcaaggatatgaccctggctcgcaacacatatggccgtcttaatagtggtagctggtcacttaccgaagatagagacgtctccggcgaatggcctagggcattccccgatacacccccaggcatgacaacgagtgtatttcccgtcgcagatgcctgtcattctgtgaaatcactgcaacgtcaacctggagcctctccctcacaagaaagaaagccaaccggcgtcagcgtaatctactgggaaagactcctgctgggatcacgttctgaccaggcctccattagtctgcgactgacctctccactgcgacctcccaagtcttcccgcccaagagagaaaactttcacggagtacagggttccaggtaggcagcctcgcacccccgagagacagaaaccgtgtgcccaggaagtgccgggacgtgcctttggcaacgctagcgacctgaaagccgcaagcggagggagggaccgccgtatgggtgccgcttggcaggagcctcacagactgcttggtggacaggagccttcaacgtgggacgagctgggggaagctctccacgctggggagaagagcttcgagtgtagggcctgctcaaaagtgttcgtgaaaagtagcgacttactcaagcacctgaggactcacactggtgagaggccgtatgaatgcacccagtgtgggaaggccttttcccagacatcacatctgacccagcatcagcgcattcactctggggagactccttatgcgtgcccagtctgcggtaaggcatttaggcactcctcctctctggtgagacatcaacggatccacacagccgaaaaatcctttagatgttcagagtgcgggaaagctttttctcatgggagtaatttgtcccagcacaggaaaatacacgccggagggagaccatacgcctgtgctcagtgtggacgacgcttttgcagaaatagtcatctgatccagcacgagaggactcatacaggtgaaaagcctttcgtgtgtgccctgtgtggtgcagctttctctcagggatccagcctattcctgcatcagcgcgtacacacgggggaaaagcccttcgcatgcgcccagtgcggcaggagttttagccggtcctcaaaccttacccagcaccagcttctgcacacaggagaacgtccattccgttgcgtagattgcggaaaaggattcgccaaaggtgctgtgctcctgtctcaccgaagaattcacacaggagaaaaaccatttgtctgcactcagtgtgggagagccttcagagagcgacccgctctcctgcaccaccagcgaatccacaccaccgagaagacgaatgctgccgctcccgattgtacgcccggtcccggattccttcaggggcaccatagaaaggtgcggaggggtggaaagccgagtcctgtgctgaaacctgctaaggtctag

SEQ ID NO: 25181 - DNA, 1749 bp, Artificial Sequence
  Description of Artificial Sequence: Synthetic coding sequence
atggactttgaggacgactatacacattctgcatgtcggaacacttaccaagggttcaacgggatggaccgcgattacggacctggctcctacggtggaatggaccgggactatggacatggctcgtacggtgggcagcgtagcatggactcatacctgaatcagagttacgggatggataatcacagcggcggaggaggcggttcaaggtttggaccttacgagtcttacgatagcagatcaagtcttgggggacgggacctctatcggtctggttatgggtttaacgaaccggagcaatctcggtttgggggaagctatggaggccgattcgagtcatcctacaggaactctctcgatagcttcgggggacggaatcaggggggttccagctgggaagccccatattcccgctctaaacttaggcctggttttatggaggacaggggtagggaaaactatagttcatatagttcattcagcagccctcacatgaaaccagccccagtcggctctagaggacggggaaccccagcttatccggagtcaactttcggatctcgtaattacgatgcgtttggtggcccatcgacaggccgaggaaggggccgaggccatatgggtgattttgggtccattcaccgccctggtatcgtggtggactaccaaaacaaatccaccaacgtgacagtggcggcagcacgtgggattaagcgcaaaatgatgcagccattcaataaaccctccggcacctttatcaaaaagcctaaactggcaaaaccaatggaaaagataagtctgtccaaaagtcctacaaagacagatccaaaaaatgaggaagaagagaagcgacgtattgaggcacgccgagagaaacagagacggaggagggaaaaaaattctgagaagtacggcgacgggtatcgaatggccttcacatgttcattctgcaaatttaggaccttcgaagagaaggacatcgagctgcatctggagtcctcaagccaccaggagaccttagaccatatacagaaacagaccaagtttgacaaggtggtgatggaatttctgcacgagtgtatggtaaataaattcaagaagacgagtatacgtaagcagcagacgaataaccagacagaggttgtaaaaatcatagagaaggatgtgatggagggcgtgaccgtggacgatcacatgatgaaggtggagacagtgcactgcagcgcatgctccgtttatatccctgctcttcacagcagcgtacaacagcaccttaagagccctgatcacatcaagggcaagcaagcctataaagaacagatcaaaagagagtccgtcctgacagcaacatctatcttaaacaaccccattgtaaaggcacgttacgagaggtttgtgaaaggcgaaaaccctttcgaaattcaagatcattcccaagaccaacagatcgaaggcgacgaggaagacgaagagaaaatcgatgagcctattgaggaggaggaggatgaggatgaggaagaggaagctgaggaggtgggtgaggtggaagaggtagaggaggtggaggaggtacgagagggagggatagagggagagggcaacatacagggcgtgggcgaggggggagaagtcggtgtcgttggtgaggtcgagggtgtgggggaagtcgaggaagtggaggaattggaggaagaaacagcaaaagaagagcctgccgattttcccgtggaacagccagaggagaactag

SEQ ID NO: 25182 - DNA, 213 bp, Artificial Sequence
  Description of Artificial Sequence: Synthetic coding sequence
atggattttgaggacgactacacgcactctgcgtgcagaaatacctaccaggggttcaatggcatggatcgcgactacggaccaggctcttacggcggaatggaccgcgactacgggcatgggtcctatggagggcaacgctcgatggactcgtacctgaaccagagttacgggatggataatcactccggcggtgggggaggctccaggtag

SEQ ID NO: 25183 - DNA, 1482 bp, Artificial Sequence
  Description of Artificial Sequence: Synthetic coding sequence
atggactttgaagatgactacacccatagtgcctgcaggaacacttaccagggattcaacgggatggatcgagactacggaccaggtagttatggcggtatggaccgggactacggtcacggctcatatggtggacagcgatctatggacagttacctcaaccagtcctacggcatggacaaccatagcggcggaggagggggatcctcatttagcagcccacacatgaagccagcgccagtgggaagtcgaggtcggggtacccccgcataccctgaaagcacattcggatcccgaaactacgacgccttcggcggtccatctaccggcagagggcgtggaagggggcacatgggggattttggatccattcaccggcctgggattgtggtcgattatcaaaacaaatccactaacgtcacggtggccgcagccagggggatcaagcgcaagatgatgcagccatttaacaaaccaagcggtacttttattaagaaacccaagcttgcaaaaccaatggaaaagatttctctgtccaaaagtcctaccaaaaccgacccaaaaaacgaagaggaggaaaaacggaggatagaggccaggagagaaaaacagagacgcagacgagagaagaatagcgagaagtacggtgatggttacagaatggcattcacttgctccttctgtaaatttcgcactttcgaggagaaggacatagagcttcacctggagagctccagtcaccaagagactctcgatcatatccagaaacagacaaaatttgacaaagttgtcatggaatttctgcacgaatgtatggtgaacaaatttaagaagactagtattaggaagcagcagactaacaaccagaccgaagtggttaagattatcgaaaaagatgttatggaaggagtcactgtcgatgaccacatgatgaaggtcgagaccgtgcattgttccgcttgtagtgtatatatacctgccctgcattcttccgtacagcagcacctgaagtcccccgaccacattaaggggaaacaagcttacaaggagcaaattaagcgcgagagcgtgctcactgcgacttccatcctgaataatcctattgtgaaggccaggtatgaacggttcgtgaagggcgaaaatccttttgagattcaggatcacagtcaagatcaacagatagagggcgacgaagaggatgaagagaagatcgacgagccaattgaagaggaagaagacgaggacgaggaggaagaagccgaagaggtcggagaggtcgaagaggtagaggaagtggaggaagtccgggaggggggaatcgaaggagaaggcaatatccaaggtgttggtgaaggcggtgaagttggcgtggttggggaggtcgaaggagtgggggaggtagaggaggtggaagagctggaagaagagactgcaaaagaggaacccgctgacttcccggtggaacagcctgaagagaattag

SEQ ID NO: 25184 - DNA, 1749 bp, Artificial Sequence
  Description of Artificial Sequence: Synthetic coding sequence
atgatgttcaaccgtgattacactcactcagcctgtcggaacacctatcaggggttcaatggaatggaccgtgattatgggccaggatcttacgggggtatggatagggactatggtcacggctcctatggcggtcagcggagtatggattcctatctgaatcagtcgtacgggatggacaaccactcaggaggcggaggcggatcaaggtttggcccatatgaatcatacgatagccgatcctcccttggaggcagagatttgtacaggagcggatacgggttcaatgaacctgagcagtccagattcggcggatcttatggtggaaggtttgagagttcgtatcggaactcccttgatagttttgggggacggaaccagggtggtagcagctgggaggcaccatattcccgtagcaaactgcgccctggattcatggaggacagggggcgtgaaaactacagttcctacagtagcttctcctccccacacatgaaaccagccccagtcggcagtcgcggacgaggcacccctgcatacccagagagtacctttggatctcgcaactacgacgccttcggcggtccctccaccggaagggggaggggtagaggccacatgggcgacttcggatcgatccaccggcctggcatcgttgtggactaccaaaataagtcgacaaacgtcaccgttgctgctgccagaggaatcaagaggaaaatgatgcagcccttcaacaaaccttccggcaccttcataaaaaagcccaagctcgccaaaccgatggaaaagatcagtctgtctaagtcacccactaagaccgaccctaagaacgaagaagaagaaaaacgtaggattgaagctcggagggagaagcagaggcgtcgccgtgaaaagaactcggaaaaatatggtgacggatataggatggccttcacttgttccttttgcaagttcagaacatttgaagaaaaagatatagaattgcacctcgagtcctctagtcatcaggaaacactggatcatatccaaaaacaaactaaattcgacaaggtcgtcatggaatttctgcacgaatgtatggtgaataaattcaaaaagacgtcaattaggaagcagcagacaaacaaccagacggaagtagttaaaattatcgagaaggacgttatggaaggagtgacggtcgacgaccacatgatgaaagttgagacggttcattgcagtgcttgtagcgtttatataccggctctccactccagcgtacagcagcatctaaaaagtcctgatcacattaagggcaagcaggcctacaaggagcaaatcaaacgggagtctgtcctgaccgcaacgtccatcctgaataatcctattgtaaaagcgagatacgagaggtttgtgaagggcgagaacccgtttgaaatccaggaccacagccaagatcagcagattgagggtgacgaagaagacgaggaaaaaatcgacgagcctatcgaggaggaggaggacgaagacgaggaggaggaagcagaggaagttggggaggtggaagaggttgaggaagtggaggaggtcagggagggcggaattgaaggggaagggaacatacaaggggtgggggaagggggtgaggtaggtgttgttggagaagtagagggcgtcggagaagtggaggaagttgaggagctggaagaagagaccgctaaagaagagccagcagactttcccgtagagcagcctgaggaaaattag

SEQ ID NO: 25185 - DNA, 1131 bp, Artificial Sequence
  Description of Artificial Sequence: Synthetic coding sequence
atgggtgattttggatccattcacagacccggaatcgtggtggattaccagaacaagtcgacaaatgtgaccgtcgcagcagctaggggaattaaaagaaagatgatgcaaccctttaacaaacctagcgggaccttcatcaaaaagccaaagttagctaagcccatggagaaaattagcctgtcaaagtcaccaaccaagaccgacccaaaaaacgaggaagaggagaagcgcagaatcgaagcgcgtcgtgagaaacagcgcagacgtagagagaaaaattcagagaagtacggggacgggtaccggatggcttttacatgctcattctgcaaatttcgcacttttgaagagaaagacatcgaattgcatctcgagagctcctcgcaccaggaaacactggaccatattcagaagcagaccaaatttgacaaggttgtgatggaatttttgcatgaatgtatggtcaacaagtttaagaagacgtccattcgaaaacagcagacgaacaaccagaccgaagtcgtcaaaatcattgagaaagatgtcatggagggcgtgacagtggacgatcatatgatgaaggtggaaacagtgcattgctccgcctgttccgtctacataccggcactccacagctcggttcaacagcaccttaaatcccccgaccatattaaagggaagcaggcctacaaagagcagattaaacgagaaagcgtactcacagccacatccattttaaacaaccctattgtgaaagctcggtacgagcgcttcgttaagggagaaaacccatttgaaatccaggatcactcccaagaccagcagatcgagggagacgaggaggatgaggagaagatagacgagcccatcgaggaggaggaagacgaagacgaggaagaagaagccgaagaggtgggcgaggtagaagaggtcgaagaggtggaggaggtccgggagggagggatcgaaggagaaggcaatatccagggtgtgggagagggcggagaagtcggggtggtcggtgaagttgaaggggtgggtgaggtggaagaggtggaggagctcgaagaggagactgcaaaggaggaaccagcagactttccggtcgagcagcctgaggaaaattag

SEQ ID NO: 25186 - DNA, 1626 bp, Artificial Sequence
  Description of Artificial Sequence: Synthetic coding sequence
atgagattgaagatgaccactcggaattttccagagagagaagtaccttgcgacgtggaggttgaacgctttaccagagaagtgccttgcctgagtagcctgggcgacggatgggattgcgaaaaccaagagggtcatctccggcagtcagccctgacacttgagaagcctggcacacaggaggctatctgcgagtacccaggctttggagagcatcttatcgctagctcggacctgcctccttcccagcgcgtgttagccactaacggattccacgcccctgacagtaacgtaagcgggctggactgtgatccggcattaccatcataccccaagagctacgctgacaaacgaacaggcgatagtgacgcttgtgggaaaggcttcaatcatagtatggaagtcatccacggtagaaaccccgtacgcgagaagccctacaaatatcctgagagcgtgaagtccttcaaccattttacgtctctgggacaccaaaagatcatgaaaagaggaaaaaaatcttacgagggcaagaatttcgagaatatttttactctgtcctctagtctgaacgaaaaccaaagaaacttgccaggcgaaaaacagtaccgttgcaccgagtgcgggaaatgcttcaaacgtaatagctccttggtgttgcaccacaggacgcatacaggagagaaaccatacacttgtaatgagtgcggtaagagttttagcaagaactacaatttgattgtgcaccaaagaatacacaccggggaaaaaccctatgagtgctccaaatgcggcaaggcattttccgacggctcagcactgacccagcatcagaggatccacacgggagagaagccttatgagtgtctagaatgtgggaagacttttaatcggaattccagcctaatcctccaccagagaactcataccggagagaaaccatacagatgtaatgaatgtggtaagccgttcacagatatctcccatttgaccgtgcacctccgcatacataccggcgagaaaccatatgagtgtagcaagtgcggtaaggctttccgggacggcagctatctcactcaacatgagcggacacacaccggcgagaagccgtttgagtgcgccgagtgcggaaagtctttcaataggaactcccacctgatcgtacaccagaaaatacactccggcgagaaaccatacgagtgtaaggaatgcggcaagacgttcatcgagtctgcttatctgattagacatcaaagaatccatacaggggagaaaccctatggttgtaatcaatgtcagaagctgttcaggaatatagcgggtctgatccggcatcaacggacacacacaggcgaaaagccgtatgagtgcaaccaatgtgggaaggcatttcgcgattcatcctgtctgacgaagcatcagcgtatccacaccaaggagaccccataccagtgcccggaatgcgggaagtccttcaagcaaaatagccacctggcggtgcaccagcgcttgcattctcgcgagggaccttcacggtgccctcaatgcggaaagatgttccagaaatcctcatctctggtccggcatcagcgtgcgcatctgggagaacagcccatggaaacctag

SEQ ID NO: 25187 - DNA, 1626 bp, Artificial Sequence
  Description of Artificial Sequence: Synthetic coding sequence
atgcgactcaagatgacaaccagaaacttccctgaacgcgaggtcccctgtgatgtcgaggtagagcgattcaccagagaggtgccctgtctgtcttctctaggcgatgggtgggattgcgagaatcaagagggacatttaagacaaagcgcgctcacactcgagaagcctggtacacaagaagctatctgcgagtacccgggtttcggagagcacctgattgccagctccgaccttcccccaagtcaaagagtactcgctaccaacggcttccatgctcccgactctaatgtgtctggtctggactgcgaccccgctctcccaagctatccaaagagctacgcagacaagcgcaccggcgatagcgacgcgtgcggaaaaggcttcaatcacagtatggaggtcatacacggcagaaatccggttcgtgagaagccctacaaatatccggagtccgttaagtctttcaatcattttacgagcctgggtcaccaaaagattatgaagaggggcaagaagagctacgagggtaagaacttcgagaacatttttacactaagcagtagcctcaatgaaaaccagaggaacctgccaggagagaaacagtaccgctgtacggaatgtggcaagtgctttaagcgaaacagctctcttgtgcttcatcataggacccatacgggcgagaagccttacacttgcaacgagtgcggcaagtcgttcagcaagaactataatctgatcgtccaccagcgtatacataccggggaaaagccctacgagtgctcaaaatgcgggaaagcgttttcagacggctcagccctgacccaacaccaacgcattcacacaggtgagaagccttatgaatgtcttgaatgcggtaaaacgttcaatcgaaacagctccttgattcttcaccagaggacacataccggagagaagccatatagatgcaatgaatgcggtaagccattcacggatatttcccacctgactgtgcatctgcgcatccataccggcgagaagccttacgagtgttccaagtgtggcaaggcctttcgggatggatcctatctgacacaacacgaaaggacccacacaggtgagaaaccttttgagtgtgccgaatgtggaaagtcctttaataggaactcccaccttattgtacaccagaaaattcacagcggcgaaaaaccatacgagtgtaaagaatgcggaaaaacctttatagagtccgcctatttgattcgtcatcaacggattcacaccggagaaaagccctacggctgcaaccagtgccaaaaactctttcgaaacattgccggactcatcagacaccagagaacccatacgggcgaaaaaccctacgaatgtaaccagtgcggtaaagcatttcgagatagcagttgcctgacaaagcatcaaaggatccatactaaggaaaccccttatcaatgccctgagtgtgggaagtcgttcaaacagaactctcatctggccgttcaccagcgcttgcacagccgcgagggaccctcccgctgtccccagtgcgggaagatgtttcagaaaagttcctctctcgtaaggcaccaacgagcccatttgggagagcagccaatggagacatag

SEQ ID NO: 25188 - DNA, 1626 bp, Artificial Sequence
  Description of Artificial Sequence: Synthetic coding sequence
atgcgcctgaagatgaccactcgcaatttcccagaacgggaggtaccctgcgatgtggaagtggaacgattcaccagagaggttccctgtctcagttcactcggagacggatgggattgcgagaatcaggagggccatctcaggcaaagcgccctcaccctggaaaaacccggaacacaagaggccatctgcgaatatccaggattcggtgagcacctcatagccagctccgaccttcctcccagtcaacgggttctagccacaaatggcttccatgctcctgacagcaatgtgagtggactggattgcgaccccgctctgccctcttacccgaaatcatacgcggataagcggacaggcgatagcgacgcctgcggaaaagggtttaaccactccatggaagtcatacacgggagaaatcctgtgagggaaaagccttacaagtaccctgaatctgtgaagtcctttaaccattttacctctctggggcatcagaagattatgaaacgcggaaaaaaatcttatgagggcaagaactttgaaaatatcttcaccctgtctagctccttaaacgaaaatcagcgcaatctgcctggtgagaagcagtacaggtgcaccgagtgcggcaagtgcttcaaaaggaattcttctttagtccttcatcaccgtacacataccggcgagaagccttatacgtgcaacgagtgcggtaaaagtttttcaaagaattataatctaattgtccatcagcgcatccatactggggagaagccctatgaatgttccaagtgtggcaaggcgttttcagatgggagcgccctgactcagcaccagcggatacatacaggggagaaaccatacgagtgtttggaatgtgggaagacattcaaccgaaactcaagtttgatcttgcaccaaaggacacacacgggcgagaagccctaccggtgcaatgaatgtgggaaaccttttacggacatcagccacctcacagtccatctacgaattcacacaggtgagaaaccctacgaatgcagcaaatgcgggaaagccttccgcgatggcagctacctgacccagcacgaacgcacccatacaggggagaaaccctttgagtgtgccgaatgtgggaaatccttcaaccggaactctcatctgattgtccatcagaaaatccatagtggggagaagccctacgaatgcaaagaatgtggtaagacctttatagaatccgcatatctgattcgccatcaacggatacatacgggcgagaaaccgtacgggtgcaatcagtgccagaagctcttcaggaatatcgctggcctgatccgacaccaaaggactcacacaggcgagaagccctatgagtgcaaccagtgcgggaaggctttcagagatagcagttgcctcacaaaacaccagagaatccacactaaggaaacaccctatcaatgtcctgaatgcggcaagagttttaagcaaaactctcacttggctgtgcaccagcgattacactcacgggaaggaccttcacgttgccctcaatgcgggaagatgttccagaagtctagctctctggtgaggcaccagagagcacacctgggcgaacaacctatggagacttag

SEQ ID NO: 25189 - DNA, 2043 bp, Artificial Sequence
  Description of Artificial Sequence: Synthetic coding sequence
atgaagatgaagaaatttcagatcccggtttcctttcaggatctgacagtgaattttacacaggaggagtggcagcagctggaccccgctcagcgactgctgtatagagatgttatgcttgagaactactcaaacctggtttccgtcggctaccatgtgtccaaacccgatgtgatctttaaactggaacagggagaggaaccgtggatcgtggaggaattcagtaatcaaaactacccggacatcgatgacgctctcgaaaaaaacaaggaaattcaggataagcaccttacccaaacagtgttctttagtaacaagaccctgattacagagcgcgagaacgtatttggcaagactctcaatctggggatgaactcagtcccttcccgcaagatgccatacaaatgcaaccccggtggaaatagtctgaagactaattccgaggtaatcgtggcaaaaaaatctaaagaaaaccggaagattcccgacgggtacagcggcttcggaaaacacgaaaaaagccacctgggaatgaaaaagtaccggtataaccccatgcgcaaggcctcgaatcaaaacgagaatctcatcctgcaccaaaacatacagatcctcaaacagccctttgactacaacaaatgtggcaagaccttctttaagagagccatcctgatcacgcagaaaggaaggcagacagagcgcaaaccgaacgagtgcaatgagtgtcgcaaaactttctctaagcgttcaacactcatcgttcatcagaggattcacacaggcgagaagccgtacgtttgttccgactgtcggaagacgtttcgtgtgaaaacctccctgaccaggcatcgacgaatccacaccggtgaacgcccttatgagtgtagcgagtgcaggaagaccttcattgataagtcagcacttattgtccatcaaaaaatacatggcggagagaagtcctatgagtgcaacgaatgcggaaaaaccttcttccggaagtctgcccttgccgaacacttcaggtcacatactggtgagaaaccctacgagtgtaaagaatgcggtaacgctttttccaaaaagagctacctcgtcgtgcatcagaggacccaccggggagagaagcccaacgagtgtaaagaatgcggcaagaccttcttttgtcagtcagccttgaccgcacatcaacgcatccatactggggagaaaccgtatgaatgctccgaatgcgagaaaaccttcttctgtcagtcggccctcaatgtgcatcgtcgctcccacacaggtgaaaaaccttatgaatgttcccaatgtggaaaattcttgtgcacaaaatccgcccttattgctcaccagattacccatcggggaaaaaaaagttacgagtgtaacgagtgtggtaaatttttctgccacaagtctaccctgaccattcaccagaggactcacacaggcgagaagcatggggtgtttaataaatgcggcaggatttccatcgtcaagtcaaattgctcccagtgtaagagaatgaatactaaggagaatttgtatgaatgctcagagcatggccacgccgtcagcaagaacagtcatctgatcgtccatcagagaacaatttgggagcggccatatgaatgcaacgaatgtggtcgaacctattgccgtaagtcagccctcacccaccaccagaggacacataccggacagaggccgtacgaatgcaacgaatgtggcaagaccttctgccagaagtttagctttgtggagcaccagagaacccacactggggaaaagccctacgaatgcaacgagtgcggcaagagcttctgtcacaagtccgcttttagagtccataggcgcattcacactggagaaaagccctacgagtgtaaccaatgcgggaaaacatatcggcgactgtggacactcaccgagcatcagaaaatccatactggcgagaagccatatgaatgtaacaagtgtgagaagacatttaggcacaagagcaactttctgcttcaccagaaatcacacaaagagtag

SEQ ID NO: 25190 - DNA, 1929 bp, Artificial Sequence
  Description of Artificial Sequence: Synthetic coding sequence
atgctcgaaaactacagcaatctcgtgagcgtagggtaccatgttagtaagcctgatgtgatcttcaagctcgagcagggtgaggaaccttggatcgtggaggaattcagtaaccagaactatccagatatagacgatgctctggaaaaaaataaagagattcaggataaacaccttactcagacagtgttctttagcaacaaaacattgattacggaacgcgagaacgtgttcggcaaaaccctcaacctcggcatgaactcagtcccttccaggaagatgccgtacaagtgcaaccccggaggcaactcccttaagaccaattctgaggttattgtagccaaaaaatccaaagaaaacagaaaaatccccgatggttacagcggctttggcaagcacgagaaatcgcatctgggcatgaaaaagtatcgttataaccccatgcggaaagctagtaatcaaaatgaaaacctgatactccaccagaatattcaaatactcaaacagccattcgactacaacaaatgtgggaaaacgtttttcaaaagggctatcttgattacccaaaaaggacgtcaaactgagcggaaacccaacgagtgtaatgagtgccggaagaccttttccaaacgatctaccctgatcgtacatcagcgcattcacaccggggagaagccatacgtctgttcagattgccgaaagactttccgcgttaagacctccttaactcgtcaccggaggattcacactggagagaggccatatgaatgctctgaatgtcgcaagacattcatcgataagtcggcattgatcgtacaccagaagatccacgggggtgaaaagtcttatgaatgcaacgagtgtggcaaaacatttttccgcaagtcagcactagcagaacactttaggagccacactggagagaagccatacgagtgcaaggaatgtggaaatgccttttccaaaaaatcctacctggtggtgcaccaacgaactcacaggggagaaaagcccaacgaatgcaaagagtgcggaaagacctttttttgtcaatctgccctgaccgctcatcaacgtatccacaccggcgagaagccctatgagtgttccgaatgtgaaaagactttcttctgtcagagcgcgttgaatgtgcaccgaaggagccatacgggcgagaaaccctacgaatgcagccagtgtggaaagtttttgtgtactaagagcgctcttattgctcaccagattacgcaccgtggaaagaagagttacgagtgcaatgagtgtggcaagttcttctgtcacaagtctacccttaccatccaccagcgaactcataccggcgagaaacacggagtgtttaacaagtgtggccgaatttcaatagttaaatccaactgcagccagtgcaagcggatgaataccaaggagaacctctatgagtgctcagaacacgggcatgcagtctctaagaatagccacttaatagttcatcagaggactatctgggagagaccctacgaatgtaacgagtgtggcagaacctactgtcggaaatctgccctgacacaccatcagagaactcacacagggcagagaccgtatgaatgtaatgaatgtggaaaaaccttctgtcagaagttctcattcgtggaacaccagcgtacacacacaggtgagaagccctacgaatgcaacgaatgtggaaaatccttttgccataagtctgccttccgagttcatcgcagaatccacaccggggagaagccttatgaatgtaatcaatgcggtaaaacttatagacgcctctggacactcacagagcaccagaaaatccacacaggagaaaagccctacgagtgtaataaatgcgagaaaacctttcgccataagtccaattttcttctgcaccaaaagtctcataaggagtag

SEQ ID NO: 25191 - DNA, 2256 bp, Artificial Sequence
  Description of Artificial Sequence: Synthetic coding sequence
atgggtcctcagggcgctagacgccaggccttcctggcctttggggacgttacggtggacttcacccagaaggagtggagattgctgtctccggcacaaagggcattatatcgcgaggttactctagagaattattctcacttagtgagtctgggcatcctccactccaaacctgagcttatccggaggctcgagcagggggaggtcccctggggcgaggagagacgccgtagacccggtccatgcgccggaatttatgctgaacacgtcctgcgcccaaagaatttagggctagcccatcagaggcagcagcagctacagttttccgaccagtcctttcagtccgacaccgcggaaggtcaggagaaggagaaaagcaccaaacccatggccttctccagtcctcccctccgccacgccgtcagcagccgacggcgaaactcagtcgtcgaaatcgaatcctctcaaggccagcgcgaaaaccccactgaaatcgacaaggtccttaaaggaatcgagaacagcaggtggggcgctttcaagtgtgccgaacgcggtcaagacttcagccgaaagatgatggtaataatccacaagaaagcccactcgcgccaaaaactttttacctgcagagagtgtcaccaggggtttagagatgagtctgcactactgctgcaccagaacacccacaccggcgaaaaatcctatgtgtgctccgtctgcggaagagggttcagcctcaaagccaatctccttcgccaccagcgcacccactccggagagaaacctttcctgtgcaaagtctgcgggagggggtacacctcaaaaagctacctgacagtgcatgaaagaacccacacaggcgaaaagccttacgaatgtcaggagtgtggcagaaggttcaacgacaaatccagctataacaagcacctgaaagcacattcaggcgagaaaccattcgtgtgcaaggaatgtggaaggggctatacgaataagtcatacttcgtcgtccacaaacgcatccattcaggtgaaaagccatatcgttgtcaggagtgtggacggggtttctccaataaatcacatctgatcacacatcaaaggacccatagtggggagaaaccctttgcatgcaggcagtgcaagcagtccttttcagtcaaagggtctctgctccggcatcaacggacccactctggggagaagcctttcgtgtgcaaggactgtgaaaggagcttttcccagaagtctaccctggtgtaccatcagcgcacgcattcgggtgagaaaccttttgtgtgcagagaatgcggccaggggttcattcaaaagagtacactcgtgaaacaccagataacgcactcagaagaaaaaccctttgtgtgcaaggattgcgggagggggttcatccagaagtcaacctttaccttacatcagcggacacactccgaagagaaaccgtatgggtgccgcgaatgcggcagacgttttagggataagtccagctataacaaacatttaagggctcatctgggcgaaaaaaggttcttctgcagggactgcggacgcggttttaccctgaaacctaatctcactatccaccaacgcacacactcgggagaaaaacctttcatgtgcaaacagtgcgaaaagtccttcagcctcaaggcgaatcttcttcggcatcagtggacccactccggcgaaaggccattcaattgcaaagattgtgggcgtggctttattctgaagtcgacccttctgtttcaccagaagacccattctggcgagaagccatttatatgctcggaatgtggacaggggttcatctggaagagcaacctggtgaaacatcagctggcccactctggaaagcagccttttgtgtgcaaggagtgtggacggggttttaactggaaggggaacctcctgactcaccagaggactcattccggtgagaagcctttcgtatgcaacgtgtgcggccaggggttttcgtggaagaggtcactgacccgccaccactggcggatccacagcaaggagaagccctttgtctgccaggagtgtaagagaggctacactagtaagtcagatttgaccgtgcacgaacgcatccacaccggagagagaccttacgagtgccaggagtgtggccgaaagtttagcaataaatcctattatagtaaacatctgaaacgtcacctgagggaaaaaaggttctgcacaggctccgtgggtgaggcctcgagctag

SEQ ID NO: 25192 - DNA, 1920 bp, Artificial Sequence
  Description of Artificial Sequence: Synthetic coding sequence
atggggccacaaggagcacggagacaggctttcctcgcttttggggatgtgacagtggacttcactcagaaggaatggcgcttactcagccccgctcaaagggcattgtatcgcgaagtaactctggaaaattacagccacctcgtcagtttggggatcttgcacagcaagcccgaactgatcagacggctcgagcaaggggaagtcccctggggtgaggaaaggagacggcgtccaggtccttgcgcaggcatctatgccgaacatgttcttagaccgaaaaacctgggacttgcccatcagcgacagcagcagctgcagttctctgaccagtcattccagagtgatacagcggagggccaggagaaagagaaatctactaagcccatggcattttcctctcctccccttcgtcatgccgttagctcacgtaggcgtaactccgtggttgaaatcgagagtagccaggggcagagggagaaccctaccgagatcgataaagtgctcaagggtatcgaaaactcacgctggggcgcatttaagtgtgctgaacggggacaggacttctctagaaaaatgatggtaattatccacaaaaaagcacacagccgtcagaagttgttcacatgccgcgagtgccatcagggcttccgagatgagtcagccctgttactgcatcagaatacccacaccggcgaaaaatcctatgtatgctccgtgtgcggaagaggctttagcctcaaagcaaatctccttcgacatcagagaacacacagcggagaaaagcctttcctctgtaaagtttgcggtcggggatacacgagcaagtcttatttgaccgtgcatgagcggacccacacaggcgaaaagccatacgaatgccaggagtgtggacgacgattcaacgataagtcatcatacaacaagcacttgaaggctcactcaggagaaaagcctttcgtgtgtaaggagtgcggccgaggatatacaaacaagtcctactttgtggtgcataagcggattcactcaggagagaagccttaccggtgtcaggaatgtggcaggggattttcaaataagagccacctcataactcatcagaggacccactccggggagaaaccgttcgcttgcagacagtgcaaacagtccttctccgtgaaggggagtttacttcgtcaccagcgtacccactccggcgagaaacccttcgtgtgcaaggattgtgagcgcagcttcagccagaaatcgacgctcgtttatcatcagagaacgcacagtggcgaaaagcccttcgtctgtagggagtgtggccaaggatttatccagaaaagcacactggtgaaacatcagatcacccattccgaagagaagcccttcgtctgcaaggactgcgggcgtggattcatacagaagtcaacattcacacttcaccagcggacccattctgaagaaaaaccatatggctgtcgggaatgcggtcgccgtttccgcgacaagagctcttataacaagcatttaagggcccatctcggggaaaagcgctttttttgtagagattgcggccgtgggtttactttaaaacccaacctcaccatccaccagcgtacccatagtggggagaagccatttgtttgcaatgtctgtgggcagggattcagctggaaaaggagcctgacccgtcaccattggcgcattcactcaaaggagaaaccctttgtttgccaggagtgcaagcggggatatacgagtaaatccgatctgactgtccacgaacgcatccacacgggagaacgcccttacgagtgccaagagtgtgggaggaaattcagcaataagtcctattactctaaacacctcaagcgacacctgcgagagaagagattctgcacaggaagtgttggagaggctagtagctag

SEQ ID NO: 25193 - DNA, 2256 bp, Artificial Sequence
  Description of Artificial Sequence: Synthetic coding sequence
atgggtccccagggggcaagacgtcaggctttcctggcttttggagatgtcaccgtcgacttcactcagaaagaatggagactgttgagccctgcccagcgggctttatatcgggaagtgacactcgaaaattacagccacctcgtttctctaggcattttgcattctaagcctgaactgatccggagacttgagcagggagaagtgccctggggcgaagaaagaaggagaagacccggaccatgcgccggaatctatgccgaacacgtgctgaggccaaaaaatctaggccttgctcatcagcggcaacagcagctgcagttctccgatcagtctttccagtccgacacagctgaagggcaggagaaagagaagagcaccaagccaatggctttctctagccccccactgcgccatgcagtgtccagtaggcggagaaatagtgtggttgagatcgaatcaagtcagggccagagggagaaccctacagagatcgacaaggttttgaagggcatcgagaacagtagatggggagcttttaagtgcgctgaacgcggacaggacttcagccgaaagatgatggtcataatccacaaaaaggctcattcccgtcaaaagctgtttacctgcagggagtgtcatcagggctttagggacgagagtgctttgctcctccaccagaacacacacactggggaaaagagttatgtgtgtagcgtctgtgggcgagggtttagcctgaaagccaacttactccggcatcagaggacccattctggagagaaaccatttctgtgtaaagtgtgcggaaggggctacacgagtaaatcatatttaaccgttcacgaaaggacccacaccggggagaaaccctatgaatgccaggaatgtggtaggcgcttcaatgacaagtcatcgtacaacaaacacctgaaggcacatagtggcgaaaagcctttcgtctgcaaggagtgcgggagaggctacaccaataagtcatatttcgtggtccacaaacgcatccactcaggcgaaaagccatatagatgccaggagtgcgggcgtgggttcagcaataagtcccatctgataactcaccagcggacacacagtggagaaaagcccttcgcttgcagacaatgtaagcagagctttagcgttaaagggtctctgttgcgccaccaaagaacccactcaggcgaaaagccatttgtgtgcaaggattgcgagcggtcattttctcagaagtcaacgctggtctaccatcagcgcacacacagcggcgagaaaccatttgtgtgcagagagtgcggtcaaggattcatccagaagtcgacactggtgaagcaccagataactcactccgaagaaaagccttttgtgtgcaaggactgcgggaggggatttatccagaaaagtacattcaccttgcaccagcgtactcattctgaggagaagccatacggatgtagagaatgcggtcggcgtttccgagacaagagcagctataacaaacacctgcgggcacatctgggtgagaagcggtttttttgcagggactgcggtcgcggattcacactaaaacctaatctgacaatccatcaaagaactcactctggagaaaaaccattcatgtgcaaacagtgtgaaaagagtttcagtctgaaggccaatctcctccgtcatcagtggactcattctggagaacggccttttaactgcaaagattgcggtaggggattcatcctgaaatccaccctgctgttccaccaaaaaacacactcaggggagaaaccgtttatttgctccgagtgtggtcagggtttcatttggaaatcaaatctcgttaagcatcagcttgcgcacagcgggaaacagccttttgtttgtaaggagtgcggcagaggatttaattggaaaggcaaccttctgacacatcagaggactcattctggcgagaagccattcgtatgcaacgtatgtggccagggcttcagctggaagcggtccctcacccggcatcactggcggatccacagtaaggaaaaaccttttgtctgccaggaatgtaagagaggctatactagtaagagcgatcttaccgtgcacgagcgtatacacaccggcgaacgaccctacgaatgccaagagtgtggacgcaaattttccaataaatcttactacagcaaacacctcaaaaggcacttacgagaaaaaaggttctgcaccggatccgtgggtgaggcgtcctcctag

SEQ ID NO: 25194 - DNA, 2160 bp, Artificial Sequence
  Description of Artificial Sequence: Synthetic coding sequence
atggggccacaaggcgctcgtcggcaggccttccttgcatttggggacgtgaccgtggatttcacacagaaggagtggcggctattgtcaccagcccagcgggcactgtatagagaagtaaccctggaaaattactctcacctggtgtcactcggaatctatgcagagcacgtgttgcgcccaaaaaatctgggactcgcccaccagcgtcagcagcagctccagttcagcgaccagagctttcagtcggatactgccgaaggacaagagaaagagaagagcaccaagcccatggccttctcaagtccacccttaagacatgctgtgtcttcaaggcgtaggaacagcgtcgtggagatcgagtcttcccaggggcagagagaaaatcccacggaaattgacaaagtcctgaaaggaatcgaaaatagccgctggggggcattcaagtgcgcggagagagggcaggacttttcacggaagatgatggtaattatacacaaaaaagcacacagcagacaaaaattatttacttgccgggagtgccaccagggatttagggatgaatccgctctgctgctacaccagaacacacatactggggagaagagctatgtgtgctccgtctgcggtaggggattcagccttaaggctaacctgctgcgccatcagcgtacccattcaggcgagaagccttttctttgcaaggtgtgcggaagaggctatacaagcaaaagttatttaacagttcatgagagaacccataccggagaaaagccttatgaatgtcaggaatgtggacgccgattcaatgataagagctcttacaacaagcacctgaaggcacactccggggaaaagccctttgtgtgcaaggagtgcggccgaggctacaccaacaagtcctattttgtggtgcacaaacgaattcattccggtgagaaaccgtataggtgccaggaatgtggccgaggcttttcaaataagtcccatttgataacacaccaacgcacgcatagcggcgagaagccttttgcctgtcgccagtgtaagcagtctttttctgttaaaggctccttgctccgacaccagcgcacccactccggagagaaaccgtttgtgtgtaaagactgtgagagatcattcagccagaaatcgaccctggtctatcaccaacggacgcactccggggagaagccctttgtctgccgggagtgcggtcagggatttatccagaaatcaacactggttaagcaccaaataacccacagcgaggaaaaacctttcgtgtgcaaagattgcgggagaggattcatccagaagtctacattcactcttcatcagagaacccactccgaggagaagccttacggctgtagggagtgtgggcgaagatttcgggataagtcgtcttacaataaacacttgagggcccatctgggggaaaagaggttcttctgtcgcgattgcggacggggattcacgctgaaacccaatctgaccattcaccagagaactcactctggcgaaaaaccttttatgtgcaagcaatgtgagaaatcttttagcctgaaagcaaatctgctgagacatcagtggacccattcgggagaacggccatttaattgcaaggactgcggcaggggattcattctgaaatctacactcttgtttcaccagaagactcacagcggtgaaaagccatttatctgtagcgaatgtggacaaggttttatctggaaaagcaacctggtgaaacaccagctagcccactctggaaaacaaccatttgtgtgcaaggagtgcggacgcggatttaactggaaaggaaatctgctcacccatcaaaggacgcacagtggagagaagccatttgtctgcaacgtttgcgggcagggtttttcttggaagcgatctctaaccaggcaccactggagaatccatagtaaggagaagccgtttgtgtgccaggaatgcaagcgtgggtataccagcaagtctgatttgacagtacacgaaagaatccacactggcgagcggccttatgagtgtcaagaatgtggaaggaagtttagcaataagtcttattattccaagcaccttaaaagacatctgcgagagaaacggttttgcactggatcagtcggcgaagcctcgagctag

SEQ ID NO: 25195 - DNA, 2544 bp, Artificial Sequence
  Description of Artificial Sequence: Synthetic coding sequence
atggcacaggccatattcgaggcgttggaggggatggacaaccaaacagtccttgccgttcagtctttgcttgacggtcaaggcgcagtgcctgatcccacaggacagagcgttaatgctcccccagcaatacagcccctggacgatgaggacgtgttcctctgtggtaaatgcaagaagcagttcaatagccttcccgcattcatgacccacaagcgcgaacaatgtcaaggtaacgctcccgctctggcaactgttagcctcgccaccaactccatttatccaccatctgcggctccgactgctgtccagcaggcaccaacacccgcaaatcggcagatttctacctacatcactgtgccaccaagccctctgatccagacactggtgcagggtaatatcctggtcagtgatgatgtgctgatgagcgctatgagcgcatttacatcgctcgatcagccaatgcctcaggggcctcctcccgtgcagtcctccctcaatatgcattccgtcccatcatacctgacacagcctccacctccgcctcccccacccccacccttgcctcccccacctccccctcagccgccaccacccccaccgcagagcttgggaccccctggcaggcctaatccgggagggaacggggttgtggaggtttactcagctgctgccccactggcagggtctggcactgtggagattcaggctctggggatgcagccttacccccctttagaggtgcccaaccagtgcgtcgagccccctgtataccctaccccaacggtctatagtccaggcaaacaagggtttaagccaaaaggtccgaatcccgctgcgccaatgacatctgcaactggtggaactgttgctactttcgactcaccagcgacactgaagactaggcgggctaaggctgcaggcaaacccaaagcccaaaagctgaagtgtagttattgcgacaagagcttcactaagaatttcgacctccagcagcacatacgcagtcacactggagagaaaccatttcagtgcattgcctgtgggagagcctttgcacagaagagtaacgtgaaaaaacacatgcagacccacaaggtttggccacctggccactcaggcggtaccgtgtctagaaatagtgtgacagtccaggtgatggcgctcaatcccagcaggcaggaagatgaagaaagcacaggactgggccagcctctgcccggtgctcctcagcctcaggctctgtccacagccggagaagaagagggcgataagcccgagagcaagcaggtcgtgcttatcgattctagttacctttgccaattctgtccctctaaattcagtacgtacttccagttgaagtcccacatgacgcagcacaaaaacgagcaggtctacaagtgcgtggttaaatcatgcgctcagacatttccaaagttggacacctttcttgagcatattaaaagtcaccaagaggagctgagttataggtgccacctatgcggcaaggatttccctagcctatacgacctgggtgtgcatcagtacagccactccctactgccacagcatagcccaaaaaaggataatgccgtctataaatgcgtaaagtgcgtgaacaaatattctactcctgaagcacttgagcatcacttgcagactgccacacataactttccctgtcctcattgtcagaaggtcttcccctgcgaacgatacctgaggagacatctgcctacccacgggagtgggggacggttcaaatgtcaggtctgcaagaagtttttcagacgtgagcactatctgaaactgcacgcgcacatacatagcggcgagaagccctataagtgctctgtgtgtgagtctgcttttaatcggaaggacaaactgaaaaggcatatgctaattcacgaacccttcaaaaaatataaatgccccttctccacccatacaggatgctcaaaggagttcaaccgccctgataagttgaaagctcacatcctctctcatagcggcatgaaattgcataaatgtgcactgtgctccaaatctttctcccggagagcccacctggcggagcaccagagggctcataccggcaattacaagtttaggtgcgctggctgcgcgaaaggctttagcagacataaatatctgaaggatcatcgatgtagacttggccctcagaaagacaaagatctccagactagaaggcccccacagaggcgggctgcaccgaggtcatgcgggtccggagggaggaaggtgcttacaccgctgcctgaccccctcggcctcgaggagttgaaggacactggtgctggcctcgtccccgaggcagtcccaggaaagcctccctttgcagagccagacgcggtccttagcatagtggttggaggcgctgtgggcgctgagactgagctggtggtgcctggtcatgccgaagggctggggtcgaatctcgccctcgcggagcttcaagcgggtgctgaggggccatgtgctatgttagccgttcctgtgtacatccaagcgtccgagtag

SEQ ID NO: 25196 - DNA, 2565 bp, Artificial Sequence
  Description of Artificial Sequence: Synthetic coding sequence
atggcccaagcgatctttgaagccctcgagggcatggataatcagaccgtcttggccgtgcagagcctgctcgacggccagggcgcagttccggatcctaccgggcagagtgtcaatgcgccaccagctattcagccactggatgacgaagacgtgtttctctgcgggaaatgcaagaagcaatttaactccctgccggcattcatgacacataagagagagcaatgccagggcaacgcacctgccctggccacggtgtcactggcgaccaacagtatataccccccttctgcggctcccaccgcggtgcagcaggcccctacacccgcaaaccgccagatcagcacctacattactgtgccacccagcccgcttattcagactctggtgcaaggtaatatcctggtaagtgatgatgtgctgatgagcgctatgagcgcatttactagcctggatcagccgatgccacaaggacctccccctgtgcaatcctctcttaacatgcattctgtgccctcctatctgacacaaccccctccgccacccccacctccacctcctctgccacctcctcctccccctcagccccctccgcctccccctcagagtctgggaccacctggccgaccgaatcccggtggaaatggtgttgttgaggtctactccgccgcagcccctctggcgggttctggcacagtagagattcaagctctcggtatgcagccataccccccactcgaggtgccaaatcaatgcgtcgaaccgccagtgtatccaacccccacagtatactcccccggaaaacaggggttcaagcccaaagggcctaacccagcagcccctatgacgagtgccacaggtgggaccgtggccaccttcgactctccggctacactgaagacgcgccgagctaagggagccagaggtctgcccgaagccgctggcaaaccaaaagcccaaaagctgaaatgcagctattgtgacaagtcattcacaaagaactttgacctccagcaacacatccgatcacatactggcgaaaaacccttccagtgtatcgcttgcggtcgggcattcgcccagaagagtaacgtcaagaaacatatgcaaactcataaggtttggccacctggccatagcggaggaaccgtgtcacggaactccgttactgtacaggtgatggccctgaatcccagccgccaggaggacgaggaatccactggtttggggcagccgctgcctggcgctccacagccacaggcattatcaaccgcaggtgaagaagagggggataagccagagagtaaacaagtggtgttgatagactcctcttatctttgccagttttgtcccagcaaattctccacatactttcagctgaagagccacatgacccaacataaaaacgagcaggtttataagtgcgtcgtcaagagctgcgcgcagacatttcctaaactcgacacctttctcgaacatatcaaatcgcatcaggaggagctgagctatcggtgtcacctgtgtggaaaagattttcctagcctttatgatctaggggtacaccagtattcccatagcctcctcccacagcattcacctaagaaagacaacgccgtgtataagtgcgtaaagtgcgtgaacaagtacagcacccccgaggcgctcgagcatcatttgcaaacggccacacacaattttccctgcccacattgccagaaagttttcccatgtgagcggtacttacgccgacatctgccaacacacggctccggtgggaggttcaagtgtcaggtttgcaagaaattcttccgcagggagcattacctcaagctgcatgcacacattcacagtggggagaagccatacaagtgctccgtctgcgagagcgcctttaacaggaaagacaagctcaaacggcacatgctgatacacgagccctttaaaaaatacaagtgccctttttcaacccacaccgggtgctccaaggaattcaatcgacctgacaagttgaaggcccacattcttagtcactccggaatgaagttacataagtgcgccttatgcagcaagtcattctctagaagggcccacctggccgagcatcaacgagcacatactggaaactacaagttccggtgcgcgggttgcgctaaaggtttcagtcgccataaatatctgaaggatcataggtgtcgactgggccctcagaaagacaaggatctgcaaaccagacgaccaccgcagcgtcgagctgcccctagatcatgtggctccggaggcagaaaagttctgaccccgctgcctgatccactaggcttggaagagttaaaagatacaggcgcaggattggtgcctgaggctgtgcccggaaagccccctttcgccgagcctgacgccgtcctgtcaatcgtggtaggaggagctgtgggagccgagacagaattggtagtccctgggcacgctgaagggctcggaagcaatcttgctcttgcagaactccaggccggtgccgaaggaccttgcgctatgctcgccgtgcctgtctatattcaggctagtgagtag

SEQ ID NO: 25197 - DNA, 1800 bp, Artificial Sequence
  Description of Artificial Sequence: Synthetic coding sequence
atgatgttaccctacccctcagctcttggcgatcagtattgggaagagatcctcctccccaaaaacggtgagaatgtggaaaccatgaagaagcttacacaaaaccacaaggccaaaggactgccgtccaatgataccgattgtcctcaaaagaaggaggggaaagcccaaattgtggtgcccgtgacgtttcgcgatgtcaccgttatattcaccgaggctgagtggaagcgcctgtccccagagcagaggaatctgtataaagaagtaatgttagaaaactaccgaaatctgcttagcctcgcggagccgaagccagaaatctatacctgttctagctgcctcctggccttctcatgccaacagtttctgtcacaacacgttctgcagatcttcttgggcctgtgcgcagagaaccattttcaccctggcaactcctcccccggacactggaaacagcagggccagcagtactcccatgtgtcgtgctggttcgaaaacgcagagggccaggagcggggaggtggaagcaagccatggagcgcccgaaccgaggagcgggagacaagtagggcttttccgtcacctctacagcgacaatcggcaagccctagaaaaggcaatatggtcgtggagacagagcctagcagtgcgcaacgtcccaaccccgtccagttggacaaaggactgaaggagctggaaacgttgcgttttggcgctatcaactgtagggaatacgagccagaccataacctggagagtaacttcattacgaatcccagaaccctcttaggaaagaagccttacatctgttctgattgtggtagaagttttaaggataggtccacccttatacgccatcacaggatccatagcatggagaaaccttacgtgtgcagcgagtgtggtcgcggattcagtcagaaaagcaatctcagccgacatcagcgcactcattccgaagagaaaccctatctctgtagggaatgtggtcagtcatttagatcaaagtccatcctgaatcggcaccagtggactcacagcgaagaaaagccttatgtttgtagcgaatgtggaagaggtttctccgaaaagtctagcttcatcagacaccagagaacacactctggtgaaaaaccctatgtatgcttggagtgcggccgtagtttttgcgacaagtctaccttacggaaacatcagcggatacacagcggggagaagccctatgtttgtcgagagtgcggccgaggcttcagccaaaattcggacctgattaagcaccagcggacccacctcgacgaaaagccctacgtgtgtcgcgagtgcggacgcggattttgcgataaaagcaccctcatcatccatgagcggactcactcaggtgagaagccttacgtttgcggtgagtgcggacggggtttctcacgaaaaagtctgctgctggtgcaccaacgtacacatagtggagagaagcactacgtttgtagagaatgccggagggggtttagccaaaaatccaatctgataaggcatcagcgaacgcattctaatgagaaaccttacatttgccgtgaatgtggcagggggttttgtgacaagtccactctgatagtgcacgagcgaactcactccggagaaaagccctatgtgtgtagcgaatgcggacgcggattcagtaggaagtcgttgctgctcgtccatcagcgtacccacagcggtgagaagcattacgtctgccgggaatgcgggagaggcttttcccataaaagtaacctgattaggcatcaacggactcactag

SEQ ID NO: 25198 - DNA, 357 bp, Artificial Sequence
  Description of Artificial Sequence: Synthetic coding sequence
atgatgctcccatatcctagtgctcttggagaccagtactgggaagagattcttctgcctaagaatggcgaaaacgtagaaactatgaagaaactcacacagaaccataaagcaaaggggctacccagcaacgataccgactgccctcagaaaaaagagggcaaggcgcagattgtggttcccgttacgttccgggacgtcacagtgatctttactgaagctgagtggaagagattatcaccagagcagaggaacctgtacaaagaggtgatgctagagaattacaggaatctgctttctctggggcaggagattgagactattctagcgaatatcgtgaagagccacctctactag

SEQ ID NO: 25199 - DNA, 306 bp, Artificial Sequence
  Description of Artificial Sequence: Synthetic coding sequence
atgatgcttccctacccatctgccctcggcgaccaatattgggaggagattctactgcccaaaaacggtgagaatgtggagaccatgaagaagctcacccaaaatcataaggctaagggccttcccagcaacgataccgattgtccacagaagaaggagggcaaagctcagattgtggttcccgtcacgttcagagacgtgacagtgatcttcaccgaagctgaatggaagcggctgagccccgaacaacgaaacctttacaaggaggtaatgctggaaaactaccgcaacctcctgtccttatag

SEQ ID NO: 25200 - DNA, 435 bp, Artificial Sequence
  Description of Artificial Sequence: Synthetic coding sequence
atgatgcttccttatccaagcgcgcttggcgaccaatattgggaggaaatcctgctcccaaagaacggagagaacgttgagactatgaagaaactgactcagaaccataaagcaaagggtctgccctcaaacgatacagattgtcctcaaaaaaaagagggaaaggcccaaatcgtagttccggttactttccgggatgtgacggtcatcttcacagaggccgagtggaaacgcttaagtcctgagcagcggaatctgtacaaggaagtgatgctcgagaactaccgtaatctgctgtccttggctgagcctaaacccgaaatctatacctgttctagctgcctgcttgccttctcgtgccaacagttcctatctcagcatgtgctgcaaatattcctgggcctatgcgcagaaaaccacttccatccaggctag

SEQ ID NO: 25201 - DNA, 342 bp, Artificial Sequence
  Description of Artificial Sequence: Synthetic coding sequence
atggaaaacttgactaagcacagcatagaatgctcttccttccgcggtgattgggagtgcaagaatcaattcgagcggaagcaggggtcccaggagggccacttctcagagatgatctttactcccgaggacatgcctacattctctatccaacatcagaggatccacaccgatgaaaaactgttggagtgcaaggagtgtggcaaagatttctcctttgtgtccgtcctggttcgtcatcagcgcatacataccggggaaaaaccttatgagtgtaaggaatgcgggaaagctttcggttctggtgccaatcttgcttatcaccagcgcatccatacttag

SEQ ID NO: 25202 - DNA, 759 bp, Artificial Sequence
  Description of Artificial Sequence: Synthetic coding sequence
atggcctttagctccggatccgcactcaccaggcatcagcgtattcacacaggtgaaaagccgtacatttgtaacgagtgtggaaaagccttctctttcgggagcgccctgacaaggcaccagaggatccatactggggaaaaaccttacgtgtgtaaagagtgtggcaaggcatttaatagtggcagcgacttaacacaacaccagcggattcataccggcgagaagccttatgagtgcaaagagtgcgaaaaagctttcaggagtggttcaaaactgatccagcatcagaggatgcacaccggtgaaaagccctatgagtgtaaggaatgcgggaagacatttagcagcggcagcgacttgactcagcaccacaggatccatactggagagaaaccgtacgagtgtaaggagtgtggtaaggccttcggatctggtagcaaacttatacagcaccaactgattcacacaggcgagcggccttatgagtgcaaagagtgtgggaaaagcttttcctcaggttccgcacttaacaggcatcagagaatccataccggcgagaaaccctatgaatgcaaagaatgcggtaaggccttttactccgggagctcgctgactcagcaccaacggatacacaccggagagaagctttacgaatgtaagaactgcggaaaggcgtacgggagggacagtgaatttcagcagcataaaaagtctcacaatggcaagaaactctgcgaactggagactatcaactag

SEQ ID NO: 25203 - DNA, 1467 bp, Artificial Sequence
  Description of Artificial Sequence: Synthetic coding sequence
atggagaacctcactaaacattctatagaatgctctagctttaggggcgactgggagtgcaaaaatcagtttgaaagaaaacagggctcgcaagaaggccacttcagcgaaatgattttcacacctgaggacatgccaaccttttccatacagcaccagagaatccacacagacgagaaactccttgagtgcaaggagtgcggcaaggacttttcgttcgtaagtgtgttggtgcgtcaccagcgcattcacacaggcgagaagccatatgagtgcaaagaatgtgggaaggcgtttggcagtggcgctaacttggcttatcaccagagaatccacactggagaaaagcccttcgagtgtaaggagtgtgggaaagcgttcgggtcgggatctaatttaacgcaccaccagcgaattcacacaggcgaaaagccttatgagtgcaaggaatgtggaaaagcgtttagctttggctccggactcatccggcaccaaattatacatagcggggaaaagccctacgagtgcaaagagtgtgggaagagttttagcttcgagagcgccctgatccgccaccaccggattcacacgggggaaaaaccatacgagtgcattgactgtggtaaagctttcggcagcggtagcaacctgacacagcaccgacgaattcacaccggggaaaagccatacgagtgcaaggcttgtggcatggccttcagttccggctcggccttgacgcgacaccagaggatccacacgggggaaaagccatatatctgtaatgagtgcgggaaggcttttagttttggaagtgcgctgactcggcaccagaggattcatactggcgagaaaccctatgtatgcaaagagtgtggcaaggccttcaacagtggcagcgacctgacccagcaccagcgtattcacactggcgagaagccctacgaatgcaaggagtgtgagaaagcctttcggagtggttctaaactgattcagcatcagcgcatgcataccggcgagaaaccatatgagtgtaaagaatgcggaaaaaccttcagttctggtagtgatttgacccagcaccaccgaattcatacaggcgagaagccatatgagtgcaaggaatgtggtaaagcctttggctctggctccaagctgattcagcaccagctgatccacactggagagagaccgtatgaatgtaaagagtgcgggaaatctttctcgagcggcagtgctctgaaccggcatcagcggatccacaccggagagaagccgtacgagtgcaaggaatgcggcaaggccttctactcgggctcatccttgacccagcaccagcggattcacaccggagagaagctgtacgagtgcaaaaattgcggaaaagcctatggacgggactctgaattccagcagcacaaaaagagccacaatggtaagaagctgtgtgagctagagaccatcaactag

SEQ ID NO: 25204 - DNA, 1467 bp, Artificial Sequence
  Description of Artificial Sequence: Synthetic coding sequence
atggaaaatcttaccaagcacagcatagagtgttcttcattccggggagattgggaatgtaaaaaccagttcgagcggaagcagggctcccaggagggccacttcagtgagatgattttcaccccagaggatatgccaactttctccatacagcatcagagaatacacaccgatgagaagttgcttgagtgcaaagagtgcggcaaagatttctcctttgtttcggtcctcgtgcggcatcagcggatccacacaggggagaagccttatgagtgtaaggagtgtgggaaggcctttggaagcggcgctaatttggcttaccaccaacgcatccataccggcgaaaaaccatttgagtgcaaggagtgcggcaaggccttcggaagcggatccaatctgactcaccaccagagaattcacacaggtgagaagccctatgagtgtaaagaatgtggcaaagctttcagctttggctccgggcttatccgccatcagatcatccactccggggagaagccctacgagtgtaaagagtgtggaaaatcattttcctttgagtccgcgctgattcgtcatcaccggatccacaccggcgagaagccgtacgagtgcatagattgcggtaaggcattcggttccggaagcaacctgacccagcatcgtcggatccacaccggggagaaaccttatgaatgtaaggcctgcggcatggccttcagcagcggaagcgctctgactcgccatcagagaatccacacaggggaaaagccttacatctgcaacgaatgtggaaaggctttcagtttcggctccgccttgacccgacaccagaggatccataccggcgagaagccatatgtctgcaaagaatgcggcaaggcattcaacagcgggagcgacctcacccaacatcaaagaattcataccggagaaaagccttacgaatgcaaggaatgcgaaaaggcctttagaagcgggagtaaattgatccaacaccagcgaatgcacacaggcgagaagccctacgagtgcaaggagtgcggcaagacattctctagtggcagtgacctgacacagcaccaccggatccacacaggcgaaaagccctatgagtgcaaagaatgtggaaaggcctttggttccggctcgaaactcattcaacaccagctgatccacaccggggagaggccatacgaatgcaaggagtgcggtaaatcattttcgagtggtagtgccctcaatagacaccagaggattcacaccggagaaaaaccatatgagtgcaaagaatgtggcaaggccttctacagtggcagctcactcactcagcaccagaggattcatacgggagaaaagctatatgaatgcaagaactgtggcaaggcctatggcagagattccgaatttcagcaacacaagaaatcacacaatggcaaaaagctgtgcgaactagagactattaactag

SEQ ID NO: 25205 - DNA, 228 bp, Artificial Sequence
  Description of Artificial Sequence: Synthetic coding sequence
atggagaacctcaccaagcactctatagagtgctcatcgttccgaggcgactgggagtgcaaaaatcaattcgagcgcaaacagggatcccaagaaggccattttagtgaaatgatctttacacccgaggacatgcccacgttcagtatccagcatcagagaattcatactgatgagaagctgctcgagtgcaaggaatgcggaaaggattttagcttcgtgtcatag

SEQ ID NO: 25206 - DNA, 1467 bp, Artificial Sequence
  Description of Artificial Sequence: Synthetic coding sequence
atggagaacctgacaaaacactctatagagtgcagcagctttcggggtgactgggagtgtaaaaatcagttcgagcggaagcaaggttctcaggaggggcactttagcgaaatgatctttacaccggaggacatgccaacatttagcatccagcatcagagaattcataccgacgagaaacttttagagtgcaaagaatgtgggaaggacttctcatttgtgtcagtcctggttcgccaccagcggatccacaccggcgagaagccctacgaatgcaaggagtgcggcaaagcatttggatcaggggctaacttggcttaccaccagcgcatccacaccggagaaaagcccttcgagtgtaaagagtgcggcaaggctttcggttcgggtagtaacctgacacatcaccagcgcatccataccggagaaaagccgtatgagtgcaaagaatgcggaaaagccttctcctttggaagcggcctgatcaggcaccagatcattcactctggggagaaaccttatgagtgtaaggaatgtggtaaaagcttctcatttgaaagcgcccttatccggcaccatagaatccacacgggcgagaagccctacgaatgtattgactgtgggaaagctttcggctccggtagcaatctgacccagcaccggaggattcatacaggtgaaaaaccctacgaatgcaaggcttgtggcatggctttttccagtgggagtgctcttactcgtcaccagagaatacataccggagaaaagccatacatttgcaatgaatgcggtaaggccttcagcttcggaagtgctttgacacgacaccagaggatccacactggggagaaaccttacgtgtgcaaagaatgtggcaaagcctttaatagtggcagtgatctcacacaacaccaaaggattcacaccggcgagaagccctacgagtgcaaggaatgcgagaaagccttcaggagtggatcaaagcttatccaacatcaaaggatgcatacaggagaaaagccttatgagtgtaaagagtgtggaaaaaccttttctagcgggagcgacctgacacagcaccatcgcattcacacaggagagaagccttacgagtgtaaggaatgtggaaaggctttcggcagcgggagtaaactgatccagcatcaactgattcacactggggagaggccatacgagtgtaaggagtgcggcaaaagcttcagctccggctctgccttgaacaggcatcagaggattcacaccggcgaaaaaccttacgagtgtaaagaatgtggaaaagccttctattcagggtccagcttaacccagcaccagcgaatccatacaggggagaagctgtacgagtgcaaaaactgcggcaaagcttatggaagagacagtgagttccagcagcataagaaatctcacaacggcaagaaactgtgtgagttagagactatcaattag

SEQ ID NO: 25207 - DNA, 960 bp, Artificial Sequence
  Description of Artificial Sequence: Synthetic coding sequence
atggagtatcctgcaccagccaccgtgcaggcagccgacgggggtgccgcaggcccttatagtagcagcgagctgctcgagggtcaggagccagatggggtgaggtttgatagagagcgtgcccgtcgcttatgggaagcagtgtccggtgctcagccagtgggtagagaggaagcacagtttttcccccattcacggacagtcatccccatcctggtgctttcagaaacttactccttgtgtcatcctgtggagcacatgatccagaagaatcaatgcctatttacaaacactcagtgcaaggtgtgttgtgccctgcttatctccgagtcacagaaactggcacattaccagagtaagaaacacgcaaataaggtgaagaggtatctggctattcacggaatggagacactgaagggggaaacaaaaaagctggattccgatcagaagtcatctcggagcaaggataaaaaccaatgctgtcctatctgcaacatgacatttagttcccctgtggtggctcaatcccattatctgggcaaaacccatgccaaaaatctcaaactgaaacaacagtctaccaaagtggaggcccttcaccagaacagagagatgattgacccagataagttttgttccttatgtcacgcaacgtttaatgatcctgtgatggcacagcagcattacgttggtaagaagcatcgaaaacaggaaacaaagctaaagctcatggccagatacgggaggctggccgaccctgccgtgacagactttccagctggaaagggctatccgtgcaaaacctgtaagatcgtgctgaactctatcgagcagtaccaggcgcacgtgtctggctttaagcataaaaaccagtcccctaagactgtggcaagcagtctggggcagatcccgatgcagcggcagccaatccagaaagatagtactactctcgaggattag

SEQ ID NO: 25208 - DNA, 885 bp, Artificial Sequence
  Description of Artificial Sequence: Synthetic coding sequence
atggagtacccagctccggctacagtacaggctgccgatggtggagccgctggaccatactcatcatcagaactacttgaagggcaggaacccgacggtgtgagatttgaccgggagcgtgcacgcaggctctgggaggctgtgtcaggtgcacagcctgtgggacgagaagaagtggaacatatgatccagaagaaccagtgtctgttcactaatacccagtgtaaagtgtgctgcgctctgctcatttctgagagtcaaaagctggcgcactatcagtcaaagaagcatgcaaacaaagtcaagcgatatctggcaattcacggaatggaaacgctgaaaggagaaaccaaaaagctcgatagcgatcagaagagctcacgctctaaggataagaaccagtgctgtccgatttgcaacatgactttcagtagcccagtcgtggctcagtcacattatctcggcaaaacccatgccaaaaacctcaagctgaagcagcagagcacaaaagtagaagccctccatcagaacagagagatgatcgacccggacaagttttgttcactatgtcatgcaacttttaatgatcctgtgatggcccagcagcactacgtaggaaagaagcaccggaagcaggagacaaaactgaagctgatggcaaggtacggacgcctagctgatccggcagtgaccgatttccctgctggtaaggggtatccatgtaaaacatgcaagattgtgctgaactccatcgagcagtaccaggctcacgtctccggatttaagcataagaatcagagtcctaaaactgttgcttcctcactcgggcagatccccatgcagcggcagcctattcagaaggattcaacaaccctggaggactag

SEQ ID NO: 25209 - DNA, 960 bp, Artificial Sequence
  Description of Artificial Sequence: Synthetic coding sequence
atggaataccctgccccagcaacagtccaagccgcagatggtggcgcagccggtccatattcatccagtgaactgctagaggggcaggaacctgacggcgtgcggttcgatagagagagggcgaggcgtctctgggaagcagtcagcggggcacagcccgtaggcagagaggaggctcagtttttcccccactcacgaaccgtaattcctatactggtcctctccgaaacatactcattgtgtcatcccgtggagcacatgatacagaagaaccagtgtttgttcactaacactcagtgcaaggtgtgctgtgcacttcttattagcgagtcccagaagcttgcccattatcaaagtaaaaagcacgcaaacaaggtcaaacgatacctggctattcacggtatggagaccctcaagggggaaacaaaaaagttggactccgaccagaaaagctctcggtccaaggacaaaaatcagtgctgccccatttgtaacatgactttctcttccccagtggtcgcgcagagccactatctagggaaaactcatgccaagaacctgaaactgaagcagcagagcaccaaggtggaggctctccatcagaacagggaaatgatagacccagataagttttgttcattatgtcatgctacgtttaacgatcctgtgatggcacagcagcattatgtgggcaagaaacacagaaagcaggaaaccaagctcaagctgatggcacgctacggcaggctcgccgaccccgctgtgacagatttccctgcaggcaaagggtacccttgcaagacctgcaaaattgtgctgaacagcatcgagcagtaccaggcacatgttagcggattcaagcacaaaaaccaaagccccaaaacggtggcctccagcctcggtcaaatccctatgcagcgccagcccattcaaaaggactcaacaacacttgaggattag

SEQ ID NO: 25210 - DNA, 789 bp, Artificial Sequence
  Description of Artificial Sequence: Synthetic coding sequence
atggagtatccagcaccagctacagtgcaggccgcagatggaggagcagcgggtccctacagtagtagcgagctgctggaaggccaggagcccgacggggtgagattcgaccgggaaagggctagacgcctgtgggaagccgtgagcggagctcagccagtgggcagggaggaggttgaacatatgatccagaagaaccagtgtttgttcacaaacacccaatgcaaagtttgctgcgctttgctgattagcgagagccagaaactcgctcattatcagtcaagtagatcaaaggataagaaccagtgttgtccgatctgtaacatgacattcagcagccctgtagttgcacaatctcactaccttggcaagacccatgcaaagaatctgaagctcaaacaacaaagcactaaggtggaagcactacatcagaaccgcgagatgatcgaccctgacaagttctgcagcttgtgccacgcgaccttcaacgaccctgtcatggcccaacaacactacgtgggcaagaaacacaggaagcaggaaactaagcttaaattaatggcaaggtacggacggctggccgatccagccgtaaccgacttccctgcgggtaagggatacccctgcaagacatgtaaaatcgtgctgaattctattgaacagtaccaagctcatgtgtctggatttaagcacaagaatcagtcaccgaagactgtggccagcagccttggccagatcccaatgcagcggcagcccatccagaaagactccactaccttggaggactag

SEQ ID NO: 25211 - DNA, 591 bp, Artificial Sequence
  Description of Artificial Sequence: Synthetic coding sequence
atggaatacccagctccagcaactgttcaggctgcagatgggggtgcagccggaccttattcaagttccgagctactcgagggccaggaacccgacggagttaggtttgacagagagagggcccgaagactgtgggaagccgtttccggggctcagccagtcgggagggaagaggctctcagcaagcgcctgaccaatccgtttctcgttgcttctacccttgccctgcatcaaaaccgagaaatgattgaccccgacaaattctgtagtctgtgccatgccacatttaacgatccggtgatggctcaacagcattacgtcggcaagaaacaccgtaaacaggagacaaagctgaaattaatggcacgctatggcagactggcggacccagccgtaactgattttcccgctggaaaaggatacccgtgcaagacatgcaagattgtgcttaacagcatcgaacaataccaggctcatgtgtcgggatttaaacataagaatcagagtcccaagactgtggcatcctctttggggcaaattccgatgcaacggcagccgatccaaaaggattcaactacactcgaggattag

SEQ ID NO: 25212 - DNA, 933 bp, Artificial Sequence
  Description of Artificial Sequence: Synthetic coding sequence
atggaatatcctgcccctgccaccgttcaggccgcagacggcggagccgcaggaccctatagttcatctgaactattagaggggcaggaacccgacggcgtgcggttcgacagagagcgggctcggcgattgtgggaagcagtgagtggtgctcagccagtgggccgtgaggaggtggaacacatgattcaaaagaaccaatgcctcttcactaatactcaatgcaaggtgtgctgtgcgctcctcatcagcgaatcacagaagctcgcgcattaccagtcgaagaagcacgcaaacaaagtgaagaggtatctcgcgatccacgggatggagaccttgaagggggagaccaagaagctcgattcagatcagaagtcaagcagatccaaagacaagaaccagtgctgccctatttgtaacatgacattcagctcaccagttgtggcccagtctcattacctcgggaagacacacgctaaaaatttgaagcttaaacagcagtccaccaaggtcgaggccctgtccaaacgcctgacaaacccgttcctcgtggcatccacactggccctgcatcaaaacagggaaatgatcgacccagataaattctgcagtctgtgccatgcgacattcaacgaccctgtgatggcccaacagcactatgtgggaaaaaagcacagaaagcaggagaccaagctgaaactcatggcacgctacggaaggctagccgaccccgcagttaccgactttcccgcaggcaagggctacccgtgtaagacatgtaaaattgttctaaattcaatcgagcagtatcaggcacacgtgagcggattcaagcacaagaatcagtcccccaaaacagtggctagcagcctgggacagatacccatgcagcgccagcccatccaaaaagactccacgacactcgaagactag

SEQ ID NO: 25213 - DNA, 357 bp, Artificial Sequence
  Description of Artificial Sequence: Synthetic coding sequence
atggaatacccggcacctgcaactgtccaggctgccgacgggggagccgctgggccttatagctcctctgagctgcttgaggggcaggagccagatggcgtgcgtttcgatcgggaacgggcaagacggctctgggaagcggtgtcaggtgcacagcccgtgggccgagaggaagcaggcaaagggtacccgtgtaaaacgtgcaagatcgttcttaatagcatcgagcagtaccaggcacatgtttctggcttcaagcataagaaccagtctccaaaaacagttgcgtcatccctcggccagatcccaatgcagcgccaaccaatacagaaggatagtaccactctcgaagattag

SEQ ID NO: 25214 - DNA, 2520 bp, Artificial Sequence
  Description of Artificial Sequence: Synthetic coding sequence
atggcgttgacacagggacaggtgacatttagagatgtcgctatcgaattttcgcaagaagagtggacttgcttggacccagctcagaggaccttatatcgtgatgtgatgctggagaactacaggaatctggcttccctgggcatttcctgctttgacctgtccatcatatctatgctggaacaaggaaaggaaccttttaccctagaaagtcaggtccagattgccggtaaccccgacgggtgggagtggatcaaagcggtgattaccgctctctctagtgagtttgtcatgaaggacttgctgcacaagggcaagtctaacactggcgaagtgttccagacagtgatgttggaaaggcaagagtctcaggacattgaggggtgctcattcagggaggtgcagaaaaacactcatggcttagaataccagtgccgggatgctgagggcaactataaaggagtgcttctgactcaggagggcaacttgactcacggcagagacgagcacgataagagggacgctagaaataagttaataaaaaatcagctgggactgagcctgcagtcccacctgcctgaactgcagctattccagtacgagggaaagatttacgaatgcaaccaggtggaaaagagctttaacaacaactctagtgtctctccaccccagcaaatgccttacaatgtcaaaacccatatcagtaagaagtacctcaaggacttcatttcttctttgctccttacccaagggcagaaagctaataactggggaagtccgtacaagtctaatggctgcgggatggtgttcccgcaaaactcccacttggccagtcaccagcgaagtcatacaaaggaaaagccttataagtgttacgaatgcggtaaggctttcagaactagatccaacctgaccacgcaccaggtgatccacacaggcgaaaagcgctacaaatgcaacgaatgcggaaaagtgttttccagaaactcccagctgagccagcaccagaagattcataccggggaaaaaccctataagtgtaatgagtgcggtaaggtgttcactcaaaatagtcatttagtgagacaccgcggaattcatactggcgagaaaccttacaaatgtaatgaatgtggcaaggcattccgcgctaggtctagcctcgctatacatcaagcaacccactcgggggaaaagccgtataaatgcaatgagtgcgggaaagttttcacacagaactcccacctgactaaccactggcgcattcatactggcgaaaaaccatataaatgtaacgaatgcgggaaggcattcggagtaaggagcagcctggccatccacctggtgattcacacaggcgagaaaccttacaagtgccacgaatgcggcaaagttttcaggagaaactctcatcttgccagacaccagttgatacacactggtgagaagccatataagtgcaatgagtgcggcaaggccttccgcgctcactctaacttgaccacacaccaagtgatccatacgggggagaaaccctacaagtgtaatgagtgtggcaaagtgttcacccaaaattcccatctggcaaaccatcagcggatccacaccggggtaaagccttatatgtgcaacgagtgcggaaaggctttttccgtgtactcttccctgactacccaccaggtcattcatactggggagaagccctataagtgcaatgagtgtggaaaagtgtttactcagaactcacacctcgccaggcataggggcattcataccggggagaagccatataaatgcaacgaatgtggtaaagtcttccggcacaatagttaccttagcaggcaccagcgaatacatacaggtgagaaaccatataagtacaatgagtatggtaaggcctttagtgaacactccaacctcacaactcaccaggtcattcataccggcgaaaagccctacaagtgtaacgagtgcggcaaggttttcacccagaattcccatctggctcgacaccggcgagtacatactggcggaaagccatatcagtgtaatgaatgtgggaaggcattctcccagacaagcaagctggctaggcaccagagagtgcataccggagaaaagccctacgaatgtaaccaatgcgggaaagctttctccgttaggtctagtctcacgacccaccaggcaattcacaccggaaagaagccctacaagtgcaacgagtgtggtaaagtgttcactcaaaatagtcatctggctaggcaccgtgggattcacacgggcgaaaagccatataagtgtaatgagtgtggaaaggccttcagtcagacatcaaaactcgctcgacaccagagaattcacacgggggagaagccctatgaatgtggcaagccgttttctatctgttcttccctcactacacaccaaactatacacacaggcggaaagccatataaatgtaacgtctggaaggtgctgaagtcggagttcaagccgtgtaaacctagccaaaattcctag

SEQ ID NO: 25215 - DNA, 282 bp, Artificial Sequence
  Description of Artificial Sequence: Synthetic coding sequence
tcacggaatagccaactctcacaacatcagaagatacacactggtgaaaaaccatataagtgtaacgaatgcggaaaggtatttacccagaatagccaccttgtgcgacatcgcggaatacacacaggcgaaaaaccttacaagtgtaatgagtgcggcaaaccattcagcatatgtagctccctaaccacgcaccagactatccacacggggggaaaaccatacaaatgcaatgtctggaaagttctcaagagcgagtttaaaccttgtaaaccatcctag

SEQ ID NO: 25216 - DNA, 2523 bp, Artificial Sequence
  Description of Artificial Sequence: Synthetic coding sequence
atggccctgacacaagggcaagtcaccttcagggacgtcgccatcgagttctcacaggaggaatggacatgcctggaccccgctcagcgaaccctttaccgggacgtaatgctggagaattatagaaatctggcatcgctcgcgggtatctcttgtttcgacttaagcatcatttccatgctcgagcagggtaaagagccatttaccctggagagccaggtgcagattgccggtaatcctgacggctgggaatggataaaggctgtaatcacagcactgtcctctgaattcgtcatgaaggacctgctgcacaagggaaagtcaaacaccggtgaagtgtttcagaccgtcatgctggaacgacaagagtcccaggacatagagggatgttcgttccgggaagtgcaaaagaatactcatggactggagtaccagtgcagagatgctgagggcaactacaaaggggtacttctaacacaggagggaaaccttacccacggaagggacgaacacgataagcgagatgcacggaataagctgattaagaatcagttggggctctcgttgcaaagccatctgccagagttacaattgttccagtacgaaggcaaaatctatgagtgtaatcaggtggagaaaagcttcaacaacaacagctctgtgtccccccctcagcagatgccgtataacgttaagacacacatctccaagaaataccttaaagacttcatctcctcactgcttttgacccagggccaaaaagcaaataactggggtagtccatataaatccaatggctgcggcatggtctttccacagaacagccacttagcttcccaccagcgctcgcacactaaagagaagccttataagtgctatgaatgtggcaaggcctttcgtactcggagcaacctgactacccatcaggtaatccacacaggcgagaagaggtacaagtgtaatgagtgtggcaaggtgttcagcagaaattctcagctctcacagcaccagaagatacacaccggggagaagccttataagtgtaatgagtgcggaaaggtgtttacacagaacagtcacctggtccgccatagaggaattcacaccggggagaaaccttataaatgtaacgagtgtggaaaggcgtttcgcgcaaggagctctcttgccatccatcaggctacccattccggggaaaaaccatacaaatgtaatgaatgcgggaaagtgttcactcagaattcccacttgaccaatcactggagaatccacaccggcgagaaaccatacaaatgtaatgagtgtggcaaggcatttggtgttcgaagcagtcttgctattcatctggtgatacatacaggggagaaaccatataagtgccacgaatgtggcaaagtgtttagacgtaactcccaccttgcgagacaccagctcatccacactggtgaaaaaccgtacaagtgcaacgaatgtggaaaggcctttcgtgcacatagcaatctcactacccatcaggtgatccataccggcgagaaaccatataagtgcaacgaatgtggtaaagtgtttactcaaaactctcacctcgccaaccaccagagaatccacactggcgtgaagccatacatgtgcaacgagtgcggcaaggccttcagtgtctattctagcctgaccacacatcaggtaatacatacaggcgagaagccctacaagtgcaatgagtgcgggaaggtcttcacccagaactcacacctcgccagacaccggggaattcacacgggtgagaagccctataagtgcaacgagtgcggtaaagtatttcggcacaatagttatttgagtcgccatcaaaggattcatacaggggagaaaccttacaaatacaatgagtatggcaaagctttctccgaacattccaatctgactacccaccaggtcatccataccggggagaagccctataagtgcaatgaatgtggcaaggtctttacacagaactcccacctggccaggcaccggagagtccatacggggggtaagccgtaccagtgtaatgagtgcggcaaggccttctcccaaacatccaagctggccaggcaccaacgtgtgcatacgggtgagaagccgtatgagtgcaatcagtgcggcaaggcattctctgtgcgcagcagcctcacaacccaccaggccatccacacaggcaaaaaaccctacaaatgtaatgagtgcggcaaggtatttacacagaattcccacctggctcggcatagggggatccatactggggagaagccatacaagtgcaatgagtgtggcaaggctttttcacagacttccaagctggctcggcaccagcggatacatacaggtgagaaaccttacgagtgcggaaagcctttcagcatttgctcatccctgaccactcatcagacaatccataccggcggaaagccctataagtgcaacgtctggaaagtgcttaagagtgagttcaaaccctgcaagccctcacagaactcttag

SEQ ID NO: 25217 - DNA, 1599 bp, Artificial Sequence
  Description of Artificial Sequence: Synthetic coding sequence
atgatccaggctcaggaaagcatcacgctcgaggacgtcgctgttgatttcacttgggaagaatggcagctgctgggtgcggctcagaaggacttatacagggatgtgatgctagagaattactccaatctggtagctgttggataccaggcctctaagcccgacgcactgttcaagctcgagcagggcgaacagttgtggacaatcgaagacgggattcactctggggcatgttcagatatctggaaagtggatcacgtgctggagcgattgcagagtgagagcctcgtgaacagacgaaaaccctgccacgaacatgatgctttcgaaaatatcgtgcattgtagcaaatcacagttcctgcttgggcagaaccatgacatctttgacctaaggggaaagtccctcaagtccaatttgacactcgtcaaccagtccaagggatacgagattaaaaactccgtggagtttactgggaacggggattccttcctgcatgcaaaccatgaacggctgcacaccgccatcaagtttccggcatcccaaaagctgatcagtacaaagagtcagtttatttcaccaaaacatcagaagactagaaagcttgagaagcaccacgtatgttctgagtgtggaaaagcattcatcaagaagtcgtggctgactgaccatcaggtgatgcatacaggggagaagccccacaggtgctccttgtgcgagaaggcttttagcagaaaatttatgctcaccgaacaccaacggacacatacaggtgagaaaccctatgagtgcccagaatgtggcaaggccttccttaagaaatcacggctcaatatccatcagaagactcacacaggggagaagccttacatatgctccgagtgcggcaagggctttattcagaaagggaacctgatcgtacaccagcgcatacacacaggggaaaagccctatatctgtaatgagtgtggtaaaggattcatccagaaaacttgcctgatcgctcaccagcgatttcacacggggaagacgccatttgtgtgttctgagtgtgggaagtcctgttctcagaaaagcggattaataaagcaccagcgcattcacactggagaaaagccattcgagtgctccgagtgtggcaaggcattttcaacgaaacagaaactgattgtgcatcagagaacccacacaggtgagagaccatatggttgtaacgagtgcgggaaggcctttgcatatatgtcctgtctcgtgaagcacaagagaatccacacgagagaaaaacaagaagcggctaaggtcgagaatccacctgccgaaaggcatagctctctccacacctccgacgtgatgcaggaaaaaaacagcgctaatggagcaacaacacaggtgccttccgtcgctccacagacctctctcaacatcagtggactgttagccaataggaatgtcgttttagtaggacaacccgttgtgcgttgtgcagcctctggcgataatcgcggttttgcacaagaccggaacttagtcaatgctgtcaatgtggtagtgccgagtgtcatcaactacgtcctgttttatgtgacagaaaacccctag

SEQ ID NO: 25218 - DNA, 1818 bp, Artificial Sequence
  Description of Artificial Sequence: Synthetic coding sequence
atggccgcaggtcagcgtgaggctcgcccacaggtgagcctcacctttgaggacgttgcggttctgttcacccgggatgagtggaggaaactggctccttcacaacgtaacctttatcgggatgtgatgctggagaactataggaacctggtgtcactgggcttgcccttcaccaagcccaaggtgatcagcttactgcagcagggcgaggacccttgggaggtcgaaaaggacggcagcggcgtgtcctctctggggtcaaaatcttcacacaagactaccaagtctacccagacgcaagattcatcttttcaggggctgatactgaagagaagtaaccgcaacgtgccctgggatctgaagctagaaaagccttatatttacgaggggaggctcgagaagaagcaggacaaaaaagggtcttttcagattgtgtccgccactcataagaagatacccactatcgaacgctctcacaagaacactgaattgtcccaaaacttcagccctaagagcgtgctcatccggcagcagatccttcccagagaaaaaactcccccaaagtgcgagattcaaggcaactcgttgaagcaaaattctcaactgctcaatcagccgaaaatcacagcagataaacggtataaatgttctttatgcgagaaaacatttattaatacttcaagtctcaggaagcacgagaaaaatcattcaggcgaaaaactgttcaagtgtaaagaatgctcaaaggccttctctcagagcagcgccctcatacagcatcagattacccatactggagagaaaccgtacatttgcaaggaatgcgggaaagcctttacattgtccacttctctgtataagcatctgcgcacgcacaccgttgagaaaagttaccggtgtaaagagtgcggtaaatcttttagccggaggtccggcctgtttatacatcaaaaaattcacgctgaagaaaacccatgcaagtacaatcctgggcgtaaggccagttcttgcagtacaagcctatctggctgccagagaatccactctcgaaaaaagtcttacctatgcaatgagtgcggcaatacatttaagtccagttctagcctcaggtaccaccaacgaatccatactggcgaaaagccattcaaatgcagcgagtgtgggagggcattttctcagtccgccagcctgatccagcatgaaaggattcatacaggtgagaagccttataggtgtaatgaatgtgggaaaggatttacctccataagtaggcttaaccgacatagaataattcatacgggtgagaagttctataactgtaatgagtgtgggaaggctctgagctcacactctacacttatcattcatgaaagaattcataccggagagaagccatgcaagtgtaaggtctgcgggaaggcattccgccagtccagcgccctgatacagcatcagaggatgcataccggtgaacgcccatacaaatgcaatgaatgtggtaagacattccgctgcaacagttccctgtcaaatcatcaacggatccataccggagaaaaaccttacaggtgtgaggaatgcggtatctcattcggccagtctagcgcactgatccagcaccggcgtatacataccggcgagaaacctttcaaatgcaatacctgcggtaagacgttccggcagagtagttccagaattgcgcatcagcgcattcatacaggtgagaaaccctatgagtgtaatacctgtggcaaactctttaaccaccgcagcagcttaacaaaccactacaagatccacattgaggaagacccctag

SEQ ID NO: 25219 - DNA, 408 bp, Artificial Sequence
  Description of Artificial Sequence: Synthetic coding sequence
atggcggcaggccagagggaggccagaccacaggtctccttaaccttcgaagatgttgccgtgctcttcaccagagatgagtggcgcaaactggctccaagtcagagaaatctttacagggatgtcatgctggagaattaccgaaaccttgtgagcctcggcctcccttttactaagcccaaggtgatcagcttgttacagcagggtgaagatccctgggaggtagaaaaggatgggtctggtgtttccagtctgggttctaagtccagccacaaaaccacaaagtccacacagacacaggactcaagctttcagggcctgattctgaagcgctctaaccggaacgtgccttgggatttgaagctcgagaagccatacatatatgagggccgactcgaaaaaaaatag

SEQ ID NO: 25220 - DNA, 1839 bp, Artificial Sequence
  Description of Artificial Sequence: Synthetic coding sequence
atggctgctggacagagagaagcccgtccgcaggtgagcctgacatttgaggatgtggcggttctctttacttgggacgaatggcgaaagctggccccaagtcagcgcaatctgtaccgggatgtcatgctagaaaactaccggaacctcgtctcccttggcttgtcttttacaaagccgaaggtcatcagcttgctgcagcaaggggaagatccttgggaggttgagaaagacagcagcggggtaagttccctggggtgtaaatcaacgcctaagatgaccaagtcaactcagacgcaggattcttttcaggagcagatccgcaagaggctgaagcgcgacgagccgtggaattttatctctgaacggagctgcatttacgaggaaaaactaaaaaaacagcaggacaaaaatgagaatctacaaattatcagcgtggcgcatactaagatcctcaccgtcgacagatctcataagaacgtagagttcggacagaatttctatctcaagtctgtgttcattaagcagcagcgcttcgccaaggagaaaaccccctcaaagtgcgaaatccagcggaacagcttcaagcagaatagtaacttgctgaatcagtccaaaattaagaccgccgagaagcggtacaagtgttccacatgcgagaaggcttttattcacaattcctctctgagaaagcaccaaaaaaatcacacaggtgaaaaactgttcaagtgtaaagaatgcctgaaagccttttctcaatcttctgcactcattcagcatcaaaggacacataccggtgagaagccatacatctgtaaggagtgtgggaaagcattctctcattccgcctctctttgcaagcacctgaggactcacactgttgaaaaatgctacagatgcaaagagtgcgggaaaagcttctcccggcgatccggactgtttattcatcagaagatccatgcccaggaaaatccccacaaatataaccccggaaggaaagcctcgtcttacagtaccagtctttctggaagtcagaaaatccatcttcgcaaaaaatcttatttatgcaacgagtgcgggaatacctttaaatcaagttccagtctccggtaccaccagaggattcacacaggtgagaagccctttaagtgctcggagtgtggtcgcgctttcagtcagtccgcctctctgattcagcacgaacgaattcacactggggaaaaaccctatcgctgcaatgaatgcggcaagggatttacttcaatcagtcgtttaaataggcacagaataatacacaccggtgagaagctctataactgtaatgagtgtggcaaggcactctcttctcacagtactctcataatccacgagaggatccataccggagagaagccttgcaaatgcaaagtgtgtggcaaagccttccggcagtcctccgcactgattcaacaccaaaggatgcacaccggcgaacgtccttacaagtgtaacgaatgcgacaagaccttccgctgcaattctagcttgtcgaatcaccagcgcatccacacaggcgagaaaccctaccggtgtttagagtgtggtatgagctttgggcagtcagccgctctgattcagcaccagcgaatccataccggagaaaaaccatttaaatgtaacacctgcggcaagaccttcaggcagagctcaagcctgattgcacatcaacgcatccatactggggagaagccctatgagtgtaatgcctgtggtaagctgtttagccagcgatcaagcctaacaaaccactacaagattcatattgaagaggacagcctgaaagcagacctgcacgtttag

SEQ ID NO: 25221 - DNA, 405 bp, Artificial Sequence
  Description of Artificial Sequence: Synthetic coding sequence
atggccgcaggccagagggaggctagaccccaagtcagcctgacctttgaggacgttgcagtcctttttacttgggacgaatggagaaagctggccccttctcagcgaaatctttaccgtgacgttatgctcgagaactacagaaatctggtatccctagggctgtcattcaccaagccaaaggtgatctccctcttacagcaaggagaggatccctgggaagttgagaaggacagttctggcgtctccagcttggggtgtaagtctaccccaaaaatgaccaagtctactcaaacgcaagactcatttcaggagcaaatccgtaaaagattgaaacgcgatgaaccctggaacttcatctcagaacgatcttgcatttacgaggagaaactaaagaaacaatag

SEQ ID NO: 25222 - DNA, 1665 bp, Artificial Sequence
  Description of Artificial Sequence: Synthetic coding sequence
atggctgtagacctgcttagtgctcaggaaccagtgactttccgtgacgtggccgtttttttcagtcaggacgagtggctccacctggactctgcacagcgcgcactgtaccgagaggtgatgctggagaactattcttcgttggttagtctgggcattccattctctatgcctaaacttattcaccagctgcagcaaggtgaggacccttgcatggtggaaagagaagtaccatccgacacacggctggggttcaaaacctggttagagacggaagctttgcctcacaggcaggacatcttcatagaagaaacttctcagggcatggttaagaaagagtctatcaaagacgggcactgggacatcaatttcgaagaagctgtggagttcgagtctgagatcgaggaggagcaggagaaaaaacccttgcgccaaatgatcgattcacacgagaagaccattagcgaggatgggaaccatacctcgctcgaactgggaaaatctttgttcacaaataccgccctggtgacccagcagagcgtcccgatagaacgtatacccaacatgtattacacctttggaaaggacttcaaacagaacttcgacttaatgaagtgttttcaaatctaccccggagggaaacctcacatctgcaatgagtgtgggaaatcttttaaacagaatcttcatctaatcgaacaccagagaatccacaccggcgaaaagccctataaatgcaacgaatgtgagaagacattcagtcaccggagttcacttttgagccaccagcgtatacacacaggtgagaagccttacaagtgtaacgaatgcgagaaggctttttctaatagctccacgctcattaagcaccttagggttcatactggagagaagccctaccgatgccgagaatgtggtaaggctttttcacaatgctcaacactcacggtgcaccagagaattcacactggagagaagctgtacaagtgtggggagtgtgagaaggctttcaactgtcgagcgaaactgcaccgtcatcaacggatccacacaggcgaaaagccctataagtgcagtgagtgcggaaaagggtatagccaattcacctctctggccgaacatcaaaggttccacaccggagagcagctgtacacatgcctcgagtgtggccgtacattcactcggatcgtgactctgattgagcaccaacggatacacacgggacagaagccatatcagtgtaatgagtgcgaaaaagccttcaaccagtattcatctttcaatgaacacaggaaaatccacactggcgagaaactatatacctgcgaagagtgcggtaaggccttcggctgtaagtccaatctgtaccgccaccaaaggattcacaccggagagaaaccttatcagtgcaaccaatgcgggaaagcattctcccagtacagcttcttgacggagcacgaaaggatccacacaggggagaagttgtataagtgcatggaatgtggcaaagcctactcctacaggagtaacctatgcaggcataagaaagtccacaccaaggagaagctgtacaaatggaaagagtacgggaagccattcatctgcagcagtagtctcactcaataccaacggttctttaaaggcgacaaggcgtacgaggtatag

SEQ ID NO: 25223 - DNA, 1707 bp, Artificial Sequence
  Description of Artificial Sequence: Synthetic coding sequence
atgcgcaggtcagttctggtgaggaaccctggtcacaaagggctccgcccagtctacgaggagctcgactcagattctgaagacctagaccccaaccccgaggatcttgaccctgtgagtgaggacccagagccggaccctgaggatttgaatactgtacctgaggacgttgacccttcatacgaggatctcgagcccgtgagcgaggatctggatcccgacgctgaggctccaggcagcgagccgcaagatcctgatcccatgtcctcgtcattcgacctggatccggacgtgattggacctgtccccctgattctggacccgaacagtgacaccctctcccccggagatcctaaagtggacccaattagcagtggtctcacagccacaccacaggttttggctactagccctgccgtgctgccagctcccgcttccccccctcgacccttctcatgccctgattgcggcagggctttcaggaggtcgtccggtctctcacagcaccgcagaacacactcaggagaaaaaccctaccgatgccctgactgtggcaagtcctttagccacggagcaaccctggcccagcatcggggtatacacaccggcgcaagaccttaccagtgtgccgcatgcggtaaagcattcgggtggcgctctaccctcctcaagcacaggtcatcccactctggcgaaaaacctcatcactgcccagtttgcggaaaggccttcggacacggaagtctgctcgcacagcacctgcggactcacggcggaccgaggcctcataagtgccctgtgtgtgcaaagggatttggacagggatcggccctgttaaaacatttgcgaacacacacaggcgagagaccctacccctgcccacaatgcggcaaagctttcggtcagtcctccgccttacttcagcaccagaggacccatacggctgaacggccttatagatgcccccattgcggcaaagccttcggtcagtcatctaatttacaacatcacctgcgcatccacaccggagaaaggccgtatgcctgtccccattgtagcaaggcctttggacagtcatctgccctcttacaacacctccacgtgcactcaggagaacggccttaccggtgtcagttgtgcggcaaggcatttggccaggccagtagcctcaccaagcataaacgtgtgcatgagggcgctgcagctgcagcagccgctgccgcagctgccgctgcagctgccgcagcaggactggggctgggcccagggttaagcccggcttccatgatgcgcccaggccaggtctctttgcttgggccagatgctgtgtctgttctggggagcgggttgggactttctcctggcacctctagtggcaggaaccccgacccaggaagtggcccaggaactctccctgatccctccagcaagcctctgccgggaagcagatcaacaccatctccaactccggtagagtcaagcgaccctaaagccggtcatgatgccggtcccgacctagtaccctcccctgacctggatccagtcccatcacccgaccccgaccctgtgccaagccctgatcccaacccagtgtcctgccctgatccgtgttctccgacgcgaggtaccgtttcccctgctcttcccacaggggaaagcccagaatgggtccaggaacaaggcgcactcctcgggccagacggatag

SEQ ID NO: 25224 - DNA, 1707 bp, Artificial Sequence
  Description of Artificial Sequence: Synthetic coding sequence
atgcgcaggtctgtgctggttaggaatccaggacataaggggcttagacctgtctatgaggagttggattctgacagtgaggatctcgaccctaatccagaagatcttgacccggtctcagaggaccccgagcctgatccagaagatcttaataccgtcccggaagacgtcgacccatcgtatgaagatcttgagccagtgtcagaggaccttgaccccgatgccgaggccccaggcagcgaacctcaggaccctgaccccatgtccagctcgtttgatctggatccagacgttattggcccagtgccactcattctggaccctaattcggacacactgagtcctggcgaccccaaggtggacccaatctccagcgggctgactgcgactccccaggttctcgccacctcgcctgccgtgctgcctgctccggcttccccccctcggccattcagttgtccggattgcggcagggctttccgcagaagcagtggactgagtcaacacagacgaactcactcaggcgagaagccttatcggtgtcccgactgtggcaaatcattctctcacggggcaacgctggcccagcatcgaggcattcataccggcgcacggccttaccagtgtgcggcatgcggaaaggcattcggctggcgtagcaccttacttaagcacaggagcagtcattccggggagaagccacaccattgccctgtatgcggaaaggcctttggccacggaagcttgttggcacagcatctgcgaacacatggaggacccaggccacacaaatgtcccgtctgtgccaagggcttcggccagggctcagcccttctcaaacatttacgaactcacactggcgagagaccatacccgtgtccacagtgcggcaaagccttcggccaaagctccgcactgctgcagcaccaaagaacgcacactgctgagcggccttaccgctgtccacattgcggaaaggcttttggacaaagctccaacttgcagcatcacttgcggattcacactggcgagcgcccttacgcatgtccccattgtagtaaagcgttcggacagagcagcgcattactgcagcacctgcacgtccatagcggcgagaggccctatagatgtcaactctgcggcaaggcctttggccaagcctcctccttaaccaagcataagcgcgtccacgagggagcagctgcagcagctgccgctgctgctgcagcggctgccgcagccgctgcgggactgggattaggtcctgggctatcaccagcaagcatgatgaggccaggacaggtgtctttattgggacctgatgccgtgtcggtgcttggatctggcctgggcctgtctcctggtaccagttccggccgtaatcccgatccaggtagtggaccagggacccttcctgatccatcctccaaaccgctaccaggttctagatccactccctcccccactcctgtggagtcaagcgatcccaaggcaggccacgacgctgggccagacctcgtcccatccccggatctcgatccggttccgagtcctgatccagaccccgtgcctagcccagaccccaacccagtgtcatgtcctgatccctgcagccctacgcggggaactgtgtctccagccctacccacaggtgagtctcctgagtgggttcaagagcagggggctctcctgggtcccgacggttag

SEQ ID NO: 25225 - DNA, 1707 bp, Artificial Sequence
  Description of Artificial Sequence: Synthetic coding sequence
atgaggcgaagcgtcctggtgcgcaacccaggtcataaagggcttcggcctgtgtacgaggagctggatagcgacagcgaggacttggacccaaaccctgaggatctggaccctgtgtcagaggaccccgagccagaccccgaagacctaaacacagtgcccgaggatgtggacccttcgtacgaagacctggaaccagtaagcgaagatctggatccggatgccgaagcacctgggagcgagccgcaggaccccgacccgatgtcatcatctttcgacctcgacccagacgtgattgggccagtccctttgatcctggatcctaactcggacaccctctctcccggagacccaaaggttgaccctatctcatcgggcctgacagcgacaccacaggtcctggctaccagtcctgcagtgttgcccgcacccgcttctcctcccagacccttctcttgtcctgactgcggcagggcttttagaagatcaagcggcctcagtcagcatagacgcacacacagcggagagaaaccttacagatgcccagactgtggtaagagcttctcccacggtgcaacattggcccagcatagggggatccacacgggcgctcgcccatatcagtgcgctgcatgcgggaaggcctttgggtggcgcagtactttactgaaacaccggagcagtcattctggggagaagccacaccactgccctgtctgcggcaaagcctttgggcacggcagcctcttggcacaacacctgcgaactcacggaggaccacggccacataaatgtccggtgtgtgccaagggatttggacaagggtccgccttactcaaacatcttagaacccacacgggcgaacgtccttacccctgcccccagtgcggaaaggcgtttggacagtccagtgcgctcttgcagcaccagcgcacccatactgccgaacgaccctatcggtgtcctcattgcgggaaagccttcggccagtctagcaaccttcagcaccatctgaggattcacacaggtgagcgtccatatgcatgcccccactgtagtaaagcattcggacagagctccgcgttgctccagcacttacacgtgcacagcggagagcgcccatataggtgccagctgtgcggcaaagccttcggtcaggcctcgtcacttaccaagcacaaaagagtgcatgagggagccgcagccgctgcagccgctgcggctgccgctgcagctgcagcagcagcgggacttggcctcggccctggtctgtcccctgccagtatgatgcgtccgggacaggtgtctttgctaggccctgatgccgtgagtgtcttaggatccggcctcggattatcccctggtaccagctcggggagaaacccagacccaggcagcggccctgggaccctgccagatccaagcagtaagccccttccgggttcacgctcaacacctagccctacccctgtggagagctcagaccccaaggcaggacatgatgctggcccagatctggtccccagtcccgacctggaccctgtgcccagcccggacccagatcccgttccttctcccgacccaaacccagtatcgtgtcccgacccctgcagtcccactcgcggaacagtctcacccgctctgccaactggcgaaagccccgagtgggtacaagagcagggcgctctgctgggacctgatggctag

SEQ ID NO: 25226 - DNA, 1263 bp, Artificial Sequence
  Description of Artificial Sequence: Synthetic coding sequence
atgtcgcgcagcagccctagtgggaagggacacagtcgaatggctgaacccaggtttaacaacccctacttctggccccctccgccaacaatgccatcacaactggacaacttggtcctcatcaataaaattaaggagcagcttatggcagaaaaaattcggccaccccacctacctcccactagcgcctcaagccaacagcctcttctggtccccccagctcctgccgaatctagtcaggcagtcatgtccctgcccaaactgcagcaagtgcctggcctgcatccacaggcggtgccccagccagatgtcgccctgcatgctcggccagccacatcaaccgtcacaggccttgggttgagcactagaaccccatcagtgagcacttcggagagcagcgctggagcgggtactggtacaggcaccagtaccccaagcaccccaaccacaacatcccagtctcggttaattgcaagcagtcccactctgatctccggaatcacaagccccccactcctggatagcattaagacaatccaggggcacggcttgctaggtcccccaaagtcggaacgtggaaggaagaagatcaaggccgaaaaccctggcggaccgccagtgcttgtggttccttatcctatcctcgcaagtggtgagaccgcaaaggaggggaaaacttaccgttgtaaagtgtgccctctaacttttttcactaagagtgagatgcagatccattcaaagtcccatacagaggcaaaaccccacaagtgcccccattgctctaagtccttcgcgaacgctagctacctggcccagcaccttcgtatacacctgggcgtgaaaccctaccactgttcatactgcgataagagctttcgacagctctcccacttacagcagcatactcgcatccacaccggggatagaccttataagtgtcctcatccgggatgcgaaaaggccttcactcagctgtctaatctgcagagccatcagcggcaacacaataaggacaagccgtacaagtgtcccaactgctacagagcctactcggattcagcctcactgcagattcatctgagcgcccacgctatcaaacatgctaaagcttactgctgctccatgtgcgggagggcgtatacctccgaaacgtacttgatgaaacacatgtccaaacatacagttgtggaacacctggtctcccatcattctccgcagcggaccgagagcccaggtatcccagtgcgcatctctcttatttag

SEQ ID NO: 25227 - DNA, 1263 bp, Artificial Sequence
  Description of Artificial Sequence: Synthetic coding sequence
atgagtaggtcctcccctagcggcaaagggcattctcggatggccgagccacggtttaataatccttacttctggccccctcccccaaccatgccaagccagcttgacaatctggtgttgatcaataaaataaaagagcagctaatggctgaaaagatcaggccaccccatctcccgcctacatccgcttcctcccagcagcccctgttggtgcctcctgctcccgcagagtcctcacaggctgttatgagcttgcccaaactgcaacaggttccaggcctccacccacaggccgtgccacagccagatgttgcactccacgccaggcccgcaaccagcaccgtgaccggcctcggccttagcaccagaaccccctctgtgtccaccagcgaaagcagcgcaggggcaggtacgggcactgggactagcaccccatctacgccaacaacaacctctcagagccgtctgatcgccagctcaccaacactaatctctggcattacttctcctcccctgttagactcaattaagacgatccagggtcacggtctgcttggccctcccaaaagcgaaagagggagaaagaaaatcaaggctgaaaatccaggagggccaccagttcttgtggtgccctatcccatactggccagcggggagaccgccaaagagggaaaaacatacaggtgtaaggtatgtccactgacatttttcactaaaagcgagatgcagattcatagcaaatcccatactgaggccaagcctcacaagtgtccgcactgtagtaaatccttcgccaatgcttcataccttgcacagcatttgaggatccacttaggggtgaagccgtaccattgcagttattgtgacaagagttttcgccaactctcacacctccagcagcatacaaggattcacacaggcgacaggccctacaagtgtccacatccgggatgtgagaaagcatttacacagctgagcaatctgcagtctcatcaaagacagcataataaggacaaaccctacaaatgtccaaattgttatcgggcatactcggactccgcgagcttacagattcacctttcagcccacgcaattaagcatgctaaggcctattgctgctcaatgtgcggtcgggcatacacatcagagacataccttatgaagcacatgtcaaagcacaccgttgtggagcatctggtctctcaccactcccctcagcgcacagaaagccccggtattccggtcagaatcagccttatttag

SEQ ID NO: 25228 - DNA, 2235 bp, Artificial Sequence
  Description of Artificial Sequence: Synthetic coding sequence
atgcagaaagaaatgaagatgattaaagatgaggatgtccacttcgatctggccgtcaagaagacaccatcctttccccattgcctgcaaccagtggcttcccggggtaaggcccctcagaggcaccctttcccggaggccctgagaggacccttctctcagtttcgctacgagccaccacctggtgatctggacgggtttcccggagtctttgagggtgcaggctctaggaaacgaaaaagcatgccaacgaaaatgccatataatcacccagcagaagaggtaacactggcccttcactcggaagaaaacaaaaatcacggcctgccgaacctgccgctgctgttccctcagccgcctcgccctaagtatgactcacaaatgattgacctctgcaacgtcggatttcagttttacagatcactggaacatttcggaggcaagcccgtgaagcaggaacccatcaagccttctgctgtctggccccagccaacgcctaccccgttcctgcccactccttatccctactaccctaaggtccaccctggattgatgttcccattcttcgtgcccagcagttcgccgtttcccttttcccggcatacgttcctgccaaagcagccccctgaacctctactgccaagaaaggccgagccacaagaatccgaagaaacaaaacagaaagtcgaacgagttgacgtcaacgttcaaattgacgacagctactacgtggacgtgggcggtagccagaaaaggtggcaatgccctacctgtgagaaatcatatacttcaaaatacaacttggttactcatattctagggcactctggtatcaaacctcacgcctgtactcactgtggcaaactgttcaagcagctttctcacttgcacacccacatgttaactcatcaaggaactcgcccacataagtgtcaggtgtgtcacaaggccttcacccagactagccatttgaagaggcatatgatgcagcacagcgaggtaaagccccataactgccgggtgtgtgggagaggcttcgcttatccgtcagagctcaaagcacacgaggccaagcatgctagcgggagagagaacatctgcgttgagtgtggcctggactttcctacacttgcacagctcaagcgacatctcactacccatcggggacctatccaatataattgttcggaatgtgataaaacgttccagtatccttctcaacttcaaaatcacatgatgaaacacaaggatatccggccttatatatgttcggagtgtggcatggagtttgtccaaccacatcatctgaagcagcacagtttgacacacaaaggagtgaaagagcataagtgtggaatctgtggccgagagttcaccctgctggccaacatgaaacgacacgtcctgatacataccaacatcagagcctatcagtgccacctatgctacaagtccttcgtgcaaaaacagactctgaaagcacatatgattgtacattccgacgtcaaaccctttaaatgtaagctttgcggaaaggagttcaatagaatgcacaatctcatgggtcacatgcacctacattccgattccaagcccttcaagtgtctgtattgcccatctaagtttactctgaaaggcaacctgacgagacatatgaaggtaaaacacggcgttatggagcgtggactccatagtcagggcctgggacgcggacggatcgccctggcacaaactgccggagtgctccggagtctcgaacaagaagagcccttcgatctgagtcagaagagaagagcaaaagttcccgtgtttcagtctgatggcgaaagcgcccagggctcacactgccatgaagaagaagaagaggacaactgttacgaagtagagccctacagtcccggacttgctccccagtcacagcagctgtgtacccccgaggatttgagcaccaagtctgaacacgctcctgaagtcctcgaagaggcttgcaaagaggagaaggaagacgcctctaagggggagtgggagaaacgaagtaagggagacctgggcgctgagggaggccaggagcgagactgtgcgggaagggacgaatgtctctctctgagggccttccagtcaacaaggaggggcccaagcttttctgattacttgtacttcaagcaccgcgatgagagccttaaggagctcctggagcggaaaatggagaagcaggccgtgctgctagggatctag

SEQ ID NO: 25229 - DNA, 717 bp, Artificial Sequence
  Description of Artificial Sequence: Synthetic coding sequence
atgaaaaatgtggcaaatactgtcacaattagccacatactaccccacataaagataatccacaccgaagaaaaaccggacaagtgcgaggagtgtaataaggtattcaattggagctctacccacactaaatacaagcgcattcatacggaagataagttctataagtatgaggagtgcgacaaatccttcaaaaacatttctacgctgataacccataaaataatctatgtggtggaaaagttttataagtgcgaagaatgcggcaaggtgttttttttcttcttgaaatggtccctcacactcagcccaaagcttgagtgtaacggagctatttccgtccactgtaaccttcgtcttctggggtcaagcgattccctggccagtacaagtcaggctgcagggatagccggtgcctgccatcacgctcagcttattttcgtgttcctggttgagaccgggtttcaccactttgatcaggccggatttgagctgctgactagcagcgaccctccagctctggcttctcaatccgcccctaagtgttgggattataagcatgagcccctttctcctgtcgagtgtggtaaggtcttcaacaaactttcaaaccatactggagaaaaactatacaaaccgaagcgacacgatagcgccctggagaacactctcaacttcagcaagcataagaggaaccacagcgttaagaagccctag

SEQ ID NO: 25230 - DNA, 1686 bp, Artificial Sequence
  Description of Artificial Sequence: Synthetic coding sequence
atgataacctcacaggggagcgtatccttccgtgatgtaaccgttggtttcacacaagaagagtggcagcacttggacccggctcagaggacactttaccgcgatgtcatgctggagaactacagccatctggtttcagttggctattgcattcctaagcccgaggtgattctcaagttggaaaaaggagaggagccctggatcctagaggagaaattcccgtcacagtcacacctggaacttatcaacacttcccgtaactattccatcatgaagtttaacgaattcaacaaaggaggcaagtgcttctgtgacgaaaagcatgaaatcatacacagcgaggaagaaccttcggagtacaacaagaacggaaatagtttttggcttaacgaagacctgatctggcatcaaaagattaagaactgggagcagtcttttgagtataatgagtgtggtaaagcattcccagagaactccctgttcttggtgcacaaacggggatataccggacaaaaaacctgtaaatacaccgagcacggaaagacttgtgacatgtcattctttatcactcaccagcaaacccaccccagagaaaaccactacggtaacgaatgcggggaaaatatcttcgaagaatctattctgctggagcaccagtccgtgtatcccttcagccagaagctgaaccttactcctatccaacggactcatagcattaacaatatcatcgaatataacgaatgcggtaccttcttttccgagaagctggtgttgcatctgcagcaacggacacacacaggggagaagccatacgagtgtcacgaatgtgggaagactttcactcagaagagtgcccacacaaggcatcagcggactcatactgggggtaagccttacgagtgccatgaatgcgggaaaaccttctacaaaaactccgatctcattaaacaccagagaatccacacaggagaacgtccgtatggttgtcacgagtgcggaaaatcattctctgaaaagtccactctcacccagcaccagcggacacacacaggtgaaaagccgtatgaatgccatgagtgtggcaaaacgtttagtttcaagagtgtcctgacggtgcatcaaaagacacataccggggaaaagccgtatgagtgctacgcttgcgggaaagccttcctgcgcaaaagcgacctgataaagcaccagcggatacatacaggcgaaaagccttatgagtgtaacgaatgtggcaagtctttttctgagaagtcaacattgactaagcatttgcgcacccacaccggcgaaaaaccatacgagtgtatccaatgcggaaaatttttttgctattacagcggattcacggagcatctccgcaggcatactggggaaaagccatttggatgcaacgaatgcgggaagacctttcgtcagaaatctgctctcattgtgcaccagcggacccatatccgccaaaaaccgtacggatgtaatcagtgcggcaagtcgttttgcgtcaagagtaagctgatcgctcaccacagaactcatacaggggaaaaaccatatgaatgcaacgtgtgtggcaagagtttttacgttaaatctaagttaacagtgcatcagcgcatccatcttggaaggaaccccatcaatgtggtgaacgaagggaactatagcggctag

SEQ ID NO: 25231 - DNA, 1686 bp, Artificial Sequence
  Description of Artificial Sequence: Synthetic coding sequence
atgatcacttcgcaggggtcagtgtcattcagagatgtgactgtgggattcacccaggaagagtggcagcatttggatcccgctcagagaacgctgtacagagatgtgatgttggagaactactcccacttggtgtccgtgggatactgcattcctaaaccagaagtcatactgaagctcgagaaaggtgaagagccgtggatcctggaggagaagtttccctcccagagtcacctggaacttatcaacaccagcaggaactactctataatgaagtttaacgaatttaacaaaggtggaaagtgtttctgtgacgagaagcacgagattatccatagcgaagaggagcccagcgaatacaataaaaacggaaatagtttctggctgaacgaggatttaatttggcatcaaaagatcaagaattgggaacagtctttcgaatacaatgaatgtggtaaggccttccccgagaatagcttgttcctagtacacaagcgcggttacacaggacagaagacctgtaagtatacagagcacggcaaaacgtgtgatatgtcttttttcataacccatcagcaaacccatcctagggaaaaccactacggcaacgagtgtggcgaaaacatttttgaggagtctatcttactggaacaccagagtgtttaccccttttcgcagaaactaaatctcacccccatccaacgcacacactccattaacaacattattgaatataacgaatgtggaactttctttagcgagaaattagttcttcacctacagcaacgaacccatactggagaaaaaccatacgaatgccatgagtgtggcaaaacattcactcagaagagtgctcacacccgccatcagcggacccacacagggggtaaaccttatgaatgccatgagtgtggaaaaaccttctataagaacagcgatttgataaaacatcagagaatccacacgggggagagaccttacggttgccacgagtgcggcaaaagttttagcgagaaaagcacactgacacaacatcaacggactcacaccggcgagaagccttacgaatgccatgagtgcgggaagacattcagtttcaagagtgtactgacggtccaccaaaagacccacacaggggagaagccatatgagtgctatgcttgcggaaaggcctttctccgaaaaagcgacctcattaagcaccagagaatccacaccggggaaaagccctacgagtgcaatgagtgcgggaagagtttctcagagaagtcaacattgaccaaacatttgcggactcacaccggcgagaagccatacgaatgtatccaatgcgggaaatttttttgctactatagcggcttcaccgaacatctgcgcaggcatactggggagaaaccgttcgggtgtaatgagtgtggaaagacattccggcagaaaagtgcacttattgtgcatcagcggactcacataagacagaagccttatggatgcaaccagtgcggaaagtcattttgcgtaaaaagcaaattgattgcgcaccacaggactcacacaggcgagaaaccttacgagtgcaatgtgtgcggaaagtccttttatgtcaaatcaaagttgaccgtgcatcaacggatacacctgggacggaatcctatcaatgtagtcaatgagggtaactattccggctag

SEQ ID NO: 25232 - DNA, 1188 bp, Artificial Sequence
  Description of Artificial Sequence: Synthetic coding sequence
atgcgaaatataatgtatttcgggggtacctgtcagagcccagcgctgcccgcactagtccgcccacccgcaccgcctttacaacctagtctcgacattaagccctttttaccatttcctcttgacaccgccgcagcagttaatttgtttcctaattttaatgcaatggaccccatccagaaagctgtgattaaccatactttcggggtcccactccctcacaggagaaagcagattatcagctgtaatatctgccagctgcggtttaatagtgactcacaggccgctgcgcactataaggggacaaaacacgctaagaagttgaaagctctggaggccatgaagaacaagcaaaaaagtgtaaccgctaaagacagtgctaagaccacgttcacgtctataaccaccaacactataaatactagctccgacaagacagatggtacagcaggcactcccgctattagcacaacaacgaccgtggagataagaaagagctcagtaatgactaccgagattacgtcaaaagtggaaaagtccccaaccacggccacaggaaactcttcttgtccgagcacagaaacagaagaggagaaggccaagagactactgtactgctccctctgcaaggttgccgttaactctgctagccagctcgaggcacacaactccggaactaagcataaaacaatgcttgaagcgcgaaatgggagcggtaccatcaaagccttccctcgagctggcgtgaagggaaaagggccagtcaacaaggggaacaccgggcttcaaaataaaacgtttcattgcgaaatttgcgatgttcatgttaattccgagacccagctgaagcaacatattagttcacggaggcacaaggacagagccgcaggcaagccacctaagccaaaatactccccatataataaacttcagaagaccgcccatccattaggggtgaagctggtgttcagtaaggagcccagtaagcctcttgctccaagaatcctgccaaatccgttagctgccgctgcggcagctgccgctgtcgccgtgtcaagtcctttttccctgcggacggctcccgcagctaccctcttccagactagcgcgctgccccctgctctgctgcggcctgcccctgggccaatccgcaccgcacacacccccgtgctcttcgcaccttactag

SEQ ID NO: 25233 - DNA, 1077 bp, Artificial Sequence
  Description of Artificial Sequence: Synthetic coding sequence
atggagagtttaaggggaaacactgcccaaggacccacaaatgaggaggattataaaaatgaaggccagctgtcccgccagacgaagtgcccagctcagaagaagtcttcgtttgagaacaccgtggtgcgcaaagtttcagtaactttgaaagaaatcttcactggcgaggaggggccagaaagctccgaatttagtttgtcaccaaatctggacgcacaacagaaaattccaaaaggacacggctcgcccatcagccggaaaaatagcaaggacaattcggacctgattaagcatcagcgactattctcccaacgcaaaccatgcaaatgcaacgagtgtgagaaggctttcagctatcagtctgatctcctagtccattcccgcatccacggtggggagaaacctttcgaatgtaacaaatgtggcaaaagcttctcgagaagcacacatctcatcgagcaccagcggacccataccggtgagaaaccctacgaatgtaacgagtgcggaaaggctttcagccgaagtacccacctgtcactgcaccagcgcatacataccggagagaaaccttacgaatgctcagagtgtggcaaggctttttctaggagtacgaacctatcacagcatcagaggactcatactcaggaacgaccatataaatgtaacgagtgtggtaaggccttcggtgaccgttcaactattatccagcatcagcggattcacaccggagaaaatccctatgaatgttccaagtgcgggaaagcttttagttggatctcgagcctgacagagcatcagcggacacataccggggagaatccttacgaatgtagtgaatgcggcaaggtgttttcaagatcttctagcctgaccgagcatcagagaatccacagtggggagaagccccatgagtgtagggtatgcggaaaaggcttctctcgatcatccagtctgataatacatcaaagaacccacaccggtgaaaaaccatacaaatgcaatgattgcggtaaagccttttgccagagcagtacactgatacggcaccagcacctgcatacaaaggaatag

SEQ ID NO: 25234 - DNA, 402 bp, Artificial Sequence
  Description of Artificial Sequence: Synthetic coding sequence
atggaaagcctgagaggcaacaccgcacaaggacccactaacgaggaggattataagaatgagggccagctgtcccggcaaaccaagtgcccggctcagaagaaaagctctttcgaaaatacagtggtacgaaaagtttctgtcaccttaaaggagatctttacaggtgaagagggcccagaatcttctgagtttagcctgtcccccaacttagatgctcagcaaaaaataccaaagggccacggttcaccaatcagcaggaaaaacagcaaggacaacagcgacctgatcaagcaccagcgcctcttcagccagagaaagccttgtaaatgcaacgagtgtgaaaaagctttctcttatcagagcgacctgttggtccatagtcggatacacggtggttag

SEQ ID NO: 25235 - DNA, 1686 bp, Artificial Sequence
  Description of Artificial Sequence: Synthetic coding sequence
atgaactcttccttgaccgcccaaagaagggggagcgatgcagaactgggtccctgggtcatggctgcaagatcaaaggatgccgcaccgagtcaacgggacggcttgctgccagtgaaggtggaggaggattcaccaggttcctgggaaccaaattaccctgccgcttctcccgatcctgagacttctcggctgcactttcgtcaactgaggtaccaggaggtggcgggacccgaggaagcactgtctagactgcgtgagctgtgcagaagatggctccgccctgagctgctttcaaaagaacagattctggagctgcttgtgctggagcagttccttactattcttcccgaggagcttcaggcctgggttcgagagcactgtcccgagtctggcgaggaggcagtcgccgttgtcagggctctgcagagagccctggatggcacgtcaagccagggcatggtaacattcgaggacacggcagtcagcctcacctgggaggaatgggaacgactagaccctgccagaagggatttttgtagagagtcggctcagaaagactccggtagtactgtccctccctccctggagtctagagttgaaaataaagagctcattcccatgcagcagatccttgaagaagccgagcctcaaggacagctgcaagaggcttttcagggaaagagaccactcttttccaagtgcggctctactcacgaggatcgcgttgagaagcagagcggcgaccccctcccgcttaaactcgagaatagccccgaggcggaaggtctgaactcaatctcagatgtgaacaaaaatgggagtatcgagggggaagacagtaagaacaatgaactacagaacagtgccagatgtagcaacctcgtgctttgccagcacattcccaaggcagagagaccgaccgatagtgaggagcacgggaataagtgcaaacaatccttccatatggttacctggcacgttctgaagccccataagtcggactcaggcgatagctttcatcacagctcgctgttcgagactcaacgccagctgcatgaggagagaccctacaaatgcgggaactgtggcaagtccttcaaacagcgtagcgatcttttccgccatcagcgaatacatactggcgaaaagccgtatggatgtcaggagtgtggaaaaagcttttctcaaagcgctgctctcacgaagcaccaacggacccatacaggtgagaagccctatacatgtttaaagtgcggagagcggtttagacagaattcacacctcaataggcatcagtccactcatagtcgcgataagcatttcaaatgtgaagagtgcggcgagacctgccatatatcaaatctgttccggcatcagcgtcttcataaaggcgagcgaccctataagtgtgaggaatgtgagaagagcttcaagcagaggagtgaccttttcaagcaccacaggatccatactggagagaagccttatggctgttcagtgtgcggcaagcggtttaaccagagtgctacactgatcaagcatcagcgcattcacacaggcgaaaaaccctacaaatgcctggagtgtggggagaggtttaggcagagcacccacttgatccggcatcaacggatccatcagaataaggtattgagcgcaggccgagggggttcccgcttatag

SEQ ID NO: 25236 - DNA, 489 bp, Artificial Sequence
  Description of Artificial Sequence: Synthetic coding sequence
atgaattcaagcctcaccgcgcagcggcgtggatccgatgcagaattgggtccttgggtaatggcagccagatccaaggacgccgctccgtctcagagggatgggctgctacccgtaaaggtggaggaggattcacctggatcgtgggaaccaaattatcccgctgcgagcccagatccagaaacaagcaggctgcactttcgtcaacttagataccaggaggtagccggaccagaggaggcactgtcccgcctacgagaattgtgtcgacgatggctcagaccagaactgttaagcaaagagcaaattttggagttgctggttctcgagcaattcctcactatcctgcctgaagagctgcaggcctgggttcgagaacattgtcctgagagcggagaggaggctgtggccgtagtacgtgccctgcagcgtgccctggacggaacctctagtcaagtttggaaggcagagtggagaacaaaatcttag

SEQ ID NO: 25237 - DNA, 1416 bp, Artificial Sequence
  Description of Artificial Sequence: Synthetic coding sequence
atgaaggggaattatgaatctctgatctctatggattatgccatcaatcagcccgatgtgctctcgcaaattcaacccgaaggagaacacaataccgaagatcaggccggacctgaggaatccgagatccctactgacccctctgaggagcctgggattagcaccagcgacatcttaagttggattaagcaggaggaggaacctcaggtcggggctccccctgaaagtaaagagtctgacgtatacaaatccacttatgcagacgaagaactggtgataaaagccgaagggctggccaggagtagcttatgtccagaggtccctgtgcccttcagctctccccctgcagccgcaaaggacgcattcagtgatgtcgccttcaagagtcagcagtccacctcaatgaccccattcggacggccagcgacagatctgccagaggctagcgagggccaggtgacattcactcagctgggatcataccccctgcccccacccgtcggggaacaggttttttcatgtcaccattgcggtaagaatctgagccaggatatgttgttgactcaccaatgctcccacgctactgaacatcctttgccatgcgcacagtgcccaaaacacttcactccacaagcagatctgtccagcacttctcaggaccacgcttccgagactcctcccacttgtccacattgcgcacggacatttacacacccttcgcggttgacataccatttgagagtgcataatagcacagaaagaccctttccatgtccagactgcccgaagagatttgcagatcaggccagactcacctcacacaggagagcccacgcctcagagcggccttttcgatgtgcacaatgcggcaggagcttttccctcaaaatttccctcctcctgcatcagaggggccatgctcaagagagacctttctcttgtcctcaatgtggtatcgatttcaatggccactccgctctcattcgccaccagatgatccacaccggggagaggccatatccctgcaccgattgcagcaagtcatttatgcggaaagagcatctactgaaccataggaggctgcacaccggcgaacgcccattcagctgcccgcactgtggcaagagtttcattcgaaagcaccacctgatgaagcaccagaggattcatactggggaaagaccatatccttgttcatattgtgggagaagctttcgttacaagcaaactctgaaagatcatctcaggtccggacataatggagggtgcggtggggattccgacccctctggccaaccgcctaatcctccaggtccactgattacgggattggaaacttccggattaggggtcaatacagagggcctggaaacaaatcaatggtacggcgaggggtcggggggaggcgttctttag

SEQ ID NO: 25238 - DNA, 1416 bp, Artificial Sequence
  Description of Artificial Sequence: Synthetic coding sequence
atgaaaggcaactatgaatcactcatctctatggactatgctattaaccagccggacgtacttagccagatccagcccgaaggggagcacaacactgaagaccaggcagggccagaggaatcggagattcccaccgacccctcagaggagcccggtatctccacgtctgatatcctatcttggataaagcaggaggaggagccccaagtcggtgcgccacccgaatcgaaagagtcagatgtttacaaatctacatacgccgacgaagaattggtgattaaggcagagggactggccagatccagtctgtgtcctgaagtccccgtgccgttttcaagcccaccagcagcggctaaggacgccttctctgatgtggcattcaagagccagcaaagtaccagcatgacaccctttggccgacccgcaacagacctccctgaagcatccgaaggccaggtgacattcactcaactggggagctacccgctcccaccccctgtgggagagcaggtgttcagctgccaccattgtggcaagaatctgtcccaggacatgcttctcacacatcagtgctcccacgctaccgagcaccctctaccgtgtgcccaatgtcctaaacactttaccccccaggccgatctgtccagtacttcgcaagatcacgccagcgagacacctccgacgtgcccccactgtgcgcgaacgtttacgcatccctcacgacttacttatcatctgcgcgtgcataactcaacggagagacccttcccatgccctgattgccccaagcgttttgctgaccaggcccgtctgactagccaccgacgcgcacacgcatccgagagaccctttcggtgcgcgcaatgcggacggtccttttctctgaagatctctttactgcttcaccagcggggtcacgcccaggaacggcctttctcttgccctcagtgtggaattgactttaatggccactctgctcttattcggcatcaaatgatccacacaggcgagcggccatacccttgtaccgactgcagcaagagctttatgaggaaagagcatctgctcaatcatcgcagactgcacacaggcgaaaggccattctcctgtccccactgcggcaagagctttataagaaagcaccacttgatgaagcatcagcggatacatactggcgaacggccttacccatgctcctactgcgggcgttcgttccggtataaacagaccttaaaagatcatctccgcagtggtcataacggcggatgcggaggcgatagcgacccttcgggacagcccccaaatccacccggtccactcataacagggttggagacgagcggcctgggcgtcaatacagaggggttggaaactaaccagtggtatggtgaaggctcaggcggtggtgtactgtag

SEQ ID NO: 25239 - DNA, 1416 bp, Artificial Sequence
  Description of Artificial Sequence: Synthetic coding sequence
atgaagggcaattacgaaagtttaatcagcatggattacgcaattaatcagcctgatgtcctgtcccaaattcagcccgaaggcgaacacaatacagaggatcaggctggtcccgaggaaagcgagatcccgaccgatccttctgaagaacccggaatcagcacaagcgacatactgtcctggatcaagcaggaagaggaacctcaggtaggcgcaccaccagaatctaaggagagcgatgtctataaaagcacctacgctgatgaagagctcgtgatcaaggcagaaggcctggccagatctagcctgtgtccagaggtgccagtgcccttctcgagcccccctgccgctgccaaagacgccttctctgacgtggcattcaagtcgcagcagtctacaagcatgactccctttggcagacccgctaccgacctacctgaagcatccgagggacaagtaacgttcacacagctcgggtcttatcctctaccacccccagttggcgagcaggtgtttagctgccaccattgtggtaaaaacctgagtcaagatatgctgctgacccaccaatgcagccatgctacagaacatcctctcccttgcgctcagtgccctaagcacttcaccccccaggcggacttaagttctacaagccaagaccacgcttcagagacacctcccacatgtccccattgtgccagaacattcactcatcccagcagactgacctatcatcttcgggtccacaacagcacggagagacccttcccctgtcccgattgtcctaaacgctttgcggatcaagcaaggctgacatcccacagacgggctcacgcatccgaacgcccatttcgctgtgcccagtgtggcaggagcttttcattaaaaattagcttgctgctgcaccagagggggcatgcgcaggagcggccattctcatgtcctcaatgtgggatcgactttaacggccattccgccctcatccggcaccagatgatacataccggcgagcggccatacccgtgcactgactgcagcaagtcattcatgcgcaaggagcatttgctgaaccaccgcaggttgcacaccggtgagcgaccttttagctgtccacattgtggcaaatcctttatcagaaaacatcacctgatgaaacaccagcgaattcacactggggagcgaccttacccatgttcctactgcggccgtagcttcagatacaagcagaccttaaaggatcatcttcgatcaggacacaacggtgggtgcgggggagattctgacccatcaggtcaaccacccaacccgccaggtccactgatcactggcctggaaacttcaggtctaggggtcaacacggaagggctcgagacgaaccaatggtatggagagggatctggcggtggcgtgctgtag

SEQ ID NO: 25240 - DNA, 1929 bp, Artificial Sequence
  Description of Artificial Sequence: Synthetic coding sequence
atggccgaagccgctccagctccaaccagcgagtgggattctgagtgcctgacctcactacagccactgcccctgccaacaccgcctgcagcgaatgaagctcacctccaaactgcagccatttccctttggactgtggtggccgctgtccaggctatcgagcgcaaggttgagattcatagtcgcaggctgctgcacttggaagggaggacaggtaccgccgaaaagaaactggcctcatgtgagaaaacagtgaccgaactgggaaaccaactggaaggaaagtgggcagtgttgggcactttgctgcaagagtacggattactgcagcgccgtctcgaaaatcttgaaaaccttctcaggaatcggaacttttggatcctccgcctccctcccggtataaaaggagacataccgaaagtaccagttgcctttgacgacgttagcatctatttttcgacgcccgagtgggagaagctcgaggagtggcaaaaggagctttataagaacattatgaaaggcaattatgagtctttgatcagcatggactacgcaatcaaccagcctgatgtgctcagccaaatccaaccggagggggagcataacaccgaggaccaggccggtccggaggagtcagaaatccccactgacccctcagaagagccaggcatctcaacgtccgatatattgagttggatcaagcaggaggaggagcctcaggttggagcccctccagagagtaaggaatccgatgtatacaagtctacatacgccgacgaagagctggtaattaaggcagaaggccttgcacggtcgtccctctgtcccgaagtgccagtcccgttcagctcaccccctgcagccgcaaaggatgcatttagcgacgtggctttcaagtcccagcagtccacctctatgactcccttcggcaggccagccacagatctccctgaagcatctgaaggccaagtcacgtttacccagttaggcagctatcccctgcctccgccagttggtgagcaggtatttagctgtcaccattgcggtaagaacctcagccaagatatgcttctcactcaccagtgcagtcatgccacagagcacccactgccatgtgcacaatgtccgaagcattttacaccccaagcggacttaagttccactagtcaggaccacgcatcagagaccccccctacctgccctcactgcgcacggaccttcactcacccctcccgcttaacttaccacctcagggtccataattccactgaaagaccatttccctgtccagattgtcccaagcgcttcgctgatcaggctaggctgacctcacaccggagggcacatgcgagcgagcggccattcagatgcgcccaatgcggtaggagcttttctctgaaaattagtttgttgctccaccagagaggccacgcacaggagcgtccgtttagttgtccccagtgtggcatcgacttcaatggacacagtgcgctcatccggcaccagatgatccacactggcgaacgcccttacccatgcaccgactgctcaaagtcctttatgaggaaggagcatcttctaaaccacaggaggctgcacacgggagagagacccttttcgtgccctcactgtggcaagtccttcatccggaagcatcacctgatgaagcaccagcgcattcacacaggtgaaagaccttatccatgttcctattgcggccgatcctttcgttataaacagactctgaaagatcatctccggagcggacacaatggaggttgtggcggtgactctgatccaagcggacagcccccaaatccccctgggcctctgataacagggttggagactagcggactaggtgtaaatacggaaggacttgagactaatcaatggtacggggaaggttccggaggcggagtgctgtag

SEQ ID NO: 25241 - DNA, 1416 bp, Artificial Sequence
  Description of Artificial Sequence: Synthetic coding sequence
atgaaggggaactacgaaagtctcatcagcatggattacgctatcaaccagccggacgtgctctctcagattcaacctgaaggagagcacaatactgaggatcaggctggtcctgaggaatcagaaatcccaacggatccttccgaagaacccggaatttctacttcagatattctatcatggattaaacaggaggaggaaccacaggtgggagccccaccagagagcaaagagtctgatgtgtacaaatccacctacgcggatgaggaactagtcattaaggcagagggtctggcacgttcttcgctctgccctgaggtgcctgtacctttttcatcgccaccagccgcagcgaaagacgctttttcagacgtggcttttaaatcacagcagtctactagcatgacaccctttggaagaccggcaaccgacctgcctgaagctagcgaagggcaggtcacattcacccaattgggttcctatcctttacccccaccagtgggggagcaggtgttttcctgccaccactgtgggaagaacctatcccaggatatgttactgacccaccagtgctcgcatgcaactgaacatcctctaccctgcgcgcagtgtcctaaacactttactcctcaggctgatctgagttctaccagccaagatcacgcttccgaaaccccacccacgtgcccccactgtgctagaaccttcacccatccctcacggctgacgtaccatctccgggtgcacaattctacagagagaccattcccttgccccgattgccccaaacggtttgcagaccaggccaggctgacatcacatcgacgcgctcatgcatccgagaggccttttcggtgcgcccagtgcggcaggtcgttctccctgaaaattagtctgctgctgcatcaacggggtcacgcgcaagagcgcccattttcttgcccccaatgcggcatcgacttcaacggacatagtgcactgatccgccaccagatgatccacacaggcgaaaggccgtacccctgtacggactgttctaagtccttcatgcggaaggagcatctgctcaaccataggcgactccacacaggagagagaccgttctcctgccctcattgcggcaagagctttatcaggaaacatcacctgatgaaacaccagagaatccacactggtgagcgcccatacccttgtagttattgcggaaggtcgtttcgatataaacagaccctcaaagatcacctgaggagcgggcacaatggtggttgcggcggagatagcgatccttccggccaacctcctaatcccccaggtcccctaataaccgggctggagacttctggcctgggcgtcaatactgaaggcctggagaccaatcagtggtacggagagggcagtggtgggggagttttgtag

SEQ ID NO: 25242 - DNA, 1416 bp, Artificial Sequence
  Description of Artificial Sequence: Synthetic coding sequence
atgaagggtaattacgagtctttgatttcaatggattacgcaattaaccagcccgatgttctatctcagatccagcccgagggcgagcataacacagaggaccaggccggacccgaggaatccgagataccaaccgatcccagcgaagaacctgggatatctacgtccgatatcctctcctggatcaagcaggaagaggaaccacaggtaggcgctccacctgagagcaaagaatctgatgtctataaatctacatatgcagacgaagagttagtaatcaaggctgagggactcgctaggtcgtctctatgtcccgaagtgcccgtgcccttcagtagcccccctgccgcagccaaggatgccttttccgacgtggccttcaagtcacagcagtcgacgtcgatgacaccattcggacgccctgcgacagatctgcccgaggcctctgaggggcaggtgacctttacccaactgggctcatacccacttccccctcccgtaggcgagcaagtcttttcctgccaccattgtggaaaaaacctgtcccaagatatgctcctgactcaccagtgctcgcatgccacagagcaccctctcccttgcgcgcagtgtcccaaacactttacccctcaggcagatctgtcaagtacctcacaggatcacgcttcggagacaccccctacatgtccccactgcgccaggacgttcacccaccccagccgtctgacctaccatctccgggtgcataactcaacagagcggccatttccatgccccgactgccccaagcgttttgccgatcaggcccgtttgactagccaccggcgtgcacacgccagtgaaagaccattccggtgcgcgcagtgcgggaggagcttttccctgaagatttccctgttactacaccagcgtgggcatgcgcaggaaagacctttttcgtgtcctcagtgtggtatcgattttaacggacacagcgcccttattagacaccagatgattcacacaggcgagcgcccttacccctgcaccgattgttccaagtctttcatgcgcaaagaacacttgttgaatcacagaaggctgcacaccggtgagcggccattctcctgccctcattgtggtaagagctttatcagaaagcaccatctgatgaagcatcagcgaatccatacgggagagcgaccttacccctgttcctactgcggcaggagttttagatacaagcagacactgaaagatcacctgcggagcgggcacaacggagggtgtggtggtgatagcgatccctccggccagcccccaaatccccctggaccactgattaccgggctggagacctcagggcttggggtgaacactgaaggcctagagacaaatcagtggtatggggaggggtctgggggaggggtgctgtag

SEQ ID NO: 25243 - DNA, 1944 bp, Artificial Sequence
  Description of Artificial Sequence: Synthetic coding sequence
atgataggcttgatacagggaaggagactggcagagcaaacaagcgagtgggatagtgagtgcctgaccagcttgcagcctctgcccctccccaccccaccagcagccaatgaagcccatctgcagactgcagcaatcagtctctggacagttgtagctgcagtccaagcaatcgagcggaaggtggagatccacagccggaggctgctgcacctggaaggtcgtaccgggactgctgagaaaaagcttgctagctgcgaaaaaacagtaacagaactgggaaaccagcttgagggcaaatgggcagtgctggggacactgttacaggaatacggactacttcaacggaggctcgagaacctggagaacctgttacgcaatcggaacttttggattctccggttgccacccggaatcaaaggcgatatccctaaagtgcccgtcgcctttgacgacgtctccatctacttctccactccagagtgggaaaagctggaagaatggcagaaggaattgtataagaatattatgaaagggaattacgaaagcttaatctctatggactacgcgataaatcagccagacgttctatcccagatccagcccgagggagagcacaacaccgaggaccaggcagggccagaagagtccgaaattcccactgaccctagcgaggaaccgggtatttccactagtgatatcctgtcatggataaagcaggaagaggagcctcaagtgggagctccacctgaatctaaggaatcagatgtgtacaaatctacctatgctgatgaggagctggttatcaaagccgaaggtctggcccgatcatccttatgtcccgaagtccccgtgcccttctcatcccctccagccgctgcaaaggatgccttctctgatgtggccttcaagagccagcaatcaacctctatgacccctttcgggaggcctgcaaccgatttgcctgaagcatcagaagggcaagtgacctttacacaattgggctcctaccccctccctccgcctgtgggcgaacaggttttttcttgtcaccattgcgggaaaaacctgtcccaggacatgctattgacccatcagtgttcacacgccactgaacaccccctcccatgtgctcagtgccccaaacactttacaccccaagctgatctcagctcaacgtcccaggatcacgcctccgaaacaccacccacttgtcctcactgtgcgaggacctttactcaccctagtcgcctgacctatcatctcagagtgcataactctactgaacgaccgttcccatgcccggactgtcctaaaaggttcgccgatcaggcccgactcactagccatagacgtgctcacgcttcagaacggccttttaggtgtgcccagtgcggacggagcttttcactgaagatatccctactgcttcatcaacgaggccatgctcaggagagaccatttagttgcccacagtgcggcatcgactttaacggccacagtgcgttgatccgccaccagatgatacataccggggaaaggccctacccctgcaccgactgttctaagtcatttatgcggaaagaacatcttctgaaccacaggcggctacacactggcgaacgccctttcagctgtccacattgcgggaagagcttcatccggaaacaccacctgatgaaacaccagcggatacataccggggaacgaccatacccttgttcatactgcggcaggtctttcagatataagcaaacgttgaaggatcatctcagatccgggcataacggagggtgcggtggtgacagtgacccgtccggccagccccctaatccccctggaccgttaatcactgggctggagacctcaggcctaggcgttaacaccgaggggctggaaaccaaccagtggtatggtgagggaagcggtgggggtgtgctgtag

SEQ ID NO: 25244 - DNA, 6746 bp, Artificial Sequence
  Description of Artificial Sequence: Synthetic coding sequence
atgatggactctgaaaacaaacctgagaacgacgaagacgagaagatcaacaaagaagcacaggatctgaccaagctgagcagtcacaatgaagatggtgggcctgtgtctgacgtaatcgcatcctttccggagaattccatgggaaagagggggtttagtgaatcctccaactctgactctgtggtgatcggagaagatcggaacaaacatgctagcaagcgcaggaagctggatgaagccgaacccctcaagtccggaaagcaagggatttgtagactggaaacctccgagagctccgtgacagagggcggtattgccctggacgaaaccgggaaagagacgtttttgtcagactgtacagttggaggaacctgcctccccaatgccctctctccaagttgcaatttctctactatagacgttgtcagtctcaagacagatacagagaagacctccgcccaggaaatggtgagtctggacctggaacgggagagccccttcccccctaaggagattagcgtatcctgtaccatagggaacgtggacaccgtgctgaagtgcagcatttgcggacatttattctctagttgttcggatctggagaagcatgcagagagtcatatgcagcagcctaaagagcacacatgctgccactgctctcacaaagccgagagctcttctgccctccatatgcacatcaagcaggcccatggccctcaaaaagtattttcatgcgatctttgtgggtttcagtgttcagaagagaatctactaaatgctcactacctgggaaaaacccaccttcgaaggcagaacctggctgcaaggggtggattcgtgcaaatcttaactaagcagccatttcccaagaaatcccgcactatggcaaccaagaatgtgcacagtaagccaagaacttcaaagtcaatagctaagaactcggatagcaagggcctccgcaatgtcggctcaacctttaaagactttcgaggcagtatttcaaaacaatccggctccagttccgagctgctggtcgagatgatgccatcaagaaatacactcagccaggaggttgaaattgttgaagagcatgtcacgagcctggggcttgcccagaatccggagaatcaatcccgaaagctggacaccctggtgactagtgaagggctgctcgagaagctcgaatctacaaagaacactttgcaggcggcacatgggaatagcgtcacttctcgtccgaggcctgaacgcaacatcttagtccttgggaacagcttccggcgaagaagctcaacgtttactctcaaggggcaagcaaagaagcggtttaacctcctaggaattaagagggggaccagtgaaactcagagaatgtatatgaaacacctccggacccaaatgaagacgcacgatgcagagtccgtgcttaaacacttggaggcatgttcttctgttcagagagtttgtgttaccacgagcgaaacacaggaagccgagcagggtcagggctctgcgcgtcctccagactccgggctgcactcactgacggtgaagcccgcaagcggttctcagactctgtgtgcctgtactgactgtggccaggtggcaactaatcggaccgacctcgagatccacgtgaaaagatgccacgcgagggagatgaaattttactgtaggacctgtgacttttcctccatgtcccgtcgcgatctcgacgaacacttgcactccaaccaacatcagcagaccgctagcgttctaagctgtcagtgttgctctttcataagcctggatgagattaacctccgagatcatatgaaagagaaacacaatatgcacttcctatgcacaccttgtaaccttttttttctcagtgagaaggacgtggaggaacataaggcaaccgagaaacatatcaactcactggtgcaacccaaaacccttcagtcatcgaatagtgacctggtcctgcaaacactgcctttgagcactctagagtcagaaaatgccaaggagagcatggatgactcaggaaaagcttctcaggaagaacccctgaagtcacgtgtgtcccatgggaatgaggttcgccactcgtccaaaccccagtttcagtgtaaaaagtgtttctataaaacaagaagcagtacagtgctcacgaggcatatcaagctgcgccatggccaggactaccattttctgtgtaaagcctgcaatctgtacagcctatctaaagagggtatggaaaagcatatcaagcgaagcaagcatctggagaacgctaagaaaaataacattgggctgtcattcgaggagtgcatagagagagtctgtattggcgcaaatgataaaaaagaggagttcgatgtgagcggcaatgggaggatcgagggccatattggggtacagctacaagagcactcttacctcgaaaaggggatgttggcatctgaagagctgagccagtccgggggttccaccaaagacgacgaactcgctagcactaccactccgaagcggggacggccaaaggggaacatatcccgcacctgctcccattgtgggctactggcctccagcatcaccaatctgaccgtgcatattcgcagaaaacactctcaccagtactcttacttgtgtaaagtctgtaaatactacaccgtgaccaaaggcgatatggagagacactgcgccactaagaaacacaaaggtcgggtagagattgaagcgtcaggtaaacattcaagcgacattatagtcggaccggaaggcggtagccttgaggcaggaaaaaagaacgccggtagcgccgttacaatgtcagacgagcatgccaataagcctgctgagtctcctacatctgtgttggaaaagccggatcggggtaattcaattgaggccgaggtggagaatgtgtttcactcactagatggggaagtaaatagccaccttctggacaagaaagagcaaatcagctccgaacccgaagacttcgctcagcctggcgacgtctattcacaaagagacgtgactggcacaggtgaaaacaagtgtctacactgtgaattttccgctcattcttccgcatctctggaactgcatgtcaaacgaaagcacaccaaggaatttgaattttactgtatggcttgcgactattatgccgtgactcgacgcgaaatgaccaggcacgcagccactgaaaagcacaaaatgaaaaggcagtcatacttaaactcagctaacgtagaggcaggctcagctgacatgtcaaagaatatcatcatgcctgaggaggaacatcaacagaacagcgaggaattccagattatctcaggccaaccgagcgacacgctaaagagccgcaatgctgctgattgctctatactcaatgagaacaccaatcttgacatgtccaaagtgttgtgtgccgctgactctgtggaagtcgagactgaagaggaatctaacttcaacgaggatcatagcttctgcgaaacatttcagcaagcacctgtgaaggataaagtaagaaaaccggaggagatgatgtccctgacaatgtcctctaattatggaagtccctctagatttcagaatgagaactcaggaagctccgcccttaactgcgaaaccgctaaaaagaaccatgaaatctctaatgatgctggcgagttacgggttcattgcgagggcgaaggtggtaacgctggagacgggggaggagttgtcccccacaggcacctgtgtcctgtgactctggatggcgaaaggagcgctgagtcacccgttctggtggtgactcgcattaccagagagcagggcaacctggagagtggaggacagaatagagtggcacgagggcacgggttggaagatctgaagggcgttcaggaggatcccgtccttggcaacaaggaaatcctcatgaatagtcagcatgagaccgagtttattctggaggaggatgggccagctagcgactcaactgtcgagtcctctgatgtttacgagacaatcatttccatcgacgataagggtcaggcgatgtactcattcggcaggtttgattcgagtattatcaggatcaaaaatcctgaagacggcgagcttatcgaccaatcggaggagggattgatcgcaaccggagtccggattagcgaactccctctgaaagactgtgctcagggggtgaaaaaaaaaaaatcagaaggctcttcaatcggggaatctacgcggattcggtgtgatgattgtgggtttctagcagacggtttgtccggcttaaatgtgcacatagccatgaaacaccctacgaaggagaagcactttcactgcttgctctgtggaaagagtttctacacagagagcaatctccatcaacacctcgcctcggctggccatatgagaaacgaacaggcatctgtggaggagctccccgagggaggtgccacatttaagtgcgtcaaatgcaccgagccattcgatagcgaacagaatttgttcttacatataaaaggccagcatgaagaactgctgcgggaggttaacaaatatattgtggaagatacagaacagattaatagggaaagggaagagaatcaaggaaacgtctgcaagtactgcggcaagatgtgcagatccagtaatagtatggccttcctggcccatatcaggacacatacgggtagcaaacccttcaaatgtaagatttgtcacttcgcaacagcccagctgggggacgctcgtaaccacgtgaaaaggcacctggggatgcgtgagtataagtgtcacgtgtgcggggtagcattcgtgatgaaaaagcacttgaacacacatctcttgggcaaacatggagtcggcacccctaaggaacggaagtttacatgccatctctgtgataggagcttcacggaaaaatgggcacttaataaccatatgaaactacacacgggcgagaagccatttaaatgtacctggcccacctgccattactcctttctgactgcatccgccatgaaggatcactaccgaacccatacaggcgaaaagtcgttcttatgcgacctgtgtggattcgccggtgggacccgtcacgccctgactaaacaccgccgtcaacatacaggagagaagccatttaagtgtgacgagtgcaacttcgcaagcacgacacagagtcatcttactaggcataagcgtgtgcatactggtgagaaaccatatcgttgcccctggtgtgactacaggtccaactgtgccgagaacattaggaagcatatactccacaccggaaagcatgaaggtgttaagatgtacaattgtccaaaatgtgattatggcaccaacgtccctgttgagtttagaaatcacctgaaggagcaacatcccgatattgaaaatccggacctggcctatttgcatgcaggaatcgtctctaaatcatatgagtgcagactgaaggggcagggagccacctttgttgaaaccgatagtccatttacggccgcagccctagctgaagaaccactggttaaggagaaaccactccggtctagtcgcaggcctgcccctcccccagagcaggtgcagcaagtaatcatatttcaaggctacgacggggagtttgccctggatccttccgtggaggagactgcagccgcaactctccaaactctggcaatggcagggcaagtggctagagtagtgcacatcactgaagacgggcaggtcatcgctacatctcaatcgggggcacacgtcgggtccgtggtgccgggtcctatactgcccgaacagctggcagatggagccactcaggtggttgtggtgggcggtagtatggaggggcacggtatggatgagagtctgtcacctggtggtgccgttattcagcaggtgacaaagcaggaaatcctaaatctgagcgaggccggtgtggcccctcccgaagctagcagtgctcttgacgcccttctgtgtgctgtcacggagctaggggaagtcgaaggacgcgcaggtttagaagaacaggggcgtccaggagcaaaggatgtgctcattcaactcccgggacaggaagtgtcacatgtggcagccgaccccgaagctcctgagatccagatgtttccccaggctcaggaatcccccgcagctgtagaggtgctgacacaggtggtgcatccgagtgctgcaatggcctcccaggagagagcgcaggtcgccttcaaaaagatggtgcaaggggtgctgcagttcgccgtgtgcgataccgccgcagcgggtcaactagtgaaggacggcgtgacccaggttgtggtctcggaagaaggggcagtacatatggtggcgggtgagggggctcagattatcatgcaggaagcccagggggaacacatggatctcgtcgaatcagacggcgagataagtcagatcatcgtgactgaggaactcgtccaggcaatggtccaggagtctagtggcggattttccgagggaacaactcattacatcctaactgaactgcctcccggagtccaggacgagcccggactgtactcacacactgttttggaaacagctgattcccaggagttacttcaggccggtgcaaccctgggtaccgaggccggagcaccaagccgagctgagcagctggcctccgttgtgatttatacacaggagggctccagtgctgctgcagcaatccagagtcagagggagtcttctgagctgcaggaagccta

SEQ ID NO: 25245 - DNA, 4983 bp, Artificial Sequence
  Description of Artificial Sequence: Synthetic coding sequence
atgatggactctgaaaacaagcccgagaatgatgaggatgagaaaataaataaggaggctcaggatctgactaagctctcatctcacaacgaggatggtggcccagttagcgacgtgatcgcgtctttccccgaaaattctatggggaaaagaggtttctctgagtctagtaactctgacagcgtcgtgatcggcgaggatagaaacaaacatgcatctaagaggaggaaactcgatgaggcagagcctctgaagagcggaaaacagggaatctgtaggttggaaacatcagagagcagcgtcactgagggtggcatcgccctggatgaaactggcaaagagactttcctgagcgactgtacagttggtggtacttgcctgccaaacgccctatcccctagctgtaatttcagcacaattgacgttgtgagcctgaaaaccgataccgagaaaactagtgcccaggagatggtcagtctggacttagaaagggagtccccttttcccccaaaagagatctccgtatcttgcacaatcggcaatgtggacaccgtgctgaagtgctcaatatgtgggcacttattcagcagctgttctgatctcgaaaagcatgctgaatcccacatgcagcagcctaaggaacatacctgttgccactgctcgcataaagcagaatcttccagtgccttgcacatgcacatcaaacaagcccacgggcctcagaaagtgttctcctgcgatctgtgtggatttcaatgctccgaagagaacctcttgaacgcccactacttgggtaaaacgcacctgcgtcgtcagaacctcgcagctagaggaggttttgtgcaaattttgaccaagcagcctttcccaaagaagagcaggaccatggccactaaaaacgtacatagcaaacccaggacttcaaaaagcatcgcgaaaaacagtgactccaaaggtctgaggaacgtggggagcacgtttaaggattttcggggaagcatctccaaacaatccggctctagcagcgagctgctcgtggagatgatgccaagcaggaacacactgtcacaggaagttgaaatcgtggaggaacatgtgacatctctgggtctcgcacagaatccagagaatcagtcaagaaaacttgacactttggttacttccgaaggcctgttggaaaagctcgagtccactaagaacactttgcaggcggcacacggaaacagcgtgacctctcgccctaggcccgagcgcaatattctcgtattgggcaattcatttaggcgtcgcagttctaccttcacactgaagggccaggcgaaaaagcgcttcaatcttctgggaataaagagaggaacgtccgagactcagagaatgtacatgaaacacctccgaacccagatgaagacccacgatgcggagagtgtgctgaagcatctcgaggcttgttcgtcagtacagagggtgtgcgtcactacaagcgagacccaggaggccgagcaagggcagggcagcgccaggcctccagatagcgggttgcattccttaaccgttaaacctgcttccggaagccaaacactctgcgcctgcaccgactgtggacaggtggcaacaaatagaaccgacttagagatccacgtcaagcgatgccatgcaagagaaatgaaattttattgtcgcacctgcgatttttcctctatgtcccgacgtgatttagatgagcacttacacagtaaccaacaccagcagaccgccagcgtgctgagctgccagtgctgcagcttcatctcactcgacgagattaatctgcgcgatcacatgaaagaaaagcacaatatgcacttcctgtgcaccccttgtaacttgtttttcttgagcgaaaaggacgtggaagaacataaggcaaccgagaaacacatcaattcacttgtgcagccaaagactcttcagtcctcaaactctgacctggtgcttcagacactcccgctatcaactctggagtccgaaaatgctaaggagtcaatggatgactctggtaaagcaagccaagaggagccactgaaaagtagagtgtcacacgggaatgaggtgcggcacagcagcaaaccacagtttcagtgcaagaaatgtttttacaaaaccaggtccagtaccgtgctcacacgacacataaaattgcgacacggtcaggactatcacttcctctgcaaggcttgcaacctctattccctgagcaaagagggtatggaaaaacatatcaaacggtccaaacatttagagaatgccaaaaagaataacattggattaagctttgaggaatgtattgagagggtttgcatcggtgcaaacgataagaaggaggaatttgacgtcagcggaaacggccgaattgaaggccatatcggagttcagctgcaggaacacagctacctggaaaagggcatgctcgcttctgaggaactcagccaatccgggggatccacaaaagacgacgaattggctagcacaacgacgccaaaaagggggagacctaaaggaaacataagcagaacctgctctcactgtggcttattggcgagctctataacgaatctcaccgtccacattcggagaaagcacagtcatcaatattcctacttatgcaaggtgtgtaagtactacacagtgacaaagggggatatggagaggcattgtgcgactaaaaagcacaagggtagagtggagatagaggcaagcggtaagcacagctccgacataattgtcggtccagaggggggatcccttgaggcaggcaagaagaatgccggttcagccgttaccatgagcgacgaacatgctaataagcctgctgagagtccaacttccgtcctggagaaaccagaccggggaaattctattgaggctgaggtagagaacgtgtttcatagtctggacggcgaggtcaactcacacctgctggataaaaaagagcagatatcttcggaacccgaggactttgctcaacctggagatgtgtattctcaacgggacgtgacggggaccggggaaaacaagtgcctgcattgtgagttcagcgcccactcttccgcctctttagagttgcacgtgaaaaggaaacataccaaagaatttgagttctactgcatggcatgtgattattatgcagtgacaaggagggagatgacacgacacgctgcgacggagaaacacaagatgaagcgccaatcttacctaaactccgccaacgtcgaggccggttcagctgatatgtccaaaaatatcataatgcctgaggaggagcaccagcagaattcagaagaatttcagatcatcagcggacagccaagcgatacgctaaaatctaggaacgcagccgactgcagcatcttgaacgaaaacacgaatttagacatgtctaaggtgctgtgcgccgctgactctgtggaggtggagaccgaggaggaatcaaactttaacgaggatcactccttctgtgaaacctttcagcaggcccctgtgaaggacaaagtccgaaagccagaagaaatgatgagcctcactatgagctccaactatggttcgccttcccggttccagaacgagaattcaggctcctctgcgttgaattgcgaaaccgcaaagaagaatcacgaaatctctaatgatgccggagaattgagggtccactgcgagggcgagggcggtaatgcgggagatgggggtggtgtcgtgccccaccggcacctgtgccctgtgactcttgacggcgagcgatccgcggaaagccctgtcttggttgtcactaggataacccgggagcaagggaaccttgagtctgggggtcaaaaccgggtggcacgtggacatggactggaggatctgaagggcgtacaggaagaccccgtcctaggaaacaaagagattctgatgaactcacagcatgagactgagtttattctggaagaggacgggccagccagtgattcaactgtcgaatccagcgacgtctatgagactataatctccattgatgataaaggccaggcaatgtatagctttggaaggtttgattcctccatcattcgcataaaaaaccccgaagatggcgagttgatcgaccaatctgaagaaggtttgatcgccactggcgtgcgaatctcggagcttcccctgaaggattgcgctcagggtgttaaaaaaaaaaagtccgaggggagctctattggggagtccacccgcatccggtgcgacgactgcggttttctagcagatggactatcagggctgaatgtccatatcgctatgaagcaccctaccaaagagaaacactttcactgtcttttgtgtgggaagtcgttctacacagaaagtaatctccatcagcatctggctagtgccggacacatgaggaatgagcaggccagcgttgaagagctgccagagggcggagccacattcaagtgcgtgaagtgtacagagccctttgactcagagcaaaatctttttctgcacattaaaggccagcacgaggaattgctcagggaggtgaacaagtacatagtagaggacaccgagcagatcaatcgagagcgggaagaaaatcaaggtaatgtgtgcaaatactgtgggaagatgtgcaggtccagcaacagcatggccttcttggctcacattcgtacacacaccgggagcaagccctttaaatgtaagatttgccacttcgctacagcacaactgggcgatgctcgcaaccacgtcaaaagacacctgggaatgagagagtacaaatgccacgtgtgcggtgtcgcattcgtgatgaagaagcatctgaacacacacctgctaggaaaacacggggtggggacccctaaggagagagtgaaggttgcttacaggaaaataggaacactgcccggaatccagaacaataggaatgcgagtagcgctagcgaggcccagagcctttgtgaacacttttcctag

SEQ ID NO: 25246 - DNA, 5447 bp, Artificial Sequence
  Description of Artificial Sequence: Synthetic coding sequence
atgatggactctgagaataagcccgagaatgatgaagacgaaaagatcaataaagaggctcaggacctaaccaagctgtcttcccacaatgaagatggcggtcccgtttctgatgttatcgcctcatttccagagaactccatgggaaagaggggcttcagcgagagctctaattccgatagtgtggtgatcggagaagaccgaaataaacacgcctctaagagacgcaaactggacgaggccgagccattaaagagcggcaaacagggtatttgtcggctagagactagcgagtcctctgtgacagaggggggaatcgctttggatgagactggtaaggagactttcctttccgattgtaccgtgggtggcacttgcctacccaacgcactcagcccctcttgtaacttctccacaatcgacgtggtgtctctgaaaacggatacagaaaagacgagcgcccaggaaatggtaagcctggaccttgagagggaaagcccattcccacccaaagaaatttcagtctcctgcaccatcggaaatgttgatacagtcctcaagtgctcgatttgcggtcacttgttttctagctgctcagatctggaaaagcacgccgaatcccacatgcaacaaccaaaagagcacacatgctgtcactgctcccataaggctgaatccagcagcgccctccacatgcacattaaacaagctcatggacctcagaaggtgttcagttgtgacctttgcggattccagtgttccgaggagaatctgctgaatgctcattacctcggaaaaactcaccttcggaggcagaacctggccgcacgtggagggttcgtacaaattctgacaaagcagcctttcccaaagaagagtcgtactatggccacaaagaacgtacattctaaacccagaacctcaaagtctattgcaaagaattctgacagtaagggcttaagaaacgtgggcagcacttttaaggactttagaggatccattagtaaacagtcaggtagtagctcagagcttttagttgagatgatgcccagtcggaataccctatcccaggaagttgaaattgtcgaagagcacgttaccagtcttggactcgcacagaatcctgagaatcaaagtaggaagctggataccctggttacctcagaagggcttctggaaaaactggagtccacgaaaaacacgctacaagccgctcacggcaatagtgtcacctcccggcctaggccagaacggaatatcctcgtcctagggaacagctttagacgtcggtcctccactttcaccctgaagggccaggccaagaaacgattcaatctcctaggcataaagagaggcacttctgaaacccagcgaatgtacatgaagcatctgaggactcagatgaagacacatgatgcggagtctgtccttaagcacttggaagcatgttcaagcgtgcaacgcgtctgcgtgacaacgtctgagacccaagaggcagaacagggccagggatccgctagacctccagacagtggattacacagtctgaccgtcaaaccagcatccggcagccagaccctctgtgcttgtaccgattgcggccaagtcgctaccaataggacggacctcgagattcacgtgaagcggtgtcacgcccgagagatgaagttctattgcaggacctgcgacttttccagcatgagtcggagggacttagatgaacatcttcacagcaatcagcatcagcagactgcgtctgtgctgagctgtcagtgttgttcttttatctccctggacgagatcaacctgcgcgaccatatgaaggaaaagcacaatatgcacttcctgtgcacgccgtgcaacctattcttcctgagtgagaaggatgttgaggaacataaagcaactgagaagcacatcaacagtcttgtgcagccaaagaccctacagtccagtaatagtgatttggtgctacagactctgccgctgagtaccctagagtctgaaaatgccaaggagtcaatggatgattcaggcaaggcctcacaagaagagcctttaaaatcccgcgtgagccatggcaacgaagttagacactccagcaaaccacagtttcagtgtaaaaagtgcttttacaagacccggagctctaccgtacttactaggcacatcaagctgcgacacggtcaggactatcattttctctgcaaggcctgcaacctatactccctcagtaaggaaggcatggagaaacatataaagcgtagcaaacatctggaaaatgctaaaaaaaacaatatcggcctcagttttgaggagtgtatcgagcgtgtctgcattggcgcaaatgacaagaaggaagagttcgacgttagtggaaacgggaggatcgaaggccacatcggagtgcaactgcaggaacattcttatctggaaaagggcatgttggcctcagaagaattgtcccaatcagggggatccacaaaggacgatgagctggcttctaccacaacccctaaacgaggtagacccaaggggaatatctctagaacctgtagccattgtggcctcctggcctctagcattaccaatctgacagtccacatacgcaggaagcactcccatcagtacagctacctgtgcaaagtttgtaagtattataccgttaccaaaggtgatatggagagacactgtgcaactaagaaacacaagggtcgagtggaaatcgaagcaagtggtaaacactcttctgatatcatcgtgggacctgaaggcggatctctcgaggctggcaagaaaaacgctggaagcgcagtgacaatgtcggacgaacatgccaacaaacccgctgagtctcctacgagcgtgttagaaaagcctgaccgtggtaacagtattgaagcagaagtggagaacgtgttccactccctggacggggaggttaacagtcatctcctggataagaaggagcagatctcatcagagcctgaggacttcgcccagcctggtgacgtttattctcagcgcgacgtgaccggtaccggcgaaaacaaatgcctgcactgcgaattttctgcccacagtagtgcttcgctggagctgcatgtgaagagaaaacatactaaggaattcgagttctactgtatggcgtgtgattactacgctgtaacgaggcgggaaatgacgaggcacgcggctacagagaagcataagatgaaaagacagtcttatctgaacagtgcaaatgtggaggcagggtcagcagacatgtccaaaaatattattatgcccgaggaggagcaccagcagaactctgaagagtttcagattatcagtgggcagccttcagataccctgaaaagcagaaacgccgctgattgtagcatactgaatgaaaatactaacctagatatgagcaaagtcttgtgcgcagcagattctgtagaagtagaaacagaagaggagtccaatttcaacgaagaccattccttctgtgaaacattccaacaagcaccagttaaagataaggtacggaagcctgaggagatgatgtccttgaccatgtcctccaattatggcagcccgtctaggttccaaaacgaaaactctggatcatcagcattgaactgcgagacagctaaaaaaaaccatgagatttctaacgacgctggggaactcagggtgcactgtgagggagagggaggcaatgccggagatgggggaggagtggtaccccacagacacctctgccccgttacactcgatggggagaggagtgcagagtctccagtcctcgtagtgactcgcatcactcgtgagcagggcaaccttgaaagcgggggacagaaccgagtggcccgtggacacgggcttgaggatttaaaaggtgtccaggaggacccggtgcttggaaataaggaaattctgatgaactctcagcatgagaccgaatttatcctggaagaggacgggccagcctcagacagtacggtggagtccagtgatgtgtacgaaaccattatctcaattgatgataaaggccaggccatgtattcattcgggaggtttgatagctctataattaggattaagaatcccgaagacggggaactgatcgaccaatcagaggaaggcctgatagcaacaggagtgaggattagcgaactcccccttaaggattgtgcccagggagtcaaaaaaaaaaaatcagagggatccagtatcggtgagtccacacgcatccgctgtgacgactgcggcttcctggcagacggtctgtcggggcttaatgtccatattgccatgaagcatccgacaaaagaaaagcacttccattgccttctctgtgggaaaagtttctatactgaaagcaatctgcatcaacacttagcttcagccggtcacatgcgcaatgagcaggcctctgtggaggaactacccgaggggggtgctacgtttaagtgtgtcaaatgcacggaacccttcgactcagagcagaacctcttcctgcatatcaagggccagcacgaagagctgctacgggaagtcaataagtatattgtggaagacaccgagcagattaacagagagcgtgaggagaaccagggaaacgtctgcaagtactgtggcaaaatgtgcaggtcctcaaacagtatggcgttcctggctcacattaggacccatactggaagcaaacctttcaagtgtaaaatatgccactttgcaactgcccagctgggggatgcccgaaatcacgtaaagcgacacctgggtatgcgcgaatataagtgtcatgtttgtggtgtggccttcgtcatgaaaaaacacctcaatactcacctactcggcaaacatggagtcggcacaccaaaagagcgcaagtttacatgtcacctttgtgatagatcatttacagagaagtgggctttgaacaaccacatgaagctgcacacaggggagaagccatttaagtgtacctggcccacgtgccattactcgtttctgactgcttccgctatgaaggatcattatagaacacacaccggtgagaagagtttcctttgtgacctgtgcgggttcgctggaggtactcgccacgctctcactaaacacaggagacaacacacaggggaaaaacctttcaaatgcgatgagtgcaactttgcgtctactacacagtcacatttaactcggcacaagcgggtgcacactggtgagaagccctatagatgtccgtggtgcgattaccgctcaaactgtgctgagaatatcaggaagcacatcctacacacaggtaagcatgaaggcgtcaagatgtacaattgccccaaatgcgattatgggaccaatgtccccgtcgagttcaggaatcatctgaaggagcagcaccccgacattgagaacccggatcttgcttacttacacgccggtaaggggcaaaaactgta

SEQ ID NO: 25247 - DNA, 4983 bp, Artificial Sequence
  Description of Artificial Sequence: Synthetic coding sequence
atgatggacagtgaaaacaaacctgagaacgacgaagacgaaaagatcaacaaagaggctcaggacctcactaaactgagctcccataacgaggacggtgggccagtctcagacgtgatagcatctttccctgagaactccatgggaaagcgaggattttcagagtcctctaatagcgatagcgtggttataggtgaagataggaacaaacatgcatcaaagcgccgaaagctggatgaagctgaacctctgaaaagtggaaagcaggggatctgtcggctggagaccagtgagagcagcgtgaccgaggggggtatagccttggacgagaccgggaaggagactttcctctcagactgtacggtgggcggaacttgtttgcccaacgctctgtcaccctcctgtaatttttccacgatcgacgtggtatccctcaagactgataccgagaagacatctgcacaagaaatggtgtccctcgatttggagagagaatcacccttccctccgaaagaaatctctgtatcttgcactattggaaacgtggacacggtgcttaagtgctcaatctgcggccacctgttttcaagctgttccgatttggagaaacacgccgagagccatatgcagcagcccaaggaacatacgtgttgccactgtagccacaaagctgagtccagctccgctctccacatgcacataaagcaagctcatggacctcagaaggttttttcctgtgacctgtgcggttttcagtgcagtgaagagaatttgctcaatgcgcactatctcggtaagactcatctgagacggcagaacctggccgctaggggagggttcgtccagatactgactaagcagcctttccccaagaaaagtagaactatggcaacaaaaaatgtccatagcaagccccgaacatcaaaatctatcgccaagaatagtgattctaagggcctgcgaaacgtgggatccactttcaaagattttaggggaagcatctccaagcagagtggaagcagctctgaactactagtagaaatgatgccttctagaaacactctgtctcaggaagttgaaatagtggaagagcacgtcaccagtctgggcctggcccagaacccggaaaatcagagccgaaaactggacacgctggtgacttcagaagggctcctcgaaaagctggaaagtactaagaacactcttcaggcagctcacggcaattccgtgacttcccgtcctcggcctgagagaaatatcctcgtgttagggaacagcttccgcagaagaagcagtacatttacgctcaagggtcaggccaaaaagaggttcaatctgctcggaatcaaacggggaacctctgaaacccagaggatgtatatgaaacatctgaggactcagatgaaaacccacgatgcagagagcgtcttgaaacacttggaggcctgtagctcagtccagcgagtctgtgtaacaacttcggagactcaggaggcggagcaggggcaaggaagtgccaggccacccgacagcggtcttcatagcctgacagtgaaacccgctagtggcagccagacactgtgtgcctgcactgactgtggccaggtcgcaacgaatcggacagaccttgaaatccatgtaaaacgatgtcacgcccgagagatgaagttctattgtcggacctgcgatttttcaagtatgtctcggcgagatctagatgagcatctccactcaaaccagcaccagcagaccgcaagtgtgttatcgtgtcaatgttgctcattcattagtcttgacgagataaacctccgggatcacatgaaagagaaacacaatatgcacttcttgtgtacgccctgtaatctattctttctgtcagagaaggacgtggaggagcataaagctacagaaaagcacattaacagcttagtgcagcctaaaacactgcagagcagcaactccgacctggtcctgcagactctcccgttgtcaaccttagagagcgaaaatgcgaaagaatcgatggatgacagtggtaaggccagccaggaggagcctttaaagtccagagtatctcacggaaatgaagtcaggcatagcagtaagccacagttccaatgtaaaaagtgcttctacaagacccgcagtagcactgtgctgacgcggcatattaaactcaggcacggtcaggattaccactttctgtgcaaggcatgtaacttatatagcctcagcaaggaagggatggagaagcacatcaagcggtccaaacacctggaaaacgcaaagaaaaataacattgggttatcatttgaagagtgtatcgagcgtgtgtgcattggagccaatgataagaaggaggagtttgacgtgagtgggaacggacgcatcgagggccatattggggtgcaactacaggagcatagctacctcgagaagggcatgctggcatcagaggaattgagtcaaagcggcggttcgactaaggacgacgagctcgcgagtacgacgacaccgaaacgaggtcggcctaagggaaatatttctcggacgtgttcccactgcgggctgttagcttcctctattaccaatctcacagtgcacataaggcggaaacattcccatcagtacagttatctctgcaaagtctgtaagtactatacagtcacaaagggtgacatggaaaggcactgtgccaccaagaagcacaagggacgtgttgagatcgaggccagtggcaaacactccagtgacatcatcgtgggccctgaaggtggcagccttgaggccggaaagaagaacgccggtagcgccgtcactatgagtgacgaacatgccaacaagccagccgagagccccactagcgtgctggaaaaacccgataggggcaacagtatcgaagcggaggtggagaacgtcttccactctctggatggcgaggtaaatagccacctgctggacaagaaggaacagatcagttctgaaccagaggactttgcacaaccaggggatgtttactctcagcgtgacgtgactggaactggtgagaataagtgtctgcactgcgaattctcagcccatagcagcgccagtctggagctgcacgtgaagcgaaaacatactaaggagttcgagttttattgcatggcctgtgattattatgcagtcacacggagagagatgacccgacacgccgctaccgagaagcataagatgaagcgccagagttatttgaatagcgccaatgtcgaagccggtagcgcagacatgagtaaaaatatcatcatgcctgaggaagaacaccaacagaactcagaagaatttcagattatttcagggcaaccctctgatacactgaagagcagaaacgctgccgactgcagcatcctcaacgagaatactaacctggacatgagtaaagtcttatgcgcagccgatagcgtggaagttgagacggaggaagagtcaaattttaacgaagatcactccttttgtgagacgttccaacaggcgccagtgaaagacaaagtacggaagcccgaagaaatgatgtctcttacgatgtcatcaaactacggctcccccagcagatttcagaatgaaaacagtgggagttccgcactcaattgtgagaccgctaaaaaaaaccatgagatttcaaatgatgccggagaacttcgcgtgcactgcgagggggagggcggaaatgctggcgatgggggtggagttgtaccacatcggcacctgtgcccggtcaccctggacggtgaaaggtccgccgagagcccagtgttggtcgtaacccggatcaccagagagcaggggaacttggagtccggcggtcaaaatcgcgtggcaaggggccacgggctggaagatctaaagggcgtgcaggaagaccccgtgctgggtaacaaagagatattaatgaactcccagcacgagaccgagttcattcttgaggaagatgggccagcaagtgatagtaccgtggagtcaagcgatgtatacgagacaatcataagcatcgatgataaggggcaggctatgtattcctttggacggtttgacagctccatcattcggatcaagaatcccgaggacggggaattgatcgatcaatcagaagagggtcttatcgccactggcgtgagaatttctgagctgcctctgaaagattgcgctcaaggggtcaaaaaaaagaaaagtgaggggtcctccatcggagagtcgacgaggatcaggtgtgacgactgcggctttctcgcggatggcttaagtggactgaacgtgcacattgcgatgaagcatcccaccaaggagaaacactttcactgcctgctgtgcggcaagtctttctataccgaaagcaacttgcaccagcacctcgcctctgccggacacatgcgcaatgaacaggcaagcgtggaggagcttcctgagggcggagccacctttaagtgtgttaaatgtaccgaacctttcgattctgagcagaatctcttcttacatataaaaggccagcatgaagagttactgcgcgaggtgaataagtatatagtggaggacaccgagcaaatcaaccgggagagggaggagaaccagggaaatgtctgtaaatactgcggcaaaatgtgtcggtctagcaattctatggcatttctggcccatattaggacacatacaggctcaaagccttttaaatgcaaaatatgtcattttgccacagcccagcttggagatgccagaaatcacgtaaaacggcatctgggcatgagggagtacaaatgccacgtttgtggggtggcgttcgtgatgaagaagcacctcaacactcatctgctgggcaaacatggtgtcggtaccccaaaggaacgcgtgaaggtagcatacagaaagatagggacactccccggtatccagaacaaccggaatgcgtcctctgcaagcgaggcacagtctctgtgcgagcacttctcgtag

SEQ ID NO: 25248 - DNA, 2163 bp, Artificial Sequence
  Description of Artificial Sequence: Synthetic coding sequence
atggaggaggccgaagagttactcttagaagggaagaaagcactgcaattagcaagggagccaaggttgggcctagatttgggctggaatccctccggtgaaggctgtacccagggtctcaaggatgtcccccctgagccgactagagacattctcgcccttaagtccctcccaagagggctggccttaggccctagtttggctaaagagcagagactgggtgtatggtgtgtcggtgatcctctccagcctgggctcttatggggtccacttgaagaggagagcgccagtaaagagaaaggagaaggggtgaaaccccgtcaggaggaaaatctgagcctggggccatggggagacgtttgcgcatgcgaacagagttctggctggacaagtcttgttcagcgcggaaggttggaatccgaggggaacgtcgcacccgtgagaatctcagaacgattacatctccaggtataccagctggtccttcctggtagtgaattgttgctgtggcctcagccgtcttccgagggcccatctctgacccagccgggtctggacaaggaggctgcagtggctgtcgtgacagaagttgagtctgctgtgcagcaggaggtcgcctcaccaggcgaggatgccgcagaaccgtgtattgaccctggcagccagagcccaagcgggatccaggcagaaaatatggtgtcacctgggctgaagttccctacccaggatcgcatcagtaaggattcccagcccctgggcccactgcttcaagatggcgatgtggacgaggagtgcccggcacaggcccagatgcctcctgaattacagtcgaatagcgcaactcagcaggaccctgatgggtccggcgcatccttttccagcagtgcaagaggcacccagcctcacggctatctcgccaagaagctgcattccccaagcgatcaatgcccacccagggctaaaacacccgagccgggtgcccagcaatctggattcccaacactgtccagatccccacccggaccagccggtagctcacctaaacaaggacggcgatatcgctgcggagagtgtggaaaagcatttttacagctgtgccatctcaagaaacacgcttttgttcacactggacacaagcctttcctgtgcaccgagtgtgggaagagctactcttcagaagagtcctttaaagcccatatgctgggccatagaggcgtgagaccttttccttgtccacagtgtgataaagcctacggcacgcagagggatctcaaagaacaccaggtcgtacactcaggtgcaaggccattcgcctgtgatcagtgcggtaaagcgtttgctcgccgaccaagtctgcgactccaccgaaaaacacaccaagtaccggcagcccctgctccctgcccttgccctgtgtgcggtaggcctcttgccaaccagggctctcttcggaaccatatgagactacatactggtgagaagccctttctgtgtccacactgtggcagagccttcagacaacgtgggaatctgagaggacacttgagactgcatacaggagaaaggccttaccgctgcccacactgcgccgatgccttcccacagctcccggaattgcgacgacatcttatctcccacactggtgaagctcatttgtgccccgtttgcggcaaagctttgcgggatcctcataccctgagggcccacgagaggttgcactcaggcgaacgccctttcccctgcccccaatgtgggagagcgtatacactggccacaaagctccgcaggcatcttaaatctcatttggaggacaaaccctaccggtgcccaacttgtgggatgggctacacactcccccagagccttcgtaggcaccagctctctcaccgcccagaggccccttgttctcccccatcagtcccctctgctgccagcgagccaactgtggtactgctccaggctgaaccccagctgctggacacccacagggaggaggaagtctcgcccgctagggatgttgtggaagtgaccatttctgagtcccaggagaagtgtttcgtggtgccagaagaacccgacgccgcaccatcgctcgtcttaatccataaggatatgggtttgggcgcatgggccgaggttgtggaggtggaaatggggacatag

SEQ ID NO: 25249 - DNA, 597 bp, Artificial Sequence
  Description of Artificial Sequence: Synthetic coding sequence
atggagaagccagcaggcaggaaaaagaaaacacctaccccccgtgaagaggctgacgtgcagaaaagtgccctgagggaggaaaaagtttctggagaccggaagccccctgagagaccaaccgtgccgagaaagcctaggacagagccctgtctgtcacctgaggatgaggagcacgtattcgacgcttttgacgcctctttcaaggatgattttgaaggcgtaccagttttcataccatttcagcggaagaagccatacgaatgttctgaatgtggcaggatctttaagcacaagaccgatcatatcagacaccagcgtgttcatacaggggaaaagccttttaaatgcgctcaatgcggcaaagctttcagacactcctctgacgtaaccaaacatcagcgaacacacaccggagaaaagccattcaagtgtggcgaatgcggtaaagccttcaattgtgggtccaatcttcttaaacaccagaaaacccataccggtgagaagccctatgagtgtactcattgtgggaaggcatttgcatattcttcctgcctgattagacaccagaagagacaccctagaaagaagccatag

SEQ ID NO: 25250 - DNA, 597 bp, Artificial Sequence
  Description of Artificial Sequence: Synthetic coding sequence
atggagaagccagcagggcgaaagaagaaaacccctaccccacgggaagaggcagacgtacagaaatctgccttgagagaagaaaaggtatccggggacagaaaaccacccgaaaggccaaccgtgccccgaaaacctaggaccgagccgtgtctgtcacccgaggatgaggaacatgtgtttgacgcttttgatgcctcgttcaaagacgacttcgaaggggtgccagtcttcatcccctttcagcgcaagaaaccctatgaatgtagcgagtgtggccgaatcttcaagcacaagaccgatcacattcgtcaccaaagggttcacaccggtgaaaagccattcaagtgcgcgcagtgtggcaaagcattcagacacagttcggacgtcacaaagcaccaaagaacacacacaggcgaaaaacccttcaagtgcggcgagtgtggtaaggcattcaactgtggttccaatctcttaaagcatcagaagacccacacgggggaaaagccttacgagtgtacacactgtggcaaggcatttgcctatagcagctgtctgatcaggcatcaaaagcggcatccgcgaaagaaaccttag

SEQ ID NO: 25251 - DNA, 597 bp, Artificial Sequence
  Description of Artificial Sequence: Synthetic coding sequence
atggagaagccagcaggaaggaagaagaagaccccgacaccaagggaagaggctgatgtgcagaagtctgccctgagagaagaaaaggtgagcggtgaccggaagccccctgagcgacccactgttcccaggaagcctcgcaccgaaccttgtctgtccccggaagacgaggagcatgtgttcgatgcctttgacgcaagcttcaaggacgactttgagggcgttccagtttttattccgtttcagcgaaaaaagccatacgagtgttcagagtgtgggagaattttcaagcataaaaccgatcacatacgccaccagcgagtgcacaccggcgaaaagcccttcaagtgtgcacagtgtggaaaagccttccgtcacagcagcgacgtcaccaagcatcaacggactcataccggagagaaacccttcaaatgtggcgagtgcggtaaggctttcaattgtggatctaacctcttgaagcaccaaaaaactcacacaggggaaaaaccttatgaatgcactcactgcgggaaagcttttgcgtatagctcctgtcttattcggcaccaaaagcgacaccctaggaagaaaccctag

SEQ ID NO: 25252 - DNA, 1296 bp, Artificial Sequence
  Description of Artificial Sequence: Synthetic coding sequence
atgctgtctgatgagctcgagtctaagcctgaactactggtgcaattcgtgcagaacacatcaatcccgttaggtcaaggactggttgagagtgaagccaaagatattacctgtctgtcgctgcttccagtgaccgaggcctccgagtgctcccgcctgatgttgcccgacgacacaaccaaccactccaatagtagcaaggaggtgccatcctctgctgttctcaggtccctaagggtgaacgtcggaccagacggggaagagacccgggctcagactgtccagaaatctccagaatttctctctacctccgaatccagtagcctgctccaggatctgcagccctcagatagcacgtcattcatacttttgaatctcacccgggcagggctgggatcctccgccgaacacttggtttttgtccaggatgaggcggaggattccggtaacgattttctttccagcgaatctactgacagcagcattccgtggttcttaagagtgcaggagttggcccacgacagcctgatcgccgcaaccagggcccagctggccaagaacgctaaaacgtcgagtaacggagaaaatgtgcatttggggtccggtgatggccagtcaaaagactcagggcctttgccacaggttgagaaaaagctgaagtgcacggttgaaggatgtgaccgcacatttgtgtggcctgctcatttcaagtaccacctaaagacccacagaaatgaccggtcattcatttgcccagctgagggatgtgggaagtctttctatgtactccagcggctaaaggtgcatatgagaacgcacaacggcgagaaaccttttatgtgccacgaatctggttgcggcaaacagtttacgaccgctggaaaccttaaaaatcaccgccgtatccacaccggcgagaagccatttctttgtgaggcgcaagggtgtggtcgctcatttgcggagtactcctccctgcgcaagcatctggtggttcatagcggtgagaagccacatcaatgccaggtgtgcggtaagactttcagtcaatctgggagccggaacgtgcatatgaggaaacaccatctacagctcggcgcagccggaagccaggaacaggaacagaccgaggtgcttgctgaagggagtccccgatcactgagttcagtcccagacgtgacacatcacctcgtgactatgcagtccggtaggcagtcttatgaagtgtcagtgctgacagccgtcaacccacaggagctactaaaccaaggggatctgactgagcgcagaacctag

SEQ ID NO: 25253 - DNA, 1278 bp, Artificial Sequence
  Description of Artificial Sequence: Synthetic coding sequence
atgttgcctgacgacaccacgaaccacagtaactcctcaaaagaagtgccgagctctgctgtgctgagaagtttgcgagtaaacgtaggacccgatggagaagagacacgtgcacaaaccgtccaaaaaagtccagagttcctctctacttccgagtccagcagcttgcttcaagatttgcagcccagcgactctacaagctttatcctgctgaacctcacacgggcaggactcggctcatctgcggaacatctcgtgtttgtgcaggatgaggcagaggattctggcaacgacttcctcagcagtgaatccaccgactctagcatcccgtggtttttgcgcgtgcaggaactagctcacgactcactcatcgccgcaaccagggcccagcttgccaagaacgctaagacttccagcaatggggaaaatgttcatttaggttccggcgatgggcagtccaaggatagcggcccattgcctcaggtggaaaagaagttaaagtgcaccgttgagggctgcgatagaacctttgtgtggcctgcccatttcaagtaccatctgaaaacccatagaaatgaccgcagcttcatatgtcctgctgaagggtgcggaaaaagcttctacgtgctgcagaggctgaaagtccacatgcgcacacacaacggagagaaaccgttcatgtgtcatgaatctgggtgtggtaagcagtttaccacagctggcaatttaaagaatcatcgcagaatacacactggcgaaaagccatttctgtgtgaagcacaaggctgcggtaggagtttcgccgaatatagttccctgaggaaacacttggtggtccacagtggcgagaaaccacaccagtgtcaagtttgtgggaaaactttttcccaaagcggaagcagaaatgtgcatatgcgtaaacaccacctgcagctgggcgcagctggtagccaagaacaggagcagaccgccgaaccactgatgggaagcagcttgcttgaggaagccagcgtgcccagcaagaatttagtttcaatgaattcacagccttcccttgggggagagagcttgaacctgcctaacaccaactcaatactgggcgtagatgacgaagtcctagccgaggggagtcccagaagtctatcctccgtgcccgacgtgactcatcacctcgtcaccatgcagtcaggaagacagtcgtatgaggtaagtgttcttaccgccgtaaatcctcaggagctgttaaaccagggtgatttgacagaaagacggacctag

SEQ ID NO: 25254 - DNA, 1551 bp, Artificial Sequence
  Description of Artificial Sequence: Synthetic coding sequence
atgctgtccgatgagctcgagtcgaagcctgagcttttggtgcaattcgtccagaatactagcattccactcggtcagggcctggtggaaagcgaagctaaagatattacttgtctatctttgctgcccgtgacagaagcctccgaatgcagccgactgatgcttcccgagcctgtgccatggcgcgaggaagacgggaaatcaggttgctccgatttgaatgacacaacgaaccactctaactcttcaaaggaagtcccctctagtgccgtactccggtcactgcgagtgaacgtgggacccgatggagaggagacaagagcgcagaccgtccagaaaagcccagagttcttaagtacctccgagtctagcagtttgttgcaagatttgcagccaagcgactccacttccttcatcttgctgaacctcactcgagctggactgggtagctccgccgagcacctcgtatttgtgcaggacgaggctgaggactctggcaatgatttcttatcctccgaatctaccgacagcagtatcccatggttcctgcgggtccaggagctcgctcacgactcactcatcgcggctacacgcgcacagttggcgaaaaacgcaaagacgtcctccaatggagaaaatgttcacctcggaagcggagacgggcagtctaaagacagtggccctctcccccaagttgaaaagaagctgaagtgtaccgtagaaggctgcgacagaacattcgtttggcccgctcactttaagtaccacctcaagacacatagaaacgaccgatctttcatttgccctgctgagggatgtggcaaatctttctatgtgctccagcggcttaaggtccacatgcgcacgcacaatggcgaaaagccatttatgtgtcacgagagtggctgcggcaaacagttcacaaccgctgggaatctgaaaaatcatcgacggattcacactggcgagaaaccctttctgtgtgaagcgcaggggtgcggcaggtctttcgccgaatacagtagtttgcgcaagcatctggtggtccacagcggggaaaagccgcatcagtgccaggtgtgcggtaaaacatttagccagtctggttcaagaaatgtccacatgaggaaacatcatctgcaactgggagccgctggaagccaggagcaggaacagaccgcagagcccctgatgggatcctcccttctggaggaagcctccgtcccgtcgaagaatctggtgtcaatgaacagtcaaccctcactcggtggagagagtcttaacctcccaaataccaattccatcttgggggttgatgacgaagttctggctgagggtagtcccaggtcattgtcttctgtgccagacgtgacccaccacctggtgacaatgcagtcagggaggcagagctacgaggtgtccgtgttaactgccgtcaaccctcaggagagtctcgccccactgccccgacttgagtgttcgggagcattctccgctcactgcaacttgtgcctcccgggttccagcgactcgcctgccagtgccagttag

SEQ ID NO: 25255 - DNA, 1404 bp, Artificial Sequence
  Description of Artificial Sequence: Synthetic coding sequence
atgctgagtgatgaattggagagtaaaccagagcttcttgtgcaatttgttcaaaacacctcaatcccattaggccaaggattagtggagagtgaggctaaggacatcacatgcctttctctgctgcccgtaaccgaggcgtccgagtgttctcgccttatgctgcctgacgatactacgaatcatagcaacagctctaaggaggtaccgagtagtgcggtgctgcggtccctgagagtgaatgtgggtcccgacggcgaggaatttttgagtaccagtgaatcaagttcccttttgcaagatcttcagccttccgattccacttcttttattctcctcaacctgacccgggcaggcctcggtagctccgcagagcacctggtattcgtgcaggacgaagctgaggatagcggcaatgattttctgtcctcagagtctacagattctagtattccatggttccttagagttcaggagttggcacatgattcgctgatcgctgctacgagagcacagctggctaaaaacgctaaaacatcaagtaacggtgaaaatgtgcacctggggagtggcgatggacagtccaaagatagtggcccactaccccaggtcgaaaagaaacttaagtgcacagtggaggggtgcgatcggaccttcgtttggcccgcacatttcaaataccatctgaagacgcaccggaatgataggagctttatctgccccgctgaagggtgcggcaaatcattctacgtccttcagagactgaaagtccacatgcggacccacaatggtgagaagccctttatgtgccacgaaagtggttgtgggaagcagttcactaccgctggcaatttgaaaaatcacagacggatacacactggcgagaagccctttctgtgcgaggctcaaggttgtgggcgttccttcgcagaatacagcagtctccgcaagcacttggtagtccacagcggcgagaaacctcaccagtgccaagtctgcggcaaaacattctctcagagcgggagccgcaatgtacatatgcgaaagcaccatttgcagttgggtgcagccggatcccaagagcaagagcagactgcagagcctctcatggggagttcccttcttgaggaggcctcagttcccagtaagaacctagtgtctatgaatagccagccatctttggggggagagtcgttaaacctgcccaatactaatagtattcttggtgttgatgacgaagtgttagccgaggggtcacctcgctccttgtctagcgttcccgacgtgacccatcacctggtgacaatgcagtcaggtcggcagagttacgaagtctccgtgctgacggctgttaatccacaggaactgttgaatcaaggcgacctaacggagaggagaacctag

SEQ ID NO: 25256 - DNA, 1218 bp, Artificial Sequence
  Description of Artificial Sequence: Synthetic coding sequence
atgctgtccgatgaactggagtccaaacctgagcttttggtgcaattcgtgcaaaatacgtcaatacctctggggcaggggcttgtcgaaagtgaggctaaggatatcacatgtctctcactcctccctgtgaccgaagcctcagagtgttctaggctgatgctgcctggcctggggtccagcgccgaacacctggtttttgtgcaggatgaggccgaagattctgggaatgactttctgagctccgagtcaacagattccagcattccttggtttctccgggtgcaagaactggcccatgattcactcatcgccgctacgagagcacagctggctaagaatgcaaagacttcttcaaacggcgagaacgtgcacttggggagtggcgatggtcaatcaaaggactctgggccattacctcaagtggagaagaaactgaaatgtacagtggaaggctgcgaccgcaccttcgtgtggcccgctcactttaagtatcatctcaagacccaccggaacgaccgctctttcatttgcccagctgaaggctgtggaaagagcttttacgtgctgcagagactcaaagtgcacatgcgaacccacaacggcgaaaagccattcatgtgtcacgaaagtggctgcggcaagcagttcacgactgccggtaatctcaaaaaccatcgcagaattcacaccggggaaaaacccttcctgtgcgaagctcaggggtgtgggagaagttttgccgaatactcctctctgagaaagcacctggtggtccattccggggaaaagcctcaccagtgtcaagtgtgtggaaaaactttttcccaaagcggcagtagaaacgtgcatatgagaaagcaccacttacagttaggagccgctggcagccaggaacaggagcagacagccgagcctctgatgggaagctccctcctggaggaagccagtgtgcctagcaagaacctagtgagtatgaactctcagccttcactcgggggagagtcgctaaatctccctaataccaactctatcctgggcgtggacgatgaggtgctggcggagggaagtcccagaagcctttccagtgttcctgatgtcacacatcacttagtgacaatgcagagcggccgtcaaagctacgaggtgtcggttttaacggctgttaacccacaggaactgctcaatcaaggggacttgaccgaacggaggacgtag
